United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 82

SEQ ID NO: 2950221 - RNA, 18 nt, Mycobacterium avium subsp. paratuberculosis
gccagcgccgcccgggcg

SEQ ID NO: 2950222 - RNA, 22 nt, Mycobacterium avium subsp. paratuberculosis
gccagcgccgcccgggcggccc

SEQ ID NO: 2950223 - RNA, 12 nt, Mycobacterium avium subsp. paratuberculosis
gccagcgccgcg

SEQ ID NO: 2950224 - RNA, 13 nt, Mycobacterium avium subsp. paratuberculosis
gccagcgccgcgc

SEQ ID NO: 2950225 - RNA, 16 nt, Mycobacterium avium subsp. paratuberculosis
gccagcgccgcgcgcg

SEQ ID NO: 2950226 - RNA, 20 nt, Mycobacterium avium subsp. paratuberculosis
gccagcgccgcgcgcgcggc

SEQ ID NO: 2950227 - RNA, 21 nt, Mycobacterium avium subsp. paratuberculosis
gccagcgccgcgcgcgcggcc

SEQ ID NO: 2950228 - RNA, 15 nt, Mycobacterium avium subsp. paratuberculosis
gccagcgccggcagc

SEQ ID NO: 2950229 - RNA, 18 nt, Mycobacterium avium subsp. paratuberculosis
gccagcgccgucaucacc

SEQ ID NO: 2950230 - RNA, 21 nt, Mycobacterium avium subsp. paratuberculosis
gccagcgccgucaucaccgcc

SEQ ID NO: 2950231 - RNA, 22 nt, Mycobacterium avium subsp. paratuberculosis
gccagcgccgucaucaccgccg

SEQ ID NO: 2950232 - RNA, 14 nt, Mycobacterium avium subsp. paratuberculosis
gccagcgccuccag

SEQ ID NO: 2950233 - RNA, 15 nt, Mycobacterium avium subsp. paratuberculosis
gccagcgccuccagc

SEQ ID NO: 2950234 - RNA, 16 nt, Mycobacterium avium subsp. paratuberculosis
gccagcgccuccagcc

SEQ ID NO: 2950235 - RNA, 18 nt, Mycobacterium avium subsp. paratuberculosis
gccagcgccuccagccgc

SEQ ID NO: 2950236 - RNA, 20 nt, Mycobacterium avium subsp. paratuberculosis
gccagcgccuccagccgcuc

SEQ ID NO: 2950237 - RNA, 16 nt, Mycobacterium avium subsp. paratuberculosis
gccagcgccuucggcg

SEQ ID NO: 2950238 - RNA, 18 nt, Mycobacterium avium subsp. paratuberculosis
gccagcgccuucuccagc

SEQ ID NO: 2950239 - RNA, 23 nt, Mycobacterium avium subsp. paratuberculosis
gccagcgccuucuccagcuccuc

SEQ ID NO: 2950240 - RNA, 22 nt, Mycobacterium avium subsp. paratuberculosis
gccagcgcgaaagcagcaacgg

SEQ ID NO: 2950241 - RNA, 22 nt, Mycobacterium avium subsp. paratuberculosis
gccagcgcgacccgcucgacgc

SEQ ID NO: 2950242 - RNA, 12 nt, Mycobacterium avium subsp. paratuberculosis
gccagcgcgacg

SEQ ID NO: 2950243 - RNA, 13 nt, Mycobacterium avium subsp. paratuberculosis
gccagcgcgacgg

SEQ ID NO: 2950244 - RNA, 17 nt, Mycobacterium avium subsp. paratuberculosis
gccagcgcgacggccuc

SEQ ID NO: 2950245 - RNA, 18 nt, Mycobacterium avium subsp. paratuberculosis
gccagcgcgacggccucg

SEQ ID NO: 2950246 - RNA, 19 nt, Mycobacterium avium subsp. paratuberculosis
gccagcgcgacggccucgu

SEQ ID NO: 2950247 - RNA, 16 nt, Mycobacterium avium subsp. paratuberculosis
gccagcgcgaucgccg

SEQ ID NO: 2950248 - RNA, 17 nt, Mycobacterium avium subsp. paratuberculosis
gccagcgcgaucgccgg

SEQ ID NO: 2950249 - RNA, 18 nt, Mycobacterium avium subsp. paratuberculosis
gccagcgcgaucgccggg

SEQ ID NO: 2950250 - RNA, 22 nt, Mycobacterium avium subsp. paratuberculosis
gccagcgcgaucgccgggaugg

SEQ ID NO: 2950251 - RNA, 23 nt, Mycobacterium avium subsp. paratuberculosis
gccagcgcgaucgccgggauggu

SEQ ID NO: 2950252 - RNA, 11 nt, Mycobacterium avium subsp. paratuberculosis
gccagcgcgcc

SEQ ID NO: 2950253 - RNA, 14 nt, Mycobacterium avium subsp. paratuberculosis
gccagcgcgcccgc

SEQ ID NO: 2950254 - RNA, 12 nt, Mycobacterium avium subsp. paratuberculosis
gccagcgcgccg

SEQ ID NO: 2950255 - RNA, 13 nt, Mycobacterium avium subsp. paratuberculosis
gccagcgcgccga

SEQ ID NO: 2950256 - RNA, 18 nt, Mycobacterium avium subsp. paratuberculosis
gccagcgggugauggccg

SEQ ID NO: 2950257 - RNA, 22 nt, Mycobacterium avium subsp. paratuberculosis
gccagcgggugauggccgccgc

SEQ ID NO: 2950258 - RNA, 13 nt, Mycobacterium avium subsp. paratuberculosis
gccagcggucacg

SEQ ID NO: 2950259 - RNA, 15 nt, Mycobacterium avium subsp. paratuberculosis
gccagcggucacgga

SEQ ID NO: 2950260 - RNA, 14 nt, Mycobacterium avium subsp. paratuberculosis
gccagcgguccagc

SEQ ID NO: 2950261 - RNA, 15 nt, Mycobacterium avium subsp. paratuberculosis
gccagcgguccagcg

SEQ ID NO: 2950262 - RNA, 18 nt, Mycobacterium avium subsp. paratuberculosis
gccagcgguccagcguga

SEQ ID NO: 2950263 - RNA, 12 nt, Mycobacterium avium subsp. paratuberculosis
gccagcgucagg

SEQ ID NO: 2950264 - RNA, 19 nt, Mycobacterium avium subsp. paratuberculosis
gccagcgucccguccuggg

SEQ ID NO: 2950265 - RNA, 21 nt, Mycobacterium avium subsp. paratuberculosis
gccagcgucgaguuguugggc

SEQ ID NO: 2950266 - RNA, 12 nt, Mycobacterium avium subsp. paratuberculosis
gccagcgucgcg

SEQ ID NO: 2950267 - RNA, 15 nt, Mycobacterium avium subsp. paratuberculosis
gccagcgucgcgccg

SEQ ID NO: 2950268 - RNA, 16 nt, Mycobacterium avium subsp. paratuberculosis
gccagcgucgcgccgc

SEQ ID NO: 2950269 - RNA, 16 nt, Mycobacterium avium subsp. paratuberculosis
gccagcgucuccggcg

SEQ ID NO: 2950270 - RNA, 17 nt, Mycobacterium avium subsp. paratuberculosis
gccagcgucuccggcgg

SEQ ID NO: 2950271 - RNA, 20 nt, Mycobacterium avium subsp. paratuberculosis
gccagcgucuccggcgggcu

SEQ ID NO: 2950272 - RNA, 19 nt, Mycobacterium avium subsp. paratuberculosis
gccagcgucugcugcgcca

SEQ ID NO: 2950273 - RNA, 20 nt, Mycobacterium avium subsp. paratuberculosis
gccagcgucuugacgaacuc

SEQ ID NO: 2950274 - RNA, 18 nt, Mycobacterium avium subsp. paratuberculosis
gccagcgugaacaccgcg

SEQ ID NO: 2950275 - RNA, 19 nt, Mycobacterium avium subsp. paratuberculosis
gccagcgugaacaccgcgu

SEQ ID NO: 2950276 - RNA, 23 nt, Mycobacterium avium subsp. paratuberculosis
gccagcgugaacagcgcccggcc

SEQ ID NO: 2950277 - RNA, 20 nt, Mycobacterium avium subsp. paratuberculosis
gccagcgugacgcccggcgc

SEQ ID NO: 2950278 - RNA, 16 nt, Mycobacterium avium subsp. paratuberculosis
gccagcgugacgccgg

SEQ ID NO: 2950279 - RNA, 20 nt, Mycobacterium avium subsp. paratuberculosis
gccagcgugacgccgggccg

SEQ ID NO: 2950280 - RNA, 21 nt, Mycobacterium avium subsp. paratuberculosis
gccagcgugacgccgggccgc

SEQ ID NO: 2950281 - RNA, 20 nt, Mycobacterium avium subsp. paratuberculosis
gccagcgugacgcucgggcu

SEQ ID NO: 2950282 - RNA, 15 nt, Mycobacterium avium subsp. paratuberculosis
gccagcguggccagc

SEQ ID NO: 2950283 - RNA, 16 nt, Mycobacterium avium subsp. paratuberculosis
gccagcguggccagca

SEQ ID NO: 2950284 - RNA, 19 nt, Mycobacterium avium subsp. paratuberculosis
gccagcguggcgcgccccg

SEQ ID NO: 2950285 - RNA, 18 nt, Mycobacterium avium subsp. paratuberculosis
gccagcguuuccagcgcc

SEQ ID NO: 2950286 - RNA, 19 nt, Mycobacterium avium subsp. paratuberculosis
gccagcguuuccagcgccg

SEQ ID NO: 2950287 - RNA, 20 nt, Mycobacterium avium subsp. paratuberculosis
gccagcguuuccagcgccgg

SEQ ID NO: 2950288 - RNA, 22 nt, Mycobacterium avium subsp. paratuberculosis
gccagcguuuccagcgccggca

SEQ ID NO: 2950289 - RNA, 23 nt, Mycobacterium avium subsp. paratuberculosis
gccagcguuuccagcgccggcac

SEQ ID NO: 2950290 - RNA, 20 nt, Mycobacterium avium subsp. paratuberculosis
gccagcguuuggccugcggc

SEQ ID NO: 2950291 - RNA, 14 nt, Mycobacterium avium subsp. paratuberculosis
gccagcucaccggc

SEQ ID NO: 2950292 - RNA, 16 nt, Mycobacterium avium subsp. paratuberculosis
gccagcucaccggcca

SEQ ID NO: 2950293 - RNA, 15 nt, Mycobacterium avium subsp. paratuberculosis
gccagcuccagcagc

SEQ ID NO: 2950294 - RNA, 20 nt, Mycobacterium avium subsp. paratuberculosis
gccagcuccagcagcccggg

SEQ ID NO: 2950295 - RNA, 22 nt, Mycobacterium avium subsp. paratuberculosis
gccagcuccagcagcccgggcu

SEQ ID NO: 2950296 - RNA, 23 nt, Mycobacterium avium subsp. paratuberculosis
gccagcuccagcagcccgggcug

SEQ ID NO: 2950297 - RNA, 16 nt, Mycobacterium avium subsp. paratuberculosis
gccagcucccgggcgg

SEQ ID NO: 2950298 - RNA, 17 nt, Mycobacterium avium subsp. paratuberculosis
gccagcucccgggcggc

SEQ ID NO: 2950299 - RNA, 16 nt, Mycobacterium avium subsp. paratuberculosis
gccagcuccgccaccc

SEQ ID NO: 2950300 - RNA, 16 nt, Mycobacterium avium subsp. paratuberculosis
gccagcuccgggucga

SEQ ID NO: 2950301 - RNA, 20 nt, Mycobacterium avium subsp. paratuberculosis
gccagcuccgggucgaccgc

SEQ ID NO: 2950302 - RNA, 19 nt, Mycobacterium avium subsp. paratuberculosis
gccagcuccucggggauga

SEQ ID NO: 2950303 - RNA, 16 nt, Mycobacterium avium subsp. paratuberculosis
gccagcucgaaccugg

SEQ ID NO: 2950304 - RNA, 18 nt, Mycobacterium avium subsp. paratuberculosis
gccagcucgaaccuggag

SEQ ID NO: 2950305 - RNA, 12 nt, Mycobacterium avium subsp. paratuberculosis
gccagcucgccg

SEQ ID NO: 2950306 - RNA, 18 nt, Mycobacterium avium subsp. paratuberculosis
gccagcucgccgccgacg

SEQ ID NO: 2950307 - RNA, 20 nt, Mycobacterium avium subsp. paratuberculosis
gccagcucgccgccgacgaa

SEQ ID NO: 2950308 - RNA, 16 nt, Mycobacterium avium subsp. paratuberculosis
gccagcucggccaucc

SEQ ID NO: 2950309 - RNA, 18 nt, Mycobacterium avium subsp. paratuberculosis
gccagcucggcccgcugc

SEQ ID NO: 2950310 - RNA, 20 nt, Mycobacterium avium subsp. paratuberculosis
gccagcucggcccgcugcgc

SEQ ID NO: 2950311 - RNA, 13 nt, Mycobacterium avium subsp. paratuberculosis
gccagcucggcgg

SEQ ID NO: 2950312 - RNA, 14 nt, Mycobacterium avium subsp. paratuberculosis
gccagcucggcggc

SEQ ID NO: 2950313 - RNA, 16 nt, Mycobacterium avium subsp. paratuberculosis
gccagcucggcggcca

SEQ ID NO: 2950314 - RNA, 18 nt, Mycobacterium avium subsp. paratuberculosis
gccagcucggcggccaug

SEQ ID NO: 2950315 - RNA, 16 nt, Mycobacterium avium subsp. paratuberculosis
gccagcucggcggccg

SEQ ID NO: 2950316 - RNA, 18 nt, Mycobacterium avium subsp. paratuberculosis
gccagcucggcggccggg

SEQ ID NO: 2950317 - RNA, 19 nt, Mycobacterium avium subsp. paratuberculosis
gccagcucggcggccgggu

SEQ ID NO: 2950318 - RNA, 23 nt, Mycobacterium avium subsp. paratuberculosis
gccagcucggcguggucgaggcc

SEQ ID NO: 2950319 - RNA, 18 nt, Mycobacterium avium subsp. paratuberculosis
gccagcucggucagccgg

SEQ ID NO: 2950320 - RNA, 20 nt, Mycobacterium avium subsp. paratuberculosis
gccagcucggucagccgggc

SEQ ID NO: 2950321 - RNA, 21 nt, Mycobacterium avium subsp. paratuberculosis
gccagcucggucagccgggcg

SEQ ID NO: 2950322 - RNA, 13 nt, Mycobacterium avium subsp. paratuberculosis
gccagcucggucg

SEQ ID NO: 2950323 - RNA, 21 nt, Mycobacterium avium subsp. paratuberculosis
gccagcucggucgcggucggc

SEQ ID NO: 2950324 - RNA, 15 nt, Mycobacterium avium subsp. paratuberculosis
gccagcucguccagc

SEQ ID NO: 2950325 - RNA, 16 nt, Mycobacterium avium subsp. paratuberculosis
gccagcucguccagcg

SEQ ID NO: 2950326 - RNA, 19 nt, Mycobacterium avium subsp. paratuberculosis
gccagcucguccagcgugc

SEQ ID NO: 2950327 - RNA, 21 nt, Mycobacterium avium subsp. paratuberculosis
gccagcucguccagcgugccg

SEQ ID NO: 2950328 - RNA, 20 nt, Mycobacterium avium subsp. paratuberculosis
gccagcucgucgagccggcc

SEQ ID NO: 2950329 - RNA, 22 nt, Mycobacterium avium subsp. paratuberculosis
gccagcucgucgagccggccgg

SEQ ID NO: 2950330 - RNA, 19 nt, Mycobacterium avium subsp. paratuberculosis
gccagcugaacacgaaccc

SEQ ID NO: 2950331 - RNA, 15 nt, Mycobacterium avium subsp. paratuberculosis
gccagcugauagccg

SEQ ID NO: 2950332 - RNA, 17 nt, Mycobacterium avium subsp. paratuberculosis
gccagcugauagccgcc

SEQ ID NO: 2950333 - RNA, 18 nt, Mycobacterium avium subsp. paratuberculosis
gccagcugauagccgccc

SEQ ID NO: 2950334 - RNA, 19 nt, Mycobacterium avium subsp. paratuberculosis
gccagcugauagccgcccu

SEQ ID NO: 2950335 - RNA, 15 nt, Mycobacterium avium subsp. paratuberculosis
gccagcugcaccggg

SEQ ID NO: 2950336 - RNA, 16 nt, Mycobacterium avium subsp. paratuberculosis
gccagcugcaccgggg

SEQ ID NO: 2950337 - RNA, 17 nt, Mycobacterium avium subsp. paratuberculosis
gccagcugcaccggggc

SEQ ID NO: 2950338 - RNA, 16 nt, Mycobacterium avium subsp. paratuberculosis
gccagcugccgcgacu

SEQ ID NO: 2950339 - RNA, 18 nt, Mycobacterium avium subsp. paratuberculosis
gccagcugcgacagcacg

SEQ ID NO: 2950340 - RNA, 13 nt, Mycobacterium avium subsp. paratuberculosis
gccaggccgucgg

SEQ ID NO: 2950341 - RNA, 14 nt, Mycobacterium avium subsp. paratuberculosis
gccaggccgucggc

SEQ ID NO: 2950342 - RNA, 15 nt, Mycobacterium avium subsp. paratuberculosis
gccaggccgucggcg

SEQ ID NO: 2950343 - RNA, 16 nt, Mycobacterium avium subsp. paratuberculosis
gccaggccgucggcgc

SEQ ID NO: 2950344 - RNA, 17 nt, Mycobacterium avium subsp. paratuberculosis
gccaggccgucggcgcg

SEQ ID NO: 2950345 - RNA, 19 nt, Mycobacterium avium subsp. paratuberculosis
gccaggccgucggcgcggc

SEQ ID NO: 2950346 - RNA, 20 nt, Mycobacterium avium subsp. paratuberculosis
gccaggccgucggcgcggcc

SEQ ID NO: 2950347 - RNA, 21 nt, Mycobacterium avium subsp. paratuberculosis
gccaggccgucggcgcggccg

SEQ ID NO: 2950348 - RNA, 14 nt, Mycobacterium avium subsp. paratuberculosis
gccaggccgugauc

SEQ ID NO: 2950349 - RNA, 19 nt, Mycobacterium avium subsp. paratuberculosis
gccaggcgacuguccaggc

SEQ ID NO: 2950350 - RNA, 21 nt, Mycobacterium avium subsp. paratuberculosis
gccaggcgaugaagccggcga

SEQ ID NO: 2950351 - RNA, 23 nt, Mycobacterium avium subsp. paratuberculosis
gccaggcgaugaagccggcgaac

SEQ ID NO: 2950352 - RNA, 14 nt, Mycobacterium avium subsp. paratuberculosis
gccaggcgcgcgcu

SEQ ID NO: 2950353 - RNA, 17 nt, Mycobacterium avium subsp. paratuberculosis
gccaggcgcgcguagcg

SEQ ID NO: 2950354 - RNA, 15 nt, Mycobacterium avium subsp. paratuberculosis
gccaggcgguggccg

SEQ ID NO: 2950355 - RNA, 17 nt, Mycobacterium avium subsp. paratuberculosis
gccaggcguugcaccgc

SEQ ID NO: 2950356 - RNA, 19 nt, Mycobacterium avium subsp. paratuberculosis
gccaggcguugcaccgcgg

SEQ ID NO: 2950357 - RNA, 18 nt, Mycobacterium avium subsp. paratuberculosis
gccaggcguuggucacca

SEQ ID NO: 2950358 - RNA, 20 nt, Mycobacterium avium subsp. paratuberculosis
gccaggcguuggucaccauc

SEQ ID NO: 2950359 - RNA, 18 nt, Mycobacterium avium subsp. paratuberculosis
gccaggcucacguagucg

SEQ ID NO: 2950360 - RNA, 14 nt, Mycobacterium avium subsp. paratuberculosis
gccaggcuggccag

SEQ ID NO: 2950361 - RNA, 12 nt, Mycobacterium avium subsp. paratuberculosis
gccaggcuggcg

SEQ ID NO: 2950362 - RNA, 14 nt, Mycobacterium avium subsp. paratuberculosis
gccaggcuggcguc

SEQ ID NO: 2950363 - RNA, 14 nt, Mycobacterium avium subsp. paratuberculosis
gccagggcagcgcg

SEQ ID NO: 2950364 - RNA, 15 nt, Mycobacterium avium subsp. paratuberculosis
gccagggcagcgcga

SEQ ID NO: 2950365 - RNA, 20 nt, Mycobacterium avium subsp. paratuberculosis
gccagggcagcgcgaccagc

SEQ ID NO: 2950366 - RNA, 23 nt, Mycobacterium avium subsp. paratuberculosis
gccagggcagcgcgaccagcccg

SEQ ID NO: 2950367 - RNA, 22 nt, Mycobacterium avium subsp. paratuberculosis
gccagggccccguuggugcggu

SEQ ID NO: 2950368 - RNA, 16 nt, Mycobacterium avium subsp. paratuberculosis
gccagggcccgcagcc

SEQ ID NO: 2950369 - RNA, 19 nt, Mycobacterium avium subsp. paratuberculosis
gccagggcccgcagccgcu

SEQ ID NO: 2950370 - RNA, 14 nt, Mycobacterium avium subsp. paratuberculosis
gccagggccgccgc

SEQ ID NO: 2950371 - RNA, 15 nt, Mycobacterium avium subsp. paratuberculosis
gccagggccgggcgu

SEQ ID NO: 2950372 - RNA, 19 nt, Mycobacterium avium subsp. paratuberculosis
gccagggccgggcgugccc

SEQ ID NO: 2950373 - RNA, 23 nt, Mycobacterium avium subsp. paratuberculosis
gccagggccgggcgugcccggcg

SEQ ID NO: 2950374 - RNA, 17 nt, Mycobacterium avium subsp. paratuberculosis
gccagggcgacgccgcg

SEQ ID NO: 2950375 - RNA, 18 nt, Mycobacterium avium subsp. paratuberculosis
gccagggcgacgccgcgg

SEQ ID NO: 2950376 - RNA, 13 nt, Mycobacterium avium subsp. paratuberculosis
gccagggcgagga

SEQ ID NO: 2950377 - RNA, 14 nt, Mycobacterium avium subsp. paratuberculosis
gccagggcgaggac

SEQ ID NO: 2950378 - RNA, 12 nt, Mycobacterium avium subsp. paratuberculosis
gccagggcggcg

SEQ ID NO: 2950379 - RNA, 20 nt, Mycobacterium avium subsp. paratuberculosis
gccagggcguggaacgcguc

SEQ ID NO: 2950380 - RNA, 14 nt, Mycobacterium avium subsp. paratuberculosis
gccagggucucggg

SEQ ID NO: 2950381 - RNA, 22 nt, Mycobacterium avium subsp. paratuberculosis
gccagggucucgggcagcagca

SEQ ID NO: 2950382 - RNA, 23 nt, Mycobacterium avium subsp. paratuberculosis
gccagggucucgggcagcagcac

SEQ ID NO: 2950383 - RNA, 21 nt, Mycobacterium avium subsp. paratuberculosis
gccagggucuggcccggugcg

SEQ ID NO: 2950384 - RNA, 23 nt, Mycobacterium avium subsp. paratuberculosis
gccagggugccccgcaccgccag

SEQ ID NO: 2950385 - RNA, 13 nt, Mycobacterium avium subsp. paratuberculosis
gccagggugccga

SEQ ID NO: 2950386 - RNA, 20 nt, Mycobacterium avium subsp. paratuberculosis
gccaggguggggaucacguc

SEQ ID NO: 2950387 - RNA, 17 nt, Mycobacterium avium subsp. paratuberculosis
gccagggugucccagcg

SEQ ID NO: 2950388 - RNA, 18 nt, Mycobacterium avium subsp. paratuberculosis
gccagguacuccucgaag

SEQ ID NO: 2950389 - RNA, 19 nt, Mycobacterium avium subsp. paratuberculosis
gccagguacuccucgaaga

SEQ ID NO: 2950390 - RNA, 16 nt, Mycobacterium avium subsp. paratuberculosis
gccagguacugaucac

SEQ ID NO: 2950391 - RNA, 17 nt, Mycobacterium avium subsp. paratuberculosis
gccagguacugaucacc

SEQ ID NO: 2950392 - RNA, 18 nt, Mycobacterium avium subsp. paratuberculosis
gccagguacugaucaccg

SEQ ID NO: 2950393 - RNA, 20 nt, Mycobacterium avium subsp. paratuberculosis
gccagguacugaucaccgcg

SEQ ID NO: 2950394 - RNA, 21 nt, Mycobacterium avium subsp. paratuberculosis
gccagguacugaucaccgcgc

SEQ ID NO: 2950395 - RNA, 23 nt, Mycobacterium avium subsp. paratuberculosis
gccagguacugaucaccgcgcuc

SEQ ID NO: 2950396 - RNA, 23 nt, Mycobacterium avium subsp. paratuberculosis
gccagguaguggugggcgugccg

SEQ ID NO: 2950397 - RNA, 15 nt, Mycobacterium avium subsp. paratuberculosis
gccagguccacaccg

SEQ ID NO: 2950398 - RNA, 22 nt, Mycobacterium avium subsp. paratuberculosis
gccagguccacaccguggagac

SEQ ID NO: 2950399 - RNA, 14 nt, Mycobacterium avium subsp. paratuberculosis
gccagguccgggca

SEQ ID NO: 2950400 - RNA, 22 nt, Mycobacterium avium subsp. paratuberculosis
gccagguccgggcacucgagcg

SEQ ID NO: 2950401 - RNA, 16 nt, Mycobacterium avium subsp. paratuberculosis
gccagguccucgcugg

SEQ ID NO: 2950402 - RNA, 17 nt, Mycobacterium avium subsp. paratuberculosis
gccagguccucgcuggc

SEQ ID NO: 2950403 - RNA, 18 nt, Mycobacterium avium subsp. paratuberculosis
gccagguccucgcuggcg

SEQ ID NO: 2950404 - RNA, 20 nt, Mycobacterium avium subsp. paratuberculosis
gccagguccucgcuggcgau

SEQ ID NO: 2950405 - RNA, 18 nt, Mycobacterium avium subsp. paratuberculosis
gccaggucgaagcgcagc

SEQ ID NO: 2950406 - RNA, 20 nt, Mycobacterium avium subsp. paratuberculosis
gccaggucgaagcgcagcac

SEQ ID NO: 2950407 - RNA, 21 nt, Mycobacterium avium subsp. paratuberculosis
gccaggucgaagcgcagcacc

SEQ ID NO: 2950408 - RNA, 18 nt, Mycobacterium avium subsp. paratuberculosis
gccaggucgacggggucg

SEQ ID NO: 2950409 - RNA, 15 nt, Mycobacterium avium subsp. paratuberculosis
gccaggucgccgcgc

SEQ ID NO: 2950410 - RNA, 16 nt, Mycobacterium avium subsp. paratuberculosis
gccaggucgcugacga

SEQ ID NO: 2950411 - RNA, 19 nt, Mycobacterium avium subsp. paratuberculosis
gccaggucgcugacgauga

SEQ ID NO: 2950412 - RNA, 12 nt, Mycobacterium avium subsp. paratuberculosis
gccaggucgggg

SEQ ID NO: 2950413 - RNA, 14 nt, Mycobacterium avium subsp. paratuberculosis
gccaggucgggguc

SEQ ID NO: 2950414 - RNA, 18 nt, Mycobacterium avium subsp. paratuberculosis
gccaggugcacgccgagc

SEQ ID NO: 2950415 - RNA, 23 nt, Mycobacterium avium subsp. paratuberculosis
gccaggugcacgccgagcagcac

SEQ ID NO: 2950416 - RNA, 15 nt, Mycobacterium avium subsp. paratuberculosis
gccagguggccgcuu

SEQ ID NO: 2950417 - RNA, 17 nt, Mycobacterium avium subsp. paratuberculosis
gccagguguagaccacg

SEQ ID NO: 2950418 - RNA, 14 nt, Mycobacterium avium subsp. paratuberculosis
gccaggugugcccg

SEQ ID NO: 2950419 - RNA, 18 nt, Mycobacterium avium subsp. paratuberculosis
gccagguguuguccggua

SEQ ID NO: 2950420 - RNA, 17 nt, Mycobacterium avium subsp. paratuberculosis
gccagguucaggcccgc

SEQ ID NO: 2950421 - RNA, 18 nt, Mycobacterium avium subsp. paratuberculosis
gccagguucaggcccgcg

SEQ ID NO: 2950422 - RNA, 21 nt, Mycobacterium avium subsp. paratuberculosis
gccagguucaggcccgcgccg

SEQ ID NO: 2950423 - RNA, 16 nt, Mycobacterium avium subsp. paratuberculosis
gccagguucaggcuga

SEQ ID NO: 2950424 - RNA, 13 nt, Mycobacterium avium subsp. paratuberculosis
gccaucagccgcc

SEQ ID NO: 2950425 - RNA, 15 nt, Mycobacterium avium subsp. paratuberculosis
gccaucagccgccgu

SEQ ID NO: 2950426 - RNA, 17 nt, Mycobacterium avium subsp. paratuberculosis
gccaucagccgccgucg

SEQ ID NO: 2950427 - RNA, 18 nt, Mycobacterium avium subsp. paratuberculosis
gccaucagccgccgucgc

SEQ ID NO: 2950428 - RNA, 22 nt, Mycobacterium avium subsp. paratuberculosis
gccaucagccgccgucgcgcca

SEQ ID NO: 2950429 - RNA, 15 nt, Mycobacterium avium subsp. paratuberculosis
gccaucaugcccacc

SEQ ID NO: 2950430 - RNA, 18 nt, Mycobacterium avium subsp. paratuberculosis
gccaucaugcccaccauc

SEQ ID NO: 2950431 - RNA, 18 nt, Mycobacterium avium subsp. paratuberculosis
gccauccccgcguuggcc

SEQ ID NO: 2950432 - RNA, 21 nt, Mycobacterium avium subsp. paratuberculosis
gccauccccgcguuggccagc

SEQ ID NO: 2950433 - RNA, 21 nt, Mycobacterium avium subsp. paratuberculosis
gccaucccggggacaccgggc

SEQ ID NO: 2950434 - RNA, 15 nt, Mycobacterium avium subsp. paratuberculosis
gccaucccggugccg

SEQ ID NO: 2950435 - RNA, 21 nt, Mycobacterium avium subsp. paratuberculosis
gccaucccggugccgcuggau

SEQ ID NO: 2950436 - RNA, 15 nt, Mycobacterium avium subsp. paratuberculosis
gccaucccgguggac

SEQ ID NO: 2950437 - RNA, 15 nt, Mycobacterium avium subsp. paratuberculosis
gccauccgccacccg

SEQ ID NO: 2950438 - RNA, 14 nt, Mycobacterium avium subsp. paratuberculosis
gccauccgcgccga

SEQ ID NO: 2950439 - RNA, 16 nt, Mycobacterium avium subsp. paratuberculosis
gccauccgcgccgaac

SEQ ID NO: 2950440 - RNA, 18 nt, Mycobacterium avium subsp. paratuberculosis
gccauccgcgccgaacgc

SEQ ID NO: 2950441 - RNA, 15 nt, Mycobacterium avium subsp. paratuberculosis
gccauccggccggcg

SEQ ID NO: 2950442 - RNA, 14 nt, Mycobacterium avium subsp. paratuberculosis
gccauccgggcggc

SEQ ID NO: 2950443 - RNA, 21 nt, Mycobacterium avium subsp. paratuberculosis
gccauccgggcggcaucgcgc

SEQ ID NO: 2950444 - RNA, 14 nt, Mycobacterium avium subsp. paratuberculosis
gccauccguucggc

SEQ ID NO: 2950445 - RNA, 14 nt, Mycobacterium avium subsp. paratuberculosis
gccaucgacuccag

SEQ ID NO: 2950446 - RNA, 17 nt, Mycobacterium avium subsp. paratuberculosis
gccaucgacuccagcac

SEQ ID NO: 2950447 - RNA, 21 nt, Mycobacterium avium subsp. paratuberculosis
gccaucgacuccagcaccggc

SEQ ID NO: 2950448 - RNA, 16 nt, Mycobacterium avium subsp. paratuberculosis
gccaucgcaccgcgag

SEQ ID NO: 2950449 - RNA, 12 nt, Mycobacterium avium subsp. paratuberculosis
gccaucgcccgg

SEQ ID NO: 2950450 - RNA, 14 nt, Mycobacterium avium subsp. paratuberculosis
gccaucgccgccgc

SEQ ID NO: 2950451 - RNA, 13 nt, Mycobacterium avium subsp. paratuberculosis
gccaucgccgcgg

SEQ ID NO: 2950452 - RNA, 18 nt, Mycobacterium avium subsp. paratuberculosis
gccaucgccgcgguggcg

SEQ ID NO: 2950453 - RNA, 19 nt, Mycobacterium avium subsp. paratuberculosis
gccaucgccucggccacca

SEQ ID NO: 2950454 - RNA, 22 nt, Mycobacterium avium subsp. paratuberculosis
gccaucgccucggccaccagau

SEQ ID NO: 2950455 - RNA, 13 nt, Mycobacterium avium subsp. paratuberculosis
gccaucgcggccc

SEQ ID NO: 2950456 - RNA, 16 nt, Mycobacterium avium subsp. paratuberculosis
gccaucgcggccccca

SEQ ID NO: 2950457 - RNA, 22 nt, Mycobacterium avium subsp. paratuberculosis
gccaucgcggcccccacgcagc

SEQ ID NO: 2950458 - RNA, 22 nt, Mycobacterium avium subsp. paratuberculosis
gccaucgcggcguuguggccac

SEQ ID NO: 2950459 - RNA, 13 nt, Mycobacterium avium subsp. paratuberculosis
gccaucggcagac

SEQ ID NO: 2950460 - RNA, 19 nt, Mycobacterium avium subsp. paratuberculosis
gccaucggcagacccagca

SEQ ID NO: 2950461 - RNA, 20 nt, Mycobacterium avium subsp. paratuberculosis
gccaucggcagacccagcag

SEQ ID NO: 2950462 - RNA, 21 nt, Mycobacterium avium subsp. paratuberculosis
gccaucggcagacccagcagc

SEQ ID NO: 2950463 - RNA, 22 nt, Mycobacterium avium subsp. paratuberculosis
gccaucggcaucgcgcgcggcg

SEQ ID NO: 2950464 - RNA, 15 nt, Mycobacterium avium subsp. paratuberculosis
gccaucgucacuucg

SEQ ID NO: 2950465 - RNA, 23 nt, Mycobacterium avium subsp. paratuberculosis
gccaucgucacuucgccgggcug

SEQ ID NO: 2950466 - RNA, 18 nt, Mycobacterium avium subsp. paratuberculosis
gccaucgucuuccccguu

SEQ ID NO: 2950467 - RNA, 23 nt, Mycobacterium avium subsp. paratuberculosis
gccaucgugggcgccgucgccgc

SEQ ID NO: 2950468 - RNA, 21 nt, Mycobacterium avium subsp. paratuberculosis
gccaucucagcguucacgucg

SEQ ID NO: 2950469 - RNA, 22 nt, Mycobacterium avium subsp. paratuberculosis
gccaucuccugcacgcgcgggu

SEQ ID NO: 2950470 - RNA, 23 nt, Mycobacterium avium subsp. paratuberculosis
gccaucucgugcccgggcccgua

SEQ ID NO: 2950471 - RNA, 16 nt, Mycobacterium avium subsp. paratuberculosis
gccaucuggaacgcga

SEQ ID NO: 2950472 - RNA, 13 nt, Mycobacterium avium subsp. paratuberculosis
gccaucuggccgc

SEQ ID NO: 2950473 - RNA, 16 nt, Mycobacterium avium subsp. paratuberculosis
gccaucuggccgcggg

SEQ ID NO: 2950474 - RNA, 23 nt, Mycobacterium avium subsp. paratuberculosis
gccaucuucacgugcgcggcguc

SEQ ID NO: 2950475 - RNA, 19 nt, Mycobacterium avium subsp. paratuberculosis
gccaucuucaguucggccg

SEQ ID NO: 2950476 - RNA, 18 nt, Mycobacterium avium subsp. paratuberculosis
gccaugaacggcggggcc

SEQ ID NO: 2950477 - RNA, 19 nt, Mycobacterium avium subsp. paratuberculosis
gccaugaacggcggggccu

SEQ ID NO: 2950478 - RNA, 20 nt, Mycobacterium avium subsp. paratuberculosis
gccaugaacuccgacuccag

SEQ ID NO: 2950479 - RNA, 22 nt, Mycobacterium avium subsp. paratuberculosis
gccaugaagccguugccgccgc

SEQ ID NO: 2950480 - RNA, 23 nt, Mycobacterium avium subsp. paratuberculosis
gccaugaagccguugccgccgcg

SEQ ID NO: 2950481 - RNA, 18 nt, Mycobacterium avium subsp. paratuberculosis
gccaugaccaugucgacg

SEQ ID NO: 2950482 - RNA, 15 nt, Mycobacterium avium subsp. paratuberculosis
gccaugcagaccagc

SEQ ID NO: 2950483 - RNA, 16 nt, Mycobacterium avium subsp. paratuberculosis
gccaugcagaccagcc

SEQ ID NO: 2950484 - RNA, 18 nt, Mycobacterium avium subsp. paratuberculosis
gccaugcagaccagcccg

SEQ ID NO: 2950485 - RNA, 19 nt, Mycobacterium avium subsp. paratuberculosis
gccaugcagaccagcccgu

SEQ ID NO: 2950486 - RNA, 20 nt, Mycobacterium avium subsp. paratuberculosis
gccaugcagaccagcccguc

SEQ ID NO: 2950487 - RNA, 13 nt, Mycobacterium avium subsp. paratuberculosis
gccaugccgccga

SEQ ID NO: 2950488 - RNA, 18 nt, Mycobacterium avium subsp. paratuberculosis
gccaugccgccgaccgcc

SEQ ID NO: 2950489 - RNA, 19 nt, Mycobacterium avium subsp. paratuberculosis
gccaugccgccgaccgccg

SEQ ID NO: 2950490 - RNA, 20 nt, Mycobacterium avium subsp. paratuberculosis
gccaugccgccgaccgccga

SEQ ID NO: 2950491 - RNA, 13 nt, Mycobacterium avium subsp. paratuberculosis
gccaugccggccu

SEQ ID NO: 2950492 - RNA, 17 nt, Mycobacterium avium subsp. paratuberculosis
gccaugccggccugacu

SEQ ID NO: 2950493 - RNA, 20 nt, Mycobacterium avium subsp. paratuberculosis
gccaugccggguuucggccc

SEQ ID NO: 2950494 - RNA, 22 nt, Mycobacterium avium subsp. paratuberculosis
gccaugccggguuucggcccgg

SEQ ID NO: 2950495 - RNA, 14 nt, Mycobacterium avium subsp. paratuberculosis
gccaugccgucgcg

SEQ ID NO: 2950496 - RNA, 16 nt, Mycobacterium avium subsp. paratuberculosis
gccaugccgucgcgca

SEQ ID NO: 2950497 - RNA, 17 nt, Mycobacterium avium subsp. paratuberculosis
gccaugccucuucggcg

SEQ ID NO: 2950498 - RNA, 23 nt, Mycobacterium avium subsp. paratuberculosis
gccaugccucuucggcgcgccgg

SEQ ID NO: 2950499 - RNA, 14 nt, Mycobacterium avium subsp. paratuberculosis
gccaugcgaccacg

SEQ ID NO: 2950500 - RNA, 15 nt, Mycobacterium avium subsp. paratuberculosis
gccaugcgaccacga

SEQ ID NO: 2950501 - RNA, 13 nt, Mycobacterium avium subsp. paratuberculosis
gccaugcgccgcg

SEQ ID NO: 2950502 - RNA, 14 nt, Mycobacterium avium subsp. paratuberculosis
gccaugcgccgcgc

SEQ ID NO: 2950503 - RNA, 20 nt, Mycobacterium avium subsp. paratuberculosis
gccaugcuuucgaucaucga

SEQ ID NO: 2950504 - RNA, 15 nt, Mycobacterium avium subsp. paratuberculosis
gccauggccaggaac

SEQ ID NO: 2950505 - RNA, 16 nt, Mycobacterium avium subsp. paratuberculosis
gccauggccaggaacg

SEQ ID NO: 2950506 - RNA, 15 nt, Mycobacterium avium subsp. paratuberculosis
gccauggcgcaccgc

SEQ ID NO: 2950507 - RNA, 12 nt, Mycobacterium avium subsp. paratuberculosis
gccauggcggca

SEQ ID NO: 2950508 - RNA, 15 nt, Mycobacterium avium subsp. paratuberculosis
gccauggcggcaucc

SEQ ID NO: 2950509 - RNA, 13 nt, Mycobacterium avium subsp. paratuberculosis
gcccaccagcauc

SEQ ID NO: 2950510 - RNA, 14 nt, Mycobacterium avium subsp. paratuberculosis
gcccaccagccggc

SEQ ID NO: 2950511 - RNA, 17 nt, Mycobacterium avium subsp. paratuberculosis
gcccaccagccggccgg

SEQ ID NO: 2950512 - RNA, 18 nt, Mycobacterium avium subsp. paratuberculosis
gcccaccagccggccggc

SEQ ID NO: 2950513 - RNA, 19 nt, Mycobacterium avium subsp. paratuberculosis
gcccaccagccggccggcg

SEQ ID NO: 2950514 - RNA, 21 nt, Mycobacterium avium subsp. paratuberculosis
gcccaccagcugggaggcgca

SEQ ID NO: 2950515 - RNA, 14 nt, Mycobacterium avium subsp. paratuberculosis
gcccaccaggucga

SEQ ID NO: 2950516 - RNA, 17 nt, Mycobacterium avium subsp. paratuberculosis
gcccaccaucccgccgc

SEQ ID NO: 2950517 - RNA, 22 nt, Mycobacterium avium subsp. paratuberculosis
gcccaccaucccgccgccgaac

SEQ ID NO: 2950518 - RNA, 12 nt, Mycobacterium avium subsp. paratuberculosis
gcccaccccgga

SEQ ID NO: 2950519 - RNA, 14 nt, Mycobacterium avium subsp. paratuberculosis
gcccaccccggaca

SEQ ID NO: 2950520 - RNA, 15 nt, Mycobacterium avium subsp. paratuberculosis
gcccacccgaugacc

SEQ ID NO: 2950521 - RNA, 18 nt, Mycobacterium avium subsp. paratuberculosis
gcccacccgaugaccggc

SEQ ID NO: 2950522 - RNA, 21 nt, Mycobacterium avium subsp. paratuberculosis
gcccacccgaugaccggcccg

SEQ ID NO: 2950523 - RNA, 23 nt, Mycobacterium avium subsp. paratuberculosis
gcccacccgaugaccggcccggc

SEQ ID NO: 2950524 - RNA, 14 nt, Mycobacterium avium subsp. paratuberculosis
gcccacccgcacgc

SEQ ID NO: 2950525 - RNA, 16 nt, Mycobacterium avium subsp. paratuberculosis
gcccacccgcacgccc

SEQ ID NO: 2950526 - RNA, 21 nt, Mycobacterium avium subsp. paratuberculosis
gcccacccgcagggcgccggu

SEQ ID NO: 2950527 - RNA, 22 nt, Mycobacterium avium subsp. paratuberculosis
gcccacccgcagggcgccggug

SEQ ID NO: 2950528 - RNA, 14 nt, Mycobacterium avium subsp. paratuberculosis
gcccacccgccagc

SEQ ID NO: 2950529 - RNA, 17 nt, Mycobacterium avium subsp. paratuberculosis
gcccacccgccagcccg

SEQ ID NO: 2950530 - RNA, 13 nt, Mycobacterium avium subsp. paratuberculosis
gcccacccgcgcc

SEQ ID NO: 2950531 - RNA, 14 nt, Mycobacterium avium subsp. paratuberculosis
gcccacccgcgccg

SEQ ID NO: 2950532 - RNA, 16 nt, Mycobacterium avium subsp. paratuberculosis
gcccacccgcgccggc

SEQ ID NO: 2950533 - RNA, 17 nt, Mycobacterium avium subsp. paratuberculosis
gcccacccgcgccggca

SEQ ID NO: 2950534 - RNA, 18 nt, Mycobacterium avium subsp. paratuberculosis
gcccacccgcucggcgau

SEQ ID NO: 2950535 - RNA, 19 nt, Mycobacterium avium subsp. paratuberculosis
gcccacccggaugucgugc

SEQ ID NO: 2950536 - RNA, 20 nt, Mycobacterium avium subsp. paratuberculosis
gcccacccggaugucgugcg

SEQ ID NO: 2950537 - RNA, 14 nt, Mycobacterium avium subsp. paratuberculosis
gcccacccggggcc

SEQ ID NO: 2950538 - RNA, 15 nt, Mycobacterium avium subsp. paratuberculosis
gcccacccggggccg

SEQ ID NO: 2950539 - RNA, 18 nt, Mycobacterium avium subsp. paratuberculosis
gcccacccggggccgucc

SEQ ID NO: 2950540 - RNA, 14 nt, Mycobacterium avium subsp. paratuberculosis
gcccacccguuggc

SEQ ID NO: 2950541 - RNA, 18 nt, Mycobacterium avium subsp. paratuberculosis
gcccacccguuggcaggc

SEQ ID NO: 2950542 - RNA, 23 nt, Mycobacterium avium subsp. paratuberculosis
gcccacccguuggcaggcccggu

SEQ ID NO: 2950543 - RNA, 24 nt, Mycobacterium avium subsp. paratuberculosis
gcccacccguuggcaggcccggua

SEQ ID NO: 2950544 - RNA, 15 nt, Mycobacterium avium subsp. paratuberculosis
gcccaccgaaucacc

SEQ ID NO: 2950545 - RNA, 21 nt, Mycobacterium avium subsp. paratuberculosis
gcccaccgaaucacccacggc

SEQ ID NO: 2950546 - RNA, 22 nt, Mycobacterium avium subsp. paratuberculosis
gcccaccgaaucacccacggcc

SEQ ID NO: 2950547 - RNA, 14 nt, Mycobacterium avium subsp. paratuberculosis
gcccaccgacgcgg

SEQ ID NO: 2950548 - RNA, 16 nt, Mycobacterium avium subsp. paratuberculosis
gcccaccgacgcggcg

SEQ ID NO: 2950549 - RNA, 20 nt, Mycobacterium avium subsp. paratuberculosis
gcccaccgacgcggcggccg

SEQ ID NO: 2950550 - RNA, 16 nt, Mycobacterium avium subsp. paratuberculosis
gcccaccgaucgcgag

SEQ ID NO: 2950551 - RNA, 19 nt, Mycobacterium avium subsp. paratuberculosis
gcccaccgaucgcgagggc

SEQ ID NO: 2950552 - RNA, 20 nt, Mycobacterium avium subsp. paratuberculosis
gcccaccgaucgcgagggcc

SEQ ID NO: 2950553 - RNA, 14 nt, Mycobacterium avium subsp. paratuberculosis
gcccaccgccacca

SEQ ID NO: 2950554 - RNA, 12 nt, Mycobacterium avium subsp. paratuberculosis
gcccaccgccgu

SEQ ID NO: 2950555 - RNA, 13 nt, Mycobacterium avium subsp. paratuberculosis
gcccaccgccguu

SEQ ID NO: 2950556 - RNA, 15 nt, Mycobacterium avium subsp. paratuberculosis
gcccaccgccguucc

SEQ ID NO: 2950557 - RNA, 12 nt, Mycobacterium avium subsp. paratuberculosis
gcccaccgcgac

SEQ ID NO: 2950558 - RNA, 18 nt, Mycobacterium avium subsp. paratuberculosis
gcccaccgcgacccggcc

SEQ ID NO: 2950559 - RNA, 14 nt, Mycobacterium avium subsp. paratuberculosis
gcccaccgcgccca

SEQ ID NO: 2950560 - RNA, 16 nt, Mycobacterium avium subsp. paratuberculosis
gcccaccgcgcccagc

SEQ ID NO: 2950561 - RNA, 13 nt, Mycobacterium avium subsp. paratuberculosis
gcccaccgcggcg

SEQ ID NO: 2950562 - RNA, 16 nt, Mycobacterium avium subsp. paratuberculosis
gcccaccgcggcgcgc

SEQ ID NO: 2950563 - RNA, 19 nt, Mycobacterium avium subsp. paratuberculosis
gcccaccgcggcgcgcggc

SEQ ID NO: 2950564 - RNA, 21 nt, Mycobacterium avium subsp. paratuberculosis
gcccaccgcggcgcgcggccg

SEQ ID NO: 2950565 - RNA, 23 nt, Mycobacterium avium subsp. paratuberculosis
gcccaccgcggcgcgcggccgcg

SEQ ID NO: 2950566 - RNA, 24 nt, Mycobacterium avium subsp. paratuberculosis
gcccaccgcggcgcgcggccgcga

SEQ ID NO: 2950567 - RNA, 13 nt, Mycobacterium avium subsp. paratuberculosis
gcccaccgcggug

SEQ ID NO: 2950568 - RNA, 22 nt, Mycobacterium avium subsp. paratuberculosis
gcccaccgcggugaccgcccgc

SEQ ID NO: 2950569 - RNA, 13 nt, Mycobacterium avium subsp. paratuberculosis
gcccaccgcgucg

SEQ ID NO: 2950570 - RNA, 20 nt, Mycobacterium avium subsp. paratuberculosis
gcccaccgcgucgcagugcc

SEQ ID NO: 2950571 - RNA, 16 nt, Mycobacterium avium subsp. paratuberculosis
gcccaccgcucgucgg

SEQ ID NO: 2950572 - RNA, 13 nt, Mycobacterium avium subsp. paratuberculosis
gcccaccggcccg

SEQ ID NO: 2950573 - RNA, 19 nt, Mycobacterium avium subsp. paratuberculosis
gcccaccggcccggcgggc

SEQ ID NO: 2950574 - RNA, 23 nt, Mycobacterium avium subsp. paratuberculosis
gcccaccggcccggcgggcauca

SEQ ID NO: 2950575 - RNA, 16 nt, Mycobacterium avium subsp. paratuberculosis
gcccaccgggcagccg

SEQ ID NO: 2950576 - RNA, 17 nt, Mycobacterium avium subsp. paratuberculosis
gcccaccgggcagccgc

SEQ ID NO: 2950577 - RNA, 18 nt, Mycobacterium avium subsp. paratuberculosis
gcccaccgggcagccgca

SEQ ID NO: 2950578 - RNA, 22 nt, Mycobacterium avium subsp. paratuberculosis
gcccaccgguggccgggagugc

SEQ ID NO: 2950579 - RNA, 14 nt, Mycobacterium avium subsp. paratuberculosis
gcccaccgucgcca

SEQ ID NO: 2950580 - RNA, 15 nt, Mycobacterium avium subsp. paratuberculosis
gcccaccgucgccac

SEQ ID NO: 2950581 - RNA, 16 nt, Mycobacterium avium subsp. paratuberculosis
gcccaccgucgccacg

SEQ ID NO: 2950582 - RNA, 17 nt, Mycobacterium avium subsp. paratuberculosis
gcccaccgucgccacga

SEQ ID NO: 2950583 - RNA, 23 nt, Mycobacterium avium subsp. paratuberculosis
gcccaccgucuuggucucgccga

SEQ ID NO: 2950584 - RNA, 20 nt, Mycobacterium avium subsp. paratuberculosis
gcccaccugguucucccguc

SEQ ID NO: 2950585 - RNA, 22 nt, Mycobacterium avium subsp. paratuberculosis
gcccaccugguucucccgucgc

SEQ ID NO: 2950586 - RNA, 20 nt, Mycobacterium avium subsp. paratuberculosis
gcccaccugguuggcccgca

SEQ ID NO: 2950587 - RNA, 20 nt, Mycobacterium avium subsp. paratuberculosis
gcccaccuucccaaccccgg

SEQ ID NO: 2950588 - RNA, 16 nt, Mycobacterium avium subsp. paratuberculosis
gcccaccuuggcgucg

SEQ ID NO: 2950589 - RNA, 17 nt, Mycobacterium avium subsp. paratuberculosis
gcccaccuuggcgucga

SEQ ID NO: 2950590 - RNA, 18 nt, Mycobacterium avium subsp. paratuberculosis
gcccaccuuggcgucgau

SEQ ID NO: 2950591 - RNA, 22 nt, Mycobacterium avium subsp. paratuberculosis
gcccacgaaccgguugcgggcc

SEQ ID NO: 2950592 - RNA, 19 nt, Mycobacterium avium subsp. paratuberculosis
gcccacgaagaugaucagc

SEQ ID NO: 2950593 - RNA, 23 nt, Mycobacterium avium subsp. paratuberculosis
gcccacgaagaugaucagcgcgc

SEQ ID NO: 2950594 - RNA, 14 nt, Mycobacterium avium subsp. paratuberculosis
gcccagcaccgccg

SEQ ID NO: 2950595 - RNA, 13 nt, Mycobacterium avium subsp. paratuberculosis
gcccagcaccgcg

SEQ ID NO: 2950596 - RNA, 17 nt, Mycobacterium avium subsp. paratuberculosis
gcccagcaccgcgacga

SEQ ID NO: 2950597 - RNA, 19 nt, Mycobacterium avium subsp. paratuberculosis
gcccagcaccgcgacgauc

SEQ ID NO: 2950598 - RNA, 16 nt, Mycobacterium avium subsp. paratuberculosis
gcccagcacgacgccg

SEQ ID NO: 2950599 - RNA, 19 nt, Mycobacterium avium subsp. paratuberculosis
gcccagcagauagcccagc

SEQ ID NO: 2950600 - RNA, 22 nt, Mycobacterium avium subsp. paratuberculosis
gcccagcagauagcccagccag

SEQ ID NO: 2950601 - RNA, 23 nt, Mycobacterium avium subsp. paratuberculosis
gcccagcagauagcccagccagc

SEQ ID NO: 2950602 - RNA, 10 nt, Mycobacterium avium subsp. paratuberculosis
gcccagcagc

SEQ ID NO: 2950603 - RNA, 17 nt, Mycobacterium avium subsp. paratuberculosis
gcccagcagcaccgcga

SEQ ID NO: 2950604 - RNA, 19 nt, Mycobacterium avium subsp. paratuberculosis
gcccagcagcaccgcgacc

SEQ ID NO: 2950605 - RNA, 20 nt, Mycobacterium avium subsp. paratuberculosis
gcccagcagcaccgcgaccg

SEQ ID NO: 2950606 - RNA, 15 nt, Mycobacterium avium subsp. paratuberculosis
gcccagcagcccggc

SEQ ID NO: 2950607 - RNA, 16 nt, Mycobacterium avium subsp. paratuberculosis
gcccagcagcccggcc

SEQ ID NO: 2950608 - RNA, 18 nt, Mycobacterium avium subsp. paratuberculosis
gcccagcagcccggccag

SEQ ID NO: 2950609 - RNA, 21 nt, Mycobacterium avium subsp. paratuberculosis
gcccagcagcccggccagccg

SEQ ID NO: 2950610 - RNA, 22 nt, Mycobacterium avium subsp. paratuberculosis
gcccagcagcccggccagccgg

SEQ ID NO: 2950611 - RNA, 18 nt, Mycobacterium avium subsp. paratuberculosis
gcccagcagccgcgccga

SEQ ID NO: 2950612 - RNA, 19 nt, Mycobacterium avium subsp. paratuberculosis
gcccagcagccgcgccgac

SEQ ID NO: 2950613 - RNA, 14 nt, Mycobacterium avium subsp. paratuberculosis
gcccagcagccugc

SEQ ID NO: 2950614 - RNA, 19 nt, Mycobacterium avium subsp. paratuberculosis
gcccagcagcgcaccggcg

SEQ ID NO: 2950615 - RNA, 22 nt, Mycobacterium avium subsp. paratuberculosis
gcccagcagcgcaccggcgaug

SEQ ID NO: 2950616 - RNA, 15 nt, Mycobacterium avium subsp. paratuberculosis
gcccagcagcggggc

SEQ ID NO: 2950617 - RNA, 21 nt, Mycobacterium avium subsp. paratuberculosis
gcccagcagcggggcgagcug

SEQ ID NO: 2950618 - RNA, 23 nt, Mycobacterium avium subsp. paratuberculosis
gcccagcagcggggcgagcuggc

SEQ ID NO: 2950619 - RNA, 22 nt, Mycobacterium avium subsp. paratuberculosis
gcccagcagcgucacgucgacg

SEQ ID NO: 2950620 - RNA, 23 nt, Mycobacterium avium subsp. paratuberculosis
gcccagcagcgucacgucgacgg

SEQ ID NO: 2950621 - RNA, 19 nt, Mycobacterium avium subsp. paratuberculosis
gcccagcagcugcgcgucg

SEQ ID NO: 2950622 - RNA, 15 nt, Mycobacterium avium subsp. paratuberculosis
gcccagcagggcggc

SEQ ID NO: 2950623 - RNA, 16 nt, Mycobacterium avium subsp. paratuberculosis
gcccagcagggcggcg

SEQ ID NO: 2950624 - RNA, 17 nt, Mycobacterium avium subsp. paratuberculosis
gcccagcaguccggcgg

SEQ ID NO: 2950625 - RNA, 19 nt, Mycobacterium avium subsp. paratuberculosis
gcccagcaguccggcgguc

SEQ ID NO: 2950626 - RNA, 23 nt, Mycobacterium avium subsp. paratuberculosis
gcccagcaguuuguccugcucgg

SEQ ID NO: 2950627 - RNA, 22 nt, Mycobacterium avium subsp. paratuberculosis
gcccagcauaggugcgccggau

SEQ ID NO: 2950628 - RNA, 14 nt, Mycobacterium avium subsp. paratuberculosis
gcccagccacgcca

SEQ ID NO: 2950629 - RNA, 16 nt, Mycobacterium avium subsp. paratuberculosis
gcccagccacgccaac

SEQ ID NO: 2950630 - RNA, 13 nt, Mycobacterium avium subsp. paratuberculosis
gcccagccagccg

SEQ ID NO: 2950631 - RNA, 14 nt, Mycobacterium avium subsp. paratuberculosis
gcccagccagccgg

SEQ ID NO: 2950632 - RNA, 21 nt, Mycobacterium avium subsp. paratuberculosis
gcccagccagccgguggcggc

SEQ ID NO: 2950633 - RNA, 16 nt, Mycobacterium avium subsp. paratuberculosis
gcccagccaggccgcc

SEQ ID NO: 2950634 - RNA, 17 nt, Mycobacterium avium subsp. paratuberculosis
gcccagccaggccgccg

SEQ ID NO: 2950635 - RNA, 18 nt, Mycobacterium avium subsp. paratuberculosis
gcccagccaggccgccgg

SEQ ID NO: 2950636 - RNA, 21 nt, Mycobacterium avium subsp. paratuberculosis
gcccagccaggccgccgggcc

SEQ ID NO: 2950637 - RNA, 22 nt, Mycobacterium avium subsp. paratuberculosis
gcccagccaggccgccgggccg

SEQ ID NO: 2950638 - RNA, 15 nt, Mycobacterium avium subsp. paratuberculosis
gcccagccaguccgc

SEQ ID NO: 2950639 - RNA, 20 nt, Mycobacterium avium subsp. paratuberculosis
gcccagccaguccgccgccg

SEQ ID NO: 2950640 - RNA, 20 nt, Mycobacterium avium subsp. paratuberculosis
gcccagccccagcacgauga

SEQ ID NO: 2950641 - RNA, 21 nt, Mycobacterium avium subsp. paratuberculosis
gcccagccccagcacgaugac

SEQ ID NO: 2950642 - RNA, 16 nt, Mycobacterium avium subsp. paratuberculosis
gcccagccccucgacg

SEQ ID NO: 2950643 - RNA, 21 nt, Mycobacterium avium subsp. paratuberculosis
gcccagccccucgacguccag

SEQ ID NO: 2950644 - RNA, 17 nt, Mycobacterium avium subsp. paratuberculosis
gcccagcccgagcacca

SEQ ID NO: 2950645 - RNA, 13 nt, Mycobacterium avium subsp. paratuberculosis
gcccagcccgccg

SEQ ID NO: 2950646 - RNA, 15 nt, Mycobacterium avium subsp. paratuberculosis
gcccagcccgccgcg

SEQ ID NO: 2950647 - RNA, 16 nt, Mycobacterium avium subsp. paratuberculosis
gcccagcccgcgccga

SEQ ID NO: 2950648 - RNA, 18 nt, Mycobacterium avium subsp. paratuberculosis
gcccagcccgcgccgagc

SEQ ID NO: 2950649 - RNA, 14 nt, Mycobacterium avium subsp. paratuberculosis
gcccagcccgcgcg

SEQ ID NO: 2950650 - RNA, 15 nt, Mycobacterium avium subsp. paratuberculosis
gcccagcccgcgcga

SEQ ID NO: 2950651 - RNA, 17 nt, Mycobacterium avium subsp. paratuberculosis
gcccagcccgcgcgagc

SEQ ID NO: 2950652 - RNA, 18 nt, Mycobacterium avium subsp. paratuberculosis
gcccagcccgcgcgagcg

SEQ ID NO: 2950653 - RNA, 13 nt, Mycobacterium avium subsp. paratuberculosis
gcccagcccgcgg

SEQ ID NO: 2950654 - RNA, 16 nt, Mycobacterium avium subsp. paratuberculosis
gcccagcccgcgggcg

SEQ ID NO: 2950655 - RNA, 18 nt, Mycobacterium avium subsp. paratuberculosis
gcccagcccgcgggcggc

SEQ ID NO: 2950656 - RNA, 12 nt, Mycobacterium avium subsp. paratuberculosis
gcccagcccggc

SEQ ID NO: 2950657 - RNA, 13 nt, Mycobacterium avium subsp. paratuberculosis
gcccagcccggcc

SEQ ID NO: 2950658 - RNA, 16 nt, Mycobacterium avium subsp. paratuberculosis
gcccagcccggccagc

SEQ ID NO: 2950659 - RNA, 22 nt, Mycobacterium avium subsp. paratuberculosis
gcccagcccggccccaccgccg

SEQ ID NO: 2950660 - RNA, 17 nt, Mycobacterium avium subsp. paratuberculosis
gcccagccgagccgggc

SEQ ID NO: 2950661 - RNA, 22 nt, Mycobacterium avium subsp. paratuberculosis
gcccagccgagccgggccaggu

SEQ ID NO: 2950662 - RNA, 13 nt, Mycobacterium avium subsp. paratuberculosis
gcccagccgcagg

SEQ ID NO: 2950663 - RNA, 14 nt, Mycobacterium avium subsp. paratuberculosis
gcccagccgcaggu

SEQ ID NO: 2950664 - RNA, 15 nt, Mycobacterium avium subsp. paratuberculosis
gcccagccgccagcc

SEQ ID NO: 2950665 - RNA, 16 nt, Mycobacterium avium subsp. paratuberculosis
gcccagccgccagccg

SEQ ID NO: 2950666 - RNA, 13 nt, Mycobacterium avium subsp. paratuberculosis
gcccagccgcguc

SEQ ID NO: 2950667 - RNA, 21 nt, Mycobacterium avium subsp. paratuberculosis
gcccagccgcgucacgucggc

SEQ ID NO: 2950668 - RNA, 13 nt, Mycobacterium avium subsp. paratuberculosis
gcccagccgcuga

SEQ ID NO: 2950669 - RNA, 11 nt, Mycobacterium avium subsp. paratuberculosis
gcccagccggc

SEQ ID NO: 2950670 - RNA, 13 nt, Mycobacterium avium subsp. paratuberculosis
gcccagccggccg

SEQ ID NO: 2950671 - RNA, 17 nt, Mycobacterium avium subsp. paratuberculosis
gcccagccggccgacgc

SEQ ID NO: 2950672 - RNA, 20 nt, Mycobacterium avium subsp. paratuberculosis
gcccagccggccgacgcggc

SEQ ID NO: 2950673 - RNA, 13 nt, Mycobacterium avium subsp. paratuberculosis
gcccagccggcgg

SEQ ID NO: 2950674 - RNA, 14 nt, Mycobacterium avium subsp. paratuberculosis
gcccagccggcgga

SEQ ID NO: 2950675 - RNA, 19 nt, Mycobacterium avium subsp. paratuberculosis
gcccagccggcggugcagg

SEQ ID NO: 2950676 - RNA, 20 nt, Mycobacterium avium subsp. paratuberculosis
gcccagccggcggugcaggg

SEQ ID NO: 2950677 - RNA, 11 nt, Mycobacterium avium subsp. paratuberculosis
gcccagccggu

SEQ ID NO: 2950678 - RNA, 19 nt, Mycobacterium avium subsp. paratuberculosis
gcccagccggucgccgggc

SEQ ID NO: 2950679 - RNA, 16 nt, Mycobacterium avium subsp. paratuberculosis
gcccaggaucaccggg

SEQ ID NO: 2950680 - RNA, 17 nt, Mycobacterium avium subsp. paratuberculosis
gcccaggaugacgccga

SEQ ID NO: 2950681 - RNA, 20 nt, Mycobacterium avium subsp. paratuberculosis
gcccaggaugacgccgaauc

SEQ ID NO: 2950682 - RNA, 16 nt, Mycobacterium avium subsp. paratuberculosis
gcccaggauucucagc

SEQ ID NO: 2950683 - RNA, 19 nt, Mycobacterium avium subsp. paratuberculosis
gcccaggauucucagcagc

SEQ ID NO: 2950684 - RNA, 15 nt, Mycobacterium avium subsp. paratuberculosis
gcccaggcacagcga

SEQ ID NO: 2950685 - RNA, 19 nt, Mycobacterium avium subsp. paratuberculosis
gcccaggcaguagccgauc

SEQ ID NO: 2950686 - RNA, 15 nt, Mycobacterium avium subsp. paratuberculosis
gcccaggccaacagc

SEQ ID NO: 2950687 - RNA, 16 nt, Mycobacterium avium subsp. paratuberculosis
gcccaggccaacagca

SEQ ID NO: 2950688 - RNA, 19 nt, Mycobacterium avium subsp. paratuberculosis
gcccaggccaacagcagca

SEQ ID NO: 2950689 - RNA, 16 nt, Mycobacterium avium subsp. paratuberculosis
gcccaggcccaccagc

SEQ ID NO: 2950690 - RNA, 12 nt, Mycobacterium avium subsp. paratuberculosis
gcccaggcccag

SEQ ID NO: 2950691 - RNA, 16 nt, Mycobacterium avium subsp. paratuberculosis
gcccaggcccagcagc

SEQ ID NO: 2950692 - RNA, 22 nt, Mycobacterium avium subsp. paratuberculosis
gcccaggcccagcagcaccgcg

SEQ ID NO: 2950693 - RNA, 14 nt, Mycobacterium avium subsp. paratuberculosis
gcccaggccccggc

SEQ ID NO: 2950694 - RNA, 15 nt, Mycobacterium avium subsp. paratuberculosis
gcccaggccccggcc

SEQ ID NO: 2950695 - RNA, 17 nt, Mycobacterium avium subsp. paratuberculosis
gcccaggccccggccga

SEQ ID NO: 2950696 - RNA, 21 nt, Mycobacterium avium subsp. paratuberculosis
gcccaggccccggccgagcgc

SEQ ID NO: 2950697 - RNA, 15 nt, Mycobacterium avium subsp. paratuberculosis
gcccaggcccggcac

SEQ ID NO: 2950698 - RNA, 17 nt, Mycobacterium avium subsp. paratuberculosis
gcccaggcccggcaccg

SEQ ID NO: 2950699 - RNA, 14 nt, Mycobacterium avium subsp. paratuberculosis
gcccaggccgacgc

SEQ ID NO: 2950700 - RNA, 18 nt, Mycobacterium avium subsp. paratuberculosis
gcccaggccgacgccggc

SEQ ID NO: 2950701 - RNA, 22 nt, Mycobacterium avium subsp. paratuberculosis
gcccaggccgacgccggccacc

SEQ ID NO: 2950702 - RNA, 23 nt, Mycobacterium avium subsp. paratuberculosis
gcccaggccgacgccggccacca

SEQ ID NO: 2950703 - RNA, 14 nt, Mycobacterium avium subsp. paratuberculosis
gcccaggccgccag

SEQ ID NO: 2950704 - RNA, 16 nt, Mycobacterium avium subsp. paratuberculosis
gcccaggccgccagcu

SEQ ID NO: 2950705 - RNA, 15 nt, Mycobacterium avium subsp. paratuberculosis
gcccaggccgcgguc

SEQ ID NO: 2950706 - RNA, 13 nt, Mycobacterium avium subsp. paratuberculosis
gcccaggccggcg

SEQ ID NO: 2950707 - RNA, 14 nt, Mycobacterium avium subsp. paratuberculosis
gcccaggccggcgg

SEQ ID NO: 2950708 - RNA, 16 nt, Mycobacterium avium subsp. paratuberculosis
gcccaggccggcggug

SEQ ID NO: 2950709 - RNA, 23 nt, Mycobacterium avium subsp. paratuberculosis
gcccaggccggcgguggugccgc

SEQ ID NO: 2950710 - RNA, 21 nt, Mycobacterium avium subsp. paratuberculosis
gcccaggccuuguacgccccg

SEQ ID NO: 2950711 - RNA, 12 nt, Mycobacterium avium subsp. paratuberculosis
gcccaggcgggc

SEQ ID NO: 2950712 - RNA, 15 nt, Mycobacterium avium subsp. paratuberculosis
gcccaggcgggccag

SEQ ID NO: 2950713 - RNA, 16 nt, Mycobacterium avium subsp. paratuberculosis
gcccaggcgggccagc

SEQ ID NO: 2950714 - RNA, 16 nt, Mycobacterium avium subsp. paratuberculosis
gcccaggcgugcgcgu

SEQ ID NO: 2950715 - RNA, 13 nt, Mycobacterium avium subsp. paratuberculosis
gcccaggcucagg

SEQ ID NO: 2950716 - RNA, 23 nt, Mycobacterium avium subsp. paratuberculosis
gcccaggcucaggaucagcagcc

SEQ ID NO: 2950717 - RNA, 20 nt, Mycobacterium avium subsp. paratuberculosis
gcccaggcugaacaccacca

SEQ ID NO: 2950718 - RNA, 13 nt, Mycobacterium avium subsp. paratuberculosis
gcccagggcgugc

SEQ ID NO: 2950719 - RNA, 15 nt, Mycobacterium avium subsp. paratuberculosis
gcccaggggagcggc

SEQ ID NO: 2950720 - RNA, 17 nt, Mycobacterium avium subsp. paratuberculosis
gcccaggggagcggcgg

SEQ ID NO: 2950721 - RNA, 22 nt, Mycobacterium avium subsp. paratuberculosis
gcccaggggucccaggugggcg

SEQ ID NO: 2950722 - RNA, 21 nt, Mycobacterium avium subsp. paratuberculosis
gcccagguaaucgaaggccag

SEQ ID NO: 2950723 - RNA, 18 nt, Mycobacterium avium subsp. paratuberculosis
gcccagguacuccucggu

SEQ ID NO: 2950724 - RNA, 13 nt, Mycobacterium avium subsp. paratuberculosis
gcccagguccacc

SEQ ID NO: 2950725 - RNA, 17 nt, Mycobacterium avium subsp. paratuberculosis
gcccagguccaccaggu

SEQ ID NO: 2950726 - RNA, 15 nt, Mycobacterium avium subsp. paratuberculosis
gcccagguccaccgu

SEQ ID NO: 2950727 - RNA, 22 nt, Mycobacterium avium subsp. paratuberculosis
gcccaggucgggacguccgcgc

SEQ ID NO: 2950728 - RNA, 13 nt, Mycobacterium avium subsp. paratuberculosis
gcccaggucguga

SEQ ID NO: 2950729 - RNA, 14 nt, Mycobacterium avium subsp. paratuberculosis
gcccaggugcaccc

SEQ ID NO: 2950730 - RNA, 20 nt, Mycobacterium avium subsp. paratuberculosis
gcccaggugcagaccggaca

SEQ ID NO: 2950731 - RNA, 17 nt, Mycobacterium avium subsp. paratuberculosis
gcccagguucuccggcc

SEQ ID NO: 2950732 - RNA, 21 nt, Mycobacterium avium subsp. paratuberculosis
gcccagguucuccggcccgcu

SEQ ID NO: 2950733 - RNA, 13 nt, Mycobacterium avium subsp. paratuberculosis
gcccaguccaguc

SEQ ID NO: 2950734 - RNA, 16 nt, Mycobacterium avium subsp. paratuberculosis
gcccaguccagucgcg

SEQ ID NO: 2950735 - RNA, 22 nt, Mycobacterium avium subsp. paratuberculosis
gcccaguccagucgcgccgagg

SEQ ID NO: 2950736 - RNA, 12 nt, Mycobacterium avium subsp. paratuberculosis
gcccagucccgu

SEQ ID NO: 2950737 - RNA, 15 nt, Mycobacterium avium subsp. paratuberculosis
gcccaguccugcagc

SEQ ID NO: 2950738 - RNA, 16 nt, Mycobacterium avium subsp. paratuberculosis
gcccaguccugcagcu

SEQ ID NO: 2950739 - RNA, 18 nt, Mycobacterium avium subsp. paratuberculosis
gcccaguccugcagcucg

SEQ ID NO: 2950740 - RNA, 22 nt, Mycobacterium avium subsp. paratuberculosis
gcccaguccugcagcucgccgg

SEQ ID NO: 2950741 - RNA, 13 nt, Mycobacterium avium subsp. paratuberculosis
gcccagucgccgc

SEQ ID NO: 2950742 - RNA, 15 nt, Mycobacterium avium subsp. paratuberculosis
gcccagucgccgccg

SEQ ID NO: 2950743 - RNA, 17 nt, Mycobacterium avium subsp. paratuberculosis
gcccagucgccgccgcg

SEQ ID NO: 2950744 - RNA, 22 nt, Mycobacterium avium subsp. paratuberculosis
gcccaguggaucggcccgacgg

SEQ ID NO: 2950745 - RNA, 17 nt, Mycobacterium avium subsp. paratuberculosis
gcccaguugcacggugu

SEQ ID NO: 2950746 - RNA, 16 nt, Mycobacterium avium subsp. paratuberculosis
gcccaucaccagcaga

SEQ ID NO: 2950747 - RNA, 17 nt, Mycobacterium avium subsp. paratuberculosis
gcccaucaccagcagac

SEQ ID NO: 2950748 - RNA, 14 nt, Mycobacterium avium subsp. paratuberculosis
gcccaucaccagcg

SEQ ID NO: 2950749 - RNA, 14 nt, Mycobacterium avium subsp. paratuberculosis
gcccaucaccccga

SEQ ID NO: 2950750 - RNA, 14 nt, Mycobacterium avium subsp. paratuberculosis
gcccaucaccgcac

SEQ ID NO: 2950751 - RNA, 17 nt, Mycobacterium avium subsp. paratuberculosis
gcccaucaccgcaccga

SEQ ID NO: 2950752 - RNA, 19 nt, Mycobacterium avium subsp. paratuberculosis
gcccaucaccgcaccgacg

SEQ ID NO: 2950753 - RNA, 15 nt, Mycobacterium avium subsp. paratuberculosis
gcccaucacgcccca

SEQ ID NO: 2950754 - RNA, 17 nt, Mycobacterium avium subsp. paratuberculosis
gcccaucacgccccagg

SEQ ID NO: 2950755 - RNA, 18 nt, Mycobacterium avium subsp. paratuberculosis
gcccaucacgucggggcc

SEQ ID NO: 2950756 - RNA, 15 nt, Mycobacterium avium subsp. paratuberculosis
gcccaucagcaggac

SEQ ID NO: 2950757 - RNA, 20 nt, Mycobacterium avium subsp. paratuberculosis
gcccaucagcaggaccaggc

SEQ ID NO: 2950758 - RNA, 21 nt, Mycobacterium avium subsp. paratuberculosis
gcccauccaggccagcaccug

SEQ ID NO: 2950759 - RNA, 20 nt, Mycobacterium avium subsp. paratuberculosis
gcccaucccgauccgcgccg

SEQ ID NO: 2950760 - RNA, 21 nt, Mycobacterium avium subsp. paratuberculosis
gcccaucccgauccgcgccgc

SEQ ID NO: 2950761 - RNA, 22 nt, Mycobacterium avium subsp. paratuberculosis
gcccaucccgauccgcgccgcc

SEQ ID NO: 2950762 - RNA, 23 nt, Mycobacterium avium subsp. paratuberculosis
gcccaucccgauccgcgccgccg

SEQ ID NO: 2950763 - RNA, 17 nt, Mycobacterium avium subsp. paratuberculosis
gcccauccggcgccgcg

SEQ ID NO: 2950764 - RNA, 23 nt, Mycobacterium avium subsp. paratuberculosis
gccccagggaccagugguggccg

SEQ ID NO: 2950765 - RNA, 15 nt, Mycobacterium avium subsp. paratuberculosis
gccccagggccucgg

SEQ ID NO: 2950766 - RNA, 16 nt, Mycobacterium avium subsp. paratuberculosis
gccccagggccucggc

SEQ ID NO: 2950767 - RNA, 20 nt, Mycobacterium avium subsp. paratuberculosis
gccccagggccucggcgacc

SEQ ID NO: 2950768 - RNA, 16 nt, Mycobacterium avium subsp. paratuberculosis
gccccagggugcgccg

SEQ ID NO: 2950769 - RNA, 18 nt, Mycobacterium avium subsp. paratuberculosis
gccccagggugcgccgcu

SEQ ID NO: 2950770 - RNA, 23 nt, Mycobacterium avium subsp. paratuberculosis
gccccagguagauucccaugucg

SEQ ID NO: 2950771 - RNA, 14 nt, Mycobacterium avium subsp. paratuberculosis
gccccaggucgggg

SEQ ID NO: 2950772 - RNA, 15 nt, Mycobacterium avium subsp. paratuberculosis
gccccaggucggggu

SEQ ID NO: 2950773 - RNA, 16 nt, Mycobacterium avium subsp. paratuberculosis
gccccaggucggggug

SEQ ID NO: 2950774 - RNA, 22 nt, Mycobacterium avium subsp. paratuberculosis
gccccaggucggggugggcgac

SEQ ID NO: 2950775 - RNA, 23 nt, Mycobacterium avium subsp. paratuberculosis
gccccaggucggggugggcgacg

SEQ ID NO: 2950776 - RNA, 15 nt, Mycobacterium avium subsp. paratuberculosis
gccccaggugacgcc

SEQ ID NO: 2950777 - RNA, 20 nt, Mycobacterium avium subsp. paratuberculosis
gccccaggugacgccgcacg

SEQ ID NO: 2950778 - RNA, 21 nt, Mycobacterium avium subsp. paratuberculosis
gccccaggugacgccgcacga

SEQ ID NO: 2950779 - RNA, 18 nt, Mycobacterium avium subsp. paratuberculosis
gccccagguuccgguguc

SEQ ID NO: 2950780 - RNA, 21 nt, Mycobacterium avium subsp. paratuberculosis
gccccagugcaggcaggcccc

SEQ ID NO: 2950781 - RNA, 13 nt, Mycobacterium avium subsp. paratuberculosis
gccccagugggug

SEQ ID NO: 2950782 - RNA, 23 nt, Mycobacterium avium subsp. paratuberculosis
gccccaguucgaucagcagcucg

SEQ ID NO: 2950783 - RNA, 16 nt, Mycobacterium avium subsp. paratuberculosis
gccccaguuggcgucg

SEQ ID NO: 2950784 - RNA, 19 nt, Mycobacterium avium subsp. paratuberculosis
gccccaguuggcgucgucg

SEQ ID NO: 2950785 - RNA, 21 nt, Mycobacterium avium subsp. paratuberculosis
gccccaguuggcgucgucggc

SEQ ID NO: 2950786 - RNA, 22 nt, Mycobacterium avium subsp. paratuberculosis
gccccaguuggcgucgucggcg

SEQ ID NO: 2950787 - RNA, 16 nt, Mycobacterium avium subsp. paratuberculosis
gccccauugccgcgcc

SEQ ID NO: 2950788 - RNA, 19 nt, Mycobacterium avium subsp. paratuberculosis
gccccauugccgcgccggg

SEQ ID NO: 2950789 - RNA, 19 nt, Mycobacterium avium subsp. paratuberculosis
gcccccaaugucacggcgg

SEQ ID NO: 2950790 - RNA, 23 nt, Mycobacterium avium subsp. paratuberculosis
gcccccaccacgaagcuggcgaa

SEQ ID NO: 2950791 - RNA, 21 nt, Mycobacterium avium subsp. paratuberculosis
gcccccaccgcgccgugaacu

SEQ ID NO: 2950792 - RNA, 16 nt, Mycobacterium avium subsp. paratuberculosis
gcccccaccugaucgc

SEQ ID NO: 2950793 - RNA, 20 nt, Mycobacterium avium subsp. paratuberculosis
gcccccaccugaucgcggcg

SEQ ID NO: 2950794 - RNA, 23 nt, Mycobacterium avium subsp. paratuberculosis
gcccccaccugaucgcggcgagc

SEQ ID NO: 2950795 - RNA, 20 nt, Mycobacterium avium subsp. paratuberculosis
gcccccacgcagcggugcag

SEQ ID NO: 2950796 - RNA, 21 nt, Mycobacterium avium subsp. paratuberculosis
gcccccacgcagcggugcagc

SEQ ID NO: 2950797 - RNA, 22 nt, Mycobacterium avium subsp. paratuberculosis
gcccccacgcagcggugcagcc

SEQ ID NO: 2950798 - RNA, 16 nt, Mycobacterium avium subsp. paratuberculosis
gcccccacgcucggcg

SEQ ID NO: 2950799 - RNA, 17 nt, Mycobacterium avium subsp. paratuberculosis
gcccccacgcucggcgc

SEQ ID NO: 2950800 - RNA, 14 nt, Mycobacterium avium subsp. paratuberculosis
gcccccagcggggc

SEQ ID NO: 2950801 - RNA, 15 nt, Mycobacterium avium subsp. paratuberculosis
gcccccagcggggca

SEQ ID NO: 2950802 - RNA, 12 nt, Mycobacterium avium subsp. paratuberculosis
gcccccagcucu

SEQ ID NO: 2950803 - RNA, 14 nt, Mycobacterium avium subsp. paratuberculosis
gccccccgggcacc

SEQ ID NO: 2950804 - RNA, 17 nt, Mycobacterium avium subsp. paratuberculosis
gccccccgggcaccagc

SEQ ID NO: 2950805 - RNA, 18 nt, Mycobacterium avium subsp. paratuberculosis
gccccccgggcaccagcg

SEQ ID NO: 2950806 - RNA, 13 nt, Mycobacterium avium subsp. paratuberculosis
gccccccugcucg

SEQ ID NO: 2950807 - RNA, 18 nt, Mycobacterium avium subsp. paratuberculosis
gccccccuugagccgguc

SEQ ID NO: 2950808 - RNA, 20 nt, Mycobacterium avium subsp. paratuberculosis
gccccccuugagccgguccg

SEQ ID NO: 2950809 - RNA, 19 nt, Mycobacterium avium subsp. paratuberculosis
gcccccgaaaugcaucagc

SEQ ID NO: 2950810 - RNA, 23 nt, Mycobacterium avium subsp. paratuberculosis
gcccccgaaaugcaucagcguga

SEQ ID NO: 2950811 - RNA, 13 nt, Mycobacterium avium subsp. paratuberculosis
gcccccgacaggc

SEQ ID NO: 2950812 - RNA, 18 nt, Mycobacterium avium subsp. paratuberculosis
gcccccgaggagacgucg

SEQ ID NO: 2950813 - RNA, 20 nt, Mycobacterium avium subsp. paratuberculosis
gcccccgaggagacgucggc

SEQ ID NO: 2950814 - RNA, 13 nt, Mycobacterium avium subsp. paratuberculosis
gcccccgaugaac

SEQ ID NO: 2950815 - RNA, 12 nt, Mycobacterium avium subsp. paratuberculosis
gcccccgcagcc

SEQ ID NO: 2950816 - RNA, 13 nt, Mycobacterium avium subsp. paratuberculosis
gcccccgcagccc

SEQ ID NO: 2950817 - RNA, 15 nt, Mycobacterium avium subsp. paratuberculosis
gcccccgcagcccgu

SEQ ID NO: 2950818 - RNA, 21 nt, Mycobacterium avium subsp. paratuberculosis
gcccccgcccacagcgguauc

SEQ ID NO: 2950819 - RNA, 19 nt, Mycobacterium avium subsp. paratuberculosis
gcccccgccccagcccggc

SEQ ID NO: 2950820 - RNA, 12 nt, Mycobacterium avium subsp. paratuberculosis
gcccccgcccgg

SEQ ID NO: 2950821 - RNA, 14 nt, Mycobacterium avium subsp. paratuberculosis
gcccccgcccggcc

SEQ ID NO: 2950822 - RNA, 15 nt, Mycobacterium avium subsp. paratuberculosis
gcccccgcccggccg

SEQ ID NO: 2950823 - RNA, 14 nt, Mycobacterium avium subsp. paratuberculosis
gcccccgccgcgag

SEQ ID NO: 2950824 - RNA, 16 nt, Mycobacterium avium subsp. paratuberculosis
gcccccgccgcgagca

SEQ ID NO: 2950825 - RNA, 17 nt, Mycobacterium avium subsp. paratuberculosis
gcccccgccucgccggu

SEQ ID NO: 2950826 - RNA, 12 nt, Mycobacterium avium subsp. paratuberculosis
gcccccgcggcg

SEQ ID NO: 2950827 - RNA, 14 nt, Mycobacterium avium subsp. paratuberculosis
gcccccgcggcggc

SEQ ID NO: 2950828 - RNA, 14 nt, Mycobacterium avium subsp. paratuberculosis
gcccccggaccacg

SEQ ID NO: 2950829 - RNA, 16 nt, Mycobacterium avium subsp. paratuberculosis
gcccccggaccacguc

SEQ ID NO: 2950830 - RNA, 13 nt, Mycobacterium avium subsp. paratuberculosis
gcccccggcucga

SEQ ID NO: 2950831 - RNA, 18 nt, Mycobacterium avium subsp. paratuberculosis
gcccccgggcccgaagcg

SEQ ID NO: 2950832 - RNA, 13 nt, Mycobacterium avium subsp. paratuberculosis
gcccccggugacg

SEQ ID NO: 2950833 - RNA, 21 nt, Mycobacterium avium subsp. paratuberculosis
gcccccguuggacauuccggu

SEQ ID NO: 2950834 - RNA, 13 nt, Mycobacterium avium subsp. paratuberculosis
gcccccucggccg

SEQ ID NO: 2950835 - RNA, 15 nt, Mycobacterium avium subsp. paratuberculosis
gcccccucggccggu

SEQ ID NO: 2950836 - RNA, 18 nt, Mycobacterium avium subsp. paratuberculosis
gcccccucggccgguccg

SEQ ID NO: 2950837 - RNA, 15 nt, Mycobacterium avium subsp. paratuberculosis
gcccccugggacagc

SEQ ID NO: 2950838 - RNA, 18 nt, Mycobacterium avium subsp. paratuberculosis
gcccccugggacagcgag

SEQ ID NO: 2950839 - RNA, 19 nt, Mycobacterium avium subsp. paratuberculosis
gcccccugggacagcgaga

SEQ ID NO: 2950840 - RNA, 16 nt, Mycobacterium avium subsp. paratuberculosis
gccccgaacagcgcca

SEQ ID NO: 2950841 - RNA, 17 nt, Mycobacterium avium subsp. paratuberculosis
gccccgaacagcgccag

SEQ ID NO: 2950842 - RNA, 13 nt, Mycobacterium avium subsp. paratuberculosis
gccccgacagcaa

SEQ ID NO: 2950843 - RNA, 17 nt, Mycobacterium avium subsp. paratuberculosis
gccccgacagcaacgcc

SEQ ID NO: 2950844 - RNA, 14 nt, Mycobacterium avium subsp. paratuberculosis
gccccgacaggagg

SEQ ID NO: 2950845 - RNA, 15 nt, Mycobacterium avium subsp. paratuberculosis
gccccgacaucgcca

SEQ ID NO: 2950846 - RNA, 20 nt, Mycobacterium avium subsp. paratuberculosis
gccccgacaucgccaucagc

SEQ ID NO: 2950847 - RNA, 22 nt, Mycobacterium avium subsp. paratuberculosis
gccccgacaucgccaucagcag

SEQ ID NO: 2950848 - RNA, 16 nt, Mycobacterium avium subsp. paratuberculosis
gccccgacgaucgcgc

SEQ ID NO: 2950849 - RNA, 16 nt, Mycobacterium avium subsp. paratuberculosis
gccccggccgagcgca

SEQ ID NO: 2950850 - RNA, 13 nt, Mycobacterium avium subsp. paratuberculosis
gccccggccgcgc

SEQ ID NO: 2950851 - RNA, 15 nt, Mycobacterium avium subsp. paratuberculosis
gccccggccgcgcac

SEQ ID NO: 2950852 - RNA, 18 nt, Mycobacterium avium subsp. paratuberculosis
gccccggccgcgcaccgc

SEQ ID NO: 2950853 - RNA, 15 nt, Mycobacterium avium subsp. paratuberculosis
gccccggccgcggug

SEQ ID NO: 2950854 - RNA, 17 nt, Mycobacterium avium subsp. paratuberculosis
gccccggccgcggugac

SEQ ID NO: 2950855 - RNA, 18 nt, Mycobacterium avium subsp. paratuberculosis
gccccggccgcggugacc

SEQ ID NO: 2950856 - RNA, 19 nt, Mycobacterium avium subsp. paratuberculosis
gccccggccgcggugaccg

SEQ ID NO: 2950857 - RNA, 14 nt, Mycobacterium avium subsp. paratuberculosis
gccccggccggcgg

SEQ ID NO: 2950858 - RNA, 15 nt, Mycobacterium avium subsp. paratuberculosis
gccccggccggcggg

SEQ ID NO: 2950859 - RNA, 14 nt, Mycobacterium avium subsp. paratuberculosis
gccccggccgggcg

SEQ ID NO: 2950860 - RNA, 16 nt, Mycobacterium avium subsp. paratuberculosis
gccccggccgggcgac

SEQ ID NO: 2950861 - RNA, 18 nt, Mycobacterium avium subsp. paratuberculosis
gccccggccgggcgacug

SEQ ID NO: 2950862 - RNA, 20 nt, Mycobacterium avium subsp. paratuberculosis
gccccggcgaacgccucggu

SEQ ID NO: 2950863 - RNA, 16 nt, Mycobacterium avium subsp. paratuberculosis
gccccggcgacggcgg

SEQ ID NO: 2950864 - RNA, 18 nt, Mycobacterium avium subsp. paratuberculosis
gccccggcgacggcggcc

SEQ ID NO: 2950865 - RNA, 14 nt, Mycobacterium avium subsp. paratuberculosis
gccccggcgacguc

SEQ ID NO: 2950866 - RNA, 20 nt, Mycobacterium avium subsp. paratuberculosis
gccccggcgacgucgccggc

SEQ ID NO: 2950867 - RNA, 21 nt, Mycobacterium avium subsp. paratuberculosis
gccccggcgacgucgccggcc

SEQ ID NO: 2950868 - RNA, 23 nt, Mycobacterium avium subsp. paratuberculosis
gccccggcgacgucgccggccug

SEQ ID NO: 2950869 - RNA, 15 nt, Mycobacterium avium subsp. paratuberculosis
gccccggcgcagcgc

SEQ ID NO: 2950870 - RNA, 18 nt, Mycobacterium avium subsp. paratuberculosis
gccccggcgcagcgccgc

SEQ ID NO: 2950871 - RNA, 19 nt, Mycobacterium avium subsp. paratuberculosis
gccccggcgcagcgccgcg

SEQ ID NO: 2950872 - RNA, 17 nt, Mycobacterium avium subsp. paratuberculosis
gccccggcgcgccugcg

SEQ ID NO: 2950873 - RNA, 18 nt, Mycobacterium avium subsp. paratuberculosis
gccccggcgcgccugcgc

SEQ ID NO: 2950874 - RNA, 16 nt, Mycobacterium avium subsp. paratuberculosis
gccccggcggccacgc

SEQ ID NO: 2950875 - RNA, 20 nt, Mycobacterium avium subsp. paratuberculosis
gccccggcggccacgcaggc

SEQ ID NO: 2950876 - RNA, 22 nt, Mycobacterium avium subsp. paratuberculosis
gccccggcggccacgcaggcgu

SEQ ID NO: 2950877 - RNA, 11 nt, Mycobacterium avium subsp. paratuberculosis
gccccggcggg

SEQ ID NO: 2950878 - RNA, 18 nt, Mycobacterium avium subsp. paratuberculosis
gccccggcgggcggccga

SEQ ID NO: 2950879 - RNA, 13 nt, Mycobacterium avium subsp. paratuberculosis
gccccggcggguc

SEQ ID NO: 2950880 - RNA, 14 nt, Mycobacterium avium subsp. paratuberculosis
gccccggcgucgga

SEQ ID NO: 2950881 - RNA, 15 nt, Mycobacterium avium subsp. paratuberculosis
gccccggcgucggag

SEQ ID NO: 2950882 - RNA, 18 nt, Mycobacterium avium subsp. paratuberculosis
gccccggcguuucgugcu

SEQ ID NO: 2950883 - RNA, 15 nt, Mycobacterium avium subsp. paratuberculosis
gccccggcucgggcc

SEQ ID NO: 2950884 - RNA, 16 nt, Mycobacterium avium subsp. paratuberculosis
gccccggcucgggcca

SEQ ID NO: 2950885 - RNA, 16 nt, Mycobacterium avium subsp. paratuberculosis
gccccgggaaccagcc

SEQ ID NO: 2950886 - RNA, 18 nt, Mycobacterium avium subsp. paratuberculosis
gccccgggaaccagccca

SEQ ID NO: 2950887 - RNA, 21 nt, Mycobacterium avium subsp. paratuberculosis
gccccgggaaccagcccaggu

SEQ ID NO: 2950888 - RNA, 18 nt, Mycobacterium avium subsp. paratuberculosis
gccccgggauccgaggcg

SEQ ID NO: 2950889 - RNA, 21 nt, Mycobacterium avium subsp. paratuberculosis
gccccgggauccgaggcguca

SEQ ID NO: 2950890 - RNA, 12 nt, Mycobacterium avium subsp. paratuberculosis
gccccgggccgc

SEQ ID NO: 2950891 - RNA, 13 nt, Mycobacterium avium subsp. paratuberculosis
gccccgggccgca

SEQ ID NO: 2950892 - RNA, 17 nt, Mycobacterium avium subsp. paratuberculosis
gccccgggccgcagggu

SEQ ID NO: 2950893 - RNA, 18 nt, Mycobacterium avium subsp. paratuberculosis
gccccgggcgcuggcgau

SEQ ID NO: 2950894 - RNA, 22 nt, Mycobacterium avium subsp. paratuberculosis
gccccgggcgcuggcgauggug

SEQ ID NO: 2950895 - RNA, 13 nt, Mycobacterium avium subsp. paratuberculosis
gccccgggggacc

SEQ ID NO: 2950896 - RNA, 14 nt, Mycobacterium avium subsp. paratuberculosis
gccccgggggacca

SEQ ID NO: 2950897 - RNA, 17 nt, Mycobacterium avium subsp. paratuberculosis
gccccgggggaccagcg

SEQ ID NO: 2950898 - RNA, 21 nt, Mycobacterium avium subsp. paratuberculosis
gccccgggggaccagcgcaac

SEQ ID NO: 2950899 - RNA, 21 nt, Mycobacterium avium subsp. paratuberculosis
gccccggggguuucgugugcu

SEQ ID NO: 2950900 - RNA, 15 nt, Mycobacterium avium subsp. paratuberculosis
gccccgguagccagc

SEQ ID NO: 2950901 - RNA, 17 nt, Mycobacterium avium subsp. paratuberculosis
gccccgguagccagcac

SEQ ID NO: 2950902 - RNA, 19 nt, Mycobacterium avium subsp. paratuberculosis
gccccgguagccagcaccg

SEQ ID NO: 2950903 - RNA, 21 nt, Mycobacterium avium subsp. paratuberculosis
gccccgguagccagcaccgcc

SEQ ID NO: 2950904 - RNA, 16 nt, Mycobacterium avium subsp. paratuberculosis
gccccggucaccccgg

SEQ ID NO: 2950905 - RNA, 17 nt, Mycobacterium avium subsp. paratuberculosis
gccccggucaccccggc

SEQ ID NO: 2950906 - RNA, 18 nt, Mycobacterium avium subsp. paratuberculosis
gccccggucccgccggug

SEQ ID NO: 2950907 - RNA, 15 nt, Mycobacterium avium subsp. paratuberculosis
gccccggucccgggg

SEQ ID NO: 2950908 - RNA, 18 nt, Mycobacterium avium subsp. paratuberculosis
gccccguccggcgccagc

SEQ ID NO: 2950909 - RNA, 22 nt, Mycobacterium avium subsp. paratuberculosis
gccccgucggucccgacgcggc

SEQ ID NO: 2950910 - RNA, 16 nt, Mycobacterium avium subsp. paratuberculosis
gccccgucggucgggc

SEQ ID NO: 2950911 - RNA, 22 nt, Mycobacterium avium subsp. paratuberculosis
gccccguguggugucgaagucg

SEQ ID NO: 2950912 - RNA, 17 nt, Mycobacterium avium subsp. paratuberculosis
gccccguucgguggcca

SEQ ID NO: 2950913 - RNA, 23 nt, Mycobacterium avium subsp. paratuberculosis
gccccguucgguggccaccgcga

SEQ ID NO: 2950914 - RNA, 15 nt, Mycobacterium avium subsp. paratuberculosis
gccccuaccgccgag

SEQ ID NO: 2950915 - RNA, 22 nt, Mycobacterium avium subsp. paratuberculosis
gccccucauugggaccggugcg

SEQ ID NO: 2950916 - RNA, 23 nt, Mycobacterium avium subsp. paratuberculosis
gccccucauugggaccggugcgg

SEQ ID NO: 2950917 - RNA, 16 nt, Mycobacterium avium subsp. paratuberculosis
gccccuccagccgccg

SEQ ID NO: 2950918 - RNA, 18 nt, Mycobacterium avium subsp. paratuberculosis
gccccuccagccgccggu

SEQ ID NO: 2950919 - RNA, 23 nt, Mycobacterium avium subsp. paratuberculosis
gccccuccagccgccgguccagu

SEQ ID NO: 2950920 - RNA, 16 nt, Mycobacterium avium subsp. paratuberculosis
gccccuccaggcaugg

SEQ ID NO: 2950921 - RNA, 18 nt, Mycobacterium avium subsp. paratuberculosis
gccccucccaccacggcc

SEQ ID NO: 2950922 - RNA, 14 nt, Mycobacterium avium subsp. paratuberculosis
gccccuccucgguc

SEQ ID NO: 2950923 - RNA, 22 nt, Mycobacterium avium subsp. paratuberculosis
gccccucgacccgaagccaggu

SEQ ID NO: 2950924 - RNA, 16 nt, Mycobacterium avium subsp. paratuberculosis
gccccucgacgaacgc

SEQ ID NO: 2950925 - RNA, 23 nt, Mycobacterium avium subsp. paratuberculosis
gccccucgacguccaggccggcg

SEQ ID NO: 2950926 - RNA, 14 nt, Mycobacterium avium subsp. paratuberculosis
gccccucgccgggc

SEQ ID NO: 2950927 - RNA, 20 nt, Mycobacterium avium subsp. paratuberculosis
gccccucggggcugcgcggc

SEQ ID NO: 2950928 - RNA, 22 nt, Mycobacterium avium subsp. paratuberculosis
gccccucguccaggugcacccg

SEQ ID NO: 2950929 - RNA, 15 nt, Mycobacterium avium subsp. paratuberculosis
gccccugcaccacga

SEQ ID NO: 2950930 - RNA, 17 nt, Mycobacterium avium subsp. paratuberculosis
gccccugcaccacgaag

SEQ ID NO: 2950931 - RNA, 22 nt, Mycobacterium avium subsp. paratuberculosis
gccccugcggggugucgaccca

SEQ ID NO: 2950932 - RNA, 21 nt, Mycobacterium avium subsp. paratuberculosis
gccccugcuggguuccgcgag

SEQ ID NO: 2950933 - RNA, 19 nt, Mycobacterium avium subsp. paratuberculosis
gcccgauagcuugagcccc

SEQ ID NO: 2950934 - RNA, 23 nt, Mycobacterium avium subsp. paratuberculosis
gcccgaucaccaggcccaggccg

SEQ ID NO: 2950935 - RNA, 19 nt, Mycobacterium avium subsp. paratuberculosis
gcccgaucaucucaccgac

SEQ ID NO: 2950936 - RNA, 22 nt, Mycobacterium avium subsp. paratuberculosis
gcccgaucaucucaccgacgac

SEQ ID NO: 2950937 - RNA, 23 nt, Mycobacterium avium subsp. paratuberculosis
gcccgaucaucucaccgacgacc

SEQ ID NO: 2950938 - RNA, 13 nt, Mycobacterium avium subsp. paratuberculosis
gcccgaucccggg

SEQ ID NO: 2950939 - RNA, 15 nt, Mycobacterium avium subsp. paratuberculosis
gcccgaucccgggcc

SEQ ID NO: 2950940 - RNA, 16 nt, Mycobacterium avium subsp. paratuberculosis
gcccgaucccgggccg

SEQ ID NO: 2950941 - RNA, 22 nt, Mycobacterium avium subsp. paratuberculosis
gcccgaucccgggccguucagc

SEQ ID NO: 2950942 - RNA, 17 nt, Mycobacterium avium subsp. paratuberculosis
gcccgaucccgucgucg

SEQ ID NO: 2950943 - RNA, 20 nt, Mycobacterium avium subsp. paratuberculosis
gcccgaucccgucgucggcg

SEQ ID NO: 2950944 - RNA, 23 nt, Mycobacterium avium subsp. paratuberculosis
gcccgaucccgucgucggcgccg

SEQ ID NO: 2950945 - RNA, 18 nt, Mycobacterium avium subsp. paratuberculosis
gcccgaucgccagcgccc

SEQ ID NO: 2950946 - RNA, 14 nt, Mycobacterium avium subsp. paratuberculosis
gcccgaucgcggcg

SEQ ID NO: 2950947 - RNA, 15 nt, Mycobacterium avium subsp. paratuberculosis
gcccgaucgcgucga

SEQ ID NO: 2950948 - RNA, 17 nt, Mycobacterium avium subsp. paratuberculosis
gcccgaucgcgucgacg

SEQ ID NO: 2950949 - RNA, 21 nt, Mycobacterium avium subsp. paratuberculosis
gcccgaucgcgucgacgaugg

SEQ ID NO: 2950950 - RNA, 13 nt, Mycobacterium avium subsp. paratuberculosis
gcccgaucggcac

SEQ ID NO: 2950951 - RNA, 16 nt, Mycobacterium avium subsp. paratuberculosis
gcccgaucggcacccg

SEQ ID NO: 2950952 - RNA, 17 nt, Mycobacterium avium subsp. paratuberculosis
gcccgaucggcacccgc

SEQ ID NO: 2950953 - RNA, 13 nt, Mycobacterium avium subsp. paratuberculosis
gcccgaucggcgu

SEQ ID NO: 2950954 - RNA, 14 nt, Mycobacterium avium subsp. paratuberculosis
gcccgaucggcgug

SEQ ID NO: 2950955 - RNA, 21 nt, Mycobacterium avium subsp. paratuberculosis
gcccgaucgugcgcccauccg

SEQ ID NO: 2950956 - RNA, 15 nt, Mycobacterium avium subsp. paratuberculosis
gcccgaucucgcgcg

SEQ ID NO: 2950957 - RNA, 19 nt, Mycobacterium avium subsp. paratuberculosis
gcccgaucucgcgcggguc

SEQ ID NO: 2950958 - RNA, 18 nt, Mycobacterium avium subsp. paratuberculosis
gcccgaucucgcggucga

SEQ ID NO: 2950959 - RNA, 15 nt, Mycobacterium avium subsp. paratuberculosis
gcccgaucucgucgg

SEQ ID NO: 2950960 - RNA, 17 nt, Mycobacterium avium subsp. paratuberculosis
gcccgaucucgucggug

SEQ ID NO: 2950961 - RNA, 22 nt, Mycobacterium avium subsp. paratuberculosis
gcccgaucugggaucggugcgc

SEQ ID NO: 2950962 - RNA, 17 nt, Mycobacterium avium subsp. paratuberculosis
gcccgaugccgccgagg

SEQ ID NO: 2950963 - RNA, 15 nt, Mycobacterium avium subsp. paratuberculosis
gcccgaugcggaccg

SEQ ID NO: 2950964 - RNA, 19 nt, Mycobacterium avium subsp. paratuberculosis
gcccgaugcuggccaucgc

SEQ ID NO: 2950965 - RNA, 20 nt, Mycobacterium avium subsp. paratuberculosis
gcccgaugcuggccaucgcc

SEQ ID NO: 2950966 - RNA, 21 nt, Mycobacterium avium subsp. paratuberculosis
gcccgauggaggugccgcgca

SEQ ID NO: 2950967 - RNA, 23 nt, Mycobacterium avium subsp. paratuberculosis
gcccgauggaggugccgcgcagc

SEQ ID NO: 2950968 - RNA, 17 nt, Mycobacterium avium subsp. paratuberculosis
gcccgauggcggccugc

SEQ ID NO: 2950969 - RNA, 16 nt, Mycobacterium avium subsp. paratuberculosis
gcccgauucagccggc

SEQ ID NO: 2950970 - RNA, 19 nt, Mycobacterium avium subsp. paratuberculosis
gcccgauucagccggcggu

SEQ ID NO: 2950971 - RNA, 21 nt, Mycobacterium avium subsp. paratuberculosis
gcccgauucagccggcgguuc

SEQ ID NO: 2950972 - RNA, 16 nt, Mycobacterium avium subsp. paratuberculosis
gcccgauucgcggcca

SEQ ID NO: 2950973 - RNA, 23 nt, Mycobacterium avium subsp. paratuberculosis
gcccgauucgcggccaccaccgg

SEQ ID NO: 2950974 - RNA, 23 nt, Mycobacterium avium subsp. paratuberculosis
gcccgauuggaagagggccaucc

SEQ ID NO: 2950975 - RNA, 17 nt, Mycobacterium avium subsp. paratuberculosis
gcccgcaaaucagccga

SEQ ID NO: 2950976 - RNA, 19 nt, Mycobacterium avium subsp. paratuberculosis
gcccgcaaaucagccgagc

SEQ ID NO: 2950977 - RNA, 21 nt, Mycobacterium avium subsp. paratuberculosis
gcccgcaaaucagccgagccg

SEQ ID NO: 2950978 - RNA, 15 nt, Mycobacterium avium subsp. paratuberculosis
gcccgcaacuccaca

SEQ ID NO: 2950979 - RNA, 22 nt, Mycobacterium avium subsp. paratuberculosis
gcccgcaacuguucgcggcugg

SEQ ID NO: 2950980 - RNA, 23 nt, Mycobacterium avium subsp. paratuberculosis
gcccgcaacuguucgcggcuggc

SEQ ID NO: 2950981 - RNA, 12 nt, Mycobacterium avium subsp. paratuberculosis
gcccgcaccacc

SEQ ID NO: 2950982 - RNA, 16 nt, Mycobacterium avium subsp. paratuberculosis
gcccgcaccacccagc

SEQ ID NO: 2950983 - RNA, 19 nt, Mycobacterium avium subsp. paratuberculosis
gcccgcaccacccagcccu

SEQ ID NO: 2950984 - RNA, 21 nt, Mycobacterium avium subsp. paratuberculosis
gcccgcaccacccagcccuug

SEQ ID NO: 2950985 - RNA, 13 nt, Mycobacterium avium subsp. paratuberculosis
gcccgcaccacga

SEQ ID NO: 2950986 - RNA, 13 nt, Mycobacterium avium subsp. paratuberculosis
gcccgcaccagca

SEQ ID NO: 2950987 - RNA, 14 nt, Mycobacterium avium subsp. paratuberculosis
gcccgcaccagcag

SEQ ID NO: 2950988 - RNA, 15 nt, Mycobacterium avium subsp. paratuberculosis
gcccgcaccagcagg

SEQ ID NO: 2950989 - RNA, 17 nt, Mycobacterium avium subsp. paratuberculosis
gcccgcaccagcagguc

SEQ ID NO: 2950990 - RNA, 22 nt, Mycobacterium avium subsp. paratuberculosis
gcccgcacccuugacuaccgcg

SEQ ID NO: 2950991 - RNA, 17 nt, Mycobacterium avium subsp. paratuberculosis
gcccgcaccugcgcgcc

SEQ ID NO: 2950992 - RNA, 17 nt, Mycobacterium avium subsp. paratuberculosis
gcccgcacggccgccag

SEQ ID NO: 2950993 - RNA, 21 nt, Mycobacterium avium subsp. paratuberculosis
gcccgcacguagacggugucg

SEQ ID NO: 2950994 - RNA, 17 nt, Mycobacterium avium subsp. paratuberculosis
gcccgcacuggucgugc

SEQ ID NO: 2950995 - RNA, 18 nt, Mycobacterium avium subsp. paratuberculosis
gcccgcacuggucgugcu

SEQ ID NO: 2950996 - RNA, 21 nt, Mycobacterium avium subsp. paratuberculosis
gcccgcacuggucgugcugga

SEQ ID NO: 2950997 - RNA, 13 nt, Mycobacterium avium subsp. paratuberculosis
gcccgcagcacgc

SEQ ID NO: 2950998 - RNA, 13 nt, Mycobacterium avium subsp. paratuberculosis
gcccgcagcauca

SEQ ID NO: 2950999 - RNA, 14 nt, Mycobacterium avium subsp. paratuberculosis
gcccgcagccagcg

SEQ ID NO: 2951000 - RNA, 17 nt, Mycobacterium avium subsp. paratuberculosis
gcccgcagccagcgcag

SEQ ID NO: 2951001 - RNA, 18 nt, Mycobacterium avium subsp. paratuberculosis
gcccgcagccagcgcagc

SEQ ID NO: 2951002 - RNA, 13 nt, Mycobacterium avium subsp. paratuberculosis
gcccgcagccgcu

SEQ ID NO: 2951003 - RNA, 17 nt, Mycobacterium avium subsp. paratuberculosis
gcccgcagccgcuggcc

SEQ ID NO: 2951004 - RNA, 18 nt, Mycobacterium avium subsp. paratuberculosis
gcccgcagccgcuggccg

SEQ ID NO: 2951005 - RNA, 17 nt, Mycobacterium avium subsp. paratuberculosis
gcccgcagcgcaucggu

SEQ ID NO: 2951006 - RNA, 22 nt, Mycobacterium avium subsp. paratuberculosis
gcccgcagcgcaucggugagac

SEQ ID NO: 2951007 - RNA, 13 nt, Mycobacterium avium subsp. paratuberculosis
gcccgcagcgccu

SEQ ID NO: 2951008 - RNA, 19 nt, Mycobacterium avium subsp. paratuberculosis
gcccgcagcgccucggcgu

SEQ ID NO: 2951009 - RNA, 15 nt, Mycobacterium avium subsp. paratuberculosis
gcccgcagcggcggu

SEQ ID NO: 2951010 - RNA, 13 nt, Mycobacterium avium subsp. paratuberculosis
gcccgcagcucgg

SEQ ID NO: 2951011 - RNA, 20 nt, Mycobacterium avium subsp. paratuberculosis
gcccgcaggaucgagccggc

SEQ ID NO: 2951012 - RNA, 22 nt, Mycobacterium avium subsp. paratuberculosis
gcccgcaggaucgagccggccg

SEQ ID NO: 2951013 - RNA, 23 nt, Mycobacterium avium subsp. paratuberculosis
gcccgcaggaucgagccggccgu

SEQ ID NO: 2951014 - RNA, 13 nt, Mycobacterium avium subsp. paratuberculosis
gcccgcaggccgc

SEQ ID NO: 2951015 - RNA, 15 nt, Mycobacterium avium subsp. paratuberculosis
gcccgcaggccgcga

SEQ ID NO: 2951016 - RNA, 20 nt, Mycobacterium avium subsp. paratuberculosis
gcccgcaguucggccgccgu

SEQ ID NO: 2951017 - RNA, 13 nt, Mycobacterium avium subsp. paratuberculosis
gcccgccgccggc

SEQ ID NO: 2951018 - RNA, 14 nt, Mycobacterium avium subsp. paratuberculosis
gcccgccgccggcg

SEQ ID NO: 2951019 - RNA, 16 nt, Mycobacterium avium subsp. paratuberculosis
gcccgccgccggcgcu

SEQ ID NO: 2951020 - RNA, 15 nt, Mycobacterium avium subsp. paratuberculosis
gcccgccgccggcgg

SEQ ID NO: 2951021 - RNA, 11 nt, Mycobacterium avium subsp. paratuberculosis
gcccgccgccu

SEQ ID NO: 2951022 - RNA, 16 nt, Mycobacterium avium subsp. paratuberculosis
gcccgccgccucaccg

SEQ ID NO: 2951023 - RNA, 12 nt, Mycobacterium avium subsp. paratuberculosis
gcccgccgcgac

SEQ ID NO: 2951024 - RNA, 13 nt, Mycobacterium avium subsp. paratuberculosis
gcccgccgcgacc

SEQ ID NO: 2951025 - RNA, 15 nt, Mycobacterium avium subsp. paratuberculosis
gcccgccgcgaccgc

SEQ ID NO: 2951026 - RNA, 16 nt, Mycobacterium avium subsp. paratuberculosis
gcccgccgcgaccgcg

SEQ ID NO: 2951027 - RNA, 15 nt, Mycobacterium avium subsp. paratuberculosis
gcccgccgcgacggg

SEQ ID NO: 2951028 - RNA, 17 nt, Mycobacterium avium subsp. paratuberculosis
gcccgccgcgagccgcc

SEQ ID NO: 2951029 - RNA, 18 nt, Mycobacterium avium subsp. paratuberculosis
gcccgccgcgagccgccc

SEQ ID NO: 2951030 - RNA, 14 nt, Mycobacterium avium subsp. paratuberculosis
gcccgccgcgcccg

SEQ ID NO: 2951031 - RNA, 15 nt, Mycobacterium avium subsp. paratuberculosis
gcccgccgcgcccgg

SEQ ID NO: 2951032 - RNA, 16 nt, Mycobacterium avium subsp. paratuberculosis
gcccgccgcgcccggc

SEQ ID NO: 2951033 - RNA, 20 nt, Mycobacterium avium subsp. paratuberculosis
gcccgccgcggccgcuggcg

SEQ ID NO: 2951034 - RNA, 15 nt, Mycobacterium avium subsp. paratuberculosis
gcccgccgcggcgac

SEQ ID NO: 2951035 - RNA, 20 nt, Mycobacterium avium subsp. paratuberculosis
gcccgccgcggcgagccggc

SEQ ID NO: 2951036 - RNA, 16 nt, Mycobacterium avium subsp. paratuberculosis
gcccgccgcggugcug

SEQ ID NO: 2951037 - RNA, 19 nt, Mycobacterium avium subsp. paratuberculosis
gcccgccgcguacaccggc

SEQ ID NO: 2951038 - RNA, 17 nt, Mycobacterium avium subsp. paratuberculosis
gcccgccgcucaccgcc

SEQ ID NO: 2951039 - RNA, 18 nt, Mycobacterium avium subsp. paratuberculosis
gcccgccgcucaccgccg

SEQ ID NO: 2951040 - RNA, 21 nt, Mycobacterium avium subsp. paratuberculosis
gcccgccgcucaccgccgagc

SEQ ID NO: 2951041 - RNA, 22 nt, Mycobacterium avium subsp. paratuberculosis
gcccgccgcucaccgccgagcc

SEQ ID NO: 2951042 - RNA, 12 nt, Mycobacterium avium subsp. paratuberculosis
gcccgccgcugc

SEQ ID NO: 2951043 - RNA, 13 nt, Mycobacterium avium subsp. paratuberculosis
gcccgccgcugca

SEQ ID NO: 2951044 - RNA, 19 nt, Mycobacterium avium subsp. paratuberculosis
gcccgccggaacucggccg

SEQ ID NO: 2951045 - RNA, 21 nt, Mycobacterium avium subsp. paratuberculosis
gcccgccggaacucggccggc

SEQ ID NO: 2951046 - RNA, 14 nt, Mycobacterium avium subsp. paratuberculosis
gcccgccggagccg

SEQ ID NO: 2951047 - RNA, 19 nt, Mycobacterium avium subsp. paratuberculosis
gcccgccggcccagcucca

SEQ ID NO: 2951048 - RNA, 11 nt, Mycobacterium avium subsp. paratuberculosis
gcccgccggcg

SEQ ID NO: 2951049 - RNA, 12 nt, Mycobacterium avium subsp. paratuberculosis
gcccgccggcgg

SEQ ID NO: 2951050 - RNA, 13 nt, Mycobacterium avium subsp. paratuberculosis
gcccgccggcggc

SEQ ID NO: 2951051 - RNA, 15 nt, Mycobacterium avium subsp. paratuberculosis
gcccgccggcggcga

SEQ ID NO: 2951052 - RNA, 20 nt, Mycobacterium avium subsp. paratuberculosis
gcccgccggcggcgaugauc

SEQ ID NO: 2951053 - RNA, 16 nt, Mycobacterium avium subsp. paratuberculosis
gcccgccggcgucugc

SEQ ID NO: 2951054 - RNA, 21 nt, Mycobacterium avium subsp. paratuberculosis
gcccgccggcgucugcauccg

SEQ ID NO: 2951055 - RNA, 14 nt, Mycobacterium avium subsp. paratuberculosis
gcccgccgggaugc

SEQ ID NO: 2951056 - RNA, 20 nt, Mycobacterium avium subsp. paratuberculosis
gcccgccgggaugcgccacc

SEQ ID NO: 2951057 - RNA, 14 nt, Mycobacterium avium subsp. paratuberculosis
gcccgccgggcacc

SEQ ID NO: 2951058 - RNA, 16 nt, Mycobacterium avium subsp. paratuberculosis
gcccgccgggcacccg

SEQ ID NO: 2951059 - RNA, 21 nt, Mycobacterium avium subsp. paratuberculosis
gcccgccgggcacccgggugg

SEQ ID NO: 2951060 - RNA, 13 nt, Mycobacterium avium subsp. paratuberculosis
gcccgccgggccg

SEQ ID NO: 2951061 - RNA, 15 nt, Mycobacterium avium subsp. paratuberculosis
gcccgccgggcgcca

SEQ ID NO: 2951062 - RNA, 17 nt, Mycobacterium avium subsp. paratuberculosis
gcccgccgggcgccacg

SEQ ID NO: 2951063 - RNA, 20 nt, Mycobacterium avium subsp. paratuberculosis
gcccgccgggcgccacgcug

SEQ ID NO: 2951064 - RNA, 19 nt, Mycobacterium avium subsp. paratuberculosis
gcccgccgggcgucgcgcu

SEQ ID NO: 2951065 - RNA, 13 nt, Mycobacterium avium subsp. paratuberculosis
gcccgccgggcug

SEQ ID NO: 2951066 - RNA, 19 nt, Mycobacterium avium subsp. paratuberculosis
gcccgccgggcugaccguc

SEQ ID NO: 2951067 - RNA, 18 nt, Mycobacterium avium subsp. paratuberculosis
gcccgccgguggccgcga

SEQ ID NO: 2951068 - RNA, 21 nt, Mycobacterium avium subsp. paratuberculosis
gcccgccgguggccgcgaacg

SEQ ID NO: 2951069 - RNA, 18 nt, Mycobacterium avium subsp. paratuberculosis
gcccgccgguggccgcgc

SEQ ID NO: 2951070 - RNA, 15 nt, Mycobacterium avium subsp. paratuberculosis
gcccgccguagcgcc

SEQ ID NO: 2951071 - RNA, 17 nt, Mycobacterium avium subsp. paratuberculosis
gcccgccguagcgccgg

SEQ ID NO: 2951072 - RNA, 18 nt, Mycobacterium avium subsp. paratuberculosis
gcccgccguagcgccggc

SEQ ID NO: 2951073 - RNA, 22 nt, Mycobacterium avium subsp. paratuberculosis
gcccgccgucacgccguauucg

SEQ ID NO: 2951074 - RNA, 14 nt, Mycobacterium avium subsp. paratuberculosis
gcccgccgucgacc

SEQ ID NO: 2951075 - RNA, 16 nt, Mycobacterium avium subsp. paratuberculosis
gcccgccgucgaccac

SEQ ID NO: 2951076 - RNA, 17 nt, Mycobacterium avium subsp. paratuberculosis
gcccgccgucgaccacg

SEQ ID NO: 2951077 - RNA, 18 nt, Mycobacterium avium subsp. paratuberculosis
gcccgccgucgaccacga

SEQ ID NO: 2951078 - RNA, 23 nt, Mycobacterium avium subsp. paratuberculosis
gcccgccgucgaccacgaagggc

SEQ ID NO: 2951079 - RNA, 22 nt, Mycobacterium avium subsp. paratuberculosis
gcccgccgucggcauccacccg

SEQ ID NO: 2951080 - RNA, 12 nt, Mycobacterium avium subsp. paratuberculosis
gcccgccgugcg

SEQ ID NO: 2951081 - RNA, 18 nt, Mycobacterium avium subsp. paratuberculosis
gcccgccgugcgccccgc

SEQ ID NO: 2951082 - RNA, 23 nt, Mycobacterium avium subsp. paratuberculosis
gcccgccucagugucguggcgac

SEQ ID NO: 2951083 - RNA, 17 nt, Mycobacterium avium subsp. paratuberculosis
gcccgccucggcggccg

SEQ ID NO: 2951084 - RNA, 18 nt, Mycobacterium avium subsp. paratuberculosis
gcccgccucggcggccgc

SEQ ID NO: 2951085 - RNA, 23 nt, Mycobacterium avium subsp. paratuberculosis
gcccgccucggcggccgccuugg

SEQ ID NO: 2951086 - RNA, 18 nt, Mycobacterium avium subsp. paratuberculosis
gcccgccuuugagcgaca

SEQ ID NO: 2951087 - RNA, 18 nt, Mycobacterium avium subsp. paratuberculosis
gcccgcgaacgccucguu

SEQ ID NO: 2951088 - RNA, 12 nt, Mycobacterium avium subsp. paratuberculosis
gcccgcgacggc

SEQ ID NO: 2951089 - RNA, 14 nt, Mycobacterium avium subsp. paratuberculosis
gcccgcgacggcga

SEQ ID NO: 2951090 - RNA, 15 nt, Mycobacterium avium subsp. paratuberculosis
gcccgcgacggcgag

SEQ ID NO: 2951091 - RNA, 23 nt, Mycobacterium avium subsp. paratuberculosis
gcccgcgacggcgagccgggccg

SEQ ID NO: 2951092 - RNA, 22 nt, Mycobacterium avium subsp. paratuberculosis
gcccgcgacugucggcgccccg

SEQ ID NO: 2951093 - RNA, 23 nt, Mycobacterium avium subsp. paratuberculosis
gcccgcgacugucggcgccccgc

SEQ ID NO: 2951094 - RNA, 17 nt, Mycobacterium avium subsp. paratuberculosis
gcccgcgacugucggcu

SEQ ID NO: 2951095 - RNA, 21 nt, Mycobacterium avium subsp. paratuberculosis
gcccgcgacugucggcucgcc

SEQ ID NO: 2951096 - RNA, 16 nt, Mycobacterium avium subsp. paratuberculosis
gcccgcgaggugucga

SEQ ID NO: 2951097 - RNA, 19 nt, Mycobacterium avium subsp. paratuberculosis
gcccgcgaggugucgacgc

SEQ ID NO: 2951098 - RNA, 20 nt, Mycobacterium avium subsp. paratuberculosis
gcccgcgaggugucgacgcu

SEQ ID NO: 2951099 - RNA, 22 nt, Mycobacterium avium subsp. paratuberculosis
gcccgcgaucaacaccgguccg

SEQ ID NO: 2951100 - RNA, 17 nt, Mycobacterium avium subsp. paratuberculosis
gcccgcgaucgccagcg

SEQ ID NO: 2951101 - RNA, 22 nt, Mycobacterium avium subsp. paratuberculosis
gcccgcgaucgccagcgcggug

SEQ ID NO: 2951102 - RNA, 17 nt, Mycobacterium avium subsp. paratuberculosis
gcccgcguaaccggcgg

SEQ ID NO: 2951103 - RNA, 20 nt, Mycobacterium avium subsp. paratuberculosis
gcccgcguaaccggcggcgg

SEQ ID NO: 2951104 - RNA, 23 nt, Mycobacterium avium subsp. paratuberculosis
gcccgcguaaccggcggcgguga

SEQ ID NO: 2951105 - RNA, 14 nt, Mycobacterium avium subsp. paratuberculosis
gcccgcguacagcg

SEQ ID NO: 2951106 - RNA, 20 nt, Mycobacterium avium subsp. paratuberculosis
gcccgcguacagcgggucgu

SEQ ID NO: 2951107 - RNA, 13 nt, Mycobacterium avium subsp. paratuberculosis
gcccgcguccagc

SEQ ID NO: 2951108 - RNA, 16 nt, Mycobacterium avium subsp. paratuberculosis
gcccgcguccagcagc

SEQ ID NO: 2951109 - RNA, 19 nt, Mycobacterium avium subsp. paratuberculosis
gcccgcguccugcagcgcc

SEQ ID NO: 2951110 - RNA, 20 nt, Mycobacterium avium subsp. paratuberculosis
gcccgcguccugcagcgccg

SEQ ID NO: 2951111 - RNA, 22 nt, Mycobacterium avium subsp. paratuberculosis
gcccgcguccugcagcgccguc

SEQ ID NO: 2951112 - RNA, 13 nt, Mycobacterium avium subsp. paratuberculosis
gcccgcgucgcgc

SEQ ID NO: 2951113 - RNA, 14 nt, Mycobacterium avium subsp. paratuberculosis
gcccgcgucgcgca

SEQ ID NO: 2951114 - RNA, 15 nt, Mycobacterium avium subsp. paratuberculosis
gcccgcgucgcgcag

SEQ ID NO: 2951115 - RNA, 16 nt, Mycobacterium avium subsp. paratuberculosis
gcccgcgucgcgcagc

SEQ ID NO: 2951116 - RNA, 21 nt, Mycobacterium avium subsp. paratuberculosis
gcccgcgucgcgcagcaacgg

SEQ ID NO: 2951117 - RNA, 17 nt, Mycobacterium avium subsp. paratuberculosis
gcccgcgucguggcccu

SEQ ID NO: 2951118 - RNA, 22 nt, Mycobacterium avium subsp. paratuberculosis
gcccgcgucguggcccugcucg

SEQ ID NO: 2951119 - RNA, 19 nt, Mycobacterium avium subsp. paratuberculosis
gcccgcgucguguccgggc

SEQ ID NO: 2951120 - RNA, 23 nt, Mycobacterium avium subsp. paratuberculosis
gcccgcgucguguccgggcccga

SEQ ID NO: 2951121 - RNA, 22 nt, Mycobacterium avium subsp. paratuberculosis
gcccgcgugggcaccccgauca

SEQ ID NO: 2951122 - RNA, 14 nt, Mycobacterium avium subsp. paratuberculosis
gcccgcguugcggc

SEQ ID NO: 2951123 - RNA, 19 nt, Mycobacterium avium subsp. paratuberculosis
gcccgcguugcggcgcagc

SEQ ID NO: 2951124 - RNA, 20 nt, Mycobacterium avium subsp. paratuberculosis
gcccgcguugcggcgcagcg

SEQ ID NO: 2951125 - RNA, 13 nt, Mycobacterium avium subsp. paratuberculosis
gcccgcucaccug

SEQ ID NO: 2951126 - RNA, 15 nt, Mycobacterium avium subsp. paratuberculosis
gcccgcucaccugcg

SEQ ID NO: 2951127 - RNA, 16 nt, Mycobacterium avium subsp. paratuberculosis
gcccgcucaccugcgg

SEQ ID NO: 2951128 - RNA, 20 nt, Mycobacterium avium subsp. paratuberculosis
gcccgcucaccugcggcccg

SEQ ID NO: 2951129 - RNA, 19 nt, Mycobacterium avium subsp. paratuberculosis
gcccgcucagagcugcacc

SEQ ID NO: 2951130 - RNA, 21 nt, Mycobacterium avium subsp. paratuberculosis
gcccgcucagagcugcaccgg

SEQ ID NO: 2951131 - RNA, 15 nt, Mycobacterium avium subsp. paratuberculosis
gcccgcuccgcgggc

SEQ ID NO: 2951132 - RNA, 16 nt, Mycobacterium avium subsp. paratuberculosis
gcccgcuccgcgggca

SEQ ID NO: 2951133 - RNA, 14 nt, Mycobacterium avium subsp. paratuberculosis
gcccgcuccgcggu

SEQ ID NO: 2951134 - RNA, 15 nt, Mycobacterium avium subsp. paratuberculosis
gcccgcuccggcgga

SEQ ID NO: 2951135 - RNA, 16 nt, Mycobacterium avium subsp. paratuberculosis
gcccgcuccggcggac

SEQ ID NO: 2951136 - RNA, 14 nt, Mycobacterium avium subsp. paratuberculosis
gcccgcuccugcag

SEQ ID NO: 2951137 - RNA, 23 nt, Mycobacterium avium subsp. paratuberculosis
gcccgcuccugcaggccgagccg

SEQ ID NO: 2951138 - RNA, 16 nt, Mycobacterium avium subsp. paratuberculosis
gcccgcucgacggccg

SEQ ID NO: 2951139 - RNA, 16 nt, Mycobacterium avium subsp. paratuberculosis
gcccgcucgaugggug

SEQ ID NO: 2951140 - RNA, 15 nt, Mycobacterium avium subsp. paratuberculosis
gcccgcucgcuagca

SEQ ID NO: 2951141 - RNA, 14 nt, Mycobacterium avium subsp. paratuberculosis
gcccgcucggcggg

SEQ ID NO: 2951142 - RNA, 18 nt, Mycobacterium avium subsp. paratuberculosis
gcccgcucggcgggucgu

SEQ ID NO: 2951143 - RNA, 21 nt, Mycobacterium avium subsp. paratuberculosis
gcccgcucggcgggucguagc

SEQ ID NO: 2951144 - RNA, 12 nt, Mycobacterium avium subsp. paratuberculosis
gcccgcugacca

SEQ ID NO: 2951145 - RNA, 15 nt, Mycobacterium avium subsp. paratuberculosis
gcccgcugaccaggc

SEQ ID NO: 2951146 - RNA, 18 nt, Mycobacterium avium subsp. paratuberculosis
gcccgcugaccaggccga

SEQ ID NO: 2951147 - RNA, 14 nt, Mycobacterium avium subsp. paratuberculosis
gcccgcugaccgcc

SEQ ID NO: 2951148 - RNA, 15 nt, Mycobacterium avium subsp. paratuberculosis
gcccgcugaccgccg

SEQ ID NO: 2951149 - RNA, 16 nt, Mycobacterium avium subsp. paratuberculosis
gcccgcugaccgccgc

SEQ ID NO: 2951150 - RNA, 15 nt, Mycobacterium avium subsp. paratuberculosis
gcccgcugcagcgcc

SEQ ID NO: 2951151 - RNA, 18 nt, Mycobacterium avium subsp. paratuberculosis
gcccgcugcagcgccgag

SEQ ID NO: 2951152 - RNA, 19 nt, Mycobacterium avium subsp. paratuberculosis
gcccgcugcagcgccgagg

SEQ ID NO: 2951153 - RNA, 22 nt, Mycobacterium avium subsp. paratuberculosis
gcccgcugcagcgccgaggcca

SEQ ID NO: 2951154 - RNA, 12 nt, Mycobacterium avium subsp. paratuberculosis
gcccgcugcgcc

SEQ ID NO: 2951155 - RNA, 14 nt, Mycobacterium avium subsp. paratuberculosis
gcccgcugcgccga

SEQ ID NO: 2951156 - RNA, 16 nt, Mycobacterium avium subsp. paratuberculosis
gcccgcugcgcggccg

SEQ ID NO: 2951157 - RNA, 17 nt, Mycobacterium avium subsp. paratuberculosis
gcccgcugcgcggccga

SEQ ID NO: 2951158 - RNA, 13 nt, Mycobacterium avium subsp. paratuberculosis
gcccgcugcggcg

SEQ ID NO: 2951159 - RNA, 14 nt, Mycobacterium avium subsp. paratuberculosis
gcccgcuggccgcc

SEQ ID NO: 2951160 - RNA, 15 nt, Mycobacterium avium subsp. paratuberculosis
gcccgcuggccgccg

SEQ ID NO: 2951161 - RNA, 17 nt, Mycobacterium avium subsp. paratuberculosis
gcccgcuggccgccgcu

SEQ ID NO: 2951162 - RNA, 15 nt, Mycobacterium avium subsp. paratuberculosis
gcccgcuggggcgca

SEQ ID NO: 2951163 - RNA, 18 nt, Mycobacterium avium subsp. paratuberculosis
gcccgcuggggcgcaccg

SEQ ID NO: 2951164 - RNA, 19 nt, Mycobacterium avium subsp. paratuberculosis
gcccgcuggggcgcaccgc

SEQ ID NO: 2951165 - RNA, 20 nt, Mycobacterium avium subsp. paratuberculosis
gcccgcuggggcgcaccgcc

SEQ ID NO: 2951166 - RNA, 22 nt, Mycobacterium avium subsp. paratuberculosis
gcccgcuucaggcagcgcacga

SEQ ID NO: 2951167 - RNA, 14 nt, Mycobacterium avium subsp. paratuberculosis
gcccgcuugccgac

SEQ ID NO: 2951168 - RNA, 16 nt, Mycobacterium avium subsp. paratuberculosis
gcccgcuugccgacgu

SEQ ID NO: 2951169 - RNA, 19 nt, Mycobacterium avium subsp. paratuberculosis
gcccggaaaaccccacccc

SEQ ID NO: 2951170 - RNA, 21 nt, Mycobacterium avium subsp. paratuberculosis
gcccggaaaaccccaccccga

SEQ ID NO: 2951171 - RNA, 15 nt, Mycobacterium avium subsp. paratuberculosis
gcccggaaagcgcgg

SEQ ID NO: 2951172 - RNA, 20 nt, Mycobacterium avium subsp. paratuberculosis
gcccggaaagcgcgggcagc

SEQ ID NO: 2951173 - RNA, 16 nt, Mycobacterium avium subsp. paratuberculosis
gcccggaacggcgggc

SEQ ID NO: 2951174 - RNA, 20 nt, Mycobacterium avium subsp. paratuberculosis
gcccggaacggcgggcccgu

SEQ ID NO: 2951175 - RNA, 15 nt, Mycobacterium avium subsp. paratuberculosis
gcccggaaucgucgg

SEQ ID NO: 2951176 - RNA, 19 nt, Mycobacterium avium subsp. paratuberculosis
gcccggaaucgucggccac

SEQ ID NO: 2951177 - RNA, 21 nt, Mycobacterium avium subsp. paratuberculosis
gcccggaaucgucggccacgc

SEQ ID NO: 2951178 - RNA, 15 nt, Mycobacterium avium subsp. paratuberculosis
gcccggacaccccgu

SEQ ID NO: 2951179 - RNA, 16 nt, Mycobacterium avium subsp. paratuberculosis
gcccggaccagggugg

SEQ ID NO: 2951180 - RNA, 19 nt, Mycobacterium avium subsp. paratuberculosis
gcccggaccaggguggccc

SEQ ID NO: 2951181 - RNA, 22 nt, Mycobacterium avium subsp. paratuberculosis
gcccggaccaggguggccccag

SEQ ID NO: 2951182 - RNA, 12 nt, Mycobacterium avium subsp. paratuberculosis
gcccggacccgc

SEQ ID NO: 2951183 - RNA, 13 nt, Mycobacterium avium subsp. paratuberculosis
gcccggaccgccg

SEQ ID NO: 2951184 - RNA, 14 nt, Mycobacterium avium subsp. paratuberculosis
gcccggaccgccgc

SEQ ID NO: 2951185 - RNA, 16 nt, Mycobacterium avium subsp. paratuberculosis
gcccggaccgccgcgg

SEQ ID NO: 2951186 - RNA, 17 nt, Mycobacterium avium subsp. paratuberculosis
gcccggaccgccgcggc

SEQ ID NO: 2951187 - RNA, 15 nt, Mycobacterium avium subsp. paratuberculosis
gcccggcccgucagg

SEQ ID NO: 2951188 - RNA, 19 nt, Mycobacterium avium subsp. paratuberculosis
gcccggcccgucgagcggc

SEQ ID NO: 2951189 - RNA, 13 nt, Mycobacterium avium subsp. paratuberculosis
gcccggccgccag

SEQ ID NO: 2951190 - RNA, 14 nt, Mycobacterium avium subsp. paratuberculosis
gcccggccgccagc

SEQ ID NO: 2951191 - RNA, 13 nt, Mycobacterium avium subsp. paratuberculosis
gcccggccgccga

SEQ ID NO: 2951192 - RNA, 11 nt, Mycobacterium avium subsp. paratuberculosis
gcccggccgcg

SEQ ID NO: 2951193 - RNA, 12 nt, Mycobacterium avium subsp. paratuberculosis
gcccggccggcg

SEQ ID NO: 2951194 - RNA, 23 nt, Mycobacterium avium subsp. paratuberculosis
gcccggccggcgcgaccagcggc

SEQ ID NO: 2951195 - RNA, 16 nt, Mycobacterium avium subsp. paratuberculosis
gcccggccggucgccg

SEQ ID NO: 2951196 - RNA, 17 nt, Mycobacterium avium subsp. paratuberculosis
gcccggccggucgccga

SEQ ID NO: 2951197 - RNA, 20 nt, Mycobacterium avium subsp. paratuberculosis
gcccggccguaucggccaaa

SEQ ID NO: 2951198 - RNA, 18 nt, Mycobacterium avium subsp. paratuberculosis
gcccggcgaacaccacgg

SEQ ID NO: 2951199 - RNA, 18 nt, Mycobacterium avium subsp. paratuberculosis
gcccggcgaaucagcagc

SEQ ID NO: 2951200 - RNA, 18 nt, Mycobacterium avium subsp. paratuberculosis
gcccggcgaccaccagcc

SEQ ID NO: 2951201 - RNA, 20 nt, Mycobacterium avium subsp. paratuberculosis
gcccggcgaccaccagccgc

SEQ ID NO: 2951202 - RNA, 23 nt, Mycobacterium avium subsp. paratuberculosis
gcccggcgaccaccagccgcagg

SEQ ID NO: 2951203 - RNA, 16 nt, Mycobacterium avium subsp. paratuberculosis
gcccggcgacgaagca

SEQ ID NO: 2951204 - RNA, 20 nt, Mycobacterium avium subsp. paratuberculosis
gcccggcgacgaagcagcuc

SEQ ID NO: 2951205 - RNA, 14 nt, Mycobacterium avium subsp. paratuberculosis
gcccggcgacgcgg

SEQ ID NO: 2951206 - RNA, 16 nt, Mycobacterium avium subsp. paratuberculosis
gcccggcgacgcggcg

SEQ ID NO: 2951207 - RNA, 14 nt, Mycobacterium avium subsp. paratuberculosis
gcccggcgacggcg

SEQ ID NO: 2951208 - RNA, 13 nt, Mycobacterium avium subsp. paratuberculosis
gcccggcgacguc

SEQ ID NO: 2951209 - RNA, 17 nt, Mycobacterium avium subsp. paratuberculosis
gcccggcgacgucgucg

SEQ ID NO: 2951210 - RNA, 23 nt, Mycobacterium avium subsp. paratuberculosis
gcccggcgacgucgucgaugccg

SEQ ID NO: 2951211 - RNA, 19 nt, Mycobacterium avium subsp. paratuberculosis
gcccggcgagcacaggaac

SEQ ID NO: 2951212 - RNA, 15 nt, Mycobacterium avium subsp. paratuberculosis
gcccggcgagcagcc

SEQ ID NO: 2951213 - RNA, 17 nt, Mycobacterium avium subsp. paratuberculosis
gcccggcgagcagcccg

SEQ ID NO: 2951214 - RNA, 18 nt, Mycobacterium avium subsp. paratuberculosis
gcccggcgagcgacgcca

SEQ ID NO: 2951215 - RNA, 20 nt, Mycobacterium avium subsp. paratuberculosis
gcccggcgagcgacgccacg

SEQ ID NO: 2951216 - RNA, 23 nt, Mycobacterium avium subsp. paratuberculosis
gcccggcgauacccgggagcauc

SEQ ID NO: 2951217 - RNA, 15 nt, Mycobacterium avium subsp. paratuberculosis
gcccggcgaugauca

SEQ ID NO: 2951218 - RNA, 12 nt, Mycobacterium avium subsp. paratuberculosis
gcccggcgaugc

SEQ ID NO: 2951219 - RNA, 13 nt, Mycobacterium avium subsp. paratuberculosis
gcccggcgauggc

SEQ ID NO: 2951220 - RNA, 12 nt, Mycobacterium avium subsp. paratuberculosis
gcccggcgaugu

SEQ ID NO: 2951221 - RNA, 13 nt, Mycobacterium avium subsp. paratuberculosis
gcccggcgauguc

SEQ ID NO: 2951222 - RNA, 12 nt, Mycobacterium avium subsp. paratuberculosis
gcccggcgccac

SEQ ID NO: 2951223 - RNA, 16 nt, Mycobacterium avium subsp. paratuberculosis
gcccggcgccccgcca

SEQ ID NO: 2951224 - RNA, 14 nt, Mycobacterium avium subsp. paratuberculosis
gcccggcgcccggc

SEQ ID NO: 2951225 - RNA, 19 nt, Mycobacterium avium subsp. paratuberculosis
gcccggcgcccggccggcc

SEQ ID NO: 2951226 - RNA, 18 nt, Mycobacterium avium subsp. paratuberculosis
gcccggcgcccggcgcgc

SEQ ID NO: 2951227 - RNA, 12 nt, Mycobacterium avium subsp. paratuberculosis
gcccggcgcccu

SEQ ID NO: 2951228 - RNA, 15 nt, Mycobacterium avium subsp. paratuberculosis
gcccggcgcccugca

SEQ ID NO: 2951229 - RNA, 17 nt, Mycobacterium avium subsp. paratuberculosis
gcccggcgcccugcacc

SEQ ID NO: 2951230 - RNA, 15 nt, Mycobacterium avium subsp. paratuberculosis
gcccggcgccggacg

SEQ ID NO: 2951231 - RNA, 18 nt, Mycobacterium avium subsp. paratuberculosis
gcccggcgccggacggcc

SEQ ID NO: 2951232 - RNA, 14 nt, Mycobacterium avium subsp. paratuberculosis
gcccggcgccggcc

SEQ ID NO: 2951233 - RNA, 16 nt, Mycobacterium avium subsp. paratuberculosis
gcccggcgccggcccg

SEQ ID NO: 2951234 - RNA, 17 nt, Mycobacterium avium subsp. paratuberculosis
gcccggcgccggcccgc

SEQ ID NO: 2951235 - RNA, 15 nt, Mycobacterium avium subsp. paratuberculosis
gcccggcgccggccg

SEQ ID NO: 2951236 - RNA, 17 nt, Mycobacterium avium subsp. paratuberculosis
gcccggcgccggccgac

SEQ ID NO: 2951237 - RNA, 21 nt, Mycobacterium avium subsp. paratuberculosis
gcccggcgccggccgacaugg

SEQ ID NO: 2951238 - RNA, 16 nt, Mycobacterium avium subsp. paratuberculosis
gcccggcgccggcggc

SEQ ID NO: 2951239 - RNA, 19 nt, Mycobacterium avium subsp. paratuberculosis
gcccggcgccggcggccac

SEQ ID NO: 2951240 - RNA, 13 nt, Mycobacterium avium subsp. paratuberculosis
gcccggcgcgcag

SEQ ID NO: 2951241 - RNA, 20 nt, Mycobacterium avium subsp. paratuberculosis
gcccggcgcgcagcccagcc

SEQ ID NO: 2951242 - RNA, 24 nt, Mycobacterium avium subsp. paratuberculosis
gcccggcgcgcagcccagccagcg

SEQ ID NO: 2951243 - RNA, 19 nt, Mycobacterium avium subsp. paratuberculosis
gcccggcgcgccacgacgu

SEQ ID NO: 2951244 - RNA, 15 nt, Mycobacterium avium subsp. paratuberculosis
gcccggcgcgccgca

SEQ ID NO: 2951245 - RNA, 17 nt, Mycobacterium avium subsp. paratuberculosis
gcccggcgcggacagcg

SEQ ID NO: 2951246 - RNA, 19 nt, Mycobacterium avium subsp. paratuberculosis
gcccggcgcggacagcgcg

SEQ ID NO: 2951247 - RNA, 12 nt, Mycobacterium avium subsp. paratuberculosis
gcccggcgcggc

SEQ ID NO: 2951248 - RNA, 19 nt, Mycobacterium avium subsp. paratuberculosis
gcccggcgcggccggugcg

SEQ ID NO: 2951249 - RNA, 22 nt, Mycobacterium avium subsp. paratuberculosis
gcccggcgcggccggugcgcgu

SEQ ID NO: 2951250 - RNA, 13 nt, Mycobacterium avium subsp. paratuberculosis
gcccggcgcggcg

SEQ ID NO: 2951251 - RNA, 17 nt, Mycobacterium avium subsp. paratuberculosis
gcccggcgcggcggcgc

SEQ ID NO: 2951252 - RNA, 19 nt, Mycobacterium avium subsp. paratuberculosis
gcccggcgcggcggcgccg

SEQ ID NO: 2951253 - RNA, 20 nt, Mycobacterium avium subsp. paratuberculosis
gcccggcgcggcggcgccgc

SEQ ID NO: 2951254 - RNA, 20 nt, Mycobacterium avium subsp. paratuberculosis
gcccggcgcuaaagccgacc

SEQ ID NO: 2951255 - RNA, 21 nt, Mycobacterium avium subsp. paratuberculosis
gcccggcgcuaaagccgaccg

SEQ ID NO: 2951256 - RNA, 18 nt, Mycobacterium avium subsp. paratuberculosis
gcccggcgcucaccgcga

SEQ ID NO: 2951257 - RNA, 15 nt, Mycobacterium avium subsp. paratuberculosis
gcccggcgcugcgcc

SEQ ID NO: 2951258 - RNA, 16 nt, Mycobacterium avium subsp. paratuberculosis
gcccggcgcugcgccc

SEQ ID NO: 2951259 - RNA, 14 nt, Mycobacterium avium subsp. paratuberculosis
gcccggcggcaccg

SEQ ID NO: 2951260 - RNA, 12 nt, Mycobacterium avium subsp. paratuberculosis
gcccggcggcca

SEQ ID NO: 2951261 - RNA, 14 nt, Mycobacterium avium subsp. paratuberculosis
gcccggcggccacc

SEQ ID NO: 2951262 - RNA, 14 nt, Mycobacterium avium subsp. paratuberculosis
gcccggcggccggc

SEQ ID NO: 2951263 - RNA, 17 nt, Mycobacterium avium subsp. paratuberculosis
gcccggcggccggccgc

SEQ ID NO: 2951264 - RNA, 15 nt, Mycobacterium avium subsp. paratuberculosis
gcccggcggcgcugc

SEQ ID NO: 2951265 - RNA, 17 nt, Mycobacterium avium subsp. paratuberculosis
gcccggcgggcaucauc

SEQ ID NO: 2951266 - RNA, 18 nt, Mycobacterium avium subsp. paratuberculosis
gcccggcgggucagcacc

SEQ ID NO: 2951267 - RNA, 19 nt, Mycobacterium avium subsp. paratuberculosis
gcccggcgggucagcaccg

SEQ ID NO: 2951268 - RNA, 21 nt, Mycobacterium avium subsp. paratuberculosis
gcccggcgggucagcaccgcg

SEQ ID NO: 2951269 - RNA, 22 nt, Mycobacterium avium subsp. paratuberculosis
gcccggcgggucagcaccgcgg

SEQ ID NO: 2951270 - RNA, 14 nt, Mycobacterium avium subsp. paratuberculosis
gcccggcggugccg

SEQ ID NO: 2951271 - RNA, 15 nt, Mycobacterium avium subsp. paratuberculosis
gcccggcggugccga

SEQ ID NO: 2951272 - RNA, 13 nt, Mycobacterium avium subsp. paratuberculosis
gcccggggugugc

SEQ ID NO: 2951273 - RNA, 15 nt, Mycobacterium avium subsp. paratuberculosis
gcccggguagcgcag

SEQ ID NO: 2951274 - RNA, 17 nt, Mycobacterium avium subsp. paratuberculosis
gcccgggucgucggugc

SEQ ID NO: 2951275 - RNA, 21 nt, Mycobacterium avium subsp. paratuberculosis
gcccgggucgucggugccgaa

SEQ ID NO: 2951276 - RNA, 19 nt, Mycobacterium avium subsp. paratuberculosis
gcccgggucgugcggcggc

SEQ ID NO: 2951277 - RNA, 22 nt, Mycobacterium avium subsp. paratuberculosis
gcccgggucuagaucuccaggc

SEQ ID NO: 2951278 - RNA, 21 nt, Mycobacterium avium subsp. paratuberculosis
gcccgggugauggucucccgg

SEQ ID NO: 2951279 - RNA, 20 nt, Mycobacterium avium subsp. paratuberculosis
gcccgggugcaggcccagcu

SEQ ID NO: 2951280 - RNA, 21 nt, Mycobacterium avium subsp. paratuberculosis
gcccgggugcaggcccagcug

SEQ ID NO: 2951281 - RNA, 21 nt, Mycobacterium avium subsp. paratuberculosis
gcccgggugcgaacagccacg

SEQ ID NO: 2951282 - RNA, 18 nt, Mycobacterium avium subsp. paratuberculosis
gcccggguggacgcccgc

SEQ ID NO: 2951283 - RNA, 21 nt, Mycobacterium avium subsp. paratuberculosis
gcccggguggacgcccgcgag

SEQ ID NO: 2951284 - RNA, 12 nt, Mycobacterium avium subsp. paratuberculosis
gcccggguggcg

SEQ ID NO: 2951285 - RNA, 17 nt, Mycobacterium avium subsp. paratuberculosis
gcccggguggcguccag

SEQ ID NO: 2951286 - RNA, 18 nt, Mycobacterium avium subsp. paratuberculosis
gcccgggugugggcgccg

SEQ ID NO: 2951287 - RNA, 22 nt, Mycobacterium avium subsp. paratuberculosis
gcccggguugcacaggucgaug

SEQ ID NO: 2951288 - RNA, 16 nt, Mycobacterium avium subsp. paratuberculosis
gcccggguugucgacg

SEQ ID NO: 2951289 - RNA, 17 nt, Mycobacterium avium subsp. paratuberculosis
gcccggguugucgacgu

SEQ ID NO: 2951290 - RNA, 19 nt, Mycobacterium avium subsp. paratuberculosis
gcccggguugucgacgugg

SEQ ID NO: 2951291 - RNA, 15 nt, Mycobacterium avium subsp. paratuberculosis
gcccgguacagcgcc

SEQ ID NO: 2951292 - RNA, 16 nt, Mycobacterium avium subsp. paratuberculosis
gcccgguacagcgccg

SEQ ID NO: 2951293 - RNA, 17 nt, Mycobacterium avium subsp. paratuberculosis
gcccgguacagcgccgc

SEQ ID NO: 2951294 - RNA, 18 nt, Mycobacterium avium subsp. paratuberculosis
gcccgguacagcgccgcg

SEQ ID NO: 2951295 - RNA, 22 nt, Mycobacterium avium subsp. paratuberculosis
gcccgguacaucgacgcgaccg

SEQ ID NO: 2951296 - RNA, 23 nt, Mycobacterium avium subsp. paratuberculosis
gcccgguagauauggcccuccac

SEQ ID NO: 2951297 - RNA, 16 nt, Mycobacterium avium subsp. paratuberculosis
gcccgguaggccgccg

SEQ ID NO: 2951298 - RNA, 18 nt, Mycobacterium avium subsp. paratuberculosis
gcccgguaggccgccgcg

SEQ ID NO: 2951299 - RNA, 19 nt, Mycobacterium avium subsp. paratuberculosis
gcccgguaggccgccgcga

SEQ ID NO: 2951300 - RNA, 19 nt, Mycobacterium avium subsp. paratuberculosis
gcccggucaggaacccggc

SEQ ID NO: 2951301 - RNA, 23 nt, Mycobacterium avium subsp. paratuberculosis
gcccggucaggaacccggcccgg

SEQ ID NO: 2951302 - RNA, 23 nt, Mycobacterium avium subsp. paratuberculosis
gcccggucaguucgucggucacg

SEQ ID NO: 2951303 - RNA, 16 nt, Mycobacterium avium subsp. paratuberculosis
gcccggucccgcguca

SEQ ID NO: 2951304 - RNA, 20 nt, Mycobacterium avium subsp. paratuberculosis
gcccggucccgcgucacauc

SEQ ID NO: 2951305 - RNA, 13 nt, Mycobacterium avium subsp. paratuberculosis
gcccgguccgcug

SEQ ID NO: 2951306 - RNA, 22 nt, Mycobacterium avium subsp. paratuberculosis
gcccgguccgcugugcggcccg

SEQ ID NO: 2951307 - RNA, 17 nt, Mycobacterium avium subsp. paratuberculosis
gcccgguccgggucgcu

SEQ ID NO: 2951308 - RNA, 15 nt, Mycobacterium avium subsp. paratuberculosis
gcccggucgacuugg

SEQ ID NO: 2951309 - RNA, 16 nt, Mycobacterium avium subsp. paratuberculosis
gcccggucgaggucgg

SEQ ID NO: 2951310 - RNA, 18 nt, Mycobacterium avium subsp. paratuberculosis
gcccggucgaggucggcc

SEQ ID NO: 2951311 - RNA, 20 nt, Mycobacterium avium subsp. paratuberculosis
gcccggucgaggucggccag

SEQ ID NO: 2951312 - RNA, 20 nt, Mycobacterium avium subsp. paratuberculosis
gcccggucgaugaucuggcg

SEQ ID NO: 2951313 - RNA, 21 nt, Mycobacterium avium subsp. paratuberculosis
gcccggucgaugaucuggcgg

SEQ ID NO: 2951314 - RNA, 22 nt, Mycobacterium avium subsp. paratuberculosis
gcccggucgaugaucuggcggu

SEQ ID NO: 2951315 - RNA, 19 nt, Mycobacterium avium subsp. paratuberculosis
gcccggucggaguccagca

SEQ ID NO: 2951316 - RNA, 13 nt, Mycobacterium avium subsp. paratuberculosis
gcccggucguaca

SEQ ID NO: 2951317 - RNA, 13 nt, Mycobacterium avium subsp. paratuberculosis
gcccggucgucga

SEQ ID NO: 2951318 - RNA, 16 nt, Mycobacterium avium subsp. paratuberculosis
gcccggucgucgagca

SEQ ID NO: 2951319 - RNA, 13 nt, Mycobacterium avium subsp. paratuberculosis
gcccggucgucgc

SEQ ID NO: 2951320 - RNA, 15 nt, Mycobacterium avium subsp. paratuberculosis
gcccggucugcggcc

SEQ ID NO: 2951321 - RNA, 17 nt, Mycobacterium avium subsp. paratuberculosis
gcccggucugcggccgc

SEQ ID NO: 2951322 - RNA, 18 nt, Mycobacterium avium subsp. paratuberculosis
gcccggucugcggccgcg

SEQ ID NO: 2951323 - RNA, 19 nt, Mycobacterium avium subsp. paratuberculosis
gcccggucugcggccgcga

SEQ ID NO: 2951324 - RNA, 22 nt, Mycobacterium avium subsp. paratuberculosis
gcccggugacgaacaucgacga

SEQ ID NO: 2951325 - RNA, 21 nt, Mycobacterium avium subsp. paratuberculosis
gcccggugagccucagggcgc

SEQ ID NO: 2951326 - RNA, 22 nt, Mycobacterium avium subsp. paratuberculosis
gcccggugagccucagggcgcg

SEQ ID NO: 2951327 - RNA, 17 nt, Mycobacterium avium subsp. paratuberculosis
gcccggugaucgccgcc

SEQ ID NO: 2951328 - RNA, 18 nt, Mycobacterium avium subsp. paratuberculosis
gcccggugaucgccgccc

SEQ ID NO: 2951329 - RNA, 19 nt, Mycobacterium avium subsp. paratuberculosis
gcccggugccacgaugaug

SEQ ID NO: 2951330 - RNA, 17 nt, Mycobacterium avium subsp. paratuberculosis
gcccggugcgacgccgc

SEQ ID NO: 2951331 - RNA, 19 nt, Mycobacterium avium subsp. paratuberculosis
gcccggugcgacgccgcgc

SEQ ID NO: 2951332 - RNA, 21 nt, Mycobacterium avium subsp. paratuberculosis
gcccggugcgacgccgcgcag

SEQ ID NO: 2951333 - RNA, 16 nt, Mycobacterium avium subsp. paratuberculosis
gcccggugcgccagcg

SEQ ID NO: 2951334 - RNA, 18 nt, Mycobacterium avium subsp. paratuberculosis
gcccggugcgccagcgug

SEQ ID NO: 2951335 - RNA, 15 nt, Mycobacterium avium subsp. paratuberculosis
gcccgguuccagcgg

SEQ ID NO: 2951336 - RNA, 23 nt, Mycobacterium avium subsp. paratuberculosis
gcccgguuccagcggcaccgcca

SEQ ID NO: 2951337 - RNA, 16 nt, Mycobacterium avium subsp. paratuberculosis
gcccgguuccgcgaca

SEQ ID NO: 2951338 - RNA, 20 nt, Mycobacterium avium subsp. paratuberculosis
gcccgguuccgcgacaucgg

SEQ ID NO: 2951339 - RNA, 23 nt, Mycobacterium avium subsp. paratuberculosis
gcccgguuccgcgacaucgguga

SEQ ID NO: 2951340 - RNA, 21 nt, Mycobacterium avium subsp. paratuberculosis
gcccgguuuccaguccggcgc

SEQ ID NO: 2951341 - RNA, 22 nt, Mycobacterium avium subsp. paratuberculosis
gcccgguuuccaguccggcgcc

SEQ ID NO: 2951342 - RNA, 17 nt, Mycobacterium avium subsp. paratuberculosis
gcccguagacccacagc

SEQ ID NO: 2951343 - RNA, 19 nt, Mycobacterium avium subsp. paratuberculosis
gcccguagacccacagcug

SEQ ID NO: 2951344 - RNA, 19 nt, Mycobacterium avium subsp. paratuberculosis
gcccguagaugcggcccag

SEQ ID NO: 2951345 - RNA, 21 nt, Mycobacterium avium subsp. paratuberculosis
gcccguagaugcggcccagcc

SEQ ID NO: 2951346 - RNA, 17 nt, Mycobacterium avium subsp. paratuberculosis
gcccguagccgcgguuc

SEQ ID NO: 2951347 - RNA, 17 nt, Mycobacterium avium subsp. paratuberculosis
gcccguagcggugggcg

SEQ ID NO: 2951348 - RNA, 20 nt, Mycobacterium avium subsp. paratuberculosis
gcccguagcggugggcgcgu

SEQ ID NO: 2951349 - RNA, 15 nt, Mycobacterium avium subsp. paratuberculosis
gcccguagcucgcgc

SEQ ID NO: 2951350 - RNA, 21 nt, Mycobacterium avium subsp. paratuberculosis
gcccguagcucgcgccgaccc

SEQ ID NO: 2951351 - RNA, 22 nt, Mycobacterium avium subsp. paratuberculosis
gcccguagcucgcgccgacccg

SEQ ID NO: 2951352 - RNA, 15 nt, Mycobacterium avium subsp. paratuberculosis
gcccguagucggcgg

SEQ ID NO: 2951353 - RNA, 16 nt, Mycobacterium avium subsp. paratuberculosis
gcccguagucggcggc

SEQ ID NO: 2951354 - RNA, 17 nt, Mycobacterium avium subsp. paratuberculosis
gcccguagucggcggcg

SEQ ID NO: 2951355 - RNA, 12 nt, Mycobacterium avium subsp. paratuberculosis
gcccgucacgcu

SEQ ID NO: 2951356 - RNA, 16 nt, Mycobacterium avium subsp. paratuberculosis
gcccuagcgguggcgu

SEQ ID NO: 2951357 - RNA, 15 nt, Mycobacterium avium subsp. paratuberculosis
gcccuagucgacgcc

SEQ ID NO: 2951358 - RNA, 17 nt, Mycobacterium avium subsp. paratuberculosis
gcccuagucgacgccga

SEQ ID NO: 2951359 - RNA, 18 nt, Mycobacterium avium subsp. paratuberculosis
gcccuauggcaucgccaa

SEQ ID NO: 2951360 - RNA, 21 nt, Mycobacterium avium subsp. paratuberculosis
gcccucaggcguccagcaccu

SEQ ID NO: 2951361 - RNA, 13 nt, Mycobacterium avium subsp. paratuberculosis
gcccucagugcgg

SEQ ID NO: 2951362 - RNA, 14 nt, Mycobacterium avium subsp. paratuberculosis
gcccucaucgucga

SEQ ID NO: 2951363 - RNA, 16 nt, Mycobacterium avium subsp. paratuberculosis
gcccucaucgucgacc

SEQ ID NO: 2951364 - RNA, 16 nt, Mycobacterium avium subsp. paratuberculosis
gcccuccagcaccguc

SEQ ID NO: 2951365 - RNA, 12 nt, Mycobacterium avium subsp. paratuberculosis
gcccuccagcug

SEQ ID NO: 2951366 - RNA, 15 nt, Mycobacterium avium subsp. paratuberculosis
gcccuccagcugguu

SEQ ID NO: 2951367 - RNA, 20 nt, Mycobacterium avium subsp. paratuberculosis
gcccuccagcugguugagug

SEQ ID NO: 2951368 - RNA, 14 nt, Mycobacterium avium subsp. paratuberculosis
gcccucccccgagu

SEQ ID NO: 2951369 - RNA, 17 nt, Mycobacterium avium subsp. paratuberculosis
gcccuccccggccagca

SEQ ID NO: 2951370 - RNA, 12 nt, Mycobacterium avium subsp. paratuberculosis
gcccuccucgcc

SEQ ID NO: 2951371 - RNA, 23 nt, Mycobacterium avium subsp. paratuberculosis
gcccuccuggcggguggcgauga

SEQ ID NO: 2951372 - RNA, 15 nt, Mycobacterium avium subsp. paratuberculosis
gcccuccuucccggu

SEQ ID NO: 2951373 - RNA, 22 nt, Mycobacterium avium subsp. paratuberculosis
gcccucgaaguagagccgcugc

SEQ ID NO: 2951374 - RNA, 23 nt, Mycobacterium avium subsp. paratuberculosis
gcccucgaaguagagccgcugca

SEQ ID NO: 2951375 - RNA, 15 nt, Mycobacterium avium subsp. paratuberculosis
gcccucgacaccggu

SEQ ID NO: 2951376 - RNA, 19 nt, Mycobacterium avium subsp. paratuberculosis
gcccucgacaccgguggcg

SEQ ID NO: 2951377 - RNA, 20 nt, Mycobacterium avium subsp. paratuberculosis
gcccucgacaccgguggcgu

SEQ ID NO: 2951378 - RNA, 19 nt, Mycobacterium avium subsp. paratuberculosis
gcccucgacguaguccggc

SEQ ID NO: 2951379 - RNA, 22 nt, Mycobacterium avium subsp. paratuberculosis
gcccucgacguaguccggccag

SEQ ID NO: 2951380 - RNA, 20 nt, Mycobacterium avium subsp. paratuberculosis
gcccucgauaauggcggccg

SEQ ID NO: 2951381 - RNA, 23 nt, Mycobacterium avium subsp. paratuberculosis
gcccucgauaauggcggccgccg

SEQ ID NO: 2951382 - RNA, 23 nt, Mycobacterium avium subsp. paratuberculosis
gcccucgaucgaggagauguuga

SEQ ID NO: 2951383 - RNA, 15 nt, Mycobacterium avium subsp. paratuberculosis
gcccucgaucgcgac

SEQ ID NO: 2951384 - RNA, 23 nt, Mycobacterium avium subsp. paratuberculosis
gcccucgccccggaugaccaggg

SEQ ID NO: 2951385 - RNA, 20 nt, Mycobacterium avium subsp. paratuberculosis
gcccucgccgaaccggggcc

SEQ ID NO: 2951386 - RNA, 13 nt, Mycobacterium avium subsp. paratuberculosis
gcccucgccggcg

SEQ ID NO: 2951387 - RNA, 15 nt, Mycobacterium avium subsp. paratuberculosis
gcccucgccggcggc

SEQ ID NO: 2951388 - RNA, 16 nt, Mycobacterium avium subsp. paratuberculosis
gcccucgcgcagggcc

SEQ ID NO: 2951389 - RNA, 20 nt, Mycobacterium avium subsp. paratuberculosis
gcccucgcgcagggccagcg

SEQ ID NO: 2951390 - RNA, 20 nt, Mycobacterium avium subsp. paratuberculosis
gcccucgcucaacccgucgc

SEQ ID NO: 2951391 - RNA, 16 nt, Mycobacterium avium subsp. paratuberculosis
gcccucgcugaucuuc

SEQ ID NO: 2951392 - RNA, 23 nt, Mycobacterium avium subsp. paratuberculosis
gcccucgcugaucuucuggauca

SEQ ID NO: 2951393 - RNA, 20 nt, Mycobacterium avium subsp. paratuberculosis
gcccucgcugccgcccccgc

SEQ ID NO: 2951394 - RNA, 19 nt, Mycobacterium avium subsp. paratuberculosis
gcccucggaggugccgcgc

SEQ ID NO: 2951395 - RNA, 20 nt, Mycobacterium avium subsp. paratuberculosis
gcccucggaggugccgcgcg

SEQ ID NO: 2951396 - RNA, 21 nt, Mycobacterium avium subsp. paratuberculosis
gcccucggaggugccgcgcgg

SEQ ID NO: 2951397 - RNA, 22 nt, Mycobacterium avium subsp. paratuberculosis
gcccucggaggugccgcgcggc

SEQ ID NO: 2951398 - RNA, 23 nt, Mycobacterium avium subsp. paratuberculosis
gcccucggaggugccgcgcggca

SEQ ID NO: 2951399 - RNA, 12 nt, Mycobacterium avium subsp. paratuberculosis
gcccucggccag

SEQ ID NO: 2951400 - RNA, 14 nt, Mycobacterium avium subsp. paratuberculosis
gcccucggccagcc

SEQ ID NO: 2951401 - RNA, 16 nt, Mycobacterium avium subsp. paratuberculosis
gcccucggccagccag

SEQ ID NO: 2951402 - RNA, 17 nt, Mycobacterium avium subsp. paratuberculosis
gcccucggccagccagg

SEQ ID NO: 2951403 - RNA, 18 nt, Mycobacterium avium subsp. paratuberculosis
gcccucggccagccaggc

SEQ ID NO: 2951404 - RNA, 21 nt, Mycobacterium avium subsp. paratuberculosis
gcccucggccagccaggccgu

SEQ ID NO: 2951405 - RNA, 21 nt, Mycobacterium avium subsp. paratuberculosis
gcccucggccguaccggcgua

SEQ ID NO: 2951406 - RNA, 21 nt, Mycobacterium avium subsp. paratuberculosis
gcccucgggguacucggcggc

SEQ ID NO: 2951407 - RNA, 15 nt, Mycobacterium avium subsp. paratuberculosis
gcccucggucgccga

SEQ ID NO: 2951408 - RNA, 18 nt, Mycobacterium avium subsp. paratuberculosis
gcccucggugacgaacuc

SEQ ID NO: 2951409 - RNA, 20 nt, Mycobacterium avium subsp. paratuberculosis
gcccucgguguucgggucgg

SEQ ID NO: 2951410 - RNA, 21 nt, Mycobacterium avium subsp. paratuberculosis
gcccucguagcggccgcacgc

SEQ ID NO: 2951411 - RNA, 17 nt, Mycobacterium avium subsp. paratuberculosis
gcccucguccgacagcg

SEQ ID NO: 2951412 - RNA, 20 nt, Mycobacterium avium subsp. paratuberculosis
gcccucguccgacagcgccu

SEQ ID NO: 2951413 - RNA, 13 nt, Mycobacterium avium subsp. paratuberculosis
gcccucgucgacc

SEQ ID NO: 2951414 - RNA, 18 nt, Mycobacterium avium subsp. paratuberculosis
gcccucgucgaccagggc

SEQ ID NO: 2951415 - RNA, 16 nt, Mycobacterium avium subsp. paratuberculosis
gcccucgucgaugacg

SEQ ID NO: 2951416 - RNA, 20 nt, Mycobacterium avium subsp. paratuberculosis
gcccucgucgaugacgucca

SEQ ID NO: 2951417 - RNA, 14 nt, Mycobacterium avium subsp. paratuberculosis
gcccucgucggcga

SEQ ID NO: 2951418 - RNA, 16 nt, Mycobacterium avium subsp. paratuberculosis
gcccucgucggcgagc

SEQ ID NO: 2951419 - RNA, 17 nt, Mycobacterium avium subsp. paratuberculosis
gcccucgucggcgagca

SEQ ID NO: 2951420 - RNA, 19 nt, Mycobacterium avium subsp. paratuberculosis
gcccucgucuuccgcggcg

SEQ ID NO: 2951421 - RNA, 15 nt, Mycobacterium avium subsp. paratuberculosis
gcccucgugcguagc

SEQ ID NO: 2951422 - RNA, 16 nt, Mycobacterium avium subsp. paratuberculosis
gcccucgugcguagcg

SEQ ID NO: 2951423 - RNA, 18 nt, Mycobacterium avium subsp. paratuberculosis
gcccucgugcguagcggc

SEQ ID NO: 2951424 - RNA, 22 nt, Mycobacterium avium subsp. paratuberculosis
gcccucgugguggacggucagc

SEQ ID NO: 2951425 - RNA, 15 nt, Mycobacterium avium subsp. paratuberculosis
gcccucuuccucgcu

SEQ ID NO: 2951426 - RNA, 19 nt, Mycobacterium avium subsp. paratuberculosis
gcccucuuccucgcugucc

SEQ ID NO: 2951427 - RNA, 22 nt, Mycobacterium avium subsp. paratuberculosis
gcccucuucgaucaggcgcagc

SEQ ID NO: 2951428 - RNA, 15 nt, Mycobacterium avium subsp. paratuberculosis
gcccugaagcugggc

SEQ ID NO: 2951429 - RNA, 16 nt, Mycobacterium avium subsp. paratuberculosis
gcccugaagcugggcg

SEQ ID NO: 2951430 - RNA, 20 nt, Mycobacterium avium subsp. paratuberculosis
gcccugaagcugggcgccca

SEQ ID NO: 2951431 - RNA, 17 nt, Mycobacterium avium subsp. paratuberculosis
gcccugacacagcaccg

SEQ ID NO: 2951432 - RNA, 19 nt, Mycobacterium avium subsp. paratuberculosis
gcccugacacagcaccggc

SEQ ID NO: 2951433 - RNA, 16 nt, Mycobacterium avium subsp. paratuberculosis
gcccugcacccagccg

SEQ ID NO: 2951434 - RNA, 20 nt, Mycobacterium avium subsp. paratuberculosis
gcccugcacccagccgugcc

SEQ ID NO: 2951435 - RNA, 17 nt, Mycobacterium avium subsp. paratuberculosis
gcccugcacgaucucgg

SEQ ID NO: 2951436 - RNA, 22 nt, Mycobacterium avium subsp. paratuberculosis
gcccugcacgaucucggcgguc

SEQ ID NO: 2951437 - RNA, 14 nt, Mycobacterium avium subsp. paratuberculosis
gcccugcacuucgg

SEQ ID NO: 2951438 - RNA, 14 nt, Mycobacterium avium subsp. paratuberculosis
gcccugcagcgcga

SEQ ID NO: 2951439 - RNA, 20 nt, Mycobacterium avium subsp. paratuberculosis
gcccugcagguagguggcca

SEQ ID NO: 2951440 - RNA, 21 nt, Mycobacterium avium subsp. paratuberculosis
gccgaacaacagggccgcgcg

SEQ ID NO: 2951441 - RNA, 14 nt, Mycobacterium avium subsp. paratuberculosis
gccgaacaccacgc

SEQ ID NO: 2951442 - RNA, 19 nt, Mycobacterium avium subsp. paratuberculosis
gccgaacaccacgccgagc

SEQ ID NO: 2951443 - RNA, 20 nt, Mycobacterium avium subsp. paratuberculosis
gccgaacaccacgccgagca

SEQ ID NO: 2951444 - RNA, 14 nt, Mycobacterium avium subsp. paratuberculosis
gccgaacaccggca

SEQ ID NO: 2951445 - RNA, 13 nt, Mycobacterium avium subsp. paratuberculosis
gccgaacaccguc

SEQ ID NO: 2951446 - RNA, 19 nt, Mycobacterium avium subsp. paratuberculosis
gccgaacaccugcggcggc

SEQ ID NO: 2951447 - RNA, 20 nt, Mycobacterium avium subsp. paratuberculosis
gccgaacaccugcggcggca

SEQ ID NO: 2951448 - RNA, 21 nt, Mycobacterium avium subsp. paratuberculosis
gccgaacaccugcggcggcag

SEQ ID NO: 2951449 - RNA, 15 nt, Mycobacterium avium subsp. paratuberculosis
gccgaacacggccgc

SEQ ID NO: 2951450 - RNA, 16 nt, Mycobacterium avium subsp. paratuberculosis
gccgaacacggccgcc

SEQ ID NO: 2951451 - RNA, 17 nt, Mycobacterium avium subsp. paratuberculosis
gccgaacacggccgccu

SEQ ID NO: 2951452 - RNA, 21 nt, Mycobacterium avium subsp. paratuberculosis
gccgaacacggccgccuccag

SEQ ID NO: 2951453 - RNA, 22 nt, Mycobacterium avium subsp. paratuberculosis
gccgaacacguacagcggcggc

SEQ ID NO: 2951454 - RNA, 23 nt, Mycobacterium avium subsp. paratuberculosis
gccgaacacguacagcggcggcc

SEQ ID NO: 2951455 - RNA, 13 nt, Mycobacterium avium subsp. paratuberculosis
gccgaacagcagc

SEQ ID NO: 2951456 - RNA, 14 nt, Mycobacterium avium subsp. paratuberculosis
gccgaacagcagcg

SEQ ID NO: 2951457 - RNA, 15 nt, Mycobacterium avium subsp. paratuberculosis
gccgaacagcagcga

SEQ ID NO: 2951458 - RNA, 21 nt, Mycobacterium avium subsp. paratuberculosis
gccgaacagcagcgaacccgc

SEQ ID NO: 2951459 - RNA, 17 nt, Mycobacterium avium subsp. paratuberculosis
gccgaacagcagcgcgc

SEQ ID NO: 2951460 - RNA, 20 nt, Mycobacterium avium subsp. paratuberculosis
gccgaacagcagcgcgccga

SEQ ID NO: 2951461 - RNA, 12 nt, Mycobacterium avium subsp. paratuberculosis
gccgaacagcga

SEQ ID NO: 2951462 - RNA, 14 nt, Mycobacterium avium subsp. paratuberculosis
gccgaacagcgacg

SEQ ID NO: 2951463 - RNA, 18 nt, Mycobacterium avium subsp. paratuberculosis
gccgaacagcgacgucug

SEQ ID NO: 2951464 - RNA, 15 nt, Mycobacterium avium subsp. paratuberculosis
gccgaacaggcgcaa

SEQ ID NO: 2951465 - RNA, 19 nt, Mycobacterium avium subsp. paratuberculosis
gccgaaccagaucggcggg

SEQ ID NO: 2951466 - RNA, 22 nt, Mycobacterium avium subsp. paratuberculosis
gccgaaccagaucggcgggugc

SEQ ID NO: 2951467 - RNA, 17 nt, Mycobacterium avium subsp. paratuberculosis
gccgaaccccagcuccg

SEQ ID NO: 2951468 - RNA, 13 nt, Mycobacterium avium subsp. paratuberculosis
gccgaacccgccc

SEQ ID NO: 2951469 - RNA, 18 nt, Mycobacterium avium subsp. paratuberculosis
gccgaaccgaucaccggc

SEQ ID NO: 2951470 - RNA, 22 nt, Mycobacterium avium subsp. paratuberculosis
gccgaaccgaucaccggcagca

SEQ ID NO: 2951471 - RNA, 17 nt, Mycobacterium avium subsp. paratuberculosis
gccgaaccgcagccgga

SEQ ID NO: 2951472 - RNA, 18 nt, Mycobacterium avium subsp. paratuberculosis
gccgaaccgcuccccgag

SEQ ID NO: 2951473 - RNA, 19 nt, Mycobacterium avium subsp. paratuberculosis
gccgaaccgcuccccgagc

SEQ ID NO: 2951474 - RNA, 21 nt, Mycobacterium avium subsp. paratuberculosis
gccgaaccgcuccccgagcac

SEQ ID NO: 2951475 - RNA, 13 nt, Mycobacterium avium subsp. paratuberculosis
gccgaaccgcugc

SEQ ID NO: 2951476 - RNA, 22 nt, Mycobacterium avium subsp. paratuberculosis
gccgaaccggaucuggcccugg

SEQ ID NO: 2951477 - RNA, 13 nt, Mycobacterium avium subsp. paratuberculosis
gccgaaccgggcg

SEQ ID NO: 2951478 - RNA, 19 nt, Mycobacterium avium subsp. paratuberculosis
gccgaaccgggcgcgcaga

SEQ ID NO: 2951479 - RNA, 14 nt, Mycobacterium avium subsp. paratuberculosis
gccgaaccggggcc

SEQ ID NO: 2951480 - RNA, 17 nt, Mycobacterium avium subsp. paratuberculosis
gccgaaccggggccgca

SEQ ID NO: 2951481 - RNA, 20 nt, Mycobacterium avium subsp. paratuberculosis
gccgaaccggggccgcaccu

SEQ ID NO: 2951482 - RNA, 17 nt, Mycobacterium avium subsp. paratuberculosis
gccgaaccgucccacac

SEQ ID NO: 2951483 - RNA, 17 nt, Mycobacterium avium subsp. paratuberculosis
gccgaacgacagcagga

SEQ ID NO: 2951484 - RNA, 20 nt, Mycobacterium avium subsp. paratuberculosis
gccgaacgauggugugcagc

SEQ ID NO: 2951485 - RNA, 19 nt, Mycobacterium avium subsp. paratuberculosis
gccgaacgcaccaccgcgg

SEQ ID NO: 2951486 - RNA, 16 nt, Mycobacterium avium subsp. paratuberculosis
gccgaacgccaccacc

SEQ ID NO: 2951487 - RNA, 23 nt, Mycobacterium avium subsp. paratuberculosis
gccgaacgccggauuggcgucgg

SEQ ID NO: 2951488 - RNA, 16 nt, Mycobacterium avium subsp. paratuberculosis
gccgaacgccuccgcc

SEQ ID NO: 2951489 - RNA, 18 nt, Mycobacterium avium subsp. paratuberculosis
gccgaacgccuccgccgc

SEQ ID NO: 2951490 - RNA, 19 nt, Mycobacterium avium subsp. paratuberculosis
gccgaacgccuccgccgcc

SEQ ID NO: 2951491 - RNA, 24 nt, Mycobacterium avium subsp. paratuberculosis
gccgaacgccuccgccgccccguc

SEQ ID NO: 2951492 - RNA, 23 nt, Mycobacterium avium subsp. paratuberculosis
gccgaacgcgcugucgcccucga

SEQ ID NO: 2951493 - RNA, 22 nt, Mycobacterium avium subsp. paratuberculosis
gccgaacggcaugucgguggac

SEQ ID NO: 2951494 - RNA, 23 nt, Mycobacterium avium subsp. paratuberculosis
gccgaacggcgcucccgauggcu

SEQ ID NO: 2951495 - RNA, 14 nt, Mycobacterium avium subsp. paratuberculosis
gccgaacgggucgg

SEQ ID NO: 2951496 - RNA, 17 nt, Mycobacterium avium subsp. paratuberculosis
gccgaacgggucggcga

SEQ ID NO: 2951497 - RNA, 17 nt, Mycobacterium avium subsp. paratuberculosis
gccgaacgucaccaaca

SEQ ID NO: 2951498 - RNA, 18 nt, Mycobacterium avium subsp. paratuberculosis
gccgaacgucgagcgcgg

SEQ ID NO: 2951499 - RNA, 21 nt, Mycobacterium avium subsp. paratuberculosis
gccgaacgucgagcgcggccc

SEQ ID NO: 2951500 - RNA, 22 nt, Mycobacterium avium subsp. paratuberculosis
gccgaacgugcugugcgggcgg

SEQ ID NO: 2951501 - RNA, 14 nt, Mycobacterium avium subsp. paratuberculosis
gccgaacuccgccg

SEQ ID NO: 2951502 - RNA, 17 nt, Mycobacterium avium subsp. paratuberculosis
gccgaacuccgccgaac

SEQ ID NO: 2951503 - RNA, 13 nt, Mycobacterium avium subsp. paratuberculosis
gccgaacucggcg

SEQ ID NO: 2951504 - RNA, 15 nt, Mycobacterium avium subsp. paratuberculosis
gccgaacucggcgcc

SEQ ID NO: 2951505 - RNA, 16 nt, Mycobacterium avium subsp. paratuberculosis
gccgaacucggcgccg

SEQ ID NO: 2951506 - RNA, 18 nt, Mycobacterium avium subsp. paratuberculosis
gccgaacucggcgccgcc

SEQ ID NO: 2951507 - RNA, 19 nt, Mycobacterium avium subsp. paratuberculosis
gccgaacucggcgccgccg

SEQ ID NO: 2951508 - RNA, 18 nt, Mycobacterium avium subsp. paratuberculosis
gccgaacucucccaggac

SEQ ID NO: 2951509 - RNA, 18 nt, Mycobacterium avium subsp. paratuberculosis
gccgaacugccgaugcug

SEQ ID NO: 2951510 - RNA, 13 nt, Mycobacterium avium subsp. paratuberculosis
gccgaacugccgg

SEQ ID NO: 2951511 - RNA, 17 nt, Mycobacterium avium subsp. paratuberculosis
gccgaacugccggacca

SEQ ID NO: 2951512 - RNA, 23 nt, Mycobacterium avium subsp. paratuberculosis
gccgaacugguuguagucgucga

SEQ ID NO: 2951513 - RNA, 23 nt, Mycobacterium avium subsp. paratuberculosis
gccgaagaacgacuggcggcggc

SEQ ID NO: 2951514 - RNA, 17 nt, Mycobacterium avium subsp. paratuberculosis
gccgaagaagauguugc

SEQ ID NO: 2951515 - RNA, 21 nt, Mycobacterium avium subsp. paratuberculosis
gccgaagaagauguugcggcg

SEQ ID NO: 2951516 - RNA, 17 nt, Mycobacterium avium subsp. paratuberculosis
gccgaagaccgccgaaa

SEQ ID NO: 2951517 - RNA, 20 nt, Mycobacterium avium subsp. paratuberculosis
gccgaagaccgggccgauga

SEQ ID NO: 2951518 - RNA, 16 nt, Mycobacterium avium subsp. paratuberculosis
gccgaagaucaccgcg

SEQ ID NO: 2951519 - RNA, 18 nt, Mycobacterium avium subsp. paratuberculosis
gccgaagaucagcgcguc

SEQ ID NO: 2951520 - RNA, 20 nt, Mycobacterium avium subsp. paratuberculosis
gccgaagaucagcgcgucca

SEQ ID NO: 2951521 - RNA, 21 nt, Mycobacterium avium subsp. paratuberculosis
gccgaagaucagcgcguccaa

SEQ ID NO: 2951522 - RNA, 16 nt, Mycobacterium avium subsp. paratuberculosis
gccgaagauggccagc

SEQ ID NO: 2951523 - RNA, 17 nt, Mycobacterium avium subsp. paratuberculosis
gccgaagauggccagcg

SEQ ID NO: 2951524 - RNA, 15 nt, Mycobacterium avium subsp. paratuberculosis
gccgacaucgcggcg

SEQ ID NO: 2951525 - RNA, 18 nt, Mycobacterium avium subsp. paratuberculosis
gccgacaucgcggcgauc

SEQ ID NO: 2951526 - RNA, 13 nt, Mycobacterium avium subsp. paratuberculosis
gccgacaucgucg

SEQ ID NO: 2951527 - RNA, 19 nt, Mycobacterium avium subsp. paratuberculosis
gccgacaucucccggucga

SEQ ID NO: 2951528 - RNA, 14 nt, Mycobacterium avium subsp. paratuberculosis
gccgacaugcuggg

SEQ ID NO: 2951529 - RNA, 23 nt, Mycobacterium avium subsp. paratuberculosis
gccgacaugcugggcuaccagcc

SEQ ID NO: 2951530 - RNA, 16 nt, Mycobacterium avium subsp. paratuberculosis
gccgacauggacgcgg

SEQ ID NO: 2951531 - RNA, 20 nt, Mycobacterium avium subsp. paratuberculosis
gccgacauggacgcggccuc

SEQ ID NO: 2951532 - RNA, 18 nt, Mycobacterium avium subsp. paratuberculosis
gccgaccaacacccccgc

SEQ ID NO: 2951533 - RNA, 19 nt, Mycobacterium avium subsp. paratuberculosis
gccgaccaacacccccgcg

SEQ ID NO: 2951534 - RNA, 18 nt, Mycobacterium avium subsp. paratuberculosis
gccgaccaacgggcggcg

SEQ ID NO: 2951535 - RNA, 20 nt, Mycobacterium avium subsp. paratuberculosis
gccgaccaacgggcggcgga

SEQ ID NO: 2951536 - RNA, 17 nt, Mycobacterium avium subsp. paratuberculosis
gccgaccacaugccguu

SEQ ID NO: 2951537 - RNA, 19 nt, Mycobacterium avium subsp. paratuberculosis
gccgaccacccccagcccg

SEQ ID NO: 2951538 - RNA, 15 nt, Mycobacterium avium subsp. paratuberculosis
gccgaccaccuugcg

SEQ ID NO: 2951539 - RNA, 22 nt, Mycobacterium avium subsp. paratuberculosis
gccgaccaccuugcgcagcagc

SEQ ID NO: 2951540 - RNA, 16 nt, Mycobacterium avium subsp. paratuberculosis
gccgaccacggcccca

SEQ ID NO: 2951541 - RNA, 21 nt, Mycobacterium avium subsp. paratuberculosis
gccgaccacggccccagccgc

SEQ ID NO: 2951542 - RNA, 14 nt, Mycobacterium avium subsp. paratuberculosis
gccgaccagcagga

SEQ ID NO: 2951543 - RNA, 21 nt, Mycobacterium avium subsp. paratuberculosis
gccgaccagcaggacgcgccc

SEQ ID NO: 2951544 - RNA, 13 nt, Mycobacterium avium subsp. paratuberculosis
gccgaccagccga

SEQ ID NO: 2951545 - RNA, 17 nt, Mycobacterium avium subsp. paratuberculosis
gccgaccagccgaggcg

SEQ ID NO: 2951546 - RNA, 19 nt, Mycobacterium avium subsp. paratuberculosis
gccgaccagccgaggcgcu

SEQ ID NO: 2951547 - RNA, 11 nt, Mycobacterium avium subsp. paratuberculosis
gccgaccagcg

SEQ ID NO: 2951548 - RNA, 14 nt, Mycobacterium avium subsp. paratuberculosis
gccgaccagcgcga

SEQ ID NO: 2951549 - RNA, 16 nt, Mycobacterium avium subsp. paratuberculosis
gccgaccagcgcgauc

SEQ ID NO: 2951550 - RNA, 20 nt, Mycobacterium avium subsp. paratuberculosis
gccgaccagcggucgggugc

SEQ ID NO: 2951551 - RNA, 12 nt, Mycobacterium avium subsp. paratuberculosis
gccgaccaggaa

SEQ ID NO: 2951552 - RNA, 15 nt, Mycobacterium avium subsp. paratuberculosis
gccgaccagguagcg

SEQ ID NO: 2951553 - RNA, 15 nt, Mycobacterium avium subsp. paratuberculosis
gccgaccaguucggc

SEQ ID NO: 2951554 - RNA, 14 nt, Mycobacterium avium subsp. paratuberculosis
gccgacccccgccg

SEQ ID NO: 2951555 - RNA, 15 nt, Mycobacterium avium subsp. paratuberculosis
gccgacccccgccgc

SEQ ID NO: 2951556 - RNA, 16 nt, Mycobacterium avium subsp. paratuberculosis
gccgacccccgccgcg

SEQ ID NO: 2951557 - RNA, 17 nt, Mycobacterium avium subsp. paratuberculosis
gccgacccccgccgcgu

SEQ ID NO: 2951558 - RNA, 18 nt, Mycobacterium avium subsp. paratuberculosis
gccgacccccgccgcguc

SEQ ID NO: 2951559 - RNA, 18 nt, Mycobacterium avium subsp. paratuberculosis
gccgaccccgaugcgcuc

SEQ ID NO: 2951560 - RNA, 12 nt, Mycobacterium avium subsp. paratuberculosis
gccgacccgccc

SEQ ID NO: 2951561 - RNA, 15 nt, Mycobacterium avium subsp. paratuberculosis
gccgacccgcccgcc

SEQ ID NO: 2951562 - RNA, 16 nt, Mycobacterium avium subsp. paratuberculosis
gccgacccgcccgccg

SEQ ID NO: 2951563 - RNA, 22 nt, Mycobacterium avium subsp. paratuberculosis
gccgacccgcccgccgggcacc

SEQ ID NO: 2951564 - RNA, 23 nt, Mycobacterium avium subsp. paratuberculosis
gccgacccgcccgccgggcaccc

SEQ ID NO: 2951565 - RNA, 11 nt, Mycobacterium avium subsp. paratuberculosis
gccgacccgcu

SEQ ID NO: 2951566 - RNA, 16 nt, Mycobacterium avium subsp. paratuberculosis
gccgacccgcugcagc

SEQ ID NO: 2951567 - RNA, 23 nt, Mycobacterium avium subsp. paratuberculosis
gccgacccggcguaguucgucga

SEQ ID NO: 2951568 - RNA, 12 nt, Mycobacterium avium subsp. paratuberculosis
gccgacccgggc

SEQ ID NO: 2951569 - RNA, 22 nt, Mycobacterium avium subsp. paratuberculosis
gccgacccgggcuagacgcgca

SEQ ID NO: 2951570 - RNA, 23 nt, Mycobacterium avium subsp. paratuberculosis
gccgacccgguugauccggaucg

SEQ ID NO: 2951571 - RNA, 14 nt, Mycobacterium avium subsp. paratuberculosis
gccgacccugcguc

SEQ ID NO: 2951572 - RNA, 15 nt, Mycobacterium avium subsp. paratuberculosis
gccgacccugcgucc

SEQ ID NO: 2951573 - RNA, 16 nt, Mycobacterium avium subsp. paratuberculosis
gccgacccugcguccg

SEQ ID NO: 2951574 - RNA, 22 nt, Mycobacterium avium subsp. paratuberculosis
gccgaccgacaguucggcgcgc

SEQ ID NO: 2951575 - RNA, 15 nt, Mycobacterium avium subsp. paratuberculosis
gccgaccgacccggc

SEQ ID NO: 2951576 - RNA, 16 nt, Mycobacterium avium subsp. paratuberculosis
gccgaccgacccggcc

SEQ ID NO: 2951577 - RNA, 17 nt, Mycobacterium avium subsp. paratuberculosis
gccgaccgacccggcca

SEQ ID NO: 2951578 - RNA, 19 nt, Mycobacterium avium subsp. paratuberculosis
gccgaccgacccggccagc

SEQ ID NO: 2951579 - RNA, 21 nt, Mycobacterium avium subsp. paratuberculosis
gccgaccgacccggccagcgg

SEQ ID NO: 2951580 - RNA, 22 nt, Mycobacterium avium subsp. paratuberculosis
gccgaccgacccggccagcggc

SEQ ID NO: 2951581 - RNA, 18 nt, Mycobacterium avium subsp. paratuberculosis
gccgaccgagggcgcggg

SEQ ID NO: 2951582 - RNA, 14 nt, Mycobacterium avium subsp. paratuberculosis
gccgaccgccccgc

SEQ ID NO: 2951583 - RNA, 15 nt, Mycobacterium avium subsp. paratuberculosis
gccgaccgccccgcu

SEQ ID NO: 2951584 - RNA, 14 nt, Mycobacterium avium subsp. paratuberculosis
gccgaccgcccgcu

SEQ ID NO: 2951585 - RNA, 12 nt, Mycobacterium avium subsp. paratuberculosis
gccgaccgccga

SEQ ID NO: 2951586 - RNA, 14 nt, Mycobacterium avium subsp. paratuberculosis
gccgaccgccgcca

SEQ ID NO: 2951587 - RNA, 16 nt, Mycobacterium avium subsp. paratuberculosis
gccgaccgccgccauc

SEQ ID NO: 2951588 - RNA, 17 nt, Mycobacterium avium subsp. paratuberculosis
gccgaccgccgccaucc

SEQ ID NO: 2951589 - RNA, 19 nt, Mycobacterium avium subsp. paratuberculosis
gccgaccgccgccauccgu

SEQ ID NO: 2951590 - RNA, 22 nt, Mycobacterium avium subsp. paratuberculosis
gccgaccgccgccauccguucg

SEQ ID NO: 2951591 - RNA, 14 nt, Mycobacterium avium subsp. paratuberculosis
gccgaccgccucga

SEQ ID NO: 2951592 - RNA, 20 nt, Mycobacterium avium subsp. paratuberculosis
gccgaccgccucgauggccc

SEQ ID NO: 2951593 - RNA, 13 nt, Mycobacterium avium subsp. paratuberculosis
gccgaccgcgagc

SEQ ID NO: 2951594 - RNA, 15 nt, Mycobacterium avium subsp. paratuberculosis
gccgaccgcgaucga

SEQ ID NO: 2951595 - RNA, 15 nt, Mycobacterium avium subsp. paratuberculosis
gccgaccgcggucgc

SEQ ID NO: 2951596 - RNA, 18 nt, Mycobacterium avium subsp. paratuberculosis
gccgaccgcggucgcggc

SEQ ID NO: 2951597 - RNA, 19 nt, Mycobacterium avium subsp. paratuberculosis
gccgaccgcggucgcggcg

SEQ ID NO: 2951598 - RNA, 20 nt, Mycobacterium avium subsp. paratuberculosis
gccgaccgcggucgcggcgc

SEQ ID NO: 2951599 - RNA, 16 nt, Mycobacterium avium subsp. paratuberculosis
gccgaccgcgugucgg

SEQ ID NO: 2951600 - RNA, 17 nt, Mycobacterium avium subsp. paratuberculosis
gccgaccgcgugucggc

SEQ ID NO: 2951601 - RNA, 23 nt, Mycobacterium avium subsp. paratuberculosis
gccgaccgcgugucggcacacca

SEQ ID NO: 2951602 - RNA, 13 nt, Mycobacterium avium subsp. paratuberculosis
gccgaccggccgg

SEQ ID NO: 2951603 - RNA, 13 nt, Mycobacterium avium subsp. paratuberculosis
gccgaccgguccg

SEQ ID NO: 2951604 - RNA, 15 nt, Mycobacterium avium subsp. paratuberculosis
gccgaccgguccgcc

SEQ ID NO: 2951605 - RNA, 18 nt, Mycobacterium avium subsp. paratuberculosis
gccgaccgguccgccgcc

SEQ ID NO: 2951606 - RNA, 19 nt, Mycobacterium avium subsp. paratuberculosis
gccgaccgguccgccgccg

SEQ ID NO: 2951607 - RNA, 22 nt, Mycobacterium avium subsp. paratuberculosis
gccgaccgguccgccgccggcg

SEQ ID NO: 2951608 - RNA, 15 nt, Mycobacterium avium subsp. paratuberculosis
gccgaccggucucga

SEQ ID NO: 2951609 - RNA, 19 nt, Mycobacterium avium subsp. paratuberculosis
gccgacgccugcgcgaaca

SEQ ID NO: 2951610 - RNA, 23 nt, Mycobacterium avium subsp. paratuberculosis
gccgacgcgccgucggcccacgg

SEQ ID NO: 2951611 - RNA, 18 nt, Mycobacterium avium subsp. paratuberculosis
gccgacgcgcugcgcgcc

SEQ ID NO: 2951612 - RNA, 14 nt, Mycobacterium avium subsp. paratuberculosis
gccgacgcggccuc

SEQ ID NO: 2951613 - RNA, 13 nt, Mycobacterium avium subsp. paratuberculosis
gccgacggccagc

SEQ ID NO: 2951614 - RNA, 14 nt, Mycobacterium avium subsp. paratuberculosis
gccgacggccgcgc

SEQ ID NO: 2951615 - RNA, 16 nt, Mycobacterium avium subsp. paratuberculosis
gccgacggccgcgccg

SEQ ID NO: 2951616 - RNA, 12 nt, Mycobacterium avium subsp. paratuberculosis
gccgacggcgcc

SEQ ID NO: 2951617 - RNA, 13 nt, Mycobacterium avium subsp. paratuberculosis
gccgacggcgccg

SEQ ID NO: 2951618 - RNA, 15 nt, Mycobacterium avium subsp. paratuberculosis
gccgacggcgccggu

SEQ ID NO: 2951619 - RNA, 17 nt, Mycobacterium avium subsp. paratuberculosis
gccgacggcugcccggc

SEQ ID NO: 2951620 - RNA, 18 nt, Mycobacterium avium subsp. paratuberculosis
gccgacggcugcccggcc

SEQ ID NO: 2951621 - RNA, 22 nt, Mycobacterium avium subsp. paratuberculosis
gccgacgggauccggauugccg

SEQ ID NO: 2951622 - RNA, 18 nt, Mycobacterium avium subsp. paratuberculosis
gccgacgggcccagcgcg

SEQ ID NO: 2951623 - RNA, 16 nt, Mycobacterium avium subsp. paratuberculosis
gccgacgggcccgcgc

SEQ ID NO: 2951624 - RNA, 21 nt, Mycobacterium avium subsp. paratuberculosis
gccgacgggcguguagccugc

SEQ ID NO: 2951625 - RNA, 14 nt, Mycobacterium avium subsp. paratuberculosis
gccgacggucccac

SEQ ID NO: 2951626 - RNA, 17 nt, Mycobacterium avium subsp. paratuberculosis
gccgacggucugcggug

SEQ ID NO: 2951627 - RNA, 13 nt, Mycobacterium avium subsp. paratuberculosis
gccgacggugagc

SEQ ID NO: 2951628 - RNA, 14 nt, Mycobacterium avium subsp. paratuberculosis
gccgacggugagca

SEQ ID NO: 2951629 - RNA, 17 nt, Mycobacterium avium subsp. paratuberculosis
gccgacggugagcaccg

SEQ ID NO: 2951630 - RNA, 19 nt, Mycobacterium avium subsp. paratuberculosis
gccgacggugagcaccgcc

SEQ ID NO: 2951631 - RNA, 20 nt, Mycobacterium avium subsp. paratuberculosis
gccgacggugagcaccgccg

SEQ ID NO: 2951632 - RNA, 22 nt, Mycobacterium avium subsp. paratuberculosis
gccgacggugagcaccgccguc

SEQ ID NO: 2951633 - RNA, 14 nt, Mycobacterium avium subsp. paratuberculosis
gccgacggugcgug

SEQ ID NO: 2951634 - RNA, 12 nt, Mycobacterium avium subsp. paratuberculosis
gccgacgguggc

SEQ ID NO: 2951635 - RNA, 14 nt, Mycobacterium avium subsp. paratuberculosis
gccgacgguggccc

SEQ ID NO: 2951636 - RNA, 17 nt, Mycobacterium avium subsp. paratuberculosis
gccgacgguggccccca

SEQ ID NO: 2951637 - RNA, 20 nt, Mycobacterium avium subsp. paratuberculosis
gccgacgguggcccccacca

SEQ ID NO: 2951638 - RNA, 22 nt, Mycobacterium avium subsp. paratuberculosis
gccgacgguggcccccaccacg

SEQ ID NO: 2951639 - RNA, 13 nt, Mycobacterium avium subsp. paratuberculosis
gccgacggugucc

SEQ ID NO: 2951640 - RNA, 17 nt, Mycobacterium avium subsp. paratuberculosis
gccgacgguguccgcgg

SEQ ID NO: 2951641 - RNA, 18 nt, Mycobacterium avium subsp. paratuberculosis
gccgacgguguccgcggg

SEQ ID NO: 2951642 - RNA, 17 nt, Mycobacterium avium subsp. paratuberculosis
gccgacggugucguaga

SEQ ID NO: 2951643 - RNA, 23 nt, Mycobacterium avium subsp. paratuberculosis
gccgacggugucguagacgacgu

SEQ ID NO: 2951644 - RNA, 15 nt, Mycobacterium avium subsp. paratuberculosis
gccgacguaaccgua

SEQ ID NO: 2951645 - RNA, 16 nt, Mycobacterium avium subsp. paratuberculosis
gccgacguaaccguac

SEQ ID NO: 2951646 - RNA, 19 nt, Mycobacterium avium subsp. paratuberculosis
gccgacguaaccguacggc

SEQ ID NO: 2951647 - RNA, 21 nt, Mycobacterium avium subsp. paratuberculosis
gccgacguaaccguacggccc

SEQ ID NO: 2951648 - RNA, 22 nt, Mycobacterium avium subsp. paratuberculosis
gccgacguaaccguacggcccg

SEQ ID NO: 2951649 - RNA, 15 nt, Mycobacterium avium subsp. paratuberculosis
gccgacguagacgag

SEQ ID NO: 2951650 - RNA, 17 nt, Mycobacterium avium subsp. paratuberculosis
gccgacguaggacagca

SEQ ID NO: 2951651 - RNA, 17 nt, Mycobacterium avium subsp. paratuberculosis
gccgacgucaggggugc

SEQ ID NO: 2951652 - RNA, 23 nt, Mycobacterium avium subsp. paratuberculosis
gccgacgucaggggugccggagg

SEQ ID NO: 2951653 - RNA, 18 nt, Mycobacterium avium subsp. paratuberculosis
gccgacgucaggguggcc

SEQ ID NO: 2951654 - RNA, 19 nt, Mycobacterium avium subsp. paratuberculosis
gccgacgucaggguggccu

SEQ ID NO: 2951655 - RNA, 16 nt, Mycobacterium avium subsp. paratuberculosis
gccgacgucccagcac

SEQ ID NO: 2951656 - RNA, 18 nt, Mycobacterium avium subsp. paratuberculosis
gccgacguccuggaucgc

SEQ ID NO: 2951657 - RNA, 12 nt, Mycobacterium avium subsp. paratuberculosis
gccgacgucgac

SEQ ID NO: 2951658 - RNA, 13 nt, Mycobacterium avium subsp. paratuberculosis
gccgacgucgacc

SEQ ID NO: 2951659 - RNA, 17 nt, Mycobacterium avium subsp. paratuberculosis
gccgacgucgaccaggu

SEQ ID NO: 2951660 - RNA, 12 nt, Mycobacterium avium subsp. paratuberculosis
gccgacgucggu

SEQ ID NO: 2951661 - RNA, 13 nt, Mycobacterium avium subsp. paratuberculosis
gccgacgucggug

SEQ ID NO: 2951662 - RNA, 22 nt, Mycobacterium avium subsp. paratuberculosis
gccgacgucgugggcgauccgc

SEQ ID NO: 2951663 - RNA, 16 nt, Mycobacterium avium subsp. paratuberculosis
gccgacgucugguugg

SEQ ID NO: 2951664 - RNA, 22 nt, Mycobacterium avium subsp. paratuberculosis
gccgacgucugguuggccggcg

SEQ ID NO: 2951665 - RNA, 18 nt, Mycobacterium avium subsp. paratuberculosis
gccgacgugaugcacccg

SEQ ID NO: 2951666 - RNA, 17 nt, Mycobacterium avium subsp. paratuberculosis
gccgacgugccggugga

SEQ ID NO: 2951667 - RNA, 18 nt, Mycobacterium avium subsp. paratuberculosis
gccgacgugcuuggccag

SEQ ID NO: 2951668 - RNA, 22 nt, Mycobacterium avium subsp. paratuberculosis
gccgacgugggugguggugccg

SEQ ID NO: 2951669 - RNA, 14 nt, Mycobacterium avium subsp. paratuberculosis
gccgacuagcgcgg

SEQ ID NO: 2951670 - RNA, 15 nt, Mycobacterium avium subsp. paratuberculosis
gccgacuagcgcggc

SEQ ID NO: 2951671 - RNA, 20 nt, Mycobacterium avium subsp. paratuberculosis
gccgacuagcgcggcggccu

SEQ ID NO: 2951672 - RNA, 16 nt, Mycobacterium avium subsp. paratuberculosis
gccgacuccccgcccg

SEQ ID NO: 2951673 - RNA, 19 nt, Mycobacterium avium subsp. paratuberculosis
gccgacuccccgcccggca

SEQ ID NO: 2951674 - RNA, 21 nt, Mycobacterium avium subsp. paratuberculosis
gccgacucgcaggugccggug

SEQ ID NO: 2951675 - RNA, 13 nt, Mycobacterium avium subsp. paratuberculosis
gccgacugugcga

SEQ ID NO: 2951676 - RNA, 15 nt, Mycobacterium avium subsp. paratuberculosis
gccgacuugaucgcg

SEQ ID NO: 2951677 - RNA, 16 nt, Mycobacterium avium subsp. paratuberculosis
gccgacuugaucgcgg

SEQ ID NO: 2951678 - RNA, 19 nt, Mycobacterium avium subsp. paratuberculosis
gccgacuugaucgcggcgu

SEQ ID NO: 2951679 - RNA, 14 nt, Mycobacterium avium subsp. paratuberculosis
gccgacuuggugcc

SEQ ID NO: 2951680 - RNA, 15 nt, Mycobacterium avium subsp. paratuberculosis
gccgacuuggugcca

SEQ ID NO: 2951681 - RNA, 18 nt, Mycobacterium avium subsp. paratuberculosis
gccgacuuggugccaugc

SEQ ID NO: 2951682 - RNA, 21 nt, Mycobacterium avium subsp. paratuberculosis
gccgacuuggugccaugccgg

SEQ ID NO: 2951683 - RNA, 13 nt, Mycobacterium avium subsp. paratuberculosis
gccgagaacaggc

SEQ ID NO: 2951684 - RNA, 15 nt, Mycobacterium avium subsp. paratuberculosis
gccgagaacaggccg

SEQ ID NO: 2951685 - RNA, 17 nt, Mycobacterium avium subsp. paratuberculosis
gccgagaaugccguaga

SEQ ID NO: 2951686 - RNA, 18 nt, Mycobacterium avium subsp. paratuberculosis
gccgagacauagacguua

SEQ ID NO: 2951687 - RNA, 20 nt, Mycobacterium avium subsp. paratuberculosis
gccgagacauagacguuacg

SEQ ID NO: 2951688 - RNA, 15 nt, Mycobacterium avium subsp. paratuberculosis
gccgagacggcgugg

SEQ ID NO: 2951689 - RNA, 22 nt, Mycobacterium avium subsp. paratuberculosis
gccgagacugaugguggcgcgc

SEQ ID NO: 2951690 - RNA, 23 nt, Mycobacterium avium subsp. paratuberculosis
gccgagacugaugguggcgcgca

SEQ ID NO: 2951691 - RNA, 16 nt, Mycobacterium avium subsp. paratuberculosis
gccgagagcgcgucga

SEQ ID NO: 2951692 - RNA, 19 nt, Mycobacterium avium subsp. paratuberculosis
gccgagagcucuugcgccc

SEQ ID NO: 2951693 - RNA, 20 nt, Mycobacterium avium subsp. paratuberculosis
gccgagagcucuugcgcccc

SEQ ID NO: 2951694 - RNA, 14 nt, Mycobacterium avium subsp. paratuberculosis
gccgagccggcacg

SEQ ID NO: 2951695 - RNA, 16 nt, Mycobacterium avium subsp. paratuberculosis
gccgagccggcacggc

SEQ ID NO: 2951696 - RNA, 18 nt, Mycobacterium avium subsp. paratuberculosis
gccgagccggcacggccg

SEQ ID NO: 2951697 - RNA, 21 nt, Mycobacterium avium subsp. paratuberculosis
gccgagccggcacggccggcc

SEQ ID NO: 2951698 - RNA, 13 nt, Mycobacterium avium subsp. paratuberculosis
gccgagccggccg

SEQ ID NO: 2951699 - RNA, 14 nt, Mycobacterium avium subsp. paratuberculosis
gccgagccggccga

SEQ ID NO: 2951700 - RNA, 15 nt, Mycobacterium avium subsp. paratuberculosis
gccgagccggccgaa

SEQ ID NO: 2951701 - RNA, 22 nt, Mycobacterium avium subsp. paratuberculosis
gccgagccggccgaagcguucc

SEQ ID NO: 2951702 - RNA, 14 nt, Mycobacterium avium subsp. paratuberculosis
gccgagccgggcca

SEQ ID NO: 2951703 - RNA, 13 nt, Mycobacterium avium subsp. paratuberculosis
gccgagccgggcg

SEQ ID NO: 2951704 - RNA, 14 nt, Mycobacterium avium subsp. paratuberculosis
gccgagccgggcgg

SEQ ID NO: 2951705 - RNA, 15 nt, Mycobacterium avium subsp. paratuberculosis
gccgagccgggcggc

SEQ ID NO: 2951706 - RNA, 16 nt, Mycobacterium avium subsp. paratuberculosis
gccgagccgggcggcc

SEQ ID NO: 2951707 - RNA, 17 nt, Mycobacterium avium subsp. paratuberculosis
gccgagccgggcggcca

SEQ ID NO: 2951708 - RNA, 18 nt, Mycobacterium avium subsp. paratuberculosis
gccgagccgggcggccag

SEQ ID NO: 2951709 - RNA, 19 nt, Mycobacterium avium subsp. paratuberculosis
gccgagccgggcggccagc

SEQ ID NO: 2951710 - RNA, 14 nt, Mycobacterium avium subsp. paratuberculosis
gccgagccggguca

SEQ ID NO: 2951711 - RNA, 16 nt, Mycobacterium avium subsp. paratuberculosis
gccgagccgguccgac

SEQ ID NO: 2951712 - RNA, 16 nt, Mycobacterium avium subsp. paratuberculosis
gccgagccgucgucgc

SEQ ID NO: 2951713 - RNA, 19 nt, Mycobacterium avium subsp. paratuberculosis
gccgagcgcaagggccgac

SEQ ID NO: 2951714 - RNA, 13 nt, Mycobacterium avium subsp. paratuberculosis
gccgagcgcaccg

SEQ ID NO: 2951715 - RNA, 15 nt, Mycobacterium avium subsp. paratuberculosis
gccgagcgcaccgcg

SEQ ID NO: 2951716 - RNA, 18 nt, Mycobacterium avium subsp. paratuberculosis
gccgagcgcaucgacugc

SEQ ID NO: 2951717 - RNA, 19 nt, Mycobacterium avium subsp. paratuberculosis
gccgagcgcaucgacugcg

SEQ ID NO: 2951718 - RNA, 14 nt, Mycobacterium avium subsp. paratuberculosis
gccgagcgccgcgu

SEQ ID NO: 2951719 - RNA, 16 nt, Mycobacterium avium subsp. paratuberculosis
gccgagcgcgccgagc

SEQ ID NO: 2951720 - RNA, 20 nt, Mycobacterium avium subsp. paratuberculosis
gccgagcgcgccgagcagcu

SEQ ID NO: 2951721 - RNA, 17 nt, Mycobacterium avium subsp. paratuberculosis
gccgagcgcgccgccgc

SEQ ID NO: 2951722 - RNA, 22 nt, Mycobacterium avium subsp. paratuberculosis
gccgagcgcgccgccgccgccc

SEQ ID NO: 2951723 - RNA, 12 nt, Mycobacterium avium subsp. paratuberculosis
gccgagcgcgcu

SEQ ID NO: 2951724 - RNA, 14 nt, Mycobacterium avium subsp. paratuberculosis
gccgagcgcgcugg

SEQ ID NO: 2951725 - RNA, 13 nt, Mycobacterium avium subsp. paratuberculosis
gccgagcgcgcuu

SEQ ID NO: 2951726 - RNA, 18 nt, Mycobacterium avium subsp. paratuberculosis
gccgagcgcgcuuggggu

SEQ ID NO: 2951727 - RNA, 21 nt, Mycobacterium avium subsp. paratuberculosis
gccgagcggcgccacgugguc

SEQ ID NO: 2951728 - RNA, 15 nt, Mycobacterium avium subsp. paratuberculosis
gccgagcggcugcug

SEQ ID NO: 2951729 - RNA, 16 nt, Mycobacterium avium subsp. paratuberculosis
gccgagcggcugcugg

SEQ ID NO: 2951730 - RNA, 17 nt, Mycobacterium avium subsp. paratuberculosis
gccgagcgggucgucgu

SEQ ID NO: 2951731 - RNA, 22 nt, Mycobacterium avium subsp. paratuberculosis
gccgagcgggucgucguucucg

SEQ ID NO: 2951732 - RNA, 22 nt, Mycobacterium avium subsp. paratuberculosis
gccgagcgguccaacgggcuca

SEQ ID NO: 2951733 - RNA, 15 nt, Mycobacterium avium subsp. paratuberculosis
gccgagcgucacgcu

SEQ ID NO: 2951734 - RNA, 17 nt, Mycobacterium avium subsp. paratuberculosis
gccgagcgucacgcugg

SEQ ID NO: 2951735 - RNA, 19 nt, Mycobacterium avium subsp. paratuberculosis
gccgagcgucacgcuggcg

SEQ ID NO: 2951736 - RNA, 20 nt, Mycobacterium avium subsp. paratuberculosis
gccgagcgucacgcuggcgu

SEQ ID NO: 2951737 - RNA, 15 nt, Mycobacterium avium subsp. paratuberculosis
gccgagcgugaaacu

SEQ ID NO: 2951738 - RNA, 19 nt, Mycobacterium avium subsp. paratuberculosis
gccgagcgugaagcuagcu

SEQ ID NO: 2951739 - RNA, 13 nt, Mycobacterium avium subsp. paratuberculosis
gccgagcguucgg

SEQ ID NO: 2951740 - RNA, 15 nt, Mycobacterium avium subsp. paratuberculosis
gccgagcguucggcg

SEQ ID NO: 2951741 - RNA, 23 nt, Mycobacterium avium subsp. paratuberculosis
gccgagcguucggcgcggaucgu

SEQ ID NO: 2951742 - RNA, 14 nt, Mycobacterium avium subsp. paratuberculosis
gccgagcucgaugu

SEQ ID NO: 2951743 - RNA, 15 nt, Mycobacterium avium subsp. paratuberculosis
gccgagcucggccac

SEQ ID NO: 2951744 - RNA, 17 nt, Mycobacterium avium subsp. paratuberculosis
gccgagcucggccacca

SEQ ID NO: 2951745 - RNA, 19 nt, Mycobacterium avium subsp. paratuberculosis
gccgagcucggccaccagc

SEQ ID NO: 2951746 - RNA, 20 nt, Mycobacterium avium subsp. paratuberculosis
gccgagcucggccaccagcg

SEQ ID NO: 2951747 - RNA, 23 nt, Mycobacterium avium subsp. paratuberculosis
gccgagcucggccaccagcgccc

SEQ ID NO: 2951748 - RNA, 22 nt, Mycobacterium avium subsp. paratuberculosis
gccgagcucgugaugguccagc

SEQ ID NO: 2951749 - RNA, 15 nt, Mycobacterium avium subsp. paratuberculosis
gccgagcuugggccg

SEQ ID NO: 2951750 - RNA, 21 nt, Mycobacterium avium subsp. paratuberculosis
gccgagcuugggccggugcag

SEQ ID NO: 2951751 - RNA, 22 nt, Mycobacterium avium subsp. paratuberculosis
gccgagcuugggccggugcagc

SEQ ID NO: 2951752 - RNA, 16 nt, Mycobacterium avium subsp. paratuberculosis
gccgaggaaagcucgc

SEQ ID NO: 2951753 - RNA, 13 nt, Mycobacterium avium subsp. paratuberculosis
gccgaggaaccgg

SEQ ID NO: 2951754 - RNA, 17 nt, Mycobacterium avium subsp. paratuberculosis
gccgaggaaccggcagc

SEQ ID NO: 2951755 - RNA, 22 nt, Mycobacterium avium subsp. paratuberculosis
gccgaggaaccggcagccggcg

SEQ ID NO: 2951756 - RNA, 23 nt, Mycobacterium avium subsp. paratuberculosis
gccgaggaaccggcagccggcgu

SEQ ID NO: 2951757 - RNA, 21 nt, Mycobacterium avium subsp. paratuberculosis
gccgaggaacugcagcgacug

SEQ ID NO: 2951758 - RNA, 19 nt, Mycobacterium avium subsp. paratuberculosis
gccgaggacacguuggcca

SEQ ID NO: 2951759 - RNA, 14 nt, Mycobacterium avium subsp. paratuberculosis
gccgaggaggccgc

SEQ ID NO: 2951760 - RNA, 20 nt, Mycobacterium avium subsp. paratuberculosis
gccgaggauuucgcgaucga

SEQ ID NO: 2951761 - RNA, 16 nt, Mycobacterium avium subsp. paratuberculosis
gccgaggcacagcagc

SEQ ID NO: 2951762 - RNA, 18 nt, Mycobacterium avium subsp. paratuberculosis
gccgaggcacagcagcac

SEQ ID NO: 2951763 - RNA, 20 nt, Mycobacterium avium subsp. paratuberculosis
gccgaggcacagcagcacgu

SEQ ID NO: 2951764 - RNA, 21 nt, Mycobacterium avium subsp. paratuberculosis
gccgaggccagcacgccgguc

SEQ ID NO: 2951765 - RNA, 18 nt, Mycobacterium avium subsp. paratuberculosis
gccgaggcgagugaggac

SEQ ID NO: 2951766 - RNA, 20 nt, Mycobacterium avium subsp. paratuberculosis
gccgaggcgagugaggacga

SEQ ID NO: 2951767 - RNA, 21 nt, Mycobacterium avium subsp. paratuberculosis
gccgaggcgagugaggacgag

SEQ ID NO: 2951768 - RNA, 13 nt, Mycobacterium avium subsp. paratuberculosis
gccgaggcgaugc

SEQ ID NO: 2951769 - RNA, 15 nt, Mycobacterium avium subsp. paratuberculosis
gccgaggcgaugccg

SEQ ID NO: 2951770 - RNA, 22 nt, Mycobacterium avium subsp. paratuberculosis
gccgaggcgaugccgugcuggg

SEQ ID NO: 2951771 - RNA, 16 nt, Mycobacterium avium subsp. paratuberculosis
gccgaggcgcaacacc

SEQ ID NO: 2951772 - RNA, 13 nt, Mycobacterium avium subsp. paratuberculosis
gccgaggcgcagg

SEQ ID NO: 2951773 - RNA, 15 nt, Mycobacterium avium subsp. paratuberculosis
gccgaggcgcucggc

SEQ ID NO: 2951774 - RNA, 17 nt, Mycobacterium avium subsp. paratuberculosis
gccgaggcgcucggccc

SEQ ID NO: 2951775 - RNA, 18 nt, Mycobacterium avium subsp. paratuberculosis
gccgaggcgcucggcccg

SEQ ID NO: 2951776 - RNA, 19 nt, Mycobacterium avium subsp. paratuberculosis
gccgaggcgcucggcccgc

SEQ ID NO: 2951777 - RNA, 18 nt, Mycobacterium avium subsp. paratuberculosis
gccgaggcgugccgcugg

SEQ ID NO: 2951778 - RNA, 17 nt, Mycobacterium avium subsp. paratuberculosis
gccgaggcugucggagg

SEQ ID NO: 2951779 - RNA, 16 nt, Mycobacterium avium subsp. paratuberculosis
gccgaucacgccggug

SEQ ID NO: 2951780 - RNA, 14 nt, Mycobacterium avium subsp. paratuberculosis
gccgaucacgguga

SEQ ID NO: 2951781 - RNA, 16 nt, Mycobacterium avium subsp. paratuberculosis
gccgaucacggugauc

SEQ ID NO: 2951782 - RNA, 21 nt, Mycobacterium avium subsp. paratuberculosis
gccgaucacggugaucgccgg

SEQ ID NO: 2951783 - RNA, 15 nt, Mycobacterium avium subsp. paratuberculosis
gccgaucagcaccag

SEQ ID NO: 2951784 - RNA, 15 nt, Mycobacterium avium subsp. paratuberculosis
gccgaucagcggcgg

SEQ ID NO: 2951785 - RNA, 19 nt, Mycobacterium avium subsp. paratuberculosis
gccgaucagcgucagcacc

SEQ ID NO: 2951786 - RNA, 20 nt, Mycobacterium avium subsp. paratuberculosis
gccgaucagcgucagcaccg

SEQ ID NO: 2951787 - RNA, 15 nt, Mycobacterium avium subsp. paratuberculosis
gccgaucagcugcuc

SEQ ID NO: 2951788 - RNA, 18 nt, Mycobacterium avium subsp. paratuberculosis
gccgaucagcugcucggc

SEQ ID NO: 2951789 - RNA, 21 nt, Mycobacterium avium subsp. paratuberculosis
gccgaucagcugcucggccac

SEQ ID NO: 2951790 - RNA, 15 nt, Mycobacterium avium subsp. paratuberculosis
gccgaucagcuggcu

SEQ ID NO: 2951791 - RNA, 17 nt, Mycobacterium avium subsp. paratuberculosis
gccgaucagcuggcuga

SEQ ID NO: 2951792 - RNA, 23 nt, Mycobacterium avium subsp. paratuberculosis
gccgaucaggcuggacaccacgu

SEQ ID NO: 2951793 - RNA, 16 nt, Mycobacterium avium subsp. paratuberculosis
gccgaucagugccgcg

SEQ ID NO: 2951794 - RNA, 17 nt, Mycobacterium avium subsp. paratuberculosis
gccgaucagugccgcgc

SEQ ID NO: 2951795 - RNA, 19 nt, Mycobacterium avium subsp. paratuberculosis
gccgaucagugccgcgcca

SEQ ID NO: 2951796 - RNA, 21 nt, Mycobacterium avium subsp. paratuberculosis
gccgaucagugccgcgccaac

SEQ ID NO: 2951797 - RNA, 18 nt, Mycobacterium avium subsp. paratuberculosis
gccgaucauggucggcga

SEQ ID NO: 2951798 - RNA, 20 nt, Mycobacterium avium subsp. paratuberculosis
gccgaucauggucggcgacg

SEQ ID NO: 2951799 - RNA, 21 nt, Mycobacterium avium subsp. paratuberculosis
gccgaucauggucggcgacgc

SEQ ID NO: 2951800 - RNA, 16 nt, Mycobacterium avium subsp. paratuberculosis
gccgauccagccgucg

SEQ ID NO: 2951801 - RNA, 17 nt, Mycobacterium avium subsp. paratuberculosis
gccgauccagccgucgu

SEQ ID NO: 2951802 - RNA, 14 nt, Mycobacterium avium subsp. paratuberculosis
gccgaucccggcca

SEQ ID NO: 2951803 - RNA, 20 nt, Mycobacterium avium subsp. paratuberculosis
gccgaucccggccacgucga

SEQ ID NO: 2951804 - RNA, 19 nt, Mycobacterium avium subsp. paratuberculosis
gccgaucccggccagcacc

SEQ ID NO: 2951805 - RNA, 19 nt, Mycobacterium avium subsp. paratuberculosis
gccgauccgcaccggacgc

SEQ ID NO: 2951806 - RNA, 16 nt, Mycobacterium avium subsp. paratuberculosis
gccgauccgcagccgc

SEQ ID NO: 2951807 - RNA, 23 nt, Mycobacterium avium subsp. paratuberculosis
gccgauccgcggguacggucggc

SEQ ID NO: 2951808 - RNA, 15 nt, Mycobacterium avium subsp. paratuberculosis
gccgauccgcugcgg

SEQ ID NO: 2951809 - RNA, 18 nt, Mycobacterium avium subsp. paratuberculosis
gccgauccggcgccgcgg

SEQ ID NO: 2951810 - RNA, 21 nt, Mycobacterium avium subsp. paratuberculosis
gccgauccggcgccgcgggcg

SEQ ID NO: 2951811 - RNA, 12 nt, Mycobacterium avium subsp. paratuberculosis
gccgauccggcu

SEQ ID NO: 2951812 - RNA, 22 nt, Mycobacterium avium subsp. paratuberculosis
gccgauccggcuccacagcagu

SEQ ID NO: 2951813 - RNA, 20 nt, Mycobacterium avium subsp. paratuberculosis
gccgauccgggcggcaggug

SEQ ID NO: 2951814 - RNA, 12 nt, Mycobacterium avium subsp. paratuberculosis
gccgaucgacga

SEQ ID NO: 2951815 - RNA, 22 nt, Mycobacterium avium subsp. paratuberculosis
gccgaucgacgaauagccuucg

SEQ ID NO: 2951816 - RNA, 14 nt, Mycobacterium avium subsp. paratuberculosis
gccgaucgcccagu

SEQ ID NO: 2951817 - RNA, 19 nt, Mycobacterium avium subsp. paratuberculosis
gccgaucgcccgguaggcc

SEQ ID NO: 2951818 - RNA, 23 nt, Mycobacterium avium subsp. paratuberculosis
gccgaucgcccgguaggccgccg

SEQ ID NO: 2951819 - RNA, 14 nt, Mycobacterium avium subsp. paratuberculosis
gccgaucgccgcgg

SEQ ID NO: 2951820 - RNA, 15 nt, Mycobacterium avium subsp. paratuberculosis
gccgaucgccgcggc

SEQ ID NO: 2951821 - RNA, 17 nt, Mycobacterium avium subsp. paratuberculosis
gccgaucgccgcggcga

SEQ ID NO: 2951822 - RNA, 18 nt, Mycobacterium avium subsp. paratuberculosis
gccgaucgccgcggcgau

SEQ ID NO: 2951823 - RNA, 22 nt, Mycobacterium avium subsp. paratuberculosis
gccgaucgccuccgucagcgcc

SEQ ID NO: 2951824 - RNA, 12 nt, Mycobacterium avium subsp. paratuberculosis
gccgaucgcggc

SEQ ID NO: 2951825 - RNA, 13 nt, Mycobacterium avium subsp. paratuberculosis
gccgaucgcggcg

SEQ ID NO: 2951826 - RNA, 14 nt, Mycobacterium avium subsp. paratuberculosis
gccgaucgcggcga

SEQ ID NO: 2951827 - RNA, 15 nt, Mycobacterium avium subsp. paratuberculosis
gccgaucgcggcgau

SEQ ID NO: 2951828 - RNA, 16 nt, Mycobacterium avium subsp. paratuberculosis
gccgaucgcggcgauc

SEQ ID NO: 2951829 - RNA, 17 nt, Mycobacterium avium subsp. paratuberculosis
gccgaucgcggcgauca

SEQ ID NO: 2951830 - RNA, 22 nt, Mycobacterium avium subsp. paratuberculosis
gccgaucgcggcgaucagcccg

SEQ ID NO: 2951831 - RNA, 17 nt, Mycobacterium avium subsp. paratuberculosis
gccgaucgcggugcugc

SEQ ID NO: 2951832 - RNA, 16 nt, Mycobacterium avium subsp. paratuberculosis
gccgaucggggcgcag

SEQ ID NO: 2951833 - RNA, 18 nt, Mycobacterium avium subsp. paratuberculosis
gccgaucggggcgcagcc

SEQ ID NO: 2951834 - RNA, 23 nt, Mycobacterium avium subsp. paratuberculosis
gccgaucggggcgcagcccggcg

SEQ ID NO: 2951835 - RNA, 20 nt, Mycobacterium avium subsp. paratuberculosis
gccgaucgugaauucggccg

SEQ ID NO: 2951836 - RNA, 17 nt, Mycobacterium avium subsp. paratuberculosis
gccgaucgugacgccgu

SEQ ID NO: 2951837 - RNA, 21 nt, Mycobacterium avium subsp. paratuberculosis
gccgaucgugacgccguccga

SEQ ID NO: 2951838 - RNA, 15 nt, Mycobacterium avium subsp. paratuberculosis
gccgaucuccaccga

SEQ ID NO: 2951839 - RNA, 15 nt, Mycobacterium avium subsp. paratuberculosis
gccgaucucggccaa

SEQ ID NO: 2951840 - RNA, 16 nt, Mycobacterium avium subsp. paratuberculosis
gccgaucucggccaac

SEQ ID NO: 2951841 - RNA, 18 nt, Mycobacterium avium subsp. paratuberculosis
gccgaucucggccaaccg

SEQ ID NO: 2951842 - RNA, 22 nt, Mycobacterium avium subsp. paratuberculosis
gccgaucucguagcccaccucg

SEQ ID NO: 2951843 - RNA, 19 nt, Mycobacterium avium subsp. paratuberculosis
gccgaucugaccgagcagc

SEQ ID NO: 2951844 - RNA, 21 nt, Mycobacterium avium subsp. paratuberculosis
gccgaucugcucggcugcagg

SEQ ID NO: 2951845 - RNA, 15 nt, Mycobacterium avium subsp. paratuberculosis
gccgaucuggcgcag

SEQ ID NO: 2951846 - RNA, 15 nt, Mycobacterium avium subsp. paratuberculosis
gccgaucuggcgggc

SEQ ID NO: 2951847 - RNA, 17 nt, Mycobacterium avium subsp. paratuberculosis
gccgaucuggcgggcgg

SEQ ID NO: 2951848 - RNA, 21 nt, Mycobacterium avium subsp. paratuberculosis
gccgaucuggcgggcggucca

SEQ ID NO: 2951849 - RNA, 16 nt, Mycobacterium avium subsp. paratuberculosis
gccgaucugguccagc

SEQ ID NO: 2951850 - RNA, 15 nt, Mycobacterium avium subsp. paratuberculosis
gccgaucugucgcgc

SEQ ID NO: 2951851 - RNA, 16 nt, Mycobacterium avium subsp. paratuberculosis
gccgaucugucgcgcu

SEQ ID NO: 2951852 - RNA, 23 nt, Mycobacterium avium subsp. paratuberculosis
gccgaucugucgcgcucagugca

SEQ ID NO: 2951853 - RNA, 18 nt, Mycobacterium avium subsp. paratuberculosis
gccgaucuucucccgggc

SEQ ID NO: 2951854 - RNA, 12 nt, Mycobacterium avium subsp. paratuberculosis
gccgaucuuguc

SEQ ID NO: 2951855 - RNA, 15 nt, Mycobacterium avium subsp. paratuberculosis
gccgaucuugucgac

SEQ ID NO: 2951856 - RNA, 16 nt, Mycobacterium avium subsp. paratuberculosis
gccgaucuugucgacc

SEQ ID NO: 2951857 - RNA, 12 nt, Mycobacterium avium subsp. paratuberculosis
gccgaugaccac

SEQ ID NO: 2951858 - RNA, 23 nt, Mycobacterium avium subsp. paratuberculosis
gccgaugaccacccucagggagc

SEQ ID NO: 2951859 - RNA, 13 nt, Mycobacterium avium subsp. paratuberculosis
gccgaugaccgcg

SEQ ID NO: 2951860 - RNA, 15 nt, Mycobacterium avium subsp. paratuberculosis
gccgaugaccgcggc

SEQ ID NO: 2951861 - RNA, 19 nt, Mycobacterium avium subsp. paratuberculosis
gccgaugaccgcggcgggc

SEQ ID NO: 2951862 - RNA, 19 nt, Mycobacterium avium subsp. paratuberculosis
gccgaugacguugcgcgcc

SEQ ID NO: 2951863 - RNA, 20 nt, Mycobacterium avium subsp. paratuberculosis
gccgaugacguugcgcgcca

SEQ ID NO: 2951864 - RNA, 20 nt, Mycobacterium avium subsp. paratuberculosis
gccgcaacggcggucgugcg

SEQ ID NO: 2951865 - RNA, 15 nt, Mycobacterium avium subsp. paratuberculosis
gccgcaacgggccgc

SEQ ID NO: 2951866 - RNA, 23 nt, Mycobacterium avium subsp. paratuberculosis
gccgcaacgggccgcagccgcgc

SEQ ID NO: 2951867 - RNA, 18 nt, Mycobacterium avium subsp. paratuberculosis
gccgcaacuugcccgacg

SEQ ID NO: 2951868 - RNA, 23 nt, Mycobacterium avium subsp. paratuberculosis
gccgcaaggugauucgcgcggcg

SEQ ID NO: 2951869 - RNA, 17 nt, Mycobacterium avium subsp. paratuberculosis
gccgcaauacaccgcga

SEQ ID NO: 2951870 - RNA, 17 nt, Mycobacterium avium subsp. paratuberculosis
gccgcaauacggugccc

SEQ ID NO: 2951871 - RNA, 21 nt, Mycobacterium avium subsp. paratuberculosis
gccgcaauacggugcccgccg

SEQ ID NO: 2951872 - RNA, 22 nt, Mycobacterium avium subsp. paratuberculosis
gccgcaauacggugcccgccgc

SEQ ID NO: 2951873 - RNA, 23 nt, Mycobacterium avium subsp. paratuberculosis
gccgcaauacggugcccgccgcg

SEQ ID NO: 2951874 - RNA, 16 nt, Mycobacterium avium subsp. paratuberculosis
gccgcaaucggcgccg

SEQ ID NO: 2951875 - RNA, 19 nt, Mycobacterium avium subsp. paratuberculosis
gccgcaaucggcgccggcu

SEQ ID NO: 2951876 - RNA, 22 nt, Mycobacterium avium subsp. paratuberculosis
gccgcacaacaugauucguucg

SEQ ID NO: 2951877 - RNA, 13 nt, Mycobacterium avium subsp. paratuberculosis
gccgcacaccacc

SEQ ID NO: 2951878 - RNA, 14 nt, Mycobacterium avium subsp. paratuberculosis
gccgcacaccacca

SEQ ID NO: 2951879 - RNA, 14 nt, Mycobacterium avium subsp. paratuberculosis
gccgcacaccgcgc

SEQ ID NO: 2951880 - RNA, 16 nt, Mycobacterium avium subsp. paratuberculosis
gccgcacaccgcgcag

SEQ ID NO: 2951881 - RNA, 15 nt, Mycobacterium avium subsp. paratuberculosis
gccgcacaccgcggc

SEQ ID NO: 2951882 - RNA, 22 nt, Mycobacterium avium subsp. paratuberculosis
gccgcacaccgcggcggcgucg

SEQ ID NO: 2951883 - RNA, 13 nt, Mycobacterium avium subsp. paratuberculosis
gccgcacaccguc

SEQ ID NO: 2951884 - RNA, 18 nt, Mycobacterium avium subsp. paratuberculosis
gccgcacaccgucuccca

SEQ ID NO: 2951885 - RNA, 16 nt, Mycobacterium avium subsp. paratuberculosis
gccgcacaccugcauc

SEQ ID NO: 2951886 - RNA, 19 nt, Mycobacterium avium subsp. paratuberculosis
gccgcacaccugcaucacg

SEQ ID NO: 2951887 - RNA, 17 nt, Mycobacterium avium subsp. paratuberculosis
gccgcaccagaucgucg

SEQ ID NO: 2951888 - RNA, 23 nt, Mycobacterium avium subsp. paratuberculosis
gccgcaccagaucgucgggcacc

SEQ ID NO: 2951889 - RNA, 12 nt, Mycobacterium avium subsp. paratuberculosis
gccgcaccagca

SEQ ID NO: 2951890 - RNA, 13 nt, Mycobacterium avium subsp. paratuberculosis
gccgcaccagcac

SEQ ID NO: 2951891 - RNA, 14 nt, Mycobacterium avium subsp. paratuberculosis
gccgcaccagcacc

SEQ ID NO: 2951892 - RNA, 16 nt, Mycobacterium avium subsp. paratuberculosis
gccgcaccagcacccc

SEQ ID NO: 2951893 - RNA, 20 nt, Mycobacterium avium subsp. paratuberculosis
gccgcaccagcaccccgccg

SEQ ID NO: 2951894 - RNA, 13 nt, Mycobacterium avium subsp. paratuberculosis
gccgcaccagguu

SEQ ID NO: 2951895 - RNA, 14 nt, Mycobacterium avium subsp. paratuberculosis
gccgcaccccaccc

SEQ ID NO: 2951896 - RNA, 15 nt, Mycobacterium avium subsp. paratuberculosis
gccgcaccccacccg

SEQ ID NO: 2951897 - RNA, 16 nt, Mycobacterium avium subsp. paratuberculosis
gccgcaccccacccgc

SEQ ID NO: 2951898 - RNA, 20 nt, Mycobacterium avium subsp. paratuberculosis
gccgcaccccacccgcgcga

SEQ ID NO: 2951899 - RNA, 16 nt, Mycobacterium avium subsp. paratuberculosis
gccgcacccccuccac

SEQ ID NO: 2951900 - RNA, 21 nt, Mycobacterium avium subsp. paratuberculosis
gccgcacccccuccacacggc

SEQ ID NO: 2951901 - RNA, 11 nt, Mycobacterium avium subsp. paratuberculosis
gccgcacccga

SEQ ID NO: 2951902 - RNA, 19 nt, Mycobacterium avium subsp. paratuberculosis
gccgcacccgauccacggc

SEQ ID NO: 2951903 - RNA, 16 nt, Mycobacterium avium subsp. paratuberculosis
gccgcaccgcaaagca

SEQ ID NO: 2951904 - RNA, 21 nt, Mycobacterium avium subsp. paratuberculosis
gccgcaccgcaaagcaccgcg

SEQ ID NO: 2951905 - RNA, 13 nt, Mycobacterium avium subsp. paratuberculosis
gccgcaccgcgac

SEQ ID NO: 2951906 - RNA, 15 nt, Mycobacterium avium subsp. paratuberculosis
gccgcaccgcgaccg

SEQ ID NO: 2951907 - RNA, 14 nt, Mycobacterium avium subsp. paratuberculosis
gccgcaccggccgg

SEQ ID NO: 2951908 - RNA, 18 nt, Mycobacterium avium subsp. paratuberculosis
gccgcaccggccggcccc

SEQ ID NO: 2951909 - RNA, 19 nt, Mycobacterium avium subsp. paratuberculosis
gccgcaccggccggccccg

SEQ ID NO: 2951910 - RNA, 18 nt, Mycobacterium avium subsp. paratuberculosis
gccgcaccggcgccgcca

SEQ ID NO: 2951911 - RNA, 19 nt, Mycobacterium avium subsp. paratuberculosis
gccgcaccgucgugccagc

SEQ ID NO: 2951912 - RNA, 12 nt, Mycobacterium avium subsp. paratuberculosis
gccgcaccucgc

SEQ ID NO: 2951913 - RNA, 16 nt, Mycobacterium avium subsp. paratuberculosis
gccgcaccucgccggc

SEQ ID NO: 2951914 - RNA, 21 nt, Mycobacterium avium subsp. paratuberculosis
gccgcaccucgccggccgccg

SEQ ID NO: 2951915 - RNA, 23 nt, Mycobacterium avium subsp. paratuberculosis
gccgcaccugaucgaugccgugg

SEQ ID NO: 2951916 - RNA, 18 nt, Mycobacterium avium subsp. paratuberculosis
gccgcacgaaccgcucga

SEQ ID NO: 2951917 - RNA, 18 nt, Mycobacterium avium subsp. paratuberculosis
gccgcacgaauugccggu

SEQ ID NO: 2951918 - RNA, 19 nt, Mycobacterium avium subsp. paratuberculosis
gccgcacgaauugccggug

SEQ ID NO: 2951919 - RNA, 23 nt, Mycobacterium avium subsp. paratuberculosis
gccgcacgaauugccgguggugc

SEQ ID NO: 2951920 - RNA, 20 nt, Mycobacterium avium subsp. paratuberculosis
gccgcacgaccaugucggcg

SEQ ID NO: 2951921 - RNA, 21 nt, Mycobacterium avium subsp. paratuberculosis
gccgcacgaccaugucggcga

SEQ ID NO: 2951922 - RNA, 15 nt, Mycobacterium avium subsp. paratuberculosis
gccgcacgcgaacac

SEQ ID NO: 2951923 - RNA, 14 nt, Mycobacterium avium subsp. paratuberculosis
gccgcacgcgaccg

SEQ ID NO: 2951924 - RNA, 15 nt, Mycobacterium avium subsp. paratuberculosis
gccgcacgcgaccgc

SEQ ID NO: 2951925 - RNA, 12 nt, Mycobacterium avium subsp. paratuberculosis
gccgcacggugc

SEQ ID NO: 2951926 - RNA, 14 nt, Mycobacterium avium subsp. paratuberculosis
gccgcacggugcag

SEQ ID NO: 2951927 - RNA, 15 nt, Mycobacterium avium subsp. paratuberculosis
gccgcacggugcagc

SEQ ID NO: 2951928 - RNA, 17 nt, Mycobacterium avium subsp. paratuberculosis
gccgcacggugcagcag

SEQ ID NO: 2951929 - RNA, 20 nt, Mycobacterium avium subsp. paratuberculosis
gccgcacggugcagcagcgc

SEQ ID NO: 2951930 - RNA, 19 nt, Mycobacterium avium subsp. paratuberculosis
gccgcacguauccgcgguc

SEQ ID NO: 2951931 - RNA, 21 nt, Mycobacterium avium subsp. paratuberculosis
gccgcacguauccgcggucga

SEQ ID NO: 2951932 - RNA, 15 nt, Mycobacterium avium subsp. paratuberculosis
gccgcacgucccgcc

SEQ ID NO: 2951933 - RNA, 16 nt, Mycobacterium avium subsp. paratuberculosis
gccgcacgucccgccc

SEQ ID NO: 2951934 - RNA, 18 nt, Mycobacterium avium subsp. paratuberculosis
gccgcacgucccgcccgg

SEQ ID NO: 2951935 - RNA, 20 nt, Mycobacterium avium subsp. paratuberculosis
gccgcacgucccgcccggcg

SEQ ID NO: 2951936 - RNA, 23 nt, Mycobacterium avium subsp. paratuberculosis
gccgcacgucccgcccggcgccg

SEQ ID NO: 2951937 - RNA, 21 nt, Mycobacterium avium subsp. paratuberculosis
gccgcacuccgucgcgaucac

SEQ ID NO: 2951938 - RNA, 19 nt, Mycobacterium avium subsp. paratuberculosis
gccgcacugcacggccucg

SEQ ID NO: 2951939 - RNA, 20 nt, Mycobacterium avium subsp. paratuberculosis
gccgcacugcacggccucgg

SEQ ID NO: 2951940 - RNA, 20 nt, Mycobacterium avium subsp. paratuberculosis
gccgcacugcaucucgaccu

SEQ ID NO: 2951941 - RNA, 21 nt, Mycobacterium avium subsp. paratuberculosis
gccgcacugcaucucgaccug

SEQ ID NO: 2951942 - RNA, 23 nt, Mycobacterium avium subsp. paratuberculosis
gccgcacugcaucucgaccuggg

SEQ ID NO: 2951943 - RNA, 21 nt, Mycobacterium avium subsp. paratuberculosis
gccgcacuuggccucgggcga

SEQ ID NO: 2951944 - RNA, 18 nt, Mycobacterium avium subsp. paratuberculosis
gccgcagaucagggcgau

SEQ ID NO: 2951945 - RNA, 12 nt, Mycobacterium avium subsp. paratuberculosis
gccgcagcacgc

SEQ ID NO: 2951946 - RNA, 19 nt, Mycobacterium avium subsp. paratuberculosis
gccgcagcacgcugaagcc

SEQ ID NO: 2951947 - RNA, 13 nt, Mycobacterium avium subsp. paratuberculosis
gccgcagcacggc

SEQ ID NO: 2951948 - RNA, 21 nt, Mycobacterium avium subsp. paratuberculosis
gccgcaggguggccagcaccg

SEQ ID NO: 2951949 - RNA, 22 nt, Mycobacterium avium subsp. paratuberculosis
gccgcaggguggccagcaccgc

SEQ ID NO: 2951950 - RNA, 14 nt, Mycobacterium avium subsp. paratuberculosis
gccgcaggugcagc

SEQ ID NO: 2951951 - RNA, 15 nt, Mycobacterium avium subsp. paratuberculosis
gccgcaggugcucgc

SEQ ID NO: 2951952 - RNA, 17 nt, Mycobacterium avium subsp. paratuberculosis
gccgcaggugcucgccg

SEQ ID NO: 2951953 - RNA, 21 nt, Mycobacterium avium subsp. paratuberculosis
gccgcaggugcucgccggcgc

SEQ ID NO: 2951954 - RNA, 23 nt, Mycobacterium avium subsp. paratuberculosis
gccgcaggugcucgccggcgcgg

SEQ ID NO: 2951955 - RNA, 14 nt, Mycobacterium avium subsp. paratuberculosis
gccgcagguggugg

SEQ ID NO: 2951956 - RNA, 15 nt, Mycobacterium avium subsp. paratuberculosis
gccgcaggugguggg

SEQ ID NO: 2951957 - RNA, 14 nt, Mycobacterium avium subsp. paratuberculosis
gccgcagucgauca

SEQ ID NO: 2951958 - RNA, 15 nt, Mycobacterium avium subsp. paratuberculosis
gccgcagugccggcg

SEQ ID NO: 2951959 - RNA, 16 nt, Mycobacterium avium subsp. paratuberculosis
gccgcagugccggcgc

SEQ ID NO: 2951960 - RNA, 18 nt, Mycobacterium avium subsp. paratuberculosis
gccgcagugccggcgcac

SEQ ID NO: 2951961 - RNA, 14 nt, Mycobacterium avium subsp. paratuberculosis
gccgcauaccgccc

SEQ ID NO: 2951962 - RNA, 18 nt, Mycobacterium avium subsp. paratuberculosis
gccgcauaccgcccgcgc

SEQ ID NO: 2951963 - RNA, 22 nt, Mycobacterium avium subsp. paratuberculosis
gccgcauaccgcccgcgcuggu

SEQ ID NO: 2951964 - RNA, 12 nt, Mycobacterium avium subsp. paratuberculosis
gccgcauccagc

SEQ ID NO: 2951965 - RNA, 18 nt, Mycobacterium avium subsp. paratuberculosis
gccgcauccagcgccgcc

SEQ ID NO: 2951966 - RNA, 19 nt, Mycobacterium avium subsp. paratuberculosis
gccgcauccagcgccgcca

SEQ ID NO: 2951967 - RNA, 20 nt, Mycobacterium avium subsp. paratuberculosis
gccgcauccagcgccgccaa

SEQ ID NO: 2951968 - RNA, 22 nt, Mycobacterium avium subsp. paratuberculosis
gccgcauccagcgccgccaacc

SEQ ID NO: 2951969 - RNA, 14 nt, Mycobacterium avium subsp. paratuberculosis
gccgcauccgcgag

SEQ ID NO: 2951970 - RNA, 16 nt, Mycobacterium avium subsp. paratuberculosis
gccgcauccgcgagcc

SEQ ID NO: 2951971 - RNA, 17 nt, Mycobacterium avium subsp. paratuberculosis
gccgcauccgcgagccg

SEQ ID NO: 2951972 - RNA, 23 nt, Mycobacterium avium subsp. paratuberculosis
gccgcaucguugguccaggcguu

SEQ ID NO: 2951973 - RNA, 17 nt, Mycobacterium avium subsp. paratuberculosis
gccgcaugaugcggcca

SEQ ID NO: 2951974 - RNA, 20 nt, Mycobacterium avium subsp. paratuberculosis
gccgcaugaugcggccauga

SEQ ID NO: 2951975 - RNA, 19 nt, Mycobacterium avium subsp. paratuberculosis
gccgcauggugcggguguc

SEQ ID NO: 2951976 - RNA, 21 nt, Mycobacterium avium subsp. paratuberculosis
gccgcauggugcggguguccg

SEQ ID NO: 2951977 - RNA, 18 nt, Mycobacterium avium subsp. paratuberculosis
gccgcaugucgaccucgg

SEQ ID NO: 2951978 - RNA, 22 nt, Mycobacterium avium subsp. paratuberculosis
gccgcaugucgaccucggccac

SEQ ID NO: 2951979 - RNA, 23 nt, Mycobacterium avium subsp. paratuberculosis
gccgcaugucgaccucggccacc

SEQ ID NO: 2951980 - RNA, 23 nt, Mycobacterium avium subsp. paratuberculosis
gccgcauguugugcccgacggcg

SEQ ID NO: 2951981 - RNA, 15 nt, Mycobacterium avium subsp. paratuberculosis
gccgcauuccucggc

SEQ ID NO: 2951982 - RNA, 17 nt, Mycobacterium avium subsp. paratuberculosis
gccgcauuccucggcca

SEQ ID NO: 2951983 - RNA, 18 nt, Mycobacterium avium subsp. paratuberculosis
gccgcauuccucggccag

SEQ ID NO: 2951984 - RNA, 21 nt, Mycobacterium avium subsp. paratuberculosis
gccgcauuggcaccgucgacc

SEQ ID NO: 2951985 - RNA, 17 nt, Mycobacterium avium subsp. paratuberculosis
gccgcauuggugccggc

SEQ ID NO: 2951986 - RNA, 20 nt, Mycobacterium avium subsp. paratuberculosis
gccgcauuggugccggccuc

SEQ ID NO: 2951987 - RNA, 17 nt, Mycobacterium avium subsp. paratuberculosis
gccgccaaaucgaucac

SEQ ID NO: 2951988 - RNA, 17 nt, Mycobacterium avium subsp. paratuberculosis
gccgccaaccaggucgc

SEQ ID NO: 2951989 - RNA, 20 nt, Mycobacterium avium subsp. paratuberculosis
gccgccaaccaggucgcggc

SEQ ID NO: 2951990 - RNA, 21 nt, Mycobacterium avium subsp. paratuberculosis
gccgccaaccaggucgcggcg

SEQ ID NO: 2951991 - RNA, 22 nt, Mycobacterium avium subsp. paratuberculosis
gccgccaaccaggucgcggcgc

SEQ ID NO: 2951992 - RNA, 23 nt, Mycobacterium avium subsp. paratuberculosis
gccgccaaccaggucgcggcgcu

SEQ ID NO: 2951993 - RNA, 18 nt, Mycobacterium avium subsp. paratuberculosis
gccgccaagugcggugug

SEQ ID NO: 2951994 - RNA, 14 nt, Mycobacterium avium subsp. paratuberculosis
gccgccacagcgcc

SEQ ID NO: 2951995 - RNA, 20 nt, Mycobacterium avium subsp. paratuberculosis
gccgccacagcgccucgcgg

SEQ ID NO: 2951996 - RNA, 23 nt, Mycobacterium avium subsp. paratuberculosis
gccgccacagcgccucgcggucg

SEQ ID NO: 2951997 - RNA, 21 nt, Mycobacterium avium subsp. paratuberculosis
gccgccaccaacaucgacgug

SEQ ID NO: 2951998 - RNA, 22 nt, Mycobacterium avium subsp. paratuberculosis
gccgccaccaacaucgacgugc

SEQ ID NO: 2951999 - RNA, 23 nt, Mycobacterium avium subsp. paratuberculosis
gccgccaccaacaucgacgugcc

SEQ ID NO: 2952000 - RNA, 19 nt, Mycobacterium avium subsp. paratuberculosis
gccgccaccacgauguuga

SEQ ID NO: 2952001 - RNA, 14 nt, Mycobacterium avium subsp. paratuberculosis
gccgccaccacggc

SEQ ID NO: 2952002 - RNA, 15 nt, Mycobacterium avium subsp. paratuberculosis
gccgccaccacggca

SEQ ID NO: 2952003 - RNA, 16 nt, Mycobacterium avium subsp. paratuberculosis
gccgccaccacggcag

SEQ ID NO: 2952004 - RNA, 21 nt, Mycobacterium avium subsp. paratuberculosis
gccgccaccaggcugaacguc

SEQ ID NO: 2952005 - RNA, 13 nt, Mycobacterium avium subsp. paratuberculosis
gccgccaccccag

SEQ ID NO: 2952006 - RNA, 15 nt, Mycobacterium avium subsp. paratuberculosis
gccgccaccccaggc

SEQ ID NO: 2952007 - RNA, 17 nt, Mycobacterium avium subsp. paratuberculosis
gccgccaccccaggcga

SEQ ID NO: 2952008 - RNA, 13 nt, Mycobacterium avium subsp. paratuberculosis
gccgccaccgagg

SEQ ID NO: 2952009 - RNA, 13 nt, Mycobacterium avium subsp. paratuberculosis
gccgccaccgcca

SEQ ID NO: 2952010 - RNA, 14 nt, Mycobacterium avium subsp. paratuberculosis
gccgccaccgccau

SEQ ID NO: 2952011 - RNA, 19 nt, Mycobacterium avium subsp. paratuberculosis
gccgccaccgccaucucgg

SEQ ID NO: 2952012 - RNA, 21 nt, Mycobacterium avium subsp. paratuberculosis
gccgccaccgcgaaagcgucg

SEQ ID NO: 2952013 - RNA, 12 nt, Mycobacterium avium subsp. paratuberculosis
gccgccaccggc

SEQ ID NO: 2952014 - RNA, 13 nt, Mycobacterium avium subsp. paratuberculosis
gccgccaccggcc

SEQ ID NO: 2952015 - RNA, 14 nt, Mycobacterium avium subsp. paratuberculosis
gccgccaccggccg

SEQ ID NO: 2952016 - RNA, 15 nt, Mycobacterium avium subsp. paratuberculosis
gccgccaccggccgg

SEQ ID NO: 2952017 - RNA, 18 nt, Mycobacterium avium subsp. paratuberculosis
gccgccaccggccggucc

SEQ ID NO: 2952018 - RNA, 14 nt, Mycobacterium avium subsp. paratuberculosis
gccgccaccgucgc

SEQ ID NO: 2952019 - RNA, 22 nt, Mycobacterium avium subsp. paratuberculosis
gccgccaccgucgccggcugac

SEQ ID NO: 2952020 - RNA, 14 nt, Mycobacterium avium subsp. paratuberculosis
gccgccacgcggcg

SEQ ID NO: 2952021 - RNA, 18 nt, Mycobacterium avium subsp. paratuberculosis
gccgccacgcggcgcgca

SEQ ID NO: 2952022 - RNA, 17 nt, Mycobacterium avium subsp. paratuberculosis
gccgccacgcuggugug

SEQ ID NO: 2952023 - RNA, 20 nt, Mycobacterium avium subsp. paratuberculosis
gccgccacgcuggugugacg

SEQ ID NO: 2952024 - RNA, 16 nt, Mycobacterium avium subsp. paratuberculosis
gccgccacggccaccg

SEQ ID NO: 2952025 - RNA, 22 nt, Mycobacterium avium subsp. paratuberculosis
gccgccacggcgccaugcgccg

SEQ ID NO: 2952026 - RNA, 21 nt, Mycobacterium avium subsp. paratuberculosis
gccgccacggggcccgcgacc

SEQ ID NO: 2952027 - RNA, 22 nt, Mycobacterium avium subsp. paratuberculosis
gccgccacguccggaugcggcg

SEQ ID NO: 2952028 - RNA, 23 nt, Mycobacterium avium subsp. paratuberculosis
gccgccacucauguucagggugc

SEQ ID NO: 2952029 - RNA, 12 nt, Mycobacterium avium subsp. paratuberculosis
gccgccagcacc

SEQ ID NO: 2952030 - RNA, 16 nt, Mycobacterium avium subsp. paratuberculosis
gccgccagcaccaccg

SEQ ID NO: 2952031 - RNA, 17 nt, Mycobacterium avium subsp. paratuberculosis
gccgccagcaccaccgu

SEQ ID NO: 2952032 - RNA, 17 nt, Mycobacterium avium subsp. paratuberculosis
gccgcccaggcgggcca

SEQ ID NO: 2952033 - RNA, 19 nt, Mycobacterium avium subsp. paratuberculosis
gccgcccaggcgggccagc

SEQ ID NO: 2952034 - RNA, 16 nt, Mycobacterium avium subsp. paratuberculosis
gccgcccagucgccgc

SEQ ID NO: 2952035 - RNA, 17 nt, Mycobacterium avium subsp. paratuberculosis
gccgcccaucaccccga

SEQ ID NO: 2952036 - RNA, 20 nt, Mycobacterium avium subsp. paratuberculosis
gccgcccaucaccccgaagc

SEQ ID NO: 2952037 - RNA, 17 nt, Mycobacterium avium subsp. paratuberculosis
gccgcccaucagcagga

SEQ ID NO: 2952038 - RNA, 22 nt, Mycobacterium avium subsp. paratuberculosis
gccgcccaucgaccggaugaug

SEQ ID NO: 2952039 - RNA, 22 nt, Mycobacterium avium subsp. paratuberculosis
gccgcccccgauagccccgcca

SEQ ID NO: 2952040 - RNA, 20 nt, Mycobacterium avium subsp. paratuberculosis
gccgcccccgcccacagcgg

SEQ ID NO: 2952041 - RNA, 15 nt, Mycobacterium avium subsp. paratuberculosis
gccgcccccgccgcg

SEQ ID NO: 2952042 - RNA, 16 nt, Mycobacterium avium subsp. paratuberculosis
gccgcccccgccgcga

SEQ ID NO: 2952043 - RNA, 17 nt, Mycobacterium avium subsp. paratuberculosis
gccgcccccgccgcgag

SEQ ID NO: 2952044 - RNA, 14 nt, Mycobacterium avium subsp. paratuberculosis
gccgcccccgcggc

SEQ ID NO: 2952045 - RNA, 15 nt, Mycobacterium avium subsp. paratuberculosis
gccgcccccgcggcg

SEQ ID NO: 2952046 - RNA, 14 nt, Mycobacterium avium subsp. paratuberculosis
gccgccccgaacag

SEQ ID NO: 2952047 - RNA, 19 nt, Mycobacterium avium subsp. paratuberculosis
gccgccccgaacagcgcca

SEQ ID NO: 2952048 - RNA, 20 nt, Mycobacterium avium subsp. paratuberculosis
gccgccccgaacagcgccag

SEQ ID NO: 2952049 - RNA, 22 nt, Mycobacterium avium subsp. paratuberculosis
gccgccccgaacagcgccaggg

SEQ ID NO: 2952050 - RNA, 21 nt, Mycobacterium avium subsp. paratuberculosis
gccgccccgaucggauccgcc

SEQ ID NO: 2952051 - RNA, 21 nt, Mycobacterium avium subsp. paratuberculosis
gccgccccggccgcgcaccgc

SEQ ID NO: 2952052 - RNA, 19 nt, Mycobacterium avium subsp. paratuberculosis
gccgccccgucggucgggc

SEQ ID NO: 2952053 - RNA, 17 nt, Mycobacterium avium subsp. paratuberculosis
gccgcccgacccgucca

SEQ ID NO: 2952054 - RNA, 14 nt, Mycobacterium avium subsp. paratuberculosis
gccgcccgcaccag

SEQ ID NO: 2952055 - RNA, 15 nt, Mycobacterium avium subsp. paratuberculosis
gccgcccgcaccagc

SEQ ID NO: 2952056 - RNA, 17 nt, Mycobacterium avium subsp. paratuberculosis
gccgcccgcaccugcgc

SEQ ID NO: 2952057 - RNA, 22 nt, Mycobacterium avium subsp. paratuberculosis
gccgcccgcaccugcgcgccgu

SEQ ID NO: 2952058 - RNA, 22 nt, Mycobacterium avium subsp. paratuberculosis
gccgcccgcaguucggccgccg

SEQ ID NO: 2952059 - RNA, 22 nt, Mycobacterium avium subsp. paratuberculosis
gccgcccgcccgagcgucauuc

SEQ ID NO: 2952060 - RNA, 13 nt, Mycobacterium avium subsp. paratuberculosis
gccgcccgcgcgg

SEQ ID NO: 2952061 - RNA, 19 nt, Mycobacterium avium subsp. paratuberculosis
gccgcccgcgcggcggcca

SEQ ID NO: 2952062 - RNA, 15 nt, Mycobacterium avium subsp. paratuberculosis
gccgcccgcgcgugg

SEQ ID NO: 2952063 - RNA, 20 nt, Mycobacterium avium subsp. paratuberculosis
gccgcccgcgcgugguccca

SEQ ID NO: 2952064 - RNA, 24 nt, Mycobacterium avium subsp. paratuberculosis
gccgcccgcuccugcaggccgagc

SEQ ID NO: 2952065 - RNA, 12 nt, Mycobacterium avium subsp. paratuberculosis
gccgcccggacc

SEQ ID NO: 2952066 - RNA, 14 nt, Mycobacterium avium subsp. paratuberculosis
gccgcccggaccgc

SEQ ID NO: 2952067 - RNA, 16 nt, Mycobacterium avium subsp. paratuberculosis
gccgcccggaccgcgg

SEQ ID NO: 2952068 - RNA, 21 nt, Mycobacterium avium subsp. paratuberculosis
gccgcccggagguucgccgga

SEQ ID NO: 2952069 - RNA, 13 nt, Mycobacterium avium subsp. paratuberculosis
gccgcccggccca

SEQ ID NO: 2952070 - RNA, 21 nt, Mycobacterium avium subsp. paratuberculosis
gccgcccggcccaagacccgc

SEQ ID NO: 2952071 - RNA, 13 nt, Mycobacterium avium subsp. paratuberculosis
gccgcccggcgag

SEQ ID NO: 2952072 - RNA, 14 nt, Mycobacterium avium subsp. paratuberculosis
gccgcccggcgagc

SEQ ID NO: 2952073 - RNA, 22 nt, Mycobacterium avium subsp. paratuberculosis
gccgcccggcgaucucggagac

SEQ ID NO: 2952074 - RNA, 17 nt, Mycobacterium avium subsp. paratuberculosis
gccgcccggcgccccgc

SEQ ID NO: 2952075 - RNA, 13 nt, Mycobacterium avium subsp. paratuberculosis
gccgcccggcgcg

SEQ ID NO: 2952076 - RNA, 14 nt, Mycobacterium avium subsp. paratuberculosis
gccgcccggcgcgc

SEQ ID NO: 2952077 - RNA, 17 nt, Mycobacterium avium subsp. paratuberculosis
gccgcccggcgcgccgc

SEQ ID NO: 2952078 - RNA, 13 nt, Mycobacterium avium subsp. paratuberculosis
gccgcccgggccc

SEQ ID NO: 2952079 - RNA, 14 nt, Mycobacterium avium subsp. paratuberculosis
gccgcccgggcccg

SEQ ID NO: 2952080 - RNA, 16 nt, Mycobacterium avium subsp. paratuberculosis
gccgcccgggccgcgc

SEQ ID NO: 2952081 - RNA, 17 nt, Mycobacterium avium subsp. paratuberculosis
gccgcccgggccgcgcc

SEQ ID NO: 2952082 - RNA, 19 nt, Mycobacterium avium subsp. paratuberculosis
gccgcccgggccgcgccca

SEQ ID NO: 2952083 - RNA, 12 nt, Mycobacterium avium subsp. paratuberculosis
gccgcccgggcg

SEQ ID NO: 2952084 - RNA, 14 nt, Mycobacterium avium subsp. paratuberculosis
gccgcccgggcggc

SEQ ID NO: 2952085 - RNA, 19 nt, Mycobacterium avium subsp. paratuberculosis
gccgcccgggcggcccgca

SEQ ID NO: 2952086 - RNA, 18 nt, Mycobacterium avium subsp. paratuberculosis
gccgcccgggcggcccgg

SEQ ID NO: 2952087 - RNA, 13 nt, Mycobacterium avium subsp. paratuberculosis
gccgcccgguccg

SEQ ID NO: 2952088 - RNA, 15 nt, Mycobacterium avium subsp. paratuberculosis
gccgcccgucagccc

SEQ ID NO: 2952089 - RNA, 18 nt, Mycobacterium avium subsp. paratuberculosis
gccgcccgucagccccuu

SEQ ID NO: 2952090 - RNA, 15 nt, Mycobacterium avium subsp. paratuberculosis
gccgcccguccagcg

SEQ ID NO: 2952091 - RNA, 22 nt, Mycobacterium avium subsp. paratuberculosis
gccgcccguccagcgcaugcca

SEQ ID NO: 2952092 - RNA, 17 nt, Mycobacterium avium subsp. paratuberculosis
gccgcccguccgggccg

SEQ ID NO: 2952093 - RNA, 14 nt, Mycobacterium avium subsp. paratuberculosis
gccgcccguccugg

SEQ ID NO: 2952094 - RNA, 24 nt, Mycobacterium avium subsp. paratuberculosis
gccgcccguccuggaugaacagca

SEQ ID NO: 2952095 - RNA, 22 nt, Mycobacterium avium subsp. paratuberculosis
gccgcccgucgccuccugcugg

SEQ ID NO: 2952096 - RNA, 13 nt, Mycobacterium avium subsp. paratuberculosis
gccgcccgucggg

SEQ ID NO: 2952097 - RNA, 15 nt, Mycobacterium avium subsp. paratuberculosis
gccgcccgucggggc

SEQ ID NO: 2952098 - RNA, 16 nt, Mycobacterium avium subsp. paratuberculosis
gccgcccucgcugccg

SEQ ID NO: 2952099 - RNA, 13 nt, Mycobacterium avium subsp. paratuberculosis
gccgcccucggcc

SEQ ID NO: 2952100 - RNA, 14 nt, Mycobacterium avium subsp. paratuberculosis
gccgcccucggccg

SEQ ID NO: 2952101 - RNA, 18 nt, Mycobacterium avium subsp. paratuberculosis
gccgcccucggccguacc

SEQ ID NO: 2952102 - RNA, 19 nt, Mycobacterium avium subsp. paratuberculosis
gccgcccugcccgucgggc

SEQ ID NO: 2952103 - RNA, 12 nt, Mycobacterium avium subsp. paratuberculosis
gccgcccugcgg

SEQ ID NO: 2952104 - RNA, 23 nt, Mycobacterium avium subsp. paratuberculosis
gccgcccuuguugaugguguugc

SEQ ID NO: 2952105 - RNA, 19 nt, Mycobacterium avium subsp. paratuberculosis
gccgccgaaagccuccgcg

SEQ ID NO: 2952106 - RNA, 16 nt, Mycobacterium avium subsp. paratuberculosis
gccgccgaacagcagc

SEQ ID NO: 2952107 - RNA, 17 nt, Mycobacterium avium subsp. paratuberculosis
gccgccgaacagccggg

SEQ ID NO: 2952108 - RNA, 19 nt, Mycobacterium avium subsp. paratuberculosis
gccgccgaaccccagcucc

SEQ ID NO: 2952109 - RNA, 17 nt, Mycobacterium avium subsp. paratuberculosis
gccgccgaagcccgaca

SEQ ID NO: 2952110 - RNA, 19 nt, Mycobacterium avium subsp. paratuberculosis
gccgccgaagcccgacauc

SEQ ID NO: 2952111 - RNA, 21 nt, Mycobacterium avium subsp. paratuberculosis
gccgccgaagcccgagcguca

SEQ ID NO: 2952112 - RNA, 17 nt, Mycobacterium avium subsp. paratuberculosis
gccgccgaagcggcgca

SEQ ID NO: 2952113 - RNA, 18 nt, Mycobacterium avium subsp. paratuberculosis
gccgccgaagcggcgcac

SEQ ID NO: 2952114 - RNA, 14 nt, Mycobacterium avium subsp. paratuberculosis
gccgccgacaccac

SEQ ID NO: 2952115 - RNA, 15 nt, Mycobacterium avium subsp. paratuberculosis
gccgccgacaccacc

SEQ ID NO: 2952116 - RNA, 20 nt, Mycobacterium avium subsp. paratuberculosis
gccgccgacaccaccacgaa

SEQ ID NO: 2952117 - RNA, 14 nt, Mycobacterium avium subsp. paratuberculosis
gccgccgcgacgcc

SEQ ID NO: 2952118 - RNA, 15 nt, Mycobacterium avium subsp. paratuberculosis
gccgccgcgacgccg

SEQ ID NO: 2952119 - RNA, 20 nt, Mycobacterium avium subsp. paratuberculosis
gccgccgcgaucagggccca

SEQ ID NO: 2952120 - RNA, 22 nt, Mycobacterium avium subsp. paratuberculosis
gccgccgcgaucuugccgccgc

SEQ ID NO: 2952121 - RNA, 14 nt, Mycobacterium avium subsp. paratuberculosis
gccgccgcgcaccg

SEQ ID NO: 2952122 - RNA, 15 nt, Mycobacterium avium subsp. paratuberculosis
gccgccgcgcaggcc

SEQ ID NO: 2952123 - RNA, 18 nt, Mycobacterium avium subsp. paratuberculosis
gccgccgcgcauccgcac

SEQ ID NO: 2952124 - RNA, 23 nt, Mycobacterium avium subsp. paratuberculosis
gccgccgcgcauccgcaccgaga

SEQ ID NO: 2952125 - RNA, 12 nt, Mycobacterium avium subsp. paratuberculosis
gccgccgcgcgc

SEQ ID NO: 2952126 - RNA, 15 nt, Mycobacterium avium subsp. paratuberculosis
gccgccgcgcgcggc

SEQ ID NO: 2952127 - RNA, 17 nt, Mycobacterium avium subsp. paratuberculosis
gccgccgcgcgcggcca

SEQ ID NO: 2952128 - RNA, 22 nt, Mycobacterium avium subsp. paratuberculosis
gccgccgcgcggguacggcggc

SEQ ID NO: 2952129 - RNA, 19 nt, Mycobacterium avium subsp. paratuberculosis
gccgccgcggagcggcggu

SEQ ID NO: 2952130 - RNA, 23 nt, Mycobacterium avium subsp. paratuberculosis
gccgccgcggaucuucuccgcca

SEQ ID NO: 2952131 - RNA, 15 nt, Mycobacterium avium subsp. paratuberculosis
gccgccgcggcaccu

SEQ ID NO: 2952132 - RNA, 16 nt, Mycobacterium avium subsp. paratuberculosis
gccgccgcggccacac

SEQ ID NO: 2952133 - RNA, 15 nt, Mycobacterium avium subsp. paratuberculosis
gccgccgcggccgcg

SEQ ID NO: 2952134 - RNA, 13 nt, Mycobacterium avium subsp. paratuberculosis
gccgccgcggguc

SEQ ID NO: 2952135 - RNA, 16 nt, Mycobacterium avium subsp. paratuberculosis
gccgccgcgggucggc

SEQ ID NO: 2952136 - RNA, 18 nt, Mycobacterium avium subsp. paratuberculosis
gccgccgcgggucggcga

SEQ ID NO: 2952137 - RNA, 20 nt, Mycobacterium avium subsp. paratuberculosis
gccgccgcggguggccagcc

SEQ ID NO: 2952138 - RNA, 21 nt, Mycobacterium avium subsp. paratuberculosis
gccgccgcguaggccaggacc

SEQ ID NO: 2952139 - RNA, 18 nt, Mycobacterium avium subsp. paratuberculosis
gccgccgcgucgccgccg

SEQ ID NO: 2952140 - RNA, 13 nt, Mycobacterium avium subsp. paratuberculosis
gccgccgcgucgu

SEQ ID NO: 2952141 - RNA, 18 nt, Mycobacterium avium subsp. paratuberculosis
gccgccgcgucgugccga

SEQ ID NO: 2952142 - RNA, 12 nt, Mycobacterium avium subsp. paratuberculosis
gccgccgcgugg

SEQ ID NO: 2952143 - RNA, 14 nt, Mycobacterium avium subsp. paratuberculosis
gccgccgcguggcc

SEQ ID NO: 2952144 - RNA, 18 nt, Mycobacterium avium subsp. paratuberculosis
gccgccgcuagucgccca

SEQ ID NO: 2952145 - RNA, 20 nt, Mycobacterium avium subsp. paratuberculosis
gccgccgcuagucgcccagc

SEQ ID NO: 2952146 - RNA, 13 nt, Mycobacterium avium subsp. paratuberculosis
gccgccgcuggag

SEQ ID NO: 2952147 - RNA, 15 nt, Mycobacterium avium subsp. paratuberculosis
gccgccggaucggca

SEQ ID NO: 2952148 - RNA, 21 nt, Mycobacterium avium subsp. paratuberculosis
gccgccggaucgugucccggc

SEQ ID NO: 2952149 - RNA, 22 nt, Mycobacterium avium subsp. paratuberculosis
gccgccggaucgugucccggcg

SEQ ID NO: 2952150 - RNA, 20 nt, Mycobacterium avium subsp. paratuberculosis
gccgccggauuacucgccgg

SEQ ID NO: 2952151 - RNA, 13 nt, Mycobacterium avium subsp. paratuberculosis
gccgccggccacc

SEQ ID NO: 2952152 - RNA, 14 nt, Mycobacterium avium subsp. paratuberculosis
gccgccggccacca

SEQ ID NO: 2952153 - RNA, 13 nt, Mycobacterium avium subsp. paratuberculosis
gccgccggccagc

SEQ ID NO: 2952154 - RNA, 12 nt, Mycobacterium avium subsp. paratuberculosis
gccgccggccgc

SEQ ID NO: 2952155 - RNA, 13 nt, Mycobacterium avium subsp. paratuberculosis
gccgccggccgcg

SEQ ID NO: 2952156 - RNA, 14 nt, Mycobacterium avium subsp. paratuberculosis
gccgccggccgcgc

SEQ ID NO: 2952157 - RNA, 16 nt, Mycobacterium avium subsp. paratuberculosis
gccgccggccgcgcag

SEQ ID NO: 2952158 - RNA, 15 nt, Mycobacterium avium subsp. paratuberculosis
gccgccggccgcggc

SEQ ID NO: 2952159 - RNA, 17 nt, Mycobacterium avium subsp. paratuberculosis
gccgccggccgcucgcg

SEQ ID NO: 2952160 - RNA, 17 nt, Mycobacterium avium subsp. paratuberculosis
gccgccggccucggggu

SEQ ID NO: 2952161 - RNA, 12 nt, Mycobacterium avium subsp. paratuberculosis
gccgccggcgau

SEQ ID NO: 2952162 - RNA, 18 nt, Mycobacterium avium subsp. paratuberculosis
gccgccggcgaucucguc

SEQ ID NO: 2952163 - RNA, 21 nt, Mycobacterium avium subsp. paratuberculosis
gccgccggcgaucucgucgcg

SEQ ID NO: 2952164 - RNA, 13 nt, Mycobacterium avium subsp. paratuberculosis
gccgccggcgcag

SEQ ID NO: 2952165 - RNA, 14 nt, Mycobacterium avium subsp. paratuberculosis
gccgccggcgcccu

SEQ ID NO: 2952166 - RNA, 17 nt, Mycobacterium avium subsp. paratuberculosis
gccgccggcgcccugcg

SEQ ID NO: 2952167 - RNA, 18 nt, Mycobacterium avium subsp. paratuberculosis
gccgccggcgcccugcgc

SEQ ID NO: 2952168 - RNA, 14 nt, Mycobacterium avium subsp. paratuberculosis
gccgccggcgcggu

SEQ ID NO: 2952169 - RNA, 13 nt, Mycobacterium avium subsp. paratuberculosis
gccgccggcgcug

SEQ ID NO: 2952170 - RNA, 17 nt, Mycobacterium avium subsp. paratuberculosis
gccgccggcgcuggcgc

SEQ ID NO: 2952171 - RNA, 19 nt, Mycobacterium avium subsp. paratuberculosis
gccgccggcgcuggcgcgc

SEQ ID NO: 2952172 - RNA, 13 nt, Mycobacterium avium subsp. paratuberculosis
gccgccggcggcc

SEQ ID NO: 2952173 - RNA, 15 nt, Mycobacterium avium subsp. paratuberculosis
gccgccggcggccaa

SEQ ID NO: 2952174 - RNA, 16 nt, Mycobacterium avium subsp. paratuberculosis
gccgccggcgguggcg

SEQ ID NO: 2952175 - RNA, 20 nt, Mycobacterium avium subsp. paratuberculosis
gccgccggcgguggcguagc

SEQ ID NO: 2952176 - RNA, 12 nt, Mycobacterium avium subsp. paratuberculosis
gccgccggcguc

SEQ ID NO: 2952177 - RNA, 14 nt, Mycobacterium avium subsp. paratuberculosis
gccgccggcgucga

SEQ ID NO: 2952178 - RNA, 18 nt, Mycobacterium avium subsp. paratuberculosis
gccgccggcgucgacguc

SEQ ID NO: 2952179 - RNA, 14 nt, Mycobacterium avium subsp. paratuberculosis
gccgccggcgucgc

SEQ ID NO: 2952180 - RNA, 18 nt, Mycobacterium avium subsp. paratuberculosis
gccgccggcgucgccgcu

SEQ ID NO: 2952181 - RNA, 14 nt, Mycobacterium avium subsp. paratuberculosis
gccgccggcucagc

SEQ ID NO: 2952182 - RNA, 16 nt, Mycobacterium avium subsp. paratuberculosis
gccgccggcucagcgg

SEQ ID NO: 2952183 - RNA, 17 nt, Mycobacterium avium subsp. paratuberculosis
gccgccggcucagcggc

SEQ ID NO: 2952184 - RNA, 13 nt, Mycobacterium avium subsp. paratuberculosis
gccgccgggaaca

SEQ ID NO: 2952185 - RNA, 20 nt, Mycobacterium avium subsp. paratuberculosis
gccgccgggaacagcgacgc

SEQ ID NO: 2952186 - RNA, 23 nt, Mycobacterium avium subsp. paratuberculosis
gccgccgggaacagcgacgccca

SEQ ID NO: 2952187 - RNA, 15 nt, Mycobacterium avium subsp. paratuberculosis
gccgccgggacgggc

SEQ ID NO: 2952188 - RNA, 20 nt, Mycobacterium avium subsp. paratuberculosis
gccgccgggacgggcauccg

SEQ ID NO: 2952189 - RNA, 20 nt, Mycobacterium avium subsp. paratuberculosis
gccgccgggauaacccagca

SEQ ID NO: 2952190 - RNA, 21 nt, Mycobacterium avium subsp. paratuberculosis
gccgccgggauaacccagcac

SEQ ID NO: 2952191 - RNA, 23 nt, Mycobacterium avium subsp. paratuberculosis
gccgccgggauaacccagcacca

SEQ ID NO: 2952192 - RNA, 13 nt, Mycobacterium avium subsp. paratuberculosis
gccgccgggcacc

SEQ ID NO: 2952193 - RNA, 14 nt, Mycobacterium avium subsp. paratuberculosis
gccgccgggcaccu

SEQ ID NO: 2952194 - RNA, 15 nt, Mycobacterium avium subsp. paratuberculosis
gccgccgggccacgc

SEQ ID NO: 2952195 - RNA, 17 nt, Mycobacterium avium subsp. paratuberculosis
gccgccgggccacgccg

SEQ ID NO: 2952196 - RNA, 20 nt, Mycobacterium avium subsp. paratuberculosis
gccgccgggccacgccgacu

SEQ ID NO: 2952197 - RNA, 22 nt, Mycobacterium avium subsp. paratuberculosis
gccgccgggccacgccgacuag

SEQ ID NO: 2952198 - RNA, 13 nt, Mycobacterium avium subsp. paratuberculosis
gccgccgggccag

SEQ ID NO: 2952199 - RNA, 20 nt, Mycobacterium avium subsp. paratuberculosis
gccgccgggccaggugugcc

SEQ ID NO: 2952200 - RNA, 12 nt, Mycobacterium avium subsp. paratuberculosis
gccgccgggccg

SEQ ID NO: 2952201 - RNA, 13 nt, Mycobacterium avium subsp. paratuberculosis
gccgccgggccgc

SEQ ID NO: 2952202 - RNA, 12 nt, Mycobacterium avium subsp. paratuberculosis
gccgccugagcc

SEQ ID NO: 2952203 - RNA, 15 nt, Mycobacterium avium subsp. paratuberculosis
gccgccugcccgggc

SEQ ID NO: 2952204 - RNA, 23 nt, Mycobacterium avium subsp. paratuberculosis
gccgccugcccgggcgccgagaa

SEQ ID NO: 2952205 - RNA, 16 nt, Mycobacterium avium subsp. paratuberculosis
gccgccugcgcgccgu

SEQ ID NO: 2952206 - RNA, 20 nt, Mycobacterium avium subsp. paratuberculosis
gccgccugcgcgccgucggc

SEQ ID NO: 2952207 - RNA, 22 nt, Mycobacterium avium subsp. paratuberculosis
gccgccugcgcgccgucggcga

SEQ ID NO: 2952208 - RNA, 23 nt, Mycobacterium avium subsp. paratuberculosis
gccgccugcggguucuggccgug

SEQ ID NO: 2952209 - RNA, 20 nt, Mycobacterium avium subsp. paratuberculosis
gccgccuucacgaccggcag

SEQ ID NO: 2952210 - RNA, 21 nt, Mycobacterium avium subsp. paratuberculosis
gccgccuucacgaccggcagc

SEQ ID NO: 2952211 - RNA, 19 nt, Mycobacterium avium subsp. paratuberculosis
gccgccuucuugcgcggcg

SEQ ID NO: 2952212 - RNA, 14 nt, Mycobacterium avium subsp. paratuberculosis
gccgccuugacgcc

SEQ ID NO: 2952213 - RNA, 19 nt, Mycobacterium avium subsp. paratuberculosis
gccgccuugacgccgggca

SEQ ID NO: 2952214 - RNA, 14 nt, Mycobacterium avium subsp. paratuberculosis
gccgccuugggccg

SEQ ID NO: 2952215 - RNA, 11 nt, Mycobacterium avium subsp. paratuberculosis
gccgccuuggu

SEQ ID NO: 2952216 - RNA, 18 nt, Mycobacterium avium subsp. paratuberculosis
gccgcgaaaauaccgccg

SEQ ID NO: 2952217 - RNA, 21 nt, Mycobacterium avium subsp. paratuberculosis
gccgcgaaaauaccgccggcc

SEQ ID NO: 2952218 - RNA, 21 nt, Mycobacterium avium subsp. paratuberculosis
gccgcgaacaauuccucugcg

SEQ ID NO: 2952219 - RNA, 16 nt, Mycobacterium avium subsp. paratuberculosis
gccgcgaacgacgacc

SEQ ID NO: 2952220 - RNA, 17 nt, Mycobacterium avium subsp. paratuberculosis
gccgcgaacgccucggc

SEQ ID NO: 2952221 - RNA, 18 nt, Mycobacterium avium subsp. paratuberculosis
gccgcgaacgccucggcg

SEQ ID NO: 2952222 - RNA, 19 nt, Mycobacterium avium subsp. paratuberculosis
gccgcgaacgccucggcga

SEQ ID NO: 2952223 - RNA, 15 nt, Mycobacterium avium subsp. paratuberculosis
gccgcgaacggcccg

SEQ ID NO: 2952224 - RNA, 17 nt, Mycobacterium avium subsp. paratuberculosis
gccgcgaacggcccgcc

SEQ ID NO: 2952225 - RNA, 20 nt, Mycobacterium avium subsp. paratuberculosis
gccgcgaacggcccgccgcc

SEQ ID NO: 2952226 - RNA, 18 nt, Mycobacterium avium subsp. paratuberculosis
gccgcgaacgggucgggg

SEQ ID NO: 2952227 - RNA, 22 nt, Mycobacterium avium subsp. paratuberculosis
gccgcgaacgggugaccggcgg

SEQ ID NO: 2952228 - RNA, 23 nt, Mycobacterium avium subsp. paratuberculosis
gccgcgaacgggugaccggcggc

SEQ ID NO: 2952229 - RNA, 17 nt, Mycobacterium avium subsp. paratuberculosis
gccgcgaacucaggcgc

SEQ ID NO: 2952230 - RNA, 18 nt, Mycobacterium avium subsp. paratuberculosis
gccgcgaacucaggcgcg

SEQ ID NO: 2952231 - RNA, 20 nt, Mycobacterium avium subsp. paratuberculosis
gccgcgaacucaggcgcgca

SEQ ID NO: 2952232 - RNA, 19 nt, Mycobacterium avium subsp. paratuberculosis
gccgcgaagaugucgccgu

SEQ ID NO: 2952233 - RNA, 22 nt, Mycobacterium avium subsp. paratuberculosis
gccgcgaagaugucgccguaca

SEQ ID NO: 2952234 - RNA, 17 nt, Mycobacterium avium subsp. paratuberculosis
gccgcgaaggcggcguc

SEQ ID NO: 2952235 - RNA, 21 nt, Mycobacterium avium subsp. paratuberculosis
gccgcgaaggcggcgucgaug

SEQ ID NO: 2952236 - RNA, 17 nt, Mycobacterium avium subsp. paratuberculosis
gccgcgaauucggcgau

SEQ ID NO: 2952237 - RNA, 18 nt, Mycobacterium avium subsp. paratuberculosis
gccgcgaauucggcgaug

SEQ ID NO: 2952238 - RNA, 21 nt, Mycobacterium avium subsp. paratuberculosis
gccgcgacacccgcgacgaca

SEQ ID NO: 2952239 - RNA, 15 nt, Mycobacterium avium subsp. paratuberculosis
gccgcgacacgugca

SEQ ID NO: 2952240 - RNA, 13 nt, Mycobacterium avium subsp. paratuberculosis
gccgcgacagccg

SEQ ID NO: 2952241 - RNA, 17 nt, Mycobacterium avium subsp. paratuberculosis
gccgcgacagccgcccg

SEQ ID NO: 2952242 - RNA, 19 nt, Mycobacterium avium subsp. paratuberculosis
gccgcgacagccgcccggc

SEQ ID NO: 2952243 - RNA, 14 nt, Mycobacterium avium subsp. paratuberculosis
gccgcgacagccgg

SEQ ID NO: 2952244 - RNA, 15 nt, Mycobacterium avium subsp. paratuberculosis
gccgcgacagccggg

SEQ ID NO: 2952245 - RNA, 14 nt, Mycobacterium avium subsp. paratuberculosis
gccgcgaccacagc

SEQ ID NO: 2952246 - RNA, 13 nt, Mycobacterium avium subsp. paratuberculosis
gccgcgaccccgg

SEQ ID NO: 2952247 - RNA, 17 nt, Mycobacterium avium subsp. paratuberculosis
gccgcgaccccggaccg

SEQ ID NO: 2952248 - RNA, 19 nt, Mycobacterium avium subsp. paratuberculosis
gccgcgaccccggaccgcg

SEQ ID NO: 2952249 - RNA, 12 nt, Mycobacterium avium subsp. paratuberculosis
gccgcgacccgg

SEQ ID NO: 2952250 - RNA, 18 nt, Mycobacterium avium subsp. paratuberculosis
gccgcgacccgggccgcc

SEQ ID NO: 2952251 - RNA, 13 nt, Mycobacterium avium subsp. paratuberculosis
gccgcgaccgcga

SEQ ID NO: 2952252 - RNA, 14 nt, Mycobacterium avium subsp. paratuberculosis
gccgcgaccgcgau

SEQ ID NO: 2952253 - RNA, 15 nt, Mycobacterium avium subsp. paratuberculosis
gccgcgaccgcgauc

SEQ ID NO: 2952254 - RNA, 19 nt, Mycobacterium avium subsp. paratuberculosis
gccgcgaccgucagcaggg

SEQ ID NO: 2952255 - RNA, 17 nt, Mycobacterium avium subsp. paratuberculosis
gccgcgacgaccgccug

SEQ ID NO: 2952256 - RNA, 20 nt, Mycobacterium avium subsp. paratuberculosis
gccgcgacgaccgccugcuu

SEQ ID NO: 2952257 - RNA, 21 nt, Mycobacterium avium subsp. paratuberculosis
gccgcgacgaugccggcgucg

SEQ ID NO: 2952258 - RNA, 20 nt, Mycobacterium avium subsp. paratuberculosis
gccgcgacgaugucgacccg

SEQ ID NO: 2952259 - RNA, 13 nt, Mycobacterium avium subsp. paratuberculosis
gccgcgacgccgc

SEQ ID NO: 2952260 - RNA, 14 nt, Mycobacterium avium subsp. paratuberculosis
gccgcgacgccgcc

SEQ ID NO: 2952261 - RNA, 15 nt, Mycobacterium avium subsp. paratuberculosis
gccgcgacgccgccg

SEQ ID NO: 2952262 - RNA, 19 nt, Mycobacterium avium subsp. paratuberculosis
gccgcgacgccgccgccga

SEQ ID NO: 2952263 - RNA, 20 nt, Mycobacterium avium subsp. paratuberculosis
gccgcgacgccgugcuucca

SEQ ID NO: 2952264 - RNA, 19 nt, Mycobacterium avium subsp. paratuberculosis
gccgcgacggccgccgauu

SEQ ID NO: 2952265 - RNA, 16 nt, Mycobacterium avium subsp. paratuberculosis
gccgcgacggcggguc

SEQ ID NO: 2952266 - RNA, 18 nt, Mycobacterium avium subsp. paratuberculosis
gccgcgacggcgggucga

SEQ ID NO: 2952267 - RNA, 14 nt, Mycobacterium avium subsp. paratuberculosis
gccgcgacgggcug

SEQ ID NO: 2952268 - RNA, 23 nt, Mycobacterium avium subsp. paratuberculosis
gccgcgacgggcugucccggccg

SEQ ID NO: 2952269 - RNA, 13 nt, Mycobacterium avium subsp. paratuberculosis
gccgcgacgucgg

SEQ ID NO: 2952270 - RNA, 16 nt, Mycobacterium avium subsp. paratuberculosis
gccgcgacucgguguc

SEQ ID NO: 2952271 - RNA, 15 nt, Mycobacterium avium subsp. paratuberculosis
gccgcgacucugcac

SEQ ID NO: 2952272 - RNA, 18 nt, Mycobacterium avium subsp. paratuberculosis
gccgcgacucugcacuca

SEQ ID NO: 2952273 - RNA, 17 nt, Mycobacterium avium subsp. paratuberculosis
gccgcgacugcacccga

SEQ ID NO: 2952274 - RNA, 22 nt, Mycobacterium avium subsp. paratuberculosis
gccgcgacugcaggugacggau

SEQ ID NO: 2952275 - RNA, 17 nt, Mycobacterium avium subsp. paratuberculosis
gccgcgagcacgacguc

SEQ ID NO: 2952276 - RNA, 18 nt, Mycobacterium avium subsp. paratuberculosis
gccgcgagcacgacgucg

SEQ ID NO: 2952277 - RNA, 19 nt, Mycobacterium avium subsp. paratuberculosis
gccgcgagcacgacgucga

SEQ ID NO: 2952278 - RNA, 13 nt, Mycobacterium avium subsp. paratuberculosis
gccgcgagcccgc

SEQ ID NO: 2952279 - RNA, 23 nt, Mycobacterium avium subsp. paratuberculosis
gccgcgagcccgcaaaucagccg

SEQ ID NO: 2952280 - RNA, 18 nt, Mycobacterium avium subsp. paratuberculosis
gccgcgagcccggcgacg

SEQ ID NO: 2952281 - RNA, 20 nt, Mycobacterium avium subsp. paratuberculosis
gccgcgagcccggcgacguc

SEQ ID NO: 2952282 - RNA, 15 nt, Mycobacterium avium subsp. paratuberculosis
gccgcgagccgccca

SEQ ID NO: 2952283 - RNA, 13 nt, Mycobacterium avium subsp. paratuberculosis
gccgcgagcgcag

SEQ ID NO: 2952284 - RNA, 14 nt, Mycobacterium avium subsp. paratuberculosis
gccgcgagcgcagc

SEQ ID NO: 2952285 - RNA, 19 nt, Mycobacterium avium subsp. paratuberculosis
gccgcgaggauuucgcuca

SEQ ID NO: 2952286 - RNA, 22 nt, Mycobacterium avium subsp. paratuberculosis
gccgcgaggauuucgcucagcc

SEQ ID NO: 2952287 - RNA, 13 nt, Mycobacterium avium subsp. paratuberculosis
gccgcgcccgucg

SEQ ID NO: 2952288 - RNA, 15 nt, Mycobacterium avium subsp. paratuberculosis
gccgcgcccgucgag

SEQ ID NO: 2952289 - RNA, 20 nt, Mycobacterium avium subsp. paratuberculosis
gccgcgccgaacaccacgcc

SEQ ID NO: 2952290 - RNA, 22 nt, Mycobacterium avium subsp. paratuberculosis
gccgcgccgaacaccacgccga

SEQ ID NO: 2952291 - RNA, 12 nt, Mycobacterium avium subsp. paratuberculosis
gccgcgccgaca

SEQ ID NO: 2952292 - RNA, 13 nt, Mycobacterium avium subsp. paratuberculosis
gccgcgccgacag

SEQ ID NO: 2952293 - RNA, 13 nt, Mycobacterium avium subsp. paratuberculosis
gccgcgccgaccu

SEQ ID NO: 2952294 - RNA, 18 nt, Mycobacterium avium subsp. paratuberculosis
gccgcgccgaccucgucg

SEQ ID NO: 2952295 - RNA, 20 nt, Mycobacterium avium subsp. paratuberculosis
gccgcgccgaccucgucggc

SEQ ID NO: 2952296 - RNA, 21 nt, Mycobacterium avium subsp. paratuberculosis
gccgcgccgaccucgucggcg

SEQ ID NO: 2952297 - RNA, 12 nt, Mycobacterium avium subsp. paratuberculosis
gccgcgccgacg

SEQ ID NO: 2952298 - RNA, 13 nt, Mycobacterium avium subsp. paratuberculosis
gccgcgccgacgc

SEQ ID NO: 2952299 - RNA, 23 nt, Mycobacterium avium subsp. paratuberculosis
gccgcgccgaggaacugcagcga

SEQ ID NO: 2952300 - RNA, 13 nt, Mycobacterium avium subsp. paratuberculosis
gccgcgccgauca

SEQ ID NO: 2952301 - RNA, 23 nt, Mycobacterium avium subsp. paratuberculosis
gccgcgccgaucacgaacagguc

SEQ ID NO: 2952302 - RNA, 12 nt, Mycobacterium avium subsp. paratuberculosis
gccgcgccgcca

SEQ ID NO: 2952303 - RNA, 15 nt, Mycobacterium avium subsp. paratuberculosis
gccgcgccgccacac

SEQ ID NO: 2952304 - RNA, 13 nt, Mycobacterium avium subsp. paratuberculosis
gccgcgccgcccg

SEQ ID NO: 2952305 - RNA, 15 nt, Mycobacterium avium subsp. paratuberculosis
gccgcgccgcccggc

SEQ ID NO: 2952306 - RNA, 16 nt, Mycobacterium avium subsp. paratuberculosis
gccgcgccgcccggcg

SEQ ID NO: 2952307 - RNA, 19 nt, Mycobacterium avium subsp. paratuberculosis
gccgcgccgcccggcgauc

SEQ ID NO: 2952308 - RNA, 12 nt, Mycobacterium avium subsp. paratuberculosis
gccgcgccgccg

SEQ ID NO: 2952309 - RNA, 13 nt, Mycobacterium avium subsp. paratuberculosis
gccgcgccgccga

SEQ ID NO: 2952310 - RNA, 14 nt, Mycobacterium avium subsp. paratuberculosis
gccgcgccgccgac

SEQ ID NO: 2952311 - RNA, 13 nt, Mycobacterium avium subsp. paratuberculosis
gccgcgccgccgc

SEQ ID NO: 2952312 - RNA, 14 nt, Mycobacterium avium subsp. paratuberculosis
gccgcgccgccgcc

SEQ ID NO: 2952313 - RNA, 19 nt, Mycobacterium avium subsp. paratuberculosis
gccgcgccgccgcccuggc

SEQ ID NO: 2952314 - RNA, 11 nt, Mycobacterium avium subsp. paratuberculosis
gccgcgccgcg

SEQ ID NO: 2952315 - RNA, 13 nt, Mycobacterium avium subsp. paratuberculosis
gccgcgccgcgcc

SEQ ID NO: 2952316 - RNA, 17 nt, Mycobacterium avium subsp. paratuberculosis
gccgcgccgcgccgccu

SEQ ID NO: 2952317 - RNA, 13 nt, Mycobacterium avium subsp. paratuberculosis
gccgcgccggcac

SEQ ID NO: 2952318 - RNA, 14 nt, Mycobacterium avium subsp. paratuberculosis
gccgcgccgggcgc

SEQ ID NO: 2952319 - RNA, 19 nt, Mycobacterium avium subsp. paratuberculosis
gccgcgccgggcggauguc

SEQ ID NO: 2952320 - RNA, 21 nt, Mycobacterium avium subsp. paratuberculosis
gccgcgccgggcggaugucgg

SEQ ID NO: 2952321 - RNA, 14 nt, Mycobacterium avium subsp. paratuberculosis
gccgcgccggggug

SEQ ID NO: 2952322 - RNA, 15 nt, Mycobacterium avium subsp. paratuberculosis
gccgcgccggggugu

SEQ ID NO: 2952323 - RNA, 13 nt, Mycobacterium avium subsp. paratuberculosis
gccgcgccgugcg

SEQ ID NO: 2952324 - RNA, 14 nt, Mycobacterium avium subsp. paratuberculosis
gccgcgccgugcgc

SEQ ID NO: 2952325 - RNA, 15 nt, Mycobacterium avium subsp. paratuberculosis
gccgcgccgugcgcc

SEQ ID NO: 2952326 - RNA, 17 nt, Mycobacterium avium subsp. paratuberculosis
gccgcgccgugcgccag

SEQ ID NO: 2952327 - RNA, 18 nt, Mycobacterium avium subsp. paratuberculosis
gccgcgccgugcgccagc

SEQ ID NO: 2952328 - RNA, 19 nt, Mycobacterium avium subsp. paratuberculosis
gccgcgccguugaccgcgg

SEQ ID NO: 2952329 - RNA, 20 nt, Mycobacterium avium subsp. paratuberculosis
gccgcgccguugaccgcggc

SEQ ID NO: 2952330 - RNA, 21 nt, Mycobacterium avium subsp. paratuberculosis
gccgcgccguugaccgcggcg

SEQ ID NO: 2952331 - RNA, 18 nt, Mycobacterium avium subsp. paratuberculosis
gccgcgcgacgccguaga

SEQ ID NO: 2952332 - RNA, 15 nt, Mycobacterium avium subsp. paratuberculosis
gccgcgcgccagcgc

SEQ ID NO: 2952333 - RNA, 16 nt, Mycobacterium avium subsp. paratuberculosis
gccgcgcgccagcgcg

SEQ ID NO: 2952334 - RNA, 17 nt, Mycobacterium avium subsp. paratuberculosis
gccgcgcgccagcgcgu

SEQ ID NO: 2952335 - RNA, 18 nt, Mycobacterium avium subsp. paratuberculosis
gccgcgcgccagcgcgug

SEQ ID NO: 2952336 - RNA, 21 nt, Mycobacterium avium subsp. paratuberculosis
gccgcgcgccagcgcgugcgg

SEQ ID NO: 2952337 - RNA, 22 nt, Mycobacterium avium subsp. paratuberculosis
gccgcgcgccagcgcgugcggg

SEQ ID NO: 2952338 - RNA, 13 nt, Mycobacterium avium subsp. paratuberculosis
gccgcgcgcccgc

SEQ ID NO: 2952339 - RNA, 21 nt, Mycobacterium avium subsp. paratuberculosis
gccgcgcgcccgcggccaucg

SEQ ID NO: 2952340 - RNA, 13 nt, Mycobacterium avium subsp. paratuberculosis
gccgcgcgccgac

SEQ ID NO: 2952341 - RNA, 20 nt, Mycobacterium avium subsp. paratuberculosis
gccgcgcgccgacagacccg

SEQ ID NO: 2952342 - RNA, 14 nt, Mycobacterium avium subsp. paratuberculosis
gccgcgcgccgaga

SEQ ID NO: 2952343 - RNA, 14 nt, Mycobacterium avium subsp. paratuberculosis
gccgcgcgcgcggc

SEQ ID NO: 2952344 - RNA, 15 nt, Mycobacterium avium subsp. paratuberculosis
gccgcgcgcgcggcc

SEQ ID NO: 2952345 - RNA, 19 nt, Mycobacterium avium subsp. paratuberculosis
gccgcgcgcgcggccucca

SEQ ID NO: 2952346 - RNA, 20 nt, Mycobacterium avium subsp. paratuberculosis
gccgcgcgcgcggccuccag

SEQ ID NO: 2952347 - RNA, 21 nt, Mycobacterium avium subsp. paratuberculosis
gccgcgcgcgcggccuccagc

SEQ ID NO: 2952348 - RNA, 12 nt, Mycobacterium avium subsp. paratuberculosis
gccgcgcgcggc

SEQ ID NO: 2952349 - RNA, 13 nt, Mycobacterium avium subsp. paratuberculosis
gccgcgcgcggcc

SEQ ID NO: 2952350 - RNA, 15 nt, Mycobacterium avium subsp. paratuberculosis
gccgcgcgcggccac

SEQ ID NO: 2952351 - RNA, 20 nt, Mycobacterium avium subsp. paratuberculosis
gccgcgcgcggcgcggagcc

SEQ ID NO: 2952352 - RNA, 13 nt, Mycobacterium avium subsp. paratuberculosis
gccgcgcgcgucg

SEQ ID NO: 2952353 - RNA, 14 nt, Mycobacterium avium subsp. paratuberculosis
gccgcgcgcgucga

SEQ ID NO: 2952354 - RNA, 17 nt, Mycobacterium avium subsp. paratuberculosis
gccgcgcgcgucgacgu

SEQ ID NO: 2952355 - RNA, 14 nt, Mycobacterium avium subsp. paratuberculosis
gccgcgcggacgcg

SEQ ID NO: 2952356 - RNA, 17 nt, Mycobacterium avium subsp. paratuberculosis
gccgcgcggacgcggcg

SEQ ID NO: 2952357 - RNA, 14 nt, Mycobacterium avium subsp. paratuberculosis
gccgcgcggccggc

SEQ ID NO: 2952358 - RNA, 16 nt, Mycobacterium avium subsp. paratuberculosis
gccgcgcggccggcca

SEQ ID NO: 2952359 - RNA, 18 nt, Mycobacterium avium subsp. paratuberculosis
gccgcgcggccggccacg

SEQ ID NO: 2952360 - RNA, 15 nt, Mycobacterium avium subsp. paratuberculosis
gccgcgcggcgccag

SEQ ID NO: 2952361 - RNA, 17 nt, Mycobacterium avium subsp. paratuberculosis
gccgcgcggcgccagcg

SEQ ID NO: 2952362 - RNA, 14 nt, Mycobacterium avium subsp. paratuberculosis
gccgcgcggcggug

SEQ ID NO: 2952363 - RNA, 18 nt, Mycobacterium avium subsp. paratuberculosis
gccgcgcggcggugaccg

SEQ ID NO: 2952364 - RNA, 15 nt, Mycobacterium avium subsp. paratuberculosis
gccgcgcggcgucgg

SEQ ID NO: 2952365 - RNA, 21 nt, Mycobacterium avium subsp. paratuberculosis
gccgcgcggcgucggccgggc

SEQ ID NO: 2952366 - RNA, 14 nt, Mycobacterium avium subsp. paratuberculosis
gccgcgcgggcgac

SEQ ID NO: 2952367 - RNA, 22 nt, Mycobacterium avium subsp. paratuberculosis
gccgcgcgggcggcgucguaga

SEQ ID NO: 2952368 - RNA, 20 nt, Mycobacterium avium subsp. paratuberculosis
gccgcgcggguacggcggcc

SEQ ID NO: 2952369 - RNA, 21 nt, Mycobacterium avium subsp. paratuberculosis
gccgcgcggguacggcggccg

SEQ ID NO: 2952370 - RNA, 22 nt, Mycobacterium avium subsp. paratuberculosis
gccgcgcggguacggcggccgc

SEQ ID NO: 2952371 - RNA, 12 nt, Mycobacterium avium subsp. paratuberculosis
gccgcgcggugc

SEQ ID NO: 2952372 - RNA, 17 nt, Mycobacterium avium subsp. paratuberculosis
gccgcgcguagaucauc

SEQ ID NO: 2952373 - RNA, 21 nt, Mycobacterium avium subsp. paratuberculosis
gccgcggccagcuccgggucg

SEQ ID NO: 2952374 - RNA, 15 nt, Mycobacterium avium subsp. paratuberculosis
gccgcggccagcugc

SEQ ID NO: 2952375 - RNA, 16 nt, Mycobacterium avium subsp. paratuberculosis
gccgcggccagcugcc

SEQ ID NO: 2952376 - RNA, 19 nt, Mycobacterium avium subsp. paratuberculosis
gccgcggccagcugcccgc

SEQ ID NO: 2952377 - RNA, 22 nt, Mycobacterium avium subsp. paratuberculosis
gccgcggccagcugcccgccga

SEQ ID NO: 2952378 - RNA, 12 nt, Mycobacterium avium subsp. paratuberculosis
gccgcggccagg

SEQ ID NO: 2952379 - RNA, 14 nt, Mycobacterium avium subsp. paratuberculosis
gccgcggccagguc

SEQ ID NO: 2952380 - RNA, 13 nt, Mycobacterium avium subsp. paratuberculosis
gccgcggcccggc

SEQ ID NO: 2952381 - RNA, 16 nt, Mycobacterium avium subsp. paratuberculosis
gccgcggcccggccac

SEQ ID NO: 2952382 - RNA, 16 nt, Mycobacterium avium subsp. paratuberculosis
gccgcggcccugcagc

SEQ ID NO: 2952383 - RNA, 17 nt, Mycobacterium avium subsp. paratuberculosis
gccgcggcccugcagcg

SEQ ID NO: 2952384 - RNA, 19 nt, Mycobacterium avium subsp. paratuberculosis
gccgcggcccugcagcgcc

SEQ ID NO: 2952385 - RNA, 23 nt, Mycobacterium avium subsp. paratuberculosis
gccgcggccgaaccgcugcaacc

SEQ ID NO: 2952386 - RNA, 15 nt, Mycobacterium avium subsp. paratuberculosis
gccgcggccgccgcg

SEQ ID NO: 2952387 - RNA, 17 nt, Mycobacterium avium subsp. paratuberculosis
gccgcggccgccgcgac

SEQ ID NO: 2952388 - RNA, 19 nt, Mycobacterium avium subsp. paratuberculosis
gccgcggccgccgcgacgg

SEQ ID NO: 2952389 - RNA, 13 nt, Mycobacterium avium subsp. paratuberculosis
gccgcggccgccu

SEQ ID NO: 2952390 - RNA, 23 nt, Mycobacterium avium subsp. paratuberculosis
gccgcggccgccucccgcagcgc

SEQ ID NO: 2952391 - RNA, 15 nt, Mycobacterium avium subsp. paratuberculosis
gccgcggccgccuuc

SEQ ID NO: 2952392 - RNA, 12 nt, Mycobacterium avium subsp. paratuberculosis
gccgcggccgcg

SEQ ID NO: 2952393 - RNA, 14 nt, Mycobacterium avium subsp. paratuberculosis
gccgcggccgcgau

SEQ ID NO: 2952394 - RNA, 14 nt, Mycobacterium avium subsp. paratuberculosis
gccgcggccgcguu

SEQ ID NO: 2952395 - RNA, 18 nt, Mycobacterium avium subsp. paratuberculosis
gccgcggccgcguugucg

SEQ ID NO: 2952396 - RNA, 14 nt, Mycobacterium avium subsp. paratuberculosis
gccgcggccgcugg

SEQ ID NO: 2952397 - RNA, 16 nt, Mycobacterium avium subsp. paratuberculosis
gccgcggccgcuggcg

SEQ ID NO: 2952398 - RNA, 20 nt, Mycobacterium avium subsp. paratuberculosis
gccgcggccgcuggcguuga

SEQ ID NO: 2952399 - RNA, 14 nt, Mycobacterium avium subsp. paratuberculosis
gccgcggccggaga

SEQ ID NO: 2952400 - RNA, 12 nt, Mycobacterium avium subsp. paratuberculosis
gccgcggccggc

SEQ ID NO: 2952401 - RNA, 13 nt, Mycobacterium avium subsp. paratuberculosis
gccgcggccggcg

SEQ ID NO: 2952402 - RNA, 15 nt, Mycobacterium avium subsp. paratuberculosis
gccgcggccggcggc

SEQ ID NO: 2952403 - RNA, 16 nt, Mycobacterium avium subsp. paratuberculosis
gccgcggccggcggca

SEQ ID NO: 2952404 - RNA, 13 nt, Mycobacterium avium subsp. paratuberculosis
gccgcggccggug

SEQ ID NO: 2952405 - RNA, 14 nt, Mycobacterium avium subsp. paratuberculosis
gccgcggccgucgu

SEQ ID NO: 2952406 - RNA, 15 nt, Mycobacterium avium subsp. paratuberculosis
gccgcggccgucguc

SEQ ID NO: 2952407 - RNA, 17 nt, Mycobacterium avium subsp. paratuberculosis
gccgcggccgucgucgu

SEQ ID NO: 2952408 - RNA, 13 nt, Mycobacterium avium subsp. paratuberculosis
gccgcggccuugc

SEQ ID NO: 2952409 - RNA, 14 nt, Mycobacterium avium subsp. paratuberculosis
gccgcggccuugcg

SEQ ID NO: 2952410 - RNA, 22 nt, Mycobacterium avium subsp. paratuberculosis
gccgcggccuugcgagccggag

SEQ ID NO: 2952411 - RNA, 23 nt, Mycobacterium avium subsp. paratuberculosis
gccgcggccuugcgagccggagc

SEQ ID NO: 2952412 - RNA, 17 nt, Mycobacterium avium subsp. paratuberculosis
gccgcggcgacacccag

SEQ ID NO: 2952413 - RNA, 18 nt, Mycobacterium avium subsp. paratuberculosis
gccgcggcgacacccagc

SEQ ID NO: 2952414 - RNA, 23 nt, Mycobacterium avium subsp. paratuberculosis
gccgcggcgacacccagcggcgc

SEQ ID NO: 2952415 - RNA, 16 nt, Mycobacterium avium subsp. paratuberculosis
gccgcggcgaccacga

SEQ ID NO: 2952416 - RNA, 13 nt, Mycobacterium avium subsp. paratuberculosis
gccgcggcgaccg

SEQ ID NO: 2952417 - RNA, 15 nt, Mycobacterium avium subsp. paratuberculosis
gccgcggcgaccggg

SEQ ID NO: 2952418 - RNA, 19 nt, Mycobacterium avium subsp. paratuberculosis
gccgcggcgaccggggcgg

SEQ ID NO: 2952419 - RNA, 21 nt, Mycobacterium avium subsp. paratuberculosis
gccgcggcgaccggggcggug

SEQ ID NO: 2952420 - RNA, 23 nt, Mycobacterium avium subsp. paratuberculosis
gccgcggcgaccggggcggugac

SEQ ID NO: 2952421 - RNA, 15 nt, Mycobacterium avium subsp. paratuberculosis
gccgcggcgaucggc

SEQ ID NO: 2952422 - RNA, 22 nt, Mycobacterium avium subsp. paratuberculosis
gccgcggcgaucucgaucgugg

SEQ ID NO: 2952423 - RNA, 14 nt, Mycobacterium avium subsp. paratuberculosis
gccgcggcgcaccc

SEQ ID NO: 2952424 - RNA, 14 nt, Mycobacterium avium subsp. paratuberculosis
gccgcggcgcccgg

SEQ ID NO: 2952425 - RNA, 20 nt, Mycobacterium avium subsp. paratuberculosis
gccgcggcgcccggcgcccg

SEQ ID NO: 2952426 - RNA, 18 nt, Mycobacterium avium subsp. paratuberculosis
gccgcggcgcccucgccg

SEQ ID NO: 2952427 - RNA, 21 nt, Mycobacterium avium subsp. paratuberculosis
gccgcggcgcccucgccggcg

SEQ ID NO: 2952428 - RNA, 15 nt, Mycobacterium avium subsp. paratuberculosis
gccgcggcgccgcca

SEQ ID NO: 2952429 - RNA, 16 nt, Mycobacterium avium subsp. paratuberculosis
gccgcggcgccguuga

SEQ ID NO: 2952430 - RNA, 15 nt, Mycobacterium avium subsp. paratuberculosis
gccgcggcgcgcauc

SEQ ID NO: 2952431 - RNA, 20 nt, Mycobacterium avium subsp. paratuberculosis
gccgcggcgcgcaucccgau

SEQ ID NO: 2952432 - RNA, 14 nt, Mycobacterium avium subsp. paratuberculosis
gccgcggcgcggcc

SEQ ID NO: 2952433 - RNA, 15 nt, Mycobacterium avium subsp. paratuberculosis
gccgcggcgcggccc

SEQ ID NO: 2952434 - RNA, 16 nt, Mycobacterium avium subsp. paratuberculosis
gccgcggcgcggcccg

SEQ ID NO: 2952435 - RNA, 21 nt, Mycobacterium avium subsp. paratuberculosis
gccgcggcgcggcccggcccg

SEQ ID NO: 2952436 - RNA, 22 nt, Mycobacterium avium subsp. paratuberculosis
gccgcggcgcggcccggcccgc

SEQ ID NO: 2952437 - RNA, 11 nt, Mycobacterium avium subsp. paratuberculosis
gccgcggcggc

SEQ ID NO: 2952438 - RNA, 19 nt, Mycobacterium avium subsp. paratuberculosis
gccgcggcggcacccaggu

SEQ ID NO: 2952439 - RNA, 18 nt, Mycobacterium avium subsp. paratuberculosis
gccgcggcggcagcaccc

SEQ ID NO: 2952440 - RNA, 20 nt, Mycobacterium avium subsp. paratuberculosis
gccgcggcggcagcacccgc

SEQ ID NO: 2952441 - RNA, 13 nt, Mycobacterium avium subsp. paratuberculosis
gccgcggcggccc

SEQ ID NO: 2952442 - RNA, 19 nt, Mycobacterium avium subsp. paratuberculosis
gccgcggcggcccggcguc

SEQ ID NO: 2952443 - RNA, 13 nt, Mycobacterium avium subsp. paratuberculosis
gccgcggcggccu

SEQ ID NO: 2952444 - RNA, 15 nt, Mycobacterium avium subsp. paratuberculosis
gccgcggcggccugc

SEQ ID NO: 2952445 - RNA, 12 nt, Mycobacterium avium subsp. paratuberculosis
gccgcggcggcg

SEQ ID NO: 2952446 - RNA, 21 nt, Mycobacterium avium subsp. paratuberculosis
gccgcggcggcgccgacgggc

SEQ ID NO: 2952447 - RNA, 22 nt, Mycobacterium avium subsp. paratuberculosis
gccgcggcggcgccgacgggcc

SEQ ID NO: 2952448 - RNA, 13 nt, Mycobacterium avium subsp. paratuberculosis
gccgcggcggcuc

SEQ ID NO: 2952449 - RNA, 15 nt, Mycobacterium avium subsp. paratuberculosis
gccgcggcggcucgg

SEQ ID NO: 2952450 - RNA, 14 nt, Mycobacterium avium subsp. paratuberculosis
gccgcggcgggcgc

SEQ ID NO: 2952451 - RNA, 18 nt, Mycobacterium avium subsp. paratuberculosis
gccgcggcgggcgcgucg

SEQ ID NO: 2952452 - RNA, 12 nt, Mycobacterium avium subsp. paratuberculosis
gccgcggcggug

SEQ ID NO: 2952453 - RNA, 15 nt, Mycobacterium avium subsp. paratuberculosis
gccgcggcggugccg

SEQ ID NO: 2952454 - RNA, 16 nt, Mycobacterium avium subsp. paratuberculosis
gccgcggcggugccgg

SEQ ID NO: 2952455 - RNA, 22 nt, Mycobacterium avium subsp. paratuberculosis
gccgcggcggugccgguguugc

SEQ ID NO: 2952456 - RNA, 13 nt, Mycobacterium avium subsp. paratuberculosis
gccgcggcggugg

SEQ ID NO: 2952457 - RNA, 16 nt, Mycobacterium avium subsp. paratuberculosis
gccgcggcgguggccu

SEQ ID NO: 2952458 - RNA, 17 nt, Mycobacterium avium subsp. paratuberculosis
gccgcgguuggucacca

SEQ ID NO: 2952459 - RNA, 21 nt, Mycobacterium avium subsp. paratuberculosis
gccgcgguuggucaccagguc

SEQ ID NO: 2952460 - RNA, 17 nt, Mycobacterium avium subsp. paratuberculosis
gccgcguacaccggcug

SEQ ID NO: 2952461 - RNA, 15 nt, Mycobacterium avium subsp. paratuberculosis
gccgcguacagcagc

SEQ ID NO: 2952462 - RNA, 16 nt, Mycobacterium avium subsp. paratuberculosis
gccgcguacagcagcu

SEQ ID NO: 2952463 - RNA, 22 nt, Mycobacterium avium subsp. paratuberculosis
gccgcguacagcagcugcccga

SEQ ID NO: 2952464 - RNA, 13 nt, Mycobacterium avium subsp. paratuberculosis
gccgcguacagcc

SEQ ID NO: 2952465 - RNA, 15 nt, Mycobacterium avium subsp. paratuberculosis
gccgcguacagccag

SEQ ID NO: 2952466 - RNA, 16 nt, Mycobacterium avium subsp. paratuberculosis
gccgcguacagccagc

SEQ ID NO: 2952467 - RNA, 18 nt, Mycobacterium avium subsp. paratuberculosis
gccgcguacagccagccc

SEQ ID NO: 2952468 - RNA, 23 nt, Mycobacterium avium subsp. paratuberculosis
gccgcguacagccagcccguggc

SEQ ID NO: 2952469 - RNA, 17 nt, Mycobacterium avium subsp. paratuberculosis
gccgcguaccagcgcca

SEQ ID NO: 2952470 - RNA, 15 nt, Mycobacterium avium subsp. paratuberculosis
gccgcguacgccgcc

SEQ ID NO: 2952471 - RNA, 16 nt, Mycobacterium avium subsp. paratuberculosis
gccgcguacgccgccu

SEQ ID NO: 2952472 - RNA, 19 nt, Mycobacterium avium subsp. paratuberculosis
gccgcguacuucgcgcccu

SEQ ID NO: 2952473 - RNA, 17 nt, Mycobacterium avium subsp. paratuberculosis
gccgcguagcucgccgc

SEQ ID NO: 2952474 - RNA, 23 nt, Mycobacterium avium subsp. paratuberculosis
gccgcguaggccaggaccgggac

SEQ ID NO: 2952475 - RNA, 14 nt, Mycobacterium avium subsp. paratuberculosis
gccgcguaggccuu

SEQ ID NO: 2952476 - RNA, 21 nt, Mycobacterium avium subsp. paratuberculosis
gccgcguaggucuucggugaa

SEQ ID NO: 2952477 - RNA, 17 nt, Mycobacterium avium subsp. paratuberculosis
gccgcgucacgucggcc

SEQ ID NO: 2952478 - RNA, 18 nt, Mycobacterium avium subsp. paratuberculosis
gccgcgucacgucggccu

SEQ ID NO: 2952479 - RNA, 16 nt, Mycobacterium avium subsp. paratuberculosis
gccgcgucagcggcgg

SEQ ID NO: 2952480 - RNA, 18 nt, Mycobacterium avium subsp. paratuberculosis
gccgcgucagcggcgggc

SEQ ID NO: 2952481 - RNA, 15 nt, Mycobacterium avium subsp. paratuberculosis
gccgcguccggggug

SEQ ID NO: 2952482 - RNA, 15 nt, Mycobacterium avium subsp. paratuberculosis
gccgcguccucgccg

SEQ ID NO: 2952483 - RNA, 18 nt, Mycobacterium avium subsp. paratuberculosis
gccgcguccucgccguac

SEQ ID NO: 2952484 - RNA, 19 nt, Mycobacterium avium subsp. paratuberculosis
gccgcguccucgucgaugc

SEQ ID NO: 2952485 - RNA, 21 nt, Mycobacterium avium subsp. paratuberculosis
gccgcguccucgucgaugccg

SEQ ID NO: 2952486 - RNA, 13 nt, Mycobacterium avium subsp. paratuberculosis
gccgcgucgacca

SEQ ID NO: 2952487 - RNA, 21 nt, Mycobacterium avium subsp. paratuberculosis
gccgcgucgacgccgcugccg

SEQ ID NO: 2952488 - RNA, 14 nt, Mycobacterium avium subsp. paratuberculosis
gccgcgucgccgac

SEQ ID NO: 2952489 - RNA, 16 nt, Mycobacterium avium subsp. paratuberculosis
gccgcgucgccgacca

SEQ ID NO: 2952490 - RNA, 22 nt, Mycobacterium avium subsp. paratuberculosis
gccgcgucgccgaccagcagga

SEQ ID NO: 2952491 - RNA, 14 nt, Mycobacterium avium subsp. paratuberculosis
gccgcgucgccgau

SEQ ID NO: 2952492 - RNA, 15 nt, Mycobacterium avium subsp. paratuberculosis
gccgcgucgccgauc

SEQ ID NO: 2952493 - RNA, 16 nt, Mycobacterium avium subsp. paratuberculosis
gccgcgucgccgaucg

SEQ ID NO: 2952494 - RNA, 19 nt, Mycobacterium avium subsp. paratuberculosis
gccgcgucgccgccgggcg

SEQ ID NO: 2952495 - RNA, 20 nt, Mycobacterium avium subsp. paratuberculosis
gccgcgucgccgccgggcgc

SEQ ID NO: 2952496 - RNA, 15 nt, Mycobacterium avium subsp. paratuberculosis
gccgcgucggacccc

SEQ ID NO: 2952497 - RNA, 12 nt, Mycobacterium avium subsp. paratuberculosis
gccgcgucggcc

SEQ ID NO: 2952498 - RNA, 14 nt, Mycobacterium avium subsp. paratuberculosis
gccgcgucggccaa

SEQ ID NO: 2952499 - RNA, 21 nt, Mycobacterium avium subsp. paratuberculosis
gccgcgucggcggcggcggcc

SEQ ID NO: 2952500 - RNA, 20 nt, Mycobacterium avium subsp. paratuberculosis
gccgcgucggcggucgccag

SEQ ID NO: 2952501 - RNA, 18 nt, Mycobacterium avium subsp. paratuberculosis
gccgcgucggucagcgcc

SEQ ID NO: 2952502 - RNA, 16 nt, Mycobacterium avium subsp. paratuberculosis
gccgcgucgucgucga

SEQ ID NO: 2952503 - RNA, 16 nt, Mycobacterium avium subsp. paratuberculosis
gccgcgugacaggggc

SEQ ID NO: 2952504 - RNA, 18 nt, Mycobacterium avium subsp. paratuberculosis
gccgcguggccucccggu

SEQ ID NO: 2952505 - RNA, 23 nt, Mycobacterium avium subsp. paratuberculosis
gccgcguggccucccgguagauc

SEQ ID NO: 2952506 - RNA, 22 nt, Mycobacterium avium subsp. paratuberculosis
gccgcgugggagagcgggaccg

SEQ ID NO: 2952507 - RNA, 15 nt, Mycobacterium avium subsp. paratuberculosis
gccgcguucacccgc

SEQ ID NO: 2952508 - RNA, 20 nt, Mycobacterium avium subsp. paratuberculosis
gccgcguucacccgcgcccg

SEQ ID NO: 2952509 - RNA, 21 nt, Mycobacterium avium subsp. paratuberculosis
gccgcguucacccgcgcccgc

SEQ ID NO: 2952510 - RNA, 14 nt, Mycobacterium avium subsp. paratuberculosis
gccgcguuccccgg

SEQ ID NO: 2952511 - RNA, 18 nt, Mycobacterium avium subsp. paratuberculosis
gccgcguuccccggcgug

SEQ ID NO: 2952512 - RNA, 19 nt, Mycobacterium avium subsp. paratuberculosis
gccgcguuccccggcgugg

SEQ ID NO: 2952513 - RNA, 13 nt, Mycobacterium avium subsp. paratuberculosis
gccgcguucggag

SEQ ID NO: 2952514 - RNA, 16 nt, Mycobacterium avium subsp. paratuberculosis
gccgcguucggcggcg

SEQ ID NO: 2952515 - RNA, 17 nt, Mycobacterium avium subsp. paratuberculosis
gccgcguucggcggcgc

SEQ ID NO: 2952516 - RNA, 21 nt, Mycobacterium avium subsp. paratuberculosis
gccgcguucggcggcgcgcug

SEQ ID NO: 2952517 - RNA, 13 nt, Mycobacterium avium subsp. paratuberculosis
gccgcguugucga

SEQ ID NO: 2952518 - RNA, 19 nt, Mycobacterium avium subsp. paratuberculosis
gccgcguugucgaccacca

SEQ ID NO: 2952519 - RNA, 22 nt, Mycobacterium avium subsp. paratuberculosis
gccgcguugucgaccaccaggu

SEQ ID NO: 2952520 - RNA, 15 nt, Mycobacterium avium subsp. paratuberculosis
gccgcguugucggcg

SEQ ID NO: 2952521 - RNA, 13 nt, Mycobacterium avium subsp. paratuberculosis
gccgcuacccggc

SEQ ID NO: 2952522 - RNA, 20 nt, Mycobacterium avium subsp. paratuberculosis
gccgcuacccggcgaaccgg

SEQ ID NO: 2952523 - RNA, 23 nt, Mycobacterium avium subsp. paratuberculosis
gccgcuacccggcgaaccgggac

SEQ ID NO: 2952524 - RNA, 13 nt, Mycobacterium avium subsp. paratuberculosis
gccgcuacgccga

SEQ ID NO: 2952525 - RNA, 15 nt, Mycobacterium avium subsp. paratuberculosis
gccgcuacgccgagg

SEQ ID NO: 2952526 - RNA, 22 nt, Mycobacterium avium subsp. paratuberculosis
gccgcuacgccgaggcgcagga

SEQ ID NO: 2952527 - RNA, 18 nt, Mycobacterium avium subsp. paratuberculosis
gccgcuagaccgauggcg

SEQ ID NO: 2952528 - RNA, 22 nt, Mycobacterium avium subsp. paratuberculosis
gccgcuagaccgauggcggcgg

SEQ ID NO: 2952529 - RNA, 24 nt, Mycobacterium avium subsp. paratuberculosis
gccgcuagaccgauggcggcggcc

SEQ ID NO: 2952530 - RNA, 14 nt, Mycobacterium avium subsp. paratuberculosis
gccgcuagucgccc

SEQ ID NO: 2952531 - RNA, 16 nt, Mycobacterium avium subsp. paratuberculosis
gccgcuagucgcccag

SEQ ID NO: 2952532 - RNA, 22 nt, Mycobacterium avium subsp. paratuberculosis
gccgcuagucgcccagcagccc

SEQ ID NO: 2952533 - RNA, 16 nt, Mycobacterium avium subsp. paratuberculosis
gccgcuaguuggugcu

SEQ ID NO: 2952534 - RNA, 20 nt, Mycobacterium avium subsp. paratuberculosis
gccgcuaguuggugcugggc

SEQ ID NO: 2952535 - RNA, 20 nt, Mycobacterium avium subsp. paratuberculosis
gccgcucaaguccucggugg

SEQ ID NO: 2952536 - RNA, 15 nt, Mycobacterium avium subsp. paratuberculosis
gccgcucacacagcc

SEQ ID NO: 2952537 - RNA, 16 nt, Mycobacterium avium subsp. paratuberculosis
gccgcucacacagccg

SEQ ID NO: 2952538 - RNA, 12 nt, Mycobacterium avium subsp. paratuberculosis
gccgcucaccgc

SEQ ID NO: 2952539 - RNA, 14 nt, Mycobacterium avium subsp. paratuberculosis
gccgcucaccgccg

SEQ ID NO: 2952540 - RNA, 15 nt, Mycobacterium avium subsp. paratuberculosis
gccgcucaccgccga

SEQ ID NO: 2952541 - RNA, 16 nt, Mycobacterium avium subsp. paratuberculosis
gccgcucaccgccgag

SEQ ID NO: 2952542 - RNA, 19 nt, Mycobacterium avium subsp. paratuberculosis
gccgcucaccgccgagccg

SEQ ID NO: 2952543 - RNA, 19 nt, Mycobacterium avium subsp. paratuberculosis
gccgcugcgcccagcgcgc

SEQ ID NO: 2952544 - RNA, 20 nt, Mycobacterium avium subsp. paratuberculosis
gccgcugcgccggcgcggcc

SEQ ID NO: 2952545 - RNA, 14 nt, Mycobacterium avium subsp. paratuberculosis
gccgcugcgcgcgc

SEQ ID NO: 2952546 - RNA, 14 nt, Mycobacterium avium subsp. paratuberculosis
gccgcugcgggcca

SEQ ID NO: 2952547 - RNA, 20 nt, Mycobacterium avium subsp. paratuberculosis
gccgcugcgggcgggccgcc

SEQ ID NO: 2952548 - RNA, 21 nt, Mycobacterium avium subsp. paratuberculosis
gccgcugcgggcgggccgcca

SEQ ID NO: 2952549 - RNA, 23 nt, Mycobacterium avium subsp. paratuberculosis
gccgcugcgugcccggaucgccg

SEQ ID NO: 2952550 - RNA, 18 nt, Mycobacterium avium subsp. paratuberculosis
gccgcugcugggugccgc

SEQ ID NO: 2952551 - RNA, 23 nt, Mycobacterium avium subsp. paratuberculosis
gccgcuggauccccucacuccag

SEQ ID NO: 2952552 - RNA, 23 nt, Mycobacterium avium subsp. paratuberculosis
gccgcuggauguccaggccgucg

SEQ ID NO: 2952553 - RNA, 18 nt, Mycobacterium avium subsp. paratuberculosis
gccgcuggauuccaccgu

SEQ ID NO: 2952554 - RNA, 23 nt, Mycobacterium avium subsp. paratuberculosis
gccgcuggauuccaccguggucg

SEQ ID NO: 2952555 - RNA, 13 nt, Mycobacterium avium subsp. paratuberculosis
gccgcuggccgcc

SEQ ID NO: 2952556 - RNA, 17 nt, Mycobacterium avium subsp. paratuberculosis
gccgcuggccgccccga

SEQ ID NO: 2952557 - RNA, 14 nt, Mycobacterium avium subsp. paratuberculosis
gccgcuggccgcgc

SEQ ID NO: 2952558 - RNA, 16 nt, Mycobacterium avium subsp. paratuberculosis
gccgcuggccgcgcca

SEQ ID NO: 2952559 - RNA, 14 nt, Mycobacterium avium subsp. paratuberculosis
gccgcuggcgucga

SEQ ID NO: 2952560 - RNA, 17 nt, Mycobacterium avium subsp. paratuberculosis
gccgcuggcgucgaucg

SEQ ID NO: 2952561 - RNA, 18 nt, Mycobacterium avium subsp. paratuberculosis
gccgcuggcgucgaucgc

SEQ ID NO: 2952562 - RNA, 16 nt, Mycobacterium avium subsp. paratuberculosis
gccgcugggcguggug

SEQ ID NO: 2952563 - RNA, 17 nt, Mycobacterium avium subsp. paratuberculosis
gccgcugggcguggugc

SEQ ID NO: 2952564 - RNA, 17 nt, Mycobacterium avium subsp. paratuberculosis
gccgcugguaggcggcg

SEQ ID NO: 2952565 - RNA, 18 nt, Mycobacterium avium subsp. paratuberculosis
gccgcugguaggcggcgc

SEQ ID NO: 2952566 - RNA, 12 nt, Mycobacterium avium subsp. paratuberculosis
gccgcuggucag

SEQ ID NO: 2952567 - RNA, 15 nt, Mycobacterium avium subsp. paratuberculosis
gccgcuggucaggcc

SEQ ID NO: 2952568 - RNA, 21 nt, Mycobacterium avium subsp. paratuberculosis
gccgcuggucaggccgaauga

SEQ ID NO: 2952569 - RNA, 19 nt, Mycobacterium avium subsp. paratuberculosis
gccgcuggugaacucgccg

SEQ ID NO: 2952570 - RNA, 22 nt, Mycobacterium avium subsp. paratuberculosis
gccgcuggugaacucgccgauc

SEQ ID NO: 2952571 - RNA, 24 nt, Mycobacterium avium subsp. paratuberculosis
gccgcuggugaacucgccgaucgg

SEQ ID NO: 2952572 - RNA, 19 nt, Mycobacterium avium subsp. paratuberculosis
gccgcuggugaggucgcgc

SEQ ID NO: 2952573 - RNA, 22 nt, Mycobacterium avium subsp. paratuberculosis
gccgcugguggugaucacccag

SEQ ID NO: 2952574 - RNA, 16 nt, Mycobacterium avium subsp. paratuberculosis
gccgcuguccucgucg

SEQ ID NO: 2952575 - RNA, 22 nt, Mycobacterium avium subsp. paratuberculosis
gccgcuguccucgucggaggcg

SEQ ID NO: 2952576 - RNA, 21 nt, Mycobacterium avium subsp. paratuberculosis
gccgcugucgucgaagagcug

SEQ ID NO: 2952577 - RNA, 23 nt, Mycobacterium avium subsp. paratuberculosis
gccgcugucgucgaagagcuggu

SEQ ID NO: 2952578 - RNA, 16 nt, Mycobacterium avium subsp. paratuberculosis
gccgcugucugcgugc

SEQ ID NO: 2952579 - RNA, 14 nt, Mycobacterium avium subsp. paratuberculosis
gccgcuucccaccc

SEQ ID NO: 2952580 - RNA, 16 nt, Mycobacterium avium subsp. paratuberculosis
gccgcuucccacccgg

SEQ ID NO: 2952581 - RNA, 17 nt, Mycobacterium avium subsp. paratuberculosis
gccgcuucccacccggu

SEQ ID NO: 2952582 - RNA, 17 nt, Mycobacterium avium subsp. paratuberculosis
gccgcuucggggugguu

SEQ ID NO: 2952583 - RNA, 14 nt, Mycobacterium avium subsp. paratuberculosis
gccgcuucgucgcc

SEQ ID NO: 2952584 - RNA, 18 nt, Mycobacterium avium subsp. paratuberculosis
gccgcuucgucgccggcc

SEQ ID NO: 2952585 - RNA, 19 nt, Mycobacterium avium subsp. paratuberculosis
gccgcuucgucgccggccg

SEQ ID NO: 2952586 - RNA, 21 nt, Mycobacterium avium subsp. paratuberculosis
gccgcuugcagcuuggcggug

SEQ ID NO: 2952587 - RNA, 13 nt, Mycobacterium avium subsp. paratuberculosis
gccgcuuggccgg

SEQ ID NO: 2952588 - RNA, 17 nt, Mycobacterium avium subsp. paratuberculosis
gccgcuuggccgggcgg

SEQ ID NO: 2952589 - RNA, 18 nt, Mycobacterium avium subsp. paratuberculosis
gccgcuuggccgggcgga

SEQ ID NO: 2952590 - RNA, 21 nt, Mycobacterium avium subsp. paratuberculosis
gccgcuuggccgggcggaagu

SEQ ID NO: 2952591 - RNA, 13 nt, Mycobacterium avium subsp. paratuberculosis
gccgcuuggcgcg

SEQ ID NO: 2952592 - RNA, 16 nt, Mycobacterium avium subsp. paratuberculosis
gccgcuuggcgcgccg

SEQ ID NO: 2952593 - RNA, 18 nt, Mycobacterium avium subsp. paratuberculosis
gccgcuuggcgcgccgca

SEQ ID NO: 2952594 - RNA, 14 nt, Mycobacterium avium subsp. paratuberculosis
gccgcuugguggcg

SEQ ID NO: 2952595 - RNA, 17 nt, Mycobacterium avium subsp. paratuberculosis
gccgcuugguggcgccg

SEQ ID NO: 2952596 - RNA, 19 nt, Mycobacterium avium subsp. paratuberculosis
gccgcuugguggcgccggu

SEQ ID NO: 2952597 - RNA, 21 nt, Mycobacterium avium subsp. paratuberculosis
gccgcuuguucgggcccacac

SEQ ID NO: 2952598 - RNA, 15 nt, Mycobacterium avium subsp. paratuberculosis
gccgcuuuccacccc

SEQ ID NO: 2952599 - RNA, 18 nt, Mycobacterium avium subsp. paratuberculosis
gccgcuuuccaccccggc

SEQ ID NO: 2952600 - RNA, 21 nt, Mycobacterium avium subsp. paratuberculosis
gccgcuuuccaccccggcggu

SEQ ID NO: 2952601 - RNA, 16 nt, Mycobacterium avium subsp. paratuberculosis
gccggaaaaguucggc

SEQ ID NO: 2952602 - RNA, 17 nt, Mycobacterium avium subsp. paratuberculosis
gccggaaaaguucggcg

SEQ ID NO: 2952603 - RNA, 19 nt, Mycobacterium avium subsp. paratuberculosis
gccggaaaaguucggcggg

SEQ ID NO: 2952604 - RNA, 22 nt, Mycobacterium avium subsp. paratuberculosis
gccggaaaaguucggcgggggc

SEQ ID NO: 2952605 - RNA, 15 nt, Mycobacterium avium subsp. paratuberculosis
gccggaaaggcguga

SEQ ID NO: 2952606 - RNA, 12 nt, Mycobacterium avium subsp. paratuberculosis
gccggaacagcu

SEQ ID NO: 2952607 - RNA, 11 nt, Mycobacterium avium subsp. paratuberculosis
gccggaaccgu

SEQ ID NO: 2952608 - RNA, 13 nt, Mycobacterium avium subsp. paratuberculosis
gccggaacgagcc

SEQ ID NO: 2952609 - RNA, 17 nt, Mycobacterium avium subsp. paratuberculosis
gccggaacucggccggc

SEQ ID NO: 2952610 - RNA, 14 nt, Mycobacterium avium subsp. paratuberculosis
gccggaagaccguu

SEQ ID NO: 2952611 - RNA, 18 nt, Mycobacterium avium subsp. paratuberculosis
gccggaagaccguugacg

SEQ ID NO: 2952612 - RNA, 20 nt, Mycobacterium avium subsp. paratuberculosis
gccggaagaccguugacgac

SEQ ID NO: 2952613 - RNA, 18 nt, Mycobacterium avium subsp. paratuberculosis
gccggaaggccaaggcca

SEQ ID NO: 2952614 - RNA, 18 nt, Mycobacterium avium subsp. paratuberculosis
gccggaaggucuuucguc

SEQ ID NO: 2952615 - RNA, 20 nt, Mycobacterium avium subsp. paratuberculosis
gccggaaguucucgccgugc

SEQ ID NO: 2952616 - RNA, 18 nt, Mycobacterium avium subsp. paratuberculosis
gccggaauggcaaggcca

SEQ ID NO: 2952617 - RNA, 21 nt, Mycobacterium avium subsp. paratuberculosis
gccggaauggcaaggccagca

SEQ ID NO: 2952618 - RNA, 22 nt, Mycobacterium avium subsp. paratuberculosis
gccggaauggcaaggccagcaa

SEQ ID NO: 2952619 - RNA, 23 nt, Mycobacterium avium subsp. paratuberculosis
gccggaauggcaaggccagcaac

SEQ ID NO: 2952620 - RNA, 15 nt, Mycobacterium avium subsp. paratuberculosis
gccggacaccaccgc

SEQ ID NO: 2952621 - RNA, 18 nt, Mycobacterium avium subsp. paratuberculosis
gccggacaccaccgcggu

SEQ ID NO: 2952622 - RNA, 13 nt, Mycobacterium avium subsp. paratuberculosis
gccggacaccccg

SEQ ID NO: 2952623 - RNA, 14 nt, Mycobacterium avium subsp. paratuberculosis
gccggacaccccgg

SEQ ID NO: 2952624 - RNA, 17 nt, Mycobacterium avium subsp. paratuberculosis
gccggacaccccggcca

SEQ ID NO: 2952625 - RNA, 20 nt, Mycobacterium avium subsp. paratuberculosis
gccggacaccgaaccgcccc

SEQ ID NO: 2952626 - RNA, 16 nt, Mycobacterium avium subsp. paratuberculosis
gccggacaccggcacg

SEQ ID NO: 2952627 - RNA, 14 nt, Mycobacterium avium subsp. paratuberculosis
gccggaggugcggg

SEQ ID NO: 2952628 - RNA, 20 nt, Mycobacterium avium subsp. paratuberculosis
gccggaggugcgggucucga

SEQ ID NO: 2952629 - RNA, 14 nt, Mycobacterium avium subsp. paratuberculosis
gccggaucaccugg

SEQ ID NO: 2952630 - RNA, 16 nt, Mycobacterium avium subsp. paratuberculosis
gccggaucaccuggug

SEQ ID NO: 2952631 - RNA, 13 nt, Mycobacterium avium subsp. paratuberculosis
gccggaucagcag

SEQ ID NO: 2952632 - RNA, 22 nt, Mycobacterium avium subsp. paratuberculosis
gccggaucagcguuccggcggc

SEQ ID NO: 2952633 - RNA, 23 nt, Mycobacterium avium subsp. paratuberculosis
gccggaucagcguuccggcggcc

SEQ ID NO: 2952634 - RNA, 22 nt, Mycobacterium avium subsp. paratuberculosis
gccggaucgaaaaggucgaaca

SEQ ID NO: 2952635 - RNA, 21 nt, Mycobacterium avium subsp. paratuberculosis
gccggaucgaauccggcggcg

SEQ ID NO: 2952636 - RNA, 22 nt, Mycobacterium avium subsp. paratuberculosis
gccggaucgaauccggcggcgc

SEQ ID NO: 2952637 - RNA, 17 nt, Mycobacterium avium subsp. paratuberculosis
gccggaucgagcacccg

SEQ ID NO: 2952638 - RNA, 20 nt, Mycobacterium avium subsp. paratuberculosis
gccggaucgagcacccggcg

SEQ ID NO: 2952639 - RNA, 22 nt, Mycobacterium avium subsp. paratuberculosis
gccggaucgagcacccggcggg

SEQ ID NO: 2952640 - RNA, 15 nt, Mycobacterium avium subsp. paratuberculosis
gccggaucgccgagg

SEQ ID NO: 2952641 - RNA, 19 nt, Mycobacterium avium subsp. paratuberculosis
gccggaucggcagcgcguu

SEQ ID NO: 2952642 - RNA, 21 nt, Mycobacterium avium subsp. paratuberculosis
gccggaucggcagcgcguuga

SEQ ID NO: 2952643 - RNA, 13 nt, Mycobacterium avium subsp. paratuberculosis
gccggaucgggac

SEQ ID NO: 2952644 - RNA, 18 nt, Mycobacterium avium subsp. paratuberculosis
gccggaucgggaccggga

SEQ ID NO: 2952645 - RNA, 15 nt, Mycobacterium avium subsp. paratuberculosis
gccggaucggggugg

SEQ ID NO: 2952646 - RNA, 18 nt, Mycobacterium avium subsp. paratuberculosis
gccggaucgggguggacg

SEQ ID NO: 2952647 - RNA, 19 nt, Mycobacterium avium subsp. paratuberculosis
gccggaucgugucccggcg

SEQ ID NO: 2952648 - RNA, 22 nt, Mycobacterium avium subsp. paratuberculosis
gccggaucgugucccggcgccc

SEQ ID NO: 2952649 - RNA, 15 nt, Mycobacterium avium subsp. paratuberculosis
gccggaucucgucgg

SEQ ID NO: 2952650 - RNA, 16 nt, Mycobacterium avium subsp. paratuberculosis
gccggaucucgucggg

SEQ ID NO: 2952651 - RNA, 14 nt, Mycobacterium avium subsp. paratuberculosis
gccggaugccgcgc

SEQ ID NO: 2952652 - RNA, 15 nt, Mycobacterium avium subsp. paratuberculosis
gccggaugccgcgcg

SEQ ID NO: 2952653 - RNA, 16 nt, Mycobacterium avium subsp. paratuberculosis
gccggaugccgcgcgg

SEQ ID NO: 2952654 - RNA, 21 nt, Mycobacterium avium subsp. paratuberculosis
gccggaugccgcgcggcgcca

SEQ ID NO: 2952655 - RNA, 13 nt, Mycobacterium avium subsp. paratuberculosis
gccggaugcggcc

SEQ ID NO: 2952656 - RNA, 15 nt, Mycobacterium avium subsp. paratuberculosis
gccggaugcggccga

SEQ ID NO: 2952657 - RNA, 18 nt, Mycobacterium avium subsp. paratuberculosis
gccggauggccagcaggu

SEQ ID NO: 2952658 - RNA, 16 nt, Mycobacterium avium subsp. paratuberculosis
gccggaugggcgcacg

SEQ ID NO: 2952659 - RNA, 19 nt, Mycobacterium avium subsp. paratuberculosis
gccggaugggcgcacgauc

SEQ ID NO: 2952660 - RNA, 22 nt, Mycobacterium avium subsp. paratuberculosis
gccggaugguccgcaugucgaa

SEQ ID NO: 2952661 - RNA, 20 nt, Mycobacterium avium subsp. paratuberculosis
gccggauguccuacggcggg

SEQ ID NO: 2952662 - RNA, 23 nt, Mycobacterium avium subsp. paratuberculosis
gccggauguccuacggcgggugc

SEQ ID NO: 2952663 - RNA, 17 nt, Mycobacterium avium subsp. paratuberculosis
gccggauuacucgccgg

SEQ ID NO: 2952664 - RNA, 18 nt, Mycobacterium avium subsp. paratuberculosis
gccggauuacucgccggc

SEQ ID NO: 2952665 - RNA, 15 nt, Mycobacterium avium subsp. paratuberculosis
gccggauucucgccc

SEQ ID NO: 2952666 - RNA, 19 nt, Mycobacterium avium subsp. paratuberculosis
gccggauucucgcccggcu

SEQ ID NO: 2952667 - RNA, 18 nt, Mycobacterium avium subsp. paratuberculosis
gccggauugcgagccggu

SEQ ID NO: 2952668 - RNA, 16 nt, Mycobacterium avium subsp. paratuberculosis
gccggauuggcgucgg

SEQ ID NO: 2952669 - RNA, 18 nt, Mycobacterium avium subsp. paratuberculosis
gccggauuggcgucggug

SEQ ID NO: 2952670 - RNA, 19 nt, Mycobacterium avium subsp. paratuberculosis
gccggauuggcgucggugg

SEQ ID NO: 2952671 - RNA, 21 nt, Mycobacterium avium subsp. paratuberculosis
gccggauuggcgucgguggcg

SEQ ID NO: 2952672 - RNA, 16 nt, Mycobacterium avium subsp. paratuberculosis
gccggcaacaacgcca

SEQ ID NO: 2952673 - RNA, 15 nt, Mycobacterium avium subsp. paratuberculosis
gccggcaaccgcugc

SEQ ID NO: 2952674 - RNA, 16 nt, Mycobacterium avium subsp. paratuberculosis
gccggcaaccgcugcg

SEQ ID NO: 2952675 - RNA, 20 nt, Mycobacterium avium subsp. paratuberculosis
gccggcaacgacccgucggg

SEQ ID NO: 2952676 - RNA, 20 nt, Mycobacterium avium subsp. paratuberculosis
gccggcaacucccgaucgcc

SEQ ID NO: 2952677 - RNA, 16 nt, Mycobacterium avium subsp. paratuberculosis
gccggcaacuggccgc

SEQ ID NO: 2952678 - RNA, 21 nt, Mycobacterium avium subsp. paratuberculosis
gccggcaacuggccgcccggg

SEQ ID NO: 2952679 - RNA, 15 nt, Mycobacterium avium subsp. paratuberculosis
gccggcacaccgagc

SEQ ID NO: 2952680 - RNA, 12 nt, Mycobacterium avium subsp. paratuberculosis
gccggcaccagc

SEQ ID NO: 2952681 - RNA, 15 nt, Mycobacterium avium subsp. paratuberculosis
gccggcaccagcagc

SEQ ID NO: 2952682 - RNA, 14 nt, Mycobacterium avium subsp. paratuberculosis
gccggcacccgggc

SEQ ID NO: 2952683 - RNA, 15 nt, Mycobacterium avium subsp. paratuberculosis
gccggcaccguccgg

SEQ ID NO: 2952684 - RNA, 16 nt, Mycobacterium avium subsp. paratuberculosis
gccggcaccguccggc

SEQ ID NO: 2952685 - RNA, 17 nt, Mycobacterium avium subsp. paratuberculosis
gccggcaccguccggcg

SEQ ID NO: 2952686 - RNA, 12 nt, Mycobacterium avium subsp. paratuberculosis
gccggcaccucg

SEQ ID NO: 2952687 - RNA, 15 nt, Mycobacterium avium subsp. paratuberculosis
gccggcaccucgaag

SEQ ID NO: 2952688 - RNA, 21 nt, Mycobacterium avium subsp. paratuberculosis
gccggcaccucgaagggcgcc

SEQ ID NO: 2952689 - RNA, 14 nt, Mycobacterium avium subsp. paratuberculosis
gccggcacgauggc

SEQ ID NO: 2952690 - RNA, 15 nt, Mycobacterium avium subsp. paratuberculosis
gccggcacgauggcg

SEQ ID NO: 2952691 - RNA, 19 nt, Mycobacterium avium subsp. paratuberculosis
gccggcacgauggcgcggc

SEQ ID NO: 2952692 - RNA, 20 nt, Mycobacterium avium subsp. paratuberculosis
gccggcacgauggcgcggcg

SEQ ID NO: 2952693 - RNA, 14 nt, Mycobacterium avium subsp. paratuberculosis
gccggcacgcgcgc

SEQ ID NO: 2952694 - RNA, 18 nt, Mycobacterium avium subsp. paratuberculosis
gccggcacgcgcgccgga

SEQ ID NO: 2952695 - RNA, 15 nt, Mycobacterium avium subsp. paratuberculosis
gccggcacggccggc

SEQ ID NO: 2952696 - RNA, 16 nt, Mycobacterium avium subsp. paratuberculosis
gccggcacggccggcc

SEQ ID NO: 2952697 - RNA, 17 nt, Mycobacterium avium subsp. paratuberculosis
gccggcacggccggccg

SEQ ID NO: 2952698 - RNA, 18 nt, Mycobacterium avium subsp. paratuberculosis
gccggcacggccggccgg

SEQ ID NO: 2952699 - RNA, 22 nt, Mycobacterium avium subsp. paratuberculosis
gccggcacuaccgccucgccag

SEQ ID NO: 2952700 - RNA, 16 nt, Mycobacterium avium subsp. paratuberculosis
gccggcacucgccucg

SEQ ID NO: 2952701 - RNA, 17 nt, Mycobacterium avium subsp. paratuberculosis
gccggcacucgccucgg

SEQ ID NO: 2952702 - RNA, 17 nt, Mycobacterium avium subsp. paratuberculosis
gccggcacucgucgugg

SEQ ID NO: 2952703 - RNA, 20 nt, Mycobacterium avium subsp. paratuberculosis
gccggcacucgucguggcgg

SEQ ID NO: 2952704 - RNA, 21 nt, Mycobacterium avium subsp. paratuberculosis
gccggcacucgucguggcggu

SEQ ID NO: 2952705 - RNA, 23 nt, Mycobacterium avium subsp. paratuberculosis
gccggcacucgucguggcggugc

SEQ ID NO: 2952706 - RNA, 20 nt, Mycobacterium avium subsp. paratuberculosis
gccggcacugcugcccgcga

SEQ ID NO: 2952707 - RNA, 19 nt, Mycobacterium avium subsp. paratuberculosis
gccggcagacgaauucgga

SEQ ID NO: 2952708 - RNA, 14 nt, Mycobacterium avium subsp. paratuberculosis
gccggcagcaaccg

SEQ ID NO: 2952709 - RNA, 15 nt, Mycobacterium avium subsp. paratuberculosis
gccggcagcaaccgg

SEQ ID NO: 2952710 - RNA, 18 nt, Mycobacterium avium subsp. paratuberculosis
gccggcagcaaccggcgg

SEQ ID NO: 2952711 - RNA, 21 nt, Mycobacterium avium subsp. paratuberculosis
gccggcagcaaccggcggcug

SEQ ID NO: 2952712 - RNA, 12 nt, Mycobacterium avium subsp. paratuberculosis
gccggccagcgg

SEQ ID NO: 2952713 - RNA, 13 nt, Mycobacterium avium subsp. paratuberculosis
gccggccagcggc

SEQ ID NO: 2952714 - RNA, 15 nt, Mycobacterium avium subsp. paratuberculosis
gccggccagcggcca

SEQ ID NO: 2952715 - RNA, 21 nt, Mycobacterium avium subsp. paratuberculosis
gccggccagcggccagcccgc

SEQ ID NO: 2952716 - RNA, 14 nt, Mycobacterium avium subsp. paratuberculosis
gccggccagcgggu

SEQ ID NO: 2952717 - RNA, 16 nt, Mycobacterium avium subsp. paratuberculosis
gccggccagcgggucg

SEQ ID NO: 2952718 - RNA, 19 nt, Mycobacterium avium subsp. paratuberculosis
gccggccagcgucgcgccg

SEQ ID NO: 2952719 - RNA, 20 nt, Mycobacterium avium subsp. paratuberculosis
gccggccagcgucgcgccgc

SEQ ID NO: 2952720 - RNA, 21 nt, Mycobacterium avium subsp. paratuberculosis
gccggccagcgucgcgccgcc

SEQ ID NO: 2952721 - RNA, 13 nt, Mycobacterium avium subsp. paratuberculosis
gccggccagcucc

SEQ ID NO: 2952722 - RNA, 23 nt, Mycobacterium avium subsp. paratuberculosis
gccggccagcuccgccacccugc

SEQ ID NO: 2952723 - RNA, 14 nt, Mycobacterium avium subsp. paratuberculosis
gccggccagcucga

SEQ ID NO: 2952724 - RNA, 18 nt, Mycobacterium avium subsp. paratuberculosis
gccggccagcucgccgcc

SEQ ID NO: 2952725 - RNA, 22 nt, Mycobacterium avium subsp. paratuberculosis
gccggccagcucgccgccgacg

SEQ ID NO: 2952726 - RNA, 20 nt, Mycobacterium avium subsp. paratuberculosis
gccggccagcuuuccggccg

SEQ ID NO: 2952727 - RNA, 12 nt, Mycobacterium avium subsp. paratuberculosis
gccggccaggca

SEQ ID NO: 2952728 - RNA, 21 nt, Mycobacterium avium subsp. paratuberculosis
gccggccaggcacagcagggc

SEQ ID NO: 2952729 - RNA, 17 nt, Mycobacterium avium subsp. paratuberculosis
gccggccaggcccagcc

SEQ ID NO: 2952730 - RNA, 17 nt, Mycobacterium avium subsp. paratuberculosis
gccggccaggccggccu

SEQ ID NO: 2952731 - RNA, 14 nt, Mycobacterium avium subsp. paratuberculosis
gccggccaggcgac

SEQ ID NO: 2952732 - RNA, 17 nt, Mycobacterium avium subsp. paratuberculosis
gccggccagguugacca

SEQ ID NO: 2952733 - RNA, 22 nt, Mycobacterium avium subsp. paratuberculosis
gccggccagguugaccaccagc

SEQ ID NO: 2952734 - RNA, 23 nt, Mycobacterium avium subsp. paratuberculosis
gccggccagguugaccaccagcg

SEQ ID NO: 2952735 - RNA, 16 nt, Mycobacterium avium subsp. paratuberculosis
gccggccaguucccgg

SEQ ID NO: 2952736 - RNA, 18 nt, Mycobacterium avium subsp. paratuberculosis
gccggccaguucccgggc

SEQ ID NO: 2952737 - RNA, 18 nt, Mycobacterium avium subsp. paratuberculosis
gccggccaucucggcggc

SEQ ID NO: 2952738 - RNA, 14 nt, Mycobacterium avium subsp. paratuberculosis
gccggccaugacca

SEQ ID NO: 2952739 - RNA, 24 nt, Mycobacterium avium subsp. paratuberculosis
gccggccaugaccaugucgacgcu

SEQ ID NO: 2952740 - RNA, 23 nt, Mycobacterium avium subsp. paratuberculosis
gccggccaugaugaugacguccu

SEQ ID NO: 2952741 - RNA, 24 nt, Mycobacterium avium subsp. paratuberculosis
gccggccaugcccucgaucgagga

SEQ ID NO: 2952742 - RNA, 13 nt, Mycobacterium avium subsp. paratuberculosis
gccggcccagcgc

SEQ ID NO: 2952743 - RNA, 14 nt, Mycobacterium avium subsp. paratuberculosis
gccggcccagcgcg

SEQ ID NO: 2952744 - RNA, 15 nt, Mycobacterium avium subsp. paratuberculosis
gccggcccagcgcgc

SEQ ID NO: 2952745 - RNA, 17 nt, Mycobacterium avium subsp. paratuberculosis
gccggcccagcgcgcgg

SEQ ID NO: 2952746 - RNA, 20 nt, Mycobacterium avium subsp. paratuberculosis
gccggcccagcgcgcggcgg

SEQ ID NO: 2952747 - RNA, 12 nt, Mycobacterium avium subsp. paratuberculosis
gccggcccagcu

SEQ ID NO: 2952748 - RNA, 15 nt, Mycobacterium avium subsp. paratuberculosis
gccggcccagcucca

SEQ ID NO: 2952749 - RNA, 23 nt, Mycobacterium avium subsp. paratuberculosis
gccggcccagcuccacgcguagc

SEQ ID NO: 2952750 - RNA, 13 nt, Mycobacterium avium subsp. paratuberculosis
gccggcccaggca

SEQ ID NO: 2952751 - RNA, 14 nt, Mycobacterium avium subsp. paratuberculosis
gccggcccaggcag

SEQ ID NO: 2952752 - RNA, 22 nt, Mycobacterium avium subsp. paratuberculosis
gccggcccaguggaucggcccg

SEQ ID NO: 2952753 - RNA, 23 nt, Mycobacterium avium subsp. paratuberculosis
gccggcccaguggaucggcccga

SEQ ID NO: 2952754 - RNA, 14 nt, Mycobacterium avium subsp. paratuberculosis
gccggccccgcccg

SEQ ID NO: 2952755 - RNA, 17 nt, Mycobacterium avium subsp. paratuberculosis
gccggccccgcccggcg

SEQ ID NO: 2952756 - RNA, 18 nt, Mycobacterium avium subsp. paratuberculosis
gccggccccgcccggcgc

SEQ ID NO: 2952757 - RNA, 19 nt, Mycobacterium avium subsp. paratuberculosis
gccggccccgcccggcgcg

SEQ ID NO: 2952758 - RNA, 20 nt, Mycobacterium avium subsp. paratuberculosis
gccggccccgcccggcgcgc

SEQ ID NO: 2952759 - RNA, 21 nt, Mycobacterium avium subsp. paratuberculosis
gccggccccgcccggcgcgca

SEQ ID NO: 2952760 - RNA, 22 nt, Mycobacterium avium subsp. paratuberculosis
gccggccccgcccggcgcgcag

SEQ ID NO: 2952761 - RNA, 23 nt, Mycobacterium avium subsp. paratuberculosis
gccggccccgcccggcgcgcagc

SEQ ID NO: 2952762 - RNA, 16 nt, Mycobacterium avium subsp. paratuberculosis
gccggccccgcccggg

SEQ ID NO: 2952763 - RNA, 22 nt, Mycobacterium avium subsp. paratuberculosis
gccggccccgcccggggcggcg

SEQ ID NO: 2952764 - RNA, 23 nt, Mycobacterium avium subsp. paratuberculosis
gccggccccgcccggggcggcga

SEQ ID NO: 2952765 - RNA, 18 nt, Mycobacterium avium subsp. paratuberculosis
gccggccccggccgggcg

SEQ ID NO: 2952766 - RNA, 15 nt, Mycobacterium avium subsp. paratuberculosis
gccggccccggcgac

SEQ ID NO: 2952767 - RNA, 16 nt, Mycobacterium avium subsp. paratuberculosis
gccggccccggcgacg

SEQ ID NO: 2952768 - RNA, 17 nt, Mycobacterium avium subsp. paratuberculosis
gccggccccggcgacgg

SEQ ID NO: 2952769 - RNA, 13 nt, Mycobacterium avium subsp. paratuberculosis
gccggccccgggg

SEQ ID NO: 2952770 - RNA, 21 nt, Mycobacterium avium subsp. paratuberculosis
gccggccccgggggaccagcg

SEQ ID NO: 2952771 - RNA, 19 nt, Mycobacterium avium subsp. paratuberculosis
gccggccccuaccgccgag

SEQ ID NO: 2952772 - RNA, 17 nt, Mycobacterium avium subsp. paratuberculosis
gccggcccgagcccugc

SEQ ID NO: 2952773 - RNA, 18 nt, Mycobacterium avium subsp. paratuberculosis
gccggcccgagcccugcg

SEQ ID NO: 2952774 - RNA, 12 nt, Mycobacterium avium subsp. paratuberculosis
gccggcccgcag

SEQ ID NO: 2952775 - RNA, 13 nt, Mycobacterium avium subsp. paratuberculosis
gccggcccgcagc

SEQ ID NO: 2952776 - RNA, 15 nt, Mycobacterium avium subsp. paratuberculosis
gccggcccgcagcca

SEQ ID NO: 2952777 - RNA, 17 nt, Mycobacterium avium subsp. paratuberculosis
gccggcccgcagccagc

SEQ ID NO: 2952778 - RNA, 18 nt, Mycobacterium avium subsp. paratuberculosis
gccggcccgcagccagcg

SEQ ID NO: 2952779 - RNA, 14 nt, Mycobacterium avium subsp. paratuberculosis
gccggcccgcagcg

SEQ ID NO: 2952780 - RNA, 15 nt, Mycobacterium avium subsp. paratuberculosis
gccggcccgcagcgc

SEQ ID NO: 2952781 - RNA, 16 nt, Mycobacterium avium subsp. paratuberculosis
gccggcccgcagcgcc

SEQ ID NO: 2952782 - RNA, 21 nt, Mycobacterium avium subsp. paratuberculosis
gccggcccgcagcgccucggc

SEQ ID NO: 2952783 - RNA, 22 nt, Mycobacterium avium subsp. paratuberculosis
gccggcccgcagcgccucggcg

SEQ ID NO: 2952784 - RNA, 12 nt, Mycobacterium avium subsp. paratuberculosis
gccggcccgcau

SEQ ID NO: 2952785 - RNA, 17 nt, Mycobacterium avium subsp. paratuberculosis
gccggcccgcaucgcgg

SEQ ID NO: 2952786 - RNA, 15 nt, Mycobacterium avium subsp. paratuberculosis
gccggcccgcccggc

SEQ ID NO: 2952787 - RNA, 17 nt, Mycobacterium avium subsp. paratuberculosis
gccggcccgcccggcgg

SEQ ID NO: 2952788 - RNA, 18 nt, Mycobacterium avium subsp. paratuberculosis
gccggcccgcccggcggc

SEQ ID NO: 2952789 - RNA, 14 nt, Mycobacterium avium subsp. paratuberculosis
gccggcccgcccgu

SEQ ID NO: 2952790 - RNA, 16 nt, Mycobacterium avium subsp. paratuberculosis
gccggcccgcggcgga

SEQ ID NO: 2952791 - RNA, 17 nt, Mycobacterium avium subsp. paratuberculosis
gccggcccggcccgacg

SEQ ID NO: 2952792 - RNA, 14 nt, Mycobacterium avium subsp. paratuberculosis
gccggcccggcggg

SEQ ID NO: 2952793 - RNA, 13 nt, Mycobacterium avium subsp. paratuberculosis
gccggcccggcgu

SEQ ID NO: 2952794 - RNA, 14 nt, Mycobacterium avium subsp. paratuberculosis
gccggcccggcguu

SEQ ID NO: 2952795 - RNA, 15 nt, Mycobacterium avium subsp. paratuberculosis
gccggcccggggugu

SEQ ID NO: 2952796 - RNA, 15 nt, Mycobacterium avium subsp. paratuberculosis
gccggcccggucgac

SEQ ID NO: 2952797 - RNA, 18 nt, Mycobacterium avium subsp. paratuberculosis
gccggccgggucgaccgc

SEQ ID NO: 2952798 - RNA, 13 nt, Mycobacterium avium subsp. paratuberculosis
gccggccgucagg

SEQ ID NO: 2952799 - RNA, 15 nt, Mycobacterium avium subsp. paratuberculosis
gccggccguccacgg

SEQ ID NO: 2952800 - RNA, 20 nt, Mycobacterium avium subsp. paratuberculosis
gccggccguccacggcggug

SEQ ID NO: 2952801 - RNA, 12 nt, Mycobacterium avium subsp. paratuberculosis
gccggccgugcc

SEQ ID NO: 2952802 - RNA, 21 nt, Mycobacterium avium subsp. paratuberculosis
gccggccgugccggcucggcg

SEQ ID NO: 2952803 - RNA, 14 nt, Mycobacterium avium subsp. paratuberculosis
gccggccguucgcc

SEQ ID NO: 2952804 - RNA, 17 nt, Mycobacterium avium subsp. paratuberculosis
gccggccguucgccggc

SEQ ID NO: 2952805 - RNA, 19 nt, Mycobacterium avium subsp. paratuberculosis
gccggccguucgccggcca

SEQ ID NO: 2952806 - RNA, 23 nt, Mycobacterium avium subsp. paratuberculosis
gccggccguucgccggccagcac

SEQ ID NO: 2952807 - RNA, 14 nt, Mycobacterium avium subsp. paratuberculosis
gccggccguugcgg

SEQ ID NO: 2952808 - RNA, 18 nt, Mycobacterium avium subsp. paratuberculosis
gccggccguugcgggugu

SEQ ID NO: 2952809 - RNA, 12 nt, Mycobacterium avium subsp. paratuberculosis
gccggccuaccu

SEQ ID NO: 2952810 - RNA, 13 nt, Mycobacterium avium subsp. paratuberculosis
gccggccuccagc

SEQ ID NO: 2952811 - RNA, 15 nt, Mycobacterium avium subsp. paratuberculosis
gccggccuccagcug

SEQ ID NO: 2952812 - RNA, 20 nt, Mycobacterium avium subsp. paratuberculosis
gccggccucgaugucgucga

SEQ ID NO: 2952813 - RNA, 13 nt, Mycobacterium avium subsp. paratuberculosis
gccggccucgccg

SEQ ID NO: 2952814 - RNA, 15 nt, Mycobacterium avium subsp. paratuberculosis
gccggccucgccggc

SEQ ID NO: 2952815 - RNA, 16 nt, Mycobacterium avium subsp. paratuberculosis
gccggccucgccggcg

SEQ ID NO: 2952816 - RNA, 19 nt, Mycobacterium avium subsp. paratuberculosis
gccggccucgggguugcug

SEQ ID NO: 2952817 - RNA, 13 nt, Mycobacterium avium subsp. paratuberculosis
gccggccucgucg

SEQ ID NO: 2952818 - RNA, 14 nt, Mycobacterium avium subsp. paratuberculosis
gccggccucgucgg

SEQ ID NO: 2952819 - RNA, 17 nt, Mycobacterium avium subsp. paratuberculosis
gccggccucgucggcga

SEQ ID NO: 2952820 - RNA, 16 nt, Mycobacterium avium subsp. paratuberculosis
gccggccucucgucga

SEQ ID NO: 2952821 - RNA, 18 nt, Mycobacterium avium subsp. paratuberculosis
gccggccucucgucgacg

SEQ ID NO: 2952822 - RNA, 19 nt, Mycobacterium avium subsp. paratuberculosis
gccggccucucgucgacga

SEQ ID NO: 2952823 - RNA, 20 nt, Mycobacterium avium subsp. paratuberculosis
gccggccucucgucgacgau

SEQ ID NO: 2952824 - RNA, 22 nt, Mycobacterium avium subsp. paratuberculosis
gccggccucucgucgacgaugg

SEQ ID NO: 2952825 - RNA, 23 nt, Mycobacterium avium subsp. paratuberculosis
gccggccucucgucgacgauggc

SEQ ID NO: 2952826 - RNA, 18 nt, Mycobacterium avium subsp. paratuberculosis
gccggccugccaccgcga

SEQ ID NO: 2952827 - RNA, 17 nt, Mycobacterium avium subsp. paratuberculosis
gccggccugcccgccgc

SEQ ID NO: 2952828 - RNA, 21 nt, Mycobacterium avium subsp. paratuberculosis
gccggccugcccgccgcggcc

SEQ ID NO: 2952829 - RNA, 19 nt, Mycobacterium avium subsp. paratuberculosis
gccggccugccggaugccg

SEQ ID NO: 2952830 - RNA, 21 nt, Mycobacterium avium subsp. paratuberculosis
gccggccugcuuuucggccga

SEQ ID NO: 2952831 - RNA, 15 nt, Mycobacterium avium subsp. paratuberculosis
gccggccuggcccag

SEQ ID NO: 2952832 - RNA, 16 nt, Mycobacterium avium subsp. paratuberculosis
gccggccuggcccagc

SEQ ID NO: 2952833 - RNA, 19 nt, Mycobacterium avium subsp. paratuberculosis
gccggccuggcccagccgc

SEQ ID NO: 2952834 - RNA, 12 nt, Mycobacterium avium subsp. paratuberculosis
gccggccuggug

SEQ ID NO: 2952835 - RNA, 16 nt, Mycobacterium avium subsp. paratuberculosis
gccggccuucucgcgc

SEQ ID NO: 2952836 - RNA, 17 nt, Mycobacterium avium subsp. paratuberculosis
gccggccuucucgcgca

SEQ ID NO: 2952837 - RNA, 18 nt, Mycobacterium avium subsp. paratuberculosis
gccggccuucucgcgcac

SEQ ID NO: 2952838 - RNA, 22 nt, Mycobacterium avium subsp. paratuberculosis
gccggccuucucgcgcaccgcg

SEQ ID NO: 2952839 - RNA, 23 nt, Mycobacterium avium subsp. paratuberculosis
gccggccuucucgcgcaccgcgg

SEQ ID NO: 2952840 - RNA, 17 nt, Mycobacterium avium subsp. paratuberculosis
gccggccuugcucgccg

SEQ ID NO: 2952841 - RNA, 17 nt, Mycobacterium avium subsp. paratuberculosis
gccggccuuggcccgcg

SEQ ID NO: 2952842 - RNA, 18 nt, Mycobacterium avium subsp. paratuberculosis
gccggccuuggcccgcgc

SEQ ID NO: 2952843 - RNA, 19 nt, Mycobacterium avium subsp. paratuberculosis
gccggccuuggcccgcgcc

SEQ ID NO: 2952844 - RNA, 22 nt, Mycobacterium avium subsp. paratuberculosis
gccggccuuggcccgcgcccgc

SEQ ID NO: 2952845 - RNA, 17 nt, Mycobacterium avium subsp. paratuberculosis
gccggcgaaacacagca

SEQ ID NO: 2952846 - RNA, 21 nt, Mycobacterium avium subsp. paratuberculosis
gccggcgaaacacagcagcac

SEQ ID NO: 2952847 - RNA, 23 nt, Mycobacterium avium subsp. paratuberculosis
gccggcgaaacacagcagcacgc

SEQ ID NO: 2952848 - RNA, 15 nt, Mycobacterium avium subsp. paratuberculosis
gccggcgaaccgccg

SEQ ID NO: 2952849 - RNA, 16 nt, Mycobacterium avium subsp. paratuberculosis
gccggcgaaccgccgc

SEQ ID NO: 2952850 - RNA, 17 nt, Mycobacterium avium subsp. paratuberculosis
gccggcgaaccgccgca

SEQ ID NO: 2952851 - RNA, 21 nt, Mycobacterium avium subsp. paratuberculosis
gccggcgaaccgccgcaccca

SEQ ID NO: 2952852 - RNA, 23 nt, Mycobacterium avium subsp. paratuberculosis
gccggcgaaccgccgcacccagc

SEQ ID NO: 2952853 - RNA, 19 nt, Mycobacterium avium subsp. paratuberculosis
gccggcgaaccucacccau

SEQ ID NO: 2952854 - RNA, 20 nt, Mycobacterium avium subsp. paratuberculosis
gccggcgaacgacgucgagg

SEQ ID NO: 2952855 - RNA, 17 nt, Mycobacterium avium subsp. paratuberculosis
gccggcgaacuccaccc

SEQ ID NO: 2952856 - RNA, 19 nt, Mycobacterium avium subsp. paratuberculosis
gccggcgaacuccacccug

SEQ ID NO: 2952857 - RNA, 23 nt, Mycobacterium avium subsp. paratuberculosis
gccggcgaacuccacccugccga

SEQ ID NO: 2952858 - RNA, 16 nt, Mycobacterium avium subsp. paratuberculosis
gccggcgaacucgcgg

SEQ ID NO: 2952859 - RNA, 20 nt, Mycobacterium avium subsp. paratuberculosis
gccggcgaacucgcggcggg

SEQ ID NO: 2952860 - RNA, 23 nt, Mycobacterium avium subsp. paratuberculosis
gccggcgaacucgcggcggguca

SEQ ID NO: 2952861 - RNA, 16 nt, Mycobacterium avium subsp. paratuberculosis
gccggcgaagccgcuc

SEQ ID NO: 2952862 - RNA, 18 nt, Mycobacterium avium subsp. paratuberculosis
gccggcgaagccgcucaa

SEQ ID NO: 2952863 - RNA, 16 nt, Mycobacterium avium subsp. paratuberculosis
gccggcgaagcucgac

SEQ ID NO: 2952864 - RNA, 17 nt, Mycobacterium avium subsp. paratuberculosis
gccggcgaagcucgacg

SEQ ID NO: 2952865 - RNA, 16 nt, Mycobacterium avium subsp. paratuberculosis
gccggcgaaggacagc

SEQ ID NO: 2952866 - RNA, 18 nt, Mycobacterium avium subsp. paratuberculosis
gccggcgaaggacagccg

SEQ ID NO: 2952867 - RNA, 20 nt, Mycobacterium avium subsp. paratuberculosis
gccggcgaaggacagccgga

SEQ ID NO: 2952868 - RNA, 21 nt, Mycobacterium avium subsp. paratuberculosis
gccggcgaaggacagccggac

SEQ ID NO: 2952869 - RNA, 13 nt, Mycobacterium avium subsp. paratuberculosis
gccggcgaccagc

SEQ ID NO: 2952870 - RNA, 16 nt, Mycobacterium avium subsp. paratuberculosis
gccggcgaccagcccc

SEQ ID NO: 2952871 - RNA, 18 nt, Mycobacterium avium subsp. paratuberculosis
gccggcgaccagccccuc

SEQ ID NO: 2952872 - RNA, 13 nt, Mycobacterium avium subsp. paratuberculosis
gccggcgaccgcc

SEQ ID NO: 2952873 - RNA, 15 nt, Mycobacterium avium subsp. paratuberculosis
gccggcgaccgccuu

SEQ ID NO: 2952874 - RNA, 17 nt, Mycobacterium avium subsp. paratuberculosis
gccggcgaccgugccca

SEQ ID NO: 2952875 - RNA, 22 nt, Mycobacterium avium subsp. paratuberculosis
gccggcgaccgugcccaccagc

SEQ ID NO: 2952876 - RNA, 17 nt, Mycobacterium avium subsp. paratuberculosis
gccggcgacgaccgcac

SEQ ID NO: 2952877 - RNA, 23 nt, Mycobacterium avium subsp. paratuberculosis
gccggcgacgaccgcaccgacca

SEQ ID NO: 2952878 - RNA, 20 nt, Mycobacterium avium subsp. paratuberculosis
gccggcgacgauaucggccg

SEQ ID NO: 2952879 - RNA, 21 nt, Mycobacterium avium subsp. paratuberculosis
gccggcgacgauaucggccgc

SEQ ID NO: 2952880 - RNA, 13 nt, Mycobacterium avium subsp. paratuberculosis
gccggcgacgccg

SEQ ID NO: 2952881 - RNA, 15 nt, Mycobacterium avium subsp. paratuberculosis
gccggcgccggugcc

SEQ ID NO: 2952882 - RNA, 20 nt, Mycobacterium avium subsp. paratuberculosis
gccggcgccggugccgcagc

SEQ ID NO: 2952883 - RNA, 21 nt, Mycobacterium avium subsp. paratuberculosis
gccggcgccggugccgcagcc

SEQ ID NO: 2952884 - RNA, 22 nt, Mycobacterium avium subsp. paratuberculosis
gccggcgccggugccgcagccg

SEQ ID NO: 2952885 - RNA, 13 nt, Mycobacterium avium subsp. paratuberculosis
gccggcgccgucg

SEQ ID NO: 2952886 - RNA, 21 nt, Mycobacterium avium subsp. paratuberculosis
gccggcgccgucgauccaccc

SEQ ID NO: 2952887 - RNA, 15 nt, Mycobacterium avium subsp. paratuberculosis
gccggcgcgaccagc

SEQ ID NO: 2952888 - RNA, 17 nt, Mycobacterium avium subsp. paratuberculosis
gccggcgcgcaacagcg

SEQ ID NO: 2952889 - RNA, 14 nt, Mycobacterium avium subsp. paratuberculosis
gccggcgcgcacgg

SEQ ID NO: 2952890 - RNA, 14 nt, Mycobacterium avium subsp. paratuberculosis
gccggcgcgcgagc

SEQ ID NO: 2952891 - RNA, 17 nt, Mycobacterium avium subsp. paratuberculosis
gccggcgcgcgagcguc

SEQ ID NO: 2952892 - RNA, 15 nt, Mycobacterium avium subsp. paratuberculosis
gccggcgcgcggugg

SEQ ID NO: 2952893 - RNA, 18 nt, Mycobacterium avium subsp. paratuberculosis
gccggcgcgcugaagcgc

SEQ ID NO: 2952894 - RNA, 22 nt, Mycobacterium avium subsp. paratuberculosis
gccggcgcgcugaagcgcgacc

SEQ ID NO: 2952895 - RNA, 22 nt, Mycobacterium avium subsp. paratuberculosis
gccggcgcggaacagcgucgcc

SEQ ID NO: 2952896 - RNA, 23 nt, Mycobacterium avium subsp. paratuberculosis
gccggcgcggaacagcgucgccg

SEQ ID NO: 2952897 - RNA, 15 nt, Mycobacterium avium subsp. paratuberculosis
gccggcgcggccagc

SEQ ID NO: 2952898 - RNA, 17 nt, Mycobacterium avium subsp. paratuberculosis
gccggcgcggccagcug

SEQ ID NO: 2952899 - RNA, 13 nt, Mycobacterium avium subsp. paratuberculosis
gccggcgcggcgg

SEQ ID NO: 2952900 - RNA, 14 nt, Mycobacterium avium subsp. paratuberculosis
gccggcgcggcggc

SEQ ID NO: 2952901 - RNA, 16 nt, Mycobacterium avium subsp. paratuberculosis
gccggcgcggcggcga

SEQ ID NO: 2952902 - RNA, 18 nt, Mycobacterium avium subsp. paratuberculosis
gccggcgcggcggcgacg

SEQ ID NO: 2952903 - RNA, 20 nt, Mycobacterium avium subsp. paratuberculosis
gccggcgcggcggcgacguc

SEQ ID NO: 2952904 - RNA, 15 nt, Mycobacterium avium subsp. paratuberculosis
gccggcgcgggccgc

SEQ ID NO: 2952905 - RNA, 18 nt, Mycobacterium avium subsp. paratuberculosis
gccggcgcgggccgcagc

SEQ ID NO: 2952906 - RNA, 19 nt, Mycobacterium avium subsp. paratuberculosis
gccggcgcgggccgcagcg

SEQ ID NO: 2952907 - RNA, 21 nt, Mycobacterium avium subsp. paratuberculosis
gccggcgcgggccgcagcgcg

SEQ ID NO: 2952908 - RNA, 19 nt, Mycobacterium avium subsp. paratuberculosis
gccggcgcgggggcggccu

SEQ ID NO: 2952909 - RNA, 21 nt, Mycobacterium avium subsp. paratuberculosis
gccggcgcgggggcggccuga

SEQ ID NO: 2952910 - RNA, 12 nt, Mycobacterium avium subsp. paratuberculosis
gccggcgcggug

SEQ ID NO: 2952911 - RNA, 16 nt, Mycobacterium avium subsp. paratuberculosis
gccggcgcggugcucg

SEQ ID NO: 2952912 - RNA, 17 nt, Mycobacterium avium subsp. paratuberculosis
gccggcgcggugcucgg

SEQ ID NO: 2952913 - RNA, 13 nt, Mycobacterium avium subsp. paratuberculosis
gccggcgcggugg

SEQ ID NO: 2952914 - RNA, 19 nt, Mycobacterium avium subsp. paratuberculosis
gccggcgcggugggcggcg

SEQ ID NO: 2952915 - RNA, 16 nt, Mycobacterium avium subsp. paratuberculosis
gccggcgcguccggag

SEQ ID NO: 2952916 - RNA, 13 nt, Mycobacterium avium subsp. paratuberculosis
gccggcgcgugcg

SEQ ID NO: 2952917 - RNA, 17 nt, Mycobacterium avium subsp. paratuberculosis
gccggcgcucgucgucg

SEQ ID NO: 2952918 - RNA, 18 nt, Mycobacterium avium subsp. paratuberculosis
gccggcgcucgucgucgc

SEQ ID NO: 2952919 - RNA, 22 nt, Mycobacterium avium subsp. paratuberculosis
gccggcgcucgucgucgccgau

SEQ ID NO: 2952920 - RNA, 18 nt, Mycobacterium avium subsp. paratuberculosis
gccggcgcugcccgucga

SEQ ID NO: 2952921 - RNA, 17 nt, Mycobacterium avium subsp. paratuberculosis
gccggcgcuggcgcgcc

SEQ ID NO: 2952922 - RNA, 21 nt, Mycobacterium avium subsp. paratuberculosis
gccggcgcuggcgcgccguac

SEQ ID NO: 2952923 - RNA, 22 nt, Mycobacterium avium subsp. paratuberculosis
gccggcgcuggcgcgccguacc

SEQ ID NO: 2952924 - RNA, 16 nt, Mycobacterium avium subsp. paratuberculosis
gccggcggacagcccc

SEQ ID NO: 2952925 - RNA, 17 nt, Mycobacterium avium subsp. paratuberculosis
gccggcggacagccccg

SEQ ID NO: 2952926 - RNA, 23 nt, Mycobacterium avium subsp. paratuberculosis
gccggcggacagccccgagccgc

SEQ ID NO: 2952927 - RNA, 14 nt, Mycobacterium avium subsp. paratuberculosis
gccggcggacgcgg

SEQ ID NO: 2952928 - RNA, 23 nt, Mycobacterium avium subsp. paratuberculosis
gccggcggauauagccgacggga

SEQ ID NO: 2952929 - RNA, 14 nt, Mycobacterium avium subsp. paratuberculosis
gccggcggcaggug

SEQ ID NO: 2952930 - RNA, 20 nt, Mycobacterium avium subsp. paratuberculosis
gccggcggcagugcgccguc

SEQ ID NO: 2952931 - RNA, 12 nt, Mycobacterium avium subsp. paratuberculosis
gccggcggccaa

SEQ ID NO: 2952932 - RNA, 20 nt, Mycobacterium avium subsp. paratuberculosis
gccggcggccaaucccacca

SEQ ID NO: 2952933 - RNA, 12 nt, Mycobacterium avium subsp. paratuberculosis
gccggcggccac

SEQ ID NO: 2952934 - RNA, 13 nt, Mycobacterium avium subsp. paratuberculosis
gccggcggccacg

SEQ ID NO: 2952935 - RNA, 14 nt, Mycobacterium avium subsp. paratuberculosis
gccggcggccacga

SEQ ID NO: 2952936 - RNA, 15 nt, Mycobacterium avium subsp. paratuberculosis
gccggcggccacgau

SEQ ID NO: 2952937 - RNA, 14 nt, Mycobacterium avium subsp. paratuberculosis
gccggcggccacgc

SEQ ID NO: 2952938 - RNA, 14 nt, Mycobacterium avium subsp. paratuberculosis
gccggcggccagca

SEQ ID NO: 2952939 - RNA, 18 nt, Mycobacterium avium subsp. paratuberculosis
gccggcggccagcaucgg

SEQ ID NO: 2952940 - RNA, 13 nt, Mycobacterium avium subsp. paratuberculosis
gccggcggccagu

SEQ ID NO: 2952941 - RNA, 14 nt, Mycobacterium avium subsp. paratuberculosis
gccggcggccaugg

SEQ ID NO: 2952942 - RNA, 21 nt, Mycobacterium avium subsp. paratuberculosis
gccggcggccauggucgcggc

SEQ ID NO: 2952943 - RNA, 23 nt, Mycobacterium avium subsp. paratuberculosis
gccggcggccauggucgcggccg

SEQ ID NO: 2952944 - RNA, 11 nt, Mycobacterium avium subsp. paratuberculosis
gccggcggccg

SEQ ID NO: 2952945 - RNA, 14 nt, Mycobacterium avium subsp. paratuberculosis
gccggcggccgaca

SEQ ID NO: 2952946 - RNA, 13 nt, Mycobacterium avium subsp. paratuberculosis
gccggcggccgcc

SEQ ID NO: 2952947 - RNA, 14 nt, Mycobacterium avium subsp. paratuberculosis
gccggcggccgcca

SEQ ID NO: 2952948 - RNA, 17 nt, Mycobacterium avium subsp. paratuberculosis
gccggcggccgccacgc

SEQ ID NO: 2952949 - RNA, 15 nt, Mycobacterium avium subsp. paratuberculosis
gccggcggccgccgc

SEQ ID NO: 2952950 - RNA, 19 nt, Mycobacterium avium subsp. paratuberculosis
gccggcggccgccgcccgc

SEQ ID NO: 2952951 - RNA, 21 nt, Mycobacterium avium subsp. paratuberculosis
gccggcggccgccgcccgcgc

SEQ ID NO: 2952952 - RNA, 15 nt, Mycobacterium avium subsp. paratuberculosis
gccggcggccgcgac

SEQ ID NO: 2952953 - RNA, 14 nt, Mycobacterium avium subsp. paratuberculosis
gccggcggcgaagc

SEQ ID NO: 2952954 - RNA, 21 nt, Mycobacterium avium subsp. paratuberculosis
gccggcggcgaagccggcccc

SEQ ID NO: 2952955 - RNA, 17 nt, Mycobacterium avium subsp. paratuberculosis
gccggcggcgaucgccg

SEQ ID NO: 2952956 - RNA, 20 nt, Mycobacterium avium subsp. paratuberculosis
gccggcggcgaucgccgcga

SEQ ID NO: 2952957 - RNA, 15 nt, Mycobacterium avium subsp. paratuberculosis
gccggcggcgaugau

SEQ ID NO: 2952958 - RNA, 11 nt, Mycobacterium avium subsp. paratuberculosis
gccggcggcgc

SEQ ID NO: 2952959 - RNA, 14 nt, Mycobacterium avium subsp. paratuberculosis
gccggcggcgcccg

SEQ ID NO: 2952960 - RNA, 15 nt, Mycobacterium avium subsp. paratuberculosis
gccggcggcgcccgc

SEQ ID NO: 2952961 - RNA, 17 nt, Mycobacterium avium subsp. paratuberculosis
gccggcggcgcccgcgg

SEQ ID NO: 2952962 - RNA, 18 nt, Mycobacterium avium subsp. paratuberculosis
gccggcggcgcccgcggc

SEQ ID NO: 2952963 - RNA, 19 nt, Mycobacterium avium subsp. paratuberculosis
gccggcggcggaccgucgg

SEQ ID NO: 2952964 - RNA, 14 nt, Mycobacterium avium subsp. paratuberculosis
gccggcggcggcca

SEQ ID NO: 2952965 - RNA, 15 nt, Mycobacterium avium subsp. paratuberculosis
gccggcggcggccag

SEQ ID NO: 2952966 - RNA, 12 nt, Mycobacterium avium subsp. paratuberculosis
gccggcgucggg

SEQ ID NO: 2952967 - RNA, 14 nt, Mycobacterium avium subsp. paratuberculosis
gccggcgucgggac

SEQ ID NO: 2952968 - RNA, 22 nt, Mycobacterium avium subsp. paratuberculosis
gccggcgucgggaccgucgcgc

SEQ ID NO: 2952969 - RNA, 23 nt, Mycobacterium avium subsp. paratuberculosis
gccggcgucgggaccgucgcgca

SEQ ID NO: 2952970 - RNA, 13 nt, Mycobacterium avium subsp. paratuberculosis
gccggcgucggug

SEQ ID NO: 2952971 - RNA, 18 nt, Mycobacterium avium subsp. paratuberculosis
gccggcgucgucgagcac

SEQ ID NO: 2952972 - RNA, 20 nt, Mycobacterium avium subsp. paratuberculosis
gccggcgucgucgagcaccg

SEQ ID NO: 2952973 - RNA, 23 nt, Mycobacterium avium subsp. paratuberculosis
gccggcgucgucgagcaccggca

SEQ ID NO: 2952974 - RNA, 19 nt, Mycobacterium avium subsp. paratuberculosis
gccggcgucgucgucgcag

SEQ ID NO: 2952975 - RNA, 21 nt, Mycobacterium avium subsp. paratuberculosis
gccggcgucgucgucgcagug

SEQ ID NO: 2952976 - RNA, 14 nt, Mycobacterium avium subsp. paratuberculosis
gccggcgucugcau

SEQ ID NO: 2952977 - RNA, 18 nt, Mycobacterium avium subsp. paratuberculosis
gccggcgucugcauccgg

SEQ ID NO: 2952978 - RNA, 23 nt, Mycobacterium avium subsp. paratuberculosis
gccggcgucugcauccggaaccg

SEQ ID NO: 2952979 - RNA, 20 nt, Mycobacterium avium subsp. paratuberculosis
gccggcgucuugaucucggc

SEQ ID NO: 2952980 - RNA, 20 nt, Mycobacterium avium subsp. paratuberculosis
gccggcgugcacaggccgcc

SEQ ID NO: 2952981 - RNA, 21 nt, Mycobacterium avium subsp. paratuberculosis
gccggcgugcacaggccgccg

SEQ ID NO: 2952982 - RNA, 22 nt, Mycobacterium avium subsp. paratuberculosis
gccggcgugcacaggccgccgc

SEQ ID NO: 2952983 - RNA, 23 nt, Mycobacterium avium subsp. paratuberculosis
gccggcgugcacaggccgccgca

SEQ ID NO: 2952984 - RNA, 15 nt, Mycobacterium avium subsp. paratuberculosis
gccggcgugcugggc

SEQ ID NO: 2952985 - RNA, 19 nt, Mycobacterium avium subsp. paratuberculosis
gccggcgugggaaccacca

SEQ ID NO: 2952986 - RNA, 15 nt, Mycobacterium avium subsp. paratuberculosis
gccggcgugucggcg

SEQ ID NO: 2952987 - RNA, 17 nt, Mycobacterium avium subsp. paratuberculosis
gccggcgugucggcgcc

SEQ ID NO: 2952988 - RNA, 22 nt, Mycobacterium avium subsp. paratuberculosis
gccggcgugucggcgccaccgg

SEQ ID NO: 2952989 - RNA, 23 nt, Mycobacterium avium subsp. paratuberculosis
gccggcgugucggcgccaccggg

SEQ ID NO: 2952990 - RNA, 20 nt, Mycobacterium avium subsp. paratuberculosis
gccggcguuauuugugcgcu

SEQ ID NO: 2952991 - RNA, 14 nt, Mycobacterium avium subsp. paratuberculosis
gccggcuaccgcgc

SEQ ID NO: 2952992 - RNA, 16 nt, Mycobacterium avium subsp. paratuberculosis
gccggcuaccgcgcgg

SEQ ID NO: 2952993 - RNA, 18 nt, Mycobacterium avium subsp. paratuberculosis
gccggcuaccggcgcugg

SEQ ID NO: 2952994 - RNA, 22 nt, Mycobacterium avium subsp. paratuberculosis
gccggcucagcggcaacugcag

SEQ ID NO: 2952995 - RNA, 15 nt, Mycobacterium avium subsp. paratuberculosis
gccggcucagggugc

SEQ ID NO: 2952996 - RNA, 18 nt, Mycobacterium avium subsp. paratuberculosis
gccggcucagggugcgcu

SEQ ID NO: 2952997 - RNA, 19 nt, Mycobacterium avium subsp. paratuberculosis
gccggcucagggugcgcug

SEQ ID NO: 2952998 - RNA, 20 nt, Mycobacterium avium subsp. paratuberculosis
gccggcucagggugcgcugg

SEQ ID NO: 2952999 - RNA, 13 nt, Mycobacterium avium subsp. paratuberculosis
gccggcuccaccg

SEQ ID NO: 2953000 - RNA, 18 nt, Mycobacterium avium subsp. paratuberculosis
gccggcuccaccgcgccg

SEQ ID NO: 2953001 - RNA, 20 nt, Mycobacterium avium subsp. paratuberculosis
gccggcuccaccgcgccggc

SEQ ID NO: 2953002 - RNA, 22 nt, Mycobacterium avium subsp. paratuberculosis
gccggcuccaccgcgccggcgg

SEQ ID NO: 2953003 - RNA, 23 nt, Mycobacterium avium subsp. paratuberculosis
gccggcuccaccgcgccggcggc

SEQ ID NO: 2953004 - RNA, 24 nt, Mycobacterium avium subsp. paratuberculosis
gccggcuccaccgcgccggcggcg

SEQ ID NO: 2953005 - RNA, 21 nt, Mycobacterium avium subsp. paratuberculosis
gccggcuccgcaugcccgggc

SEQ ID NO: 2953006 - RNA, 22 nt, Mycobacterium avium subsp. paratuberculosis
gccggcuccgcaugcccgggcg

SEQ ID NO: 2953007 - RNA, 20 nt, Mycobacterium avium subsp. paratuberculosis
gccggcucgaaaugccuugg

SEQ ID NO: 2953008 - RNA, 23 nt, Mycobacterium avium subsp. paratuberculosis
gccggcucgguaugcggcgacga

SEQ ID NO: 2953009 - RNA, 20 nt, Mycobacterium avium subsp. paratuberculosis
gccggcugaaccugcugggc

SEQ ID NO: 2953010 - RNA, 16 nt, Mycobacterium avium subsp. paratuberculosis
gccggcugacugccgg

SEQ ID NO: 2953011 - RNA, 21 nt, Mycobacterium avium subsp. paratuberculosis
gccggcugacugccggcgacg

SEQ ID NO: 2953012 - RNA, 14 nt, Mycobacterium avium subsp. paratuberculosis
gccggcugcagccg

SEQ ID NO: 2953013 - RNA, 18 nt, Mycobacterium avium subsp. paratuberculosis
gccggcugcagccgggcg

SEQ ID NO: 2953014 - RNA, 21 nt, Mycobacterium avium subsp. paratuberculosis
gccggcugcagccgggcggcg

SEQ ID NO: 2953015 - RNA, 14 nt, Mycobacterium avium subsp. paratuberculosis
gccggcugcccgcg

SEQ ID NO: 2953016 - RNA, 18 nt, Mycobacterium avium subsp. paratuberculosis
gccggcuggaacaucccg

SEQ ID NO: 2953017 - RNA, 14 nt, Mycobacterium avium subsp. paratuberculosis
gccggcuuaccgac

SEQ ID NO: 2953018 - RNA, 22 nt, Mycobacterium avium subsp. paratuberculosis
gccggcuuaccgaccucgaggc

SEQ ID NO: 2953019 - RNA, 23 nt, Mycobacterium avium subsp. paratuberculosis
gccggcuuaccgaccucgaggcc

SEQ ID NO: 2953020 - RNA, 15 nt, Mycobacterium avium subsp. paratuberculosis
gccggcuuccucgcg

SEQ ID NO: 2953021 - RNA, 16 nt, Mycobacterium avium subsp. paratuberculosis
gccggcuuccucgcgg

SEQ ID NO: 2953022 - RNA, 16 nt, Mycobacterium avium subsp. paratuberculosis
gccggcuucggccaag

SEQ ID NO: 2953023 - RNA, 16 nt, Mycobacterium avium subsp. paratuberculosis
gccggcuucucggcgu

SEQ ID NO: 2953024 - RNA, 17 nt, Mycobacterium avium subsp. paratuberculosis
gccggcuucucggcgug

SEQ ID NO: 2953025 - RNA, 19 nt, Mycobacterium avium subsp. paratuberculosis
gccggcuugaucucgaccu

SEQ ID NO: 2953026 - RNA, 19 nt, Mycobacterium avium subsp. paratuberculosis
gccggcuugccccgguccc

SEQ ID NO: 2953027 - RNA, 20 nt, Mycobacterium avium subsp. paratuberculosis
gccggcuugccccggucccg

SEQ ID NO: 2953028 - RNA, 14 nt, Mycobacterium avium subsp. paratuberculosis
gccggcuugggcga

SEQ ID NO: 2953029 - RNA, 18 nt, Mycobacterium avium subsp. paratuberculosis
gccgggaaacccucgacg

SEQ ID NO: 2953030 - RNA, 19 nt, Mycobacterium avium subsp. paratuberculosis
gccgggaaacccucgacgc

SEQ ID NO: 2953031 - RNA, 22 nt, Mycobacterium avium subsp. paratuberculosis
gccgggaaacccucgacgccgg

SEQ ID NO: 2953032 - RNA, 13 nt, Mycobacterium avium subsp. paratuberculosis
gccgggaacagcg

SEQ ID NO: 2953033 - RNA, 15 nt, Mycobacterium avium subsp. paratuberculosis
gccgggaacagcgac

SEQ ID NO: 2953034 - RNA, 17 nt, Mycobacterium avium subsp. paratuberculosis
gccgggaagcgaagcgg

SEQ ID NO: 2953035 - RNA, 17 nt, Mycobacterium avium subsp. paratuberculosis
gccgggaaguuggccuc

SEQ ID NO: 2953036 - RNA, 18 nt, Mycobacterium avium subsp. paratuberculosis
gccgggaaguuggccucc

SEQ ID NO: 2953037 - RNA, 18 nt, Mycobacterium avium subsp. paratuberculosis
gccgggaaucgagggcgc

SEQ ID NO: 2953038 - RNA, 20 nt, Mycobacterium avium subsp. paratuberculosis
gccgggaaucgagggcgcgc

SEQ ID NO: 2953039 - RNA, 18 nt, Mycobacterium avium subsp. paratuberculosis
gccgggaaugucgcgcag

SEQ ID NO: 2953040 - RNA, 19 nt, Mycobacterium avium subsp. paratuberculosis
gccgggaaugucgcgcagc

SEQ ID NO: 2953041 - RNA, 20 nt, Mycobacterium avium subsp. paratuberculosis
gccgggacagguagcgcagc

SEQ ID NO: 2953042 - RNA, 19 nt, Mycobacterium avium subsp. paratuberculosis
gccgggagugcuggacggc

SEQ ID NO: 2953043 - RNA, 20 nt, Mycobacterium avium subsp. paratuberculosis
gccgggagugcuggacggcc

SEQ ID NO: 2953044 - RNA, 19 nt, Mycobacterium avium subsp. paratuberculosis
gccgggauagagcaccgcg

SEQ ID NO: 2953045 - RNA, 20 nt, Mycobacterium avium subsp. paratuberculosis
gccgggauagagcaccgcgc

SEQ ID NO: 2953046 - RNA, 19 nt, Mycobacterium avium subsp. paratuberculosis
gccgggauauucgcccagc

SEQ ID NO: 2953047 - RNA, 20 nt, Mycobacterium avium subsp. paratuberculosis
gccgggauauucgcccagcg

SEQ ID NO: 2953048 - RNA, 22 nt, Mycobacterium avium subsp. paratuberculosis
gccgggauauucgcccagcggc

SEQ ID NO: 2953049 - RNA, 12 nt, Mycobacterium avium subsp. paratuberculosis
gccgggccgcgg

SEQ ID NO: 2953050 - RNA, 14 nt, Mycobacterium avium subsp. paratuberculosis
gccgggccgcggcg

SEQ ID NO: 2953051 - RNA, 17 nt, Mycobacterium avium subsp. paratuberculosis
gccgggccgcggcggua

SEQ ID NO: 2953052 - RNA, 14 nt, Mycobacterium avium subsp. paratuberculosis
gccgggccggaacg

SEQ ID NO: 2953053 - RNA, 18 nt, Mycobacterium avium subsp. paratuberculosis
gccgggccggaacgcccg

SEQ ID NO: 2953054 - RNA, 19 nt, Mycobacterium avium subsp. paratuberculosis
gccgggccggaacgcccga

SEQ ID NO: 2953055 - RNA, 13 nt, Mycobacterium avium subsp. paratuberculosis
gccgggccggaga

SEQ ID NO: 2953056 - RNA, 16 nt, Mycobacterium avium subsp. paratuberculosis
gccgggccggaucgcg

SEQ ID NO: 2953057 - RNA, 17 nt, Mycobacterium avium subsp. paratuberculosis
gccgggccggaucgcgc

SEQ ID NO: 2953058 - RNA, 14 nt, Mycobacterium avium subsp. paratuberculosis
gccgggccggcggc

SEQ ID NO: 2953059 - RNA, 17 nt, Mycobacterium avium subsp. paratuberculosis
gccgggccggcggccag

SEQ ID NO: 2953060 - RNA, 21 nt, Mycobacterium avium subsp. paratuberculosis
gccgggccggcggccaguucg

SEQ ID NO: 2953061 - RNA, 15 nt, Mycobacterium avium subsp. paratuberculosis
gccgggccggcggug

SEQ ID NO: 2953062 - RNA, 15 nt, Mycobacterium avium subsp. paratuberculosis
gccgggccgggucca

SEQ ID NO: 2953063 - RNA, 17 nt, Mycobacterium avium subsp. paratuberculosis
gccgggccugcagcaac

SEQ ID NO: 2953064 - RNA, 20 nt, Mycobacterium avium subsp. paratuberculosis
gccgggccugcagcaacucg

SEQ ID NO: 2953065 - RNA, 19 nt, Mycobacterium avium subsp. paratuberculosis
gccgggccugcggcgcggc

SEQ ID NO: 2953066 - RNA, 22 nt, Mycobacterium avium subsp. paratuberculosis
gccgggccugcggcgcggccac

SEQ ID NO: 2953067 - RNA, 14 nt, Mycobacterium avium subsp. paratuberculosis
gccgggccugucca

SEQ ID NO: 2953068 - RNA, 14 nt, Mycobacterium avium subsp. paratuberculosis
gccgggcgaagucg

SEQ ID NO: 2953069 - RNA, 19 nt, Mycobacterium avium subsp. paratuberculosis
gccgggcgaagucgccggc

SEQ ID NO: 2953070 - RNA, 18 nt, Mycobacterium avium subsp. paratuberculosis
gccgggcgaccgucuucu

SEQ ID NO: 2953071 - RNA, 13 nt, Mycobacterium avium subsp. paratuberculosis
gccgggcgaucau

SEQ ID NO: 2953072 - RNA, 15 nt, Mycobacterium avium subsp. paratuberculosis
gccgggcgccacccg

SEQ ID NO: 2953073 - RNA, 14 nt, Mycobacterium avium subsp. paratuberculosis
gccgggcgccacgc

SEQ ID NO: 2953074 - RNA, 17 nt, Mycobacterium avium subsp. paratuberculosis
gccgggcgccacgcugg

SEQ ID NO: 2953075 - RNA, 20 nt, Mycobacterium avium subsp. paratuberculosis
gccgggcgccacgcuggcgu

SEQ ID NO: 2953076 - RNA, 21 nt, Mycobacterium avium subsp. paratuberculosis
gccgggcgcccgagccgcaca

SEQ ID NO: 2953077 - RNA, 17 nt, Mycobacterium avium subsp. paratuberculosis
gccgggcgcgggcgccg

SEQ ID NO: 2953078 - RNA, 19 nt, Mycobacterium avium subsp. paratuberculosis
gccgggcgcgggcgccguc

SEQ ID NO: 2953079 - RNA, 14 nt, Mycobacterium avium subsp. paratuberculosis
gccgggcgcuggcc

SEQ ID NO: 2953080 - RNA, 15 nt, Mycobacterium avium subsp. paratuberculosis
gccgggcgcuggccg

SEQ ID NO: 2953081 - RNA, 19 nt, Mycobacterium avium subsp. paratuberculosis
gccgggcggaugucggugu

SEQ ID NO: 2953082 - RNA, 16 nt, Mycobacterium avium subsp. paratuberculosis
gccgggcggcagcagc

SEQ ID NO: 2953083 - RNA, 17 nt, Mycobacterium avium subsp. paratuberculosis
gccgggcggcagcagcu

SEQ ID NO: 2953084 - RNA, 18 nt, Mycobacterium avium subsp. paratuberculosis
gccgggcggcagcagcug

SEQ ID NO: 2953085 - RNA, 20 nt, Mycobacterium avium subsp. paratuberculosis
gccgggcggcagcagcugcg

SEQ ID NO: 2953086 - RNA, 14 nt, Mycobacterium avium subsp. paratuberculosis
gccgggcggccagc

SEQ ID NO: 2953087 - RNA, 14 nt, Mycobacterium avium subsp. paratuberculosis
gccgggcggcccgc

SEQ ID NO: 2953088 - RNA, 19 nt, Mycobacterium avium subsp. paratuberculosis
gccgggcggcccgccucgg

SEQ ID NO: 2953089 - RNA, 13 nt, Mycobacterium avium subsp. paratuberculosis
gccgggcggccgg

SEQ ID NO: 2953090 - RNA, 18 nt, Mycobacterium avium subsp. paratuberculosis
gccgggcggccggagccg

SEQ ID NO: 2953091 - RNA, 15 nt, Mycobacterium avium subsp. paratuberculosis
gccgggcggccgggc

SEQ ID NO: 2953092 - RNA, 16 nt, Mycobacterium avium subsp. paratuberculosis
gccgggcggccgggcc

SEQ ID NO: 2953093 - RNA, 19 nt, Mycobacterium avium subsp. paratuberculosis
gccgggcggccgggccgga

SEQ ID NO: 2953094 - RNA, 14 nt, Mycobacterium avium subsp. paratuberculosis
gccgggcggcgccg

SEQ ID NO: 2953095 - RNA, 17 nt, Mycobacterium avium subsp. paratuberculosis
gccgggcggcgccgaac

SEQ ID NO: 2953096 - RNA, 14 nt, Mycobacterium avium subsp. paratuberculosis
gccgggcgggcacc

SEQ ID NO: 2953097 - RNA, 17 nt, Mycobacterium avium subsp. paratuberculosis
gccgggcgggcacccca

SEQ ID NO: 2953098 - RNA, 13 nt, Mycobacterium avium subsp. paratuberculosis
gccgggcgggccg

SEQ ID NO: 2953099 - RNA, 14 nt, Mycobacterium avium subsp. paratuberculosis
gccgggcgggccgc

SEQ ID NO: 2953100 - RNA, 15 nt, Mycobacterium avium subsp. paratuberculosis
gccgggcgggccgca

SEQ ID NO: 2953101 - RNA, 16 nt, Mycobacterium avium subsp. paratuberculosis
gccgggcgggcgcagg

SEQ ID NO: 2953102 - RNA, 21 nt, Mycobacterium avium subsp. paratuberculosis
gccgggcgggggcuguccacc

SEQ ID NO: 2953103 - RNA, 21 nt, Mycobacterium avium subsp. paratuberculosis
gccgggcgguacgcgccgcgc

SEQ ID NO: 2953104 - RNA, 13 nt, Mycobacterium avium subsp. paratuberculosis
gccgggcgguuuc

SEQ ID NO: 2953105 - RNA, 14 nt, Mycobacterium avium subsp. paratuberculosis
gccgggcguagucg

SEQ ID NO: 2953106 - RNA, 16 nt, Mycobacterium avium subsp. paratuberculosis
gccgggcguagucgau

SEQ ID NO: 2953107 - RNA, 19 nt, Mycobacterium avium subsp. paratuberculosis
gccgggcguagucgauggc

SEQ ID NO: 2953108 - RNA, 21 nt, Mycobacterium avium subsp. paratuberculosis
gccgggcguagucgauggccu

SEQ ID NO: 2953109 - RNA, 18 nt, Mycobacterium avium subsp. paratuberculosis
gccgggcgucacgccagc

SEQ ID NO: 2953110 - RNA, 13 nt, Mycobacterium avium subsp. paratuberculosis
gccgggcgucgac

SEQ ID NO: 2953111 - RNA, 14 nt, Mycobacterium avium subsp. paratuberculosis
gccgggcgucgcgc

SEQ ID NO: 2953112 - RNA, 18 nt, Mycobacterium avium subsp. paratuberculosis
gccgggcgugcccggcgc

SEQ ID NO: 2953113 - RNA, 20 nt, Mycobacterium avium subsp. paratuberculosis
gccgggcgugcccggcgcac

SEQ ID NO: 2953114 - RNA, 20 nt, Mycobacterium avium subsp. paratuberculosis
gccgggcguugcccgccgcg

SEQ ID NO: 2953115 - RNA, 21 nt, Mycobacterium avium subsp. paratuberculosis
gccgggcguugcccgccgcgg

SEQ ID NO: 2953116 - RNA, 23 nt, Mycobacterium avium subsp. paratuberculosis
gccgggcguugcccgccgcggcg

SEQ ID NO: 2953117 - RNA, 14 nt, Mycobacterium avium subsp. paratuberculosis
gccgggcucccgcu

SEQ ID NO: 2953118 - RNA, 17 nt, Mycobacterium avium subsp. paratuberculosis
gccgggcucccgcucca

SEQ ID NO: 2953119 - RNA, 18 nt, Mycobacterium avium subsp. paratuberculosis
gccgggcuccgcguucga

SEQ ID NO: 2953120 - RNA, 19 nt, Mycobacterium avium subsp. paratuberculosis
gccgggcuccgcguucgac

SEQ ID NO: 2953121 - RNA, 13 nt, Mycobacterium avium subsp. paratuberculosis
gccgggcucgagc

SEQ ID NO: 2953122 - RNA, 14 nt, Mycobacterium avium subsp. paratuberculosis
gccgggcucgaggg

SEQ ID NO: 2953123 - RNA, 15 nt, Mycobacterium avium subsp. paratuberculosis
gccgggcucgagggc

SEQ ID NO: 2953124 - RNA, 20 nt, Mycobacterium avium subsp. paratuberculosis
gccgggcucgaguuuggcca

SEQ ID NO: 2953125 - RNA, 12 nt, Mycobacterium avium subsp. paratuberculosis
gccgggcucgcc

SEQ ID NO: 2953126 - RNA, 17 nt, Mycobacterium avium subsp. paratuberculosis
gccgggcugagcugugc

SEQ ID NO: 2953127 - RNA, 19 nt, Mycobacterium avium subsp. paratuberculosis
gccgggcugagcugugccg

SEQ ID NO: 2953128 - RNA, 22 nt, Mycobacterium avium subsp. paratuberculosis
gccgggcugagcugugccgcgg

SEQ ID NO: 2953129 - RNA, 14 nt, Mycobacterium avium subsp. paratuberculosis
gccgggcugcacgc

SEQ ID NO: 2953130 - RNA, 13 nt, Mycobacterium avium subsp. paratuberculosis
gccgggcugcgca

SEQ ID NO: 2953131 - RNA, 13 nt, Mycobacterium avium subsp. paratuberculosis
gccgggcuggccg

SEQ ID NO: 2953132 - RNA, 20 nt, Mycobacterium avium subsp. paratuberculosis
gccgggcuggccgucggcga

SEQ ID NO: 2953133 - RNA, 13 nt, Mycobacterium avium subsp. paratuberculosis
gccgggcuggcgc

SEQ ID NO: 2953134 - RNA, 16 nt, Mycobacterium avium subsp. paratuberculosis
gccggguccagccgcg

SEQ ID NO: 2953135 - RNA, 17 nt, Mycobacterium avium subsp. paratuberculosis
gccggguccagccgcgg

SEQ ID NO: 2953136 - RNA, 17 nt, Mycobacterium avium subsp. paratuberculosis
gccggguccuugcgccc

SEQ ID NO: 2953137 - RNA, 18 nt, Mycobacterium avium subsp. paratuberculosis
gccggguccuugcgcccc

SEQ ID NO: 2953138 - RNA, 20 nt, Mycobacterium avium subsp. paratuberculosis
gccggguccuugcgccccgg

SEQ ID NO: 2953139 - RNA, 18 nt, Mycobacterium avium subsp. paratuberculosis
gccgggucgaacggcaac

SEQ ID NO: 2953140 - RNA, 18 nt, Mycobacterium avium subsp. paratuberculosis
gccgggucgaccgcgaug

SEQ ID NO: 2953141 - RNA, 19 nt, Mycobacterium avium subsp. paratuberculosis
gccgggucgaccgcgaugg

SEQ ID NO: 2953142 - RNA, 13 nt, Mycobacterium avium subsp. paratuberculosis
gccgggucgacgc

SEQ ID NO: 2953143 - RNA, 14 nt, Mycobacterium avium subsp. paratuberculosis
gccgggucgagcgc

SEQ ID NO: 2953144 - RNA, 17 nt, Mycobacterium avium subsp. paratuberculosis
gccgggucgagcgcgcc

SEQ ID NO: 2953145 - RNA, 17 nt, Mycobacterium avium subsp. paratuberculosis
gccgggucgcacgccgg

SEQ ID NO: 2953146 - RNA, 13 nt, Mycobacterium avium subsp. paratuberculosis
gccgggucgcagc

SEQ ID NO: 2953147 - RNA, 14 nt, Mycobacterium avium subsp. paratuberculosis
gccgggucgcagcg

SEQ ID NO: 2953148 - RNA, 22 nt, Mycobacterium avium subsp. paratuberculosis
gccgggucgcaggcagcagcac

SEQ ID NO: 2953149 - RNA, 13 nt, Mycobacterium avium subsp. paratuberculosis
gccgggucgccgu

SEQ ID NO: 2953150 - RNA, 16 nt, Mycobacterium avium subsp. paratuberculosis
gccgggucgcgguggg

SEQ ID NO: 2953151 - RNA, 23 nt, Mycobacterium avium subsp. paratuberculosis
gccgggucgcggugggcucggcg

SEQ ID NO: 2953152 - RNA, 23 nt, Mycobacterium avium subsp. paratuberculosis
gccgggucguaggccggaucccg

SEQ ID NO: 2953153 - RNA, 21 nt, Mycobacterium avium subsp. paratuberculosis
gccgggucuuccacgccggug

SEQ ID NO: 2953154 - RNA, 15 nt, Mycobacterium avium subsp. paratuberculosis
gccgggugaacccga

SEQ ID NO: 2953155 - RNA, 22 nt, Mycobacterium avium subsp. paratuberculosis
gccgggugcccaucugcacagc

SEQ ID NO: 2953156 - RNA, 13 nt, Mycobacterium avium subsp. paratuberculosis
gccgggugcccgc

SEQ ID NO: 2953157 - RNA, 21 nt, Mycobacterium avium subsp. paratuberculosis
gccgggugcgggccagcagcc

SEQ ID NO: 2953158 - RNA, 13 nt, Mycobacterium avium subsp. paratuberculosis
gccgggugcggug

SEQ ID NO: 2953159 - RNA, 22 nt, Mycobacterium avium subsp. paratuberculosis
gccgggugcugaacgccugccg

SEQ ID NO: 2953160 - RNA, 19 nt, Mycobacterium avium subsp. paratuberculosis
gccggguggcccgcccggg

SEQ ID NO: 2953161 - RNA, 15 nt, Mycobacterium avium subsp. paratuberculosis
gccggguggcccgcg

SEQ ID NO: 2953162 - RNA, 17 nt, Mycobacterium avium subsp. paratuberculosis
gccggguggcccgcgcg

SEQ ID NO: 2953163 - RNA, 14 nt, Mycobacterium avium subsp. paratuberculosis
gccggguggccgcc

SEQ ID NO: 2953164 - RNA, 15 nt, Mycobacterium avium subsp. paratuberculosis
gccggguggccgcca

SEQ ID NO: 2953165 - RNA, 22 nt, Mycobacterium avium subsp. paratuberculosis
gccggguggccgccacguccgg

SEQ ID NO: 2953166 - RNA, 14 nt, Mycobacterium avium subsp. paratuberculosis
gccggguggccggg

SEQ ID NO: 2953167 - RNA, 22 nt, Mycobacterium avium subsp. paratuberculosis
gccgggugggcagccccagcga

SEQ ID NO: 2953168 - RNA, 21 nt, Mycobacterium avium subsp. paratuberculosis
gccggguguugcggcagggcc

SEQ ID NO: 2953169 - RNA, 22 nt, Mycobacterium avium subsp. paratuberculosis
gccggguuccgguuggccaggu

SEQ ID NO: 2953170 - RNA, 16 nt, Mycobacterium avium subsp. paratuberculosis
gccggguugcaggcgc

SEQ ID NO: 2953171 - RNA, 16 nt, Mycobacterium avium subsp. paratuberculosis
gccggguugggcggcg

SEQ ID NO: 2953172 - RNA, 17 nt, Mycobacterium avium subsp. paratuberculosis
gccggguuguagcaggc

SEQ ID NO: 2953173 - RNA, 19 nt, Mycobacterium avium subsp. paratuberculosis
gccggguuguagcaggcgg

SEQ ID NO: 2953174 - RNA, 18 nt, Mycobacterium avium subsp. paratuberculosis
gccggguuguccuggccc

SEQ ID NO: 2953175 - RNA, 18 nt, Mycobacterium avium subsp. paratuberculosis
gccggguuucggcccggc

SEQ ID NO: 2953176 - RNA, 22 nt, Mycobacterium avium subsp. paratuberculosis
gccggguuuguccggccagguc

SEQ ID NO: 2953177 - RNA, 20 nt, Mycobacterium avium subsp. paratuberculosis
gccggguuuucgggccgguc

SEQ ID NO: 2953178 - RNA, 23 nt, Mycobacterium avium subsp. paratuberculosis
gccggguuuucgggccggucagc

SEQ ID NO: 2953179 - RNA, 13 nt, Mycobacterium avium subsp. paratuberculosis
gccgguaccgccg

SEQ ID NO: 2953180 - RNA, 21 nt, Mycobacterium avium subsp. paratuberculosis
gccgguaccgccggccaggcg

SEQ ID NO: 2953181 - RNA, 22 nt, Mycobacterium avium subsp. paratuberculosis
gccgguaccgccggccaggcga

SEQ ID NO: 2953182 - RNA, 18 nt, Mycobacterium avium subsp. paratuberculosis
gccgguacggaucgccgg

SEQ ID NO: 2953183 - RNA, 14 nt, Mycobacterium avium subsp. paratuberculosis
gccgguacggccga

SEQ ID NO: 2953184 - RNA, 15 nt, Mycobacterium avium subsp. paratuberculosis
gccgguacggccgac

SEQ ID NO: 2953185 - RNA, 17 nt, Mycobacterium avium subsp. paratuberculosis
gccgguacggccgacgc

SEQ ID NO: 2953186 - RNA, 17 nt, Mycobacterium avium subsp. paratuberculosis
gccgguagagcgccagg

SEQ ID NO: 2953187 - RNA, 14 nt, Mycobacterium avium subsp. paratuberculosis
gccgguagaucagc

SEQ ID NO: 2953188 - RNA, 15 nt, Mycobacterium avium subsp. paratuberculosis
gccgguagaucagcg

SEQ ID NO: 2953189 - RNA, 21 nt, Mycobacterium avium subsp. paratuberculosis
gccgguagaucagcgccuggu

SEQ ID NO: 2953190 - RNA, 19 nt, Mycobacterium avium subsp. paratuberculosis
gccgguagccgcucgccca

SEQ ID NO: 2953191 - RNA, 14 nt, Mycobacterium avium subsp. paratuberculosis
gccgguaggccgcg

SEQ ID NO: 2953192 - RNA, 15 nt, Mycobacterium avium subsp. paratuberculosis
gccgguaggccgcgc

SEQ ID NO: 2953193 - RNA, 18 nt, Mycobacterium avium subsp. paratuberculosis
gccgguaggccgcgccga

SEQ ID NO: 2953194 - RNA, 20 nt, Mycobacterium avium subsp. paratuberculosis
gccgguaggccgcgccgauc

SEQ ID NO: 2953195 - RNA, 15 nt, Mycobacterium avium subsp. paratuberculosis
gccgguaggcgcggg

SEQ ID NO: 2953196 - RNA, 14 nt, Mycobacterium avium subsp. paratuberculosis
gccgguaggcggcc

SEQ ID NO: 2953197 - RNA, 19 nt, Mycobacterium avium subsp. paratuberculosis
gccgguaggcggccagcgc

SEQ ID NO: 2953198 - RNA, 17 nt, Mycobacterium avium subsp. paratuberculosis
gccgguagggccgguca

SEQ ID NO: 2953199 - RNA, 15 nt, Mycobacterium avium subsp. paratuberculosis
gccgguagugcuugc

SEQ ID NO: 2953200 - RNA, 17 nt, Mycobacterium avium subsp. paratuberculosis
gccgguauauucgcgau

SEQ ID NO: 2953201 - RNA, 16 nt, Mycobacterium avium subsp. paratuberculosis
gccgguauccauccgc

SEQ ID NO: 2953202 - RNA, 17 nt, Mycobacterium avium subsp. paratuberculosis
gccgguaucgagcacca

SEQ ID NO: 2953203 - RNA, 17 nt, Mycobacterium avium subsp. paratuberculosis
gccgguaugcgaucgcg

SEQ ID NO: 2953204 - RNA, 19 nt, Mycobacterium avium subsp. paratuberculosis
gccgguaugcgaucgcguc

SEQ ID NO: 2953205 - RNA, 17 nt, Mycobacterium avium subsp. paratuberculosis
gccgguauuggccacgc

SEQ ID NO: 2953206 - RNA, 18 nt, Mycobacterium avium subsp. paratuberculosis
gccggucacccaggccga

SEQ ID NO: 2953207 - RNA, 13 nt, Mycobacterium avium subsp. paratuberculosis
gccggucaccuug

SEQ ID NO: 2953208 - RNA, 17 nt, Mycobacterium avium subsp. paratuberculosis
gccggucaccuugacca

SEQ ID NO: 2953209 - RNA, 12 nt, Mycobacterium avium subsp. paratuberculosis
gccggucacggc

SEQ ID NO: 2953210 - RNA, 16 nt, Mycobacterium avium subsp. paratuberculosis
gccggucacggcgucg

SEQ ID NO: 2953211 - RNA, 19 nt, Mycobacterium avium subsp. paratuberculosis
gccggucagcaccauggcg

SEQ ID NO: 2953212 - RNA, 14 nt, Mycobacterium avium subsp. paratuberculosis
gccggucagcacgu

SEQ ID NO: 2953213 - RNA, 22 nt, Mycobacterium avium subsp. paratuberculosis
gccggucagcacgucggucagc

SEQ ID NO: 2953214 - RNA, 14 nt, Mycobacterium avium subsp. paratuberculosis
gccggucagcgacg

SEQ ID NO: 2953215 - RNA, 15 nt, Mycobacterium avium subsp. paratuberculosis
gccggucagcgacga

SEQ ID NO: 2953216 - RNA, 19 nt, Mycobacterium avium subsp. paratuberculosis
gccggucagcgacgagagc

SEQ ID NO: 2953217 - RNA, 14 nt, Mycobacterium avium subsp. paratuberculosis
gccggucagcgcga

SEQ ID NO: 2953218 - RNA, 23 nt, Mycobacterium avium subsp. paratuberculosis
gccggucagcgcuccuggccgga

SEQ ID NO: 2953219 - RNA, 20 nt, Mycobacterium avium subsp. paratuberculosis
gccggucuuggacagcagca

SEQ ID NO: 2953220 - RNA, 19 nt, Mycobacterium avium subsp. paratuberculosis
gccggucuugggcucggcg

SEQ ID NO: 2953221 - RNA, 16 nt, Mycobacterium avium subsp. paratuberculosis
gccggucuuguagucg

SEQ ID NO: 2953222 - RNA, 22 nt, Mycobacterium avium subsp. paratuberculosis
gccggucuuguagucgaccacc

SEQ ID NO: 2953223 - RNA, 23 nt, Mycobacterium avium subsp. paratuberculosis
gccggucuuguagucgaccaccc

SEQ ID NO: 2953224 - RNA, 23 nt, Mycobacterium avium subsp. paratuberculosis
gccggugaacacgaacggcgccu

SEQ ID NO: 2953225 - RNA, 23 nt, Mycobacterium avium subsp. paratuberculosis
gccggugaagaucagcgcgucgg

SEQ ID NO: 2953226 - RNA, 17 nt, Mycobacterium avium subsp. paratuberculosis
gccggugaagaucgccc

SEQ ID NO: 2953227 - RNA, 23 nt, Mycobacterium avium subsp. paratuberculosis
gccggugaagaucgcccgccgcg

SEQ ID NO: 2953228 - RNA, 13 nt, Mycobacterium avium subsp. paratuberculosis
gccggugaagcgg

SEQ ID NO: 2953229 - RNA, 20 nt, Mycobacterium avium subsp. paratuberculosis
gccggugaaugucguagcgg

SEQ ID NO: 2953230 - RNA, 14 nt, Mycobacterium avium subsp. paratuberculosis
gccggugaccgcgc

SEQ ID NO: 2953231 - RNA, 16 nt, Mycobacterium avium subsp. paratuberculosis
gccggugaccgcgccg

SEQ ID NO: 2953232 - RNA, 19 nt, Mycobacterium avium subsp. paratuberculosis
gccggugaccgcgccggug

SEQ ID NO: 2953233 - RNA, 13 nt, Mycobacterium avium subsp. paratuberculosis
gccggugaccugc

SEQ ID NO: 2953234 - RNA, 12 nt, Mycobacterium avium subsp. paratuberculosis
gccggugacggu

SEQ ID NO: 2953235 - RNA, 16 nt, Mycobacterium avium subsp. paratuberculosis
gccggugacggucagg

SEQ ID NO: 2953236 - RNA, 20 nt, Mycobacterium avium subsp. paratuberculosis
gccggugacggucagggugu

SEQ ID NO: 2953237 - RNA, 16 nt, Mycobacterium avium subsp. paratuberculosis
gccggugacuccuccu

SEQ ID NO: 2953238 - RNA, 23 nt, Mycobacterium avium subsp. paratuberculosis
gccggugacuccuccucggccag

SEQ ID NO: 2953239 - RNA, 12 nt, Mycobacterium avium subsp. paratuberculosis
gccggugagcac

SEQ ID NO: 2953240 - RNA, 23 nt, Mycobacterium avium subsp. paratuberculosis
gccggugaggguuuccacgugca

SEQ ID NO: 2953241 - RNA, 15 nt, Mycobacterium avium subsp. paratuberculosis
gccggugagguggcg

SEQ ID NO: 2953242 - RNA, 21 nt, Mycobacterium avium subsp. paratuberculosis
gccggugagguggcguagucg

SEQ ID NO: 2953243 - RNA, 23 nt, Mycobacterium avium subsp. paratuberculosis
gccggugauccacuccagcaccg

SEQ ID NO: 2953244 - RNA, 13 nt, Mycobacterium avium subsp. paratuberculosis
gccggugaucgcg

SEQ ID NO: 2953245 - RNA, 14 nt, Mycobacterium avium subsp. paratuberculosis
gccggugaucgcgg

SEQ ID NO: 2953246 - RNA, 16 nt, Mycobacterium avium subsp. paratuberculosis
gccggugaucgcggcg

SEQ ID NO: 2953247 - RNA, 17 nt, Mycobacterium avium subsp. paratuberculosis
gccggugaucgcggcgc

SEQ ID NO: 2953248 - RNA, 18 nt, Mycobacterium avium subsp. paratuberculosis
gccggugaucgcggcgcu

SEQ ID NO: 2953249 - RNA, 13 nt, Mycobacterium avium subsp. paratuberculosis
gccggugaucucc

SEQ ID NO: 2953250 - RNA, 19 nt, Mycobacterium avium subsp. paratuberculosis
gccggugaucucccgugcg

SEQ ID NO: 2953251 - RNA, 21 nt, Mycobacterium avium subsp. paratuberculosis
gccggugaucucccgugcggu

SEQ ID NO: 2953252 - RNA, 17 nt, Mycobacterium avium subsp. paratuberculosis
gccggugaugaacgcgc

SEQ ID NO: 2953253 - RNA, 22 nt, Mycobacterium avium subsp. paratuberculosis
gccggugaugaacgcgccgucg

SEQ ID NO: 2953254 - RNA, 21 nt, Mycobacterium avium subsp. paratuberculosis
gccggugcaccacgaugaagc

SEQ ID NO: 2953255 - RNA, 13 nt, Mycobacterium avium subsp. paratuberculosis
gccggugcagauc

SEQ ID NO: 2953256 - RNA, 16 nt, Mycobacterium avium subsp. paratuberculosis
gccggugcagcaccuc

SEQ ID NO: 2953257 - RNA, 20 nt, Mycobacterium avium subsp. paratuberculosis
gccggugcagcaccucgauc

SEQ ID NO: 2953258 - RNA, 14 nt, Mycobacterium avium subsp. paratuberculosis
gccggugcagcacg

SEQ ID NO: 2953259 - RNA, 20 nt, Mycobacterium avium subsp. paratuberculosis
gccggugcaguacgcaucgg

SEQ ID NO: 2953260 - RNA, 13 nt, Mycobacterium avium subsp. paratuberculosis
gccggugccacgg

SEQ ID NO: 2953261 - RNA, 18 nt, Mycobacterium avium subsp. paratuberculosis
gccggugccacggucagg

SEQ ID NO: 2953262 - RNA, 20 nt, Mycobacterium avium subsp. paratuberculosis
gccggugccacggucaggcg

SEQ ID NO: 2953263 - RNA, 14 nt, Mycobacterium avium subsp. paratuberculosis
gccggugccgacga

SEQ ID NO: 2953264 - RNA, 23 nt, Mycobacterium avium subsp. paratuberculosis
gccggugccgacgauccgggcgc

SEQ ID NO: 2953265 - RNA, 17 nt, Mycobacterium avium subsp. paratuberculosis
gccggugccgacgauga

SEQ ID NO: 2953266 - RNA, 21 nt, Mycobacterium avium subsp. paratuberculosis
gccggugccgacgaugagggc

SEQ ID NO: 2953267 - RNA, 15 nt, Mycobacterium avium subsp. paratuberculosis
gccggugccgcagcc

SEQ ID NO: 2953268 - RNA, 16 nt, Mycobacterium avium subsp. paratuberculosis
gccggugccgcccauc

SEQ ID NO: 2953269 - RNA, 14 nt, Mycobacterium avium subsp. paratuberculosis
gccggugccgccgg

SEQ ID NO: 2953270 - RNA, 15 nt, Mycobacterium avium subsp. paratuberculosis
gccggugccgccggc

SEQ ID NO: 2953271 - RNA, 15 nt, Mycobacterium avium subsp. paratuberculosis
gccggugcgagccgc

SEQ ID NO: 2953272 - RNA, 18 nt, Mycobacterium avium subsp. paratuberculosis
gccggugcgagccgcuga

SEQ ID NO: 2953273 - RNA, 15 nt, Mycobacterium avium subsp. paratuberculosis
gccggugcgcagcuu

SEQ ID NO: 2953274 - RNA, 14 nt, Mycobacterium avium subsp. paratuberculosis
gccggugcgccgac

SEQ ID NO: 2953275 - RNA, 16 nt, Mycobacterium avium subsp. paratuberculosis
gccggugcgccgaccg

SEQ ID NO: 2953276 - RNA, 17 nt, Mycobacterium avium subsp. paratuberculosis
gccggugcgccgaccgc

SEQ ID NO: 2953277 - RNA, 21 nt, Mycobacterium avium subsp. paratuberculosis
gccggugcgcgucagccgucg

SEQ ID NO: 2953278 - RNA, 22 nt, Mycobacterium avium subsp. paratuberculosis
gccggugcgcgucagccgucgu

SEQ ID NO: 2953279 - RNA, 22 nt, Mycobacterium avium subsp. paratuberculosis
gccggugcggaugaagugcgcc

SEQ ID NO: 2953280 - RNA, 12 nt, Mycobacterium avium subsp. paratuberculosis
gccggugcggcc

SEQ ID NO: 2953281 - RNA, 19 nt, Mycobacterium avium subsp. paratuberculosis
gccggugcggccgcgaucg

SEQ ID NO: 2953282 - RNA, 17 nt, Mycobacterium avium subsp. paratuberculosis
gccggugcguccgccgg

SEQ ID NO: 2953283 - RNA, 19 nt, Mycobacterium avium subsp. paratuberculosis
gccggugcguccgccggcg

SEQ ID NO: 2953284 - RNA, 22 nt, Mycobacterium avium subsp. paratuberculosis
gccggugcguccgccggcggug

SEQ ID NO: 2953285 - RNA, 16 nt, Mycobacterium avium subsp. paratuberculosis
gccggugcugacccgg

SEQ ID NO: 2953286 - RNA, 17 nt, Mycobacterium avium subsp. paratuberculosis
gccggugcugacccggu

SEQ ID NO: 2953287 - RNA, 22 nt, Mycobacterium avium subsp. paratuberculosis
gccggugcuggucaugccgucg

SEQ ID NO: 2953288 - RNA, 20 nt, Mycobacterium avium subsp. paratuberculosis
gccggugcuguccacaucgg

SEQ ID NO: 2953289 - RNA, 18 nt, Mycobacterium avium subsp. paratuberculosis
gccggugcuuggcguuga

SEQ ID NO: 2953290 - RNA, 19 nt, Mycobacterium avium subsp. paratuberculosis
gccgguggaauucuggccg

SEQ ID NO: 2953291 - RNA, 20 nt, Mycobacterium avium subsp. paratuberculosis
gccgguggaauucuggccga

SEQ ID NO: 2953292 - RNA, 22 nt, Mycobacterium avium subsp. paratuberculosis
gccgguggaauucuggccgacc

SEQ ID NO: 2953293 - RNA, 23 nt, Mycobacterium avium subsp. paratuberculosis
gccgguggaauucuggccgaccg

SEQ ID NO: 2953294 - RNA, 19 nt, Mycobacterium avium subsp. paratuberculosis
gccgguggacaggugcauc

SEQ ID NO: 2953295 - RNA, 20 nt, Mycobacterium avium subsp. paratuberculosis
gccgguggacgaggugaccg

SEQ ID NO: 2953296 - RNA, 23 nt, Mycobacterium avium subsp. paratuberculosis
gccgguggagauggccagcacca

SEQ ID NO: 2953297 - RNA, 22 nt, Mycobacterium avium subsp. paratuberculosis
gccgguggauauuucgcggccg

SEQ ID NO: 2953298 - RNA, 23 nt, Mycobacterium avium subsp. paratuberculosis
gccgguggauauuucgcggccga

SEQ ID NO: 2953299 - RNA, 15 nt, Mycobacterium avium subsp. paratuberculosis
gccgguggcagcccg

SEQ ID NO: 2953300 - RNA, 17 nt, Mycobacterium avium subsp. paratuberculosis
gccgguggcagcccggc

SEQ ID NO: 2953301 - RNA, 18 nt, Mycobacterium avium subsp. paratuberculosis
gccgguggcagcccggcu

SEQ ID NO: 2953302 - RNA, 13 nt, Mycobacterium avium subsp. paratuberculosis
gccgguggccgcg

SEQ ID NO: 2953303 - RNA, 17 nt, Mycobacterium avium subsp. paratuberculosis
gccguagcggcucgcca

SEQ ID NO: 2953304 - RNA, 23 nt, Mycobacterium avium subsp. paratuberculosis
gccguagcggcucgccaccucgg

SEQ ID NO: 2953305 - RNA, 13 nt, Mycobacterium avium subsp. paratuberculosis
gccguagcggucg

SEQ ID NO: 2953306 - RNA, 15 nt, Mycobacterium avium subsp. paratuberculosis
gccguagcggucgcc

SEQ ID NO: 2953307 - RNA, 20 nt, Mycobacterium avium subsp. paratuberculosis
gccguagcggucgccccaga

SEQ ID NO: 2953308 - RNA, 17 nt, Mycobacterium avium subsp. paratuberculosis
gccguagcguugccggc

SEQ ID NO: 2953309 - RNA, 21 nt, Mycobacterium avium subsp. paratuberculosis
gccguagcguugccggccgaa

SEQ ID NO: 2953310 - RNA, 23 nt, Mycobacterium avium subsp. paratuberculosis
gccguaggacaggaacgggccgg

SEQ ID NO: 2953311 - RNA, 22 nt, Mycobacterium avium subsp. paratuberculosis
gccguaggaguagcaggcaucg

SEQ ID NO: 2953312 - RNA, 13 nt, Mycobacterium avium subsp. paratuberculosis
gccguaggccagg

SEQ ID NO: 2953313 - RNA, 14 nt, Mycobacterium avium subsp. paratuberculosis
gccguaggccaggu

SEQ ID NO: 2953314 - RNA, 14 nt, Mycobacterium avium subsp. paratuberculosis
gccguaggccgcgc

SEQ ID NO: 2953315 - RNA, 17 nt, Mycobacterium avium subsp. paratuberculosis
gccguaggccgcgcuga

SEQ ID NO: 2953316 - RNA, 13 nt, Mycobacterium avium subsp. paratuberculosis
gccguagguggcc

SEQ ID NO: 2953317 - RNA, 20 nt, Mycobacterium avium subsp. paratuberculosis
gccguaucggccccggccga

SEQ ID NO: 2953318 - RNA, 21 nt, Mycobacterium avium subsp. paratuberculosis
gccgucacaccgcggccagcg

SEQ ID NO: 2953319 - RNA, 15 nt, Mycobacterium avium subsp. paratuberculosis
gccgucacaggccgc

SEQ ID NO: 2953320 - RNA, 19 nt, Mycobacterium avium subsp. paratuberculosis
gccgucacccagaucgccc

SEQ ID NO: 2953321 - RNA, 20 nt, Mycobacterium avium subsp. paratuberculosis
gccgucacccagaucgcccg

SEQ ID NO: 2953322 - RNA, 22 nt, Mycobacterium avium subsp. paratuberculosis
gccgucacccagaucgcccggg

SEQ ID NO: 2953323 - RNA, 13 nt, Mycobacterium avium subsp. paratuberculosis
gccgucaccgcca

SEQ ID NO: 2953324 - RNA, 15 nt, Mycobacterium avium subsp. paratuberculosis
gccgucaccgccagg

SEQ ID NO: 2953325 - RNA, 18 nt, Mycobacterium avium subsp. paratuberculosis
gccgucaccgccaggacc

SEQ ID NO: 2953326 - RNA, 13 nt, Mycobacterium avium subsp. paratuberculosis
gccgucaccggcc

SEQ ID NO: 2953327 - RNA, 16 nt, Mycobacterium avium subsp. paratuberculosis
gccgucaccggccauc

SEQ ID NO: 2953328 - RNA, 18 nt, Mycobacterium avium subsp. paratuberculosis
gccgucaccggccauccg

SEQ ID NO: 2953329 - RNA, 20 nt, Mycobacterium avium subsp. paratuberculosis
gccgucaccggccauccgcu

SEQ ID NO: 2953330 - RNA, 13 nt, Mycobacterium avium subsp. paratuberculosis
gccgucaccggcu

SEQ ID NO: 2953331 - RNA, 14 nt, Mycobacterium avium subsp. paratuberculosis
gccgucaccggcug

SEQ ID NO: 2953332 - RNA, 16 nt, Mycobacterium avium subsp. paratuberculosis
gccgucaccggcugcc

SEQ ID NO: 2953333 - RNA, 21 nt, Mycobacterium avium subsp. paratuberculosis
gccgucaccggcugcccgacc

SEQ ID NO: 2953334 - RNA, 14 nt, Mycobacterium avium subsp. paratuberculosis
gccgucacgcccgu

SEQ ID NO: 2953335 - RNA, 16 nt, Mycobacterium avium subsp. paratuberculosis
gccgucacgcuggcgu

SEQ ID NO: 2953336 - RNA, 18 nt, Mycobacterium avium subsp. paratuberculosis
gccgucacgcuggcguga

SEQ ID NO: 2953337 - RNA, 19 nt, Mycobacterium avium subsp. paratuberculosis
gccgucacgcuggcgugac

SEQ ID NO: 2953338 - RNA, 22 nt, Mycobacterium avium subsp. paratuberculosis
gccgucacgcuggcgugacgcu

SEQ ID NO: 2953339 - RNA, 18 nt, Mycobacterium avium subsp. paratuberculosis
gccgucacguagcgcggc

SEQ ID NO: 2953340 - RNA, 22 nt, Mycobacterium avium subsp. paratuberculosis
gccgucacgucauuucggucgg

SEQ ID NO: 2953341 - RNA, 23 nt, Mycobacterium avium subsp. paratuberculosis
gccgucacgucauuucggucggc

SEQ ID NO: 2953342 - RNA, 18 nt, Mycobacterium avium subsp. paratuberculosis
gccgucacguucaccacc

SEQ ID NO: 2953343 - RNA, 20 nt, Mycobacterium avium subsp. paratuberculosis
gccgucacguucaccaccgg

SEQ ID NO: 2953344 - RNA, 19 nt, Mycobacterium avium subsp. paratuberculosis
gccgucacugcacgcacgg

SEQ ID NO: 2953345 - RNA, 21 nt, Mycobacterium avium subsp. paratuberculosis
gccgucacugcacgcacggcg

SEQ ID NO: 2953346 - RNA, 19 nt, Mycobacterium avium subsp. paratuberculosis
gccgucacugucggcgcgg

SEQ ID NO: 2953347 - RNA, 20 nt, Mycobacterium avium subsp. paratuberculosis
gccgucacugucggcgcgga

SEQ ID NO: 2953348 - RNA, 17 nt, Mycobacterium avium subsp. paratuberculosis
gccgucaggaacgccgg

SEQ ID NO: 2953349 - RNA, 19 nt, Mycobacterium avium subsp. paratuberculosis
gccgucaggagugcucggc

SEQ ID NO: 2953350 - RNA, 20 nt, Mycobacterium avium subsp. paratuberculosis
gccgucaggagugcucggcg

SEQ ID NO: 2953351 - RNA, 23 nt, Mycobacterium avium subsp. paratuberculosis
gccgucaggagugcucggcguug

SEQ ID NO: 2953352 - RNA, 23 nt, Mycobacterium avium subsp. paratuberculosis
gccgucaggccugguaggccgcc

SEQ ID NO: 2953353 - RNA, 13 nt, Mycobacterium avium subsp. paratuberculosis
gccgucagugcgc

SEQ ID NO: 2953354 - RNA, 17 nt, Mycobacterium avium subsp. paratuberculosis
gccgucaucaccgccga

SEQ ID NO: 2953355 - RNA, 18 nt, Mycobacterium avium subsp. paratuberculosis
gccgucaucaccgccgag

SEQ ID NO: 2953356 - RNA, 21 nt, Mycobacterium avium subsp. paratuberculosis
gccgucaucaccgccgagggc

SEQ ID NO: 2953357 - RNA, 23 nt, Mycobacterium avium subsp. paratuberculosis
gccgucauccccaucucgagcag

SEQ ID NO: 2953358 - RNA, 17 nt, Mycobacterium avium subsp. paratuberculosis
gccgucaucgccgacgg

SEQ ID NO: 2953359 - RNA, 18 nt, Mycobacterium avium subsp. paratuberculosis
gccgucaucgccgacggu

SEQ ID NO: 2953360 - RNA, 21 nt, Mycobacterium avium subsp. paratuberculosis
gccgucaucgccgacggugag

SEQ ID NO: 2953361 - RNA, 15 nt, Mycobacterium avium subsp. paratuberculosis
gccgucaucggcgga

SEQ ID NO: 2953362 - RNA, 14 nt, Mycobacterium avium subsp. paratuberculosis
gccgucaugguguc

SEQ ID NO: 2953363 - RNA, 14 nt, Mycobacterium avium subsp. paratuberculosis
gccguccaccagau

SEQ ID NO: 2953364 - RNA, 14 nt, Mycobacterium avium subsp. paratuberculosis
gccguccacccggc

SEQ ID NO: 2953365 - RNA, 16 nt, Mycobacterium avium subsp. paratuberculosis
gccguccacccggccc

SEQ ID NO: 2953366 - RNA, 17 nt, Mycobacterium avium subsp. paratuberculosis
gccguccacccggccca

SEQ ID NO: 2953367 - RNA, 18 nt, Mycobacterium avium subsp. paratuberculosis
gccguccacccggcccac

SEQ ID NO: 2953368 - RNA, 19 nt, Mycobacterium avium subsp. paratuberculosis
gccguccacccggcccacc

SEQ ID NO: 2953369 - RNA, 18 nt, Mycobacterium avium subsp. paratuberculosis
gccguccacgggucgccg

SEQ ID NO: 2953370 - RNA, 23 nt, Mycobacterium avium subsp. paratuberculosis
gccguccacgggucgccguggcc

SEQ ID NO: 2953371 - RNA, 15 nt, Mycobacterium avium subsp. paratuberculosis
gccguccagcaacgc

SEQ ID NO: 2953372 - RNA, 17 nt, Mycobacterium avium subsp. paratuberculosis
gccguccagcaacgccg

SEQ ID NO: 2953373 - RNA, 19 nt, Mycobacterium avium subsp. paratuberculosis
gccguccagcaacgccgac

SEQ ID NO: 2953374 - RNA, 20 nt, Mycobacterium avium subsp. paratuberculosis
gccguccagcaacgccgaca

SEQ ID NO: 2953375 - RNA, 14 nt, Mycobacterium avium subsp. paratuberculosis
gccguccagcagca

SEQ ID NO: 2953376 - RNA, 13 nt, Mycobacterium avium subsp. paratuberculosis
gccguccagccgu

SEQ ID NO: 2953377 - RNA, 17 nt, Mycobacterium avium subsp. paratuberculosis
gccguccagccgugcgg

SEQ ID NO: 2953378 - RNA, 20 nt, Mycobacterium avium subsp. paratuberculosis
gccguccagcgucuggcagc

SEQ ID NO: 2953379 - RNA, 12 nt, Mycobacterium avium subsp. paratuberculosis
gccguccagcuc

SEQ ID NO: 2953380 - RNA, 17 nt, Mycobacterium avium subsp. paratuberculosis
gccguccagcuccgccg

SEQ ID NO: 2953381 - RNA, 20 nt, Mycobacterium avium subsp. paratuberculosis
gccguccagcuccgccgaca

SEQ ID NO: 2953382 - RNA, 16 nt, Mycobacterium avium subsp. paratuberculosis
gccguccagcucgcgu

SEQ ID NO: 2953383 - RNA, 13 nt, Mycobacterium avium subsp. paratuberculosis
gccguccaggccg

SEQ ID NO: 2953384 - RNA, 17 nt, Mycobacterium avium subsp. paratuberculosis
gccguccaggccgcuga

SEQ ID NO: 2953385 - RNA, 19 nt, Mycobacterium avium subsp. paratuberculosis
gccguccaggcgccauugu

SEQ ID NO: 2953386 - RNA, 15 nt, Mycobacterium avium subsp. paratuberculosis
gccgucccaccggcg

SEQ ID NO: 2953387 - RNA, 18 nt, Mycobacterium avium subsp. paratuberculosis
gccgucgaggcgcugcag

SEQ ID NO: 2953388 - RNA, 21 nt, Mycobacterium avium subsp. paratuberculosis
gccgucgaucaccugcgggcg

SEQ ID NO: 2953389 - RNA, 22 nt, Mycobacterium avium subsp. paratuberculosis
gccgucgauccacccaccggca

SEQ ID NO: 2953390 - RNA, 18 nt, Mycobacterium avium subsp. paratuberculosis
gccgucgaucgcccgcuc

SEQ ID NO: 2953391 - RNA, 23 nt, Mycobacterium avium subsp. paratuberculosis
gccgucgaucgcccgcuccgcgg

SEQ ID NO: 2953392 - RNA, 19 nt, Mycobacterium avium subsp. paratuberculosis
gccgucgaucuugacgugg

SEQ ID NO: 2953393 - RNA, 17 nt, Mycobacterium avium subsp. paratuberculosis
gccgucgaugacgcgcu

SEQ ID NO: 2953394 - RNA, 15 nt, Mycobacterium avium subsp. paratuberculosis
gccgucgaugccggc

SEQ ID NO: 2953395 - RNA, 19 nt, Mycobacterium avium subsp. paratuberculosis
gccgucgaugccggcgacg

SEQ ID NO: 2953396 - RNA, 20 nt, Mycobacterium avium subsp. paratuberculosis
gccgucgaugccggcgacga

SEQ ID NO: 2953397 - RNA, 18 nt, Mycobacterium avium subsp. paratuberculosis
gccgucgauggcgcggcc

SEQ ID NO: 2953398 - RNA, 19 nt, Mycobacterium avium subsp. paratuberculosis
gccgucgauggcgcggccc

SEQ ID NO: 2953399 - RNA, 14 nt, Mycobacterium avium subsp. paratuberculosis
gccgucgcaccgcc

SEQ ID NO: 2953400 - RNA, 14 nt, Mycobacterium avium subsp. paratuberculosis
gccgucgcaucagc

SEQ ID NO: 2953401 - RNA, 17 nt, Mycobacterium avium subsp. paratuberculosis
gccgucgcaucagcucg

SEQ ID NO: 2953402 - RNA, 18 nt, Mycobacterium avium subsp. paratuberculosis
gccgucgcaucagcucgg

SEQ ID NO: 2953403 - RNA, 20 nt, Mycobacterium avium subsp. paratuberculosis
gccgucgcaucagcucggca

SEQ ID NO: 2953404 - RNA, 21 nt, Mycobacterium avium subsp. paratuberculosis
gccgucgcaucagcucggcag

SEQ ID NO: 2953405 - RNA, 22 nt, Mycobacterium avium subsp. paratuberculosis
gccgucgcaucagcucggcagc

SEQ ID NO: 2953406 - RNA, 12 nt, Mycobacterium avium subsp. paratuberculosis
gccgucgccacc

SEQ ID NO: 2953407 - RNA, 17 nt, Mycobacterium avium subsp. paratuberculosis
gccgucgccaccaccgc

SEQ ID NO: 2953408 - RNA, 19 nt, Mycobacterium avium subsp. paratuberculosis
gccgucgccaccaccgcgc

SEQ ID NO: 2953409 - RNA, 21 nt, Mycobacterium avium subsp. paratuberculosis
gccgucgccaccaccgcgccg

SEQ ID NO: 2953410 - RNA, 13 nt, Mycobacterium avium subsp. paratuberculosis
gccgucgccaccg

SEQ ID NO: 2953411 - RNA, 21 nt, Mycobacterium avium subsp. paratuberculosis
gccgucgccaccgagucgcgc

SEQ ID NO: 2953412 - RNA, 12 nt, Mycobacterium avium subsp. paratuberculosis
gccgucgcccgg

SEQ ID NO: 2953413 - RNA, 23 nt, Mycobacterium avium subsp. paratuberculosis
gccgucgccgaaguuccagccga

SEQ ID NO: 2953414 - RNA, 13 nt, Mycobacterium avium subsp. paratuberculosis
gccgucgccgauc

SEQ ID NO: 2953415 - RNA, 17 nt, Mycobacterium avium subsp. paratuberculosis
gccgucgccgaucaccu

SEQ ID NO: 2953416 - RNA, 21 nt, Mycobacterium avium subsp. paratuberculosis
gccgucgccgaucaccugaca

SEQ ID NO: 2953417 - RNA, 19 nt, Mycobacterium avium subsp. paratuberculosis
gccgucgccgcacgcccac

SEQ ID NO: 2953418 - RNA, 14 nt, Mycobacterium avium subsp. paratuberculosis
gccgucgccgccgu

SEQ ID NO: 2953419 - RNA, 12 nt, Mycobacterium avium subsp. paratuberculosis
gccgucgccgcg

SEQ ID NO: 2953420 - RNA, 14 nt, Mycobacterium avium subsp. paratuberculosis
gccgucgccgcgcc

SEQ ID NO: 2953421 - RNA, 15 nt, Mycobacterium avium subsp. paratuberculosis
gccgucgccgcgccc

SEQ ID NO: 2953422 - RNA, 17 nt, Mycobacterium avium subsp. paratuberculosis
gccgucgccgcgcccgc

SEQ ID NO: 2953423 - RNA, 21 nt, Mycobacterium avium subsp. paratuberculosis
gccgucgccgcgcccgccggc

SEQ ID NO: 2953424 - RNA, 22 nt, Mycobacterium avium subsp. paratuberculosis
gccgucgccgcgcccgccggcc

SEQ ID NO: 2953425 - RNA, 20 nt, Mycobacterium avium subsp. paratuberculosis
gccgucgccggacucgaucg

SEQ ID NO: 2953426 - RNA, 14 nt, Mycobacterium avium subsp. paratuberculosis
gccgucgccgggcg

SEQ ID NO: 2953427 - RNA, 15 nt, Mycobacterium avium subsp. paratuberculosis
gccgucgccgggcgg

SEQ ID NO: 2953428 - RNA, 13 nt, Mycobacterium avium subsp. paratuberculosis
gccgucgccgguc

SEQ ID NO: 2953429 - RNA, 13 nt, Mycobacterium avium subsp. paratuberculosis
gccgucgccucgc

SEQ ID NO: 2953430 - RNA, 19 nt, Mycobacterium avium subsp. paratuberculosis
gccgucgccucgcccucgg

SEQ ID NO: 2953431 - RNA, 16 nt, Mycobacterium avium subsp. paratuberculosis
gccgucgcgaucgcgg

SEQ ID NO: 2953432 - RNA, 17 nt, Mycobacterium avium subsp. paratuberculosis
gccgucgcgaucgcggu

SEQ ID NO: 2953433 - RNA, 20 nt, Mycobacterium avium subsp. paratuberculosis
gccgucgcgaucgcggucca

SEQ ID NO: 2953434 - RNA, 14 nt, Mycobacterium avium subsp. paratuberculosis
gccgucgcgcacca

SEQ ID NO: 2953435 - RNA, 15 nt, Mycobacterium avium subsp. paratuberculosis
gccgucgcgcaccac

SEQ ID NO: 2953436 - RNA, 17 nt, Mycobacterium avium subsp. paratuberculosis
gccgucgcgcaccaccu

SEQ ID NO: 2953437 - RNA, 15 nt, Mycobacterium avium subsp. paratuberculosis
gccgucgcgcaccgc

SEQ ID NO: 2953438 - RNA, 14 nt, Mycobacterium avium subsp. paratuberculosis
gccgucgcgcagcc

SEQ ID NO: 2953439 - RNA, 14 nt, Mycobacterium avium subsp. paratuberculosis
gccgucgcgccagg

SEQ ID NO: 2953440 - RNA, 16 nt, Mycobacterium avium subsp. paratuberculosis
gccgucgcgccaggac

SEQ ID NO: 2953441 - RNA, 22 nt, Mycobacterium avium subsp. paratuberculosis
gccgucgcgccaggaccagcgg

SEQ ID NO: 2953442 - RNA, 16 nt, Mycobacterium avium subsp. paratuberculosis
gccgucgcgcucgacg

SEQ ID NO: 2953443 - RNA, 17 nt, Mycobacterium avium subsp. paratuberculosis
gccgucgcggcgaucgc

SEQ ID NO: 2953444 - RNA, 21 nt, Mycobacterium avium subsp. paratuberculosis
gccgucgcggcgaucgcgagc

SEQ ID NO: 2953445 - RNA, 12 nt, Mycobacterium avium subsp. paratuberculosis
gccgucgcggga

SEQ ID NO: 2953446 - RNA, 22 nt, Mycobacterium avium subsp. paratuberculosis
gccgucgcgggaaucccacccg

SEQ ID NO: 2953447 - RNA, 23 nt, Mycobacterium avium subsp. paratuberculosis
gccgucgcgggaaucccacccgc

SEQ ID NO: 2953448 - RNA, 15 nt, Mycobacterium avium subsp. paratuberculosis
gccgucgcgggagag

SEQ ID NO: 2953449 - RNA, 20 nt, Mycobacterium avium subsp. paratuberculosis
gccgucgcgggagagcgcgg

SEQ ID NO: 2953450 - RNA, 21 nt, Mycobacterium avium subsp. paratuberculosis
gccgucgcgggagagcgcggg

SEQ ID NO: 2953451 - RNA, 15 nt, Mycobacterium avium subsp. paratuberculosis
gccgucgcguucgac

SEQ ID NO: 2953452 - RNA, 15 nt, Mycobacterium avium subsp. paratuberculosis
gccgucggaucgaag

SEQ ID NO: 2953453 - RNA, 14 nt, Mycobacterium avium subsp. paratuberculosis
gccgucggccagca

SEQ ID NO: 2953454 - RNA, 17 nt, Mycobacterium avium subsp. paratuberculosis
gccgucggccagcagcg

SEQ ID NO: 2953455 - RNA, 20 nt, Mycobacterium avium subsp. paratuberculosis
gccgucggccagcagcgcgu

SEQ ID NO: 2953456 - RNA, 22 nt, Mycobacterium avium subsp. paratuberculosis
gccgucggccagcagcgcgucg

SEQ ID NO: 2953457 - RNA, 18 nt, Mycobacterium avium subsp. paratuberculosis
gccgucggcccacgguga

SEQ ID NO: 2953458 - RNA, 14 nt, Mycobacterium avium subsp. paratuberculosis
gccgucggccgccg

SEQ ID NO: 2953459 - RNA, 16 nt, Mycobacterium avium subsp. paratuberculosis
gccgucggccgccgac

SEQ ID NO: 2953460 - RNA, 21 nt, Mycobacterium avium subsp. paratuberculosis
gccgucggccugcgcugcggc

SEQ ID NO: 2953461 - RNA, 15 nt, Mycobacterium avium subsp. paratuberculosis
gccgucggcgaugcg

SEQ ID NO: 2953462 - RNA, 18 nt, Mycobacterium avium subsp. paratuberculosis
gccgucggcgaugcggug

SEQ ID NO: 2953463 - RNA, 21 nt, Mycobacterium avium subsp. paratuberculosis
gccgucggcgaugcggugguc

SEQ ID NO: 2953464 - RNA, 22 nt, Mycobacterium avium subsp. paratuberculosis
gccgucggcgaugcgguggucg

SEQ ID NO: 2953465 - RNA, 15 nt, Mycobacterium avium subsp. paratuberculosis
gccgucggcgcccgg

SEQ ID NO: 2953466 - RNA, 16 nt, Mycobacterium avium subsp. paratuberculosis
gccgucggcgcccggc

SEQ ID NO: 2953467 - RNA, 17 nt, Mycobacterium avium subsp. paratuberculosis
gccgucggcgccgccga

SEQ ID NO: 2953468 - RNA, 19 nt, Mycobacterium avium subsp. paratuberculosis
gccgucggcgccgccgagc

SEQ ID NO: 2953469 - RNA, 21 nt, Mycobacterium avium subsp. paratuberculosis
gccgucggcgccgccgagccg

SEQ ID NO: 2953470 - RNA, 14 nt, Mycobacterium avium subsp. paratuberculosis
gccgucggcgcggc

SEQ ID NO: 2953471 - RNA, 17 nt, Mycobacterium avium subsp. paratuberculosis
gccgucggcgcggccgg

SEQ ID NO: 2953472 - RNA, 16 nt, Mycobacterium avium subsp. paratuberculosis
gccgugaaccggcguu

SEQ ID NO: 2953473 - RNA, 17 nt, Mycobacterium avium subsp. paratuberculosis
gccgugaaccggcguug

SEQ ID NO: 2953474 - RNA, 18 nt, Mycobacterium avium subsp. paratuberculosis
gccgugaaccggcguugc

SEQ ID NO: 2953475 - RNA, 17 nt, Mycobacterium avium subsp. paratuberculosis
gccgugaagggcccgcc

SEQ ID NO: 2953476 - RNA, 21 nt, Mycobacterium avium subsp. paratuberculosis
gccgugaagggcccgccggug

SEQ ID NO: 2953477 - RNA, 18 nt, Mycobacterium avium subsp. paratuberculosis
gccgugacauugggggcu

SEQ ID NO: 2953478 - RNA, 14 nt, Mycobacterium avium subsp. paratuberculosis
gccgugacgccgau

SEQ ID NO: 2953479 - RNA, 15 nt, Mycobacterium avium subsp. paratuberculosis
gccgugacgccgauc

SEQ ID NO: 2953480 - RNA, 20 nt, Mycobacterium avium subsp. paratuberculosis
gccgugagauccagcagcca

SEQ ID NO: 2953481 - RNA, 15 nt, Mycobacterium avium subsp. paratuberculosis
gccgugaucggccag

SEQ ID NO: 2953482 - RNA, 16 nt, Mycobacterium avium subsp. paratuberculosis
gccgugaucggccagc

SEQ ID NO: 2953483 - RNA, 17 nt, Mycobacterium avium subsp. paratuberculosis
gccgugaucggccagcc

SEQ ID NO: 2953484 - RNA, 20 nt, Mycobacterium avium subsp. paratuberculosis
gccgugaucucgugccgcac

SEQ ID NO: 2953485 - RNA, 22 nt, Mycobacterium avium subsp. paratuberculosis
gccgugaucucgugccgcaccc

SEQ ID NO: 2953486 - RNA, 16 nt, Mycobacterium avium subsp. paratuberculosis
gccgugaucugguggg

SEQ ID NO: 2953487 - RNA, 22 nt, Mycobacterium avium subsp. paratuberculosis
gccgugaucuggugggcgggca

SEQ ID NO: 2953488 - RNA, 19 nt, Mycobacterium avium subsp. paratuberculosis
gccgugaucuucgugcuca

SEQ ID NO: 2953489 - RNA, 14 nt, Mycobacterium avium subsp. paratuberculosis
gccgugaugccggg

SEQ ID NO: 2953490 - RNA, 22 nt, Mycobacterium avium subsp. paratuberculosis
gccgugaugcgcaagcaccggc

SEQ ID NO: 2953491 - RNA, 21 nt, Mycobacterium avium subsp. paratuberculosis
gccgugcaccgucgccggcgg

SEQ ID NO: 2953492 - RNA, 20 nt, Mycobacterium avium subsp. paratuberculosis
gccgugcacgaacaggguga

SEQ ID NO: 2953493 - RNA, 17 nt, Mycobacterium avium subsp. paratuberculosis
gccgugcagaacagcac

SEQ ID NO: 2953494 - RNA, 19 nt, Mycobacterium avium subsp. paratuberculosis
gccgugcagaacagcacga

SEQ ID NO: 2953495 - RNA, 13 nt, Mycobacterium avium subsp. paratuberculosis
gccgugcagcacc

SEQ ID NO: 2953496 - RNA, 16 nt, Mycobacterium avium subsp. paratuberculosis
gccgugcagcaccucg

SEQ ID NO: 2953497 - RNA, 17 nt, Mycobacterium avium subsp. paratuberculosis
gccgugcagcaccucga

SEQ ID NO: 2953498 - RNA, 23 nt, Mycobacterium avium subsp. paratuberculosis
gccgugcagcaccucgaagccga

SEQ ID NO: 2953499 - RNA, 14 nt, Mycobacterium avium subsp. paratuberculosis
gccgugcagcacgc

SEQ ID NO: 2953500 - RNA, 18 nt, Mycobacterium avium subsp. paratuberculosis
gccgugcagcacgccgcg

SEQ ID NO: 2953501 - RNA, 19 nt, Mycobacterium avium subsp. paratuberculosis
gccgugcagcacgccgcgg

SEQ ID NO: 2953502 - RNA, 20 nt, Mycobacterium avium subsp. paratuberculosis
gccgugcagcacgccgcgga

SEQ ID NO: 2953503 - RNA, 21 nt, Mycobacterium avium subsp. paratuberculosis
gccgugcagcaguuccggagc

SEQ ID NO: 2953504 - RNA, 14 nt, Mycobacterium avium subsp. paratuberculosis
gccgugcagcgccc

SEQ ID NO: 2953505 - RNA, 15 nt, Mycobacterium avium subsp. paratuberculosis
gccgugcagcgccca

SEQ ID NO: 2953506 - RNA, 17 nt, Mycobacterium avium subsp. paratuberculosis
gccgugcagcgcccagc

SEQ ID NO: 2953507 - RNA, 19 nt, Mycobacterium avium subsp. paratuberculosis
gccgugcagcgcccagccg

SEQ ID NO: 2953508 - RNA, 22 nt, Mycobacterium avium subsp. paratuberculosis
gccgugcagcgcccagccgagc

SEQ ID NO: 2953509 - RNA, 24 nt, Mycobacterium avium subsp. paratuberculosis
gccgugcagcgcccagccgagccg

SEQ ID NO: 2953510 - RNA, 21 nt, Mycobacterium avium subsp. paratuberculosis
gccgugcaggaugaccgcguc

SEQ ID NO: 2953511 - RNA, 22 nt, Mycobacterium avium subsp. paratuberculosis
gccgugcaggaugaccgcgucg

SEQ ID NO: 2953512 - RNA, 18 nt, Mycobacterium avium subsp. paratuberculosis
gccgugcagggggcgcag

SEQ ID NO: 2953513 - RNA, 22 nt, Mycobacterium avium subsp. paratuberculosis
gccgugcagggggcgcagccga

SEQ ID NO: 2953514 - RNA, 15 nt, Mycobacterium avium subsp. paratuberculosis
gccgugcauccagcc

SEQ ID NO: 2953515 - RNA, 16 nt, Mycobacterium avium subsp. paratuberculosis
gccgugcauccagccg

SEQ ID NO: 2953516 - RNA, 13 nt, Mycobacterium avium subsp. paratuberculosis
gccgugcaucggg

SEQ ID NO: 2953517 - RNA, 17 nt, Mycobacterium avium subsp. paratuberculosis
gccgugcaucgggcgcu

SEQ ID NO: 2953518 - RNA, 21 nt, Mycobacterium avium subsp. paratuberculosis
gccgugcaucgggcgcucggc

SEQ ID NO: 2953519 - RNA, 14 nt, Mycobacterium avium subsp. paratuberculosis
gccgugccagccgg

SEQ ID NO: 2953520 - RNA, 15 nt, Mycobacterium avium subsp. paratuberculosis
gccgugccagccggc

SEQ ID NO: 2953521 - RNA, 16 nt, Mycobacterium avium subsp. paratuberculosis
gccgugccagccggcc

SEQ ID NO: 2953522 - RNA, 17 nt, Mycobacterium avium subsp. paratuberculosis
gccgugccagccggccg

SEQ ID NO: 2953523 - RNA, 18 nt, Mycobacterium avium subsp. paratuberculosis
gccgugccagccggccgc

SEQ ID NO: 2953524 - RNA, 21 nt, Mycobacterium avium subsp. paratuberculosis
gccgugccagccggccgcuga

SEQ ID NO: 2953525 - RNA, 22 nt, Mycobacterium avium subsp. paratuberculosis
gccgugcccaacacgccccgac

SEQ ID NO: 2953526 - RNA, 21 nt, Mycobacterium avium subsp. paratuberculosis
gccgugcccaauagcacccgc

SEQ ID NO: 2953527 - RNA, 16 nt, Mycobacterium avium subsp. paratuberculosis
gccgugccccaggucg

SEQ ID NO: 2953528 - RNA, 14 nt, Mycobacterium avium subsp. paratuberculosis
gccgugcccgcggg

SEQ ID NO: 2953529 - RNA, 18 nt, Mycobacterium avium subsp. paratuberculosis
gccgugcccggcgcccug

SEQ ID NO: 2953530 - RNA, 19 nt, Mycobacterium avium subsp. paratuberculosis
gccgugcccggcgcccugc

SEQ ID NO: 2953531 - RNA, 18 nt, Mycobacterium avium subsp. paratuberculosis
gccgugccgauuccagca

SEQ ID NO: 2953532 - RNA, 13 nt, Mycobacterium avium subsp. paratuberculosis
gccgugccgcgcg

SEQ ID NO: 2953533 - RNA, 15 nt, Mycobacterium avium subsp. paratuberculosis
gccgugccgcgcggc

SEQ ID NO: 2953534 - RNA, 14 nt, Mycobacterium avium subsp. paratuberculosis
gccgugccggaccg

SEQ ID NO: 2953535 - RNA, 14 nt, Mycobacterium avium subsp. paratuberculosis
gccgugccggcucg

SEQ ID NO: 2953536 - RNA, 17 nt, Mycobacterium avium subsp. paratuberculosis
gccgugccggcucggcg

SEQ ID NO: 2953537 - RNA, 17 nt, Mycobacterium avium subsp. paratuberculosis
gccgugccgguggaaca

SEQ ID NO: 2953538 - RNA, 13 nt, Mycobacterium avium subsp. paratuberculosis
gccgugccguggu

SEQ ID NO: 2953539 - RNA, 19 nt, Mycobacterium avium subsp. paratuberculosis
gccgugccguggucggugc

SEQ ID NO: 2953540 - RNA, 21 nt, Mycobacterium avium subsp. paratuberculosis
gccgugccguggucggugccc

SEQ ID NO: 2953541 - RNA, 13 nt, Mycobacterium avium subsp. paratuberculosis
gccgugcgcagca

SEQ ID NO: 2953542 - RNA, 13 nt, Mycobacterium avium subsp. paratuberculosis
gccgugcgccagc

SEQ ID NO: 2953543 - RNA, 15 nt, Mycobacterium avium subsp. paratuberculosis
gccgugcgccagcga

SEQ ID NO: 2953544 - RNA, 16 nt, Mycobacterium avium subsp. paratuberculosis
gccgugcgccagcgac

SEQ ID NO: 2953545 - RNA, 21 nt, Mycobacterium avium subsp. paratuberculosis
gccgugcgccagcgaccgcag

SEQ ID NO: 2953546 - RNA, 15 nt, Mycobacterium avium subsp. paratuberculosis
gccgugcgccccgcc

SEQ ID NO: 2953547 - RNA, 17 nt, Mycobacterium avium subsp. paratuberculosis
gccgugcgccccgcccu

SEQ ID NO: 2953548 - RNA, 16 nt, Mycobacterium avium subsp. paratuberculosis
gccgugcgcgcuggug

SEQ ID NO: 2953549 - RNA, 22 nt, Mycobacterium avium subsp. paratuberculosis
gccgugcgcgcuggugcugccg

SEQ ID NO: 2953550 - RNA, 19 nt, Mycobacterium avium subsp. paratuberculosis
gccgugcgcggcgaccacc

SEQ ID NO: 2953551 - RNA, 22 nt, Mycobacterium avium subsp. paratuberculosis
gccgugcgcggcgaccaccucg

SEQ ID NO: 2953552 - RNA, 14 nt, Mycobacterium avium subsp. paratuberculosis
gccgugcgcgucga

SEQ ID NO: 2953553 - RNA, 16 nt, Mycobacterium avium subsp. paratuberculosis
gccgugcgcgucgaca

SEQ ID NO: 2953554 - RNA, 17 nt, Mycobacterium avium subsp. paratuberculosis
gccgugcggcacgccgc

SEQ ID NO: 2953555 - RNA, 18 nt, Mycobacterium avium subsp. paratuberculosis
gccgugcggcacgccgca

SEQ ID NO: 2953556 - RNA, 16 nt, Mycobacterium avium subsp. paratuberculosis
gccguucugacccuuc

SEQ ID NO: 2953557 - RNA, 16 nt, Mycobacterium avium subsp. paratuberculosis
gccguucuugcgggug

SEQ ID NO: 2953558 - RNA, 15 nt, Mycobacterium avium subsp. paratuberculosis
gccguugacaccggg

SEQ ID NO: 2953559 - RNA, 17 nt, Mycobacterium avium subsp. paratuberculosis
gccguugacaccgggug

SEQ ID NO: 2953560 - RNA, 16 nt, Mycobacterium avium subsp. paratuberculosis
gccguugaccccgacg

SEQ ID NO: 2953561 - RNA, 18 nt, Mycobacterium avium subsp. paratuberculosis
gccguugaccccgacggc

SEQ ID NO: 2953562 - RNA, 22 nt, Mycobacterium avium subsp. paratuberculosis
gccguugaccccgacggcgccg

SEQ ID NO: 2953563 - RNA, 13 nt, Mycobacterium avium subsp. paratuberculosis
gccguugaccgcg

SEQ ID NO: 2953564 - RNA, 17 nt, Mycobacterium avium subsp. paratuberculosis
gccguugaccgcggcga

SEQ ID NO: 2953565 - RNA, 19 nt, Mycobacterium avium subsp. paratuberculosis
gccguugaccgcggcgaug

SEQ ID NO: 2953566 - RNA, 14 nt, Mycobacterium avium subsp. paratuberculosis
gccguugaccggcc

SEQ ID NO: 2953567 - RNA, 15 nt, Mycobacterium avium subsp. paratuberculosis
gccguugaccggccg

SEQ ID NO: 2953568 - RNA, 18 nt, Mycobacterium avium subsp. paratuberculosis
gccguugaccggugcgcc

SEQ ID NO: 2953569 - RNA, 14 nt, Mycobacterium avium subsp. paratuberculosis
gccguugacggugu

SEQ ID NO: 2953570 - RNA, 20 nt, Mycobacterium avium subsp. paratuberculosis
gccguugagcguggacaccg

SEQ ID NO: 2953571 - RNA, 16 nt, Mycobacterium avium subsp. paratuberculosis
gccguugaucgagcac

SEQ ID NO: 2953572 - RNA, 20 nt, Mycobacterium avium subsp. paratuberculosis
gccguugaucgagcaccggg

SEQ ID NO: 2953573 - RNA, 19 nt, Mycobacterium avium subsp. paratuberculosis
gccguugaugcgcaccgcg

SEQ ID NO: 2953574 - RNA, 20 nt, Mycobacterium avium subsp. paratuberculosis
gccguugaugcgcaccgcgg

SEQ ID NO: 2953575 - RNA, 19 nt, Mycobacterium avium subsp. paratuberculosis
gccguugauugcgcccgcc

SEQ ID NO: 2953576 - RNA, 21 nt, Mycobacterium avium subsp. paratuberculosis
gccguugauugcgcccgccga

SEQ ID NO: 2953577 - RNA, 13 nt, Mycobacterium avium subsp. paratuberculosis
gccguugccaggc

SEQ ID NO: 2953578 - RNA, 16 nt, Mycobacterium avium subsp. paratuberculosis
gccguugccaggccgc

SEQ ID NO: 2953579 - RNA, 18 nt, Mycobacterium avium subsp. paratuberculosis
gccguugccaggccgcga

SEQ ID NO: 2953580 - RNA, 14 nt, Mycobacterium avium subsp. paratuberculosis
gccguugccgccgc

SEQ ID NO: 2953581 - RNA, 16 nt, Mycobacterium avium subsp. paratuberculosis
gccguugccgccgcgc

SEQ ID NO: 2953582 - RNA, 17 nt, Mycobacterium avium subsp. paratuberculosis
gccguugccgccgcgcg

SEQ ID NO: 2953583 - RNA, 16 nt, Mycobacterium avium subsp. paratuberculosis
gccguugccggcccgc

SEQ ID NO: 2953584 - RNA, 17 nt, Mycobacterium avium subsp. paratuberculosis
gccguugccggcccgca

SEQ ID NO: 2953585 - RNA, 16 nt, Mycobacterium avium subsp. paratuberculosis
gccguugcgccagcgg

SEQ ID NO: 2953586 - RNA, 17 nt, Mycobacterium avium subsp. paratuberculosis
gccguugcggcccacgg

SEQ ID NO: 2953587 - RNA, 20 nt, Mycobacterium avium subsp. paratuberculosis
gccguugcggcccacgguga

SEQ ID NO: 2953588 - RNA, 17 nt, Mycobacterium avium subsp. paratuberculosis
gccguugcgggucggcg

SEQ ID NO: 2953589 - RNA, 18 nt, Mycobacterium avium subsp. paratuberculosis
gccguugcgggucggcgu

SEQ ID NO: 2953590 - RNA, 23 nt, Mycobacterium avium subsp. paratuberculosis
gccguugcucucggccucccggu

SEQ ID NO: 2953591 - RNA, 20 nt, Mycobacterium avium subsp. paratuberculosis
gccguugggcacgguguagc

SEQ ID NO: 2953592 - RNA, 22 nt, Mycobacterium avium subsp. paratuberculosis
gccguugggcacgguguagcug

SEQ ID NO: 2953593 - RNA, 13 nt, Mycobacterium avium subsp. paratuberculosis
gccguugggcagc

SEQ ID NO: 2953594 - RNA, 16 nt, Mycobacterium avium subsp. paratuberculosis
gccguugggcagcucg

SEQ ID NO: 2953595 - RNA, 18 nt, Mycobacterium avium subsp. paratuberculosis
gccguugggcagcucggc

SEQ ID NO: 2953596 - RNA, 20 nt, Mycobacterium avium subsp. paratuberculosis
gccguugggccagcggcgcc

SEQ ID NO: 2953597 - RNA, 19 nt, Mycobacterium avium subsp. paratuberculosis
gccguuggucugcgcgagc

SEQ ID NO: 2953598 - RNA, 23 nt, Mycobacterium avium subsp. paratuberculosis
gccguuggucugcgcgagcagau

SEQ ID NO: 2953599 - RNA, 23 nt, Mycobacterium avium subsp. paratuberculosis
gccguuggugacgcucacccggc

SEQ ID NO: 2953600 - RNA, 18 nt, Mycobacterium avium subsp. paratuberculosis
gccguuguaggccgcgcg

SEQ ID NO: 2953601 - RNA, 16 nt, Mycobacterium avium subsp. paratuberculosis
gccguugucgaguucg

SEQ ID NO: 2953602 - RNA, 21 nt, Mycobacterium avium subsp. paratuberculosis
gccguuucggauccauugcga

SEQ ID NO: 2953603 - RNA, 17 nt, Mycobacterium avium subsp. paratuberculosis
gccguuuugccgccgag

SEQ ID NO: 2953604 - RNA, 23 nt, Mycobacterium avium subsp. paratuberculosis
gccuaauucguuguuggcggugg

SEQ ID NO: 2953605 - RNA, 16 nt, Mycobacterium avium subsp. paratuberculosis
gccuacacagccccca

SEQ ID NO: 2953606 - RNA, 22 nt, Mycobacterium avium subsp. paratuberculosis
gccuacacagcccccacgcucg

SEQ ID NO: 2953607 - RNA, 17 nt, Mycobacterium avium subsp. paratuberculosis
gccuacaggugccggcg

SEQ ID NO: 2953608 - RNA, 19 nt, Mycobacterium avium subsp. paratuberculosis
gccuacaggugccggcggc

SEQ ID NO: 2953609 - RNA, 20 nt, Mycobacterium avium subsp. paratuberculosis
gccuacaggugccggcggcg

SEQ ID NO: 2953610 - RNA, 14 nt, Mycobacterium avium subsp. paratuberculosis
gccuaccggguggc

SEQ ID NO: 2953611 - RNA, 16 nt, Mycobacterium avium subsp. paratuberculosis
gccuaccggguggcca

SEQ ID NO: 2953612 - RNA, 19 nt, Mycobacterium avium subsp. paratuberculosis
gccuaccggguggccagca

SEQ ID NO: 2953613 - RNA, 22 nt, Mycobacterium avium subsp. paratuberculosis
gccuaccggguggccagcacca

SEQ ID NO: 2953614 - RNA, 23 nt, Mycobacterium avium subsp. paratuberculosis
gccuaccggguggccagcaccag

SEQ ID NO: 2953615 - RNA, 19 nt, Mycobacterium avium subsp. paratuberculosis
gccuacgacauccugcgca

SEQ ID NO: 2953616 - RNA, 12 nt, Mycobacterium avium subsp. paratuberculosis
gccuacggcgcc

SEQ ID NO: 2953617 - RNA, 13 nt, Mycobacterium avium subsp. paratuberculosis
gccuacggcgccg

SEQ ID NO: 2953618 - RNA, 20 nt, Mycobacterium avium subsp. paratuberculosis
gccuacuugcggccgcgacg

SEQ ID NO: 2953619 - RNA, 21 nt, Mycobacterium avium subsp. paratuberculosis
gccuacuugcguugcgcggcg

SEQ ID NO: 2953620 - RNA, 23 nt, Mycobacterium avium subsp. paratuberculosis
gccuacuugcguugcgcggcggc

SEQ ID NO: 2953621 - RNA, 16 nt, Mycobacterium avium subsp. paratuberculosis
gccuagccuuggccgc

SEQ ID NO: 2953622 - RNA, 22 nt, Mycobacterium avium subsp. paratuberculosis
gccuagccuuggccgcaggcgg

SEQ ID NO: 2953623 - RNA, 14 nt, Mycobacterium avium subsp. paratuberculosis
gccuaggaccccgg

SEQ ID NO: 2953624 - RNA, 16 nt, Mycobacterium avium subsp. paratuberculosis
gccuaggaccccggcu

SEQ ID NO: 2953625 - RNA, 15 nt, Mycobacterium avium subsp. paratuberculosis
gccuaggacgccgcc

SEQ ID NO: 2953626 - RNA, 16 nt, Mycobacterium avium subsp. paratuberculosis
gccuaggacgccgccc

SEQ ID NO: 2953627 - RNA, 19 nt, Mycobacterium avium subsp. paratuberculosis
gccuaggggagcagcacga

SEQ ID NO: 2953628 - RNA, 14 nt, Mycobacterium avium subsp. paratuberculosis
gccuagugccgggg

SEQ ID NO: 2953629 - RNA, 17 nt, Mycobacterium avium subsp. paratuberculosis
gccucacagcgacaacg

SEQ ID NO: 2953630 - RNA, 15 nt, Mycobacterium avium subsp. paratuberculosis
gccucaccccagcgc

SEQ ID NO: 2953631 - RNA, 16 nt, Mycobacterium avium subsp. paratuberculosis
gccucaccccagcgcg

SEQ ID NO: 2953632 - RNA, 17 nt, Mycobacterium avium subsp. paratuberculosis
gccucaccccagcgcga

SEQ ID NO: 2953633 - RNA, 22 nt, Mycobacterium avium subsp. paratuberculosis
gccucaccccagcgcgaccagu

SEQ ID NO: 2953634 - RNA, 24 nt, Mycobacterium avium subsp. paratuberculosis
gccucaccgcgggccaggcccacc

SEQ ID NO: 2953635 - RNA, 21 nt, Mycobacterium avium subsp. paratuberculosis
gccucagcagcugcuggcgug

SEQ ID NO: 2953636 - RNA, 21 nt, Mycobacterium avium subsp. paratuberculosis
gccucagcgcgcaacgacgaa

SEQ ID NO: 2953637 - RNA, 19 nt, Mycobacterium avium subsp. paratuberculosis
gccucaggcgagcacccgg

SEQ ID NO: 2953638 - RNA, 16 nt, Mycobacterium avium subsp. paratuberculosis
gccucaggcgucgguc

SEQ ID NO: 2953639 - RNA, 19 nt, Mycobacterium avium subsp. paratuberculosis
gccucaggcugacgccacg

SEQ ID NO: 2953640 - RNA, 13 nt, Mycobacterium avium subsp. paratuberculosis
gccuccgugcugg

SEQ ID NO: 2953641 - RNA, 16 nt, Mycobacterium avium subsp. paratuberculosis
gccuccuccucgcugc

SEQ ID NO: 2953642 - RNA, 17 nt, Mycobacterium avium subsp. paratuberculosis
gccuccuccucgcugcc

SEQ ID NO: 2953643 - RNA, 19 nt, Mycobacterium avium subsp. paratuberculosis
gccuccucggugaccucga

SEQ ID NO: 2953644 - RNA, 21 nt, Mycobacterium avium subsp. paratuberculosis
gccuccucggugaccucgaag

SEQ ID NO: 2953645 - RNA, 15 nt, Mycobacterium avium subsp. paratuberculosis
gccuccucggugagc

SEQ ID NO: 2953646 - RNA, 18 nt, Mycobacterium avium subsp. paratuberculosis
gccuccugcuggcgcugc

SEQ ID NO: 2953647 - RNA, 20 nt, Mycobacterium avium subsp. paratuberculosis
gccuccugcuggcgcugcca

SEQ ID NO: 2953648 - RNA, 15 nt, Mycobacterium avium subsp. paratuberculosis
gccuccuguuggccc

SEQ ID NO: 2953649 - RNA, 18 nt, Mycobacterium avium subsp. paratuberculosis
gccuccuguuggcccugc

SEQ ID NO: 2953650 - RNA, 15 nt, Mycobacterium avium subsp. paratuberculosis
gccucgaacaucggc

SEQ ID NO: 2953651 - RNA, 17 nt, Mycobacterium avium subsp. paratuberculosis
gccucgaagucgccggc

SEQ ID NO: 2953652 - RNA, 18 nt, Mycobacterium avium subsp. paratuberculosis
gccucgaagucgccggcc

SEQ ID NO: 2953653 - RNA, 14 nt, Mycobacterium avium subsp. paratuberculosis
gccucgaccagcac

SEQ ID NO: 2953654 - RNA, 15 nt, Mycobacterium avium subsp. paratuberculosis
gccucgaccagcacc

SEQ ID NO: 2953655 - RNA, 16 nt, Mycobacterium avium subsp. paratuberculosis
gccucgaccagcaccg

SEQ ID NO: 2953656 - RNA, 15 nt, Mycobacterium avium subsp. paratuberculosis
gccucgaccaggcuu

SEQ ID NO: 2953657 - RNA, 18 nt, Mycobacterium avium subsp. paratuberculosis
gccucgaccaggcuuggc

SEQ ID NO: 2953658 - RNA, 20 nt, Mycobacterium avium subsp. paratuberculosis
gccucgaccaggcuuggccc

SEQ ID NO: 2953659 - RNA, 21 nt, Mycobacterium avium subsp. paratuberculosis
gccucgacgauugucggggcc

SEQ ID NO: 2953660 - RNA, 22 nt, Mycobacterium avium subsp. paratuberculosis
gccucgacgauugucggggccg

SEQ ID NO: 2953661 - RNA, 15 nt, Mycobacterium avium subsp. paratuberculosis
gccucgacggugacc

SEQ ID NO: 2953662 - RNA, 17 nt, Mycobacterium avium subsp. paratuberculosis
gccucgacggugaccuc

SEQ ID NO: 2953663 - RNA, 16 nt, Mycobacterium avium subsp. paratuberculosis
gccucgagcaccacgg

SEQ ID NO: 2953664 - RNA, 20 nt, Mycobacterium avium subsp. paratuberculosis
gccucgagcaccacggcccg

SEQ ID NO: 2953665 - RNA, 15 nt, Mycobacterium avium subsp. paratuberculosis
gccucgaggaucgcg

SEQ ID NO: 2953666 - RNA, 16 nt, Mycobacterium avium subsp. paratuberculosis
gccucgaggaucgcgg

SEQ ID NO: 2953667 - RNA, 20 nt, Mycobacterium avium subsp. paratuberculosis
gccucgaggaucgcggccac

SEQ ID NO: 2953668 - RNA, 16 nt, Mycobacterium avium subsp. paratuberculosis
gccucgaucaacgccg

SEQ ID NO: 2953669 - RNA, 18 nt, Mycobacterium avium subsp. paratuberculosis
gccucgaucagagcgggc

SEQ ID NO: 2953670 - RNA, 24 nt, Mycobacterium avium subsp. paratuberculosis
gccucgaucagagcgggccgaccg

SEQ ID NO: 2953671 - RNA, 18 nt, Mycobacterium avium subsp. paratuberculosis
gccucgaucaucaccacc

SEQ ID NO: 2953672 - RNA, 19 nt, Mycobacterium avium subsp. paratuberculosis
gccucgaucugguucaccg

SEQ ID NO: 2953673 - RNA, 15 nt, Mycobacterium avium subsp. paratuberculosis
gccucgaugcggccg

SEQ ID NO: 2953674 - RNA, 20 nt, Mycobacterium avium subsp. paratuberculosis
gccucgaugcggccgucggg

SEQ ID NO: 2953675 - RNA, 19 nt, Mycobacterium avium subsp. paratuberculosis
gccucgaugcggguguugc

SEQ ID NO: 2953676 - RNA, 16 nt, Mycobacterium avium subsp. paratuberculosis
gccucgaugucgucga

SEQ ID NO: 2953677 - RNA, 14 nt, Mycobacterium avium subsp. paratuberculosis
gccucgcagcgaca

SEQ ID NO: 2953678 - RNA, 20 nt, Mycobacterium avium subsp. paratuberculosis
gccucgccacugggcgucgg

SEQ ID NO: 2953679 - RNA, 12 nt, Mycobacterium avium subsp. paratuberculosis
gccucgccagcc

SEQ ID NO: 2953680 - RNA, 23 nt, Mycobacterium avium subsp. paratuberculosis
gccucgccagccccaccggccac

SEQ ID NO: 2953681 - RNA, 19 nt, Mycobacterium avium subsp. paratuberculosis
gccucgccagccguccugg

SEQ ID NO: 2953682 - RNA, 15 nt, Mycobacterium avium subsp. paratuberculosis
gccucgcccagcgcc

SEQ ID NO: 2953683 - RNA, 19 nt, Mycobacterium avium subsp. paratuberculosis
gccucgcccagcgccgcgg

SEQ ID NO: 2953684 - RNA, 23 nt, Mycobacterium avium subsp. paratuberculosis
gccucgcccagcgccgcggcgaa

SEQ ID NO: 2953685 - RNA, 16 nt, Mycobacterium avium subsp. paratuberculosis
gccucgcccucggugu

SEQ ID NO: 2953686 - RNA, 12 nt, Mycobacterium avium subsp. paratuberculosis
gccucgccgacc

SEQ ID NO: 2953687 - RNA, 22 nt, Mycobacterium avium subsp. paratuberculosis
gccucgccgaccuuggcguugu

SEQ ID NO: 2953688 - RNA, 14 nt, Mycobacterium avium subsp. paratuberculosis
gccucgccgcuggg

SEQ ID NO: 2953689 - RNA, 15 nt, Mycobacterium avium subsp. paratuberculosis
gccucgccggcgccg

SEQ ID NO: 2953690 - RNA, 18 nt, Mycobacterium avium subsp. paratuberculosis
gccucgccggcgccgggc

SEQ ID NO: 2953691 - RNA, 20 nt, Mycobacterium avium subsp. paratuberculosis
gccucgccggcgccgggcgg

SEQ ID NO: 2953692 - RNA, 14 nt, Mycobacterium avium subsp. paratuberculosis
gccucgccgggccc

SEQ ID NO: 2953693 - RNA, 16 nt, Mycobacterium avium subsp. paratuberculosis
gccucgccgggcccgc

SEQ ID NO: 2953694 - RNA, 17 nt, Mycobacterium avium subsp. paratuberculosis
gccucgccguugccggc

SEQ ID NO: 2953695 - RNA, 18 nt, Mycobacterium avium subsp. paratuberculosis
gccucgccguugccggcc

SEQ ID NO: 2953696 - RNA, 19 nt, Mycobacterium avium subsp. paratuberculosis
gccucgccguugccggccc

SEQ ID NO: 2953697 - RNA, 20 nt, Mycobacterium avium subsp. paratuberculosis
gccucgccguugccggcccg

SEQ ID NO: 2953698 - RNA, 22 nt, Mycobacterium avium subsp. paratuberculosis
gccucgccuacacagcccccac

SEQ ID NO: 2953699 - RNA, 22 nt, Mycobacterium avium subsp. paratuberculosis
gccucgcgcaaugccgccgcga

SEQ ID NO: 2953700 - RNA, 19 nt, Mycobacterium avium subsp. paratuberculosis
gccucgcgcagcgcgucgg

SEQ ID NO: 2953701 - RNA, 22 nt, Mycobacterium avium subsp. paratuberculosis
gccucgcgcagcgcgucgggcu

SEQ ID NO: 2953702 - RNA, 15 nt, Mycobacterium avium subsp. paratuberculosis
gccucgcgcaucagc

SEQ ID NO: 2953703 - RNA, 23 nt, Mycobacterium avium subsp. paratuberculosis
gccucgcgcaucagcaccuccgg

SEQ ID NO: 2953704 - RNA, 20 nt, Mycobacterium avium subsp. paratuberculosis
gccucgcgggugcugggcgg

SEQ ID NO: 2953705 - RNA, 15 nt, Mycobacterium avium subsp. paratuberculosis
gccucgcuaaucgcc

SEQ ID NO: 2953706 - RNA, 18 nt, Mycobacterium avium subsp. paratuberculosis
gccucgcuaaucgccgcg

SEQ ID NO: 2953707 - RNA, 17 nt, Mycobacterium avium subsp. paratuberculosis
gccucggaggccaccgc

SEQ ID NO: 2953708 - RNA, 21 nt, Mycobacterium avium subsp. paratuberculosis
gccucggaucccggggcgcgc

SEQ ID NO: 2953709 - RNA, 22 nt, Mycobacterium avium subsp. paratuberculosis
gccucggaucccggggcgcgcu

SEQ ID NO: 2953710 - RNA, 22 nt, Mycobacterium avium subsp. paratuberculosis
gccucggcaccgugccgcgcgg

SEQ ID NO: 2953711 - RNA, 23 nt, Mycobacterium avium subsp. paratuberculosis
gccucggcaccgugccgcgcggc

SEQ ID NO: 2953712 - RNA, 19 nt, Mycobacterium avium subsp. paratuberculosis
gccucggccaccagaugcc

SEQ ID NO: 2953713 - RNA, 13 nt, Mycobacterium avium subsp. paratuberculosis
gccucggccaccu

SEQ ID NO: 2953714 - RNA, 20 nt, Mycobacterium avium subsp. paratuberculosis
gccucggccaccuugcgcgg

SEQ ID NO: 2953715 - RNA, 13 nt, Mycobacterium avium subsp. paratuberculosis
gccucggccagca

SEQ ID NO: 2953716 - RNA, 17 nt, Mycobacterium avium subsp. paratuberculosis
gccucggccgcggucuc

SEQ ID NO: 2953717 - RNA, 23 nt, Mycobacterium avium subsp. paratuberculosis
gccucggccgcggucucgaccga

SEQ ID NO: 2953718 - RNA, 13 nt, Mycobacterium avium subsp. paratuberculosis
gccucggccucgu

SEQ ID NO: 2953719 - RNA, 16 nt, Mycobacterium avium subsp. paratuberculosis
gccucggccucgucga

SEQ ID NO: 2953720 - RNA, 19 nt, Mycobacterium avium subsp. paratuberculosis
gccucggccucgucgacgu

SEQ ID NO: 2953721 - RNA, 14 nt, Mycobacterium avium subsp. paratuberculosis
gccucggccugcgc

SEQ ID NO: 2953722 - RNA, 18 nt, Mycobacterium avium subsp. paratuberculosis
gccucggccugcgcccgg

SEQ ID NO: 2953723 - RNA, 20 nt, Mycobacterium avium subsp. paratuberculosis
gccucggccuuggccaccgc

SEQ ID NO: 2953724 - RNA, 17 nt, Mycobacterium avium subsp. paratuberculosis
gccugacccggccgugc

SEQ ID NO: 2953725 - RNA, 12 nt, Mycobacterium avium subsp. paratuberculosis
gccugaccgcgg

SEQ ID NO: 2953726 - RNA, 16 nt, Mycobacterium avium subsp. paratuberculosis
gccugacgggagucgg

SEQ ID NO: 2953727 - RNA, 19 nt, Mycobacterium avium subsp. paratuberculosis
gccugacgggagucgggcc

SEQ ID NO: 2953728 - RNA, 22 nt, Mycobacterium avium subsp. paratuberculosis
gccugacuaagucaccagggug

SEQ ID NO: 2953729 - RNA, 21 nt, Mycobacterium avium subsp. paratuberculosis
gccugacugagucaagccggc

SEQ ID NO: 2953730 - RNA, 14 nt, Mycobacterium avium subsp. paratuberculosis
gccugagacgacgc

SEQ ID NO: 2953731 - RNA, 15 nt, Mycobacterium avium subsp. paratuberculosis
gccugagacgacgcc

SEQ ID NO: 2953732 - RNA, 15 nt, Mycobacterium avium subsp. paratuberculosis
gccugagcaaccggu

SEQ ID NO: 2953733 - RNA, 12 nt, Mycobacterium avium subsp. paratuberculosis
gccugagcccgc

SEQ ID NO: 2953734 - RNA, 18 nt, Mycobacterium avium subsp. paratuberculosis
gccugagcccgccucagu

SEQ ID NO: 2953735 - RNA, 17 nt, Mycobacterium avium subsp. paratuberculosis
gccugauacgacguccg

SEQ ID NO: 2953736 - RNA, 21 nt, Mycobacterium avium subsp. paratuberculosis
gccugauacgacguccgggcc

SEQ ID NO: 2953737 - RNA, 23 nt, Mycobacterium avium subsp. paratuberculosis
gccugauugacggcccacgucgc

SEQ ID NO: 2953738 - RNA, 13 nt, Mycobacterium avium subsp. paratuberculosis
gccugcaacuggu

SEQ ID NO: 2953739 - RNA, 18 nt, Mycobacterium avium subsp. paratuberculosis
gccugcaacuggucgugc

SEQ ID NO: 2953740 - RNA, 19 nt, Mycobacterium avium subsp. paratuberculosis
gccugcacaggggcgcgua

SEQ ID NO: 2953741 - RNA, 20 nt, Mycobacterium avium subsp. paratuberculosis
gccugcaccaccacacccag

SEQ ID NO: 2953742 - RNA, 14 nt, Mycobacterium avium subsp. paratuberculosis
gccugcacccaggu

SEQ ID NO: 2953743 - RNA, 15 nt, Mycobacterium avium subsp. paratuberculosis
gccugcacccagguc

SEQ ID NO: 2953744 - RNA, 13 nt, Mycobacterium avium subsp. paratuberculosis
gccugcaccggcg

SEQ ID NO: 2953745 - RNA, 18 nt, Mycobacterium avium subsp. paratuberculosis
gccugcaccggcgacggc

SEQ ID NO: 2953746 - RNA, 13 nt, Mycobacterium avium subsp. paratuberculosis
gccugcaccucgg

SEQ ID NO: 2953747 - RNA, 17 nt, Mycobacterium avium subsp. paratuberculosis
gccugcaccuugcccgu

SEQ ID NO: 2953748 - RNA, 22 nt, Mycobacterium avium subsp. paratuberculosis
gccugcaccuugcccgucgcgu

SEQ ID NO: 2953749 - RNA, 14 nt, Mycobacterium avium subsp. paratuberculosis
gccugcacgaaguc

SEQ ID NO: 2953750 - RNA, 16 nt, Mycobacterium avium subsp. paratuberculosis
gccugcacgaagucga

SEQ ID NO: 2953751 - RNA, 20 nt, Mycobacterium avium subsp. paratuberculosis
gccugcacgaagucgaccgc

SEQ ID NO: 2953752 - RNA, 22 nt, Mycobacterium avium subsp. paratuberculosis
gccugcacgaagucgaccgcgg

SEQ ID NO: 2953753 - RNA, 23 nt, Mycobacterium avium subsp. paratuberculosis
gccugcacgaagucgaccgcggc

SEQ ID NO: 2953754 - RNA, 16 nt, Mycobacterium avium subsp. paratuberculosis
gccugcacggugcgcc

SEQ ID NO: 2953755 - RNA, 19 nt, Mycobacterium avium subsp. paratuberculosis
gccugcacggugcgccggc

SEQ ID NO: 2953756 - RNA, 22 nt, Mycobacterium avium subsp. paratuberculosis
gccugcacggugcgccggcagc

SEQ ID NO: 2953757 - RNA, 18 nt, Mycobacterium avium subsp. paratuberculosis
gccugcacguccuugggc

SEQ ID NO: 2953758 - RNA, 14 nt, Mycobacterium avium subsp. paratuberculosis
gccugcacgucggc

SEQ ID NO: 2953759 - RNA, 19 nt, Mycobacterium avium subsp. paratuberculosis
gccugcacgucggcgcgca

SEQ ID NO: 2953760 - RNA, 22 nt, Mycobacterium avium subsp. paratuberculosis
gccugcacgucggcgcgcaggc

SEQ ID NO: 2953761 - RNA, 18 nt, Mycobacterium avium subsp. paratuberculosis
gccugcagcaacucgcgc

SEQ ID NO: 2953762 - RNA, 13 nt, Mycobacterium avium subsp. paratuberculosis
gccugcagcacca

SEQ ID NO: 2953763 - RNA, 14 nt, Mycobacterium avium subsp. paratuberculosis
gccugcagcaccga

SEQ ID NO: 2953764 - RNA, 19 nt, Mycobacterium avium subsp. paratuberculosis
gccugcagcaccgaaccgg

SEQ ID NO: 2953765 - RNA, 22 nt, Mycobacterium avium subsp. paratuberculosis
gccugcagcaccgaaccggcgg

SEQ ID NO: 2953766 - RNA, 12 nt, Mycobacterium avium subsp. paratuberculosis
gccugcagccgc

SEQ ID NO: 2953767 - RNA, 14 nt, Mycobacterium avium subsp. paratuberculosis
gccugcagccgccg

SEQ ID NO: 2953768 - RNA, 22 nt, Mycobacterium avium subsp. paratuberculosis
gccugcagccgccgcgccaccg

SEQ ID NO: 2953769 - RNA, 22 nt, Mycobacterium avium subsp. paratuberculosis
gccugcagcgcggucaucguca

SEQ ID NO: 2953770 - RNA, 14 nt, Mycobacterium avium subsp. paratuberculosis
gccugccaccgcga

SEQ ID NO: 2953771 - RNA, 23 nt, Mycobacterium avium subsp. paratuberculosis
gccugcccagcggcacgggcacc

SEQ ID NO: 2953772 - RNA, 24 nt, Mycobacterium avium subsp. paratuberculosis
gccugccccccuugagccgguccg

SEQ ID NO: 2953773 - RNA, 12 nt, Mycobacterium avium subsp. paratuberculosis
gccugcccgccg

SEQ ID NO: 2953774 - RNA, 13 nt, Mycobacterium avium subsp. paratuberculosis
gccugcccgccgc

SEQ ID NO: 2953775 - RNA, 18 nt, Mycobacterium avium subsp. paratuberculosis
gccugcccgccgcggccg

SEQ ID NO: 2953776 - RNA, 14 nt, Mycobacterium avium subsp. paratuberculosis
gccugcccgcgcag

SEQ ID NO: 2953777 - RNA, 17 nt, Mycobacterium avium subsp. paratuberculosis
gccugcccgcgcaggcc

SEQ ID NO: 2953778 - RNA, 13 nt, Mycobacterium avium subsp. paratuberculosis
gccugcccgcggg

SEQ ID NO: 2953779 - RNA, 22 nt, Mycobacterium avium subsp. paratuberculosis
gccugcccggagaaaccgucgg

SEQ ID NO: 2953780 - RNA, 13 nt, Mycobacterium avium subsp. paratuberculosis
gccugcccggcgg

SEQ ID NO: 2953781 - RNA, 18 nt, Mycobacterium avium subsp. paratuberculosis
gccugcccggcggugccg

SEQ ID NO: 2953782 - RNA, 16 nt, Mycobacterium avium subsp. paratuberculosis
gccugcccgggcgccg

SEQ ID NO: 2953783 - RNA, 17 nt, Mycobacterium avium subsp. paratuberculosis
gccugcccgggcgccga

SEQ ID NO: 2953784 - RNA, 22 nt, Mycobacterium avium subsp. paratuberculosis
gccugcccuugaagcgcagauc

SEQ ID NO: 2953785 - RNA, 16 nt, Mycobacterium avium subsp. paratuberculosis
gccugccggccgccgc

SEQ ID NO: 2953786 - RNA, 19 nt, Mycobacterium avium subsp. paratuberculosis
gccugccggccgccgcgca

SEQ ID NO: 2953787 - RNA, 14 nt, Mycobacterium avium subsp. paratuberculosis
gccugccggcgccg

SEQ ID NO: 2953788 - RNA, 23 nt, Mycobacterium avium subsp. paratuberculosis
gccugccuccacgucaccgacgc

SEQ ID NO: 2953789 - RNA, 20 nt, Mycobacterium avium subsp. paratuberculosis
gccugcgacuucuacggcgg

SEQ ID NO: 2953790 - RNA, 21 nt, Mycobacterium avium subsp. paratuberculosis
gccugcgacuucuacggcggg

SEQ ID NO: 2953791 - RNA, 13 nt, Mycobacterium avium subsp. paratuberculosis
gccugcgagcaca

SEQ ID NO: 2953792 - RNA, 14 nt, Mycobacterium avium subsp. paratuberculosis
gccugcgagcguga

SEQ ID NO: 2953793 - RNA, 13 nt, Mycobacterium avium subsp. paratuberculosis
gccugcgcccaca

SEQ ID NO: 2953794 - RNA, 13 nt, Mycobacterium avium subsp. paratuberculosis
gccugcgcccggc

SEQ ID NO: 2953795 - RNA, 13 nt, Mycobacterium avium subsp. paratuberculosis
gccugcgccgccg

SEQ ID NO: 2953796 - RNA, 14 nt, Mycobacterium avium subsp. paratuberculosis
gccugcgccgccgu

SEQ ID NO: 2953797 - RNA, 13 nt, Mycobacterium avium subsp. paratuberculosis
gccugcgccuugg

SEQ ID NO: 2953798 - RNA, 22 nt, Mycobacterium avium subsp. paratuberculosis
gccugcgccuuggccucggugg

SEQ ID NO: 2953799 - RNA, 20 nt, Mycobacterium avium subsp. paratuberculosis
gccugcgcgaacagcgaagc

SEQ ID NO: 2953800 - RNA, 14 nt, Mycobacterium avium subsp. paratuberculosis
gccugcgcgaucgc

SEQ ID NO: 2953801 - RNA, 15 nt, Mycobacterium avium subsp. paratuberculosis
gccugcgcgaucgcc

SEQ ID NO: 2953802 - RNA, 13 nt, Mycobacterium avium subsp. paratuberculosis
gccugcgcgccga

SEQ ID NO: 2953803 - RNA, 16 nt, Mycobacterium avium subsp. paratuberculosis
gccugcgcgccgaugu

SEQ ID NO: 2953804 - RNA, 13 nt, Mycobacterium avium subsp. paratuberculosis
gccugcgcggccg

SEQ ID NO: 2953805 - RNA, 14 nt, Mycobacterium avium subsp. paratuberculosis
gccugcgcggccgc

SEQ ID NO: 2953806 - RNA, 15 nt, Mycobacterium avium subsp. paratuberculosis
gccugcgcggccgcg

SEQ ID NO: 2953807 - RNA, 18 nt, Mycobacterium avium subsp. paratuberculosis
gccugcgcggccgcgucg

SEQ ID NO: 2953808 - RNA, 19 nt, Mycobacterium avium subsp. paratuberculosis
gccugcgcggccgcgucgg

SEQ ID NO: 2953809 - RNA, 20 nt, Mycobacterium avium subsp. paratuberculosis
gccugucaguuugcgcgacg

SEQ ID NO: 2953810 - RNA, 13 nt, Mycobacterium avium subsp. paratuberculosis
gccuguccagccg

SEQ ID NO: 2953811 - RNA, 18 nt, Mycobacterium avium subsp. paratuberculosis
gccugucggucguacguc

SEQ ID NO: 2953812 - RNA, 13 nt, Mycobacterium avium subsp. paratuberculosis
gccugugcgacgg

SEQ ID NO: 2953813 - RNA, 19 nt, Mycobacterium avium subsp. paratuberculosis
gccugugcgacggcgucgg

SEQ ID NO: 2953814 - RNA, 20 nt, Mycobacterium avium subsp. paratuberculosis
gccugugcgacggcgucggc

SEQ ID NO: 2953815 - RNA, 22 nt, Mycobacterium avium subsp. paratuberculosis
gccugugcgacggcgucggcga

SEQ ID NO: 2953816 - RNA, 14 nt, Mycobacterium avium subsp. paratuberculosis
gccuguggagacca

SEQ ID NO: 2953817 - RNA, 14 nt, Mycobacterium avium subsp. paratuberculosis
gccuuacaaagccg

SEQ ID NO: 2953818 - RNA, 13 nt, Mycobacterium avium subsp. paratuberculosis
gccuuagcccggc

SEQ ID NO: 2953819 - RNA, 16 nt, Mycobacterium avium subsp. paratuberculosis
gccuuagcccggccgc

SEQ ID NO: 2953820 - RNA, 18 nt, Mycobacterium avium subsp. paratuberculosis
gccuuagcccggccgcgg

SEQ ID NO: 2953821 - RNA, 20 nt, Mycobacterium avium subsp. paratuberculosis
gccuuagcccggccgcggcc

SEQ ID NO: 2953822 - RNA, 15 nt, Mycobacterium avium subsp. paratuberculosis
gccuucacgaccggc

SEQ ID NO: 2953823 - RNA, 18 nt, Mycobacterium avium subsp. paratuberculosis
gccuucacgaccggcagc

SEQ ID NO: 2953824 - RNA, 24 nt, Mycobacterium avium subsp. paratuberculosis
gccuucacgaccggcagcaccggc

SEQ ID NO: 2953825 - RNA, 16 nt, Mycobacterium avium subsp. paratuberculosis
gccuucacgcuggccu

SEQ ID NO: 2953826 - RNA, 22 nt, Mycobacterium avium subsp. paratuberculosis
gccuucacgcuggccuccagcu

SEQ ID NO: 2953827 - RNA, 17 nt, Mycobacterium avium subsp. paratuberculosis
gccuuccgcaacaucgu

SEQ ID NO: 2953828 - RNA, 22 nt, Mycobacterium avium subsp. paratuberculosis
gccuucgacccgguggcccggu

SEQ ID NO: 2953829 - RNA, 16 nt, Mycobacterium avium subsp. paratuberculosis
gccuucgacggccggc

SEQ ID NO: 2953830 - RNA, 17 nt, Mycobacterium avium subsp. paratuberculosis
gccuucgacggccggcc

SEQ ID NO: 2953831 - RNA, 22 nt, Mycobacterium avium subsp. paratuberculosis
gccuucgaugcccuccagcacc

SEQ ID NO: 2953832 - RNA, 23 nt, Mycobacterium avium subsp. paratuberculosis
gccuucgaugcccuccagcaccg

SEQ ID NO: 2953833 - RNA, 14 nt, Mycobacterium avium subsp. paratuberculosis
gccuucgccgcacg

SEQ ID NO: 2953834 - RNA, 15 nt, Mycobacterium avium subsp. paratuberculosis
gccuucggcgccagc

SEQ ID NO: 2953835 - RNA, 16 nt, Mycobacterium avium subsp. paratuberculosis
gccuucggcgccagcc

SEQ ID NO: 2953836 - RNA, 18 nt, Mycobacterium avium subsp. paratuberculosis
gccuucggcgccagcccg

SEQ ID NO: 2953837 - RNA, 22 nt, Mycobacterium avium subsp. paratuberculosis
gccuucggcgccagcccgccga

SEQ ID NO: 2953838 - RNA, 15 nt, Mycobacterium avium subsp. paratuberculosis
gccuucuccagcucc

SEQ ID NO: 2953839 - RNA, 19 nt, Mycobacterium avium subsp. paratuberculosis
gccuucuccagcuccucgg

SEQ ID NO: 2953840 - RNA, 14 nt, Mycobacterium avium subsp. paratuberculosis
gccuucucgcgcac

SEQ ID NO: 2953841 - RNA, 19 nt, Mycobacterium avium subsp. paratuberculosis
gccuucucgcgcaccgcgg

SEQ ID NO: 2953842 - RNA, 22 nt, Mycobacterium avium subsp. paratuberculosis
gccuucucgcgcaccgcgggcu

SEQ ID NO: 2953843 - RNA, 15 nt, Mycobacterium avium subsp. paratuberculosis
gccuucuucgccgca

SEQ ID NO: 2953844 - RNA, 19 nt, Mycobacterium avium subsp. paratuberculosis
gccuucuucgccggggccu

SEQ ID NO: 2953845 - RNA, 22 nt, Mycobacterium avium subsp. paratuberculosis
gccuucuugcgcggcgcgaagc

SEQ ID NO: 2953846 - RNA, 15 nt, Mycobacterium avium subsp. paratuberculosis
gccuucuuggccgcg

SEQ ID NO: 2953847 - RNA, 18 nt, Mycobacterium avium subsp. paratuberculosis
gccuucuuggccgcgccc

SEQ ID NO: 2953848 - RNA, 15 nt, Mycobacterium avium subsp. paratuberculosis
gccuucuuggccgga

SEQ ID NO: 2953849 - RNA, 16 nt, Mycobacterium avium subsp. paratuberculosis
gccuucuuggcggcgg

SEQ ID NO: 2953850 - RNA, 17 nt, Mycobacterium avium subsp. paratuberculosis
gccuucuuggcggcggc

SEQ ID NO: 2953851 - RNA, 20 nt, Mycobacterium avium subsp. paratuberculosis
gccuucuuggcgggcgccuu

SEQ ID NO: 2953852 - RNA, 22 nt, Mycobacterium avium subsp. paratuberculosis
gccuugaaccggcuggacaccc

SEQ ID NO: 2953853 - RNA, 14 nt, Mycobacterium avium subsp. paratuberculosis
gccuugaccacggu

SEQ ID NO: 2953854 - RNA, 19 nt, Mycobacterium avium subsp. paratuberculosis
gccuugaccgcguuggcgc

SEQ ID NO: 2953855 - RNA, 14 nt, Mycobacterium avium subsp. paratuberculosis
gccuugacgacggc

SEQ ID NO: 2953856 - RNA, 23 nt, Mycobacterium avium subsp. paratuberculosis
gccuugacgacggccaccgcgac

SEQ ID NO: 2953857 - RNA, 16 nt, Mycobacterium avium subsp. paratuberculosis
gccuugacgccgggca

SEQ ID NO: 2953858 - RNA, 18 nt, Mycobacterium avium subsp. paratuberculosis
gccuugagaacgucgcgu

SEQ ID NO: 2953859 - RNA, 23 nt, Mycobacterium avium subsp. paratuberculosis
gccuugaucggguaacccuccgg

SEQ ID NO: 2953860 - RNA, 19 nt, Mycobacterium avium subsp. paratuberculosis
gccuugaugaacgccucga

SEQ ID NO: 2953861 - RNA, 23 nt, Mycobacterium avium subsp. paratuberculosis
gccuugaugaacgccucgagcgc

SEQ ID NO: 2953862 - RNA, 14 nt, Mycobacterium avium subsp. paratuberculosis
gccuugcacccagc

SEQ ID NO: 2953863 - RNA, 13 nt, Mycobacterium avium subsp. paratuberculosis
gccuugcagccgc

SEQ ID NO: 2953864 - RNA, 14 nt, Mycobacterium avium subsp. paratuberculosis
gccuugcagccgcu

SEQ ID NO: 2953865 - RNA, 21 nt, Mycobacterium avium subsp. paratuberculosis
gccuugcccggcucggugcgc

SEQ ID NO: 2953866 - RNA, 18 nt, Mycobacterium avium subsp. paratuberculosis
gccuugccgacgacgucg

SEQ ID NO: 2953867 - RNA, 21 nt, Mycobacterium avium subsp. paratuberculosis
gccuugcgcccacaguccgcc

SEQ ID NO: 2953868 - RNA, 13 nt, Mycobacterium avium subsp. paratuberculosis
gccuugcgggccg

SEQ ID NO: 2953869 - RNA, 13 nt, Mycobacterium avium subsp. paratuberculosis
gccuugcgguugg

SEQ ID NO: 2953870 - RNA, 17 nt, Mycobacterium avium subsp. paratuberculosis
gccuugcuccacacugg

SEQ ID NO: 2953871 - RNA, 18 nt, Mycobacterium avium subsp. paratuberculosis
gccuugcugacgccgcgg

SEQ ID NO: 2953872 - RNA, 19 nt, Mycobacterium avium subsp. paratuberculosis
gccuugcugacgccgcggu

SEQ ID NO: 2953873 - RNA, 23 nt, Mycobacterium avium subsp. paratuberculosis
gccuugcugacgccgcggugcag

SEQ ID NO: 2953874 - RNA, 14 nt, Mycobacterium avium subsp. paratuberculosis
gccuugcugauccc

SEQ ID NO: 2953875 - RNA, 16 nt, Mycobacterium avium subsp. paratuberculosis
gccuugcuggcggccu

SEQ ID NO: 2953876 - RNA, 14 nt, Mycobacterium avium subsp. paratuberculosis
gccuuggccaacgc

SEQ ID NO: 2953877 - RNA, 18 nt, Mycobacterium avium subsp. paratuberculosis
gccuuggcccgcgcccgc

SEQ ID NO: 2953878 - RNA, 22 nt, Mycobacterium avium subsp. paratuberculosis
gccuuggcccgcgcccgcucga

SEQ ID NO: 2953879 - RNA, 15 nt, Mycobacterium avium subsp. paratuberculosis
gccuuggcccgcgcg

SEQ ID NO: 2953880 - RNA, 16 nt, Mycobacterium avium subsp. paratuberculosis
gccuuggcccgcgcgg

SEQ ID NO: 2953881 - RNA, 20 nt, Mycobacterium avium subsp. paratuberculosis
gccuuggcccgcgcggccgc

SEQ ID NO: 2953882 - RNA, 21 nt, Mycobacterium avium subsp. paratuberculosis
gccuuggcccgcgcggccgcc

SEQ ID NO: 2953883 - RNA, 12 nt, Mycobacterium avium subsp. paratuberculosis
gccuuggccgca

SEQ ID NO: 2953884 - RNA, 15 nt, Mycobacterium avium subsp. paratuberculosis
gccuuggccguaggu

SEQ ID NO: 2953885 - RNA, 17 nt, Mycobacterium avium subsp. paratuberculosis
gccuuggcgcgcucggu

SEQ ID NO: 2953886 - RNA, 18 nt, Mycobacterium avium subsp. paratuberculosis
gccuuggcgcgcucggug

SEQ ID NO: 2953887 - RNA, 15 nt, Mycobacterium avium subsp. paratuberculosis
gccuuggcggcgugg

SEQ ID NO: 2953888 - RNA, 14 nt, Mycobacterium avium subsp. paratuberculosis
gccuugggccgguc

SEQ ID NO: 2953889 - RNA, 20 nt, Mycobacterium avium subsp. paratuberculosis
gccuugguagaugcguucca

SEQ ID NO: 2953890 - RNA, 21 nt, Mycobacterium avium subsp. paratuberculosis
gccuugguagaugcguuccag

SEQ ID NO: 2953891 - RNA, 21 nt, Mycobacterium avium subsp. paratuberculosis
gccuuggugauccggggcacg

SEQ ID NO: 2953892 - RNA, 18 nt, Mycobacterium avium subsp. paratuberculosis
gccuuggugaugggcagc

SEQ ID NO: 2953893 - RNA, 13 nt, Mycobacterium avium subsp. paratuberculosis
gcgaacgaggccg

SEQ ID NO: 2953894 - RNA, 12 nt, Mycobacterium avium subsp. paratuberculosis
gcgaacgccgcc

SEQ ID NO: 2953895 - RNA, 14 nt, Mycobacterium avium subsp. paratuberculosis
gcgaacgccucggc

SEQ ID NO: 2953896 - RNA, 15 nt, Mycobacterium avium subsp. paratuberculosis
gcgaacgccucggcg

SEQ ID NO: 2953897 - RNA, 17 nt, Mycobacterium avium subsp. paratuberculosis
gcgaacgccucggcgag

SEQ ID NO: 2953898 - RNA, 13 nt, Mycobacterium avium subsp. paratuberculosis
gcgaacgccucgu

SEQ ID NO: 2953899 - RNA, 19 nt, Mycobacterium avium subsp. paratuberculosis
gcgaacgccucguuggcca

SEQ ID NO: 2953900 - RNA, 18 nt, Mycobacterium avium subsp. paratuberculosis
gcgaacgcgccccgccgg

SEQ ID NO: 2953901 - RNA, 13 nt, Mycobacterium avium subsp. paratuberculosis
gcgaacgcgcggu

SEQ ID NO: 2953902 - RNA, 18 nt, Mycobacterium avium subsp. paratuberculosis
gcgaacgcgguuuugaug

SEQ ID NO: 2953903 - RNA, 20 nt, Mycobacterium avium subsp. paratuberculosis
gcgaacgcgguuuugaugcc

SEQ ID NO: 2953904 - RNA, 17 nt, Mycobacterium avium subsp. paratuberculosis
gcgaacgcgucccgggc

SEQ ID NO: 2953905 - RNA, 18 nt, Mycobacterium avium subsp. paratuberculosis
gcgaacggcccgccgccg

SEQ ID NO: 2953906 - RNA, 21 nt, Mycobacterium avium subsp. paratuberculosis
gcgaacggcccgccgccggcg

SEQ ID NO: 2953907 - RNA, 24 nt, Mycobacterium avium subsp. paratuberculosis
gcgaacggcccgccgccggcggcg

SEQ ID NO: 2953908 - RNA, 18 nt, Mycobacterium avium subsp. paratuberculosis
gcgaacgggcuggccagg

SEQ ID NO: 2953909 - RNA, 19 nt, Mycobacterium avium subsp. paratuberculosis
gcgaacgggugaccggcgg

SEQ ID NO: 2953910 - RNA, 23 nt, Mycobacterium avium subsp. paratuberculosis
gcgaacgggugaguaacacgugg

SEQ ID NO: 2953911 - RNA, 19 nt, Mycobacterium avium subsp. paratuberculosis
gcgaacgucgaugucacgu

SEQ ID NO: 2953912 - RNA, 17 nt, Mycobacterium avium subsp. paratuberculosis
gcgaacgucucgcggga

SEQ ID NO: 2953913 - RNA, 24 nt, Mycobacterium avium subsp. paratuberculosis
gcgaacgucucgcgggaguggccg

SEQ ID NO: 2953914 - RNA, 13 nt, Mycobacterium avium subsp. paratuberculosis
gcgaacucaggcg

SEQ ID NO: 2953915 - RNA, 22 nt, Mycobacterium avium subsp. paratuberculosis
gcgaacucaggcgcgcacguug

SEQ ID NO: 2953916 - RNA, 20 nt, Mycobacterium avium subsp. paratuberculosis
gcgaacuccagaucgccgcc

SEQ ID NO: 2953917 - RNA, 21 nt, Mycobacterium avium subsp. paratuberculosis
gcgaacuccagaucgccgccc

SEQ ID NO: 2953918 - RNA, 22 nt, Mycobacterium avium subsp. paratuberculosis
gcgaacuccagaucgccgccca

SEQ ID NO: 2953919 - RNA, 23 nt, Mycobacterium avium subsp. paratuberculosis
gcgaacuccagaucgccgcccau

SEQ ID NO: 2953920 - RNA, 17 nt, Mycobacterium avium subsp. paratuberculosis
gcgaacucgcggcgggu

SEQ ID NO: 2953921 - RNA, 22 nt, Mycobacterium avium subsp. paratuberculosis
gcgaacucgcggcgggucagca

SEQ ID NO: 2953922 - RNA, 16 nt, Mycobacterium avium subsp. paratuberculosis
gcgaacucgucgacgc

SEQ ID NO: 2953923 - RNA, 18 nt, Mycobacterium avium subsp. paratuberculosis
gcgaacucgucgacgccc

SEQ ID NO: 2953924 - RNA, 23 nt, Mycobacterium avium subsp. paratuberculosis
gcgaacucgucgacgcccaccug

SEQ ID NO: 2953925 - RNA, 16 nt, Mycobacterium avium subsp. paratuberculosis
gcgaacucgucgaugc

SEQ ID NO: 2953926 - RNA, 13 nt, Mycobacterium avium subsp. paratuberculosis
gcgaacugcacca

SEQ ID NO: 2953927 - RNA, 14 nt, Mycobacterium avium subsp. paratuberculosis
gcgaacugcaccag

SEQ ID NO: 2953928 - RNA, 15 nt, Mycobacterium avium subsp. paratuberculosis
gcgaacugcaccagc

SEQ ID NO: 2953929 - RNA, 16 nt, Mycobacterium avium subsp. paratuberculosis
gcgaacugcaccagca

SEQ ID NO: 2953930 - RNA, 19 nt, Mycobacterium avium subsp. paratuberculosis
gcgaacuugcuggccgagu

SEQ ID NO: 2953931 - RNA, 18 nt, Mycobacterium avium subsp. paratuberculosis
gcgaacuuggccgacacg

SEQ ID NO: 2953932 - RNA, 16 nt, Mycobacterium avium subsp. paratuberculosis
gcgaagaacgacgcca

SEQ ID NO: 2953933 - RNA, 17 nt, Mycobacterium avium subsp. paratuberculosis
gcgaagaacgacgccac

SEQ ID NO: 2953934 - RNA, 19 nt, Mycobacterium avium subsp. paratuberculosis
gcgaagaccagcgugucgc

SEQ ID NO: 2953935 - RNA, 18 nt, Mycobacterium avium subsp. paratuberculosis
gcgaagacccgaaacugg

SEQ ID NO: 2953936 - RNA, 18 nt, Mycobacterium avium subsp. paratuberculosis
gcgaagacgcuggccacg

SEQ ID NO: 2953937 - RNA, 16 nt, Mycobacterium avium subsp. paratuberculosis
gcgaagacgucggcgc

SEQ ID NO: 2953938 - RNA, 13 nt, Mycobacterium avium subsp. paratuberculosis
gcgaagagcggca

SEQ ID NO: 2953939 - RNA, 15 nt, Mycobacterium avium subsp. paratuberculosis
gcgaagagcggcacg

SEQ ID NO: 2953940 - RNA, 16 nt, Mycobacterium avium subsp. paratuberculosis
gcgaagagcggcacga

SEQ ID NO: 2953941 - RNA, 15 nt, Mycobacterium avium subsp. paratuberculosis
gcgaagaugucgccg

SEQ ID NO: 2953942 - RNA, 15 nt, Mycobacterium avium subsp. paratuberculosis
gcgaagcaggccagg

SEQ ID NO: 2953943 - RNA, 19 nt, Mycobacterium avium subsp. paratuberculosis
gcgaagcccaugccgaugc

SEQ ID NO: 2953944 - RNA, 14 nt, Mycobacterium avium subsp. paratuberculosis
gcgaagccggcccc

SEQ ID NO: 2953945 - RNA, 15 nt, Mycobacterium avium subsp. paratuberculosis
gcgaagccggccccg

SEQ ID NO: 2953946 - RNA, 19 nt, Mycobacterium avium subsp. paratuberculosis
gcgaagccggccccgcccg

SEQ ID NO: 2953947 - RNA, 21 nt, Mycobacterium avium subsp. paratuberculosis
gcgaagccggccccgcccggg

SEQ ID NO: 2953948 - RNA, 13 nt, Mycobacterium avium subsp. paratuberculosis
gcgaagccggcgu

SEQ ID NO: 2953949 - RNA, 15 nt, Mycobacterium avium subsp. paratuberculosis
gcgaagccggcguca

SEQ ID NO: 2953950 - RNA, 22 nt, Mycobacterium avium subsp. paratuberculosis
gcgaagccgugacccgccguga

SEQ ID NO: 2953951 - RNA, 19 nt, Mycobacterium avium subsp. paratuberculosis
gcgaagcgcgaugcggcuc

SEQ ID NO: 2953952 - RNA, 20 nt, Mycobacterium avium subsp. paratuberculosis
gcgaagcguuucagcaaccc

SEQ ID NO: 2953953 - RNA, 17 nt, Mycobacterium avium subsp. paratuberculosis
gcgaagcuaaaccccac

SEQ ID NO: 2953954 - RNA, 23 nt, Mycobacterium avium subsp. paratuberculosis
gcgaagcuaaaccccacggccgc

SEQ ID NO: 2953955 - RNA, 14 nt, Mycobacterium avium subsp. paratuberculosis
gcgaagcucgacga

SEQ ID NO: 2953956 - RNA, 17 nt, Mycobacterium avium subsp. paratuberculosis
gcgaaggcaucccgcuu

SEQ ID NO: 2953957 - RNA, 22 nt, Mycobacterium avium subsp. paratuberculosis
gcgaaggcaugggcgugccggc

SEQ ID NO: 2953958 - RNA, 15 nt, Mycobacterium avium subsp. paratuberculosis
gcgaaggccagcgau

SEQ ID NO: 2953959 - RNA, 15 nt, Mycobacterium avium subsp. paratuberculosis
gcgaaggcgcgcagg

SEQ ID NO: 2953960 - RNA, 15 nt, Mycobacterium avium subsp. paratuberculosis
gcgaaggcggcgucg

SEQ ID NO: 2953961 - RNA, 17 nt, Mycobacterium avium subsp. paratuberculosis
gcgaaggcucgccacgc

SEQ ID NO: 2953962 - RNA, 18 nt, Mycobacterium avium subsp. paratuberculosis
gcgaaggugccccgcugg

SEQ ID NO: 2953963 - RNA, 15 nt, Mycobacterium avium subsp. paratuberculosis
gcgaaggugccgcga

SEQ ID NO: 2953964 - RNA, 14 nt, Mycobacterium avium subsp. paratuberculosis
gcgaagguggcgcc

SEQ ID NO: 2953965 - RNA, 17 nt, Mycobacterium avium subsp. paratuberculosis
gcgaagguggcgccggu

SEQ ID NO: 2953966 - RNA, 18 nt, Mycobacterium avium subsp. paratuberculosis
gcgaagguggcgccggua

SEQ ID NO: 2953967 - RNA, 17 nt, Mycobacterium avium subsp. paratuberculosis
gcgaagguggcgucggc

SEQ ID NO: 2953968 - RNA, 19 nt, Mycobacterium avium subsp. paratuberculosis
gcgaaggugggcagcgcca

SEQ ID NO: 2953969 - RNA, 16 nt, Mycobacterium avium subsp. paratuberculosis
gcgaagguguccucga

SEQ ID NO: 2953970 - RNA, 16 nt, Mycobacterium avium subsp. paratuberculosis
gcgaaguagacgagcu

SEQ ID NO: 2953971 - RNA, 14 nt, Mycobacterium avium subsp. paratuberculosis
gcgaaguagccggc

SEQ ID NO: 2953972 - RNA, 23 nt, Mycobacterium avium subsp. paratuberculosis
gcgaaguagccggcgaucgucgc

SEQ ID NO: 2953973 - RNA, 15 nt, Mycobacterium avium subsp. paratuberculosis
gcgaaguagcgggcg

SEQ ID NO: 2953974 - RNA, 16 nt, Mycobacterium avium subsp. paratuberculosis
gcgaaguagucggcgu

SEQ ID NO: 2953975 - RNA, 17 nt, Mycobacterium avium subsp. paratuberculosis
gcgaagucaucaccggg

SEQ ID NO: 2953976 - RNA, 14 nt, Mycobacterium avium subsp. paratuberculosis
gcgaagucccacug

SEQ ID NO: 2953977 - RNA, 15 nt, Mycobacterium avium subsp. paratuberculosis
gcgaagucccacugc

SEQ ID NO: 2953978 - RNA, 17 nt, Mycobacterium avium subsp. paratuberculosis
gcgacagcacgggcggg

SEQ ID NO: 2953979 - RNA, 13 nt, Mycobacterium avium subsp. paratuberculosis
gcgacagcagcgu

SEQ ID NO: 2953980 - RNA, 15 nt, Mycobacterium avium subsp. paratuberculosis
gcgacagcagcgugg

SEQ ID NO: 2953981 - RNA, 13 nt, Mycobacterium avium subsp. paratuberculosis
gcgacagccgccc

SEQ ID NO: 2953982 - RNA, 15 nt, Mycobacterium avium subsp. paratuberculosis
gcgacagccgcccgg

SEQ ID NO: 2953983 - RNA, 16 nt, Mycobacterium avium subsp. paratuberculosis
gcgacagccgcccggc

SEQ ID NO: 2953984 - RNA, 17 nt, Mycobacterium avium subsp. paratuberculosis
gcgacagccgcccggcg

SEQ ID NO: 2953985 - RNA, 19 nt, Mycobacterium avium subsp. paratuberculosis
gcgacagccgcccggcgcc

SEQ ID NO: 2953986 - RNA, 21 nt, Mycobacterium avium subsp. paratuberculosis
gcgacagccgggaaucgaggg

SEQ ID NO: 2953987 - RNA, 23 nt, Mycobacterium avium subsp. paratuberculosis
gcgacagccgggaaucgagggcg

SEQ ID NO: 2953988 - RNA, 14 nt, Mycobacterium avium subsp. paratuberculosis
gcgacagcgcgucg

SEQ ID NO: 2953989 - RNA, 16 nt, Mycobacterium avium subsp. paratuberculosis
gcgacagcgcgucggc

SEQ ID NO: 2953990 - RNA, 20 nt, Mycobacterium avium subsp. paratuberculosis
gcgacagcgcgucggccagc

SEQ ID NO: 2953991 - RNA, 13 nt, Mycobacterium avium subsp. paratuberculosis
gcgacagcggccu

SEQ ID NO: 2953992 - RNA, 14 nt, Mycobacterium avium subsp. paratuberculosis
gcgacagcggccua

SEQ ID NO: 2953993 - RNA, 22 nt, Mycobacterium avium subsp. paratuberculosis
gcgacaggaaccuggucggggu

SEQ ID NO: 2953994 - RNA, 15 nt, Mycobacterium avium subsp. paratuberculosis
gcgacaggucggcgg

SEQ ID NO: 2953995 - RNA, 15 nt, Mycobacterium avium subsp. paratuberculosis
gcgacaucaccgcgg

SEQ ID NO: 2953996 - RNA, 16 nt, Mycobacterium avium subsp. paratuberculosis
gcgacaucaccgcggg

SEQ ID NO: 2953997 - RNA, 22 nt, Mycobacterium avium subsp. paratuberculosis
gcgacaucaccgcgggcgcgcc

SEQ ID NO: 2953998 - RNA, 12 nt, Mycobacterium avium subsp. paratuberculosis
gcgacaucgccg

SEQ ID NO: 2953999 - RNA, 16 nt, Mycobacterium avium subsp. paratuberculosis
gcgacaucgccgcggc

SEQ ID NO: 2954000 - RNA, 16 nt, Mycobacterium avium subsp. paratuberculosis
gcgacaucgccggcga

SEQ ID NO: 2954001 - RNA, 14 nt, Mycobacterium avium subsp. paratuberculosis
gcgacaucggcgcc

SEQ ID NO: 2954002 - RNA, 14 nt, Mycobacterium avium subsp. paratuberculosis
gcgacaucggugac

SEQ ID NO: 2954003 - RNA, 16 nt, Mycobacterium avium subsp. paratuberculosis
gcgacaucggugaccg

SEQ ID NO: 2954004 - RNA, 21 nt, Mycobacterium avium subsp. paratuberculosis
gcgacaucggugaccgucgcc

SEQ ID NO: 2954005 - RNA, 23 nt, Mycobacterium avium subsp. paratuberculosis
gcgacaucggugaccgucgccga

SEQ ID NO: 2954006 - RNA, 13 nt, Mycobacterium avium subsp. paratuberculosis
gcgacaucucggu

SEQ ID NO: 2954007 - RNA, 15 nt, Mycobacterium avium subsp. paratuberculosis
gcgacaucucgguga

SEQ ID NO: 2954008 - RNA, 19 nt, Mycobacterium avium subsp. paratuberculosis
gcgacaugaccaccgcguc

SEQ ID NO: 2954009 - RNA, 20 nt, Mycobacterium avium subsp. paratuberculosis
gcgacaugaccaccgcgucg

SEQ ID NO: 2954010 - RNA, 15 nt, Mycobacterium avium subsp. paratuberculosis
gcgacaugcccgcgg

SEQ ID NO: 2954011 - RNA, 18 nt, Mycobacterium avium subsp. paratuberculosis
gcgacaugcgcagcgccc

SEQ ID NO: 2954012 - RNA, 22 nt, Mycobacterium avium subsp. paratuberculosis
gcgacaugcgcagcgcccaggc

SEQ ID NO: 2954013 - RNA, 16 nt, Mycobacterium avium subsp. paratuberculosis
gcgacauggucgggcg

SEQ ID NO: 2954014 - RNA, 18 nt, Mycobacterium avium subsp. paratuberculosis
gcgacauggucgggcgca

SEQ ID NO: 2954015 - RNA, 21 nt, Mycobacterium avium subsp. paratuberculosis
gcgacauggucgggcgcacca

SEQ ID NO: 2954016 - RNA, 22 nt, Mycobacterium avium subsp. paratuberculosis
gcgacauguccgggauggacga

SEQ ID NO: 2954017 - RNA, 14 nt, Mycobacterium avium subsp. paratuberculosis
gcgacauuggccgc

SEQ ID NO: 2954018 - RNA, 19 nt, Mycobacterium avium subsp. paratuberculosis
gcgacauuggccgcgcgca

SEQ ID NO: 2954019 - RNA, 21 nt, Mycobacterium avium subsp. paratuberculosis
gcgacauuggccgcgcgcagg

SEQ ID NO: 2954020 - RNA, 22 nt, Mycobacterium avium subsp. paratuberculosis
gcgacauuggccgcgcgcaggc

SEQ ID NO: 2954021 - RNA, 23 nt, Mycobacterium avium subsp. paratuberculosis
gcgaccaaugcccugaccccggu

SEQ ID NO: 2954022 - RNA, 22 nt, Mycobacterium avium subsp. paratuberculosis
gcgaccaauugcgagcaggccg

SEQ ID NO: 2954023 - RNA, 13 nt, Mycobacterium avium subsp. paratuberculosis
gcgaccacaccgc

SEQ ID NO: 2954024 - RNA, 15 nt, Mycobacterium avium subsp. paratuberculosis
gcgaccacaccgccg

SEQ ID NO: 2954025 - RNA, 16 nt, Mycobacterium avium subsp. paratuberculosis
gcgaccacaccgccgg

SEQ ID NO: 2954026 - RNA, 19 nt, Mycobacterium avium subsp. paratuberculosis
gcgaccacaccgccggcca

SEQ ID NO: 2954027 - RNA, 20 nt, Mycobacterium avium subsp. paratuberculosis
gcgaccacaccgccggccac

SEQ ID NO: 2954028 - RNA, 15 nt, Mycobacterium avium subsp. paratuberculosis
gcgaccacaccgucg

SEQ ID NO: 2954029 - RNA, 19 nt, Mycobacterium avium subsp. paratuberculosis
gcgaccacaccgucgacga

SEQ ID NO: 2954030 - RNA, 23 nt, Mycobacterium avium subsp. paratuberculosis
gcgaccacaccgucgacgacgaa

SEQ ID NO: 2954031 - RNA, 14 nt, Mycobacterium avium subsp. paratuberculosis
gcgaccacagcgcc

SEQ ID NO: 2954032 - RNA, 15 nt, Mycobacterium avium subsp. paratuberculosis
gcgaccacagcgccu

SEQ ID NO: 2954033 - RNA, 18 nt, Mycobacterium avium subsp. paratuberculosis
gcgaccacauaccgggac

SEQ ID NO: 2954034 - RNA, 23 nt, Mycobacterium avium subsp. paratuberculosis
gcgaccacauaccgggacaucgu

SEQ ID NO: 2954035 - RNA, 13 nt, Mycobacterium avium subsp. paratuberculosis
gcgaccaccaccg

SEQ ID NO: 2954036 - RNA, 15 nt, Mycobacterium avium subsp. paratuberculosis
gcgaccaccaccgcc

SEQ ID NO: 2954037 - RNA, 21 nt, Mycobacterium avium subsp. paratuberculosis
gcgaccaccaccgcccacagc

SEQ ID NO: 2954038 - RNA, 18 nt, Mycobacterium avium subsp. paratuberculosis
gcgaccaccacggccgca

SEQ ID NO: 2954039 - RNA, 20 nt, Mycobacterium avium subsp. paratuberculosis
gcgaccaccacggccgcagc

SEQ ID NO: 2954040 - RNA, 15 nt, Mycobacterium avium subsp. paratuberculosis
gcgaccaccagccgc

SEQ ID NO: 2954041 - RNA, 21 nt, Mycobacterium avium subsp. paratuberculosis
gcgaccaccagccgcaggugc

SEQ ID NO: 2954042 - RNA, 13 nt, Mycobacterium avium subsp. paratuberculosis
gcgaccaccggcc

SEQ ID NO: 2954043 - RNA, 14 nt, Mycobacterium avium subsp. paratuberculosis
gcgaccaccggccg

SEQ ID NO: 2954044 - RNA, 15 nt, Mycobacterium avium subsp. paratuberculosis
gcgaccaccggccga

SEQ ID NO: 2954045 - RNA, 14 nt, Mycobacterium avium subsp. paratuberculosis
gcgaccaccucggc

SEQ ID NO: 2954046 - RNA, 16 nt, Mycobacterium avium subsp. paratuberculosis
gcgaccaccucggcga

SEQ ID NO: 2954047 - RNA, 17 nt, Mycobacterium avium subsp. paratuberculosis
gcgaccaccucggcgac

SEQ ID NO: 2954048 - RNA, 20 nt, Mycobacterium avium subsp. paratuberculosis
gcgaccacgccgcggucgcu

SEQ ID NO: 2954049 - RNA, 21 nt, Mycobacterium avium subsp. paratuberculosis
gcgaccagauaggccagcgcg

SEQ ID NO: 2954050 - RNA, 16 nt, Mycobacterium avium subsp. paratuberculosis
gcgaccagcaggucga

SEQ ID NO: 2954051 - RNA, 17 nt, Mycobacterium avium subsp. paratuberculosis
gcgaccagcaggucgag

SEQ ID NO: 2954052 - RNA, 19 nt, Mycobacterium avium subsp. paratuberculosis
gcgaccagcaggucgagca

SEQ ID NO: 2954053 - RNA, 16 nt, Mycobacterium avium subsp. paratuberculosis
gcgaccagcccggccg

SEQ ID NO: 2954054 - RNA, 17 nt, Mycobacterium avium subsp. paratuberculosis
gcgaccagcccggccgc

SEQ ID NO: 2954055 - RNA, 20 nt, Mycobacterium avium subsp. paratuberculosis
gcgaccagcccggccgccga

SEQ ID NO: 2954056 - RNA, 15 nt, Mycobacterium avium subsp. paratuberculosis
gcgaccagcgacggc

SEQ ID NO: 2954057 - RNA, 19 nt, Mycobacterium avium subsp. paratuberculosis
gcgaccagcgacggcaggu

SEQ ID NO: 2954058 - RNA, 15 nt, Mycobacterium avium subsp. paratuberculosis
gcgaccagcgagccc

SEQ ID NO: 2954059 - RNA, 17 nt, Mycobacterium avium subsp. paratuberculosis
gcgaccagcgagcccag

SEQ ID NO: 2954060 - RNA, 18 nt, Mycobacterium avium subsp. paratuberculosis
gcgaccagcgagcccagc

SEQ ID NO: 2954061 - RNA, 20 nt, Mycobacterium avium subsp. paratuberculosis
gcgaccagcgagcccagcug

SEQ ID NO: 2954062 - RNA, 21 nt, Mycobacterium avium subsp. paratuberculosis
gcgaccagcgagcccagcugc

SEQ ID NO: 2954063 - RNA, 23 nt, Mycobacterium avium subsp. paratuberculosis
gcgaccgcgacgguggacccgac

SEQ ID NO: 2954064 - RNA, 19 nt, Mycobacterium avium subsp. paratuberculosis
gcgaccgcgaucagggccg

SEQ ID NO: 2954065 - RNA, 17 nt, Mycobacterium avium subsp. paratuberculosis
gcgaccgcgaugcgaca

SEQ ID NO: 2954066 - RNA, 20 nt, Mycobacterium avium subsp. paratuberculosis
gcgaccgcgaugcgacaccg

SEQ ID NO: 2954067 - RNA, 12 nt, Mycobacterium avium subsp. paratuberculosis
gcgaccgcgcag

SEQ ID NO: 2954068 - RNA, 16 nt, Mycobacterium avium subsp. paratuberculosis
gcgaccgcgcaggcgg

SEQ ID NO: 2954069 - RNA, 16 nt, Mycobacterium avium subsp. paratuberculosis
gcgaccgcgcgcggcg

SEQ ID NO: 2954070 - RNA, 18 nt, Mycobacterium avium subsp. paratuberculosis
gcgaccgcgcgcggcgcc

SEQ ID NO: 2954071 - RNA, 21 nt, Mycobacterium avium subsp. paratuberculosis
gcgaccgcgcgcggcgccgcg

SEQ ID NO: 2954072 - RNA, 13 nt, Mycobacterium avium subsp. paratuberculosis
gcgaccgcgcggc

SEQ ID NO: 2954073 - RNA, 12 nt, Mycobacterium avium subsp. paratuberculosis
gcgaccgcggcc

SEQ ID NO: 2954074 - RNA, 13 nt, Mycobacterium avium subsp. paratuberculosis
gcgaccgcggccg

SEQ ID NO: 2954075 - RNA, 20 nt, Mycobacterium avium subsp. paratuberculosis
gcgaccgcggccgcgacggu

SEQ ID NO: 2954076 - RNA, 15 nt, Mycobacterium avium subsp. paratuberculosis
gcgaccgcgucgacg

SEQ ID NO: 2954077 - RNA, 16 nt, Mycobacterium avium subsp. paratuberculosis
gcgaccgcgucgacgg

SEQ ID NO: 2954078 - RNA, 13 nt, Mycobacterium avium subsp. paratuberculosis
gcgaccggccauc

SEQ ID NO: 2954079 - RNA, 20 nt, Mycobacterium avium subsp. paratuberculosis
gcgaccggccccaacggcgu

SEQ ID NO: 2954080 - RNA, 13 nt, Mycobacterium avium subsp. paratuberculosis
gcgaccggcccga

SEQ ID NO: 2954081 - RNA, 15 nt, Mycobacterium avium subsp. paratuberculosis
gcgaccgguccgugc

SEQ ID NO: 2954082 - RNA, 22 nt, Mycobacterium avium subsp. paratuberculosis
gcgaccgguccgugccacggcc

SEQ ID NO: 2954083 - RNA, 13 nt, Mycobacterium avium subsp. paratuberculosis
gcgaccgucagca

SEQ ID NO: 2954084 - RNA, 20 nt, Mycobacterium avium subsp. paratuberculosis
gcgaccgucagcagggccuc

SEQ ID NO: 2954085 - RNA, 22 nt, Mycobacterium avium subsp. paratuberculosis
gcgaccgucagcagggccucgc

SEQ ID NO: 2954086 - RNA, 20 nt, Mycobacterium avium subsp. paratuberculosis
gcgaccgucgggacggccag

SEQ ID NO: 2954087 - RNA, 15 nt, Mycobacterium avium subsp. paratuberculosis
gcgaccgugcccacc

SEQ ID NO: 2954088 - RNA, 18 nt, Mycobacterium avium subsp. paratuberculosis
gcgaccgugcccaccagc

SEQ ID NO: 2954089 - RNA, 21 nt, Mycobacterium avium subsp. paratuberculosis
gcgaccgugcccaccagccgg

SEQ ID NO: 2954090 - RNA, 20 nt, Mycobacterium avium subsp. paratuberculosis
gcgaccuccugcaaggcccc

SEQ ID NO: 2954091 - RNA, 21 nt, Mycobacterium avium subsp. paratuberculosis
gcgaccuccugcaaggccccc

SEQ ID NO: 2954092 - RNA, 13 nt, Mycobacterium avium subsp. paratuberculosis
gcgaccucgggug

SEQ ID NO: 2954093 - RNA, 13 nt, Mycobacterium avium subsp. paratuberculosis
gcgaccucggugg

SEQ ID NO: 2954094 - RNA, 18 nt, Mycobacterium avium subsp. paratuberculosis
gcgaccucgguggugcug

SEQ ID NO: 2954095 - RNA, 21 nt, Mycobacterium avium subsp. paratuberculosis
gcgaccucgguggugcugaug

SEQ ID NO: 2954096 - RNA, 13 nt, Mycobacterium avium subsp. paratuberculosis
gcgaccucguggu

SEQ ID NO: 2954097 - RNA, 18 nt, Mycobacterium avium subsp. paratuberculosis
gcgaccucuucgcuggac

SEQ ID NO: 2954098 - RNA, 19 nt, Mycobacterium avium subsp. paratuberculosis
gcgaccugcggcucgucgg

SEQ ID NO: 2954099 - RNA, 13 nt, Mycobacterium avium subsp. paratuberculosis
gcgaccugcgggc

SEQ ID NO: 2954100 - RNA, 14 nt, Mycobacterium avium subsp. paratuberculosis
gcgaccugcgggcc

SEQ ID NO: 2954101 - RNA, 16 nt, Mycobacterium avium subsp. paratuberculosis
gcgaccugcgggccca

SEQ ID NO: 2954102 - RNA, 19 nt, Mycobacterium avium subsp. paratuberculosis
gcgaccugcuuggcggccu

SEQ ID NO: 2954103 - RNA, 21 nt, Mycobacterium avium subsp. paratuberculosis
gcgaccugcuuggcggccugc

SEQ ID NO: 2954104 - RNA, 17 nt, Mycobacterium avium subsp. paratuberculosis
gcgaccugguccaccgc

SEQ ID NO: 2954105 - RNA, 19 nt, Mycobacterium avium subsp. paratuberculosis
gcgaccugguccaccgcgg

SEQ ID NO: 2954106 - RNA, 21 nt, Mycobacterium avium subsp. paratuberculosis
gcgaccugguccaccgcggcg

SEQ ID NO: 2954107 - RNA, 23 nt, Mycobacterium avium subsp. paratuberculosis
gcgaccugguccaccgcggcggc

SEQ ID NO: 2954108 - RNA, 18 nt, Mycobacterium avium subsp. paratuberculosis
gcgaccuguuuggccagc

SEQ ID NO: 2954109 - RNA, 20 nt, Mycobacterium avium subsp. paratuberculosis
gcgaccuguuuggccagcca

SEQ ID NO: 2954110 - RNA, 22 nt, Mycobacterium avium subsp. paratuberculosis
gcgaccuugcgcagccggcagc

SEQ ID NO: 2954111 - RNA, 23 nt, Mycobacterium avium subsp. paratuberculosis
gcgacgaaaaugcccagugucgc

SEQ ID NO: 2954112 - RNA, 16 nt, Mycobacterium avium subsp. paratuberculosis
gcgacgaacagcaccg

SEQ ID NO: 2954113 - RNA, 20 nt, Mycobacterium avium subsp. paratuberculosis
gcgacgaacagcaccgccac

SEQ ID NO: 2954114 - RNA, 21 nt, Mycobacterium avium subsp. paratuberculosis
gcgacgaacagcaccgccacg

SEQ ID NO: 2954115 - RNA, 22 nt, Mycobacterium avium subsp. paratuberculosis
gcgacgaacagcaccgccacgg

SEQ ID NO: 2954116 - RNA, 23 nt, Mycobacterium avium subsp. paratuberculosis
gcgacgaacagcaccgccacggc

SEQ ID NO: 2954117 - RNA, 15 nt, Mycobacterium avium subsp. paratuberculosis
gcgacgaaccuggcu

SEQ ID NO: 2954118 - RNA, 21 nt, Mycobacterium avium subsp. paratuberculosis
gcgacgaaccuggcugccugg

SEQ ID NO: 2954119 - RNA, 22 nt, Mycobacterium avium subsp. paratuberculosis
gcgacgaaccuggcugccuggu

SEQ ID NO: 2954120 - RNA, 22 nt, Mycobacterium avium subsp. paratuberculosis
gcgacgaacgcuuccagcacca

SEQ ID NO: 2954121 - RNA, 23 nt, Mycobacterium avium subsp. paratuberculosis
gcgacgaacgcuuccagcaccac

SEQ ID NO: 2954122 - RNA, 19 nt, Mycobacterium avium subsp. paratuberculosis
gcgacgaagcagcucgcgu

SEQ ID NO: 2954123 - RNA, 20 nt, Mycobacterium avium subsp. paratuberculosis
gcgacgaagcagcucgcgua

SEQ ID NO: 2954124 - RNA, 14 nt, Mycobacterium avium subsp. paratuberculosis
gcgacgaagccggu

SEQ ID NO: 2954125 - RNA, 16 nt, Mycobacterium avium subsp. paratuberculosis
gcgacgaagccggugc

SEQ ID NO: 2954126 - RNA, 19 nt, Mycobacterium avium subsp. paratuberculosis
gcgacgaagccggugccca

SEQ ID NO: 2954127 - RNA, 16 nt, Mycobacterium avium subsp. paratuberculosis
gcgacgaagucgacgg

SEQ ID NO: 2954128 - RNA, 18 nt, Mycobacterium avium subsp. paratuberculosis
gcgacgaagucgacggcg

SEQ ID NO: 2954129 - RNA, 17 nt, Mycobacterium avium subsp. paratuberculosis
gcgacgaauaucccagc

SEQ ID NO: 2954130 - RNA, 22 nt, Mycobacterium avium subsp. paratuberculosis
gcgacgaauccggugaccgccu

SEQ ID NO: 2954131 - RNA, 15 nt, Mycobacterium avium subsp. paratuberculosis
gcgacgacaccaccg

SEQ ID NO: 2954132 - RNA, 16 nt, Mycobacterium avium subsp. paratuberculosis
gcgacgacaccaccgu

SEQ ID NO: 2954133 - RNA, 21 nt, Mycobacterium avium subsp. paratuberculosis
gcgacgacaccaccgugcugg

SEQ ID NO: 2954134 - RNA, 18 nt, Mycobacterium avium subsp. paratuberculosis
gcgacgaccaccaggagc

SEQ ID NO: 2954135 - RNA, 18 nt, Mycobacterium avium subsp. paratuberculosis
gcgacgaccgcaccgacc

SEQ ID NO: 2954136 - RNA, 16 nt, Mycobacterium avium subsp. paratuberculosis
gcgacgaccucgcccg

SEQ ID NO: 2954137 - RNA, 17 nt, Mycobacterium avium subsp. paratuberculosis
gcgacgaccucgcccgc

SEQ ID NO: 2954138 - RNA, 18 nt, Mycobacterium avium subsp. paratuberculosis
gcgacgaccucgcccgcc

SEQ ID NO: 2954139 - RNA, 19 nt, Mycobacterium avium subsp. paratuberculosis
gcgacgaccucgcccgccg

SEQ ID NO: 2954140 - RNA, 22 nt, Mycobacterium avium subsp. paratuberculosis
gcgacgagagcggaucggcggc

SEQ ID NO: 2954141 - RNA, 14 nt, Mycobacterium avium subsp. paratuberculosis
gcgacgagcgggcc

SEQ ID NO: 2954142 - RNA, 15 nt, Mycobacterium avium subsp. paratuberculosis
gcgacgagcgggccg

SEQ ID NO: 2954143 - RNA, 16 nt, Mycobacterium avium subsp. paratuberculosis
gcgacgagcgggccga

SEQ ID NO: 2954144 - RNA, 21 nt, Mycobacterium avium subsp. paratuberculosis
gcgacgauaucggccgcgggg

SEQ ID NO: 2954145 - RNA, 22 nt, Mycobacterium avium subsp. paratuberculosis
gcgacgauaucggccgcggggc

SEQ ID NO: 2954146 - RNA, 21 nt, Mycobacterium avium subsp. paratuberculosis
gcgacgaucaccuuguugcgg

SEQ ID NO: 2954147 - RNA, 16 nt, Mycobacterium avium subsp. paratuberculosis
gcgacggcccgccgga

SEQ ID NO: 2954148 - RNA, 12 nt, Mycobacterium avium subsp. paratuberculosis
gcgacggcccgg

SEQ ID NO: 2954149 - RNA, 13 nt, Mycobacterium avium subsp. paratuberculosis
gcgacggcccggu

SEQ ID NO: 2954150 - RNA, 17 nt, Mycobacterium avium subsp. paratuberculosis
gcgacggcccgguccag

SEQ ID NO: 2954151 - RNA, 21 nt, Mycobacterium avium subsp. paratuberculosis
gcgacggcccgguccaguugu

SEQ ID NO: 2954152 - RNA, 17 nt, Mycobacterium avium subsp. paratuberculosis
gcgacggccggggccag

SEQ ID NO: 2954153 - RNA, 18 nt, Mycobacterium avium subsp. paratuberculosis
gcgacggccggggccagc

SEQ ID NO: 2954154 - RNA, 21 nt, Mycobacterium avium subsp. paratuberculosis
gcgacggccggggccagcacc

SEQ ID NO: 2954155 - RNA, 15 nt, Mycobacterium avium subsp. paratuberculosis
gcgacggccucgccg

SEQ ID NO: 2954156 - RNA, 16 nt, Mycobacterium avium subsp. paratuberculosis
gcgacggccucgccgu

SEQ ID NO: 2954157 - RNA, 18 nt, Mycobacterium avium subsp. paratuberculosis
gcgacggccucgccgucg

SEQ ID NO: 2954158 - RNA, 14 nt, Mycobacterium avium subsp. paratuberculosis
gcgacggcgaacgg

SEQ ID NO: 2954159 - RNA, 16 nt, Mycobacterium avium subsp. paratuberculosis
gcgacggcgacgaccg

SEQ ID NO: 2954160 - RNA, 17 nt, Mycobacterium avium subsp. paratuberculosis
gcgacggcgacgaccgu

SEQ ID NO: 2954161 - RNA, 14 nt, Mycobacterium avium subsp. paratuberculosis
gcgacggcgacggc

SEQ ID NO: 2954162 - RNA, 15 nt, Mycobacterium avium subsp. paratuberculosis
gcgacggcgacggcc

SEQ ID NO: 2954163 - RNA, 13 nt, Mycobacterium avium subsp. paratuberculosis
gcgacggcgagcc

SEQ ID NO: 2954164 - RNA, 16 nt, Mycobacterium avium subsp. paratuberculosis
gcgacggcgagccggg

SEQ ID NO: 2954165 - RNA, 17 nt, Mycobacterium avium subsp. paratuberculosis
gcgacggcgagccgggc

SEQ ID NO: 2954166 - RNA, 18 nt, Mycobacterium avium subsp. paratuberculosis
gcgacggcgagccgggcc

SEQ ID NO: 2954167 - RNA, 12 nt, Mycobacterium avium subsp. paratuberculosis
gcgacggcgccc

SEQ ID NO: 2954168 - RNA, 19 nt, Mycobacterium avium subsp. paratuberculosis
gcgacggcgcccgccccga

SEQ ID NO: 2954169 - RNA, 15 nt, Mycobacterium avium subsp. paratuberculosis
gcgacggcgccugau

SEQ ID NO: 2954170 - RNA, 18 nt, Mycobacterium avium subsp. paratuberculosis
gcgacggcgcucaccggc

SEQ ID NO: 2954171 - RNA, 13 nt, Mycobacterium avium subsp. paratuberculosis
gcgacggcggcga

SEQ ID NO: 2954172 - RNA, 14 nt, Mycobacterium avium subsp. paratuberculosis
gcgacggcggcgac

SEQ ID NO: 2954173 - RNA, 15 nt, Mycobacterium avium subsp. paratuberculosis
gcgacggcggcgacg

SEQ ID NO: 2954174 - RNA, 15 nt, Mycobacterium avium subsp. paratuberculosis
gcgacggcggggugc

SEQ ID NO: 2954175 - RNA, 17 nt, Mycobacterium avium subsp. paratuberculosis
gcgacggcggggugcgc

SEQ ID NO: 2954176 - RNA, 12 nt, Mycobacterium avium subsp. paratuberculosis
gcgacggcggug

SEQ ID NO: 2954177 - RNA, 15 nt, Mycobacterium avium subsp. paratuberculosis
gcgacggcguccagc

SEQ ID NO: 2954178 - RNA, 13 nt, Mycobacterium avium subsp. paratuberculosis
gcgacggcguccg

SEQ ID NO: 2954179 - RNA, 17 nt, Mycobacterium avium subsp. paratuberculosis
gcgacggcgucggcgag

SEQ ID NO: 2954180 - RNA, 18 nt, Mycobacterium avium subsp. paratuberculosis
gcgacggcgucggcgagc

SEQ ID NO: 2954181 - RNA, 16 nt, Mycobacterium avium subsp. paratuberculosis
gcgacggcgucggcgg

SEQ ID NO: 2954182 - RNA, 18 nt, Mycobacterium avium subsp. paratuberculosis
gcgacggcgucggcggcc

SEQ ID NO: 2954183 - RNA, 18 nt, Mycobacterium avium subsp. paratuberculosis
gcgacggcguugcuggcg

SEQ ID NO: 2954184 - RNA, 19 nt, Mycobacterium avium subsp. paratuberculosis
gcgacggcguugcuggcgc

SEQ ID NO: 2954185 - RNA, 19 nt, Mycobacterium avium subsp. paratuberculosis
gcgacggcucuucgcggcg

SEQ ID NO: 2954186 - RNA, 21 nt, Mycobacterium avium subsp. paratuberculosis
gcgacggcucuucgcggcggg

SEQ ID NO: 2954187 - RNA, 14 nt, Mycobacterium avium subsp. paratuberculosis
gcgacgggcacccg

SEQ ID NO: 2954188 - RNA, 17 nt, Mycobacterium avium subsp. paratuberculosis
gcgacgggcacccgcgc

SEQ ID NO: 2954189 - RNA, 19 nt, Mycobacterium avium subsp. paratuberculosis
gcgacgggcacccgcgcgu

SEQ ID NO: 2954190 - RNA, 13 nt, Mycobacterium avium subsp. paratuberculosis
gcgacgggcaugc

SEQ ID NO: 2954191 - RNA, 19 nt, Mycobacterium avium subsp. paratuberculosis
gcgacgggcaugccgucgg

SEQ ID NO: 2954192 - RNA, 23 nt, Mycobacterium avium subsp. paratuberculosis
gcgacgggcaugccgucggcgcc

SEQ ID NO: 2954193 - RNA, 15 nt, Mycobacterium avium subsp. paratuberculosis
gcgacgggccgauca

SEQ ID NO: 2954194 - RNA, 12 nt, Mycobacterium avium subsp. paratuberculosis
gcgacgggccgg

SEQ ID NO: 2954195 - RNA, 14 nt, Mycobacterium avium subsp. paratuberculosis
gcgacgggccgggc

SEQ ID NO: 2954196 - RNA, 15 nt, Mycobacterium avium subsp. paratuberculosis
gcgacgggccgggca

SEQ ID NO: 2954197 - RNA, 19 nt, Mycobacterium avium subsp. paratuberculosis
gcgacgggccgggcacguc

SEQ ID NO: 2954198 - RNA, 15 nt, Mycobacterium avium subsp. paratuberculosis
gcgacgggcguccga

SEQ ID NO: 2954199 - RNA, 15 nt, Mycobacterium avium subsp. paratuberculosis
gcgacgggcucggcg

SEQ ID NO: 2954200 - RNA, 16 nt, Mycobacterium avium subsp. paratuberculosis
gcgacgggcucggcgu

SEQ ID NO: 2954201 - RNA, 14 nt, Mycobacterium avium subsp. paratuberculosis
gcgacgggcugcug

SEQ ID NO: 2954202 - RNA, 18 nt, Mycobacterium avium subsp. paratuberculosis
gcgacgggcugcugcacg

SEQ ID NO: 2954203 - RNA, 18 nt, Mycobacterium avium subsp. paratuberculosis
gcgacgggcugucccggc

SEQ ID NO: 2954204 - RNA, 20 nt, Mycobacterium avium subsp. paratuberculosis
gcgacgggcugucccggccg

SEQ ID NO: 2954205 - RNA, 13 nt, Mycobacterium avium subsp. paratuberculosis
gcgacggucgugc

SEQ ID NO: 2954206 - RNA, 18 nt, Mycobacterium avium subsp. paratuberculosis
gcgacggucugccgggac

SEQ ID NO: 2954207 - RNA, 15 nt, Mycobacterium avium subsp. paratuberculosis
gcgacgguggacccg

SEQ ID NO: 2954208 - RNA, 16 nt, Mycobacterium avium subsp. paratuberculosis
gcgacgguggacccga

SEQ ID NO: 2954209 - RNA, 17 nt, Mycobacterium avium subsp. paratuberculosis
gcgacgguggacccgac

SEQ ID NO: 2954210 - RNA, 12 nt, Mycobacterium avium subsp. paratuberculosis
gcgacgguggcg

SEQ ID NO: 2954211 - RNA, 13 nt, Mycobacterium avium subsp. paratuberculosis
gcgacgguggcgc

SEQ ID NO: 2954212 - RNA, 15 nt, Mycobacterium avium subsp. paratuberculosis
gcgacgguggcgccc

SEQ ID NO: 2954213 - RNA, 18 nt, Mycobacterium avium subsp. paratuberculosis
gcgacgguggcgcccagc

SEQ ID NO: 2954214 - RNA, 20 nt, Mycobacterium avium subsp. paratuberculosis
gcgacgguggcgcccagcga

SEQ ID NO: 2954215 - RNA, 22 nt, Mycobacterium avium subsp. paratuberculosis
gcgacgguggcgcccagcgagc

SEQ ID NO: 2954216 - RNA, 15 nt, Mycobacterium avium subsp. paratuberculosis
gcgacgguggcggcg

SEQ ID NO: 2954217 - RNA, 18 nt, Mycobacterium avium subsp. paratuberculosis
gcgacgguggcgggccgc

SEQ ID NO: 2954218 - RNA, 22 nt, Mycobacterium avium subsp. paratuberculosis
gcgacgguguaggacgccgugc

SEQ ID NO: 2954219 - RNA, 23 nt, Mycobacterium avium subsp. paratuberculosis
gcgacgguguaggacgccgugca

SEQ ID NO: 2954220 - RNA, 17 nt, Mycobacterium avium subsp. paratuberculosis
gcgacgguguccgcggc

SEQ ID NO: 2954221 - RNA, 21 nt, Mycobacterium avium subsp. paratuberculosis
gcgacgguguccgcggcgucg

SEQ ID NO: 2954222 - RNA, 20 nt, Mycobacterium avium subsp. paratuberculosis
gcgacgguuguucagcccgg

SEQ ID NO: 2954223 - RNA, 19 nt, Mycobacterium avium subsp. paratuberculosis
gcgacguacagcgagccgu

SEQ ID NO: 2954224 - RNA, 21 nt, Mycobacterium avium subsp. paratuberculosis
gcgacgucaggucgaccggcu

SEQ ID NO: 2954225 - RNA, 15 nt, Mycobacterium avium subsp. paratuberculosis
gcgacguccggucag

SEQ ID NO: 2954226 - RNA, 14 nt, Mycobacterium avium subsp. paratuberculosis
gcgacgucgaccgc

SEQ ID NO: 2954227 - RNA, 15 nt, Mycobacterium avium subsp. paratuberculosis
gcgacgucgaccgcg

SEQ ID NO: 2954228 - RNA, 12 nt, Mycobacterium avium subsp. paratuberculosis
gcgacgucgacg

SEQ ID NO: 2954229 - RNA, 21 nt, Mycobacterium avium subsp. paratuberculosis
gcgacgucgacggcagcgcua

SEQ ID NO: 2954230 - RNA, 13 nt, Mycobacterium avium subsp. paratuberculosis
gcgacgucgccgg

SEQ ID NO: 2954231 - RNA, 16 nt, Mycobacterium avium subsp. paratuberculosis
gcgacgucgccggccu

SEQ ID NO: 2954232 - RNA, 21 nt, Mycobacterium avium subsp. paratuberculosis
gcgagaugaucagccgcccga

SEQ ID NO: 2954233 - RNA, 16 nt, Mycobacterium avium subsp. paratuberculosis
gcgagaugcccacccg

SEQ ID NO: 2954234 - RNA, 20 nt, Mycobacterium avium subsp. paratuberculosis
gcgagauuggccucggcgcg

SEQ ID NO: 2954235 - RNA, 22 nt, Mycobacterium avium subsp. paratuberculosis
gcgagauuggccucggcgcggg

SEQ ID NO: 2954236 - RNA, 24 nt, Mycobacterium avium subsp. paratuberculosis
gcgagauuggccucggcgcgggcg

SEQ ID NO: 2954237 - RNA, 18 nt, Mycobacterium avium subsp. paratuberculosis
gcgagcaaggcgagcacg

SEQ ID NO: 2954238 - RNA, 21 nt, Mycobacterium avium subsp. paratuberculosis
gcgagcacacccucaccccgc

SEQ ID NO: 2954239 - RNA, 21 nt, Mycobacterium avium subsp. paratuberculosis
gcgagcacaggaacgcgacgg

SEQ ID NO: 2954240 - RNA, 13 nt, Mycobacterium avium subsp. paratuberculosis
gcgagcaccgcga

SEQ ID NO: 2954241 - RNA, 18 nt, Mycobacterium avium subsp. paratuberculosis
gcgagcaccgugccgucg

SEQ ID NO: 2954242 - RNA, 19 nt, Mycobacterium avium subsp. paratuberculosis
gcgagcacgacgucgacgu

SEQ ID NO: 2954243 - RNA, 16 nt, Mycobacterium avium subsp. paratuberculosis
gcgagcacgccgccgg

SEQ ID NO: 2954244 - RNA, 20 nt, Mycobacterium avium subsp. paratuberculosis
gcgagcacggcacgcccguu

SEQ ID NO: 2954245 - RNA, 18 nt, Mycobacterium avium subsp. paratuberculosis
gcgagcagacgcaaaaac

SEQ ID NO: 2954246 - RNA, 20 nt, Mycobacterium avium subsp. paratuberculosis
gcgagcagacgcaaaaaccc

SEQ ID NO: 2954247 - RNA, 18 nt, Mycobacterium avium subsp. paratuberculosis
gcgagcagacgcaaaagc

SEQ ID NO: 2954248 - RNA, 19 nt, Mycobacterium avium subsp. paratuberculosis
gcgagcagacgcaaaagcc

SEQ ID NO: 2954249 - RNA, 23 nt, Mycobacterium avium subsp. paratuberculosis
gcgagcagacgcaaaagccccgc

SEQ ID NO: 2954250 - RNA, 20 nt, Mycobacterium avium subsp. paratuberculosis
gcgagcagacgcgaaagcac

SEQ ID NO: 2954251 - RNA, 13 nt, Mycobacterium avium subsp. paratuberculosis
gcgagcagcagcg

SEQ ID NO: 2954252 - RNA, 16 nt, Mycobacterium avium subsp. paratuberculosis
gcgagcagcagcgcgg

SEQ ID NO: 2954253 - RNA, 18 nt, Mycobacterium avium subsp. paratuberculosis
gcgagcagcagcgcggug

SEQ ID NO: 2954254 - RNA, 19 nt, Mycobacterium avium subsp. paratuberculosis
gcgagcagcagcgcggugc

SEQ ID NO: 2954255 - RNA, 20 nt, Mycobacterium avium subsp. paratuberculosis
gcgagcagcagcgcggugcc

SEQ ID NO: 2954256 - RNA, 17 nt, Mycobacterium avium subsp. paratuberculosis
gcgagcagcccggcgaa

SEQ ID NO: 2954257 - RNA, 13 nt, Mycobacterium avium subsp. paratuberculosis
gcgagcagccgcg

SEQ ID NO: 2954258 - RNA, 14 nt, Mycobacterium avium subsp. paratuberculosis
gcgagcagccgcgc

SEQ ID NO: 2954259 - RNA, 20 nt, Mycobacterium avium subsp. paratuberculosis
gcgagcagccgcgccgggcg

SEQ ID NO: 2954260 - RNA, 16 nt, Mycobacterium avium subsp. paratuberculosis
gcgagcagccgggugc

SEQ ID NO: 2954261 - RNA, 14 nt, Mycobacterium avium subsp. paratuberculosis
gcgagcagcgcccg

SEQ ID NO: 2954262 - RNA, 16 nt, Mycobacterium avium subsp. paratuberculosis
gcgagcagcgcccggg

SEQ ID NO: 2954263 - RNA, 20 nt, Mycobacterium avium subsp. paratuberculosis
gcgagcagcgcccgggugcg

SEQ ID NO: 2954264 - RNA, 21 nt, Mycobacterium avium subsp. paratuberculosis
gcgagcagcgcccgggugcgc

SEQ ID NO: 2954265 - RNA, 13 nt, Mycobacterium avium subsp. paratuberculosis
gcgagcagcgcga

SEQ ID NO: 2954266 - RNA, 20 nt, Mycobacterium avium subsp. paratuberculosis
gcgagcagcgcgaugccggc

SEQ ID NO: 2954267 - RNA, 23 nt, Mycobacterium avium subsp. paratuberculosis
gcgagcagcgcgaugccggccag

SEQ ID NO: 2954268 - RNA, 23 nt, Mycobacterium avium subsp. paratuberculosis
gcgagcagcucgacaucggccgc

SEQ ID NO: 2954269 - RNA, 18 nt, Mycobacterium avium subsp. paratuberculosis
gcgagcagcugcagcguc

SEQ ID NO: 2954270 - RNA, 18 nt, Mycobacterium avium subsp. paratuberculosis
gcgagcagggcgggcagg

SEQ ID NO: 2954271 - RNA, 19 nt, Mycobacterium avium subsp. paratuberculosis
gcgagcagggcgggcaggc

SEQ ID NO: 2954272 - RNA, 23 nt, Mycobacterium avium subsp. paratuberculosis
gcgagcagggcgggcaggcccga

SEQ ID NO: 2954273 - RNA, 13 nt, Mycobacterium avium subsp. paratuberculosis
gcgagccagcugc

SEQ ID NO: 2954274 - RNA, 15 nt, Mycobacterium avium subsp. paratuberculosis
gcgagccagcugcgc

SEQ ID NO: 2954275 - RNA, 12 nt, Mycobacterium avium subsp. paratuberculosis
gcgagcccagcu

SEQ ID NO: 2954276 - RNA, 14 nt, Mycobacterium avium subsp. paratuberculosis
gcgagcccggccag

SEQ ID NO: 2954277 - RNA, 20 nt, Mycobacterium avium subsp. paratuberculosis
gcgagcccggccaguccggc

SEQ ID NO: 2954278 - RNA, 12 nt, Mycobacterium avium subsp. paratuberculosis
gcgagcccggcg

SEQ ID NO: 2954279 - RNA, 22 nt, Mycobacterium avium subsp. paratuberculosis
gcgagcccggcgacgucgucga

SEQ ID NO: 2954280 - RNA, 17 nt, Mycobacterium avium subsp. paratuberculosis
gcgagcccuucgcggug

SEQ ID NO: 2954281 - RNA, 22 nt, Mycobacterium avium subsp. paratuberculosis
gcgagccgaaacggugcccgca

SEQ ID NO: 2954282 - RNA, 13 nt, Mycobacterium avium subsp. paratuberculosis
gcgagccgaagcg

SEQ ID NO: 2954283 - RNA, 19 nt, Mycobacterium avium subsp. paratuberculosis
gcgagccgacagucgcggg

SEQ ID NO: 2954284 - RNA, 20 nt, Mycobacterium avium subsp. paratuberculosis
gcgagccgacagucgcgggc

SEQ ID NO: 2954285 - RNA, 21 nt, Mycobacterium avium subsp. paratuberculosis
gcgagccgacagucgcgggcg

SEQ ID NO: 2954286 - RNA, 14 nt, Mycobacterium avium subsp. paratuberculosis
gcgagccgagcacg

SEQ ID NO: 2954287 - RNA, 12 nt, Mycobacterium avium subsp. paratuberculosis
gcgagccgagcc

SEQ ID NO: 2954288 - RNA, 22 nt, Mycobacterium avium subsp. paratuberculosis
gcgagccgagccgguccgacca

SEQ ID NO: 2954289 - RNA, 13 nt, Mycobacterium avium subsp. paratuberculosis
gcgagccgcccag

SEQ ID NO: 2954290 - RNA, 15 nt, Mycobacterium avium subsp. paratuberculosis
gcgagccggagccuu

SEQ ID NO: 2954291 - RNA, 21 nt, Mycobacterium avium subsp. paratuberculosis
gcgagccggagccuugcuggc

SEQ ID NO: 2954292 - RNA, 13 nt, Mycobacterium avium subsp. paratuberculosis
gcgagccggcacg

SEQ ID NO: 2954293 - RNA, 16 nt, Mycobacterium avium subsp. paratuberculosis
gcgagccggcacgcgc

SEQ ID NO: 2954294 - RNA, 19 nt, Mycobacterium avium subsp. paratuberculosis
gcgagccggcacgcgcgcc

SEQ ID NO: 2954295 - RNA, 12 nt, Mycobacterium avium subsp. paratuberculosis
gcgagccggccc

SEQ ID NO: 2954296 - RNA, 13 nt, Mycobacterium avium subsp. paratuberculosis
gcgagccggcccg

SEQ ID NO: 2954297 - RNA, 14 nt, Mycobacterium avium subsp. paratuberculosis
gcgagccggcccgg

SEQ ID NO: 2954298 - RNA, 18 nt, Mycobacterium avium subsp. paratuberculosis
gcgagccggcccggggug

SEQ ID NO: 2954299 - RNA, 20 nt, Mycobacterium avium subsp. paratuberculosis
gcgagccggccguagcggac

SEQ ID NO: 2954300 - RNA, 13 nt, Mycobacterium avium subsp. paratuberculosis
gcgagccgggccg

SEQ ID NO: 2954301 - RNA, 23 nt, Mycobacterium avium subsp. paratuberculosis
gcgagccggucugggcgaccaug

SEQ ID NO: 2954302 - RNA, 14 nt, Mycobacterium avium subsp. paratuberculosis
gcgagccgucgacc

SEQ ID NO: 2954303 - RNA, 16 nt, Mycobacterium avium subsp. paratuberculosis
gcgagccgucgaccgg

SEQ ID NO: 2954304 - RNA, 15 nt, Mycobacterium avium subsp. paratuberculosis
gcgagcgacgccacg

SEQ ID NO: 2954305 - RNA, 23 nt, Mycobacterium avium subsp. paratuberculosis
gcgagcgaggccaucaucccgua

SEQ ID NO: 2954306 - RNA, 12 nt, Mycobacterium avium subsp. paratuberculosis
gcgagcgcagca

SEQ ID NO: 2954307 - RNA, 14 nt, Mycobacterium avium subsp. paratuberculosis
gcgagcgcagcgcc

SEQ ID NO: 2954308 - RNA, 15 nt, Mycobacterium avium subsp. paratuberculosis
gcgagcgcagcgcca

SEQ ID NO: 2954309 - RNA, 19 nt, Mycobacterium avium subsp. paratuberculosis
gcgagcgcagcgccaggca

SEQ ID NO: 2954310 - RNA, 14 nt, Mycobacterium avium subsp. paratuberculosis
gcgagcgcgcggug

SEQ ID NO: 2954311 - RNA, 21 nt, Mycobacterium avium subsp. paratuberculosis
gcgagcgcgugcacgaacgcg

SEQ ID NO: 2954312 - RNA, 22 nt, Mycobacterium avium subsp. paratuberculosis
gcgagcgcguucuccaccgcgc

SEQ ID NO: 2954313 - RNA, 18 nt, Mycobacterium avium subsp. paratuberculosis
gcgagcgcuucgggagca

SEQ ID NO: 2954314 - RNA, 14 nt, Mycobacterium avium subsp. paratuberculosis
gcgagcggacgggc

SEQ ID NO: 2954315 - RNA, 22 nt, Mycobacterium avium subsp. paratuberculosis
gcgagcggcaccuuggugagca

SEQ ID NO: 2954316 - RNA, 13 nt, Mycobacterium avium subsp. paratuberculosis
gcgagucgaagcc

SEQ ID NO: 2954317 - RNA, 23 nt, Mycobacterium avium subsp. paratuberculosis
gcgagucgaagccguccaggccg

SEQ ID NO: 2954318 - RNA, 21 nt, Mycobacterium avium subsp. paratuberculosis
gcgagucgaagccguggcagg

SEQ ID NO: 2954319 - RNA, 14 nt, Mycobacterium avium subsp. paratuberculosis
gcgagucgaaggcg

SEQ ID NO: 2954320 - RNA, 20 nt, Mycobacterium avium subsp. paratuberculosis
gcgagucgaaggcgcgggcg

SEQ ID NO: 2954321 - RNA, 15 nt, Mycobacterium avium subsp. paratuberculosis
gcgagucgagcaccg

SEQ ID NO: 2954322 - RNA, 19 nt, Mycobacterium avium subsp. paratuberculosis
gcgagucgagguugaugcc

SEQ ID NO: 2954323 - RNA, 23 nt, Mycobacterium avium subsp. paratuberculosis
gcgagucgaugaccucgcgcccg

SEQ ID NO: 2954324 - RNA, 23 nt, Mycobacterium avium subsp. paratuberculosis
gcgagucguacuucgcccccgga

SEQ ID NO: 2954325 - RNA, 14 nt, Mycobacterium avium subsp. paratuberculosis
gcgagugaggacga

SEQ ID NO: 2954326 - RNA, 14 nt, Mycobacterium avium subsp. paratuberculosis
gcgagugccggcca

SEQ ID NO: 2954327 - RNA, 15 nt, Mycobacterium avium subsp. paratuberculosis
gcgagugccggccag

SEQ ID NO: 2954328 - RNA, 16 nt, Mycobacterium avium subsp. paratuberculosis
gcgagugccggccagc

SEQ ID NO: 2954329 - RNA, 23 nt, Mycobacterium avium subsp. paratuberculosis
gcgagugccggccagcucgccgc

SEQ ID NO: 2954330 - RNA, 17 nt, Mycobacterium avium subsp. paratuberculosis
gcgagugguaccgggug

SEQ ID NO: 2954331 - RNA, 20 nt, Mycobacterium avium subsp. paratuberculosis
gcgagugguaccggguggcc

SEQ ID NO: 2954332 - RNA, 20 nt, Mycobacterium avium subsp. paratuberculosis
gcgaguucagaagucgcccg

SEQ ID NO: 2954333 - RNA, 22 nt, Mycobacterium avium subsp. paratuberculosis
gcgaguucagaagucgcccgcg

SEQ ID NO: 2954334 - RNA, 21 nt, Mycobacterium avium subsp. paratuberculosis
gcgaguucgaccuccacccgc

SEQ ID NO: 2954335 - RNA, 22 nt, Mycobacterium avium subsp. paratuberculosis
gcgaguucgaccuccacccgcu

SEQ ID NO: 2954336 - RNA, 16 nt, Mycobacterium avium subsp. paratuberculosis
gcgaguucgaugacgu

SEQ ID NO: 2954337 - RNA, 21 nt, Mycobacterium avium subsp. paratuberculosis
gcgaguucgaugacgucgcgc

SEQ ID NO: 2954338 - RNA, 22 nt, Mycobacterium avium subsp. paratuberculosis
gcgaguucgaugacgucgcgcu

SEQ ID NO: 2954339 - RNA, 15 nt, Mycobacterium avium subsp. paratuberculosis
gcgaguucgccugcu

SEQ ID NO: 2954340 - RNA, 22 nt, Mycobacterium avium subsp. paratuberculosis
gcgaguucgcgcacgcuggccg

SEQ ID NO: 2954341 - RNA, 16 nt, Mycobacterium avium subsp. paratuberculosis
gcgaguucggcggccc

SEQ ID NO: 2954342 - RNA, 18 nt, Mycobacterium avium subsp. paratuberculosis
gcgaguucggcggcccgc

SEQ ID NO: 2954343 - RNA, 20 nt, Mycobacterium avium subsp. paratuberculosis
gcgaguucggcggcccgcuu

SEQ ID NO: 2954344 - RNA, 21 nt, Mycobacterium avium subsp. paratuberculosis
gcgaguucugguaggcggccg

SEQ ID NO: 2954345 - RNA, 18 nt, Mycobacterium avium subsp. paratuberculosis
gcgauaaccucggcggcg

SEQ ID NO: 2954346 - RNA, 19 nt, Mycobacterium avium subsp. paratuberculosis
gcgauaaccucggcggcgg

SEQ ID NO: 2954347 - RNA, 20 nt, Mycobacterium avium subsp. paratuberculosis
gcgauaaccucggcggcggc

SEQ ID NO: 2954348 - RNA, 17 nt, Mycobacterium avium subsp. paratuberculosis
gcgauacccguugcgcc

SEQ ID NO: 2954349 - RNA, 14 nt, Mycobacterium avium subsp. paratuberculosis
gcgauacgacggga

SEQ ID NO: 2954350 - RNA, 21 nt, Mycobacterium avium subsp. paratuberculosis
gcgauagccggugaucgcggc

SEQ ID NO: 2954351 - RNA, 14 nt, Mycobacterium avium subsp. paratuberculosis
gcgauaggcggcca

SEQ ID NO: 2954352 - RNA, 21 nt, Mycobacterium avium subsp. paratuberculosis
gcgauaggcggccagcucccg

SEQ ID NO: 2954353 - RNA, 15 nt, Mycobacterium avium subsp. paratuberculosis
gcgauagggccggcc

SEQ ID NO: 2954354 - RNA, 16 nt, Mycobacterium avium subsp. paratuberculosis
gcgauagggccggccg

SEQ ID NO: 2954355 - RNA, 18 nt, Mycobacterium avium subsp. paratuberculosis
gcgauagggccggccgga

SEQ ID NO: 2954356 - RNA, 19 nt, Mycobacterium avium subsp. paratuberculosis
gcgaucaacaccgguccgg

SEQ ID NO: 2954357 - RNA, 20 nt, Mycobacterium avium subsp. paratuberculosis
gcgaucaacaccgguccggc

SEQ ID NO: 2954358 - RNA, 22 nt, Mycobacterium avium subsp. paratuberculosis
gcgaucaacaccgguccggccg

SEQ ID NO: 2954359 - RNA, 17 nt, Mycobacterium avium subsp. paratuberculosis
gcgaucacaccaccacg

SEQ ID NO: 2954360 - RNA, 20 nt, Mycobacterium avium subsp. paratuberculosis
gcgaucaccaccccggugcc

SEQ ID NO: 2954361 - RNA, 14 nt, Mycobacterium avium subsp. paratuberculosis
gcgaucaccccggc

SEQ ID NO: 2954362 - RNA, 18 nt, Mycobacterium avium subsp. paratuberculosis
gcgaucaccccggcgacg

SEQ ID NO: 2954363 - RNA, 12 nt, Mycobacterium avium subsp. paratuberculosis
gcgaucaccgag

SEQ ID NO: 2954364 - RNA, 12 nt, Mycobacterium avium subsp. paratuberculosis
gcgaucaccgcg

SEQ ID NO: 2954365 - RNA, 13 nt, Mycobacterium avium subsp. paratuberculosis
gcgaucaccgcgg

SEQ ID NO: 2954366 - RNA, 22 nt, Mycobacterium avium subsp. paratuberculosis
gcgaucaccgcggccaccuggg

SEQ ID NO: 2954367 - RNA, 15 nt, Mycobacterium avium subsp. paratuberculosis
gcgaucaccgcggcg

SEQ ID NO: 2954368 - RNA, 18 nt, Mycobacterium avium subsp. paratuberculosis
gcgaucaccuugcggccg

SEQ ID NO: 2954369 - RNA, 23 nt, Mycobacterium avium subsp. paratuberculosis
gcgaucaccuugcggccggcggc

SEQ ID NO: 2954370 - RNA, 19 nt, Mycobacterium avium subsp. paratuberculosis
gcgaucacguucucggcga

SEQ ID NO: 2954371 - RNA, 19 nt, Mycobacterium avium subsp. paratuberculosis
gcgaucagaugcucgucgg

SEQ ID NO: 2954372 - RNA, 21 nt, Mycobacterium avium subsp. paratuberculosis
gcgaucagaugcucgucgguc

SEQ ID NO: 2954373 - RNA, 17 nt, Mycobacterium avium subsp. paratuberculosis
gcgaucagcagcacccg

SEQ ID NO: 2954374 - RNA, 19 nt, Mycobacterium avium subsp. paratuberculosis
gcgaucagcagcacccggg

SEQ ID NO: 2954375 - RNA, 20 nt, Mycobacterium avium subsp. paratuberculosis
gcgaucagcagcacccgggc

SEQ ID NO: 2954376 - RNA, 22 nt, Mycobacterium avium subsp. paratuberculosis
gcgaucagcagcacccgggccu

SEQ ID NO: 2954377 - RNA, 15 nt, Mycobacterium avium subsp. paratuberculosis
gcgaucagccccagg

SEQ ID NO: 2954378 - RNA, 22 nt, Mycobacterium avium subsp. paratuberculosis
gcgaucagccccagggugcgcc

SEQ ID NO: 2954379 - RNA, 15 nt, Mycobacterium avium subsp. paratuberculosis
gcgaucagcccggcc

SEQ ID NO: 2954380 - RNA, 18 nt, Mycobacterium avium subsp. paratuberculosis
gcgaucagcccggcccgc

SEQ ID NO: 2954381 - RNA, 12 nt, Mycobacterium avium subsp. paratuberculosis
gcgaucagcgcc

SEQ ID NO: 2954382 - RNA, 17 nt, Mycobacterium avium subsp. paratuberculosis
gcgaucagcgcgcacag

SEQ ID NO: 2954383 - RNA, 13 nt, Mycobacterium avium subsp. paratuberculosis
gcgaucagcuccu

SEQ ID NO: 2954384 - RNA, 23 nt, Mycobacterium avium subsp. paratuberculosis
gcgaucagcucguggcgggcccg

SEQ ID NO: 2954385 - RNA, 13 nt, Mycobacterium avium subsp. paratuberculosis
gcgaucagcugcc

SEQ ID NO: 2954386 - RNA, 16 nt, Mycobacterium avium subsp. paratuberculosis
gcgaucagcugcucgu

SEQ ID NO: 2954387 - RNA, 16 nt, Mycobacterium avium subsp. paratuberculosis
gcgaucaggccggcca

SEQ ID NO: 2954388 - RNA, 17 nt, Mycobacterium avium subsp. paratuberculosis
gcgaucaggccggccac

SEQ ID NO: 2954389 - RNA, 18 nt, Mycobacterium avium subsp. paratuberculosis
gcgaucaggccggccacc

SEQ ID NO: 2954390 - RNA, 21 nt, Mycobacterium avium subsp. paratuberculosis
gcgaucaggccggccaccagg

SEQ ID NO: 2954391 - RNA, 22 nt, Mycobacterium avium subsp. paratuberculosis
gcgaucaggcugccgcugcgcc

SEQ ID NO: 2954392 - RNA, 18 nt, Mycobacterium avium subsp. paratuberculosis
gcgaucagggcccacagc

SEQ ID NO: 2954393 - RNA, 16 nt, Mycobacterium avium subsp. paratuberculosis
gcgaucagggccgcgg

SEQ ID NO: 2954394 - RNA, 18 nt, Mycobacterium avium subsp. paratuberculosis
gcgaucagggccgcggcc

SEQ ID NO: 2954395 - RNA, 15 nt, Mycobacterium avium subsp. paratuberculosis
gcgaucagggcggcg

SEQ ID NO: 2954396 - RNA, 21 nt, Mycobacterium avium subsp. paratuberculosis
gcgaucagggcggcgccgcgg

SEQ ID NO: 2954397 - RNA, 22 nt, Mycobacterium avium subsp. paratuberculosis
gcgaucagggcggcgccgcggc

SEQ ID NO: 2954398 - RNA, 18 nt, Mycobacterium avium subsp. paratuberculosis
gcgaucaguauggagaaa

SEQ ID NO: 2954399 - RNA, 15 nt, Mycobacterium avium subsp. paratuberculosis
gcgaucaucgucguc

SEQ ID NO: 2954400 - RNA, 14 nt, Mycobacterium avium subsp. paratuberculosis
gcgaucucgucgcg

SEQ ID NO: 2954401 - RNA, 15 nt, Mycobacterium avium subsp. paratuberculosis
gcgaucucgucgcgc

SEQ ID NO: 2954402 - RNA, 22 nt, Mycobacterium avium subsp. paratuberculosis
gcgaucucuucgaugccggugg

SEQ ID NO: 2954403 - RNA, 22 nt, Mycobacterium avium subsp. paratuberculosis
gcgaucugcuccucggucagcg

SEQ ID NO: 2954404 - RNA, 23 nt, Mycobacterium avium subsp. paratuberculosis
gcgaucugcucggugucgaucga

SEQ ID NO: 2954405 - RNA, 20 nt, Mycobacterium avium subsp. paratuberculosis
gcgaucuggcgguuggacag

SEQ ID NO: 2954406 - RNA, 22 nt, Mycobacterium avium subsp. paratuberculosis
gcgaucuugucccgcauggccu

SEQ ID NO: 2954407 - RNA, 16 nt, Mycobacterium avium subsp. paratuberculosis
gcgaucuuugcggccg

SEQ ID NO: 2954408 - RNA, 20 nt, Mycobacterium avium subsp. paratuberculosis
gcgaucuuugcggccguggc

SEQ ID NO: 2954409 - RNA, 21 nt, Mycobacterium avium subsp. paratuberculosis
gcgaucuuugcggccguggcg

SEQ ID NO: 2954410 - RNA, 16 nt, Mycobacterium avium subsp. paratuberculosis
gcgaugaacacgccga

SEQ ID NO: 2954411 - RNA, 13 nt, Mycobacterium avium subsp. paratuberculosis
gcgaugaagcccc

SEQ ID NO: 2954412 - RNA, 17 nt, Mycobacterium avium subsp. paratuberculosis
gcgaugaagccccggac

SEQ ID NO: 2954413 - RNA, 15 nt, Mycobacterium avium subsp. paratuberculosis
gcgaugaagccggcg

SEQ ID NO: 2954414 - RNA, 13 nt, Mycobacterium avium subsp. paratuberculosis
gcgaugaccaccc

SEQ ID NO: 2954415 - RNA, 13 nt, Mycobacterium avium subsp. paratuberculosis
gcgaugaccggac

SEQ ID NO: 2954416 - RNA, 22 nt, Mycobacterium avium subsp. paratuberculosis
gcgaugaccggacgauucgcga

SEQ ID NO: 2954417 - RNA, 14 nt, Mycobacterium avium subsp. paratuberculosis
gcgaugaccgggac

SEQ ID NO: 2954418 - RNA, 21 nt, Mycobacterium avium subsp. paratuberculosis
gcgaugacgucgucgcggcgc

SEQ ID NO: 2954419 - RNA, 17 nt, Mycobacterium avium subsp. paratuberculosis
gcgaugaucaacaggau

SEQ ID NO: 2954420 - RNA, 19 nt, Mycobacterium avium subsp. paratuberculosis
gcgaugaucacacccacga

SEQ ID NO: 2954421 - RNA, 22 nt, Mycobacterium avium subsp. paratuberculosis
gcgaugaucacacccacgaacg

SEQ ID NO: 2954422 - RNA, 16 nt, Mycobacterium avium subsp. paratuberculosis
gcgaugaucaccucgg

SEQ ID NO: 2954423 - RNA, 18 nt, Mycobacterium avium subsp. paratuberculosis
gcgaugaucagcucgcgc

SEQ ID NO: 2954424 - RNA, 14 nt, Mycobacterium avium subsp. paratuberculosis
gcgaugaucaggcc

SEQ ID NO: 2954425 - RNA, 20 nt, Mycobacterium avium subsp. paratuberculosis
gcgaugaucgccggcgccgg

SEQ ID NO: 2954426 - RNA, 22 nt, Mycobacterium avium subsp. paratuberculosis
gcgaugaugagcaagucggcgg

SEQ ID NO: 2954427 - RNA, 18 nt, Mycobacterium avium subsp. paratuberculosis
gcgaugauggcgucgacg

SEQ ID NO: 2954428 - RNA, 17 nt, Mycobacterium avium subsp. paratuberculosis
gcgaugcaacaccgaac

SEQ ID NO: 2954429 - RNA, 18 nt, Mycobacterium avium subsp. paratuberculosis
gcgaugcaacaccgaacg

SEQ ID NO: 2954430 - RNA, 18 nt, Mycobacterium avium subsp. paratuberculosis
gcgaugcagaacagccgg

SEQ ID NO: 2954431 - RNA, 19 nt, Mycobacterium avium subsp. paratuberculosis
gcgaugcagaacagccggu

SEQ ID NO: 2954432 - RNA, 17 nt, Mycobacterium avium subsp. paratuberculosis
gcgaugccagcgcaccg

SEQ ID NO: 2954433 - RNA, 20 nt, Mycobacterium avium subsp. paratuberculosis
gcgaugccagcgcaccgggc

SEQ ID NO: 2954434 - RNA, 23 nt, Mycobacterium avium subsp. paratuberculosis
gcgaugccagcgcaccgggcccg

SEQ ID NO: 2954435 - RNA, 19 nt, Mycobacterium avium subsp. paratuberculosis
gcgaugcccaagccggcca

SEQ ID NO: 2954436 - RNA, 20 nt, Mycobacterium avium subsp. paratuberculosis
gcgaugcccaagccggccag

SEQ ID NO: 2954437 - RNA, 22 nt, Mycobacterium avium subsp. paratuberculosis
gcgaugcccaagccggccaggc

SEQ ID NO: 2954438 - RNA, 19 nt, Mycobacterium avium subsp. paratuberculosis
gcgaugcccacagccaggu

SEQ ID NO: 2954439 - RNA, 14 nt, Mycobacterium avium subsp. paratuberculosis
gcgaugcccgccgg

SEQ ID NO: 2954440 - RNA, 23 nt, Mycobacterium avium subsp. paratuberculosis
gcgaugcccgugaucgccacggc

SEQ ID NO: 2954441 - RNA, 21 nt, Mycobacterium avium subsp. paratuberculosis
gcgaugccgaggauuucgcga

SEQ ID NO: 2954442 - RNA, 16 nt, Mycobacterium avium subsp. paratuberculosis
gcgaugccggccaggc

SEQ ID NO: 2954443 - RNA, 16 nt, Mycobacterium avium subsp. paratuberculosis
gcgaugccguugauca

SEQ ID NO: 2954444 - RNA, 21 nt, Mycobacterium avium subsp. paratuberculosis
gcgaugccuuccucggcgcuc

SEQ ID NO: 2954445 - RNA, 16 nt, Mycobacterium avium subsp. paratuberculosis
gcgaugcgacaccgcg

SEQ ID NO: 2954446 - RNA, 13 nt, Mycobacterium avium subsp. paratuberculosis
gcgaugcgcacca

SEQ ID NO: 2954447 - RNA, 15 nt, Mycobacterium avium subsp. paratuberculosis
gcgaugcgcaccauc

SEQ ID NO: 2954448 - RNA, 12 nt, Mycobacterium avium subsp. paratuberculosis
gcgaugcgcacg

SEQ ID NO: 2954449 - RNA, 21 nt, Mycobacterium avium subsp. paratuberculosis
gcgaugcgcacgucggccgcc

SEQ ID NO: 2954450 - RNA, 17 nt, Mycobacterium avium subsp. paratuberculosis
gcgaugcgcggcccguu

SEQ ID NO: 2954451 - RNA, 14 nt, Mycobacterium avium subsp. paratuberculosis
gcgaugcggcccgg

SEQ ID NO: 2954452 - RNA, 16 nt, Mycobacterium avium subsp. paratuberculosis
gcgaugcggcccggcc

SEQ ID NO: 2954453 - RNA, 17 nt, Mycobacterium avium subsp. paratuberculosis
gcgaugcggcccggcca

SEQ ID NO: 2954454 - RNA, 18 nt, Mycobacterium avium subsp. paratuberculosis
gcgaugcggcccggccac

SEQ ID NO: 2954455 - RNA, 15 nt, Mycobacterium avium subsp. paratuberculosis
gcgaugcgggcgccg

SEQ ID NO: 2954456 - RNA, 16 nt, Mycobacterium avium subsp. paratuberculosis
gcgaugcgggcgccga

SEQ ID NO: 2954457 - RNA, 17 nt, Mycobacterium avium subsp. paratuberculosis
gcgaugcgggcgccgaa

SEQ ID NO: 2954458 - RNA, 16 nt, Mycobacterium avium subsp. paratuberculosis
gcgaugcuauucgggc

SEQ ID NO: 2954459 - RNA, 19 nt, Mycobacterium avium subsp. paratuberculosis
gcgaugcuauucgggccag

SEQ ID NO: 2954460 - RNA, 19 nt, Mycobacterium avium subsp. paratuberculosis
gcgauggaagcgcccgcgc

SEQ ID NO: 2954461 - RNA, 16 nt, Mycobacterium avium subsp. paratuberculosis
gcgauggacagcagcc

SEQ ID NO: 2954462 - RNA, 17 nt, Mycobacterium avium subsp. paratuberculosis
gcgauggacagcagcca

SEQ ID NO: 2954463 - RNA, 15 nt, Mycobacterium avium subsp. paratuberculosis
gcgauggacguccag

SEQ ID NO: 2954464 - RNA, 20 nt, Mycobacterium avium subsp. paratuberculosis
gcgauggacguccagcggcc

SEQ ID NO: 2954465 - RNA, 19 nt, Mycobacterium avium subsp. paratuberculosis
gcgauggaggucccgagga

SEQ ID NO: 2954466 - RNA, 15 nt, Mycobacterium avium subsp. paratuberculosis
gcgauggcccgcugc

SEQ ID NO: 2954467 - RNA, 17 nt, Mycobacterium avium subsp. paratuberculosis
gcgauggcccgcugcgc

SEQ ID NO: 2954468 - RNA, 20 nt, Mycobacterium avium subsp. paratuberculosis
gcgauggcccgcugcgccga

SEQ ID NO: 2954469 - RNA, 14 nt, Mycobacterium avium subsp. paratuberculosis
gcgauggccuccga

SEQ ID NO: 2954470 - RNA, 23 nt, Mycobacterium avium subsp. paratuberculosis
gcgauggccuccgacccguccag

SEQ ID NO: 2954471 - RNA, 18 nt, Mycobacterium avium subsp. paratuberculosis
gcgauggccugcucgcga

SEQ ID NO: 2954472 - RNA, 16 nt, Mycobacterium avium subsp. paratuberculosis
gcgauggcgcggccgg

SEQ ID NO: 2954473 - RNA, 19 nt, Mycobacterium avium subsp. paratuberculosis
gcgauggcgcggccggccg

SEQ ID NO: 2954474 - RNA, 21 nt, Mycobacterium avium subsp. paratuberculosis
gcgauggcgcggccggccgac

SEQ ID NO: 2954475 - RNA, 16 nt, Mycobacterium avium subsp. paratuberculosis
gcgauggcgcuggccg

SEQ ID NO: 2954476 - RNA, 13 nt, Mycobacterium avium subsp. paratuberculosis
gcgauggcggcgc

SEQ ID NO: 2954477 - RNA, 15 nt, Mycobacterium avium subsp. paratuberculosis
gcgauggcggcgcgc

SEQ ID NO: 2954478 - RNA, 16 nt, Mycobacterium avium subsp. paratuberculosis
gcgauggcgggccgcu

SEQ ID NO: 2954479 - RNA, 15 nt, Mycobacterium avium subsp. paratuberculosis
gcgauggcggguugg

SEQ ID NO: 2954480 - RNA, 21 nt, Mycobacterium avium subsp. paratuberculosis
gcgauggcggguuggugucga

SEQ ID NO: 2954481 - RNA, 12 nt, Mycobacterium avium subsp. paratuberculosis
gcgauggcgucg

SEQ ID NO: 2954482 - RNA, 14 nt, Mycobacterium avium subsp. paratuberculosis
gcgauggcgucggc

SEQ ID NO: 2954483 - RNA, 17 nt, Mycobacterium avium subsp. paratuberculosis
gcgauggcgucggccag

SEQ ID NO: 2954484 - RNA, 19 nt, Mycobacterium avium subsp. paratuberculosis
gcgcacaucacgguggccg

SEQ ID NO: 2954485 - RNA, 22 nt, Mycobacterium avium subsp. paratuberculosis
gcgcacaucacgguggccgcca

SEQ ID NO: 2954486 - RNA, 17 nt, Mycobacterium avium subsp. paratuberculosis
gcgcacaucguggcgac

SEQ ID NO: 2954487 - RNA, 19 nt, Mycobacterium avium subsp. paratuberculosis
gcgcacaucguggcgacga

SEQ ID NO: 2954488 - RNA, 22 nt, Mycobacterium avium subsp. paratuberculosis
gcgcaccaaccggccccgagcg

SEQ ID NO: 2954489 - RNA, 20 nt, Mycobacterium avium subsp. paratuberculosis
gcgcaccaccagcucgucgc

SEQ ID NO: 2954490 - RNA, 16 nt, Mycobacterium avium subsp. paratuberculosis
gcgcaccaccucgauc

SEQ ID NO: 2954491 - RNA, 19 nt, Mycobacterium avium subsp. paratuberculosis
gcgcaccaccucgaucggg

SEQ ID NO: 2954492 - RNA, 15 nt, Mycobacterium avium subsp. paratuberculosis
gcgcaccaccucggc

SEQ ID NO: 2954493 - RNA, 17 nt, Mycobacterium avium subsp. paratuberculosis
gcgcaccaccucggcga

SEQ ID NO: 2954494 - RNA, 19 nt, Mycobacterium avium subsp. paratuberculosis
gcgcaccaccucggcgauc

SEQ ID NO: 2954495 - RNA, 22 nt, Mycobacterium avium subsp. paratuberculosis
gcgcaccacgaccuccgugccg

SEQ ID NO: 2954496 - RNA, 17 nt, Mycobacterium avium subsp. paratuberculosis
gcgcaccacgcccgacg

SEQ ID NO: 2954497 - RNA, 21 nt, Mycobacterium avium subsp. paratuberculosis
gcgcaccacgcccgacgacga

SEQ ID NO: 2954498 - RNA, 22 nt, Mycobacterium avium subsp. paratuberculosis
gcgcaccacgucggguucgccg

SEQ ID NO: 2954499 - RNA, 23 nt, Mycobacterium avium subsp. paratuberculosis
gcgcaccacgucggguucgccgg

SEQ ID NO: 2954500 - RNA, 20 nt, Mycobacterium avium subsp. paratuberculosis
gcgcaccagauucaccagcg

SEQ ID NO: 2954501 - RNA, 23 nt, Mycobacterium avium subsp. paratuberculosis
gcgcaccagauucaccagcgccu

SEQ ID NO: 2954502 - RNA, 17 nt, Mycobacterium avium subsp. paratuberculosis
gcgcaccagcaggucuc

SEQ ID NO: 2954503 - RNA, 19 nt, Mycobacterium avium subsp. paratuberculosis
gcgcaccagcucgaggccg

SEQ ID NO: 2954504 - RNA, 12 nt, Mycobacterium avium subsp. paratuberculosis
gcgcaccagcug

SEQ ID NO: 2954505 - RNA, 13 nt, Mycobacterium avium subsp. paratuberculosis
gcgcaccagcuga

SEQ ID NO: 2954506 - RNA, 22 nt, Mycobacterium avium subsp. paratuberculosis
gcgcaccagcugauucgcggug

SEQ ID NO: 2954507 - RNA, 20 nt, Mycobacterium avium subsp. paratuberculosis
gcgcaccaggccgacgcugg

SEQ ID NO: 2954508 - RNA, 22 nt, Mycobacterium avium subsp. paratuberculosis
gcgcaccaggccgacgcuggcc

SEQ ID NO: 2954509 - RNA, 15 nt, Mycobacterium avium subsp. paratuberculosis
gcgcaccaggcgcca

SEQ ID NO: 2954510 - RNA, 23 nt, Mycobacterium avium subsp. paratuberculosis
gcgcaccaggcgccacagcagca

SEQ ID NO: 2954511 - RNA, 17 nt, Mycobacterium avium subsp. paratuberculosis
gcgcaccaucaccugua

SEQ ID NO: 2954512 - RNA, 13 nt, Mycobacterium avium subsp. paratuberculosis
gcgcacccagacg

SEQ ID NO: 2954513 - RNA, 12 nt, Mycobacterium avium subsp. paratuberculosis
gcgcacccagcc

SEQ ID NO: 2954514 - RNA, 13 nt, Mycobacterium avium subsp. paratuberculosis
gcgcacccagccg

SEQ ID NO: 2954515 - RNA, 14 nt, Mycobacterium avium subsp. paratuberculosis
gcgcacccagccgc

SEQ ID NO: 2954516 - RNA, 16 nt, Mycobacterium avium subsp. paratuberculosis
gcgcacccccggggcc

SEQ ID NO: 2954517 - RNA, 21 nt, Mycobacterium avium subsp. paratuberculosis
gcgcacccccuucuccacgcu

SEQ ID NO: 2954518 - RNA, 12 nt, Mycobacterium avium subsp. paratuberculosis
gcgcaccccgaa

SEQ ID NO: 2954519 - RNA, 17 nt, Mycobacterium avium subsp. paratuberculosis
gcgcaccccgaaccagu

SEQ ID NO: 2954520 - RNA, 19 nt, Mycobacterium avium subsp. paratuberculosis
gcgcaccccgaaccgcccg

SEQ ID NO: 2954521 - RNA, 21 nt, Mycobacterium avium subsp. paratuberculosis
gcgcaccccgaaccgcccgcc

SEQ ID NO: 2954522 - RNA, 23 nt, Mycobacterium avium subsp. paratuberculosis
gcgcaccccgaaccgcccgcccg

SEQ ID NO: 2954523 - RNA, 23 nt, Mycobacterium avium subsp. paratuberculosis
gcgcaccccguugccgccggcgc

SEQ ID NO: 2954524 - RNA, 12 nt, Mycobacterium avium subsp. paratuberculosis
gcgcacccgcac

SEQ ID NO: 2954525 - RNA, 21 nt, Mycobacterium avium subsp. paratuberculosis
gcgcacccgcacgugcgcgcc

SEQ ID NO: 2954526 - RNA, 22 nt, Mycobacterium avium subsp. paratuberculosis
gcgcacccgcacgugcgcgccg

SEQ ID NO: 2954527 - RNA, 24 nt, Mycobacterium avium subsp. paratuberculosis
gcgcacccgcacgugcgcgccgac

SEQ ID NO: 2954528 - RNA, 12 nt, Mycobacterium avium subsp. paratuberculosis
gcgcacccgcgg

SEQ ID NO: 2954529 - RNA, 14 nt, Mycobacterium avium subsp. paratuberculosis
gcgcacccgcgggu

SEQ ID NO: 2954530 - RNA, 19 nt, Mycobacterium avium subsp. paratuberculosis
gcgcacccgcgggucgucg

SEQ ID NO: 2954531 - RNA, 20 nt, Mycobacterium avium subsp. paratuberculosis
gcgcacccgcgggucgucgg

SEQ ID NO: 2954532 - RNA, 13 nt, Mycobacterium avium subsp. paratuberculosis
gcgcacccggcca

SEQ ID NO: 2954533 - RNA, 15 nt, Mycobacterium avium subsp. paratuberculosis
gcgcacccggccacg

SEQ ID NO: 2954534 - RNA, 19 nt, Mycobacterium avium subsp. paratuberculosis
gcgcacccggccacgccgg

SEQ ID NO: 2954535 - RNA, 12 nt, Mycobacterium avium subsp. paratuberculosis
gcgcacccggga

SEQ ID NO: 2954536 - RNA, 17 nt, Mycobacterium avium subsp. paratuberculosis
gcgcacccgggaccggu

SEQ ID NO: 2954537 - RNA, 16 nt, Mycobacterium avium subsp. paratuberculosis
gcgcacccgguccggc

SEQ ID NO: 2954538 - RNA, 21 nt, Mycobacterium avium subsp. paratuberculosis
gcgcacccguaacacgaucac

SEQ ID NO: 2954539 - RNA, 22 nt, Mycobacterium avium subsp. paratuberculosis
gcgcacccguaacacgaucacc

SEQ ID NO: 2954540 - RNA, 20 nt, Mycobacterium avium subsp. paratuberculosis
gcgcaccgacaucaccaacc

SEQ ID NO: 2954541 - RNA, 22 nt, Mycobacterium avium subsp. paratuberculosis
gcgcaccgacaucaccaaccgc

SEQ ID NO: 2954542 - RNA, 16 nt, Mycobacterium avium subsp. paratuberculosis
gcgcaccgagcccguu

SEQ ID NO: 2954543 - RNA, 18 nt, Mycobacterium avium subsp. paratuberculosis
gcgcaccgagucggugac

SEQ ID NO: 2954544 - RNA, 19 nt, Mycobacterium avium subsp. paratuberculosis
gcgcaccgagucggugacc

SEQ ID NO: 2954545 - RNA, 16 nt, Mycobacterium avium subsp. paratuberculosis
gcgcaccgcauagcgg

SEQ ID NO: 2954546 - RNA, 13 nt, Mycobacterium avium subsp. paratuberculosis
gcgcaccgccacc

SEQ ID NO: 2954547 - RNA, 14 nt, Mycobacterium avium subsp. paratuberculosis
gcgcaccgccaccg

SEQ ID NO: 2954548 - RNA, 18 nt, Mycobacterium avium subsp. paratuberculosis
gcgcaccgccaccgcgca

SEQ ID NO: 2954549 - RNA, 12 nt, Mycobacterium avium subsp. paratuberculosis
gcgcaccgccag

SEQ ID NO: 2954550 - RNA, 14 nt, Mycobacterium avium subsp. paratuberculosis
gcgcaccgccagca

SEQ ID NO: 2954551 - RNA, 16 nt, Mycobacterium avium subsp. paratuberculosis
gcgcaccgccagcacc

SEQ ID NO: 2954552 - RNA, 19 nt, Mycobacterium avium subsp. paratuberculosis
gcgcaccgccagcaccgac

SEQ ID NO: 2954553 - RNA, 22 nt, Mycobacterium avium subsp. paratuberculosis
gcgcaccgccagcaccgacgcg

SEQ ID NO: 2954554 - RNA, 13 nt, Mycobacterium avium subsp. paratuberculosis
gcgcaccgcccaa

SEQ ID NO: 2954555 - RNA, 12 nt, Mycobacterium avium subsp. paratuberculosis
gcgcaccgcccc

SEQ ID NO: 2954556 - RNA, 12 nt, Mycobacterium avium subsp. paratuberculosis
gcgcaccgccgc

SEQ ID NO: 2954557 - RNA, 20 nt, Mycobacterium avium subsp. paratuberculosis
gcgcaccgccgcgggaugcu

SEQ ID NO: 2954558 - RNA, 14 nt, Mycobacterium avium subsp. paratuberculosis
gcgcaccgccgggc

SEQ ID NO: 2954559 - RNA, 15 nt, Mycobacterium avium subsp. paratuberculosis
gcgcaccgccgucgg

SEQ ID NO: 2954560 - RNA, 12 nt, Mycobacterium avium subsp. paratuberculosis
gcgcaccgcgcg

SEQ ID NO: 2954561 - RNA, 13 nt, Mycobacterium avium subsp. paratuberculosis
gcgcaccgcgcgc

SEQ ID NO: 2954562 - RNA, 15 nt, Mycobacterium avium subsp. paratuberculosis
gcgcaccgcgcgcca

SEQ ID NO: 2954563 - RNA, 16 nt, Mycobacterium avium subsp. paratuberculosis
gcgcaccgcgcgccag

SEQ ID NO: 2954564 - RNA, 13 nt, Mycobacterium avium subsp. paratuberculosis
gcgcaccgcgcgu

SEQ ID NO: 2954565 - RNA, 22 nt, Mycobacterium avium subsp. paratuberculosis
gcgcaccgcggauuccagcgcg

SEQ ID NO: 2954566 - RNA, 13 nt, Mycobacterium avium subsp. paratuberculosis
gcgcaccgcggcc

SEQ ID NO: 2954567 - RNA, 14 nt, Mycobacterium avium subsp. paratuberculosis
gcgcaccgcggccu

SEQ ID NO: 2954568 - RNA, 15 nt, Mycobacterium avium subsp. paratuberculosis
gcgcaccgcggccuc

SEQ ID NO: 2954569 - RNA, 15 nt, Mycobacterium avium subsp. paratuberculosis
gcgcacuuccuccuc

SEQ ID NO: 2954570 - RNA, 17 nt, Mycobacterium avium subsp. paratuberculosis
gcgcacuuccuccucuu

SEQ ID NO: 2954571 - RNA, 15 nt, Mycobacterium avium subsp. paratuberculosis
gcgcagaaaaaggcc

SEQ ID NO: 2954572 - RNA, 19 nt, Mycobacterium avium subsp. paratuberculosis
gcgcagaaaaaggccgccg

SEQ ID NO: 2954573 - RNA, 20 nt, Mycobacterium avium subsp. paratuberculosis
gcgcagaaaaaggccgccgc

SEQ ID NO: 2954574 - RNA, 20 nt, Mycobacterium avium subsp. paratuberculosis
gcgcagaaaccauuccgcca

SEQ ID NO: 2954575 - RNA, 16 nt, Mycobacterium avium subsp. paratuberculosis
gcgcagaaaugggcca

SEQ ID NO: 2954576 - RNA, 21 nt, Mycobacterium avium subsp. paratuberculosis
gcgcagaacaccaccgccagg

SEQ ID NO: 2954577 - RNA, 19 nt, Mycobacterium avium subsp. paratuberculosis
gcgcagaacaccacggugu

SEQ ID NO: 2954578 - RNA, 16 nt, Mycobacterium avium subsp. paratuberculosis
gcgcagaagcuaacgc

SEQ ID NO: 2954579 - RNA, 19 nt, Mycobacterium avium subsp. paratuberculosis
gcgcagaagcuaacgccag

SEQ ID NO: 2954580 - RNA, 14 nt, Mycobacterium avium subsp. paratuberculosis
gcgcagacccggug

SEQ ID NO: 2954581 - RNA, 18 nt, Mycobacterium avium subsp. paratuberculosis
gcgcagacccgguggccg

SEQ ID NO: 2954582 - RNA, 21 nt, Mycobacterium avium subsp. paratuberculosis
gcgcagacccgguggccgagg

SEQ ID NO: 2954583 - RNA, 22 nt, Mycobacterium avium subsp. paratuberculosis
gcgcagaucgagaucagggcgc

SEQ ID NO: 2954584 - RNA, 14 nt, Mycobacterium avium subsp. paratuberculosis
gcgcagaucgccag

SEQ ID NO: 2954585 - RNA, 15 nt, Mycobacterium avium subsp. paratuberculosis
gcgcagaucgccagc

SEQ ID NO: 2954586 - RNA, 19 nt, Mycobacterium avium subsp. paratuberculosis
gcgcagaucgccagcaccg

SEQ ID NO: 2954587 - RNA, 21 nt, Mycobacterium avium subsp. paratuberculosis
gcgcagaucgccagcaccggc

SEQ ID NO: 2954588 - RNA, 23 nt, Mycobacterium avium subsp. paratuberculosis
gcgcagaucgccagcaccggcgc

SEQ ID NO: 2954589 - RNA, 23 nt, Mycobacterium avium subsp. paratuberculosis
gcgcagaucgucgaccugcucgu

SEQ ID NO: 2954590 - RNA, 18 nt, Mycobacterium avium subsp. paratuberculosis
gcgcagaugaccggccug

SEQ ID NO: 2954591 - RNA, 15 nt, Mycobacterium avium subsp. paratuberculosis
gcgcagcaacgguac

SEQ ID NO: 2954592 - RNA, 21 nt, Mycobacterium avium subsp. paratuberculosis
gcgcagcaacgguacgugcgc

SEQ ID NO: 2954593 - RNA, 21 nt, Mycobacterium avium subsp. paratuberculosis
gcgcagcaauugacgccgaca

SEQ ID NO: 2954594 - RNA, 13 nt, Mycobacterium avium subsp. paratuberculosis
gcgcagcaccagg

SEQ ID NO: 2954595 - RNA, 16 nt, Mycobacterium avium subsp. paratuberculosis
gcgcagcaccaggccc

SEQ ID NO: 2954596 - RNA, 17 nt, Mycobacterium avium subsp. paratuberculosis
gcgcagcaccaggcccu

SEQ ID NO: 2954597 - RNA, 13 nt, Mycobacterium avium subsp. paratuberculosis
gcgcagcaccauc

SEQ ID NO: 2954598 - RNA, 19 nt, Mycobacterium avium subsp. paratuberculosis
gcgcagcaccauccgcgcg

SEQ ID NO: 2954599 - RNA, 12 nt, Mycobacterium avium subsp. paratuberculosis
gcgcagcaccgc

SEQ ID NO: 2954600 - RNA, 14 nt, Mycobacterium avium subsp. paratuberculosis
gcgcagcaccgcgu

SEQ ID NO: 2954601 - RNA, 16 nt, Mycobacterium avium subsp. paratuberculosis
gcgcagcaccgcgucg

SEQ ID NO: 2954602 - RNA, 20 nt, Mycobacterium avium subsp. paratuberculosis
gcgcagcaccgcgucggcgc

SEQ ID NO: 2954603 - RNA, 13 nt, Mycobacterium avium subsp. paratuberculosis
gcgcagcaccguc

SEQ ID NO: 2954604 - RNA, 12 nt, Mycobacterium avium subsp. paratuberculosis
gcgcagcaccuc

SEQ ID NO: 2954605 - RNA, 13 nt, Mycobacterium avium subsp. paratuberculosis
gcgcagcaccucc

SEQ ID NO: 2954606 - RNA, 17 nt, Mycobacterium avium subsp. paratuberculosis
gcgcagcaccuccgaca

SEQ ID NO: 2954607 - RNA, 22 nt, Mycobacterium avium subsp. paratuberculosis
gcgcagcaccuccugggugagc

SEQ ID NO: 2954608 - RNA, 17 nt, Mycobacterium avium subsp. paratuberculosis
gcgcagcaccuugccgg

SEQ ID NO: 2954609 - RNA, 22 nt, Mycobacterium avium subsp. paratuberculosis
gcgcagcacgaugaucccgagg

SEQ ID NO: 2954610 - RNA, 17 nt, Mycobacterium avium subsp. paratuberculosis
gcgcagcacggccacug

SEQ ID NO: 2954611 - RNA, 18 nt, Mycobacterium avium subsp. paratuberculosis
gcgcagcacggccacugc

SEQ ID NO: 2954612 - RNA, 20 nt, Mycobacterium avium subsp. paratuberculosis
gcgcagcacggccacugccc

SEQ ID NO: 2954613 - RNA, 19 nt, Mycobacterium avium subsp. paratuberculosis
gcgcagcacguguucggga

SEQ ID NO: 2954614 - RNA, 17 nt, Mycobacterium avium subsp. paratuberculosis
gcgcagcacugagcggc

SEQ ID NO: 2954615 - RNA, 15 nt, Mycobacterium avium subsp. paratuberculosis
gcgcagcagcagguc

SEQ ID NO: 2954616 - RNA, 19 nt, Mycobacterium avium subsp. paratuberculosis
gcgcagcagcaggucggcc

SEQ ID NO: 2954617 - RNA, 21 nt, Mycobacterium avium subsp. paratuberculosis
gcgcagcagcaggucggccag

SEQ ID NO: 2954618 - RNA, 22 nt, Mycobacterium avium subsp. paratuberculosis
gcgcagcagcaggucggccagc

SEQ ID NO: 2954619 - RNA, 13 nt, Mycobacterium avium subsp. paratuberculosis
gcgcagcagccag

SEQ ID NO: 2954620 - RNA, 19 nt, Mycobacterium avium subsp. paratuberculosis
gcgcagcagccaggacagc

SEQ ID NO: 2954621 - RNA, 23 nt, Mycobacterium avium subsp. paratuberculosis
gcgcagcagccaggacagcguca

SEQ ID NO: 2954622 - RNA, 14 nt, Mycobacterium avium subsp. paratuberculosis
gcgcagcagcgcca

SEQ ID NO: 2954623 - RNA, 16 nt, Mycobacterium avium subsp. paratuberculosis
gcgcagcagcgccagc

SEQ ID NO: 2954624 - RNA, 17 nt, Mycobacterium avium subsp. paratuberculosis
gcgcagcagcgccagca

SEQ ID NO: 2954625 - RNA, 19 nt, Mycobacterium avium subsp. paratuberculosis
gcgcagcagcgccagcagc

SEQ ID NO: 2954626 - RNA, 22 nt, Mycobacterium avium subsp. paratuberculosis
gcgcagcagcgccagcagcggc

SEQ ID NO: 2954627 - RNA, 12 nt, Mycobacterium avium subsp. paratuberculosis
gcgcagcagcgg

SEQ ID NO: 2954628 - RNA, 16 nt, Mycobacterium avium subsp. paratuberculosis
gcgcagcagcggcuug

SEQ ID NO: 2954629 - RNA, 23 nt, Mycobacterium avium subsp. paratuberculosis
gcgcagcagcggcuugagcgcca

SEQ ID NO: 2954630 - RNA, 13 nt, Mycobacterium avium subsp. paratuberculosis
gcgcagcagcucg

SEQ ID NO: 2954631 - RNA, 16 nt, Mycobacterium avium subsp. paratuberculosis
gcgcagcagcucgucg

SEQ ID NO: 2954632 - RNA, 22 nt, Mycobacterium avium subsp. paratuberculosis
gcgcagcagcucgucguacucg

SEQ ID NO: 2954633 - RNA, 21 nt, Mycobacterium avium subsp. paratuberculosis
gcgcagcagguaaaccagcag

SEQ ID NO: 2954634 - RNA, 22 nt, Mycobacterium avium subsp. paratuberculosis
gcgcagcagguaaaccagcagc

SEQ ID NO: 2954635 - RNA, 13 nt, Mycobacterium avium subsp. paratuberculosis
gcgcagcaucacg

SEQ ID NO: 2954636 - RNA, 16 nt, Mycobacterium avium subsp. paratuberculosis
gcgcagcaucacgucg

SEQ ID NO: 2954637 - RNA, 20 nt, Mycobacterium avium subsp. paratuberculosis
gcgcagcaucacgucggcga

SEQ ID NO: 2954638 - RNA, 15 nt, Mycobacterium avium subsp. paratuberculosis
gcgcagcauccgcac

SEQ ID NO: 2954639 - RNA, 16 nt, Mycobacterium avium subsp. paratuberculosis
gcgcagcauccgcacc

SEQ ID NO: 2954640 - RNA, 17 nt, Mycobacterium avium subsp. paratuberculosis
gcgcagcaucggcagau

SEQ ID NO: 2954641 - RNA, 19 nt, Mycobacterium avium subsp. paratuberculosis
gcgcagcaucuccgagucg

SEQ ID NO: 2954642 - RNA, 18 nt, Mycobacterium avium subsp. paratuberculosis
gcgcagcaucucuugaug

SEQ ID NO: 2954643 - RNA, 22 nt, Mycobacterium avium subsp. paratuberculosis
gcgcagcauggcccacaggacg

SEQ ID NO: 2954644 - RNA, 13 nt, Mycobacterium avium subsp. paratuberculosis
gcgcagccaccgc

SEQ ID NO: 2954645 - RNA, 17 nt, Mycobacterium avium subsp. paratuberculosis
gcgcagccaccgcccga

SEQ ID NO: 2954646 - RNA, 19 nt, Mycobacterium avium subsp. paratuberculosis
gcgcagccagaccucgccg

SEQ ID NO: 2954647 - RNA, 23 nt, Mycobacterium avium subsp. paratuberculosis
gcgcagccagaccucgccgacgg

SEQ ID NO: 2954648 - RNA, 16 nt, Mycobacterium avium subsp. paratuberculosis
gcgcagccagcgccgc

SEQ ID NO: 2954649 - RNA, 13 nt, Mycobacterium avium subsp. paratuberculosis
gcgcagccagcgg

SEQ ID NO: 2954650 - RNA, 15 nt, Mycobacterium avium subsp. paratuberculosis
gcgcagccagcgguc

SEQ ID NO: 2954651 - RNA, 19 nt, Mycobacterium avium subsp. paratuberculosis
gcgcagccagucgccggcc

SEQ ID NO: 2954652 - RNA, 23 nt, Mycobacterium avium subsp. paratuberculosis
gcgcagccagucgccggccaggc

SEQ ID NO: 2954653 - RNA, 14 nt, Mycobacterium avium subsp. paratuberculosis
gcgcagcugcgccg

SEQ ID NO: 2954654 - RNA, 20 nt, Mycobacterium avium subsp. paratuberculosis
gcgcagcugcgccgcgucga

SEQ ID NO: 2954655 - RNA, 14 nt, Mycobacterium avium subsp. paratuberculosis
gcgcagcuggccgu

SEQ ID NO: 2954656 - RNA, 22 nt, Mycobacterium avium subsp. paratuberculosis
gcgcagcuggccgugcaccguc

SEQ ID NO: 2954657 - RNA, 16 nt, Mycobacterium avium subsp. paratuberculosis
gcgcaggaacagcgac

SEQ ID NO: 2954658 - RNA, 17 nt, Mycobacterium avium subsp. paratuberculosis
gcgcaggaacuccagca

SEQ ID NO: 2954659 - RNA, 20 nt, Mycobacterium avium subsp. paratuberculosis
gcgcaggaacuccagcagcu

SEQ ID NO: 2954660 - RNA, 21 nt, Mycobacterium avium subsp. paratuberculosis
gcgcaggaacuccagcagcug

SEQ ID NO: 2954661 - RNA, 16 nt, Mycobacterium avium subsp. paratuberculosis
gcgcaggaggcggcca

SEQ ID NO: 2954662 - RNA, 18 nt, Mycobacterium avium subsp. paratuberculosis
gcgcaggaggcggccaac

SEQ ID NO: 2954663 - RNA, 18 nt, Mycobacterium avium subsp. paratuberculosis
gcgcaggaugcccagcac

SEQ ID NO: 2954664 - RNA, 14 nt, Mycobacterium avium subsp. paratuberculosis
gcgcaggccccggc

SEQ ID NO: 2954665 - RNA, 16 nt, Mycobacterium avium subsp. paratuberculosis
gcgcaggccccggcgc

SEQ ID NO: 2954666 - RNA, 17 nt, Mycobacterium avium subsp. paratuberculosis
gcgcaggccgccgacga

SEQ ID NO: 2954667 - RNA, 16 nt, Mycobacterium avium subsp. paratuberculosis
gcgcaggccguccagc

SEQ ID NO: 2954668 - RNA, 17 nt, Mycobacterium avium subsp. paratuberculosis
gcgcaggccguccagca

SEQ ID NO: 2954669 - RNA, 19 nt, Mycobacterium avium subsp. paratuberculosis
gcgcaggccguccagcagc

SEQ ID NO: 2954670 - RNA, 20 nt, Mycobacterium avium subsp. paratuberculosis
gcgcaggccguccagcagca

SEQ ID NO: 2954671 - RNA, 21 nt, Mycobacterium avium subsp. paratuberculosis
gcgcaggccguccagcagcag

SEQ ID NO: 2954672 - RNA, 14 nt, Mycobacterium avium subsp. paratuberculosis
gcgcaggccguugu

SEQ ID NO: 2954673 - RNA, 22 nt, Mycobacterium avium subsp. paratuberculosis
gcgcaggccguuguggccaccc

SEQ ID NO: 2954674 - RNA, 14 nt, Mycobacterium avium subsp. paratuberculosis
gcgcaggcgcacca

SEQ ID NO: 2954675 - RNA, 12 nt, Mycobacterium avium subsp. paratuberculosis
gcgcaggcgcgc

SEQ ID NO: 2954676 - RNA, 16 nt, Mycobacterium avium subsp. paratuberculosis
gcgcaggcgcgcggcc

SEQ ID NO: 2954677 - RNA, 18 nt, Mycobacterium avium subsp. paratuberculosis
gcgcaggcgcgcggccag

SEQ ID NO: 2954678 - RNA, 19 nt, Mycobacterium avium subsp. paratuberculosis
gcgcaggcgcgcggccagc

SEQ ID NO: 2954679 - RNA, 14 nt, Mycobacterium avium subsp. paratuberculosis
gcgcaggcgcuggg

SEQ ID NO: 2954680 - RNA, 15 nt, Mycobacterium avium subsp. paratuberculosis
gcgcaggcggcgacg

SEQ ID NO: 2954681 - RNA, 18 nt, Mycobacterium avium subsp. paratuberculosis
gcgcaggcggcgacggcc

SEQ ID NO: 2954682 - RNA, 14 nt, Mycobacterium avium subsp. paratuberculosis
gcgcaggcggcgcg

SEQ ID NO: 2954683 - RNA, 15 nt, Mycobacterium avium subsp. paratuberculosis
gcgcaggcggcgcgc

SEQ ID NO: 2954684 - RNA, 16 nt, Mycobacterium avium subsp. paratuberculosis
gcgcaggcggcgcgca

SEQ ID NO: 2954685 - RNA, 17 nt, Mycobacterium avium subsp. paratuberculosis
gcgcaggcggcgcgcag

SEQ ID NO: 2954686 - RNA, 20 nt, Mycobacterium avium subsp. paratuberculosis
gcgcaggcggcgcgcagccg

SEQ ID NO: 2954687 - RNA, 21 nt, Mycobacterium avium subsp. paratuberculosis
gcgcaggcuggcaucgucggc

SEQ ID NO: 2954688 - RNA, 23 nt, Mycobacterium avium subsp. paratuberculosis
gcgcaggcuggcaucgucggcgc

SEQ ID NO: 2954689 - RNA, 20 nt, Mycobacterium avium subsp. paratuberculosis
gcgcagggacgggcgugacg

SEQ ID NO: 2954690 - RNA, 21 nt, Mycobacterium avium subsp. paratuberculosis
gcgcagggccagcgccucggc

SEQ ID NO: 2954691 - RNA, 15 nt, Mycobacterium avium subsp. paratuberculosis
gcgcagggcgaacgg

SEQ ID NO: 2954692 - RNA, 23 nt, Mycobacterium avium subsp. paratuberculosis
gcgcagggcgaacuugcuggccg

SEQ ID NO: 2954693 - RNA, 17 nt, Mycobacterium avium subsp. paratuberculosis
gcgcagggcggccggcc

SEQ ID NO: 2954694 - RNA, 19 nt, Mycobacterium avium subsp. paratuberculosis
gcgcagggcggccggccag

SEQ ID NO: 2954695 - RNA, 17 nt, Mycobacterium avium subsp. paratuberculosis
gcgcagggcguucgacg

SEQ ID NO: 2954696 - RNA, 14 nt, Mycobacterium avium subsp. paratuberculosis
gcgcagggucagcg

SEQ ID NO: 2954697 - RNA, 16 nt, Mycobacterium avium subsp. paratuberculosis
gcgcagguacgcggcg

SEQ ID NO: 2954698 - RNA, 16 nt, Mycobacterium avium subsp. paratuberculosis
gcgcagguagccgccg

SEQ ID NO: 2954699 - RNA, 14 nt, Mycobacterium avium subsp. paratuberculosis
gcgcagguaggugg

SEQ ID NO: 2954700 - RNA, 13 nt, Mycobacterium avium subsp. paratuberculosis
gcgcagguccacc

SEQ ID NO: 2954701 - RNA, 14 nt, Mycobacterium avium subsp. paratuberculosis
gcgcagguccaccc

SEQ ID NO: 2954702 - RNA, 19 nt, Mycobacterium avium subsp. paratuberculosis
gcgcagguccacccgcccc

SEQ ID NO: 2954703 - RNA, 16 nt, Mycobacterium avium subsp. paratuberculosis
gcgcagguccguggug

SEQ ID NO: 2954704 - RNA, 23 nt, Mycobacterium avium subsp. paratuberculosis
gcgcagguccguggugaucgccg

SEQ ID NO: 2954705 - RNA, 20 nt, Mycobacterium avium subsp. paratuberculosis
gcgcagguccucggacucgu

SEQ ID NO: 2954706 - RNA, 15 nt, Mycobacterium avium subsp. paratuberculosis
gcgcaggucgggccg

SEQ ID NO: 2954707 - RNA, 19 nt, Mycobacterium avium subsp. paratuberculosis
gcgcaggucgggccggccg

SEQ ID NO: 2954708 - RNA, 15 nt, Mycobacterium avium subsp. paratuberculosis
gcgcaggucguccga

SEQ ID NO: 2954709 - RNA, 22 nt, Mycobacterium avium subsp. paratuberculosis
gcgcaggugaugcggcccgacc

SEQ ID NO: 2954710 - RNA, 16 nt, Mycobacterium avium subsp. paratuberculosis
gcgcaggugggcggug

SEQ ID NO: 2954711 - RNA, 19 nt, Mycobacterium avium subsp. paratuberculosis
gcgcagguuguccagccgg

SEQ ID NO: 2954712 - RNA, 20 nt, Mycobacterium avium subsp. paratuberculosis
gcgcagguuguccagccggu

SEQ ID NO: 2954713 - RNA, 22 nt, Mycobacterium avium subsp. paratuberculosis
gcgcagguuguccagccggugc

SEQ ID NO: 2954714 - RNA, 16 nt, Mycobacterium avium subsp. paratuberculosis
gcgcagguugucggcc

SEQ ID NO: 2954715 - RNA, 17 nt, Mycobacterium avium subsp. paratuberculosis
gcgcagguugucggcca

SEQ ID NO: 2954716 - RNA, 17 nt, Mycobacterium avium subsp. paratuberculosis
gcgcaguagccgacgug

SEQ ID NO: 2954717 - RNA, 24 nt, Mycobacterium avium subsp. paratuberculosis
gcgcaguagcgcauaggccgcgag

SEQ ID NO: 2954718 - RNA, 19 nt, Mycobacterium avium subsp. paratuberculosis
gcgcaguccaggguggugg

SEQ ID NO: 2954719 - RNA, 20 nt, Mycobacterium avium subsp. paratuberculosis
gcgcaguccagggugguggu

SEQ ID NO: 2954720 - RNA, 14 nt, Mycobacterium avium subsp. paratuberculosis
gcgcagucgcaggc

SEQ ID NO: 2954721 - RNA, 15 nt, Mycobacterium avium subsp. paratuberculosis
gcgcagucgcaggcc

SEQ ID NO: 2954722 - RNA, 17 nt, Mycobacterium avium subsp. paratuberculosis
gcgcagucgcuggucga

SEQ ID NO: 2954723 - RNA, 13 nt, Mycobacterium avium subsp. paratuberculosis
gcgcagucggcgu

SEQ ID NO: 2954724 - RNA, 14 nt, Mycobacterium avium subsp. paratuberculosis
gcgcagucggcguc

SEQ ID NO: 2954725 - RNA, 17 nt, Mycobacterium avium subsp. paratuberculosis
gcgcagucggcgucgcg

SEQ ID NO: 2954726 - RNA, 13 nt, Mycobacterium avium subsp. paratuberculosis
gcgcaguggacgg

SEQ ID NO: 2954727 - RNA, 16 nt, Mycobacterium avium subsp. paratuberculosis
gcgcaguuaccggcgu

SEQ ID NO: 2954728 - RNA, 15 nt, Mycobacterium avium subsp. paratuberculosis
gcgcaguucaccgaa

SEQ ID NO: 2954729 - RNA, 23 nt, Mycobacterium avium subsp. paratuberculosis
gcgcaguucaccgaaguccgcca

SEQ ID NO: 2954730 - RNA, 16 nt, Mycobacterium avium subsp. paratuberculosis
gcgcaguucgaccggc

SEQ ID NO: 2954731 - RNA, 20 nt, Mycobacterium avium subsp. paratuberculosis
gcgcaguucgaccggcacca

SEQ ID NO: 2954732 - RNA, 23 nt, Mycobacterium avium subsp. paratuberculosis
gcgcaguucgaccggcaccagca

SEQ ID NO: 2954733 - RNA, 19 nt, Mycobacterium avium subsp. paratuberculosis
gcgcaguucgggaucgucg

SEQ ID NO: 2954734 - RNA, 22 nt, Mycobacterium avium subsp. paratuberculosis
gcgcaguucgggaucgucgccg

SEQ ID NO: 2954735 - RNA, 23 nt, Mycobacterium avium subsp. paratuberculosis
gcgcaguucgggaucgucgccgg

SEQ ID NO: 2954736 - RNA, 24 nt, Mycobacterium avium subsp. paratuberculosis
gcgcaguucgggaucgucgccggg

SEQ ID NO: 2954737 - RNA, 14 nt, Mycobacterium avium subsp. paratuberculosis
gcgccacagcagca

SEQ ID NO: 2954738 - RNA, 18 nt, Mycobacterium avium subsp. paratuberculosis
gcgccacagcagcaccag

SEQ ID NO: 2954739 - RNA, 19 nt, Mycobacterium avium subsp. paratuberculosis
gcgccacagcagcaccagc

SEQ ID NO: 2954740 - RNA, 22 nt, Mycobacterium avium subsp. paratuberculosis
gcgccacagcagcaccagcgcg

SEQ ID NO: 2954741 - RNA, 23 nt, Mycobacterium avium subsp. paratuberculosis
gcgccacagccggggaucgcgca

SEQ ID NO: 2954742 - RNA, 24 nt, Mycobacterium avium subsp. paratuberculosis
gcgccacagcgucucgaccgcggu

SEQ ID NO: 2954743 - RNA, 12 nt, Mycobacterium avium subsp. paratuberculosis
gcgccacaucag

SEQ ID NO: 2954744 - RNA, 19 nt, Mycobacterium avium subsp. paratuberculosis
gcgccacaucagcucggcg

SEQ ID NO: 2954745 - RNA, 20 nt, Mycobacterium avium subsp. paratuberculosis
gcgccacaucagcucggcgg

SEQ ID NO: 2954746 - RNA, 13 nt, Mycobacterium avium subsp. paratuberculosis
gcgccaccagcac

SEQ ID NO: 2954747 - RNA, 19 nt, Mycobacterium avium subsp. paratuberculosis
gcgccaccagcaccgggaa

SEQ ID NO: 2954748 - RNA, 19 nt, Mycobacterium avium subsp. paratuberculosis
gcgccaccagccacaccgc

SEQ ID NO: 2954749 - RNA, 15 nt, Mycobacterium avium subsp. paratuberculosis
gcgccaccagcuccu

SEQ ID NO: 2954750 - RNA, 17 nt, Mycobacterium avium subsp. paratuberculosis
gcgccaccagcuccucg

SEQ ID NO: 2954751 - RNA, 13 nt, Mycobacterium avium subsp. paratuberculosis
gcgccaccaggcg

SEQ ID NO: 2954752 - RNA, 19 nt, Mycobacterium avium subsp. paratuberculosis
gcgccaccccgaacccggc

SEQ ID NO: 2954753 - RNA, 22 nt, Mycobacterium avium subsp. paratuberculosis
gcgccaccccgaacccggccag

SEQ ID NO: 2954754 - RNA, 15 nt, Mycobacterium avium subsp. paratuberculosis
gcgccaccccgagcu

SEQ ID NO: 2954755 - RNA, 12 nt, Mycobacterium avium subsp. paratuberculosis
gcgccacccgca

SEQ ID NO: 2954756 - RNA, 15 nt, Mycobacterium avium subsp. paratuberculosis
gcgccaccgacacca

SEQ ID NO: 2954757 - RNA, 20 nt, Mycobacterium avium subsp. paratuberculosis
gcgccaccgacaccaccggc

SEQ ID NO: 2954758 - RNA, 22 nt, Mycobacterium avium subsp. paratuberculosis
gcgccaccgacaccaccggccg

SEQ ID NO: 2954759 - RNA, 12 nt, Mycobacterium avium subsp. paratuberculosis
gcgccaccgagg

SEQ ID NO: 2954760 - RNA, 17 nt, Mycobacterium avium subsp. paratuberculosis
gcgccaccgaggccagc

SEQ ID NO: 2954761 - RNA, 20 nt, Mycobacterium avium subsp. paratuberculosis
gcgccaccgaggccagcaga

SEQ ID NO: 2954762 - RNA, 14 nt, Mycobacterium avium subsp. paratuberculosis
gcgccaccgcgggg

SEQ ID NO: 2954763 - RNA, 22 nt, Mycobacterium avium subsp. paratuberculosis
gcgccaccgcggggcugggcgc

SEQ ID NO: 2954764 - RNA, 24 nt, Mycobacterium avium subsp. paratuberculosis
gcgccaccgcggggcugggcgcca

SEQ ID NO: 2954765 - RNA, 18 nt, Mycobacterium avium subsp. paratuberculosis
gcgccaccggcuggccgg

SEQ ID NO: 2954766 - RNA, 12 nt, Mycobacterium avium subsp. paratuberculosis
gcgccaccgggu

SEQ ID NO: 2954767 - RNA, 13 nt, Mycobacterium avium subsp. paratuberculosis
gcgccaccgggua

SEQ ID NO: 2954768 - RNA, 17 nt, Mycobacterium avium subsp. paratuberculosis
gcgccacgacauccccg

SEQ ID NO: 2954769 - RNA, 13 nt, Mycobacterium avium subsp. paratuberculosis
gcgccacgaccag

SEQ ID NO: 2954770 - RNA, 19 nt, Mycobacterium avium subsp. paratuberculosis
gcgccacgaccagcggcag

SEQ ID NO: 2954771 - RNA, 20 nt, Mycobacterium avium subsp. paratuberculosis
gcgccacgaccagcggcagc

SEQ ID NO: 2954772 - RNA, 16 nt, Mycobacterium avium subsp. paratuberculosis
gcgccacgacugcgcg

SEQ ID NO: 2954773 - RNA, 20 nt, Mycobacterium avium subsp. paratuberculosis
gcgccacgacugcgcggccg

SEQ ID NO: 2954774 - RNA, 22 nt, Mycobacterium avium subsp. paratuberculosis
gcgccacgacugcgcggccggc

SEQ ID NO: 2954775 - RNA, 18 nt, Mycobacterium avium subsp. paratuberculosis
gcgccacgcacaccgcgc

SEQ ID NO: 2954776 - RNA, 19 nt, Mycobacterium avium subsp. paratuberculosis
gcgccacgcacaccgcgcg

SEQ ID NO: 2954777 - RNA, 15 nt, Mycobacterium avium subsp. paratuberculosis
gcgccacgccccggc

SEQ ID NO: 2954778 - RNA, 16 nt, Mycobacterium avium subsp. paratuberculosis
gcgccacgccccggcg

SEQ ID NO: 2954779 - RNA, 17 nt, Mycobacterium avium subsp. paratuberculosis
gcgccacgccccggcgc

SEQ ID NO: 2954780 - RNA, 18 nt, Mycobacterium avium subsp. paratuberculosis
gcgccacgccccggcgcc

SEQ ID NO: 2954781 - RNA, 19 nt, Mycobacterium avium subsp. paratuberculosis
gcgccacgccccggcgccg

SEQ ID NO: 2954782 - RNA, 21 nt, Mycobacterium avium subsp. paratuberculosis
gcgccacgccccggcgccguc

SEQ ID NO: 2954783 - RNA, 16 nt, Mycobacterium avium subsp. paratuberculosis
gcgccacgcccgcagc

SEQ ID NO: 2954784 - RNA, 17 nt, Mycobacterium avium subsp. paratuberculosis
gcgccacgcccgcagcg

SEQ ID NO: 2954785 - RNA, 16 nt, Mycobacterium avium subsp. paratuberculosis
gcgccacgcgcagggc

SEQ ID NO: 2954786 - RNA, 20 nt, Mycobacterium avium subsp. paratuberculosis
gcgccacgcucaugcccgcc

SEQ ID NO: 2954787 - RNA, 13 nt, Mycobacterium avium subsp. paratuberculosis
gcgccacgcuggc

SEQ ID NO: 2954788 - RNA, 14 nt, Mycobacterium avium subsp. paratuberculosis
gcgccacgcuggcg

SEQ ID NO: 2954789 - RNA, 20 nt, Mycobacterium avium subsp. paratuberculosis
gcgccacgcuggcgugacgc

SEQ ID NO: 2954790 - RNA, 13 nt, Mycobacterium avium subsp. paratuberculosis
gcgccacggggcg

SEQ ID NO: 2954791 - RNA, 16 nt, Mycobacterium avium subsp. paratuberculosis
gcgccacggggcgccg

SEQ ID NO: 2954792 - RNA, 13 nt, Mycobacterium avium subsp. paratuberculosis
gcgccacgguggc

SEQ ID NO: 2954793 - RNA, 24 nt, Mycobacterium avium subsp. paratuberculosis
gcgccacgguggcggucaggguca

SEQ ID NO: 2954794 - RNA, 18 nt, Mycobacterium avium subsp. paratuberculosis
gcgccacguggucgagca

SEQ ID NO: 2954795 - RNA, 20 nt, Mycobacterium avium subsp. paratuberculosis
gcgccacugccgccgcccag

SEQ ID NO: 2954796 - RNA, 21 nt, Mycobacterium avium subsp. paratuberculosis
gcgccacugccgccgcccagg

SEQ ID NO: 2954797 - RNA, 20 nt, Mycobacterium avium subsp. paratuberculosis
gcgccacuggcuggucaccc

SEQ ID NO: 2954798 - RNA, 18 nt, Mycobacterium avium subsp. paratuberculosis
gcgccacuucuccacgcc

SEQ ID NO: 2954799 - RNA, 19 nt, Mycobacterium avium subsp. paratuberculosis
gcgccacuucuccacgccg

SEQ ID NO: 2954800 - RNA, 20 nt, Mycobacterium avium subsp. paratuberculosis
gcgccacuucuccacgccga

SEQ ID NO: 2954801 - RNA, 23 nt, Mycobacterium avium subsp. paratuberculosis
gcgccacuucuccacgccgacga

SEQ ID NO: 2954802 - RNA, 17 nt, Mycobacterium avium subsp. paratuberculosis
gcgccacuuguccacca

SEQ ID NO: 2954803 - RNA, 16 nt, Mycobacterium avium subsp. paratuberculosis
gcgccagacguccagc

SEQ ID NO: 2954804 - RNA, 21 nt, Mycobacterium avium subsp. paratuberculosis
gcgccagacguccagcgccgc

SEQ ID NO: 2954805 - RNA, 17 nt, Mycobacterium avium subsp. paratuberculosis
gcgccagagacaaccgc

SEQ ID NO: 2954806 - RNA, 19 nt, Mycobacterium avium subsp. paratuberculosis
gcgccagaucagcgugguc

SEQ ID NO: 2954807 - RNA, 20 nt, Mycobacterium avium subsp. paratuberculosis
gcgccagaucagcgugguca

SEQ ID NO: 2954808 - RNA, 12 nt, Mycobacterium avium subsp. paratuberculosis
gcgccagcaccg

SEQ ID NO: 2954809 - RNA, 14 nt, Mycobacterium avium subsp. paratuberculosis
gcgccagcaccgcc

SEQ ID NO: 2954810 - RNA, 15 nt, Mycobacterium avium subsp. paratuberculosis
gcgccagcaccgccu

SEQ ID NO: 2954811 - RNA, 20 nt, Mycobacterium avium subsp. paratuberculosis
gcgccagcaccgccuggguc

SEQ ID NO: 2954812 - RNA, 14 nt, Mycobacterium avium subsp. paratuberculosis
gcgccagcaccggg

SEQ ID NO: 2954813 - RNA, 15 nt, Mycobacterium avium subsp. paratuberculosis
gcgccagcaccgggc

SEQ ID NO: 2954814 - RNA, 17 nt, Mycobacterium avium subsp. paratuberculosis
gcgccagcaccgggccc

SEQ ID NO: 2954815 - RNA, 18 nt, Mycobacterium avium subsp. paratuberculosis
gcgccagcaccgggccca

SEQ ID NO: 2954816 - RNA, 20 nt, Mycobacterium avium subsp. paratuberculosis
gcgccagcaccgggcccagc

SEQ ID NO: 2954817 - RNA, 13 nt, Mycobacterium avium subsp. paratuberculosis
gcgccagcaccuc

SEQ ID NO: 2954818 - RNA, 14 nt, Mycobacterium avium subsp. paratuberculosis
gcgccagcaccucg

SEQ ID NO: 2954819 - RNA, 20 nt, Mycobacterium avium subsp. paratuberculosis
gcgccagcaccucgaacgcc

SEQ ID NO: 2954820 - RNA, 16 nt, Mycobacterium avium subsp. paratuberculosis
gcgccagcaccucggc

SEQ ID NO: 2954821 - RNA, 19 nt, Mycobacterium avium subsp. paratuberculosis
gcgccagcaccucggcgac

SEQ ID NO: 2954822 - RNA, 14 nt, Mycobacterium avium subsp. paratuberculosis
gcgccauccccgcu

SEQ ID NO: 2954823 - RNA, 19 nt, Mycobacterium avium subsp. paratuberculosis
gcgccauccccgcuucggc

SEQ ID NO: 2954824 - RNA, 21 nt, Mycobacterium avium subsp. paratuberculosis
gcgccauccccgcuucggcuc

SEQ ID NO: 2954825 - RNA, 14 nt, Mycobacterium avium subsp. paratuberculosis
gcgccauccgcagc

SEQ ID NO: 2954826 - RNA, 22 nt, Mycobacterium avium subsp. paratuberculosis
gcgccauccgcagcccgucgau

SEQ ID NO: 2954827 - RNA, 13 nt, Mycobacterium avium subsp. paratuberculosis
gcgccauccgcca

SEQ ID NO: 2954828 - RNA, 16 nt, Mycobacterium avium subsp. paratuberculosis
gcgccauccgccaccc

SEQ ID NO: 2954829 - RNA, 19 nt, Mycobacterium avium subsp. paratuberculosis
gcgccauccgccgguucgu

SEQ ID NO: 2954830 - RNA, 15 nt, Mycobacterium avium subsp. paratuberculosis
gcgccaugaacggcg

SEQ ID NO: 2954831 - RNA, 23 nt, Mycobacterium avium subsp. paratuberculosis
gcgccaugaacggcggggccucc

SEQ ID NO: 2954832 - RNA, 21 nt, Mycobacterium avium subsp. paratuberculosis
gcgccaugaacuccgacucca

SEQ ID NO: 2954833 - RNA, 13 nt, Mycobacterium avium subsp. paratuberculosis
gcgccaugccgcc

SEQ ID NO: 2954834 - RNA, 15 nt, Mycobacterium avium subsp. paratuberculosis
gcgccaugccgccga

SEQ ID NO: 2954835 - RNA, 17 nt, Mycobacterium avium subsp. paratuberculosis
gcgccaugccgccgacc

SEQ ID NO: 2954836 - RNA, 12 nt, Mycobacterium avium subsp. paratuberculosis
gcgccaugcgcc

SEQ ID NO: 2954837 - RNA, 16 nt, Mycobacterium avium subsp. paratuberculosis
gcgccaugcgccgcgc

SEQ ID NO: 2954838 - RNA, 16 nt, Mycobacterium avium subsp. paratuberculosis
gcgccauguccggcag

SEQ ID NO: 2954839 - RNA, 21 nt, Mycobacterium avium subsp. paratuberculosis
gcgccauguccggcaggcuca

SEQ ID NO: 2954840 - RNA, 20 nt, Mycobacterium avium subsp. paratuberculosis
gcgccauguccuuggugaug

SEQ ID NO: 2954841 - RNA, 23 nt, Mycobacterium avium subsp. paratuberculosis
gcgccauuuccguugugccaccg

SEQ ID NO: 2954842 - RNA, 19 nt, Mycobacterium avium subsp. paratuberculosis
gcgcccacagguccagcgu

SEQ ID NO: 2954843 - RNA, 18 nt, Mycobacterium avium subsp. paratuberculosis
gcgcccacaguccgccca

SEQ ID NO: 2954844 - RNA, 20 nt, Mycobacterium avium subsp. paratuberculosis
gcgcccacccgaugaccggc

SEQ ID NO: 2954845 - RNA, 16 nt, Mycobacterium avium subsp. paratuberculosis
gcgcccacccgcgcac

SEQ ID NO: 2954846 - RNA, 22 nt, Mycobacterium avium subsp. paratuberculosis
gcgcccacccgcgcacgcucgc

SEQ ID NO: 2954847 - RNA, 18 nt, Mycobacterium avium subsp. paratuberculosis
gcgcccacccguuggcag

SEQ ID NO: 2954848 - RNA, 11 nt, Mycobacterium avium subsp. paratuberculosis
gcgcccaccgc

SEQ ID NO: 2954849 - RNA, 12 nt, Mycobacterium avium subsp. paratuberculosis
gcgcccaccgcg

SEQ ID NO: 2954850 - RNA, 13 nt, Mycobacterium avium subsp. paratuberculosis
gcgcccaccgcgg

SEQ ID NO: 2954851 - RNA, 16 nt, Mycobacterium avium subsp. paratuberculosis
gcgcccaccgcggcgc

SEQ ID NO: 2954852 - RNA, 18 nt, Mycobacterium avium subsp. paratuberculosis
gcgcccaccgcggcgcgc

SEQ ID NO: 2954853 - RNA, 22 nt, Mycobacterium avium subsp. paratuberculosis
gcgcccaccgcggcgcgcggcc

SEQ ID NO: 2954854 - RNA, 20 nt, Mycobacterium avium subsp. paratuberculosis
gcgcccaccgcucgucgggc

SEQ ID NO: 2954855 - RNA, 18 nt, Mycobacterium avium subsp. paratuberculosis
gcgcccaccuggaggcca

SEQ ID NO: 2954856 - RNA, 20 nt, Mycobacterium avium subsp. paratuberculosis
gcgcccacgugccaucgcug

SEQ ID NO: 2954857 - RNA, 18 nt, Mycobacterium avium subsp. paratuberculosis
gcgcccagaucggccagc

SEQ ID NO: 2954858 - RNA, 16 nt, Mycobacterium avium subsp. paratuberculosis
gcgcccagaugccgcc

SEQ ID NO: 2954859 - RNA, 19 nt, Mycobacterium avium subsp. paratuberculosis
gcgcccagaugccgccgcc

SEQ ID NO: 2954860 - RNA, 18 nt, Mycobacterium avium subsp. paratuberculosis
gcgcccagaugccggcgu

SEQ ID NO: 2954861 - RNA, 20 nt, Mycobacterium avium subsp. paratuberculosis
gcgcccagcaaacccagcac

SEQ ID NO: 2954862 - RNA, 18 nt, Mycobacterium avium subsp. paratuberculosis
gcgcccagcacgucaccg

SEQ ID NO: 2954863 - RNA, 13 nt, Mycobacterium avium subsp. paratuberculosis
gcgcccagcccca

SEQ ID NO: 2954864 - RNA, 16 nt, Mycobacterium avium subsp. paratuberculosis
gcgcccagccccagca

SEQ ID NO: 2954865 - RNA, 19 nt, Mycobacterium avium subsp. paratuberculosis
gcgcccagccccagcacga

SEQ ID NO: 2954866 - RNA, 13 nt, Mycobacterium avium subsp. paratuberculosis
gcgcccagcccga

SEQ ID NO: 2954867 - RNA, 16 nt, Mycobacterium avium subsp. paratuberculosis
gcgcccagcccgagca

SEQ ID NO: 2954868 - RNA, 14 nt, Mycobacterium avium subsp. paratuberculosis
gcgcccagccgagc

SEQ ID NO: 2954869 - RNA, 16 nt, Mycobacterium avium subsp. paratuberculosis
gcgcccagccgagccg

SEQ ID NO: 2954870 - RNA, 20 nt, Mycobacterium avium subsp. paratuberculosis
gcgcccagccgagccgggcc

SEQ ID NO: 2954871 - RNA, 21 nt, Mycobacterium avium subsp. paratuberculosis
gcgcccagccgagccgggcca

SEQ ID NO: 2954872 - RNA, 12 nt, Mycobacterium avium subsp. paratuberculosis
gcgcccagcgag

SEQ ID NO: 2954873 - RNA, 19 nt, Mycobacterium avium subsp. paratuberculosis
gcgcccagcgagcugccgg

SEQ ID NO: 2954874 - RNA, 20 nt, Mycobacterium avium subsp. paratuberculosis
gcgcccagcgagcugccggc

SEQ ID NO: 2954875 - RNA, 23 nt, Mycobacterium avium subsp. paratuberculosis
gcgcccagcgagcugccggcggc

SEQ ID NO: 2954876 - RNA, 16 nt, Mycobacterium avium subsp. paratuberculosis
gcgcccagcgcgcgau

SEQ ID NO: 2954877 - RNA, 21 nt, Mycobacterium avium subsp. paratuberculosis
gcgcccagcgcgcgaucgccg

SEQ ID NO: 2954878 - RNA, 24 nt, Mycobacterium avium subsp. paratuberculosis
gcgcccagcgcgcgaucgccggug

SEQ ID NO: 2954879 - RNA, 12 nt, Mycobacterium avium subsp. paratuberculosis
gcgcccagcggc

SEQ ID NO: 2954880 - RNA, 17 nt, Mycobacterium avium subsp. paratuberculosis
gcgcccagcgucucggc

SEQ ID NO: 2954881 - RNA, 20 nt, Mycobacterium avium subsp. paratuberculosis
gcgcccagcgucucggcggc

SEQ ID NO: 2954882 - RNA, 21 nt, Mycobacterium avium subsp. paratuberculosis
gcgcccagcgucucggcggcc

SEQ ID NO: 2954883 - RNA, 14 nt, Mycobacterium avium subsp. paratuberculosis
gcgcccagcguggu

SEQ ID NO: 2954884 - RNA, 15 nt, Mycobacterium avium subsp. paratuberculosis
gcgcccagcgugguc

SEQ ID NO: 2954885 - RNA, 20 nt, Mycobacterium avium subsp. paratuberculosis
gcgcccaggaacgcgccggc

SEQ ID NO: 2954886 - RNA, 21 nt, Mycobacterium avium subsp. paratuberculosis
gcgcccaggaacgcgccggcg

SEQ ID NO: 2954887 - RNA, 17 nt, Mycobacterium avium subsp. paratuberculosis
gcgcccaggauucucag

SEQ ID NO: 2954888 - RNA, 22 nt, Mycobacterium avium subsp. paratuberculosis
gcgcccaggauucucagcagcg

SEQ ID NO: 2954889 - RNA, 12 nt, Mycobacterium avium subsp. paratuberculosis
gcgcccaggcgu

SEQ ID NO: 2954890 - RNA, 20 nt, Mycobacterium avium subsp. paratuberculosis
gcgcccaggcugaacaccac

SEQ ID NO: 2954891 - RNA, 14 nt, Mycobacterium avium subsp. paratuberculosis
gcgcccaggggagc

SEQ ID NO: 2954892 - RNA, 18 nt, Mycobacterium avium subsp. paratuberculosis
gcgcccaggggagcggcg

SEQ ID NO: 2954893 - RNA, 20 nt, Mycobacterium avium subsp. paratuberculosis
gcgcccaggggagcggcgga

SEQ ID NO: 2954894 - RNA, 17 nt, Mycobacterium avium subsp. paratuberculosis
gcgcccagguacuccuc

SEQ ID NO: 2954895 - RNA, 21 nt, Mycobacterium avium subsp. paratuberculosis
gcgcccagguacuccucggug

SEQ ID NO: 2954896 - RNA, 22 nt, Mycobacterium avium subsp. paratuberculosis
gcgcccagguacuccucggugu

SEQ ID NO: 2954897 - RNA, 16 nt, Mycobacterium avium subsp. paratuberculosis
gcgcccagguccacca

SEQ ID NO: 2954898 - RNA, 16 nt, Mycobacterium avium subsp. paratuberculosis
gcgcccauccggcgcc

SEQ ID NO: 2954899 - RNA, 16 nt, Mycobacterium avium subsp. paratuberculosis
gcgcccaucgcggccg

SEQ ID NO: 2954900 - RNA, 17 nt, Mycobacterium avium subsp. paratuberculosis
gcgcccaucgcggccgc

SEQ ID NO: 2954901 - RNA, 13 nt, Mycobacterium avium subsp. paratuberculosis
gcgccccacgccu

SEQ ID NO: 2954902 - RNA, 13 nt, Mycobacterium avium subsp. paratuberculosis
gcgccccacggcg

SEQ ID NO: 2954903 - RNA, 14 nt, Mycobacterium avium subsp. paratuberculosis
gcgccccacggcgc

SEQ ID NO: 2954904 - RNA, 20 nt, Mycobacterium avium subsp. paratuberculosis
gcgccccagccccucgccgg

SEQ ID NO: 2954905 - RNA, 17 nt, Mycobacterium avium subsp. paratuberculosis
gcgccccagcuccucgg

SEQ ID NO: 2954906 - RNA, 18 nt, Mycobacterium avium subsp. paratuberculosis
gcgccccagcuccucggc

SEQ ID NO: 2954907 - RNA, 23 nt, Mycobacterium avium subsp. paratuberculosis
gcgcccgcugcgcgggucggcgc

SEQ ID NO: 2954908 - RNA, 14 nt, Mycobacterium avium subsp. paratuberculosis
gcgcccgcugcggc

SEQ ID NO: 2954909 - RNA, 16 nt, Mycobacterium avium subsp. paratuberculosis
gcgcccgcugcggcgc

SEQ ID NO: 2954910 - RNA, 17 nt, Mycobacterium avium subsp. paratuberculosis
gcgcccgcugcggcgca

SEQ ID NO: 2954911 - RNA, 20 nt, Mycobacterium avium subsp. paratuberculosis
gcgcccgcugcggcgcaggu

SEQ ID NO: 2954912 - RNA, 17 nt, Mycobacterium avium subsp. paratuberculosis
gcgcccggaaagcgcgg

SEQ ID NO: 2954913 - RNA, 20 nt, Mycobacterium avium subsp. paratuberculosis
gcgcccggaaagcgcgggca

SEQ ID NO: 2954914 - RNA, 20 nt, Mycobacterium avium subsp. paratuberculosis
gcgcccggagcugucgguga

SEQ ID NO: 2954915 - RNA, 21 nt, Mycobacterium avium subsp. paratuberculosis
gcgcccggagcugucggugac

SEQ ID NO: 2954916 - RNA, 20 nt, Mycobacterium avium subsp. paratuberculosis
gcgcccggcaccgcggcggu

SEQ ID NO: 2954917 - RNA, 15 nt, Mycobacterium avium subsp. paratuberculosis
gcgcccggcaccggg

SEQ ID NO: 2954918 - RNA, 16 nt, Mycobacterium avium subsp. paratuberculosis
gcgcccggcaccggga

SEQ ID NO: 2954919 - RNA, 14 nt, Mycobacterium avium subsp. paratuberculosis
gcgcccggcagccg

SEQ ID NO: 2954920 - RNA, 21 nt, Mycobacterium avium subsp. paratuberculosis
gcgcccggcagccgcuccggc

SEQ ID NO: 2954921 - RNA, 12 nt, Mycobacterium avium subsp. paratuberculosis
gcgcccggccag

SEQ ID NO: 2954922 - RNA, 17 nt, Mycobacterium avium subsp. paratuberculosis
gcgcccggccagccggu

SEQ ID NO: 2954923 - RNA, 12 nt, Mycobacterium avium subsp. paratuberculosis
gcgcccggccau

SEQ ID NO: 2954924 - RNA, 15 nt, Mycobacterium avium subsp. paratuberculosis
gcgcccggcccagcc

SEQ ID NO: 2954925 - RNA, 13 nt, Mycobacterium avium subsp. paratuberculosis
gcgcccggccggc

SEQ ID NO: 2954926 - RNA, 14 nt, Mycobacterium avium subsp. paratuberculosis
gcgcccggccggcc

SEQ ID NO: 2954927 - RNA, 18 nt, Mycobacterium avium subsp. paratuberculosis
gcgcccggccggccccua

SEQ ID NO: 2954928 - RNA, 13 nt, Mycobacterium avium subsp. paratuberculosis
gcgcccggccggu

SEQ ID NO: 2954929 - RNA, 12 nt, Mycobacterium avium subsp. paratuberculosis
gcgcccggccgu

SEQ ID NO: 2954930 - RNA, 14 nt, Mycobacterium avium subsp. paratuberculosis
gcgcccggccguga

SEQ ID NO: 2954931 - RNA, 12 nt, Mycobacterium avium subsp. paratuberculosis
gcgcccggcgac

SEQ ID NO: 2954932 - RNA, 16 nt, Mycobacterium avium subsp. paratuberculosis
gcgcccggcgaccacc

SEQ ID NO: 2954933 - RNA, 15 nt, Mycobacterium avium subsp. paratuberculosis
gcgcccggcgacgcg

SEQ ID NO: 2954934 - RNA, 20 nt, Mycobacterium avium subsp. paratuberculosis
gcgcccggcgacgcggcggg

SEQ ID NO: 2954935 - RNA, 14 nt, Mycobacterium avium subsp. paratuberculosis
gcgcccggcgaucg

SEQ ID NO: 2954936 - RNA, 19 nt, Mycobacterium avium subsp. paratuberculosis
gcgcccggcgcccggcgcg

SEQ ID NO: 2954937 - RNA, 13 nt, Mycobacterium avium subsp. paratuberculosis
gcgcccggcgccg

SEQ ID NO: 2954938 - RNA, 16 nt, Mycobacterium avium subsp. paratuberculosis
gcgcccggcgccggcc

SEQ ID NO: 2954939 - RNA, 17 nt, Mycobacterium avium subsp. paratuberculosis
gcgcccggcgccggccc

SEQ ID NO: 2954940 - RNA, 19 nt, Mycobacterium avium subsp. paratuberculosis
gcgcccggcgccggcccgc

SEQ ID NO: 2954941 - RNA, 13 nt, Mycobacterium avium subsp. paratuberculosis
gcgcccggcgcgc

SEQ ID NO: 2954942 - RNA, 15 nt, Mycobacterium avium subsp. paratuberculosis
gcgcccggcgcgcca

SEQ ID NO: 2954943 - RNA, 19 nt, Mycobacterium avium subsp. paratuberculosis
gcgcccggcgcgccacgac

SEQ ID NO: 2954944 - RNA, 15 nt, Mycobacterium avium subsp. paratuberculosis
gcgcccggcgucggu

SEQ ID NO: 2954945 - RNA, 19 nt, Mycobacterium avium subsp. paratuberculosis
gcgcccggcgucggugguc

SEQ ID NO: 2954946 - RNA, 16 nt, Mycobacterium avium subsp. paratuberculosis
gcgcccggcuccccga

SEQ ID NO: 2954947 - RNA, 17 nt, Mycobacterium avium subsp. paratuberculosis
gcgcccggcuucgccgc

SEQ ID NO: 2954948 - RNA, 19 nt, Mycobacterium avium subsp. paratuberculosis
gcgcccggcuucgccgcgc

SEQ ID NO: 2954949 - RNA, 15 nt, Mycobacterium avium subsp. paratuberculosis
gcgcccgggccagga

SEQ ID NO: 2954950 - RNA, 12 nt, Mycobacterium avium subsp. paratuberculosis
gcgcccgggcgc

SEQ ID NO: 2954951 - RNA, 14 nt, Mycobacterium avium subsp. paratuberculosis
gcgcccgggcgcgu

SEQ ID NO: 2954952 - RNA, 22 nt, Mycobacterium avium subsp. paratuberculosis
gcgcccgggcgcgugcacaccg

SEQ ID NO: 2954953 - RNA, 23 nt, Mycobacterium avium subsp. paratuberculosis
gcgcccgggcgcgugcacaccgg

SEQ ID NO: 2954954 - RNA, 22 nt, Mycobacterium avium subsp. paratuberculosis
gcgcccgggcguucccgcgcgc

SEQ ID NO: 2954955 - RNA, 13 nt, Mycobacterium avium subsp. paratuberculosis
gcgcccgggugcg

SEQ ID NO: 2954956 - RNA, 12 nt, Mycobacterium avium subsp. paratuberculosis
gcgcccgggugg

SEQ ID NO: 2954957 - RNA, 14 nt, Mycobacterium avium subsp. paratuberculosis
gcgcccgggugggc

SEQ ID NO: 2954958 - RNA, 19 nt, Mycobacterium avium subsp. paratuberculosis
gcgcccggucaggaacccg

SEQ ID NO: 2954959 - RNA, 22 nt, Mycobacterium avium subsp. paratuberculosis
gcgcccguagccgcgguucggc

SEQ ID NO: 2954960 - RNA, 16 nt, Mycobacterium avium subsp. paratuberculosis
gcgcccguagcggcgg

SEQ ID NO: 2954961 - RNA, 18 nt, Mycobacterium avium subsp. paratuberculosis
gcgcccgucacgcuggcg

SEQ ID NO: 2954962 - RNA, 16 nt, Mycobacterium avium subsp. paratuberculosis
gcgcccgucgagcguc

SEQ ID NO: 2954963 - RNA, 17 nt, Mycobacterium avium subsp. paratuberculosis
gcgcccgucgagcguca

SEQ ID NO: 2954964 - RNA, 18 nt, Mycobacterium avium subsp. paratuberculosis
gcgcccgucgagcgucac

SEQ ID NO: 2954965 - RNA, 22 nt, Mycobacterium avium subsp. paratuberculosis
gcgcccgucgagcgucacgccg

SEQ ID NO: 2954966 - RNA, 20 nt, Mycobacterium avium subsp. paratuberculosis
gcgcccgucgagcgucauuc

SEQ ID NO: 2954967 - RNA, 13 nt, Mycobacterium avium subsp. paratuberculosis
gcgcccgucggug

SEQ ID NO: 2954968 - RNA, 14 nt, Mycobacterium avium subsp. paratuberculosis
gcgcccgucgucgc

SEQ ID NO: 2954969 - RNA, 17 nt, Mycobacterium avium subsp. paratuberculosis
gcgcccgucgucgccga

SEQ ID NO: 2954970 - RNA, 15 nt, Mycobacterium avium subsp. paratuberculosis
gcgcccuaacgugcc

SEQ ID NO: 2954971 - RNA, 17 nt, Mycobacterium avium subsp. paratuberculosis
gcgcccuagucgacgcc

SEQ ID NO: 2954972 - RNA, 14 nt, Mycobacterium avium subsp. paratuberculosis
gcgcccuccacguc

SEQ ID NO: 2954973 - RNA, 16 nt, Mycobacterium avium subsp. paratuberculosis
gcgcccuccacgucgu

SEQ ID NO: 2954974 - RNA, 23 nt, Mycobacterium avium subsp. paratuberculosis
gcgcccucgauaauggcggccgc

SEQ ID NO: 2954975 - RNA, 21 nt, Mycobacterium avium subsp. paratuberculosis
gcgcccucgaugcgcaccgug

SEQ ID NO: 2954976 - RNA, 14 nt, Mycobacterium avium subsp. paratuberculosis
gcgcccucgccggc

SEQ ID NO: 2954977 - RNA, 19 nt, Mycobacterium avium subsp. paratuberculosis
gcgcccucgccggcggcgc

SEQ ID NO: 2954978 - RNA, 21 nt, Mycobacterium avium subsp. paratuberculosis
gcgcccucgccggcggcgccc

SEQ ID NO: 2954979 - RNA, 12 nt, Mycobacterium avium subsp. paratuberculosis
gcgcccucggcg

SEQ ID NO: 2954980 - RNA, 15 nt, Mycobacterium avium subsp. paratuberculosis
gcgcccucggcgauc

SEQ ID NO: 2954981 - RNA, 14 nt, Mycobacterium avium subsp. paratuberculosis
gcgcccugaggccc

SEQ ID NO: 2954982 - RNA, 17 nt, Mycobacterium avium subsp. paratuberculosis
gcgcccugaggcccggu

SEQ ID NO: 2954983 - RNA, 16 nt, Mycobacterium avium subsp. paratuberculosis
gcgcccugcacccagc

SEQ ID NO: 2954984 - RNA, 18 nt, Mycobacterium avium subsp. paratuberculosis
gcgcccugcacccagccg

SEQ ID NO: 2954985 - RNA, 19 nt, Mycobacterium avium subsp. paratuberculosis
gcgcccugcacccagccgu

SEQ ID NO: 2954986 - RNA, 13 nt, Mycobacterium avium subsp. paratuberculosis
gcgcccugcacga

SEQ ID NO: 2954987 - RNA, 13 nt, Mycobacterium avium subsp. paratuberculosis
gcgcccugcgagc

SEQ ID NO: 2954988 - RNA, 16 nt, Mycobacterium avium subsp. paratuberculosis
gcgcccugcgagcccg

SEQ ID NO: 2954989 - RNA, 17 nt, Mycobacterium avium subsp. paratuberculosis
gcgcccugcgagcccgg

SEQ ID NO: 2954990 - RNA, 19 nt, Mycobacterium avium subsp. paratuberculosis
gcgcccugcgagcccggga

SEQ ID NO: 2954991 - RNA, 13 nt, Mycobacterium avium subsp. paratuberculosis
gcgcccugcgcgc

SEQ ID NO: 2954992 - RNA, 16 nt, Mycobacterium avium subsp. paratuberculosis
gcgccgacggccgcgc

SEQ ID NO: 2954993 - RNA, 17 nt, Mycobacterium avium subsp. paratuberculosis
gcgccgacggccgcgcc

SEQ ID NO: 2954994 - RNA, 18 nt, Mycobacterium avium subsp. paratuberculosis
gcgccgacggccgcgccg

SEQ ID NO: 2954995 - RNA, 19 nt, Mycobacterium avium subsp. paratuberculosis
gcgccgacggccgcgccgu

SEQ ID NO: 2954996 - RNA, 12 nt, Mycobacterium avium subsp. paratuberculosis
gcgccgacgggc

SEQ ID NO: 2954997 - RNA, 13 nt, Mycobacterium avium subsp. paratuberculosis
gcgccgacgggcc

SEQ ID NO: 2954998 - RNA, 14 nt, Mycobacterium avium subsp. paratuberculosis
gcgccgacgggccc

SEQ ID NO: 2954999 - RNA, 20 nt, Mycobacterium avium subsp. paratuberculosis
gcgccgacuugaucgcggcg

SEQ ID NO: 2955000 - RNA, 23 nt, Mycobacterium avium subsp. paratuberculosis
gcgccgacuugaucgcggcguag

SEQ ID NO: 2955001 - RNA, 14 nt, Mycobacterium avium subsp. paratuberculosis
gcgccgagaccagc

SEQ ID NO: 2955002 - RNA, 18 nt, Mycobacterium avium subsp. paratuberculosis
gcgccgagaccagccaga

SEQ ID NO: 2955003 - RNA, 13 nt, Mycobacterium avium subsp. paratuberculosis
gcgccgagagcgc

SEQ ID NO: 2955004 - RNA, 21 nt, Mycobacterium avium subsp. paratuberculosis
gcgccgagagcgcgucgacgc

SEQ ID NO: 2955005 - RNA, 14 nt, Mycobacterium avium subsp. paratuberculosis
gcgccgagaucgcg

SEQ ID NO: 2955006 - RNA, 19 nt, Mycobacterium avium subsp. paratuberculosis
gcgccgagaucgcgguggc

SEQ ID NO: 2955007 - RNA, 21 nt, Mycobacterium avium subsp. paratuberculosis
gcgccgagaucgcgguggcgc

SEQ ID NO: 2955008 - RNA, 15 nt, Mycobacterium avium subsp. paratuberculosis
gcgccgagcaaccgg

SEQ ID NO: 2955009 - RNA, 17 nt, Mycobacterium avium subsp. paratuberculosis
gcgccgagcaaccggga

SEQ ID NO: 2955010 - RNA, 22 nt, Mycobacterium avium subsp. paratuberculosis
gcgccgagcaaccgggauaccg

SEQ ID NO: 2955011 - RNA, 17 nt, Mycobacterium avium subsp. paratuberculosis
gcgccgagcacgaacgc

SEQ ID NO: 2955012 - RNA, 18 nt, Mycobacterium avium subsp. paratuberculosis
gcgccgagcacgaacgcg

SEQ ID NO: 2955013 - RNA, 22 nt, Mycobacterium avium subsp. paratuberculosis
gcgccgagcacgaacgcggccg

SEQ ID NO: 2955014 - RNA, 20 nt, Mycobacterium avium subsp. paratuberculosis
gcgccgagcacggcucgucc

SEQ ID NO: 2955015 - RNA, 14 nt, Mycobacterium avium subsp. paratuberculosis
gcgccgagcagcug

SEQ ID NO: 2955016 - RNA, 16 nt, Mycobacterium avium subsp. paratuberculosis
gcgccgagcgcugguu

SEQ ID NO: 2955017 - RNA, 14 nt, Mycobacterium avium subsp. paratuberculosis
gcgccgagcgucac

SEQ ID NO: 2955018 - RNA, 19 nt, Mycobacterium avium subsp. paratuberculosis
gcgccgaggaacugcagcg

SEQ ID NO: 2955019 - RNA, 20 nt, Mycobacterium avium subsp. paratuberculosis
gcgccgaggaacugcagcga

SEQ ID NO: 2955020 - RNA, 12 nt, Mycobacterium avium subsp. paratuberculosis
gcgccgaggcca

SEQ ID NO: 2955021 - RNA, 14 nt, Mycobacterium avium subsp. paratuberculosis
gcgccgaggccagc

SEQ ID NO: 2955022 - RNA, 17 nt, Mycobacterium avium subsp. paratuberculosis
gcgccgaggcgcucggc

SEQ ID NO: 2955023 - RNA, 15 nt, Mycobacterium avium subsp. paratuberculosis
gcgccgaggucaccg

SEQ ID NO: 2955024 - RNA, 16 nt, Mycobacterium avium subsp. paratuberculosis
gcgccgaggucaccgc

SEQ ID NO: 2955025 - RNA, 17 nt, Mycobacterium avium subsp. paratuberculosis
gcgccgaggucaccgcg

SEQ ID NO: 2955026 - RNA, 20 nt, Mycobacterium avium subsp. paratuberculosis
gcgccgaggucaccgcggga

SEQ ID NO: 2955027 - RNA, 21 nt, Mycobacterium avium subsp. paratuberculosis
gcgccgaggugcugucgucgc

SEQ ID NO: 2955028 - RNA, 13 nt, Mycobacterium avium subsp. paratuberculosis
gcgccgagguggc

SEQ ID NO: 2955029 - RNA, 15 nt, Mycobacterium avium subsp. paratuberculosis
gcgccgagguggccc

SEQ ID NO: 2955030 - RNA, 20 nt, Mycobacterium avium subsp. paratuberculosis
gcgccgagguggcccgccac

SEQ ID NO: 2955031 - RNA, 17 nt, Mycobacterium avium subsp. paratuberculosis
gcgccgagguggccgcc

SEQ ID NO: 2955032 - RNA, 20 nt, Mycobacterium avium subsp. paratuberculosis
gcgccgagguggccgccagc

SEQ ID NO: 2955033 - RNA, 21 nt, Mycobacterium avium subsp. paratuberculosis
gcgccgagguggccgccagca

SEQ ID NO: 2955034 - RNA, 22 nt, Mycobacterium avium subsp. paratuberculosis
gcgccgagguggccgccagcac

SEQ ID NO: 2955035 - RNA, 23 nt, Mycobacterium avium subsp. paratuberculosis
gcgccgagguggccgccagcacc

SEQ ID NO: 2955036 - RNA, 15 nt, Mycobacterium avium subsp. paratuberculosis
gcgccgaguccgggc

SEQ ID NO: 2955037 - RNA, 17 nt, Mycobacterium avium subsp. paratuberculosis
gcgccgaguccgggccg

SEQ ID NO: 2955038 - RNA, 22 nt, Mycobacterium avium subsp. paratuberculosis
gcgccgaguccgggccgccggc

SEQ ID NO: 2955039 - RNA, 14 nt, Mycobacterium avium subsp. paratuberculosis
gcgccgaucacgaa

SEQ ID NO: 2955040 - RNA, 15 nt, Mycobacterium avium subsp. paratuberculosis
gcgccgaucacgccg

SEQ ID NO: 2955041 - RNA, 16 nt, Mycobacterium avium subsp. paratuberculosis
gcgccgaucacgccgg

SEQ ID NO: 2955042 - RNA, 19 nt, Mycobacterium avium subsp. paratuberculosis
gcgccgaucacgccggugg

SEQ ID NO: 2955043 - RNA, 22 nt, Mycobacterium avium subsp. paratuberculosis
gcgccgaucacgccgguggaca

SEQ ID NO: 2955044 - RNA, 23 nt, Mycobacterium avium subsp. paratuberculosis
gcgccgauccggcuccacagcag

SEQ ID NO: 2955045 - RNA, 15 nt, Mycobacterium avium subsp. paratuberculosis
gcgccgaucgcccag

SEQ ID NO: 2955046 - RNA, 12 nt, Mycobacterium avium subsp. paratuberculosis
gcgccgaucgcg

SEQ ID NO: 2955047 - RNA, 15 nt, Mycobacterium avium subsp. paratuberculosis
gcgccgaucgcgcgc

SEQ ID NO: 2955048 - RNA, 17 nt, Mycobacterium avium subsp. paratuberculosis
gcgccgaucgcgcgcag

SEQ ID NO: 2955049 - RNA, 19 nt, Mycobacterium avium subsp. paratuberculosis
gcgccgaucugaccgagca

SEQ ID NO: 2955050 - RNA, 22 nt, Mycobacterium avium subsp. paratuberculosis
gcgccgaucugaccgagcagcg

SEQ ID NO: 2955051 - RNA, 15 nt, Mycobacterium avium subsp. paratuberculosis
gcgccgaucugcucg

SEQ ID NO: 2955052 - RNA, 16 nt, Mycobacterium avium subsp. paratuberculosis
gcgccgaucugcucgg

SEQ ID NO: 2955053 - RNA, 14 nt, Mycobacterium avium subsp. paratuberculosis
gcgccgaugcagca

SEQ ID NO: 2955054 - RNA, 21 nt, Mycobacterium avium subsp. paratuberculosis
gcgccgaugcagcacauccag

SEQ ID NO: 2955055 - RNA, 23 nt, Mycobacterium avium subsp. paratuberculosis
gcgccgaugcauuggugcacgcc

SEQ ID NO: 2955056 - RNA, 12 nt, Mycobacterium avium subsp. paratuberculosis
gcgccgaugccc

SEQ ID NO: 2955057 - RNA, 16 nt, Mycobacterium avium subsp. paratuberculosis
gcgccgaugcccgccc

SEQ ID NO: 2955058 - RNA, 17 nt, Mycobacterium avium subsp. paratuberculosis
gcgccgaugcccgcccc

SEQ ID NO: 2955059 - RNA, 16 nt, Mycobacterium avium subsp. paratuberculosis
gcgccgaugccgaacg

SEQ ID NO: 2955060 - RNA, 18 nt, Mycobacterium avium subsp. paratuberculosis
gcgccgaugccgaacguc

SEQ ID NO: 2955061 - RNA, 19 nt, Mycobacterium avium subsp. paratuberculosis
gcgccgauguacugggccg

SEQ ID NO: 2955062 - RNA, 15 nt, Mycobacterium avium subsp. paratuberculosis
gcgccgauguggccg

SEQ ID NO: 2955063 - RNA, 17 nt, Mycobacterium avium subsp. paratuberculosis
gcgccgauuccgucggu

SEQ ID NO: 2955064 - RNA, 18 nt, Mycobacterium avium subsp. paratuberculosis
gcgccgauuccgucggug

SEQ ID NO: 2955065 - RNA, 19 nt, Mycobacterium avium subsp. paratuberculosis
gcgccgauuccgucggugg

SEQ ID NO: 2955066 - RNA, 21 nt, Mycobacterium avium subsp. paratuberculosis
gcgccgauuccgucgguggcg

SEQ ID NO: 2955067 - RNA, 22 nt, Mycobacterium avium subsp. paratuberculosis
gcgccgauuccgucgguggcgg

SEQ ID NO: 2955068 - RNA, 15 nt, Mycobacterium avium subsp. paratuberculosis
gcgccgcaacggcgc

SEQ ID NO: 2955069 - RNA, 19 nt, Mycobacterium avium subsp. paratuberculosis
gcgccgcaacggcgcaacg

SEQ ID NO: 2955070 - RNA, 20 nt, Mycobacterium avium subsp. paratuberculosis
gcgccgcaacggcgcaacgg

SEQ ID NO: 2955071 - RNA, 23 nt, Mycobacterium avium subsp. paratuberculosis
gcgccgcaacggcucccaggccc

SEQ ID NO: 2955072 - RNA, 16 nt, Mycobacterium avium subsp. paratuberculosis
gcgccgcacagccggc

SEQ ID NO: 2955073 - RNA, 18 nt, Mycobacterium avium subsp. paratuberculosis
gcgccgcacagccggcgg

SEQ ID NO: 2955074 - RNA, 19 nt, Mycobacterium avium subsp. paratuberculosis
gcgccgcacagccggcggc

SEQ ID NO: 2955075 - RNA, 20 nt, Mycobacterium avium subsp. paratuberculosis
gcgccgcacagccggcggcg

SEQ ID NO: 2955076 - RNA, 20 nt, Mycobacterium avium subsp. paratuberculosis
gcgccgccuucuugcgcggc

SEQ ID NO: 2955077 - RNA, 21 nt, Mycobacterium avium subsp. paratuberculosis
gcgccgccuucuugcgcggcg

SEQ ID NO: 2955078 - RNA, 22 nt, Mycobacterium avium subsp. paratuberculosis
gcgccgccuucuugcgcggcgc

SEQ ID NO: 2955079 - RNA, 12 nt, Mycobacterium avium subsp. paratuberculosis
gcgccgcgaccc

SEQ ID NO: 2955080 - RNA, 14 nt, Mycobacterium avium subsp. paratuberculosis
gcgccgcgaccccg

SEQ ID NO: 2955081 - RNA, 18 nt, Mycobacterium avium subsp. paratuberculosis
gcgccgcgacgucggugu

SEQ ID NO: 2955082 - RNA, 14 nt, Mycobacterium avium subsp. paratuberculosis
gcgccgcgagcgca

SEQ ID NO: 2955083 - RNA, 13 nt, Mycobacterium avium subsp. paratuberculosis
gcgccgcgcagcc

SEQ ID NO: 2955084 - RNA, 15 nt, Mycobacterium avium subsp. paratuberculosis
gcgccgcgccgaccu

SEQ ID NO: 2955085 - RNA, 13 nt, Mycobacterium avium subsp. paratuberculosis
gcgccgcgccgcc

SEQ ID NO: 2955086 - RNA, 14 nt, Mycobacterium avium subsp. paratuberculosis
gcgccgcgcgccag

SEQ ID NO: 2955087 - RNA, 18 nt, Mycobacterium avium subsp. paratuberculosis
gcgccgcgcgccagcgcg

SEQ ID NO: 2955088 - RNA, 23 nt, Mycobacterium avium subsp. paratuberculosis
gcgccgcgcgcccuagucgacgc

SEQ ID NO: 2955089 - RNA, 15 nt, Mycobacterium avium subsp. paratuberculosis
gcgccgcgcgcgcgg

SEQ ID NO: 2955090 - RNA, 16 nt, Mycobacterium avium subsp. paratuberculosis
gcgccgcgcgcgcggc

SEQ ID NO: 2955091 - RNA, 17 nt, Mycobacterium avium subsp. paratuberculosis
gcgccgcgcgcgcggcc

SEQ ID NO: 2955092 - RNA, 19 nt, Mycobacterium avium subsp. paratuberculosis
gcgccgcgcgcgcggccuc

SEQ ID NO: 2955093 - RNA, 22 nt, Mycobacterium avium subsp. paratuberculosis
gcgccgcgcgcgcggccuccag

SEQ ID NO: 2955094 - RNA, 13 nt, Mycobacterium avium subsp. paratuberculosis
gcgccgcgcuggc

SEQ ID NO: 2955095 - RNA, 15 nt, Mycobacterium avium subsp. paratuberculosis
gcgccgcgcuggccg

SEQ ID NO: 2955096 - RNA, 21 nt, Mycobacterium avium subsp. paratuberculosis
gcgccgcgcuugcgaucgccg

SEQ ID NO: 2955097 - RNA, 22 nt, Mycobacterium avium subsp. paratuberculosis
gcgccgcgcuugcgaucgccgc

SEQ ID NO: 2955098 - RNA, 20 nt, Mycobacterium avium subsp. paratuberculosis
gcgccgcggccaccgggucg

SEQ ID NO: 2955099 - RNA, 13 nt, Mycobacterium avium subsp. paratuberculosis
gcgccgcggccag

SEQ ID NO: 2955100 - RNA, 14 nt, Mycobacterium avium subsp. paratuberculosis
gcgccgcggccagc

SEQ ID NO: 2955101 - RNA, 16 nt, Mycobacterium avium subsp. paratuberculosis
gcgccgcggccagccg

SEQ ID NO: 2955102 - RNA, 18 nt, Mycobacterium avium subsp. paratuberculosis
gcgccgcggccagccggu

SEQ ID NO: 2955103 - RNA, 15 nt, Mycobacterium avium subsp. paratuberculosis
gcgccgcggccagcg

SEQ ID NO: 2955104 - RNA, 16 nt, Mycobacterium avium subsp. paratuberculosis
gcgccgcggccagcgc

SEQ ID NO: 2955105 - RNA, 17 nt, Mycobacterium avium subsp. paratuberculosis
gcgccgcggccagcgcc

SEQ ID NO: 2955106 - RNA, 14 nt, Mycobacterium avium subsp. paratuberculosis
gcgccgcggcccug

SEQ ID NO: 2955107 - RNA, 17 nt, Mycobacterium avium subsp. paratuberculosis
gcgccgcggcccugcag

SEQ ID NO: 2955108 - RNA, 18 nt, Mycobacterium avium subsp. paratuberculosis
gcgccgcggcccugcagc

SEQ ID NO: 2955109 - RNA, 12 nt, Mycobacterium avium subsp. paratuberculosis
gcgccgcggccg

SEQ ID NO: 2955110 - RNA, 13 nt, Mycobacterium avium subsp. paratuberculosis
gcgccgcggccgu

SEQ ID NO: 2955111 - RNA, 12 nt, Mycobacterium avium subsp. paratuberculosis
gcgccgcggcgc

SEQ ID NO: 2955112 - RNA, 20 nt, Mycobacterium avium subsp. paratuberculosis
gcgccgcggcgcccucgccg

SEQ ID NO: 2955113 - RNA, 14 nt, Mycobacterium avium subsp. paratuberculosis
gcgccgcggcgccg

SEQ ID NO: 2955114 - RNA, 15 nt, Mycobacterium avium subsp. paratuberculosis
gcgccgcggcgccgc

SEQ ID NO: 2955115 - RNA, 16 nt, Mycobacterium avium subsp. paratuberculosis
gcgccgcggcgccgcc

SEQ ID NO: 2955116 - RNA, 13 nt, Mycobacterium avium subsp. paratuberculosis
gcgccgcggcgcu

SEQ ID NO: 2955117 - RNA, 19 nt, Mycobacterium avium subsp. paratuberculosis
gcgccgcggcggcacccag

SEQ ID NO: 2955118 - RNA, 17 nt, Mycobacterium avium subsp. paratuberculosis
gcgccgcggcggcucgg

SEQ ID NO: 2955119 - RNA, 18 nt, Mycobacterium avium subsp. paratuberculosis
gcgccgcggcggcucggc

SEQ ID NO: 2955120 - RNA, 21 nt, Mycobacterium avium subsp. paratuberculosis
gcgccgcggcggcucggcggc

SEQ ID NO: 2955121 - RNA, 14 nt, Mycobacterium avium subsp. paratuberculosis
gcgccgcgggcgcc

SEQ ID NO: 2955122 - RNA, 15 nt, Mycobacterium avium subsp. paratuberculosis
gcgccgcgggcgccg

SEQ ID NO: 2955123 - RNA, 22 nt, Mycobacterium avium subsp. paratuberculosis
gcgccgcgggcggucgcgcagc

SEQ ID NO: 2955124 - RNA, 17 nt, Mycobacterium avium subsp. paratuberculosis
gcgccgcgggugcggca

SEQ ID NO: 2955125 - RNA, 21 nt, Mycobacterium avium subsp. paratuberculosis
gcgccgcgggugcggcacggc

SEQ ID NO: 2955126 - RNA, 19 nt, Mycobacterium avium subsp. paratuberculosis
gcgccgcgguagaaccaac

SEQ ID NO: 2955127 - RNA, 15 nt, Mycobacterium avium subsp. paratuberculosis
gcgccgcggugcgcc

SEQ ID NO: 2955128 - RNA, 16 nt, Mycobacterium avium subsp. paratuberculosis
gcgccgcggugcgcca

SEQ ID NO: 2955129 - RNA, 18 nt, Mycobacterium avium subsp. paratuberculosis
gcgccgcggugcgccacg

SEQ ID NO: 2955130 - RNA, 15 nt, Mycobacterium avium subsp. paratuberculosis
gcgccgcgucgacgc

SEQ ID NO: 2955131 - RNA, 19 nt, Mycobacterium avium subsp. paratuberculosis
gcgccgcgucgacgccgcu

SEQ ID NO: 2955132 - RNA, 22 nt, Mycobacterium avium subsp. paratuberculosis
gcgccgcgucggaccccgaugc

SEQ ID NO: 2955133 - RNA, 12 nt, Mycobacterium avium subsp. paratuberculosis
gcgccgcgucgu

SEQ ID NO: 2955134 - RNA, 19 nt, Mycobacterium avium subsp. paratuberculosis
gcgccgcgucgucgucgac

SEQ ID NO: 2955135 - RNA, 22 nt, Mycobacterium avium subsp. paratuberculosis
gcgccgcgucgucgucgaccgu

SEQ ID NO: 2955136 - RNA, 21 nt, Mycobacterium avium subsp. paratuberculosis
gcgccgcguucacccgcgccc

SEQ ID NO: 2955137 - RNA, 16 nt, Mycobacterium avium subsp. paratuberculosis
gcgccgcguucggcgg

SEQ ID NO: 2955138 - RNA, 18 nt, Mycobacterium avium subsp. paratuberculosis
gcgccgcguugucggcgu

SEQ ID NO: 2955139 - RNA, 19 nt, Mycobacterium avium subsp. paratuberculosis
gcgccgcguugucggcguc

SEQ ID NO: 2955140 - RNA, 22 nt, Mycobacterium avium subsp. paratuberculosis
gcgccgcucgaccccucggcau

SEQ ID NO: 2955141 - RNA, 12 nt, Mycobacterium avium subsp. paratuberculosis
gcgccgcucggc

SEQ ID NO: 2955142 - RNA, 14 nt, Mycobacterium avium subsp. paratuberculosis
gcgccgcucggcca

SEQ ID NO: 2955143 - RNA, 15 nt, Mycobacterium avium subsp. paratuberculosis
gcgccgcucggccag

SEQ ID NO: 2955144 - RNA, 17 nt, Mycobacterium avium subsp. paratuberculosis
gcgccgcucggccagca

SEQ ID NO: 2955145 - RNA, 18 nt, Mycobacterium avium subsp. paratuberculosis
gcgccgcucggccagcag

SEQ ID NO: 2955146 - RNA, 20 nt, Mycobacterium avium subsp. paratuberculosis
gcgccgcucggccagcagca

SEQ ID NO: 2955147 - RNA, 23 nt, Mycobacterium avium subsp. paratuberculosis
gcgccgcucggccagcagcacca

SEQ ID NO: 2955148 - RNA, 15 nt, Mycobacterium avium subsp. paratuberculosis
gcgccgcucgucggc

SEQ ID NO: 2955149 - RNA, 16 nt, Mycobacterium avium subsp. paratuberculosis
gcgccgcucgucggcc

SEQ ID NO: 2955150 - RNA, 18 nt, Mycobacterium avium subsp. paratuberculosis
gcgccgcucgucggccag

SEQ ID NO: 2955151 - RNA, 24 nt, Mycobacterium avium subsp. paratuberculosis
gcgccgcugacugcgaucgccgac

SEQ ID NO: 2955152 - RNA, 16 nt, Mycobacterium avium subsp. paratuberculosis
gcgccgcugcgggcca

SEQ ID NO: 2955153 - RNA, 17 nt, Mycobacterium avium subsp. paratuberculosis
gcgccgcuucgucgccg

SEQ ID NO: 2955154 - RNA, 19 nt, Mycobacterium avium subsp. paratuberculosis
gcgccgcuucgucgccggc

SEQ ID NO: 2955155 - RNA, 21 nt, Mycobacterium avium subsp. paratuberculosis
gcgccgcuucgucgccggccg

SEQ ID NO: 2955156 - RNA, 22 nt, Mycobacterium avium subsp. paratuberculosis
gcgccgcuucgucgccggccgc

SEQ ID NO: 2955157 - RNA, 23 nt, Mycobacterium avium subsp. paratuberculosis
gcgccgcuucgucgccggccgcc

SEQ ID NO: 2955158 - RNA, 18 nt, Mycobacterium avium subsp. paratuberculosis
gcgccggaccgauccggc

SEQ ID NO: 2955159 - RNA, 22 nt, Mycobacterium avium subsp. paratuberculosis
gcgccggaccgauccggcgccc

SEQ ID NO: 2955160 - RNA, 14 nt, Mycobacterium avium subsp. paratuberculosis
gcgccggacggccc

SEQ ID NO: 2955161 - RNA, 14 nt, Mycobacterium avium subsp. paratuberculosis
gcgccggcguccag

SEQ ID NO: 2955162 - RNA, 17 nt, Mycobacterium avium subsp. paratuberculosis
gcgccggcguccagcgc

SEQ ID NO: 2955163 - RNA, 18 nt, Mycobacterium avium subsp. paratuberculosis
gcgccggcguccagcgcc

SEQ ID NO: 2955164 - RNA, 20 nt, Mycobacterium avium subsp. paratuberculosis
gcgccggcguccagcgccgc

SEQ ID NO: 2955165 - RNA, 21 nt, Mycobacterium avium subsp. paratuberculosis
gcgccggcguccagcgccgcc

SEQ ID NO: 2955166 - RNA, 14 nt, Mycobacterium avium subsp. paratuberculosis
gcgccggcgucggu

SEQ ID NO: 2955167 - RNA, 15 nt, Mycobacterium avium subsp. paratuberculosis
gcgccggcgucggug

SEQ ID NO: 2955168 - RNA, 13 nt, Mycobacterium avium subsp. paratuberculosis
gcgccggcguguc

SEQ ID NO: 2955169 - RNA, 18 nt, Mycobacterium avium subsp. paratuberculosis
gcgccggcgugucggcgc

SEQ ID NO: 2955170 - RNA, 20 nt, Mycobacterium avium subsp. paratuberculosis
gcgccggcgugucggcgcca

SEQ ID NO: 2955171 - RNA, 22 nt, Mycobacterium avium subsp. paratuberculosis
gcgccggcgugucggcgccacc

SEQ ID NO: 2955172 - RNA, 17 nt, Mycobacterium avium subsp. paratuberculosis
gcgccggcuccaccgcg

SEQ ID NO: 2955173 - RNA, 21 nt, Mycobacterium avium subsp. paratuberculosis
gcgccggcuccaccgcgccgg

SEQ ID NO: 2955174 - RNA, 18 nt, Mycobacterium avium subsp. paratuberculosis
gcgccggcuccgcaugcc

SEQ ID NO: 2955175 - RNA, 23 nt, Mycobacterium avium subsp. paratuberculosis
gcgccggcuccgcaugcccgggc

SEQ ID NO: 2955176 - RNA, 15 nt, Mycobacterium avium subsp. paratuberculosis
gcgccggcugcccgc

SEQ ID NO: 2955177 - RNA, 17 nt, Mycobacterium avium subsp. paratuberculosis
gcgccggcugcccgcga

SEQ ID NO: 2955178 - RNA, 18 nt, Mycobacterium avium subsp. paratuberculosis
gcgccggcugcccgcgac

SEQ ID NO: 2955179 - RNA, 19 nt, Mycobacterium avium subsp. paratuberculosis
gcgccggcugcccgcgacu

SEQ ID NO: 2955180 - RNA, 20 nt, Mycobacterium avium subsp. paratuberculosis
gcgccgggaucacacgcgcg

SEQ ID NO: 2955181 - RNA, 21 nt, Mycobacterium avium subsp. paratuberculosis
gcgccgggaucggcagcgcgc

SEQ ID NO: 2955182 - RNA, 19 nt, Mycobacterium avium subsp. paratuberculosis
gcgccgggcaacagcgcgc

SEQ ID NO: 2955183 - RNA, 12 nt, Mycobacterium avium subsp. paratuberculosis
gcgccgggcacc

SEQ ID NO: 2955184 - RNA, 13 nt, Mycobacterium avium subsp. paratuberculosis
gcgccgggcacca

SEQ ID NO: 2955185 - RNA, 16 nt, Mycobacterium avium subsp. paratuberculosis
gcgccgggcaccacca

SEQ ID NO: 2955186 - RNA, 16 nt, Mycobacterium avium subsp. paratuberculosis
gcgccgggcagcccgg

SEQ ID NO: 2955187 - RNA, 17 nt, Mycobacterium avium subsp. paratuberculosis
gcgccgggcagcccggg

SEQ ID NO: 2955188 - RNA, 21 nt, Mycobacterium avium subsp. paratuberculosis
gcgccgggcauuucggcuucc

SEQ ID NO: 2955189 - RNA, 23 nt, Mycobacterium avium subsp. paratuberculosis
gcgccgggcccggucccgcguca

SEQ ID NO: 2955190 - RNA, 14 nt, Mycobacterium avium subsp. paratuberculosis
gcgccgggcgaagu

SEQ ID NO: 2955191 - RNA, 23 nt, Mycobacterium avium subsp. paratuberculosis
gcgccgggcgaagucgccggcca

SEQ ID NO: 2955192 - RNA, 14 nt, Mycobacterium avium subsp. paratuberculosis
gcgccgggcgcccg

SEQ ID NO: 2955193 - RNA, 15 nt, Mycobacterium avium subsp. paratuberculosis
gcgccgggcgcccga

SEQ ID NO: 2955194 - RNA, 12 nt, Mycobacterium avium subsp. paratuberculosis
gcgccgggcgga

SEQ ID NO: 2955195 - RNA, 14 nt, Mycobacterium avium subsp. paratuberculosis
gcgccgggcggccc

SEQ ID NO: 2955196 - RNA, 21 nt, Mycobacterium avium subsp. paratuberculosis
gcgccgggcggcccgccucgg

SEQ ID NO: 2955197 - RNA, 22 nt, Mycobacterium avium subsp. paratuberculosis
gcgccgggcggcccgccucggc

SEQ ID NO: 2955198 - RNA, 14 nt, Mycobacterium avium subsp. paratuberculosis
gcgccgggcggccu

SEQ ID NO: 2955199 - RNA, 15 nt, Mycobacterium avium subsp. paratuberculosis
gcgccgggcggccuc

SEQ ID NO: 2955200 - RNA, 16 nt, Mycobacterium avium subsp. paratuberculosis
gcgccgggcggccucg

SEQ ID NO: 2955201 - RNA, 18 nt, Mycobacterium avium subsp. paratuberculosis
gcgccgggcggccucggc

SEQ ID NO: 2955202 - RNA, 13 nt, Mycobacterium avium subsp. paratuberculosis
gcgccgggcgggc

SEQ ID NO: 2955203 - RNA, 20 nt, Mycobacterium avium subsp. paratuberculosis
gcgccgggcgggcgcaggug

SEQ ID NO: 2955204 - RNA, 18 nt, Mycobacterium avium subsp. paratuberculosis
gcgccgggcguugcccgc

SEQ ID NO: 2955205 - RNA, 21 nt, Mycobacterium avium subsp. paratuberculosis
gcgccgggcguugcccgccgc

SEQ ID NO: 2955206 - RNA, 12 nt, Mycobacterium avium subsp. paratuberculosis
gcgccggggccg

SEQ ID NO: 2955207 - RNA, 15 nt, Mycobacterium avium subsp. paratuberculosis
gcgccggggccgcgg

SEQ ID NO: 2955208 - RNA, 16 nt, Mycobacterium avium subsp. paratuberculosis
gcgccggggccgcggc

SEQ ID NO: 2955209 - RNA, 17 nt, Mycobacterium avium subsp. paratuberculosis
gcgccggggccgcggcu

SEQ ID NO: 2955210 - RNA, 18 nt, Mycobacterium avium subsp. paratuberculosis
gcgccggggccgcggcuc

SEQ ID NO: 2955211 - RNA, 14 nt, Mycobacterium avium subsp. paratuberculosis
gcgccggggcgggc

SEQ ID NO: 2955212 - RNA, 17 nt, Mycobacterium avium subsp. paratuberculosis
gcgccggggcgggcggc

SEQ ID NO: 2955213 - RNA, 21 nt, Mycobacterium avium subsp. paratuberculosis
gcgccggggcgggcggcggcu

SEQ ID NO: 2955214 - RNA, 22 nt, Mycobacterium avium subsp. paratuberculosis
gcgccggggcgggcggcggcug

SEQ ID NO: 2955215 - RNA, 18 nt, Mycobacterium avium subsp. paratuberculosis
gcgccgggguccucucgg

SEQ ID NO: 2955216 - RNA, 19 nt, Mycobacterium avium subsp. paratuberculosis
gcgccgggguccucucggc

SEQ ID NO: 2955217 - RNA, 21 nt, Mycobacterium avium subsp. paratuberculosis
gcgccgggguccucucggcgc

SEQ ID NO: 2955218 - RNA, 23 nt, Mycobacterium avium subsp. paratuberculosis
gcgccgggguccucucggcgccg

SEQ ID NO: 2955219 - RNA, 16 nt, Mycobacterium avium subsp. paratuberculosis
gcgccggggugggcca

SEQ ID NO: 2955220 - RNA, 19 nt, Mycobacterium avium subsp. paratuberculosis
gcgccgggguguccagcgg

SEQ ID NO: 2955221 - RNA, 20 nt, Mycobacterium avium subsp. paratuberculosis
gcgccgggguguccagcggg

SEQ ID NO: 2955222 - RNA, 15 nt, Mycobacterium avium subsp. paratuberculosis
gcgccgggucaccgg

SEQ ID NO: 2955223 - RNA, 16 nt, Mycobacterium avium subsp. paratuberculosis
gcgccgggucaccgga

SEQ ID NO: 2955224 - RNA, 17 nt, Mycobacterium avium subsp. paratuberculosis
gcgccgggucaccggau

SEQ ID NO: 2955225 - RNA, 23 nt, Mycobacterium avium subsp. paratuberculosis
gcgccgggucaccggaugcaccg

SEQ ID NO: 2955226 - RNA, 21 nt, Mycobacterium avium subsp. paratuberculosis
gcgccgggucauccccgugcg

SEQ ID NO: 2955227 - RNA, 11 nt, Mycobacterium avium subsp. paratuberculosis
gcgccgggucc

SEQ ID NO: 2955228 - RNA, 17 nt, Mycobacterium avium subsp. paratuberculosis
gcgccggguccagccgc

SEQ ID NO: 2955229 - RNA, 19 nt, Mycobacterium avium subsp. paratuberculosis
gcgccggguccagccgcgg

SEQ ID NO: 2955230 - RNA, 20 nt, Mycobacterium avium subsp. paratuberculosis
gcgccggguccagccgcggu

SEQ ID NO: 2955231 - RNA, 12 nt, Mycobacterium avium subsp. paratuberculosis
gcgccgggucgc

SEQ ID NO: 2955232 - RNA, 16 nt, Mycobacterium avium subsp. paratuberculosis
gcgccgggucgcggua

SEQ ID NO: 2955233 - RNA, 16 nt, Mycobacterium avium subsp. paratuberculosis
gcgccgggucgcggug

SEQ ID NO: 2955234 - RNA, 14 nt, Mycobacterium avium subsp. paratuberculosis
gcgccggguggccg

SEQ ID NO: 2955235 - RNA, 19 nt, Mycobacterium avium subsp. paratuberculosis
gcgccggguggccggggcc

SEQ ID NO: 2955236 - RNA, 22 nt, Mycobacterium avium subsp. paratuberculosis
gcgccggguggccggggccauc

SEQ ID NO: 2955237 - RNA, 13 nt, Mycobacterium avium subsp. paratuberculosis
gcgccggguggcg

SEQ ID NO: 2955238 - RNA, 20 nt, Mycobacterium avium subsp. paratuberculosis
gcgccggguugcaggcgccc

SEQ ID NO: 2955239 - RNA, 21 nt, Mycobacterium avium subsp. paratuberculosis
gcgccggguuguagcaggcgg

SEQ ID NO: 2955240 - RNA, 18 nt, Mycobacterium avium subsp. paratuberculosis
gcgccgguaaugggcgau

SEQ ID NO: 2955241 - RNA, 20 nt, Mycobacterium avium subsp. paratuberculosis
gcgccgguaaugggcgaucg

SEQ ID NO: 2955242 - RNA, 23 nt, Mycobacterium avium subsp. paratuberculosis
gcgccgguaaugggcgaucgauc

SEQ ID NO: 2955243 - RNA, 16 nt, Mycobacterium avium subsp. paratuberculosis
gcgccgguagagcgcc

SEQ ID NO: 2955244 - RNA, 16 nt, Mycobacterium avium subsp. paratuberculosis
gcgccgguagcgacac

SEQ ID NO: 2955245 - RNA, 14 nt, Mycobacterium avium subsp. paratuberculosis
gcgccgucgauggc

SEQ ID NO: 2955246 - RNA, 15 nt, Mycobacterium avium subsp. paratuberculosis
gcgccgucgauggcg

SEQ ID NO: 2955247 - RNA, 19 nt, Mycobacterium avium subsp. paratuberculosis
gcgccgucgauggcgcggc

SEQ ID NO: 2955248 - RNA, 20 nt, Mycobacterium avium subsp. paratuberculosis
gcgccgucgauggcgcggcc

SEQ ID NO: 2955249 - RNA, 23 nt, Mycobacterium avium subsp. paratuberculosis
gcgccgucgauggcgcggcccag

SEQ ID NO: 2955250 - RNA, 12 nt, Mycobacterium avium subsp. paratuberculosis
gcgccgucgccg

SEQ ID NO: 2955251 - RNA, 14 nt, Mycobacterium avium subsp. paratuberculosis
gcgccgucgccgac

SEQ ID NO: 2955252 - RNA, 14 nt, Mycobacterium avium subsp. paratuberculosis
gcgccgucgccgau

SEQ ID NO: 2955253 - RNA, 22 nt, Mycobacterium avium subsp. paratuberculosis
gcgccgucgccgaucaccugac

SEQ ID NO: 2955254 - RNA, 15 nt, Mycobacterium avium subsp. paratuberculosis
gcgccgucgccgccg

SEQ ID NO: 2955255 - RNA, 16 nt, Mycobacterium avium subsp. paratuberculosis
gcgccgucgccgccgu

SEQ ID NO: 2955256 - RNA, 18 nt, Mycobacterium avium subsp. paratuberculosis
gcgccgucgccgccguga

SEQ ID NO: 2955257 - RNA, 14 nt, Mycobacterium avium subsp. paratuberculosis
gcgccgucgccgga

SEQ ID NO: 2955258 - RNA, 22 nt, Mycobacterium avium subsp. paratuberculosis
gcgccgucgcgggagagcgcgg

SEQ ID NO: 2955259 - RNA, 12 nt, Mycobacterium avium subsp. paratuberculosis
gcgccgucggcc

SEQ ID NO: 2955260 - RNA, 13 nt, Mycobacterium avium subsp. paratuberculosis
gcgccgucggcga

SEQ ID NO: 2955261 - RNA, 14 nt, Mycobacterium avium subsp. paratuberculosis
gcgccgucggcgau

SEQ ID NO: 2955262 - RNA, 15 nt, Mycobacterium avium subsp. paratuberculosis
gcgccgucggcgaug

SEQ ID NO: 2955263 - RNA, 16 nt, Mycobacterium avium subsp. paratuberculosis
gcgccgucggcgaugc

SEQ ID NO: 2955264 - RNA, 14 nt, Mycobacterium avium subsp. paratuberculosis
gcgccgucggcggg

SEQ ID NO: 2955265 - RNA, 14 nt, Mycobacterium avium subsp. paratuberculosis
gcgccgucggcguu

SEQ ID NO: 2955266 - RNA, 21 nt, Mycobacterium avium subsp. paratuberculosis
gcgccgucggcguucagcggc

SEQ ID NO: 2955267 - RNA, 23 nt, Mycobacterium avium subsp. paratuberculosis
gcgccgucggcguucagcggcac

SEQ ID NO: 2955268 - RNA, 13 nt, Mycobacterium avium subsp. paratuberculosis
gcgccgucggugg

SEQ ID NO: 2955269 - RNA, 19 nt, Mycobacterium avium subsp. paratuberculosis
gcgccgucggugggggcca

SEQ ID NO: 2955270 - RNA, 18 nt, Mycobacterium avium subsp. paratuberculosis
gcgccgucgucggacacc

SEQ ID NO: 2955271 - RNA, 13 nt, Mycobacterium avium subsp. paratuberculosis
gcgccgucgucgu

SEQ ID NO: 2955272 - RNA, 16 nt, Mycobacterium avium subsp. paratuberculosis
gcgccgucgucgucgc

SEQ ID NO: 2955273 - RNA, 17 nt, Mycobacterium avium subsp. paratuberculosis
gcgccgucgucgucggc

SEQ ID NO: 2955274 - RNA, 19 nt, Mycobacterium avium subsp. paratuberculosis
gcgccgucgucgucggccg

SEQ ID NO: 2955275 - RNA, 23 nt, Mycobacterium avium subsp. paratuberculosis
gcgccgucgucgucggccgggcc

SEQ ID NO: 2955276 - RNA, 23 nt, Mycobacterium avium subsp. paratuberculosis
gcgccgucguucuccauccgggc

SEQ ID NO: 2955277 - RNA, 14 nt, Mycobacterium avium subsp. paratuberculosis
gcgccgucuccggc

SEQ ID NO: 2955278 - RNA, 17 nt, Mycobacterium avium subsp. paratuberculosis
gcgccgucuccucgacc

SEQ ID NO: 2955279 - RNA, 21 nt, Mycobacterium avium subsp. paratuberculosis
gcgccgucuccucgaccagcg

SEQ ID NO: 2955280 - RNA, 22 nt, Mycobacterium avium subsp. paratuberculosis
gcgccgucuccucgaccagcgc

SEQ ID NO: 2955281 - RNA, 23 nt, Mycobacterium avium subsp. paratuberculosis
gcgccgucuccucgaccagcgcg

SEQ ID NO: 2955282 - RNA, 14 nt, Mycobacterium avium subsp. paratuberculosis
gcgccgucucgacc

SEQ ID NO: 2955283 - RNA, 16 nt, Mycobacterium avium subsp. paratuberculosis
gcgccgucucgacccg

SEQ ID NO: 2955284 - RNA, 18 nt, Mycobacterium avium subsp. paratuberculosis
gcgccgucucgacccggg

SEQ ID NO: 2955285 - RNA, 19 nt, Mycobacterium avium subsp. paratuberculosis
gcgccgucucgacccgggc

SEQ ID NO: 2955286 - RNA, 22 nt, Mycobacterium avium subsp. paratuberculosis
gcgccgucucgacccgggccag

SEQ ID NO: 2955287 - RNA, 17 nt, Mycobacterium avium subsp. paratuberculosis
gcgccgucuuccgggcc

SEQ ID NO: 2955288 - RNA, 18 nt, Mycobacterium avium subsp. paratuberculosis
gcgccgucuuccgggcca

SEQ ID NO: 2955289 - RNA, 22 nt, Mycobacterium avium subsp. paratuberculosis
gcgccgugaacugugcggugcg

SEQ ID NO: 2955290 - RNA, 22 nt, Mycobacterium avium subsp. paratuberculosis
gcgccgugaagggcccgccggu

SEQ ID NO: 2955291 - RNA, 14 nt, Mycobacterium avium subsp. paratuberculosis
gcgccgugacgccg

SEQ ID NO: 2955292 - RNA, 15 nt, Mycobacterium avium subsp. paratuberculosis
gcgccgugacgccga

SEQ ID NO: 2955293 - RNA, 15 nt, Mycobacterium avium subsp. paratuberculosis
gcgccgugcagcacg

SEQ ID NO: 2955294 - RNA, 19 nt, Mycobacterium avium subsp. paratuberculosis
gcgccgugcagcacgccgc

SEQ ID NO: 2955295 - RNA, 21 nt, Mycobacterium avium subsp. paratuberculosis
gcgccgugcagcacgccgcgg

SEQ ID NO: 2955296 - RNA, 22 nt, Mycobacterium avium subsp. paratuberculosis
gcgccgugcagcacgccgcgga

SEQ ID NO: 2955297 - RNA, 13 nt, Mycobacterium avium subsp. paratuberculosis
gcgccgugcagga

SEQ ID NO: 2955298 - RNA, 15 nt, Mycobacterium avium subsp. paratuberculosis
gcgccgugcaggaug

SEQ ID NO: 2955299 - RNA, 20 nt, Mycobacterium avium subsp. paratuberculosis
gcgccgugcaggaugaccgc

SEQ ID NO: 2955300 - RNA, 13 nt, Mycobacterium avium subsp. paratuberculosis
gcgccgugcccaa

SEQ ID NO: 2955301 - RNA, 16 nt, Mycobacterium avium subsp. paratuberculosis
gcgccgugcccaacac

SEQ ID NO: 2955302 - RNA, 14 nt, Mycobacterium avium subsp. paratuberculosis
gcgccgugccgcgc

SEQ ID NO: 2955303 - RNA, 15 nt, Mycobacterium avium subsp. paratuberculosis
gcgccgugcgccagc

SEQ ID NO: 2955304 - RNA, 21 nt, Mycobacterium avium subsp. paratuberculosis
gcgccgugcgccagcgaccgc

SEQ ID NO: 2955305 - RNA, 15 nt, Mycobacterium avium subsp. paratuberculosis
gcgccguggcccaug

SEQ ID NO: 2955306 - RNA, 19 nt, Mycobacterium avium subsp. paratuberculosis
gcgccguugaccgcggcga

SEQ ID NO: 2955307 - RNA, 20 nt, Mycobacterium avium subsp. paratuberculosis
gcgccguugaccgcggcgau

SEQ ID NO: 2955308 - RNA, 22 nt, Mycobacterium avium subsp. paratuberculosis
gcgccguugaccgcggcgaugg

SEQ ID NO: 2955309 - RNA, 15 nt, Mycobacterium avium subsp. paratuberculosis
gcgccguugaccggc

SEQ ID NO: 2955310 - RNA, 18 nt, Mycobacterium avium subsp. paratuberculosis
gcgccguugaccggccgg

SEQ ID NO: 2955311 - RNA, 21 nt, Mycobacterium avium subsp. paratuberculosis
gcgccguugaccggccggucg

SEQ ID NO: 2955312 - RNA, 16 nt, Mycobacterium avium subsp. paratuberculosis
gcgccguugauugcgc

SEQ ID NO: 2955313 - RNA, 22 nt, Mycobacterium avium subsp. paratuberculosis
gcgccguugauugcgcccgccg

SEQ ID NO: 2955314 - RNA, 15 nt, Mycobacterium avium subsp. paratuberculosis
gcgccguuggugguc

SEQ ID NO: 2955315 - RNA, 23 nt, Mycobacterium avium subsp. paratuberculosis
gcgccguugguggucugccagaa

SEQ ID NO: 2955316 - RNA, 18 nt, Mycobacterium avium subsp. paratuberculosis
gcgccguuguaggccgcg

SEQ ID NO: 2955317 - RNA, 19 nt, Mycobacterium avium subsp. paratuberculosis
gcgccguuguaggccgcgc

SEQ ID NO: 2955318 - RNA, 22 nt, Mycobacterium avium subsp. paratuberculosis
gcgccguuguaggccgcgcggu

SEQ ID NO: 2955319 - RNA, 21 nt, Mycobacterium avium subsp. paratuberculosis
gcgccuaauucguuguuggcg

SEQ ID NO: 2955320 - RNA, 23 nt, Mycobacterium avium subsp. paratuberculosis
gcgccuaauucguuguuggcggu

SEQ ID NO: 2955321 - RNA, 22 nt, Mycobacterium avium subsp. paratuberculosis
gcgccuaccggguggccagcac

SEQ ID NO: 2955322 - RNA, 23 nt, Mycobacterium avium subsp. paratuberculosis
gcgccuaccggguggccagcacc

SEQ ID NO: 2955323 - RNA, 14 nt, Mycobacterium avium subsp. paratuberculosis
gcgccuccagccgc

SEQ ID NO: 2955324 - RNA, 22 nt, Mycobacterium avium subsp. paratuberculosis
gcgccucccggaccaccaggaa

SEQ ID NO: 2955325 - RNA, 13 nt, Mycobacterium avium subsp. paratuberculosis
gcgccuccgacga

SEQ ID NO: 2955326 - RNA, 17 nt, Mycobacterium avium subsp. paratuberculosis
gcgccucgaacaucggc

SEQ ID NO: 2955327 - RNA, 21 nt, Mycobacterium avium subsp. paratuberculosis
gcgccucgagcaacggccgca

SEQ ID NO: 2955328 - RNA, 23 nt, Mycobacterium avium subsp. paratuberculosis
gcgccucgagcaacggccgcagc

SEQ ID NO: 2955329 - RNA, 19 nt, Mycobacterium avium subsp. paratuberculosis
gcgcgaaaaccagcaccgg

SEQ ID NO: 2955330 - RNA, 22 nt, Mycobacterium avium subsp. paratuberculosis
gcgcgaaaaccagcaccggcac

SEQ ID NO: 2955331 - RNA, 14 nt, Mycobacterium avium subsp. paratuberculosis
gcgcgaaacccccg

SEQ ID NO: 2955332 - RNA, 20 nt, Mycobacterium avium subsp. paratuberculosis
gcgcgaaagcagcaacggcg

SEQ ID NO: 2955333 - RNA, 13 nt, Mycobacterium avium subsp. paratuberculosis
gcgcgaacaaucg

SEQ ID NO: 2955334 - RNA, 14 nt, Mycobacterium avium subsp. paratuberculosis
gcgcgaacaaucgc

SEQ ID NO: 2955335 - RNA, 22 nt, Mycobacterium avium subsp. paratuberculosis
gcgcgaacaaucgcugcgagcc

SEQ ID NO: 2955336 - RNA, 21 nt, Mycobacterium avium subsp. paratuberculosis
gcgcgaacagccgaccgauca

SEQ ID NO: 2955337 - RNA, 13 nt, Mycobacterium avium subsp. paratuberculosis
gcgcgaacagcga

SEQ ID NO: 2955338 - RNA, 17 nt, Mycobacterium avium subsp. paratuberculosis
gcgcgaacagcgaagcc

SEQ ID NO: 2955339 - RNA, 18 nt, Mycobacterium avium subsp. paratuberculosis
gcgcgaacagcgaagcca

SEQ ID NO: 2955340 - RNA, 16 nt, Mycobacterium avium subsp. paratuberculosis
gcgcgaacagcgccga

SEQ ID NO: 2955341 - RNA, 17 nt, Mycobacterium avium subsp. paratuberculosis
gcgcgaacagcgccgac

SEQ ID NO: 2955342 - RNA, 14 nt, Mycobacterium avium subsp. paratuberculosis
gcgcgaacagcgcg

SEQ ID NO: 2955343 - RNA, 19 nt, Mycobacterium avium subsp. paratuberculosis
gcgcgaacagcgcggccac

SEQ ID NO: 2955344 - RNA, 15 nt, Mycobacterium avium subsp. paratuberculosis
gcgcgaacagguccu

SEQ ID NO: 2955345 - RNA, 13 nt, Mycobacterium avium subsp. paratuberculosis
gcgcgaaccgggc

SEQ ID NO: 2955346 - RNA, 16 nt, Mycobacterium avium subsp. paratuberculosis
gcgcgaaccgggccag

SEQ ID NO: 2955347 - RNA, 13 nt, Mycobacterium avium subsp. paratuberculosis
gcgcgaagcuggg

SEQ ID NO: 2955348 - RNA, 14 nt, Mycobacterium avium subsp. paratuberculosis
gcgcgaagguggcg

SEQ ID NO: 2955349 - RNA, 15 nt, Mycobacterium avium subsp. paratuberculosis
gcgcgaagucgagca

SEQ ID NO: 2955350 - RNA, 16 nt, Mycobacterium avium subsp. paratuberculosis
gcgcgaagucgagcag

SEQ ID NO: 2955351 - RNA, 15 nt, Mycobacterium avium subsp. paratuberculosis
gcgcgaaucccggcc

SEQ ID NO: 2955352 - RNA, 19 nt, Mycobacterium avium subsp. paratuberculosis
gcgcgaaucccggccucgu

SEQ ID NO: 2955353 - RNA, 14 nt, Mycobacterium avium subsp. paratuberculosis
gcgcgaauccgguc

SEQ ID NO: 2955354 - RNA, 15 nt, Mycobacterium avium subsp. paratuberculosis
gcgcgaaucgcuucc

SEQ ID NO: 2955355 - RNA, 16 nt, Mycobacterium avium subsp. paratuberculosis
gcgcgaauuccucagc

SEQ ID NO: 2955356 - RNA, 18 nt, Mycobacterium avium subsp. paratuberculosis
gcgcgaauuccucagcgc

SEQ ID NO: 2955357 - RNA, 21 nt, Mycobacterium avium subsp. paratuberculosis
gcgcgaauuccucagcgcccc

SEQ ID NO: 2955358 - RNA, 16 nt, Mycobacterium avium subsp. paratuberculosis
gcgcgacaccgcggcg

SEQ ID NO: 2955359 - RNA, 14 nt, Mycobacterium avium subsp. paratuberculosis
gcgcgacaccggac

SEQ ID NO: 2955360 - RNA, 19 nt, Mycobacterium avium subsp. paratuberculosis
gcgcgacaccugcucaccg

SEQ ID NO: 2955361 - RNA, 13 nt, Mycobacterium avium subsp. paratuberculosis
gcgcgacagccaa

SEQ ID NO: 2955362 - RNA, 17 nt, Mycobacterium avium subsp. paratuberculosis
gcgcgacaucaccgcgg

SEQ ID NO: 2955363 - RNA, 19 nt, Mycobacterium avium subsp. paratuberculosis
gcgcgacaucaccgcgggc

SEQ ID NO: 2955364 - RNA, 23 nt, Mycobacterium avium subsp. paratuberculosis
gcgcgacaucaccgcgggcgcgc

SEQ ID NO: 2955365 - RNA, 14 nt, Mycobacterium avium subsp. paratuberculosis
gcgcgacaucgccg

SEQ ID NO: 2955366 - RNA, 15 nt, Mycobacterium avium subsp. paratuberculosis
gcgcgacaucgccgg

SEQ ID NO: 2955367 - RNA, 16 nt, Mycobacterium avium subsp. paratuberculosis
gcgcgacaucgccggc

SEQ ID NO: 2955368 - RNA, 15 nt, Mycobacterium avium subsp. paratuberculosis
gcgcgaccagcccgg

SEQ ID NO: 2955369 - RNA, 18 nt, Mycobacterium avium subsp. paratuberculosis
gcgcgaccagcccggccg

SEQ ID NO: 2955370 - RNA, 12 nt, Mycobacterium avium subsp. paratuberculosis
gcgcgaccagcg

SEQ ID NO: 2955371 - RNA, 18 nt, Mycobacterium avium subsp. paratuberculosis
gcgcgaccagcggcagca

SEQ ID NO: 2955372 - RNA, 21 nt, Mycobacterium avium subsp. paratuberculosis
gcgcgaccagcggcagcagca

SEQ ID NO: 2955373 - RNA, 13 nt, Mycobacterium avium subsp. paratuberculosis
gcgcgaccagguu

SEQ ID NO: 2955374 - RNA, 18 nt, Mycobacterium avium subsp. paratuberculosis
gcgcgaccaguaccgggc

SEQ ID NO: 2955375 - RNA, 20 nt, Mycobacterium avium subsp. paratuberculosis
gcgcgaccaguaccgggccu

SEQ ID NO: 2955376 - RNA, 21 nt, Mycobacterium avium subsp. paratuberculosis
gcgcgaccaguaccgggccug

SEQ ID NO: 2955377 - RNA, 18 nt, Mycobacterium avium subsp. paratuberculosis
gcgcgaccagugcaccuc

SEQ ID NO: 2955378 - RNA, 14 nt, Mycobacterium avium subsp. paratuberculosis
gcgcgaccaucagc

SEQ ID NO: 2955379 - RNA, 19 nt, Mycobacterium avium subsp. paratuberculosis
gcgcgacccgcucgacgcg

SEQ ID NO: 2955380 - RNA, 17 nt, Mycobacterium avium subsp. paratuberculosis
gcgcgaccgcccgggcc

SEQ ID NO: 2955381 - RNA, 18 nt, Mycobacterium avium subsp. paratuberculosis
gcgcgaccucgguggugc

SEQ ID NO: 2955382 - RNA, 15 nt, Mycobacterium avium subsp. paratuberculosis
gcgcgaccugcuugg

SEQ ID NO: 2955383 - RNA, 18 nt, Mycobacterium avium subsp. paratuberculosis
gcgcgaccugcuuggcgg

SEQ ID NO: 2955384 - RNA, 19 nt, Mycobacterium avium subsp. paratuberculosis
gcgcgacgaacagcaccgc

SEQ ID NO: 2955385 - RNA, 20 nt, Mycobacterium avium subsp. paratuberculosis
gcgcgacgaacagcaccgcc

SEQ ID NO: 2955386 - RNA, 22 nt, Mycobacterium avium subsp. paratuberculosis
gcgcgacgaacagcaccgccac

SEQ ID NO: 2955387 - RNA, 23 nt, Mycobacterium avium subsp. paratuberculosis
gcgcgacgaacagcaccgccacg

SEQ ID NO: 2955388 - RNA, 17 nt, Mycobacterium avium subsp. paratuberculosis
gcgcgacgaauccggug

SEQ ID NO: 2955389 - RNA, 19 nt, Mycobacterium avium subsp. paratuberculosis
gcgcgacgaauccggugac

SEQ ID NO: 2955390 - RNA, 16 nt, Mycobacterium avium subsp. paratuberculosis
gcgcgacgcacgccgg

SEQ ID NO: 2955391 - RNA, 17 nt, Mycobacterium avium subsp. paratuberculosis
gcgcgacgcacgccggc

SEQ ID NO: 2955392 - RNA, 14 nt, Mycobacterium avium subsp. paratuberculosis
gcgcgacgccgacg

SEQ ID NO: 2955393 - RNA, 15 nt, Mycobacterium avium subsp. paratuberculosis
gcgcgacgccgacgc

SEQ ID NO: 2955394 - RNA, 16 nt, Mycobacterium avium subsp. paratuberculosis
gcgcgacgccgacgcc

SEQ ID NO: 2955395 - RNA, 21 nt, Mycobacterium avium subsp. paratuberculosis
gcgcgacgccguagaucacgc

SEQ ID NO: 2955396 - RNA, 14 nt, Mycobacterium avium subsp. paratuberculosis
gcgcgacggccucg

SEQ ID NO: 2955397 - RNA, 14 nt, Mycobacterium avium subsp. paratuberculosis
gcgcgacggcgcgu

SEQ ID NO: 2955398 - RNA, 18 nt, Mycobacterium avium subsp. paratuberculosis
gcgcgacggcgcgugauc

SEQ ID NO: 2955399 - RNA, 14 nt, Mycobacterium avium subsp. paratuberculosis
gcgcgacggcgcug

SEQ ID NO: 2955400 - RNA, 15 nt, Mycobacterium avium subsp. paratuberculosis
gcgcgacgggcaccc

SEQ ID NO: 2955401 - RNA, 16 nt, Mycobacterium avium subsp. paratuberculosis
gcgcgacgggcacccg

SEQ ID NO: 2955402 - RNA, 13 nt, Mycobacterium avium subsp. paratuberculosis
gcgcgacgggcug

SEQ ID NO: 2955403 - RNA, 22 nt, Mycobacterium avium subsp. paratuberculosis
gcgcgacgggcugcugcacguc

SEQ ID NO: 2955404 - RNA, 22 nt, Mycobacterium avium subsp. paratuberculosis
gcgcgacgguguaggacgccgu

SEQ ID NO: 2955405 - RNA, 18 nt, Mycobacterium avium subsp. paratuberculosis
gcgcgacgucgaccgcga

SEQ ID NO: 2955406 - RNA, 18 nt, Mycobacterium avium subsp. paratuberculosis
gcgcgacgugccggcgau

SEQ ID NO: 2955407 - RNA, 20 nt, Mycobacterium avium subsp. paratuberculosis
gcgcgacgugccggcgaugg

SEQ ID NO: 2955408 - RNA, 13 nt, Mycobacterium avium subsp. paratuberculosis
gcgcgacugggcg

SEQ ID NO: 2955409 - RNA, 20 nt, Mycobacterium avium subsp. paratuberculosis
gcgcgagacaccucgucgau

SEQ ID NO: 2955410 - RNA, 18 nt, Mycobacterium avium subsp. paratuberculosis
gcgcgagaguaucgccac

SEQ ID NO: 2955411 - RNA, 17 nt, Mycobacterium avium subsp. paratuberculosis
gcgcgagauggcgauca

SEQ ID NO: 2955412 - RNA, 17 nt, Mycobacterium avium subsp. paratuberculosis
gcgcgagcagaucgcgg

SEQ ID NO: 2955413 - RNA, 13 nt, Mycobacterium avium subsp. paratuberculosis
gcgcgagcgcagc

SEQ ID NO: 2955414 - RNA, 18 nt, Mycobacterium avium subsp. paratuberculosis
gcgcgagcgcagcgccag

SEQ ID NO: 2955415 - RNA, 14 nt, Mycobacterium avium subsp. paratuberculosis
gcgcgagcgucacg

SEQ ID NO: 2955416 - RNA, 16 nt, Mycobacterium avium subsp. paratuberculosis
gcgcgagcgucacgcu

SEQ ID NO: 2955417 - RNA, 17 nt, Mycobacterium avium subsp. paratuberculosis
gcgcgagcgucacgcug

SEQ ID NO: 2955418 - RNA, 18 nt, Mycobacterium avium subsp. paratuberculosis
gcgcgagcgucacgcugg

SEQ ID NO: 2955419 - RNA, 17 nt, Mycobacterium avium subsp. paratuberculosis
gcgcgaggcggguaggc

SEQ ID NO: 2955420 - RNA, 21 nt, Mycobacterium avium subsp. paratuberculosis
gcgcgaggcggguaggcgucg

SEQ ID NO: 2955421 - RNA, 16 nt, Mycobacterium avium subsp. paratuberculosis
gcgcgaggucgacgga

SEQ ID NO: 2955422 - RNA, 23 nt, Mycobacterium avium subsp. paratuberculosis
gcgcgaggucgacggagucgucg

SEQ ID NO: 2955423 - RNA, 17 nt, Mycobacterium avium subsp. paratuberculosis
gcgcgaguaggcgaaga

SEQ ID NO: 2955424 - RNA, 17 nt, Mycobacterium avium subsp. paratuberculosis
gcgcgagucgagcaccg

SEQ ID NO: 2955425 - RNA, 23 nt, Mycobacterium avium subsp. paratuberculosis
gcgcgauagccggugaucgcggc

SEQ ID NO: 2955426 - RNA, 22 nt, Mycobacterium avium subsp. paratuberculosis
gcgcgaucaacgggucgagcac

SEQ ID NO: 2955427 - RNA, 14 nt, Mycobacterium avium subsp. paratuberculosis
gcgcgaucaggccg

SEQ ID NO: 2955428 - RNA, 16 nt, Mycobacterium avium subsp. paratuberculosis
gcgcgaucaggccggc

SEQ ID NO: 2955429 - RNA, 20 nt, Mycobacterium avium subsp. paratuberculosis
gcgcgaucaggccggccacc

SEQ ID NO: 2955430 - RNA, 13 nt, Mycobacterium avium subsp. paratuberculosis
gcgcgauccgcgc

SEQ ID NO: 2955431 - RNA, 15 nt, Mycobacterium avium subsp. paratuberculosis
gcgcgauccgcgcgu

SEQ ID NO: 2955432 - RNA, 16 nt, Mycobacterium avium subsp. paratuberculosis
gcgcgauccgcgcguc

SEQ ID NO: 2955433 - RNA, 19 nt, Mycobacterium avium subsp. paratuberculosis
gcgcgauccgcgcgucggg

SEQ ID NO: 2955434 - RNA, 20 nt, Mycobacterium avium subsp. paratuberculosis
gcgcgauccggggggcgggg

SEQ ID NO: 2955435 - RNA, 13 nt, Mycobacterium avium subsp. paratuberculosis
gcgcgaucgccgg

SEQ ID NO: 2955436 - RNA, 14 nt, Mycobacterium avium subsp. paratuberculosis
gcgcgaucgccggu

SEQ ID NO: 2955437 - RNA, 13 nt, Mycobacterium avium subsp. paratuberculosis
gcgcgaucggcag

SEQ ID NO: 2955438 - RNA, 20 nt, Mycobacterium avium subsp. paratuberculosis
gcgcgaucggcaggucgucg

SEQ ID NO: 2955439 - RNA, 21 nt, Mycobacterium avium subsp. paratuberculosis
gcgcgaucggcaggucgucga

SEQ ID NO: 2955440 - RNA, 13 nt, Mycobacterium avium subsp. paratuberculosis
gcgcgaucggccg

SEQ ID NO: 2955441 - RNA, 15 nt, Mycobacterium avium subsp. paratuberculosis
gcgcgaucggccgcu

SEQ ID NO: 2955442 - RNA, 22 nt, Mycobacterium avium subsp. paratuberculosis
gcgcgaucggccgcugcccggg

SEQ ID NO: 2955443 - RNA, 13 nt, Mycobacterium avium subsp. paratuberculosis
gcgcgaucggcga

SEQ ID NO: 2955444 - RNA, 14 nt, Mycobacterium avium subsp. paratuberculosis
gcgcgaucggcgag

SEQ ID NO: 2955445 - RNA, 20 nt, Mycobacterium avium subsp. paratuberculosis
gcgcgaucgguguccagccg

SEQ ID NO: 2955446 - RNA, 22 nt, Mycobacterium avium subsp. paratuberculosis
gcgcgaucgguguccagccgca

SEQ ID NO: 2955447 - RNA, 16 nt, Mycobacterium avium subsp. paratuberculosis
gcgcgaucgucgacca

SEQ ID NO: 2955448 - RNA, 17 nt, Mycobacterium avium subsp. paratuberculosis
gcgcgaucgucgaccac

SEQ ID NO: 2955449 - RNA, 21 nt, Mycobacterium avium subsp. paratuberculosis
gcgcgaugaucgccggcgccg

SEQ ID NO: 2955450 - RNA, 16 nt, Mycobacterium avium subsp. paratuberculosis
gcgcgaugccggccag

SEQ ID NO: 2955451 - RNA, 16 nt, Mycobacterium avium subsp. paratuberculosis
gcgcgaugcgggcgcc

SEQ ID NO: 2955452 - RNA, 20 nt, Mycobacterium avium subsp. paratuberculosis
gcgcgaugcgggcgccgaac

SEQ ID NO: 2955453 - RNA, 20 nt, Mycobacterium avium subsp. paratuberculosis
gcgcgaugcuauucgggcca

SEQ ID NO: 2955454 - RNA, 21 nt, Mycobacterium avium subsp. paratuberculosis
gcgcgaugcuauucgggccag

SEQ ID NO: 2955455 - RNA, 23 nt, Mycobacterium avium subsp. paratuberculosis
gcgcgaugcuauucgggccagcc

SEQ ID NO: 2955456 - RNA, 15 nt, Mycobacterium avium subsp. paratuberculosis
gcgcgauggacagca

SEQ ID NO: 2955457 - RNA, 18 nt, Mycobacterium avium subsp. paratuberculosis
gcgcgauggacagcagcc

SEQ ID NO: 2955458 - RNA, 21 nt, Mycobacterium avium subsp. paratuberculosis
gcgcgauggcgugccggcgcu

SEQ ID NO: 2955459 - RNA, 22 nt, Mycobacterium avium subsp. paratuberculosis
gcgcgauggcgugccggcgcug

SEQ ID NO: 2955460 - RNA, 15 nt, Mycobacterium avium subsp. paratuberculosis
gcgcgaugucgacgg

SEQ ID NO: 2955461 - RNA, 21 nt, Mycobacterium avium subsp. paratuberculosis
gcgcgcaacagcgucucgacg

SEQ ID NO: 2955462 - RNA, 15 nt, Mycobacterium avium subsp. paratuberculosis
gcgcgcaacgacgaa

SEQ ID NO: 2955463 - RNA, 15 nt, Mycobacterium avium subsp. paratuberculosis
gcgcgcaacgaggcg

SEQ ID NO: 2955464 - RNA, 19 nt, Mycobacterium avium subsp. paratuberculosis
gcgcgcaacgaggcggugg

SEQ ID NO: 2955465 - RNA, 21 nt, Mycobacterium avium subsp. paratuberculosis
gcgcgcaacgaggcgguggug

SEQ ID NO: 2955466 - RNA, 23 nt, Mycobacterium avium subsp. paratuberculosis
gcgcgcaacgauucacccagcga

SEQ ID NO: 2955467 - RNA, 21 nt, Mycobacterium avium subsp. paratuberculosis
gcgcgcacaauucggucagcg

SEQ ID NO: 2955468 - RNA, 15 nt, Mycobacterium avium subsp. paratuberculosis
gcgcgcacagcgcca

SEQ ID NO: 2955469 - RNA, 17 nt, Mycobacterium avium subsp. paratuberculosis
gcgcgcacagcgccaca

SEQ ID NO: 2955470 - RNA, 16 nt, Mycobacterium avium subsp. paratuberculosis
gcgcgcaccacgugcg

SEQ ID NO: 2955471 - RNA, 12 nt, Mycobacterium avium subsp. paratuberculosis
gcgcgcaccagc

SEQ ID NO: 2955472 - RNA, 14 nt, Mycobacterium avium subsp. paratuberculosis
gcgcgcaccagcuc

SEQ ID NO: 2955473 - RNA, 16 nt, Mycobacterium avium subsp. paratuberculosis
gcgcgcaccagcucgg

SEQ ID NO: 2955474 - RNA, 15 nt, Mycobacterium avium subsp. paratuberculosis
gcgcgcaccccggca

SEQ ID NO: 2955475 - RNA, 13 nt, Mycobacterium avium subsp. paratuberculosis
gcgcgcaccgcga

SEQ ID NO: 2955476 - RNA, 14 nt, Mycobacterium avium subsp. paratuberculosis
gcgcgcaccgcgaa

SEQ ID NO: 2955477 - RNA, 19 nt, Mycobacterium avium subsp. paratuberculosis
gcgcgcaccgcgggcagca

SEQ ID NO: 2955478 - RNA, 21 nt, Mycobacterium avium subsp. paratuberculosis
gcgcgcaccgguuugucggcg

SEQ ID NO: 2955479 - RNA, 20 nt, Mycobacterium avium subsp. paratuberculosis
gcgcgcaccugaaccgcgca

SEQ ID NO: 2955480 - RNA, 21 nt, Mycobacterium avium subsp. paratuberculosis
gcgcgcaccugaaccgcgcac

SEQ ID NO: 2955481 - RNA, 13 nt, Mycobacterium avium subsp. paratuberculosis
gcgcgcacgcgga

SEQ ID NO: 2955482 - RNA, 15 nt, Mycobacterium avium subsp. paratuberculosis
gcgcgcacgcggaca

SEQ ID NO: 2955483 - RNA, 17 nt, Mycobacterium avium subsp. paratuberculosis
gcgcgcacgcggacacg

SEQ ID NO: 2955484 - RNA, 13 nt, Mycobacterium avium subsp. paratuberculosis
gcgcgcacggcag

SEQ ID NO: 2955485 - RNA, 17 nt, Mycobacterium avium subsp. paratuberculosis
gcgcgcacggcagcccg

SEQ ID NO: 2955486 - RNA, 18 nt, Mycobacterium avium subsp. paratuberculosis
gcgcgcacggcagcccga

SEQ ID NO: 2955487 - RNA, 23 nt, Mycobacterium avium subsp. paratuberculosis
gcgcgcacggcagcccgacgucc

SEQ ID NO: 2955488 - RNA, 17 nt, Mycobacterium avium subsp. paratuberculosis
gcgcgcacgucaccgcg

SEQ ID NO: 2955489 - RNA, 20 nt, Mycobacterium avium subsp. paratuberculosis
gcgcgcacguuggcggccag

SEQ ID NO: 2955490 - RNA, 12 nt, Mycobacterium avium subsp. paratuberculosis
gcgcgcacuucc

SEQ ID NO: 2955491 - RNA, 17 nt, Mycobacterium avium subsp. paratuberculosis
gcgcgcagaacaccacc

SEQ ID NO: 2955492 - RNA, 15 nt, Mycobacterium avium subsp. paratuberculosis
gcgcgcagaucgucg

SEQ ID NO: 2955493 - RNA, 18 nt, Mycobacterium avium subsp. paratuberculosis
gcgcgcagaucgucgacc

SEQ ID NO: 2955494 - RNA, 19 nt, Mycobacterium avium subsp. paratuberculosis
gcgcgcagcacaaaagggc

SEQ ID NO: 2955495 - RNA, 13 nt, Mycobacterium avium subsp. paratuberculosis
gcgcgcagcacca

SEQ ID NO: 2955496 - RNA, 14 nt, Mycobacterium avium subsp. paratuberculosis
gcgcgcagcaccag

SEQ ID NO: 2955497 - RNA, 15 nt, Mycobacterium avium subsp. paratuberculosis
gcgcgcagcaccagc

SEQ ID NO: 2955498 - RNA, 17 nt, Mycobacterium avium subsp. paratuberculosis
gcgcgcagcaccagcuc

SEQ ID NO: 2955499 - RNA, 18 nt, Mycobacterium avium subsp. paratuberculosis
gcgcgccgaugccgcgcu

SEQ ID NO: 2955500 - RNA, 17 nt, Mycobacterium avium subsp. paratuberculosis
gcgcgccgauguggccg

SEQ ID NO: 2955501 - RNA, 12 nt, Mycobacterium avium subsp. paratuberculosis
gcgcgccgcaca

SEQ ID NO: 2955502 - RNA, 15 nt, Mycobacterium avium subsp. paratuberculosis
gcgcgccgcacagcc

SEQ ID NO: 2955503 - RNA, 18 nt, Mycobacterium avium subsp. paratuberculosis
gcgcgccgcacagccggc

SEQ ID NO: 2955504 - RNA, 22 nt, Mycobacterium avium subsp. paratuberculosis
gcgcgccgcacagccggcggcg

SEQ ID NO: 2955505 - RNA, 12 nt, Mycobacterium avium subsp. paratuberculosis
gcgcgccgcacc

SEQ ID NO: 2955506 - RNA, 15 nt, Mycobacterium avium subsp. paratuberculosis
gcgcgccgcaccucg

SEQ ID NO: 2955507 - RNA, 15 nt, Mycobacterium avium subsp. paratuberculosis
gcgcgccgcagcgcg

SEQ ID NO: 2955508 - RNA, 16 nt, Mycobacterium avium subsp. paratuberculosis
gcgcgccgcagcgcgc

SEQ ID NO: 2955509 - RNA, 13 nt, Mycobacterium avium subsp. paratuberculosis
gcgcgccgcagga

SEQ ID NO: 2955510 - RNA, 13 nt, Mycobacterium avium subsp. paratuberculosis
gcgcgccgcccag

SEQ ID NO: 2955511 - RNA, 17 nt, Mycobacterium avium subsp. paratuberculosis
gcgcgccgcccagcggu

SEQ ID NO: 2955512 - RNA, 15 nt, Mycobacterium avium subsp. paratuberculosis
gcgcgccgcccccgc

SEQ ID NO: 2955513 - RNA, 16 nt, Mycobacterium avium subsp. paratuberculosis
gcgcgccgcccccgcg

SEQ ID NO: 2955514 - RNA, 19 nt, Mycobacterium avium subsp. paratuberculosis
gcgcgccgcccucgccgaa

SEQ ID NO: 2955515 - RNA, 24 nt, Mycobacterium avium subsp. paratuberculosis
gcgcgccgccgccgcccacgccgc

SEQ ID NO: 2955516 - RNA, 13 nt, Mycobacterium avium subsp. paratuberculosis
gcgcgccgcgacg

SEQ ID NO: 2955517 - RNA, 12 nt, Mycobacterium avium subsp. paratuberculosis
gcgcgccgcgau

SEQ ID NO: 2955518 - RNA, 16 nt, Mycobacterium avium subsp. paratuberculosis
gcgcgccgcgcuggcc

SEQ ID NO: 2955519 - RNA, 16 nt, Mycobacterium avium subsp. paratuberculosis
gcgcgccgcguucggc

SEQ ID NO: 2955520 - RNA, 17 nt, Mycobacterium avium subsp. paratuberculosis
gcgcgccgcguucggcg

SEQ ID NO: 2955521 - RNA, 14 nt, Mycobacterium avium subsp. paratuberculosis
gcgcgccggagauc

SEQ ID NO: 2955522 - RNA, 13 nt, Mycobacterium avium subsp. paratuberculosis
gcgcgccggccag

SEQ ID NO: 2955523 - RNA, 14 nt, Mycobacterium avium subsp. paratuberculosis
gcgcgccggccagc

SEQ ID NO: 2955524 - RNA, 17 nt, Mycobacterium avium subsp. paratuberculosis
gcgcgccggccagcacg

SEQ ID NO: 2955525 - RNA, 19 nt, Mycobacterium avium subsp. paratuberculosis
gcgcgccggccagcacggc

SEQ ID NO: 2955526 - RNA, 23 nt, Mycobacterium avium subsp. paratuberculosis
gcgcgccggccagcacggcggcg

SEQ ID NO: 2955527 - RNA, 18 nt, Mycobacterium avium subsp. paratuberculosis
gcgcgccggccagcagca

SEQ ID NO: 2955528 - RNA, 13 nt, Mycobacterium avium subsp. paratuberculosis
gcgcgccggcccg

SEQ ID NO: 2955529 - RNA, 12 nt, Mycobacterium avium subsp. paratuberculosis
gcgcgccggccg

SEQ ID NO: 2955530 - RNA, 14 nt, Mycobacterium avium subsp. paratuberculosis
gcgcgccggccgga

SEQ ID NO: 2955531 - RNA, 14 nt, Mycobacterium avium subsp. paratuberculosis
gcgcgccggccggc

SEQ ID NO: 2955532 - RNA, 13 nt, Mycobacterium avium subsp. paratuberculosis
gcgcgccggcgca

SEQ ID NO: 2955533 - RNA, 14 nt, Mycobacterium avium subsp. paratuberculosis
gcgcgccggcgcag

SEQ ID NO: 2955534 - RNA, 18 nt, Mycobacterium avium subsp. paratuberculosis
gcgcgccggcgcagcggc

SEQ ID NO: 2955535 - RNA, 12 nt, Mycobacterium avium subsp. paratuberculosis
gcgcgccggcgg

SEQ ID NO: 2955536 - RNA, 14 nt, Mycobacterium avium subsp. paratuberculosis
gcgcgccggcggcc

SEQ ID NO: 2955537 - RNA, 15 nt, Mycobacterium avium subsp. paratuberculosis
gcgcgccggcggccg

SEQ ID NO: 2955538 - RNA, 22 nt, Mycobacterium avium subsp. paratuberculosis
gcgcgccggcggccgccgcccg

SEQ ID NO: 2955539 - RNA, 12 nt, Mycobacterium avium subsp. paratuberculosis
gcgcgccggcgu

SEQ ID NO: 2955540 - RNA, 23 nt, Mycobacterium avium subsp. paratuberculosis
gcgcgccgggaucacacgcgcgc

SEQ ID NO: 2955541 - RNA, 13 nt, Mycobacterium avium subsp. paratuberculosis
gcgcgccgggcag

SEQ ID NO: 2955542 - RNA, 14 nt, Mycobacterium avium subsp. paratuberculosis
gcgcgccgggcagc

SEQ ID NO: 2955543 - RNA, 18 nt, Mycobacterium avium subsp. paratuberculosis
gcgcgccgggcagcccgc

SEQ ID NO: 2955544 - RNA, 21 nt, Mycobacterium avium subsp. paratuberculosis
gcgcgccgguaaugggcgauc

SEQ ID NO: 2955545 - RNA, 13 nt, Mycobacterium avium subsp. paratuberculosis
gcgcgccguaccg

SEQ ID NO: 2955546 - RNA, 16 nt, Mycobacterium avium subsp. paratuberculosis
gcgcgccgucccagcc

SEQ ID NO: 2955547 - RNA, 11 nt, Mycobacterium avium subsp. paratuberculosis
gcgcgccgucg

SEQ ID NO: 2955548 - RNA, 13 nt, Mycobacterium avium subsp. paratuberculosis
gcgcgccgucggc

SEQ ID NO: 2955549 - RNA, 14 nt, Mycobacterium avium subsp. paratuberculosis
gcgcgccgucggcg

SEQ ID NO: 2955550 - RNA, 14 nt, Mycobacterium avium subsp. paratuberculosis
gcgcgccgugacgc

SEQ ID NO: 2955551 - RNA, 15 nt, Mycobacterium avium subsp. paratuberculosis
gcgcgccguuggugg

SEQ ID NO: 2955552 - RNA, 14 nt, Mycobacterium avium subsp. paratuberculosis
gcgcgccugcgcgg

SEQ ID NO: 2955553 - RNA, 15 nt, Mycobacterium avium subsp. paratuberculosis
gcgcgccugcgcggc

SEQ ID NO: 2955554 - RNA, 16 nt, Mycobacterium avium subsp. paratuberculosis
gcgcgccugcgcggcg

SEQ ID NO: 2955555 - RNA, 20 nt, Mycobacterium avium subsp. paratuberculosis
gcgcgccugcgcggcggcgu

SEQ ID NO: 2955556 - RNA, 20 nt, Mycobacterium avium subsp. paratuberculosis
gcgcgcgaaaaaacggcggc

SEQ ID NO: 2955557 - RNA, 20 nt, Mycobacterium avium subsp. paratuberculosis
gcgcgcgaacagguccuugc

SEQ ID NO: 2955558 - RNA, 13 nt, Mycobacterium avium subsp. paratuberculosis
gcgcgcgacggcg

SEQ ID NO: 2955559 - RNA, 12 nt, Mycobacterium avium subsp. paratuberculosis
gcgcgcgaucag

SEQ ID NO: 2955560 - RNA, 16 nt, Mycobacterium avium subsp. paratuberculosis
gcgcgcgaucagcgcc

SEQ ID NO: 2955561 - RNA, 17 nt, Mycobacterium avium subsp. paratuberculosis
gcgcgcgaucagcgccg

SEQ ID NO: 2955562 - RNA, 19 nt, Mycobacterium avium subsp. paratuberculosis
gcgcgcgaucgccggugcg

SEQ ID NO: 2955563 - RNA, 20 nt, Mycobacterium avium subsp. paratuberculosis
gcgcgcgaucgguguccagc

SEQ ID NO: 2955564 - RNA, 12 nt, Mycobacterium avium subsp. paratuberculosis
gcgcgcgcaccu

SEQ ID NO: 2955565 - RNA, 23 nt, Mycobacterium avium subsp. paratuberculosis
gcgcgcgcaccugaaccgcgcac

SEQ ID NO: 2955566 - RNA, 13 nt, Mycobacterium avium subsp. paratuberculosis
gcgcgcgccacga

SEQ ID NO: 2955567 - RNA, 14 nt, Mycobacterium avium subsp. paratuberculosis
gcgcgcgccagcgu

SEQ ID NO: 2955568 - RNA, 12 nt, Mycobacterium avium subsp. paratuberculosis
gcgcgcgccgau

SEQ ID NO: 2955569 - RNA, 13 nt, Mycobacterium avium subsp. paratuberculosis
gcgcgcgccgccc

SEQ ID NO: 2955570 - RNA, 17 nt, Mycobacterium avium subsp. paratuberculosis
gcgcgcgccgcccccgc

SEQ ID NO: 2955571 - RNA, 12 nt, Mycobacterium avium subsp. paratuberculosis
gcgcgcgccggg

SEQ ID NO: 2955572 - RNA, 12 nt, Mycobacterium avium subsp. paratuberculosis
gcgcgcgcgcca

SEQ ID NO: 2955573 - RNA, 13 nt, Mycobacterium avium subsp. paratuberculosis
gcgcgcgcggccu

SEQ ID NO: 2955574 - RNA, 12 nt, Mycobacterium avium subsp. paratuberculosis
gcgcgcgcucgg

SEQ ID NO: 2955575 - RNA, 14 nt, Mycobacterium avium subsp. paratuberculosis
gcgcgcgcucggcg

SEQ ID NO: 2955576 - RNA, 23 nt, Mycobacterium avium subsp. paratuberculosis
gcgcgcgcuggugcgggccagca

SEQ ID NO: 2955577 - RNA, 13 nt, Mycobacterium avium subsp. paratuberculosis
gcgcgcggccacc

SEQ ID NO: 2955578 - RNA, 14 nt, Mycobacterium avium subsp. paratuberculosis
gcgcgcggccaccg

SEQ ID NO: 2955579 - RNA, 13 nt, Mycobacterium avium subsp. paratuberculosis
gcgcgcggccagc

SEQ ID NO: 2955580 - RNA, 14 nt, Mycobacterium avium subsp. paratuberculosis
gcgcgcggccagcc

SEQ ID NO: 2955581 - RNA, 16 nt, Mycobacterium avium subsp. paratuberculosis
gcgcgcggccagcccc

SEQ ID NO: 2955582 - RNA, 18 nt, Mycobacterium avium subsp. paratuberculosis
gcgcgcggcccagcguca

SEQ ID NO: 2955583 - RNA, 14 nt, Mycobacterium avium subsp. paratuberculosis
gcgcgcggccgcga

SEQ ID NO: 2955584 - RNA, 18 nt, Mycobacterium avium subsp. paratuberculosis
gcgcgcggccuccagccg

SEQ ID NO: 2955585 - RNA, 17 nt, Mycobacterium avium subsp. paratuberculosis
gcgcggagccggccgcc

SEQ ID NO: 2955586 - RNA, 17 nt, Mycobacterium avium subsp. paratuberculosis
gcgcggagcgucgcgau

SEQ ID NO: 2955587 - RNA, 20 nt, Mycobacterium avium subsp. paratuberculosis
gcgcggaugacgugcaccac

SEQ ID NO: 2955588 - RNA, 21 nt, Mycobacterium avium subsp. paratuberculosis
gcgcggaugacgugcaccacc

SEQ ID NO: 2955589 - RNA, 18 nt, Mycobacterium avium subsp. paratuberculosis
gcgcggaugcccaggccg

SEQ ID NO: 2955590 - RNA, 20 nt, Mycobacterium avium subsp. paratuberculosis
gcgcggaugcccaggccggc

SEQ ID NO: 2955591 - RNA, 21 nt, Mycobacterium avium subsp. paratuberculosis
gcgcggaugcccaggccggcg

SEQ ID NO: 2955592 - RNA, 22 nt, Mycobacterium avium subsp. paratuberculosis
gcgcggaugcccaggccggcga

SEQ ID NO: 2955593 - RNA, 18 nt, Mycobacterium avium subsp. paratuberculosis
gcgcggauggguggcgau

SEQ ID NO: 2955594 - RNA, 21 nt, Mycobacterium avium subsp. paratuberculosis
gcgcggauuccagcgcgaccg

SEQ ID NO: 2955595 - RNA, 22 nt, Mycobacterium avium subsp. paratuberculosis
gcgcggauuccagcgcgaccgc

SEQ ID NO: 2955596 - RNA, 20 nt, Mycobacterium avium subsp. paratuberculosis
gcgcggauuucucagcggcg

SEQ ID NO: 2955597 - RNA, 21 nt, Mycobacterium avium subsp. paratuberculosis
gcgcggauuucucagcggcgc

SEQ ID NO: 2955598 - RNA, 14 nt, Mycobacterium avium subsp. paratuberculosis
gcgcggcacgggcc

SEQ ID NO: 2955599 - RNA, 15 nt, Mycobacterium avium subsp. paratuberculosis
gcgcggcacgggccg

SEQ ID NO: 2955600 - RNA, 22 nt, Mycobacterium avium subsp. paratuberculosis
gcgcggcaggaauuccagcgac

SEQ ID NO: 2955601 - RNA, 15 nt, Mycobacterium avium subsp. paratuberculosis
gcgcggcagggccag

SEQ ID NO: 2955602 - RNA, 17 nt, Mycobacterium avium subsp. paratuberculosis
gcgcggcagggccaggc

SEQ ID NO: 2955603 - RNA, 22 nt, Mycobacterium avium subsp. paratuberculosis
gcgcggcagggccaggccguga

SEQ ID NO: 2955604 - RNA, 14 nt, Mycobacterium avium subsp. paratuberculosis
gcgcggcaucggcg

SEQ ID NO: 2955605 - RNA, 12 nt, Mycobacterium avium subsp. paratuberculosis
gcgcggcaucgu

SEQ ID NO: 2955606 - RNA, 21 nt, Mycobacterium avium subsp. paratuberculosis
gcgcggcaucgucaccucgag

SEQ ID NO: 2955607 - RNA, 19 nt, Mycobacterium avium subsp. paratuberculosis
gcgcggcaugccgcccggg

SEQ ID NO: 2955608 - RNA, 18 nt, Mycobacterium avium subsp. paratuberculosis
gcgcggcauggcuggcgg

SEQ ID NO: 2955609 - RNA, 20 nt, Mycobacterium avium subsp. paratuberculosis
gcgcggcauggcuggcggca

SEQ ID NO: 2955610 - RNA, 12 nt, Mycobacterium avium subsp. paratuberculosis
gcgcggccacca

SEQ ID NO: 2955611 - RNA, 13 nt, Mycobacterium avium subsp. paratuberculosis
gcgcggccaccac

SEQ ID NO: 2955612 - RNA, 15 nt, Mycobacterium avium subsp. paratuberculosis
gcgcggccaccacca

SEQ ID NO: 2955613 - RNA, 19 nt, Mycobacterium avium subsp. paratuberculosis
gcgcggccaccaccacggc

SEQ ID NO: 2955614 - RNA, 21 nt, Mycobacterium avium subsp. paratuberculosis
gcgcggccaccaccacggcca

SEQ ID NO: 2955615 - RNA, 22 nt, Mycobacterium avium subsp. paratuberculosis
gcgcggccaccaccacggccau

SEQ ID NO: 2955616 - RNA, 18 nt, Mycobacterium avium subsp. paratuberculosis
gcgcggccaccacgacgg

SEQ ID NO: 2955617 - RNA, 14 nt, Mycobacterium avium subsp. paratuberculosis
gcgcggccaccagc

SEQ ID NO: 2955618 - RNA, 15 nt, Mycobacterium avium subsp. paratuberculosis
gcgcggccaccagcg

SEQ ID NO: 2955619 - RNA, 17 nt, Mycobacterium avium subsp. paratuberculosis
gcgcggccaccagcgcg

SEQ ID NO: 2955620 - RNA, 18 nt, Mycobacterium avium subsp. paratuberculosis
gcgcggccaccagcgcgg

SEQ ID NO: 2955621 - RNA, 19 nt, Mycobacterium avium subsp. paratuberculosis
gcgcggccaccagcgcggc

SEQ ID NO: 2955622 - RNA, 13 nt, Mycobacterium avium subsp. paratuberculosis
gcgcggccacccc

SEQ ID NO: 2955623 - RNA, 12 nt, Mycobacterium avium subsp. paratuberculosis
gcgcggccaccg

SEQ ID NO: 2955624 - RNA, 15 nt, Mycobacterium avium subsp. paratuberculosis
gcgcggccaccgcgc

SEQ ID NO: 2955625 - RNA, 21 nt, Mycobacterium avium subsp. paratuberculosis
gcgcggccaccgcgcgcugcc

SEQ ID NO: 2955626 - RNA, 17 nt, Mycobacterium avium subsp. paratuberculosis
gcgcggccaccuccagc

SEQ ID NO: 2955627 - RNA, 18 nt, Mycobacterium avium subsp. paratuberculosis
gcgcggccaccuccagcc

SEQ ID NO: 2955628 - RNA, 21 nt, Mycobacterium avium subsp. paratuberculosis
gcgcggccaccuccagcccgg

SEQ ID NO: 2955629 - RNA, 13 nt, Mycobacterium avium subsp. paratuberculosis
gcgcggccagcac

SEQ ID NO: 2955630 - RNA, 17 nt, Mycobacterium avium subsp. paratuberculosis
gcgcggccagcacgguc

SEQ ID NO: 2955631 - RNA, 13 nt, Mycobacterium avium subsp. paratuberculosis
gcgcggccagcgg

SEQ ID NO: 2955632 - RNA, 16 nt, Mycobacterium avium subsp. paratuberculosis
gcgcggccagcggcgc

SEQ ID NO: 2955633 - RNA, 18 nt, Mycobacterium avium subsp. paratuberculosis
gcgcggccagcggcgccg

SEQ ID NO: 2955634 - RNA, 20 nt, Mycobacterium avium subsp. paratuberculosis
gcgcggccagcugaacacga

SEQ ID NO: 2955635 - RNA, 14 nt, Mycobacterium avium subsp. paratuberculosis
gcgcggcccagcgu

SEQ ID NO: 2955636 - RNA, 13 nt, Mycobacterium avium subsp. paratuberculosis
gcgcggcccaggg

SEQ ID NO: 2955637 - RNA, 16 nt, Mycobacterium avium subsp. paratuberculosis
gcgcggcccaguucgc

SEQ ID NO: 2955638 - RNA, 16 nt, Mycobacterium avium subsp. paratuberculosis
gcgcggcccgccgaac

SEQ ID NO: 2955639 - RNA, 13 nt, Mycobacterium avium subsp. paratuberculosis
gcgcggcccgcgg

SEQ ID NO: 2955640 - RNA, 14 nt, Mycobacterium avium subsp. paratuberculosis
gcgcggcccgcggc

SEQ ID NO: 2955641 - RNA, 15 nt, Mycobacterium avium subsp. paratuberculosis
gcgcggcccgcggcg

SEQ ID NO: 2955642 - RNA, 16 nt, Mycobacterium avium subsp. paratuberculosis
gcgcggcccgcggcgu

SEQ ID NO: 2955643 - RNA, 17 nt, Mycobacterium avium subsp. paratuberculosis
gcgcggcccgcggcguc

SEQ ID NO: 2955644 - RNA, 15 nt, Mycobacterium avium subsp. paratuberculosis
gcgcggcccggcccg

SEQ ID NO: 2955645 - RNA, 19 nt, Mycobacterium avium subsp. paratuberculosis
gcgcggcccggcccgcugg

SEQ ID NO: 2955646 - RNA, 12 nt, Mycobacterium avium subsp. paratuberculosis
gcgcggcccguu

SEQ ID NO: 2955647 - RNA, 21 nt, Mycobacterium avium subsp. paratuberculosis
gcgcggccgauucggcgccgc

SEQ ID NO: 2955648 - RNA, 23 nt, Mycobacterium avium subsp. paratuberculosis
gcgcggccgauucggcgccgcga

SEQ ID NO: 2955649 - RNA, 11 nt, Mycobacterium avium subsp. paratuberculosis
gcgcggccgca

SEQ ID NO: 2955650 - RNA, 20 nt, Mycobacterium avium subsp. paratuberculosis
gcgcggccgcaugucgaccu

SEQ ID NO: 2955651 - RNA, 23 nt, Mycobacterium avium subsp. paratuberculosis
gcgcggccgccaggucggggccc

SEQ ID NO: 2955652 - RNA, 12 nt, Mycobacterium avium subsp. paratuberculosis
gcgcggccgccc

SEQ ID NO: 2955653 - RNA, 19 nt, Mycobacterium avium subsp. paratuberculosis
gcgcggccgcccagcccgc

SEQ ID NO: 2955654 - RNA, 22 nt, Mycobacterium avium subsp. paratuberculosis
gcgcggccgcccagucgccgcc

SEQ ID NO: 2955655 - RNA, 12 nt, Mycobacterium avium subsp. paratuberculosis
gcgcggccgccu

SEQ ID NO: 2955656 - RNA, 12 nt, Mycobacterium avium subsp. paratuberculosis
gcgcggccgcga

SEQ ID NO: 2955657 - RNA, 18 nt, Mycobacterium avium subsp. paratuberculosis
gcgcggccgcgucggcgg

SEQ ID NO: 2955658 - RNA, 12 nt, Mycobacterium avium subsp. paratuberculosis
gcgcggccggaa

SEQ ID NO: 2955659 - RNA, 19 nt, Mycobacterium avium subsp. paratuberculosis
gcgcggccggaucgaaucc

SEQ ID NO: 2955660 - RNA, 14 nt, Mycobacterium avium subsp. paratuberculosis
gcgcggccggccac

SEQ ID NO: 2955661 - RNA, 16 nt, Mycobacterium avium subsp. paratuberculosis
gcgcggccggccacgc

SEQ ID NO: 2955662 - RNA, 13 nt, Mycobacterium avium subsp. paratuberculosis
gcgcggccggccg

SEQ ID NO: 2955663 - RNA, 12 nt, Mycobacterium avium subsp. paratuberculosis
gcgcggccggcg

SEQ ID NO: 2955664 - RNA, 14 nt, Mycobacterium avium subsp. paratuberculosis
gcgcggccgggcgc

SEQ ID NO: 2955665 - RNA, 16 nt, Mycobacterium avium subsp. paratuberculosis
gcgcggccgggcgccc

SEQ ID NO: 2955666 - RNA, 15 nt, Mycobacterium avium subsp. paratuberculosis
gcgcggccgggcucc

SEQ ID NO: 2955667 - RNA, 14 nt, Mycobacterium avium subsp. paratuberculosis
gcgcggccggugcg

SEQ ID NO: 2955668 - RNA, 17 nt, Mycobacterium avium subsp. paratuberculosis
gcgcggccuccagccgc

SEQ ID NO: 2955669 - RNA, 14 nt, Mycobacterium avium subsp. paratuberculosis
gcgcggccugcagc

SEQ ID NO: 2955670 - RNA, 21 nt, Mycobacterium avium subsp. paratuberculosis
gcgcgguggcgugcagcgcgg

SEQ ID NO: 2955671 - RNA, 22 nt, Mycobacterium avium subsp. paratuberculosis
gcgcgguggcgugcagcgcggc

SEQ ID NO: 2955672 - RNA, 23 nt, Mycobacterium avium subsp. paratuberculosis
gcgcgguggcgugcagcgcggcg

SEQ ID NO: 2955673 - RNA, 13 nt, Mycobacterium avium subsp. paratuberculosis
gcgcggugggcgg

SEQ ID NO: 2955674 - RNA, 17 nt, Mycobacterium avium subsp. paratuberculosis
gcgcggugggcggcggg

SEQ ID NO: 2955675 - RNA, 20 nt, Mycobacterium avium subsp. paratuberculosis
gcgcggugggcggcgggagc

SEQ ID NO: 2955676 - RNA, 22 nt, Mycobacterium avium subsp. paratuberculosis
gcgcgguggucagcaccggcgu

SEQ ID NO: 2955677 - RNA, 19 nt, Mycobacterium avium subsp. paratuberculosis
gcgcgguggucagcggcgc

SEQ ID NO: 2955678 - RNA, 20 nt, Mycobacterium avium subsp. paratuberculosis
gcgcgguggucagcggcgcc

SEQ ID NO: 2955679 - RNA, 21 nt, Mycobacterium avium subsp. paratuberculosis
gcgcgguggucagcggcgcca

SEQ ID NO: 2955680 - RNA, 22 nt, Mycobacterium avium subsp. paratuberculosis
gcgcgguggucagcggcgccac

SEQ ID NO: 2955681 - RNA, 18 nt, Mycobacterium avium subsp. paratuberculosis
gcgcgguguacagcgcgc

SEQ ID NO: 2955682 - RNA, 21 nt, Mycobacterium avium subsp. paratuberculosis
gcgcgguguacagcgcgccgc

SEQ ID NO: 2955683 - RNA, 19 nt, Mycobacterium avium subsp. paratuberculosis
gcgcggugucgacgucggu

SEQ ID NO: 2955684 - RNA, 23 nt, Mycobacterium avium subsp. paratuberculosis
gcgcggugucgacgucgguggug

SEQ ID NO: 2955685 - RNA, 21 nt, Mycobacterium avium subsp. paratuberculosis
gcgcggugugcggcggcucgu

SEQ ID NO: 2955686 - RNA, 16 nt, Mycobacterium avium subsp. paratuberculosis
gcgcggugugggcgau

SEQ ID NO: 2955687 - RNA, 19 nt, Mycobacterium avium subsp. paratuberculosis
gcgcgguguuuggccgcgc

SEQ ID NO: 2955688 - RNA, 21 nt, Mycobacterium avium subsp. paratuberculosis
gcgcgguguuuggccgcgcag

SEQ ID NO: 2955689 - RNA, 15 nt, Mycobacterium avium subsp. paratuberculosis
gcgcgguuccggcgu

SEQ ID NO: 2955690 - RNA, 23 nt, Mycobacterium avium subsp. paratuberculosis
gcgcgguuccggcgugcagcacg

SEQ ID NO: 2955691 - RNA, 20 nt, Mycobacterium avium subsp. paratuberculosis
gcgcgguucuuggcguagug

SEQ ID NO: 2955692 - RNA, 19 nt, Mycobacterium avium subsp. paratuberculosis
gcgcgguugaccgccgaca

SEQ ID NO: 2955693 - RNA, 20 nt, Mycobacterium avium subsp. paratuberculosis
gcgcgguugaccgccgacac

SEQ ID NO: 2955694 - RNA, 16 nt, Mycobacterium avium subsp. paratuberculosis
gcgcgguugcccgcac

SEQ ID NO: 2955695 - RNA, 17 nt, Mycobacterium avium subsp. paratuberculosis
gcgcgguugcgguuguc

SEQ ID NO: 2955696 - RNA, 21 nt, Mycobacterium avium subsp. paratuberculosis
gcgcgguuucggcgucgccuu

SEQ ID NO: 2955697 - RNA, 18 nt, Mycobacterium avium subsp. paratuberculosis
gcgcguacaggucgcaca

SEQ ID NO: 2955698 - RNA, 15 nt, Mycobacterium avium subsp. paratuberculosis
gcgcguacuccgaca

SEQ ID NO: 2955699 - RNA, 14 nt, Mycobacterium avium subsp. paratuberculosis
gcgcguagcgcagc

SEQ ID NO: 2955700 - RNA, 16 nt, Mycobacterium avium subsp. paratuberculosis
gcgcguagcgcagcuc

SEQ ID NO: 2955701 - RNA, 20 nt, Mycobacterium avium subsp. paratuberculosis
gcgcguagcgcagcuccagg

SEQ ID NO: 2955702 - RNA, 19 nt, Mycobacterium avium subsp. paratuberculosis
gcgcguagucggcgucggc

SEQ ID NO: 2955703 - RNA, 18 nt, Mycobacterium avium subsp. paratuberculosis
gcgcguagugcucgcgca

SEQ ID NO: 2955704 - RNA, 16 nt, Mycobacterium avium subsp. paratuberculosis
gcgcguauuccagcgc

SEQ ID NO: 2955705 - RNA, 18 nt, Mycobacterium avium subsp. paratuberculosis
gcgcguauuccagcgcca

SEQ ID NO: 2955706 - RNA, 19 nt, Mycobacterium avium subsp. paratuberculosis
gcgcguauuccagcgccag

SEQ ID NO: 2955707 - RNA, 22 nt, Mycobacterium avium subsp. paratuberculosis
gcgcguauuccagcgccagcga

SEQ ID NO: 2955708 - RNA, 20 nt, Mycobacterium avium subsp. paratuberculosis
gcgcgucacgcuggcgugac

SEQ ID NO: 2955709 - RNA, 21 nt, Mycobacterium avium subsp. paratuberculosis
gcgcgucacgcuggcgugacg

SEQ ID NO: 2955710 - RNA, 14 nt, Mycobacterium avium subsp. paratuberculosis
gcgcgucagccguc

SEQ ID NO: 2955711 - RNA, 19 nt, Mycobacterium avium subsp. paratuberculosis
gcgcgucauggccgucggg

SEQ ID NO: 2955712 - RNA, 21 nt, Mycobacterium avium subsp. paratuberculosis
gcgcgucauggccgucggguc

SEQ ID NO: 2955713 - RNA, 23 nt, Mycobacterium avium subsp. paratuberculosis
gcgcguccacuccaauacggccc

SEQ ID NO: 2955714 - RNA, 16 nt, Mycobacterium avium subsp. paratuberculosis
gcgcguccaggugcgc

SEQ ID NO: 2955715 - RNA, 18 nt, Mycobacterium avium subsp. paratuberculosis
gcgcguccaggugcgccg

SEQ ID NO: 2955716 - RNA, 20 nt, Mycobacterium avium subsp. paratuberculosis
gcgcguccaggugcgccgcc

SEQ ID NO: 2955717 - RNA, 17 nt, Mycobacterium avium subsp. paratuberculosis
gcgcguccauggucgag

SEQ ID NO: 2955718 - RNA, 21 nt, Mycobacterium avium subsp. paratuberculosis
gcgcguccauggucgagccgc

SEQ ID NO: 2955719 - RNA, 14 nt, Mycobacterium avium subsp. paratuberculosis
gcgcguccgcgggc

SEQ ID NO: 2955720 - RNA, 16 nt, Mycobacterium avium subsp. paratuberculosis
gcgcguccgcgggcgg

SEQ ID NO: 2955721 - RNA, 22 nt, Mycobacterium avium subsp. paratuberculosis
gcgcguccgcgggcggggccug

SEQ ID NO: 2955722 - RNA, 15 nt, Mycobacterium avium subsp. paratuberculosis
gcgcguccggaggug

SEQ ID NO: 2955723 - RNA, 11 nt, Mycobacterium avium subsp. paratuberculosis
gcgcgucgacg

SEQ ID NO: 2955724 - RNA, 14 nt, Mycobacterium avium subsp. paratuberculosis
gcgcgucgacgcgg

SEQ ID NO: 2955725 - RNA, 22 nt, Mycobacterium avium subsp. paratuberculosis
gcgcgucgacguucgccgccag

SEQ ID NO: 2955726 - RNA, 24 nt, Mycobacterium avium subsp. paratuberculosis
gcgcgucgacguucgccgccagca

SEQ ID NO: 2955727 - RNA, 14 nt, Mycobacterium avium subsp. paratuberculosis
gcgcgucgagcagc

SEQ ID NO: 2955728 - RNA, 21 nt, Mycobacterium avium subsp. paratuberculosis
gcgcgucgagcagcaccaccc

SEQ ID NO: 2955729 - RNA, 23 nt, Mycobacterium avium subsp. paratuberculosis
gcgcgucgagcagcaccacccgc

SEQ ID NO: 2955730 - RNA, 22 nt, Mycobacterium avium subsp. paratuberculosis
gcgcgucgaggucgcgcagcac

SEQ ID NO: 2955731 - RNA, 11 nt, Mycobacterium avium subsp. paratuberculosis
gcgcgucgauc

SEQ ID NO: 2955732 - RNA, 14 nt, Mycobacterium avium subsp. paratuberculosis
gcgcgucgcacagc

SEQ ID NO: 2955733 - RNA, 14 nt, Mycobacterium avium subsp. paratuberculosis
gcgcgucgcgcagc

SEQ ID NO: 2955734 - RNA, 12 nt, Mycobacterium avium subsp. paratuberculosis
gcgcgucgcgcc

SEQ ID NO: 2955735 - RNA, 13 nt, Mycobacterium avium subsp. paratuberculosis
gcgcgucgcgccc

SEQ ID NO: 2955736 - RNA, 16 nt, Mycobacterium avium subsp. paratuberculosis
gcgcgucgcgcccggc

SEQ ID NO: 2955737 - RNA, 13 nt, Mycobacterium avium subsp. paratuberculosis
gcgcgucgcggcg

SEQ ID NO: 2955738 - RNA, 14 nt, Mycobacterium avium subsp. paratuberculosis
gcgcgucgcggcgc

SEQ ID NO: 2955739 - RNA, 17 nt, Mycobacterium avium subsp. paratuberculosis
gcgcgucgcggcgcgga

SEQ ID NO: 2955740 - RNA, 19 nt, Mycobacterium avium subsp. paratuberculosis
gcgcgucgcggcgcggacc

SEQ ID NO: 2955741 - RNA, 14 nt, Mycobacterium avium subsp. paratuberculosis
gcgcgucgcgggcc

SEQ ID NO: 2955742 - RNA, 14 nt, Mycobacterium avium subsp. paratuberculosis
gcgcgucgcggugg

SEQ ID NO: 2955743 - RNA, 19 nt, Mycobacterium avium subsp. paratuberculosis
gcgcgucgcugccguagcg

SEQ ID NO: 2955744 - RNA, 18 nt, Mycobacterium avium subsp. paratuberculosis
gcgcgucgcugggcagcc

SEQ ID NO: 2955745 - RNA, 21 nt, Mycobacterium avium subsp. paratuberculosis
gcgcgucgcugggcagccguc

SEQ ID NO: 2955746 - RNA, 14 nt, Mycobacterium avium subsp. paratuberculosis
gcgcgucggagauc

SEQ ID NO: 2955747 - RNA, 19 nt, Mycobacterium avium subsp. paratuberculosis
gcgcgucggagaucaccgg

SEQ ID NO: 2955748 - RNA, 20 nt, Mycobacterium avium subsp. paratuberculosis
gcgcgucggagaucaccggc

SEQ ID NO: 2955749 - RNA, 13 nt, Mycobacterium avium subsp. paratuberculosis
gcgcgucggccag

SEQ ID NO: 2955750 - RNA, 14 nt, Mycobacterium avium subsp. paratuberculosis
gcgcgucggccagc

SEQ ID NO: 2955751 - RNA, 23 nt, Mycobacterium avium subsp. paratuberculosis
gcgcgucggccagcaccaccaac

SEQ ID NO: 2955752 - RNA, 16 nt, Mycobacterium avium subsp. paratuberculosis
gcgcgucggccagcgc

SEQ ID NO: 2955753 - RNA, 22 nt, Mycobacterium avium subsp. paratuberculosis
gcgcgucggccagcgcgcgggc

SEQ ID NO: 2955754 - RNA, 15 nt, Mycobacterium avium subsp. paratuberculosis
gcgcucaacccgggc

SEQ ID NO: 2955755 - RNA, 17 nt, Mycobacterium avium subsp. paratuberculosis
gcgcucaacccgggccg

SEQ ID NO: 2955756 - RNA, 18 nt, Mycobacterium avium subsp. paratuberculosis
gcgcucaacccgggccgg

SEQ ID NO: 2955757 - RNA, 19 nt, Mycobacterium avium subsp. paratuberculosis
gcgcucaacccgggccgga

SEQ ID NO: 2955758 - RNA, 20 nt, Mycobacterium avium subsp. paratuberculosis
gcgcucaacccgggccggac

SEQ ID NO: 2955759 - RNA, 16 nt, Mycobacterium avium subsp. paratuberculosis
gcgcucaaccgcccag

SEQ ID NO: 2955760 - RNA, 18 nt, Mycobacterium avium subsp. paratuberculosis
gcgcucaaccgcccagcg

SEQ ID NO: 2955761 - RNA, 20 nt, Mycobacterium avium subsp. paratuberculosis
gcgcucaaccgcccagcggc

SEQ ID NO: 2955762 - RNA, 22 nt, Mycobacterium avium subsp. paratuberculosis
gcgcucaacgugauacgccgac

SEQ ID NO: 2955763 - RNA, 22 nt, Mycobacterium avium subsp. paratuberculosis
gcgcucacccaaaaaggcgcgg

SEQ ID NO: 2955764 - RNA, 13 nt, Mycobacterium avium subsp. paratuberculosis
gcgcucaccgcau

SEQ ID NO: 2955765 - RNA, 16 nt, Mycobacterium avium subsp. paratuberculosis
gcgcucaccgcaucga

SEQ ID NO: 2955766 - RNA, 20 nt, Mycobacterium avium subsp. paratuberculosis
gcgcucaccgcaucgaaccg

SEQ ID NO: 2955767 - RNA, 15 nt, Mycobacterium avium subsp. paratuberculosis
gcgcucaccgcgaug

SEQ ID NO: 2955768 - RNA, 16 nt, Mycobacterium avium subsp. paratuberculosis
gcgcucaccgcgauga

SEQ ID NO: 2955769 - RNA, 16 nt, Mycobacterium avium subsp. paratuberculosis
gcgcucaccgcggggu

SEQ ID NO: 2955770 - RNA, 23 nt, Mycobacterium avium subsp. paratuberculosis
gcgcucaccgcggggugcccggc

SEQ ID NO: 2955771 - RNA, 13 nt, Mycobacterium avium subsp. paratuberculosis
gcgcucaccggcg

SEQ ID NO: 2955772 - RNA, 18 nt, Mycobacterium avium subsp. paratuberculosis
gcgcucaccggcguggug

SEQ ID NO: 2955773 - RNA, 15 nt, Mycobacterium avium subsp. paratuberculosis
gcgcucaccgucgcg

SEQ ID NO: 2955774 - RNA, 16 nt, Mycobacterium avium subsp. paratuberculosis
gcgcucaccgucgcgg

SEQ ID NO: 2955775 - RNA, 17 nt, Mycobacterium avium subsp. paratuberculosis
gcgcucaccgucgcggu

SEQ ID NO: 2955776 - RNA, 13 nt, Mycobacterium avium subsp. paratuberculosis
gcgcucagcacgc

SEQ ID NO: 2955777 - RNA, 18 nt, Mycobacterium avium subsp. paratuberculosis
gcgcucagccccagcgga

SEQ ID NO: 2955778 - RNA, 14 nt, Mycobacterium avium subsp. paratuberculosis
gcgcucagcgcggc

SEQ ID NO: 2955779 - RNA, 15 nt, Mycobacterium avium subsp. paratuberculosis
gcgcucagcgcggcc

SEQ ID NO: 2955780 - RNA, 18 nt, Mycobacterium avium subsp. paratuberculosis
gcgcucagcgcggccaca

SEQ ID NO: 2955781 - RNA, 21 nt, Mycobacterium avium subsp. paratuberculosis
gcgcucagcgcggccacaccg

SEQ ID NO: 2955782 - RNA, 22 nt, Mycobacterium avium subsp. paratuberculosis
gcgcucagcgcggccacaccga

SEQ ID NO: 2955783 - RNA, 19 nt, Mycobacterium avium subsp. paratuberculosis
gcgcucagcgcggcgggcc

SEQ ID NO: 2955784 - RNA, 21 nt, Mycobacterium avium subsp. paratuberculosis
gcgcucagcgcggcgggccag

SEQ ID NO: 2955785 - RNA, 12 nt, Mycobacterium avium subsp. paratuberculosis
gcgcucagcggc

SEQ ID NO: 2955786 - RNA, 15 nt, Mycobacterium avium subsp. paratuberculosis
gcgcucagcggcagc

SEQ ID NO: 2955787 - RNA, 18 nt, Mycobacterium avium subsp. paratuberculosis
gcgcucagcggcagcguc

SEQ ID NO: 2955788 - RNA, 20 nt, Mycobacterium avium subsp. paratuberculosis
gcgcucagcggcagcgucgc

SEQ ID NO: 2955789 - RNA, 20 nt, Mycobacterium avium subsp. paratuberculosis
gcgcucagugcacgcucggc

SEQ ID NO: 2955790 - RNA, 22 nt, Mycobacterium avium subsp. paratuberculosis
gcgcucagugcacgcucggcgc

SEQ ID NO: 2955791 - RNA, 18 nt, Mycobacterium avium subsp. paratuberculosis
gcgcucaucaggcggccg

SEQ ID NO: 2955792 - RNA, 19 nt, Mycobacterium avium subsp. paratuberculosis
gcgcucaucaggcggccgg

SEQ ID NO: 2955793 - RNA, 20 nt, Mycobacterium avium subsp. paratuberculosis
gcgcucaucaggcggccggc

SEQ ID NO: 2955794 - RNA, 21 nt, Mycobacterium avium subsp. paratuberculosis
gcgcucaucguguccagcaug

SEQ ID NO: 2955795 - RNA, 14 nt, Mycobacterium avium subsp. paratuberculosis
gcgcuccaccaccg

SEQ ID NO: 2955796 - RNA, 14 nt, Mycobacterium avium subsp. paratuberculosis
gcgcuccagcaggc

SEQ ID NO: 2955797 - RNA, 16 nt, Mycobacterium avium subsp. paratuberculosis
gcgcuccagcaggcug

SEQ ID NO: 2955798 - RNA, 18 nt, Mycobacterium avium subsp. paratuberculosis
gcgcuccagcaggcuggc

SEQ ID NO: 2955799 - RNA, 20 nt, Mycobacterium avium subsp. paratuberculosis
gcgcuccagccacuccacca

SEQ ID NO: 2955800 - RNA, 16 nt, Mycobacterium avium subsp. paratuberculosis
gcgcuccagcgggcgg

SEQ ID NO: 2955801 - RNA, 13 nt, Mycobacterium avium subsp. paratuberculosis
gcgcucccgaugg

SEQ ID NO: 2955802 - RNA, 15 nt, Mycobacterium avium subsp. paratuberculosis
gcgcucccggcgccg

SEQ ID NO: 2955803 - RNA, 19 nt, Mycobacterium avium subsp. paratuberculosis
gcgcucccggcgccgccgu

SEQ ID NO: 2955804 - RNA, 15 nt, Mycobacterium avium subsp. paratuberculosis
gcgcuccugcagcgc

SEQ ID NO: 2955805 - RNA, 18 nt, Mycobacterium avium subsp. paratuberculosis
gcgcuccugcagcgcggc

SEQ ID NO: 2955806 - RNA, 19 nt, Mycobacterium avium subsp. paratuberculosis
gcgcuccugcagcgcggcg

SEQ ID NO: 2955807 - RNA, 23 nt, Mycobacterium avium subsp. paratuberculosis
gcgcuccugcagcgcggcgauca

SEQ ID NO: 2955808 - RNA, 16 nt, Mycobacterium avium subsp. paratuberculosis
gcgcuccugccagcgg

SEQ ID NO: 2955809 - RNA, 19 nt, Mycobacterium avium subsp. paratuberculosis
gcgcuccugccagcggcgc

SEQ ID NO: 2955810 - RNA, 20 nt, Mycobacterium avium subsp. paratuberculosis
gcgcuccugccagcggcgca

SEQ ID NO: 2955811 - RNA, 12 nt, Mycobacterium avium subsp. paratuberculosis
gcgcuccuggcc

SEQ ID NO: 2955812 - RNA, 18 nt, Mycobacterium avium subsp. paratuberculosis
gcgcuccuggccggacgg

SEQ ID NO: 2955813 - RNA, 17 nt, Mycobacterium avium subsp. paratuberculosis
gcgcucgaacucaccgg

SEQ ID NO: 2955814 - RNA, 23 nt, Mycobacterium avium subsp. paratuberculosis
gcgcucgaacucaccgguggccg

SEQ ID NO: 2955815 - RNA, 16 nt, Mycobacterium avium subsp. paratuberculosis
gcgcucgaccucggcg

SEQ ID NO: 2955816 - RNA, 18 nt, Mycobacterium avium subsp. paratuberculosis
gcgcucgaccucggcggc

SEQ ID NO: 2955817 - RNA, 22 nt, Mycobacterium avium subsp. paratuberculosis
gcgcucgaccucggcggccagc

SEQ ID NO: 2955818 - RNA, 15 nt, Mycobacterium avium subsp. paratuberculosis
gcgcucgacgaggcg

SEQ ID NO: 2955819 - RNA, 16 nt, Mycobacterium avium subsp. paratuberculosis
gcgcucgacgaugucg

SEQ ID NO: 2955820 - RNA, 21 nt, Mycobacterium avium subsp. paratuberculosis
gcgcucgacgaugucgacgcc

SEQ ID NO: 2955821 - RNA, 16 nt, Mycobacterium avium subsp. paratuberculosis
gcgcucgacggccugc

SEQ ID NO: 2955822 - RNA, 17 nt, Mycobacterium avium subsp. paratuberculosis
gcgcucgacggccugca

SEQ ID NO: 2955823 - RNA, 19 nt, Mycobacterium avium subsp. paratuberculosis
gcgcucgacggccugcacg

SEQ ID NO: 2955824 - RNA, 24 nt, Mycobacterium avium subsp. paratuberculosis
gcgcucgauggaauucgucggcgg

SEQ ID NO: 2955825 - RNA, 20 nt, Mycobacterium avium subsp. paratuberculosis
gcgcucgcacaacccgcccg

SEQ ID NO: 2955826 - RNA, 21 nt, Mycobacterium avium subsp. paratuberculosis
gcgcucgcacaacccgcccgg

SEQ ID NO: 2955827 - RNA, 13 nt, Mycobacterium avium subsp. paratuberculosis
gcgcucgcaccag

SEQ ID NO: 2955828 - RNA, 15 nt, Mycobacterium avium subsp. paratuberculosis
gcgcucgcaccagcg

SEQ ID NO: 2955829 - RNA, 15 nt, Mycobacterium avium subsp. paratuberculosis
gcgcucgccgcgcgg

SEQ ID NO: 2955830 - RNA, 21 nt, Mycobacterium avium subsp. paratuberculosis
gcgcucgccgcgcggcccgcg

SEQ ID NO: 2955831 - RNA, 14 nt, Mycobacterium avium subsp. paratuberculosis
gcgcucgccgucgg

SEQ ID NO: 2955832 - RNA, 19 nt, Mycobacterium avium subsp. paratuberculosis
gcgcucgccgucggccagc

SEQ ID NO: 2955833 - RNA, 23 nt, Mycobacterium avium subsp. paratuberculosis
gcgcucgccgucggccagcagcg

SEQ ID NO: 2955834 - RNA, 14 nt, Mycobacterium avium subsp. paratuberculosis
gcgcucggacucag

SEQ ID NO: 2955835 - RNA, 14 nt, Mycobacterium avium subsp. paratuberculosis
gcgcucggccagca

SEQ ID NO: 2955836 - RNA, 20 nt, Mycobacterium avium subsp. paratuberculosis
gcgcucggccagcagugcca

SEQ ID NO: 2955837 - RNA, 13 nt, Mycobacterium avium subsp. paratuberculosis
gcgcucggccauc

SEQ ID NO: 2955838 - RNA, 19 nt, Mycobacterium avium subsp. paratuberculosis
gcgcugccggcgcacccgc

SEQ ID NO: 2955839 - RNA, 13 nt, Mycobacterium avium subsp. paratuberculosis
gcgcugccggugc

SEQ ID NO: 2955840 - RNA, 16 nt, Mycobacterium avium subsp. paratuberculosis
gcgcugccggugcugc

SEQ ID NO: 2955841 - RNA, 13 nt, Mycobacterium avium subsp. paratuberculosis
gcgcugccguccu

SEQ ID NO: 2955842 - RNA, 13 nt, Mycobacterium avium subsp. paratuberculosis
gcgcugcgccggg

SEQ ID NO: 2955843 - RNA, 15 nt, Mycobacterium avium subsp. paratuberculosis
gcgcugcgccgggug

SEQ ID NO: 2955844 - RNA, 15 nt, Mycobacterium avium subsp. paratuberculosis
gcgcugcgccguuga

SEQ ID NO: 2955845 - RNA, 14 nt, Mycobacterium avium subsp. paratuberculosis
gcgcugcgcgacac

SEQ ID NO: 2955846 - RNA, 14 nt, Mycobacterium avium subsp. paratuberculosis
gcgcugcgcgccgc

SEQ ID NO: 2955847 - RNA, 12 nt, Mycobacterium avium subsp. paratuberculosis
gcgcugcgcggu

SEQ ID NO: 2955848 - RNA, 13 nt, Mycobacterium avium subsp. paratuberculosis
gcgcugcgcggug

SEQ ID NO: 2955849 - RNA, 16 nt, Mycobacterium avium subsp. paratuberculosis
gcgcugcgcgguggcg

SEQ ID NO: 2955850 - RNA, 12 nt, Mycobacterium avium subsp. paratuberculosis
gcgcugcggcgu

SEQ ID NO: 2955851 - RNA, 14 nt, Mycobacterium avium subsp. paratuberculosis
gcgcugcggcgucg

SEQ ID NO: 2955852 - RNA, 17 nt, Mycobacterium avium subsp. paratuberculosis
gcgcugcuguugcucgg

SEQ ID NO: 2955853 - RNA, 17 nt, Mycobacterium avium subsp. paratuberculosis
gcgcugcuugacccgcu

SEQ ID NO: 2955854 - RNA, 17 nt, Mycobacterium avium subsp. paratuberculosis
gcgcuggaucugcccga

SEQ ID NO: 2955855 - RNA, 14 nt, Mycobacterium avium subsp. paratuberculosis
gcgcuggccagcgc

SEQ ID NO: 2955856 - RNA, 16 nt, Mycobacterium avium subsp. paratuberculosis
gcgcuggccagcgcga

SEQ ID NO: 2955857 - RNA, 22 nt, Mycobacterium avium subsp. paratuberculosis
gcgcuggccagcgcgacggccu

SEQ ID NO: 2955858 - RNA, 14 nt, Mycobacterium avium subsp. paratuberculosis
gcgcuggccagcgu

SEQ ID NO: 2955859 - RNA, 16 nt, Mycobacterium avium subsp. paratuberculosis
gcgcuggccgaccccg

SEQ ID NO: 2955860 - RNA, 18 nt, Mycobacterium avium subsp. paratuberculosis
gcgcuggccgaucccggc

SEQ ID NO: 2955861 - RNA, 18 nt, Mycobacterium avium subsp. paratuberculosis
gcgcuggccgcgaacggc

SEQ ID NO: 2955862 - RNA, 17 nt, Mycobacterium avium subsp. paratuberculosis
gcgcuggccgcggccag

SEQ ID NO: 2955863 - RNA, 14 nt, Mycobacterium avium subsp. paratuberculosis
gcgcuggccggcca

SEQ ID NO: 2955864 - RNA, 17 nt, Mycobacterium avium subsp. paratuberculosis
gcgcuggccggccacca

SEQ ID NO: 2955865 - RNA, 19 nt, Mycobacterium avium subsp. paratuberculosis
gcgcuggccggccaccagc

SEQ ID NO: 2955866 - RNA, 20 nt, Mycobacterium avium subsp. paratuberculosis
gcgcuggccggccaccagcg

SEQ ID NO: 2955867 - RNA, 12 nt, Mycobacterium avium subsp. paratuberculosis
gcgcuggccggg

SEQ ID NO: 2955868 - RNA, 13 nt, Mycobacterium avium subsp. paratuberculosis
gcgcuggccgggu

SEQ ID NO: 2955869 - RNA, 19 nt, Mycobacterium avium subsp. paratuberculosis
gcgcuggccguggccguga

SEQ ID NO: 2955870 - RNA, 13 nt, Mycobacterium avium subsp. paratuberculosis
gcgcuggcgaaca

SEQ ID NO: 2955871 - RNA, 20 nt, Mycobacterium avium subsp. paratuberculosis
gcgcuggcgaacaugguggu

SEQ ID NO: 2955872 - RNA, 18 nt, Mycobacterium avium subsp. paratuberculosis
gcgcuggcgaccaucagc

SEQ ID NO: 2955873 - RNA, 22 nt, Mycobacterium avium subsp. paratuberculosis
gcgcuggcgauggugccgaagc

SEQ ID NO: 2955874 - RNA, 14 nt, Mycobacterium avium subsp. paratuberculosis
gcgcuggcgcaggc

SEQ ID NO: 2955875 - RNA, 14 nt, Mycobacterium avium subsp. paratuberculosis
gcgcuggcgcgccg

SEQ ID NO: 2955876 - RNA, 16 nt, Mycobacterium avium subsp. paratuberculosis
gcgcuggcggccaucg

SEQ ID NO: 2955877 - RNA, 22 nt, Mycobacterium avium subsp. paratuberculosis
gcgcuggcggccaucgccgcgg

SEQ ID NO: 2955878 - RNA, 15 nt, Mycobacterium avium subsp. paratuberculosis
gcgcugggagcgggc

SEQ ID NO: 2955879 - RNA, 16 nt, Mycobacterium avium subsp. paratuberculosis
gcgcugggagcgggcc

SEQ ID NO: 2955880 - RNA, 13 nt, Mycobacterium avium subsp. paratuberculosis
gcgcugggcuggc

SEQ ID NO: 2955881 - RNA, 15 nt, Mycobacterium avium subsp. paratuberculosis
gcgcugggcuggccg

SEQ ID NO: 2955882 - RNA, 16 nt, Mycobacterium avium subsp. paratuberculosis
gcgcugggugcgggcu

SEQ ID NO: 2955883 - RNA, 17 nt, Mycobacterium avium subsp. paratuberculosis
gcgcugggugcgggcug

SEQ ID NO: 2955884 - RNA, 22 nt, Mycobacterium avium subsp. paratuberculosis
gcgcuggguguuccccgggcga

SEQ ID NO: 2955885 - RNA, 22 nt, Mycobacterium avium subsp. paratuberculosis
gcgcugguaccgguugcccggu

SEQ ID NO: 2955886 - RNA, 16 nt, Mycobacterium avium subsp. paratuberculosis
gcgcugguaguggcgu

SEQ ID NO: 2955887 - RNA, 21 nt, Mycobacterium avium subsp. paratuberculosis
gcgcugguaguggcgugcggc

SEQ ID NO: 2955888 - RNA, 20 nt, Mycobacterium avium subsp. paratuberculosis
gcgcuggucaacucgacccg

SEQ ID NO: 2955889 - RNA, 21 nt, Mycobacterium avium subsp. paratuberculosis
gcgcuggucaacucgacccgc

SEQ ID NO: 2955890 - RNA, 18 nt, Mycobacterium avium subsp. paratuberculosis
gcgcugguccucggggau

SEQ ID NO: 2955891 - RNA, 14 nt, Mycobacterium avium subsp. paratuberculosis
gcgcuggucggcga

SEQ ID NO: 2955892 - RNA, 19 nt, Mycobacterium avium subsp. paratuberculosis
gcgcuggucggcgggcagc

SEQ ID NO: 2955893 - RNA, 16 nt, Mycobacterium avium subsp. paratuberculosis
gcgcuggugcacccga

SEQ ID NO: 2955894 - RNA, 15 nt, Mycobacterium avium subsp. paratuberculosis
gcgcuggugcgggcc

SEQ ID NO: 2955895 - RNA, 16 nt, Mycobacterium avium subsp. paratuberculosis
gcgcuggugcgggcca

SEQ ID NO: 2955896 - RNA, 17 nt, Mycobacterium avium subsp. paratuberculosis
gcgcuggugcgggccag

SEQ ID NO: 2955897 - RNA, 20 nt, Mycobacterium avium subsp. paratuberculosis
gcgcuggugcgggccagcac

SEQ ID NO: 2955898 - RNA, 16 nt, Mycobacterium avium subsp. paratuberculosis
gcgcuggugcugccga

SEQ ID NO: 2955899 - RNA, 17 nt, Mycobacterium avium subsp. paratuberculosis
gcgcugguugucgacgc

SEQ ID NO: 2955900 - RNA, 14 nt, Mycobacterium avium subsp. paratuberculosis
gcgcuguaccgcga

SEQ ID NO: 2955901 - RNA, 15 nt, Mycobacterium avium subsp. paratuberculosis
gcgcuguaggcggcg

SEQ ID NO: 2955902 - RNA, 17 nt, Mycobacterium avium subsp. paratuberculosis
gcgcuguaggcggcgug

SEQ ID NO: 2955903 - RNA, 16 nt, Mycobacterium avium subsp. paratuberculosis
gcgcuguaggucgcgu

SEQ ID NO: 2955904 - RNA, 20 nt, Mycobacterium avium subsp. paratuberculosis
gcgcuguaggucgcguacgg

SEQ ID NO: 2955905 - RNA, 19 nt, Mycobacterium avium subsp. paratuberculosis
gcgcuguccacguccugcc

SEQ ID NO: 2955906 - RNA, 13 nt, Mycobacterium avium subsp. paratuberculosis
gcgcugucgacgc

SEQ ID NO: 2955907 - RNA, 19 nt, Mycobacterium avium subsp. paratuberculosis
gcgcugucgcccucgaucg

SEQ ID NO: 2955908 - RNA, 13 nt, Mycobacterium avium subsp. paratuberculosis
gcgcugucggcgg

SEQ ID NO: 2955909 - RNA, 14 nt, Mycobacterium avium subsp. paratuberculosis
gcgcugucggcggg

SEQ ID NO: 2955910 - RNA, 21 nt, Mycobacterium avium subsp. paratuberculosis
gcgcugugcgccauguccggc

SEQ ID NO: 2955911 - RNA, 14 nt, Mycobacterium avium subsp. paratuberculosis
gcgcugugcgggug

SEQ ID NO: 2955912 - RNA, 16 nt, Mycobacterium avium subsp. paratuberculosis
gcgcuguggccguuga

SEQ ID NO: 2955913 - RNA, 13 nt, Mycobacterium avium subsp. paratuberculosis
gcgcuguucggga

SEQ ID NO: 2955914 - RNA, 14 nt, Mycobacterium avium subsp. paratuberculosis
gcgcuguucgggau

SEQ ID NO: 2955915 - RNA, 23 nt, Mycobacterium avium subsp. paratuberculosis
gcgcuguugcccaauucgacugc

SEQ ID NO: 2955916 - RNA, 16 nt, Mycobacterium avium subsp. paratuberculosis
gcgcuuccagcgcggc

SEQ ID NO: 2955917 - RNA, 14 nt, Mycobacterium avium subsp. paratuberculosis
gcgcuucgcgcugu

SEQ ID NO: 2955918 - RNA, 22 nt, Mycobacterium avium subsp. paratuberculosis
gcgcuucgcgcuguucgggauu

SEQ ID NO: 2955919 - RNA, 22 nt, Mycobacterium avium subsp. paratuberculosis
gcgcuugacgaacgccaccacg

SEQ ID NO: 2955920 - RNA, 18 nt, Mycobacterium avium subsp. paratuberculosis
gcgcuugacggccgggcc

SEQ ID NO: 2955921 - RNA, 19 nt, Mycobacterium avium subsp. paratuberculosis
gcgcuugccgcgacccggg

SEQ ID NO: 2955922 - RNA, 18 nt, Mycobacterium avium subsp. paratuberculosis
gcgcuugcgaccgccgcu

SEQ ID NO: 2955923 - RNA, 18 nt, Mycobacterium avium subsp. paratuberculosis
gcggaccccagcgugacg

SEQ ID NO: 2955924 - RNA, 23 nt, Mycobacterium avium subsp. paratuberculosis
gcggaccccagcgugacgucgac

SEQ ID NO: 2955925 - RNA, 17 nt, Mycobacterium avium subsp. paratuberculosis
gcggaccccagugcagg

SEQ ID NO: 2955926 - RNA, 19 nt, Mycobacterium avium subsp. paratuberculosis
gcggacccgacggucgggc

SEQ ID NO: 2955927 - RNA, 22 nt, Mycobacterium avium subsp. paratuberculosis
gcggacccgacggucgggccca

SEQ ID NO: 2955928 - RNA, 23 nt, Mycobacterium avium subsp. paratuberculosis
gcggacccgacggucgggcccag

SEQ ID NO: 2955929 - RNA, 19 nt, Mycobacterium avium subsp. paratuberculosis
gcggacccggaggcggcgg

SEQ ID NO: 2955930 - RNA, 15 nt, Mycobacterium avium subsp. paratuberculosis
gcggacccggucggc

SEQ ID NO: 2955931 - RNA, 17 nt, Mycobacterium avium subsp. paratuberculosis
gcggacccuggccagca

SEQ ID NO: 2955932 - RNA, 21 nt, Mycobacterium avium subsp. paratuberculosis
gcggacccuggccagcaccgc

SEQ ID NO: 2955933 - RNA, 22 nt, Mycobacterium avium subsp. paratuberculosis
gcggacccuggccagcaccgcg

SEQ ID NO: 2955934 - RNA, 16 nt, Mycobacterium avium subsp. paratuberculosis
gcggaccgcaccccca

SEQ ID NO: 2955935 - RNA, 20 nt, Mycobacterium avium subsp. paratuberculosis
gcggaccgcacccccagcuc

SEQ ID NO: 2955936 - RNA, 21 nt, Mycobacterium avium subsp. paratuberculosis
gcggaccggcgauuucggccg

SEQ ID NO: 2955937 - RNA, 22 nt, Mycobacterium avium subsp. paratuberculosis
gcggaccggcgauuucggccgu

SEQ ID NO: 2955938 - RNA, 14 nt, Mycobacterium avium subsp. paratuberculosis
gcggaccggcggcc

SEQ ID NO: 2955939 - RNA, 18 nt, Mycobacterium avium subsp. paratuberculosis
gcggaccggcggccgcca

SEQ ID NO: 2955940 - RNA, 20 nt, Mycobacterium avium subsp. paratuberculosis
gcggaccggcggccgccauc

SEQ ID NO: 2955941 - RNA, 18 nt, Mycobacterium avium subsp. paratuberculosis
gcggaccgucggugucga

SEQ ID NO: 2955942 - RNA, 23 nt, Mycobacterium avium subsp. paratuberculosis
gcggaccgucggugucgaagacg

SEQ ID NO: 2955943 - RNA, 16 nt, Mycobacterium avium subsp. paratuberculosis
gcggaccugggugcgc

SEQ ID NO: 2955944 - RNA, 17 nt, Mycobacterium avium subsp. paratuberculosis
gcggaccugggugcgcc

SEQ ID NO: 2955945 - RNA, 23 nt, Mycobacterium avium subsp. paratuberculosis
gcggaccugggugcgccacugcg

SEQ ID NO: 2955946 - RNA, 19 nt, Mycobacterium avium subsp. paratuberculosis
gcggaccuuggugucggcg

SEQ ID NO: 2955947 - RNA, 15 nt, Mycobacterium avium subsp. paratuberculosis
gcggacgacggccag

SEQ ID NO: 2955948 - RNA, 17 nt, Mycobacterium avium subsp. paratuberculosis
gcggacgauguccgccg

SEQ ID NO: 2955949 - RNA, 20 nt, Mycobacterium avium subsp. paratuberculosis
gcggacgauguccgccggcc

SEQ ID NO: 2955950 - RNA, 22 nt, Mycobacterium avium subsp. paratuberculosis
gcggacgauguccgccggccgg

SEQ ID NO: 2955951 - RNA, 23 nt, Mycobacterium avium subsp. paratuberculosis
gcggacgauguccgccggccggu

SEQ ID NO: 2955952 - RNA, 14 nt, Mycobacterium avium subsp. paratuberculosis
gcggacgccucgcc

SEQ ID NO: 2955953 - RNA, 13 nt, Mycobacterium avium subsp. paratuberculosis
gcggacgcggcca

SEQ ID NO: 2955954 - RNA, 18 nt, Mycobacterium avium subsp. paratuberculosis
gcggacgcggccagcgcc

SEQ ID NO: 2955955 - RNA, 19 nt, Mycobacterium avium subsp. paratuberculosis
gcggacgcggccagcgccc

SEQ ID NO: 2955956 - RNA, 14 nt, Mycobacterium avium subsp. paratuberculosis
gcggacgcggcgga

SEQ ID NO: 2955957 - RNA, 13 nt, Mycobacterium avium subsp. paratuberculosis
gcggacgcguuga

SEQ ID NO: 2955958 - RNA, 23 nt, Mycobacterium avium subsp. paratuberculosis
gcggacggaucgagucccgcgcg

SEQ ID NO: 2955959 - RNA, 16 nt, Mycobacterium avium subsp. paratuberculosis
gcggacggcaccgacg

SEQ ID NO: 2955960 - RNA, 14 nt, Mycobacterium avium subsp. paratuberculosis
gcggacggccagcc

SEQ ID NO: 2955961 - RNA, 22 nt, Mycobacterium avium subsp. paratuberculosis
gcggacgggaccacccgcagcg

SEQ ID NO: 2955962 - RNA, 14 nt, Mycobacterium avium subsp. paratuberculosis
gcggacgggccgca

SEQ ID NO: 2955963 - RNA, 19 nt, Mycobacterium avium subsp. paratuberculosis
gcggacgggccgcauccgc

SEQ ID NO: 2955964 - RNA, 19 nt, Mycobacterium avium subsp. paratuberculosis
gcggacggguugggcgcca

SEQ ID NO: 2955965 - RNA, 22 nt, Mycobacterium avium subsp. paratuberculosis
gcggacggguugggcgccagca

SEQ ID NO: 2955966 - RNA, 12 nt, Mycobacterium avium subsp. paratuberculosis
gcggacggucgc

SEQ ID NO: 2955967 - RNA, 14 nt, Mycobacterium avium subsp. paratuberculosis
gcggacggucgccg

SEQ ID NO: 2955968 - RNA, 13 nt, Mycobacterium avium subsp. paratuberculosis
gcggacucggcga

SEQ ID NO: 2955969 - RNA, 18 nt, Mycobacterium avium subsp. paratuberculosis
gcggacugcccgaccgcg

SEQ ID NO: 2955970 - RNA, 20 nt, Mycobacterium avium subsp. paratuberculosis
gcggacugcccgaccgcgcc

SEQ ID NO: 2955971 - RNA, 21 nt, Mycobacterium avium subsp. paratuberculosis
gcggacugcccgaccgcgccg

SEQ ID NO: 2955972 - RNA, 23 nt, Mycobacterium avium subsp. paratuberculosis
gcggacuggcugagcagcacccg

SEQ ID NO: 2955973 - RNA, 14 nt, Mycobacterium avium subsp. paratuberculosis
gcggacuggugggc

SEQ ID NO: 2955974 - RNA, 17 nt, Mycobacterium avium subsp. paratuberculosis
gcggacuggugggcguc

SEQ ID NO: 2955975 - RNA, 19 nt, Mycobacterium avium subsp. paratuberculosis
gcggacuggugggcgucgu

SEQ ID NO: 2955976 - RNA, 17 nt, Mycobacterium avium subsp. paratuberculosis
gcggagaaggugucgca

SEQ ID NO: 2955977 - RNA, 20 nt, Mycobacterium avium subsp. paratuberculosis
gcggagaaggugucgcacug

SEQ ID NO: 2955978 - RNA, 14 nt, Mycobacterium avium subsp. paratuberculosis
gcggagaucacccc

SEQ ID NO: 2955979 - RNA, 20 nt, Mycobacterium avium subsp. paratuberculosis
gcggagaucaccccuggcgg

SEQ ID NO: 2955980 - RNA, 21 nt, Mycobacterium avium subsp. paratuberculosis
gcggagaucaccccuggcggg

SEQ ID NO: 2955981 - RNA, 17 nt, Mycobacterium avium subsp. paratuberculosis
gcggagaucgugcugug

SEQ ID NO: 2955982 - RNA, 22 nt, Mycobacterium avium subsp. paratuberculosis
gcggagaugcuggugacgccgc

SEQ ID NO: 2955983 - RNA, 18 nt, Mycobacterium avium subsp. paratuberculosis
gcggagcggcggucacga

SEQ ID NO: 2955984 - RNA, 16 nt, Mycobacterium avium subsp. paratuberculosis
gcggagcgggucagcg

SEQ ID NO: 2955985 - RNA, 18 nt, Mycobacterium avium subsp. paratuberculosis
gcggaggaauucgccgac

SEQ ID NO: 2955986 - RNA, 20 nt, Mycobacterium avium subsp. paratuberculosis
gcggaggaauucgccgacgc

SEQ ID NO: 2955987 - RNA, 21 nt, Mycobacterium avium subsp. paratuberculosis
gcggaggaguuuuucggggug

SEQ ID NO: 2955988 - RNA, 22 nt, Mycobacterium avium subsp. paratuberculosis
gcggaggaguuuuucggggugg

SEQ ID NO: 2955989 - RNA, 18 nt, Mycobacterium avium subsp. paratuberculosis
gcggaggaugccggccag

SEQ ID NO: 2955990 - RNA, 12 nt, Mycobacterium avium subsp. paratuberculosis
gcggaggccugc

SEQ ID NO: 2955991 - RNA, 19 nt, Mycobacterium avium subsp. paratuberculosis
gcggaggccugcgcggccg

SEQ ID NO: 2955992 - RNA, 15 nt, Mycobacterium avium subsp. paratuberculosis
gcggaggcgagcagc

SEQ ID NO: 2955993 - RNA, 16 nt, Mycobacterium avium subsp. paratuberculosis
gcggaggcgagcagcc

SEQ ID NO: 2955994 - RNA, 17 nt, Mycobacterium avium subsp. paratuberculosis
gcggaggcgagcagccg

SEQ ID NO: 2955995 - RNA, 22 nt, Mycobacterium avium subsp. paratuberculosis
gcggaggcgagcagccgggugc

SEQ ID NO: 2955996 - RNA, 20 nt, Mycobacterium avium subsp. paratuberculosis
gcggaggucauggcgaccgc

SEQ ID NO: 2955997 - RNA, 14 nt, Mycobacterium avium subsp. paratuberculosis
gcggaguaggcgcc

SEQ ID NO: 2955998 - RNA, 16 nt, Mycobacterium avium subsp. paratuberculosis
gcggaguaggcgccgc

SEQ ID NO: 2955999 - RNA, 19 nt, Mycobacterium avium subsp. paratuberculosis
gcggaguaggcgccgccgc

SEQ ID NO: 2956000 - RNA, 23 nt, Mycobacterium avium subsp. paratuberculosis
gcggagucguagucgaugcccgc

SEQ ID NO: 2956001 - RNA, 18 nt, Mycobacterium avium subsp. paratuberculosis
gcggagugaccgccagca

SEQ ID NO: 2956002 - RNA, 19 nt, Mycobacterium avium subsp. paratuberculosis
gcggagugaccgccagcac

SEQ ID NO: 2956003 - RNA, 20 nt, Mycobacterium avium subsp. paratuberculosis
gcggagugaccgccagcacc

SEQ ID NO: 2956004 - RNA, 21 nt, Mycobacterium avium subsp. paratuberculosis
gcggagugaccgccagcaccg

SEQ ID NO: 2956005 - RNA, 22 nt, Mycobacterium avium subsp. paratuberculosis
gcggagugaccgccagcaccgc

SEQ ID NO: 2956006 - RNA, 17 nt, Mycobacterium avium subsp. paratuberculosis
gcggaguuuggacauca

SEQ ID NO: 2956007 - RNA, 16 nt, Mycobacterium avium subsp. paratuberculosis
gcggcaaaacgcuggg

SEQ ID NO: 2956008 - RNA, 18 nt, Mycobacterium avium subsp. paratuberculosis
gcggcaaaacgcugggcg

SEQ ID NO: 2956009 - RNA, 21 nt, Mycobacterium avium subsp. paratuberculosis
gcggcaaagcguugccgcgcg

SEQ ID NO: 2956010 - RNA, 17 nt, Mycobacterium avium subsp. paratuberculosis
gcggcaacacgccggcg

SEQ ID NO: 2956011 - RNA, 21 nt, Mycobacterium avium subsp. paratuberculosis
gcggcaacacgccggcggcca

SEQ ID NO: 2956012 - RNA, 22 nt, Mycobacterium avium subsp. paratuberculosis
gcggcaacacgccggcggccac

SEQ ID NO: 2956013 - RNA, 23 nt, Mycobacterium avium subsp. paratuberculosis
gcggcaacacgccggcggccacg

SEQ ID NO: 2956014 - RNA, 16 nt, Mycobacterium avium subsp. paratuberculosis
gcggcaacagcaccag

SEQ ID NO: 2956015 - RNA, 23 nt, Mycobacterium avium subsp. paratuberculosis
gcggcaacagcaccagcaccacc

SEQ ID NO: 2956016 - RNA, 12 nt, Mycobacterium avium subsp. paratuberculosis
gcggcaacccga

SEQ ID NO: 2956017 - RNA, 17 nt, Mycobacterium avium subsp. paratuberculosis
gcggcaacccgaucgcc

SEQ ID NO: 2956018 - RNA, 18 nt, Mycobacterium avium subsp. paratuberculosis
gcggcaacccgaucgccg

SEQ ID NO: 2956019 - RNA, 19 nt, Mycobacterium avium subsp. paratuberculosis
gcggcaacccgaucgccga

SEQ ID NO: 2956020 - RNA, 15 nt, Mycobacterium avium subsp. paratuberculosis
gcggcaacgccagcc

SEQ ID NO: 2956021 - RNA, 16 nt, Mycobacterium avium subsp. paratuberculosis
gcggcaacgccagcca

SEQ ID NO: 2956022 - RNA, 18 nt, Mycobacterium avium subsp. paratuberculosis
gcggcaacugggcggccu

SEQ ID NO: 2956023 - RNA, 20 nt, Mycobacterium avium subsp. paratuberculosis
gcggcaacugggcggccugc

SEQ ID NO: 2956024 - RNA, 21 nt, Mycobacterium avium subsp. paratuberculosis
gcggcaacugggcggccugca

SEQ ID NO: 2956025 - RNA, 14 nt, Mycobacterium avium subsp. paratuberculosis
gcggcacaccagcg

SEQ ID NO: 2956026 - RNA, 12 nt, Mycobacterium avium subsp. paratuberculosis
gcggcacaccgc

SEQ ID NO: 2956027 - RNA, 13 nt, Mycobacterium avium subsp. paratuberculosis
gcggcacaccgcg

SEQ ID NO: 2956028 - RNA, 14 nt, Mycobacterium avium subsp. paratuberculosis
gcggcacaccgcgc

SEQ ID NO: 2956029 - RNA, 15 nt, Mycobacterium avium subsp. paratuberculosis
gcggcacaccgcgcg

SEQ ID NO: 2956030 - RNA, 17 nt, Mycobacterium avium subsp. paratuberculosis
gcggcacaccgcgcgaa

SEQ ID NO: 2956031 - RNA, 14 nt, Mycobacterium avium subsp. paratuberculosis
gcggcacaggcgaa

SEQ ID NO: 2956032 - RNA, 20 nt, Mycobacterium avium subsp. paratuberculosis
gcggcacaggcgaaucggcg

SEQ ID NO: 2956033 - RNA, 22 nt, Mycobacterium avium subsp. paratuberculosis
gcggcacaggcgaaucggcgca

SEQ ID NO: 2956034 - RNA, 13 nt, Mycobacterium avium subsp. paratuberculosis
gcggcaccaaccc

SEQ ID NO: 2956035 - RNA, 20 nt, Mycobacterium avium subsp. paratuberculosis
gcggcaccaacccgaucggc

SEQ ID NO: 2956036 - RNA, 20 nt, Mycobacterium avium subsp. paratuberculosis
gcggcaccacccgcggccgg

SEQ ID NO: 2956037 - RNA, 14 nt, Mycobacterium avium subsp. paratuberculosis
gcggcaccacccgg

SEQ ID NO: 2956038 - RNA, 15 nt, Mycobacterium avium subsp. paratuberculosis
gcggcaccagcccgc

SEQ ID NO: 2956039 - RNA, 18 nt, Mycobacterium avium subsp. paratuberculosis
gcggcaccagcccgccgu

SEQ ID NO: 2956040 - RNA, 13 nt, Mycobacterium avium subsp. paratuberculosis
gcggcaccaggua

SEQ ID NO: 2956041 - RNA, 19 nt, Mycobacterium avium subsp. paratuberculosis
gcggcaccagguaccggcg

SEQ ID NO: 2956042 - RNA, 21 nt, Mycobacterium avium subsp. paratuberculosis
gcggcaccagguaccggcggg

SEQ ID NO: 2956043 - RNA, 22 nt, Mycobacterium avium subsp. paratuberculosis
gcggcaccagguucacgucggg

SEQ ID NO: 2956044 - RNA, 15 nt, Mycobacterium avium subsp. paratuberculosis
gcggcaccagucgcg

SEQ ID NO: 2956045 - RNA, 18 nt, Mycobacterium avium subsp. paratuberculosis
gcggcaccagucgcgcag

SEQ ID NO: 2956046 - RNA, 19 nt, Mycobacterium avium subsp. paratuberculosis
gcggcaccagucgcgcagc

SEQ ID NO: 2956047 - RNA, 23 nt, Mycobacterium avium subsp. paratuberculosis
gcggcaccagucgcgcagcguca

SEQ ID NO: 2956048 - RNA, 18 nt, Mycobacterium avium subsp. paratuberculosis
gcggcacccaggucaccg

SEQ ID NO: 2956049 - RNA, 18 nt, Mycobacterium avium subsp. paratuberculosis
gcggcacccgguccggcc

SEQ ID NO: 2956050 - RNA, 19 nt, Mycobacterium avium subsp. paratuberculosis
gcggcacccgguccggccc

SEQ ID NO: 2956051 - RNA, 15 nt, Mycobacterium avium subsp. paratuberculosis
gcggcaccgaucggc

SEQ ID NO: 2956052 - RNA, 16 nt, Mycobacterium avium subsp. paratuberculosis
gcggcaccgaucggca

SEQ ID NO: 2956053 - RNA, 17 nt, Mycobacterium avium subsp. paratuberculosis
gcggcaccgaucggcac

SEQ ID NO: 2956054 - RNA, 13 nt, Mycobacterium avium subsp. paratuberculosis
gcggcaccgccau

SEQ ID NO: 2956055 - RNA, 15 nt, Mycobacterium avium subsp. paratuberculosis
gcggcaccgccaucg

SEQ ID NO: 2956056 - RNA, 21 nt, Mycobacterium avium subsp. paratuberculosis
gcggcaccgccaucggcaucg

SEQ ID NO: 2956057 - RNA, 15 nt, Mycobacterium avium subsp. paratuberculosis
gcggcaccgcccggg

SEQ ID NO: 2956058 - RNA, 12 nt, Mycobacterium avium subsp. paratuberculosis
gcggcaccgccg

SEQ ID NO: 2956059 - RNA, 15 nt, Mycobacterium avium subsp. paratuberculosis
gcggcaccgccgcgg

SEQ ID NO: 2956060 - RNA, 23 nt, Mycobacterium avium subsp. paratuberculosis
gcggcaccgccgcgguggguccg

SEQ ID NO: 2956061 - RNA, 16 nt, Mycobacterium avium subsp. paratuberculosis
gcggcaccgcggcucg

SEQ ID NO: 2956062 - RNA, 17 nt, Mycobacterium avium subsp. paratuberculosis
gcggcaccgcggcucgg

SEQ ID NO: 2956063 - RNA, 22 nt, Mycobacterium avium subsp. paratuberculosis
gcggcaccgcggcucggucgcg

SEQ ID NO: 2956064 - RNA, 16 nt, Mycobacterium avium subsp. paratuberculosis
gcggcaccgcugccgg

SEQ ID NO: 2956065 - RNA, 16 nt, Mycobacterium avium subsp. paratuberculosis
gcggcaccgucaccga

SEQ ID NO: 2956066 - RNA, 18 nt, Mycobacterium avium subsp. paratuberculosis
gcggcaccgucaccgacg

SEQ ID NO: 2956067 - RNA, 21 nt, Mycobacterium avium subsp. paratuberculosis
gcggcaccgucaccgacggcu

SEQ ID NO: 2956068 - RNA, 20 nt, Mycobacterium avium subsp. paratuberculosis
gcggcaccuccagcccggcg

SEQ ID NO: 2956069 - RNA, 21 nt, Mycobacterium avium subsp. paratuberculosis
gcggcaccucggccuugacca

SEQ ID NO: 2956070 - RNA, 18 nt, Mycobacterium avium subsp. paratuberculosis
gcggcaccuucaccgacc

SEQ ID NO: 2956071 - RNA, 21 nt, Mycobacterium avium subsp. paratuberculosis
gcggcaccuuggugagcaccg

SEQ ID NO: 2956072 - RNA, 16 nt, Mycobacterium avium subsp. paratuberculosis
gcggcacgaaguuggu

SEQ ID NO: 2956073 - RNA, 14 nt, Mycobacterium avium subsp. paratuberculosis
gcggcacgaucggc

SEQ ID NO: 2956074 - RNA, 17 nt, Mycobacterium avium subsp. paratuberculosis
gcggcacgaucggcagc

SEQ ID NO: 2956075 - RNA, 18 nt, Mycobacterium avium subsp. paratuberculosis
gcggcacgaucggcagcg

SEQ ID NO: 2956076 - RNA, 21 nt, Mycobacterium avium subsp. paratuberculosis
gcggcacgauggacgcccaac

SEQ ID NO: 2956077 - RNA, 13 nt, Mycobacterium avium subsp. paratuberculosis
gcggcacgccgcu

SEQ ID NO: 2956078 - RNA, 16 nt, Mycobacterium avium subsp. paratuberculosis
gcggcacgccgcucgu

SEQ ID NO: 2956079 - RNA, 17 nt, Mycobacterium avium subsp. paratuberculosis
gcggcacgccgcucguc

SEQ ID NO: 2956080 - RNA, 19 nt, Mycobacterium avium subsp. paratuberculosis
gcggcacgccgcucgucgg

SEQ ID NO: 2956081 - RNA, 22 nt, Mycobacterium avium subsp. paratuberculosis
gcggcacgccgcucgucgggca

SEQ ID NO: 2956082 - RNA, 15 nt, Mycobacterium avium subsp. paratuberculosis
gcggcacgcgucacc

SEQ ID NO: 2956083 - RNA, 19 nt, Mycobacterium avium subsp. paratuberculosis
gcggcacgcugcgccagcc

SEQ ID NO: 2956084 - RNA, 20 nt, Mycobacterium avium subsp. paratuberculosis
gcggcacgcugcgccagccg

SEQ ID NO: 2956085 - RNA, 22 nt, Mycobacterium avium subsp. paratuberculosis
gcggcacgcugcgccagccguc

SEQ ID NO: 2956086 - RNA, 16 nt, Mycobacterium avium subsp. paratuberculosis
gcggcacggcgagguc

SEQ ID NO: 2956087 - RNA, 15 nt, Mycobacterium avium subsp. paratuberculosis
gcggcacgggcaccg

SEQ ID NO: 2956088 - RNA, 16 nt, Mycobacterium avium subsp. paratuberculosis
gcggcacgggcaccga

SEQ ID NO: 2956089 - RNA, 19 nt, Mycobacterium avium subsp. paratuberculosis
gcggcacgggcaccgacga

SEQ ID NO: 2956090 - RNA, 13 nt, Mycobacterium avium subsp. paratuberculosis
gcggcacgggccg

SEQ ID NO: 2956091 - RNA, 17 nt, Mycobacterium avium subsp. paratuberculosis
gcggcacgggccguucg

SEQ ID NO: 2956092 - RNA, 23 nt, Mycobacterium avium subsp. paratuberculosis
gcggcagucgcagcagcagcccg

SEQ ID NO: 2956093 - RNA, 15 nt, Mycobacterium avium subsp. paratuberculosis
gcggcagugcgccgu

SEQ ID NO: 2956094 - RNA, 16 nt, Mycobacterium avium subsp. paratuberculosis
gcggcauaguccagcu

SEQ ID NO: 2956095 - RNA, 19 nt, Mycobacterium avium subsp. paratuberculosis
gcggcauaguccagcucgc

SEQ ID NO: 2956096 - RNA, 16 nt, Mycobacterium avium subsp. paratuberculosis
gcggcauccccagcug

SEQ ID NO: 2956097 - RNA, 21 nt, Mycobacterium avium subsp. paratuberculosis
gcggcauccccagcugggccg

SEQ ID NO: 2956098 - RNA, 23 nt, Mycobacterium avium subsp. paratuberculosis
gcggcaucccuggugaccgacga

SEQ ID NO: 2956099 - RNA, 19 nt, Mycobacterium avium subsp. paratuberculosis
gcggcaucgaggaccggcg

SEQ ID NO: 2956100 - RNA, 20 nt, Mycobacterium avium subsp. paratuberculosis
gcggcaucgaggaccggcgc

SEQ ID NO: 2956101 - RNA, 14 nt, Mycobacterium avium subsp. paratuberculosis
gcggcaucgccgcc

SEQ ID NO: 2956102 - RNA, 20 nt, Mycobacterium avium subsp. paratuberculosis
gcggcaucgccgccaagggg

SEQ ID NO: 2956103 - RNA, 15 nt, Mycobacterium avium subsp. paratuberculosis
gcggcaucgcgccgc

SEQ ID NO: 2956104 - RNA, 18 nt, Mycobacterium avium subsp. paratuberculosis
gcggcaucgcgccgcaug

SEQ ID NO: 2956105 - RNA, 19 nt, Mycobacterium avium subsp. paratuberculosis
gcggcaucgcgccgcauga

SEQ ID NO: 2956106 - RNA, 13 nt, Mycobacterium avium subsp. paratuberculosis
gcggcaucgcgcg

SEQ ID NO: 2956107 - RNA, 16 nt, Mycobacterium avium subsp. paratuberculosis
gcggcaucgcgcgcgg

SEQ ID NO: 2956108 - RNA, 18 nt, Mycobacterium avium subsp. paratuberculosis
gcggcaucgcgcgcggcg

SEQ ID NO: 2956109 - RNA, 20 nt, Mycobacterium avium subsp. paratuberculosis
gcggcaucgcgcgcggcggc

SEQ ID NO: 2956110 - RNA, 22 nt, Mycobacterium avium subsp. paratuberculosis
gcggcaucgcgcgcggcggcca

SEQ ID NO: 2956111 - RNA, 15 nt, Mycobacterium avium subsp. paratuberculosis
gcggcaucggcgacg

SEQ ID NO: 2956112 - RNA, 18 nt, Mycobacterium avium subsp. paratuberculosis
gcggcaucggcgacggcg

SEQ ID NO: 2956113 - RNA, 14 nt, Mycobacterium avium subsp. paratuberculosis
gcggcaucgucggg

SEQ ID NO: 2956114 - RNA, 19 nt, Mycobacterium avium subsp. paratuberculosis
gcggcaugaccggccagca

SEQ ID NO: 2956115 - RNA, 21 nt, Mycobacterium avium subsp. paratuberculosis
gcggcaugaccggccagcaug

SEQ ID NO: 2956116 - RNA, 12 nt, Mycobacterium avium subsp. paratuberculosis
gcggcaugccgc

SEQ ID NO: 2956117 - RNA, 15 nt, Mycobacterium avium subsp. paratuberculosis
gcggcaugccgcccg

SEQ ID NO: 2956118 - RNA, 13 nt, Mycobacterium avium subsp. paratuberculosis
gcggcauggcgau

SEQ ID NO: 2956119 - RNA, 23 nt, Mycobacterium avium subsp. paratuberculosis
gcggcauggcgaugaccagcgcg

SEQ ID NO: 2956120 - RNA, 16 nt, Mycobacterium avium subsp. paratuberculosis
gcggcauggcuggcgg

SEQ ID NO: 2956121 - RNA, 16 nt, Mycobacterium avium subsp. paratuberculosis
gcggccaacaacgcca

SEQ ID NO: 2956122 - RNA, 19 nt, Mycobacterium avium subsp. paratuberculosis
gcggccaacaacgccaaga

SEQ ID NO: 2956123 - RNA, 15 nt, Mycobacterium avium subsp. paratuberculosis
gcggccaacccgggc

SEQ ID NO: 2956124 - RNA, 13 nt, Mycobacterium avium subsp. paratuberculosis
gcggccaacgccu

SEQ ID NO: 2956125 - RNA, 21 nt, Mycobacterium avium subsp. paratuberculosis
gcggccaacgccucgucgacc

SEQ ID NO: 2956126 - RNA, 16 nt, Mycobacterium avium subsp. paratuberculosis
gcggccaacgcgacga

SEQ ID NO: 2956127 - RNA, 21 nt, Mycobacterium avium subsp. paratuberculosis
gcggccaacgcgacgaagccg

SEQ ID NO: 2956128 - RNA, 22 nt, Mycobacterium avium subsp. paratuberculosis
gcggccaacgcgacgaagccgg

SEQ ID NO: 2956129 - RNA, 21 nt, Mycobacterium avium subsp. paratuberculosis
gcggccaagugcggucgguuc

SEQ ID NO: 2956130 - RNA, 16 nt, Mycobacterium avium subsp. paratuberculosis
gcggccaaucccacca

SEQ ID NO: 2956131 - RNA, 18 nt, Mycobacterium avium subsp. paratuberculosis
gcggccacaccgaucagc

SEQ ID NO: 2956132 - RNA, 15 nt, Mycobacterium avium subsp. paratuberculosis
gcggccacacuggcg

SEQ ID NO: 2956133 - RNA, 19 nt, Mycobacterium avium subsp. paratuberculosis
gcggccaccaacggcagca

SEQ ID NO: 2956134 - RNA, 22 nt, Mycobacterium avium subsp. paratuberculosis
gcggccaccaacggcagcagca

SEQ ID NO: 2956135 - RNA, 13 nt, Mycobacterium avium subsp. paratuberculosis
gcggccaccacca

SEQ ID NO: 2956136 - RNA, 16 nt, Mycobacterium avium subsp. paratuberculosis
gcggccaccaccacgg

SEQ ID NO: 2956137 - RNA, 16 nt, Mycobacterium avium subsp. paratuberculosis
gcggccaccaccgcca

SEQ ID NO: 2956138 - RNA, 18 nt, Mycobacterium avium subsp. paratuberculosis
gcggccaccaccgccacg

SEQ ID NO: 2956139 - RNA, 21 nt, Mycobacterium avium subsp. paratuberculosis
gcggccaccaccgccacggcg

SEQ ID NO: 2956140 - RNA, 14 nt, Mycobacterium avium subsp. paratuberculosis
gcggccaccaccgg

SEQ ID NO: 2956141 - RNA, 16 nt, Mycobacterium avium subsp. paratuberculosis
gcggccaccaccggug

SEQ ID NO: 2956142 - RNA, 15 nt, Mycobacterium avium subsp. paratuberculosis
gcggccaccacgacg

SEQ ID NO: 2956143 - RNA, 18 nt, Mycobacterium avium subsp. paratuberculosis
gcggccaccacgacgccg

SEQ ID NO: 2956144 - RNA, 12 nt, Mycobacterium avium subsp. paratuberculosis
gcggccaccagc

SEQ ID NO: 2956145 - RNA, 15 nt, Mycobacterium avium subsp. paratuberculosis
gcggccaccagccgg

SEQ ID NO: 2956146 - RNA, 17 nt, Mycobacterium avium subsp. paratuberculosis
gcggccaccagccggcc

SEQ ID NO: 2956147 - RNA, 18 nt, Mycobacterium avium subsp. paratuberculosis
gcggccaccagccggccg

SEQ ID NO: 2956148 - RNA, 19 nt, Mycobacterium avium subsp. paratuberculosis
gcggccaccagccggccgg

SEQ ID NO: 2956149 - RNA, 21 nt, Mycobacterium avium subsp. paratuberculosis
gcggccaccagccggccggcc

SEQ ID NO: 2956150 - RNA, 17 nt, Mycobacterium avium subsp. paratuberculosis
gcggccaccagcgcggc

SEQ ID NO: 2956151 - RNA, 18 nt, Mycobacterium avium subsp. paratuberculosis
gcggccaccagcgcggcc

SEQ ID NO: 2956152 - RNA, 21 nt, Mycobacterium avium subsp. paratuberculosis
gcggccaccaucuccgcggcg

SEQ ID NO: 2956153 - RNA, 22 nt, Mycobacterium avium subsp. paratuberculosis
gcggccaccaucuccgcggcgc

SEQ ID NO: 2956154 - RNA, 22 nt, Mycobacterium avium subsp. paratuberculosis
gcggccaccaugccggcgucca

SEQ ID NO: 2956155 - RNA, 23 nt, Mycobacterium avium subsp. paratuberculosis
gcggccaccaugccggcguccag

SEQ ID NO: 2956156 - RNA, 19 nt, Mycobacterium avium subsp. paratuberculosis
gcggccaccaugggcggga

SEQ ID NO: 2956157 - RNA, 13 nt, Mycobacterium avium subsp. paratuberculosis
gcggccaccccgg

SEQ ID NO: 2956158 - RNA, 17 nt, Mycobacterium avium subsp. paratuberculosis
gcggccaccccggagca

SEQ ID NO: 2956159 - RNA, 14 nt, Mycobacterium avium subsp. paratuberculosis
gcggccaccccggu

SEQ ID NO: 2956160 - RNA, 17 nt, Mycobacterium avium subsp. paratuberculosis
gcggccaccccggugac

SEQ ID NO: 2956161 - RNA, 13 nt, Mycobacterium avium subsp. paratuberculosis
gcggccaccgcgc

SEQ ID NO: 2956162 - RNA, 15 nt, Mycobacterium avium subsp. paratuberculosis
gcggccaccgcgccc

SEQ ID NO: 2956163 - RNA, 21 nt, Mycobacterium avium subsp. paratuberculosis
gcggccaccgcgccccggcgc

SEQ ID NO: 2956164 - RNA, 22 nt, Mycobacterium avium subsp. paratuberculosis
gcggccaccgcgccccggcgca

SEQ ID NO: 2956165 - RNA, 16 nt, Mycobacterium avium subsp. paratuberculosis
gcggccaccgcgccgu

SEQ ID NO: 2956166 - RNA, 21 nt, Mycobacterium avium subsp. paratuberculosis
gcggccaccgcgccgugggcg

SEQ ID NO: 2956167 - RNA, 14 nt, Mycobacterium avium subsp. paratuberculosis
gcggccaccgcgcg

SEQ ID NO: 2956168 - RNA, 16 nt, Mycobacterium avium subsp. paratuberculosis
gcggccaccgcgcgcu

SEQ ID NO: 2956169 - RNA, 14 nt, Mycobacterium avium subsp. paratuberculosis
gcggccaccgcggc

SEQ ID NO: 2956170 - RNA, 18 nt, Mycobacterium avium subsp. paratuberculosis
gcggccaccgcggccagc

SEQ ID NO: 2956171 - RNA, 12 nt, Mycobacterium avium subsp. paratuberculosis
gcggccaccggg

SEQ ID NO: 2956172 - RNA, 21 nt, Mycobacterium avium subsp. paratuberculosis
gcggccaccgggaccgucggg

SEQ ID NO: 2956173 - RNA, 15 nt, Mycobacterium avium subsp. paratuberculosis
gcggccaccgggucg

SEQ ID NO: 2956174 - RNA, 23 nt, Mycobacterium avium subsp. paratuberculosis
gcggccaccgggucguccgcgac

SEQ ID NO: 2956175 - RNA, 15 nt, Mycobacterium avium subsp. paratuberculosis
gcggccaccuccagc

SEQ ID NO: 2956176 - RNA, 17 nt, Mycobacterium avium subsp. paratuberculosis
gcggccaccuccagccc

SEQ ID NO: 2956177 - RNA, 15 nt, Mycobacterium avium subsp. paratuberculosis
gcggccagggcggcg

SEQ ID NO: 2956178 - RNA, 19 nt, Mycobacterium avium subsp. paratuberculosis
gcggccagggcggcgccgg

SEQ ID NO: 2956179 - RNA, 21 nt, Mycobacterium avium subsp. paratuberculosis
gcggccaggguagaggcggcg

SEQ ID NO: 2956180 - RNA, 17 nt, Mycobacterium avium subsp. paratuberculosis
gcggccaggguguccca

SEQ ID NO: 2956181 - RNA, 21 nt, Mycobacterium avium subsp. paratuberculosis
gcggccagggugucccagcgc

SEQ ID NO: 2956182 - RNA, 22 nt, Mycobacterium avium subsp. paratuberculosis
gcggccagggugucccagcgcc

SEQ ID NO: 2956183 - RNA, 15 nt, Mycobacterium avium subsp. paratuberculosis
gcggccagugccggg

SEQ ID NO: 2956184 - RNA, 17 nt, Mycobacterium avium subsp. paratuberculosis
gcggccagugccgggcc

SEQ ID NO: 2956185 - RNA, 17 nt, Mycobacterium avium subsp. paratuberculosis
gcggccaguucgagcgc

SEQ ID NO: 2956186 - RNA, 19 nt, Mycobacterium avium subsp. paratuberculosis
gcggccaguucgagcgccg

SEQ ID NO: 2956187 - RNA, 21 nt, Mycobacterium avium subsp. paratuberculosis
gcggccaguucgagcgccgcg

SEQ ID NO: 2956188 - RNA, 18 nt, Mycobacterium avium subsp. paratuberculosis
gcggccauauaggggugg

SEQ ID NO: 2956189 - RNA, 21 nt, Mycobacterium avium subsp. paratuberculosis
gcggccauauaggggugggcg

SEQ ID NO: 2956190 - RNA, 14 nt, Mycobacterium avium subsp. paratuberculosis
gcggccaucgccgc

SEQ ID NO: 2956191 - RNA, 16 nt, Mycobacterium avium subsp. paratuberculosis
gcggccaucgccgcca

SEQ ID NO: 2956192 - RNA, 19 nt, Mycobacterium avium subsp. paratuberculosis
gcggccaucgccgccaucg

SEQ ID NO: 2956193 - RNA, 14 nt, Mycobacterium avium subsp. paratuberculosis
gcggccaucgccug

SEQ ID NO: 2956194 - RNA, 16 nt, Mycobacterium avium subsp. paratuberculosis
gcggccaucucgugcc

SEQ ID NO: 2956195 - RNA, 21 nt, Mycobacterium avium subsp. paratuberculosis
gcggccaucucgugcccgggc

SEQ ID NO: 2956196 - RNA, 22 nt, Mycobacterium avium subsp. paratuberculosis
gcggccaucucgugcccgggcc

SEQ ID NO: 2956197 - RNA, 20 nt, Mycobacterium avium subsp. paratuberculosis
gcggccauggucgcggccgu

SEQ ID NO: 2956198 - RNA, 23 nt, Mycobacterium avium subsp. paratuberculosis
gcggccauguccccgccgguggc

SEQ ID NO: 2956199 - RNA, 21 nt, Mycobacterium avium subsp. paratuberculosis
gcggccaugucggagcugcgc

SEQ ID NO: 2956200 - RNA, 23 nt, Mycobacterium avium subsp. paratuberculosis
gcggccaugucggagcugcgcgc

SEQ ID NO: 2956201 - RNA, 16 nt, Mycobacterium avium subsp. paratuberculosis
gcggcccaacacgccc

SEQ ID NO: 2956202 - RNA, 20 nt, Mycobacterium avium subsp. paratuberculosis
gcggcccaaccggaucggcu

SEQ ID NO: 2956203 - RNA, 23 nt, Mycobacterium avium subsp. paratuberculosis
gcggcccaauucguaggcgagga

SEQ ID NO: 2956204 - RNA, 12 nt, Mycobacterium avium subsp. paratuberculosis
gcggcccacccg

SEQ ID NO: 2956205 - RNA, 20 nt, Mycobacterium avium subsp. paratuberculosis
gcggcccacccgcagggcgc

SEQ ID NO: 2956206 - RNA, 13 nt, Mycobacterium avium subsp. paratuberculosis
gcggcccacccgg

SEQ ID NO: 2956207 - RNA, 12 nt, Mycobacterium avium subsp. paratuberculosis
gcggcccaccgc

SEQ ID NO: 2956208 - RNA, 13 nt, Mycobacterium avium subsp. paratuberculosis
gcggcccaccgcg

SEQ ID NO: 2956209 - RNA, 14 nt, Mycobacterium avium subsp. paratuberculosis
gcggcccaccgcga

SEQ ID NO: 2956210 - RNA, 17 nt, Mycobacterium avium subsp. paratuberculosis
gcggcccaccgcgaccc

SEQ ID NO: 2956211 - RNA, 13 nt, Mycobacterium avium subsp. paratuberculosis
gcggcccagaucg

SEQ ID NO: 2956212 - RNA, 15 nt, Mycobacterium avium subsp. paratuberculosis
gcggcccagaucgcg

SEQ ID NO: 2956213 - RNA, 18 nt, Mycobacterium avium subsp. paratuberculosis
gcggcccagcccggccag

SEQ ID NO: 2956214 - RNA, 23 nt, Mycobacterium avium subsp. paratuberculosis
gcggcccagcccggccagcaccc

SEQ ID NO: 2956215 - RNA, 13 nt, Mycobacterium avium subsp. paratuberculosis
gcggcccagcgua

SEQ ID NO: 2956216 - RNA, 12 nt, Mycobacterium avium subsp. paratuberculosis
gcggcccagcuc

SEQ ID NO: 2956217 - RNA, 14 nt, Mycobacterium avium subsp. paratuberculosis
gcggcccagcucgg

SEQ ID NO: 2956218 - RNA, 21 nt, Mycobacterium avium subsp. paratuberculosis
gcggcccagggcgcucuggaa

SEQ ID NO: 2956219 - RNA, 21 nt, Mycobacterium avium subsp. paratuberculosis
gcggcccagguucuccggccc

SEQ ID NO: 2956220 - RNA, 21 nt, Mycobacterium avium subsp. paratuberculosis
gcggcccaguucgcaccccac

SEQ ID NO: 2956221 - RNA, 21 nt, Mycobacterium avium subsp. paratuberculosis
gcggcccccacgcagcggugc

SEQ ID NO: 2956222 - RNA, 14 nt, Mycobacterium avium subsp. paratuberculosis
gcggccccccgcac

SEQ ID NO: 2956223 - RNA, 18 nt, Mycobacterium avium subsp. paratuberculosis
gcggccccccgcacaccg

SEQ ID NO: 2956224 - RNA, 20 nt, Mycobacterium avium subsp. paratuberculosis
gcggccccccgcacaccggc

SEQ ID NO: 2956225 - RNA, 19 nt, Mycobacterium avium subsp. paratuberculosis
gcggcccccugaucggccg

SEQ ID NO: 2956226 - RNA, 20 nt, Mycobacterium avium subsp. paratuberculosis
gcggcccccugaucggccgc

SEQ ID NO: 2956227 - RNA, 22 nt, Mycobacterium avium subsp. paratuberculosis
gcggcccccugaucggccgcaa

SEQ ID NO: 2956228 - RNA, 18 nt, Mycobacterium avium subsp. paratuberculosis
gcggccccggcucgggcc

SEQ ID NO: 2956229 - RNA, 19 nt, Mycobacterium avium subsp. paratuberculosis
gcggccccggcucgggcca

SEQ ID NO: 2956230 - RNA, 20 nt, Mycobacterium avium subsp. paratuberculosis
gcggccccgguagccagcac

SEQ ID NO: 2956231 - RNA, 22 nt, Mycobacterium avium subsp. paratuberculosis
gcggccccgguggaugggcucg

SEQ ID NO: 2956232 - RNA, 15 nt, Mycobacterium avium subsp. paratuberculosis
gcggccccugcgggg

SEQ ID NO: 2956233 - RNA, 17 nt, Mycobacterium avium subsp. paratuberculosis
gcggccccugcggggug

SEQ ID NO: 2956234 - RNA, 23 nt, Mycobacterium avium subsp. paratuberculosis
gcggccccugcggggugucgacc

SEQ ID NO: 2956235 - RNA, 23 nt, Mycobacterium avium subsp. paratuberculosis
gcggccccuucgaugucgccggc

SEQ ID NO: 2956236 - RNA, 19 nt, Mycobacterium avium subsp. paratuberculosis
gcggcccgaccagcgggcc

SEQ ID NO: 2956237 - RNA, 21 nt, Mycobacterium avium subsp. paratuberculosis
gcggcccgaccagcgggccga

SEQ ID NO: 2956238 - RNA, 13 nt, Mycobacterium avium subsp. paratuberculosis
gcggcccgacccg

SEQ ID NO: 2956239 - RNA, 14 nt, Mycobacterium avium subsp. paratuberculosis
gcggcccgaucacc

SEQ ID NO: 2956240 - RNA, 16 nt, Mycobacterium avium subsp. paratuberculosis
gcggcccgaucaccag

SEQ ID NO: 2956241 - RNA, 18 nt, Mycobacterium avium subsp. paratuberculosis
gcggcccgaucaccaggc

SEQ ID NO: 2956242 - RNA, 20 nt, Mycobacterium avium subsp. paratuberculosis
gcggcccgaucaccaggccc

SEQ ID NO: 2956243 - RNA, 22 nt, Mycobacterium avium subsp. paratuberculosis
gcggcccgaucaccaggcccag

SEQ ID NO: 2956244 - RNA, 15 nt, Mycobacterium avium subsp. paratuberculosis
gcggcccgaucaccg

SEQ ID NO: 2956245 - RNA, 18 nt, Mycobacterium avium subsp. paratuberculosis
gcggcccgaucaccgccg

SEQ ID NO: 2956246 - RNA, 21 nt, Mycobacterium avium subsp. paratuberculosis
gcggcccgcacggccgccagg

SEQ ID NO: 2956247 - RNA, 15 nt, Mycobacterium avium subsp. paratuberculosis
gcggcccgcaggauc

SEQ ID NO: 2956248 - RNA, 13 nt, Mycobacterium avium subsp. paratuberculosis
gcggcccgcaucg

SEQ ID NO: 2956249 - RNA, 15 nt, Mycobacterium avium subsp. paratuberculosis
gcggcccgcaucgac

SEQ ID NO: 2956250 - RNA, 16 nt, Mycobacterium avium subsp. paratuberculosis
gcggcccgcaucgacg

SEQ ID NO: 2956251 - RNA, 13 nt, Mycobacterium avium subsp. paratuberculosis
gcggcccgccgaa

SEQ ID NO: 2956252 - RNA, 15 nt, Mycobacterium avium subsp. paratuberculosis
gcggcccgccgaacg

SEQ ID NO: 2956253 - RNA, 23 nt, Mycobacterium avium subsp. paratuberculosis
gcggcccgccgaacgccuccgcc

SEQ ID NO: 2956254 - RNA, 14 nt, Mycobacterium avium subsp. paratuberculosis
gcggcccgccgcgc

SEQ ID NO: 2956255 - RNA, 15 nt, Mycobacterium avium subsp. paratuberculosis
gcggcccgccgcgcc

SEQ ID NO: 2956256 - RNA, 17 nt, Mycobacterium avium subsp. paratuberculosis
gcggcccgccgcgcccg

SEQ ID NO: 2956257 - RNA, 19 nt, Mycobacterium avium subsp. paratuberculosis
gcggcccgccgcgcccggc

SEQ ID NO: 2956258 - RNA, 19 nt, Mycobacterium avium subsp. paratuberculosis
gcggcccgccgcucaccgc

SEQ ID NO: 2956259 - RNA, 21 nt, Mycobacterium avium subsp. paratuberculosis
gcggcccgccgcucaccgccg

SEQ ID NO: 2956260 - RNA, 12 nt, Mycobacterium avium subsp. paratuberculosis
gcggcccgccgg

SEQ ID NO: 2956261 - RNA, 18 nt, Mycobacterium avium subsp. paratuberculosis
gcggccgccacgcuggug

SEQ ID NO: 2956262 - RNA, 11 nt, Mycobacterium avium subsp. paratuberculosis
gcggccgccag

SEQ ID NO: 2956263 - RNA, 14 nt, Mycobacterium avium subsp. paratuberculosis
gcggccgccagcgc

SEQ ID NO: 2956264 - RNA, 18 nt, Mycobacterium avium subsp. paratuberculosis
gcggccgccagcgcaccg

SEQ ID NO: 2956265 - RNA, 23 nt, Mycobacterium avium subsp. paratuberculosis
gcggccgccagcgcaccgagccc

SEQ ID NO: 2956266 - RNA, 14 nt, Mycobacterium avium subsp. paratuberculosis
gcggccgccagcgu

SEQ ID NO: 2956267 - RNA, 13 nt, Mycobacterium avium subsp. paratuberculosis
gcggccgccauca

SEQ ID NO: 2956268 - RNA, 20 nt, Mycobacterium avium subsp. paratuberculosis
gcggccgccaucgaucgggc

SEQ ID NO: 2956269 - RNA, 13 nt, Mycobacterium avium subsp. paratuberculosis
gcggccgcccagc

SEQ ID NO: 2956270 - RNA, 14 nt, Mycobacterium avium subsp. paratuberculosis
gcggccgcccagcc

SEQ ID NO: 2956271 - RNA, 21 nt, Mycobacterium avium subsp. paratuberculosis
gcggccgcccagcccgcgccg

SEQ ID NO: 2956272 - RNA, 23 nt, Mycobacterium avium subsp. paratuberculosis
gcggccgcccagcccgcgccgag

SEQ ID NO: 2956273 - RNA, 14 nt, Mycobacterium avium subsp. paratuberculosis
gcggccgcccaguc

SEQ ID NO: 2956274 - RNA, 19 nt, Mycobacterium avium subsp. paratuberculosis
gcggccgcccagucgccgc

SEQ ID NO: 2956275 - RNA, 22 nt, Mycobacterium avium subsp. paratuberculosis
gcggccgcccagucgccgccgc

SEQ ID NO: 2956276 - RNA, 15 nt, Mycobacterium avium subsp. paratuberculosis
gcggccgcccgggcg

SEQ ID NO: 2956277 - RNA, 15 nt, Mycobacterium avium subsp. paratuberculosis
gcggccgcccggucc

SEQ ID NO: 2956278 - RNA, 17 nt, Mycobacterium avium subsp. paratuberculosis
gcggccgcccgguccgg

SEQ ID NO: 2956279 - RNA, 14 nt, Mycobacterium avium subsp. paratuberculosis
gcggccgcccgucg

SEQ ID NO: 2956280 - RNA, 11 nt, Mycobacterium avium subsp. paratuberculosis
gcggccgccga

SEQ ID NO: 2956281 - RNA, 12 nt, Mycobacterium avium subsp. paratuberculosis
gcggccgccgau

SEQ ID NO: 2956282 - RNA, 14 nt, Mycobacterium avium subsp. paratuberculosis
gcggccgccgauca

SEQ ID NO: 2956283 - RNA, 13 nt, Mycobacterium avium subsp. paratuberculosis
gcggccgccgccc

SEQ ID NO: 2956284 - RNA, 16 nt, Mycobacterium avium subsp. paratuberculosis
gcggccgccgcccgcg

SEQ ID NO: 2956285 - RNA, 18 nt, Mycobacterium avium subsp. paratuberculosis
gcggccgccgcccgcgcg

SEQ ID NO: 2956286 - RNA, 19 nt, Mycobacterium avium subsp. paratuberculosis
gcggccgccgcccgcgcgg

SEQ ID NO: 2956287 - RNA, 16 nt, Mycobacterium avium subsp. paratuberculosis
gcggccgccgccgcgg

SEQ ID NO: 2956288 - RNA, 16 nt, Mycobacterium avium subsp. paratuberculosis
gcggccgccgcgacgg

SEQ ID NO: 2956289 - RNA, 19 nt, Mycobacterium avium subsp. paratuberculosis
gcggccgccgcgacggccg

SEQ ID NO: 2956290 - RNA, 20 nt, Mycobacterium avium subsp. paratuberculosis
gcggccgccgcgacggccgc

SEQ ID NO: 2956291 - RNA, 21 nt, Mycobacterium avium subsp. paratuberculosis
gcggccgccgcgaucagggcc

SEQ ID NO: 2956292 - RNA, 16 nt, Mycobacterium avium subsp. paratuberculosis
gcggccgccggcaccg

SEQ ID NO: 2956293 - RNA, 14 nt, Mycobacterium avium subsp. paratuberculosis
gcggccgccggcca

SEQ ID NO: 2956294 - RNA, 15 nt, Mycobacterium avium subsp. paratuberculosis
gcggccgccggccag

SEQ ID NO: 2956295 - RNA, 16 nt, Mycobacterium avium subsp. paratuberculosis
gcggccgccggccagc

SEQ ID NO: 2956296 - RNA, 22 nt, Mycobacterium avium subsp. paratuberculosis
gcggccgccggccagcuccgcc

SEQ ID NO: 2956297 - RNA, 13 nt, Mycobacterium avium subsp. paratuberculosis
gcggccgccgggc

SEQ ID NO: 2956298 - RNA, 14 nt, Mycobacterium avium subsp. paratuberculosis
gcggccgccgggcc

SEQ ID NO: 2956299 - RNA, 17 nt, Mycobacterium avium subsp. paratuberculosis
gcggccgccgggccggc

SEQ ID NO: 2956300 - RNA, 20 nt, Mycobacterium avium subsp. paratuberculosis
gcggccgccgggccggcggc

SEQ ID NO: 2956301 - RNA, 22 nt, Mycobacterium avium subsp. paratuberculosis
gcggccgccgggccggcggcca

SEQ ID NO: 2956302 - RNA, 23 nt, Mycobacterium avium subsp. paratuberculosis
gcggccgccgggccggcggccag

SEQ ID NO: 2956303 - RNA, 15 nt, Mycobacterium avium subsp. paratuberculosis
gcggccgccggggcc

SEQ ID NO: 2956304 - RNA, 16 nt, Mycobacterium avium subsp. paratuberculosis
gcggccgccggggccc

SEQ ID NO: 2956305 - RNA, 15 nt, Mycobacterium avium subsp. paratuberculosis
gcggccgccucccgc

SEQ ID NO: 2956306 - RNA, 21 nt, Mycobacterium avium subsp. paratuberculosis
gcggccgccucccgcagcgcc

SEQ ID NO: 2956307 - RNA, 21 nt, Mycobacterium avium subsp. paratuberculosis
gcggccgccuucacgaccggc

SEQ ID NO: 2956308 - RNA, 22 nt, Mycobacterium avium subsp. paratuberculosis
gcggccgccuuggugauccggg

SEQ ID NO: 2956309 - RNA, 15 nt, Mycobacterium avium subsp. paratuberculosis
gcggccgcgaaggcg

SEQ ID NO: 2956310 - RNA, 12 nt, Mycobacterium avium subsp. paratuberculosis
gcggccgcgacg

SEQ ID NO: 2956311 - RNA, 14 nt, Mycobacterium avium subsp. paratuberculosis
gcggccgcgacgcg

SEQ ID NO: 2956312 - RNA, 15 nt, Mycobacterium avium subsp. paratuberculosis
gcggccgcgacgcgc

SEQ ID NO: 2956313 - RNA, 15 nt, Mycobacterium avium subsp. paratuberculosis
gcggccgcgacggac

SEQ ID NO: 2956314 - RNA, 19 nt, Mycobacterium avium subsp. paratuberculosis
gcggccgcgacggaccagu

SEQ ID NO: 2956315 - RNA, 18 nt, Mycobacterium avium subsp. paratuberculosis
gcggccgcgacugcaccc

SEQ ID NO: 2956316 - RNA, 21 nt, Mycobacterium avium subsp. paratuberculosis
gcggccgcgacugcacccgaa

SEQ ID NO: 2956317 - RNA, 16 nt, Mycobacterium avium subsp. paratuberculosis
gcggccgcgagcccgg

SEQ ID NO: 2956318 - RNA, 17 nt, Mycobacterium avium subsp. paratuberculosis
gcggccgcgagcccggc

SEQ ID NO: 2956319 - RNA, 20 nt, Mycobacterium avium subsp. paratuberculosis
gcggccgcgagcccggcgac

SEQ ID NO: 2956320 - RNA, 21 nt, Mycobacterium avium subsp. paratuberculosis
gcggccgcgagcccggcgacg

SEQ ID NO: 2956321 - RNA, 18 nt, Mycobacterium avium subsp. paratuberculosis
gcggccgcgaucgccaac

SEQ ID NO: 2956322 - RNA, 12 nt, Mycobacterium avium subsp. paratuberculosis
gcggccgcgaug

SEQ ID NO: 2956323 - RNA, 22 nt, Mycobacterium avium subsp. paratuberculosis
gcggccgcgauguagcggacgg

SEQ ID NO: 2956324 - RNA, 13 nt, Mycobacterium avium subsp. paratuberculosis
gcggccgcgcagc

SEQ ID NO: 2956325 - RNA, 16 nt, Mycobacterium avium subsp. paratuberculosis
gcggccgcgcagcucg

SEQ ID NO: 2956326 - RNA, 19 nt, Mycobacterium avium subsp. paratuberculosis
gcggccgcgcagcucgacg

SEQ ID NO: 2956327 - RNA, 13 nt, Mycobacterium avium subsp. paratuberculosis
gcggccgcgccgg

SEQ ID NO: 2956328 - RNA, 15 nt, Mycobacterium avium subsp. paratuberculosis
gcggccgcgccggcc

SEQ ID NO: 2956329 - RNA, 18 nt, Mycobacterium avium subsp. paratuberculosis
gcggccgcgccggccgga

SEQ ID NO: 2956330 - RNA, 13 nt, Mycobacterium avium subsp. paratuberculosis
gcggccgcgcgcc

SEQ ID NO: 2956331 - RNA, 22 nt, Mycobacterium avium subsp. paratuberculosis
gcggccgcgcgcccgucgucgg

SEQ ID NO: 2956332 - RNA, 15 nt, Mycobacterium avium subsp. paratuberculosis
gcggccgcggcgcgc

SEQ ID NO: 2956333 - RNA, 16 nt, Mycobacterium avium subsp. paratuberculosis
gcggccgcggcgcgca

SEQ ID NO: 2956334 - RNA, 13 nt, Mycobacterium avium subsp. paratuberculosis
gcggccgcggcgg

SEQ ID NO: 2956335 - RNA, 14 nt, Mycobacterium avium subsp. paratuberculosis
gcggccgcggcggg

SEQ ID NO: 2956336 - RNA, 13 nt, Mycobacterium avium subsp. paratuberculosis
gcggccgcguccu

SEQ ID NO: 2956337 - RNA, 16 nt, Mycobacterium avium subsp. paratuberculosis
gcggccgcguccucgc

SEQ ID NO: 2956338 - RNA, 17 nt, Mycobacterium avium subsp. paratuberculosis
gcggccgcguccucgcc

SEQ ID NO: 2956339 - RNA, 13 nt, Mycobacterium avium subsp. paratuberculosis
gcggccgcgucgc

SEQ ID NO: 2956340 - RNA, 14 nt, Mycobacterium avium subsp. paratuberculosis
gcggccgcgucgcc

SEQ ID NO: 2956341 - RNA, 19 nt, Mycobacterium avium subsp. paratuberculosis
gcggccgcgucgccgaucg

SEQ ID NO: 2956342 - RNA, 15 nt, Mycobacterium avium subsp. paratuberculosis
gcggccgcgucggcg

SEQ ID NO: 2956343 - RNA, 16 nt, Mycobacterium avium subsp. paratuberculosis
gcggccgcgucggcgg

SEQ ID NO: 2956344 - RNA, 22 nt, Mycobacterium avium subsp. paratuberculosis
gcggccgcuaguuggugcuggg

SEQ ID NO: 2956345 - RNA, 14 nt, Mycobacterium avium subsp. paratuberculosis
gcggccgcugcgcc

SEQ ID NO: 2956346 - RNA, 16 nt, Mycobacterium avium subsp. paratuberculosis
gcggccgucgccgggc

SEQ ID NO: 2956347 - RNA, 17 nt, Mycobacterium avium subsp. paratuberculosis
gcggccgucgccgggcg

SEQ ID NO: 2956348 - RNA, 12 nt, Mycobacterium avium subsp. paratuberculosis
gcggccgucgcg

SEQ ID NO: 2956349 - RNA, 13 nt, Mycobacterium avium subsp. paratuberculosis
gcggccgucgcgc

SEQ ID NO: 2956350 - RNA, 21 nt, Mycobacterium avium subsp. paratuberculosis
gcggccgucgcgcaccaccuc

SEQ ID NO: 2956351 - RNA, 14 nt, Mycobacterium avium subsp. paratuberculosis
gcggccgucggauc

SEQ ID NO: 2956352 - RNA, 15 nt, Mycobacterium avium subsp. paratuberculosis
gcggccgucggaucg

SEQ ID NO: 2956353 - RNA, 12 nt, Mycobacterium avium subsp. paratuberculosis
gcggccgucggg

SEQ ID NO: 2956354 - RNA, 18 nt, Mycobacterium avium subsp. paratuberculosis
gcggccgucgucgugcac

SEQ ID NO: 2956355 - RNA, 22 nt, Mycobacterium avium subsp. paratuberculosis
gcggccguggcgaacucgacgg

SEQ ID NO: 2956356 - RNA, 16 nt, Mycobacterium avium subsp. paratuberculosis
gcggccguggucgaug

SEQ ID NO: 2956357 - RNA, 20 nt, Mycobacterium avium subsp. paratuberculosis
gcggccguguacagcagggu

SEQ ID NO: 2956358 - RNA, 17 nt, Mycobacterium avium subsp. paratuberculosis
gcggccuaggacgccgc

SEQ ID NO: 2956359 - RNA, 18 nt, Mycobacterium avium subsp. paratuberculosis
gcggccuaggacgccgcc

SEQ ID NO: 2956360 - RNA, 19 nt, Mycobacterium avium subsp. paratuberculosis
gcggccuaggacgccgccc

SEQ ID NO: 2956361 - RNA, 21 nt, Mycobacterium avium subsp. paratuberculosis
gcggccuaggacgccgcccuc

SEQ ID NO: 2956362 - RNA, 16 nt, Mycobacterium avium subsp. paratuberculosis
gcggccuaugcgcccg

SEQ ID NO: 2956363 - RNA, 18 nt, Mycobacterium avium subsp. paratuberculosis
gcggccuaugcgcccggg

SEQ ID NO: 2956364 - RNA, 15 nt, Mycobacterium avium subsp. paratuberculosis
gcggccucaccgcgg

SEQ ID NO: 2956365 - RNA, 18 nt, Mycobacterium avium subsp. paratuberculosis
gcggccucaccgcgggcc

SEQ ID NO: 2956366 - RNA, 20 nt, Mycobacterium avium subsp. paratuberculosis
gcggccucaccgcgggccag

SEQ ID NO: 2956367 - RNA, 13 nt, Mycobacterium avium subsp. paratuberculosis
gcggccuccagcc

SEQ ID NO: 2956368 - RNA, 15 nt, Mycobacterium avium subsp. paratuberculosis
gcggccuccagccgc

SEQ ID NO: 2956369 - RNA, 19 nt, Mycobacterium avium subsp. paratuberculosis
gcggccuccagccgcgcgg

SEQ ID NO: 2956370 - RNA, 22 nt, Mycobacterium avium subsp. paratuberculosis
gcggccuccagccgcgcggccg

SEQ ID NO: 2956371 - RNA, 16 nt, Mycobacterium avium subsp. paratuberculosis
gcggccuccgagcggc

SEQ ID NO: 2956372 - RNA, 22 nt, Mycobacterium avium subsp. paratuberculosis
gcggccuccgagcggcgcaggc

SEQ ID NO: 2956373 - RNA, 17 nt, Mycobacterium avium subsp. paratuberculosis
gcggccuccggauggcg

SEQ ID NO: 2956374 - RNA, 12 nt, Mycobacterium avium subsp. paratuberculosis
gcggccucgaag

SEQ ID NO: 2956375 - RNA, 12 nt, Mycobacterium avium subsp. paratuberculosis
gcggccucgacg

SEQ ID NO: 2956376 - RNA, 12 nt, Mycobacterium avium subsp. paratuberculosis
gcggccucgccg

SEQ ID NO: 2956377 - RNA, 15 nt, Mycobacterium avium subsp. paratuberculosis
gcggccucggcaccg

SEQ ID NO: 2956378 - RNA, 20 nt, Mycobacterium avium subsp. paratuberculosis
gcggccucggcaccgugccg

SEQ ID NO: 2956379 - RNA, 19 nt, Mycobacterium avium subsp. paratuberculosis
gcggccucggcguccgcgg

SEQ ID NO: 2956380 - RNA, 14 nt, Mycobacterium avium subsp. paratuberculosis
gcggccucggugcu

SEQ ID NO: 2956381 - RNA, 16 nt, Mycobacterium avium subsp. paratuberculosis
gcggccucggugcuca

SEQ ID NO: 2956382 - RNA, 23 nt, Mycobacterium avium subsp. paratuberculosis
gcggccucucagcgcugucgcgg

SEQ ID NO: 2956383 - RNA, 13 nt, Mycobacterium avium subsp. paratuberculosis
gcggccugagccg

SEQ ID NO: 2956384 - RNA, 17 nt, Mycobacterium avium subsp. paratuberculosis
gcggccugagccgccgg

SEQ ID NO: 2956385 - RNA, 18 nt, Mycobacterium avium subsp. paratuberculosis
gcggccugagccgccggg

SEQ ID NO: 2956386 - RNA, 15 nt, Mycobacterium avium subsp. paratuberculosis
gcggccugcacccag

SEQ ID NO: 2956387 - RNA, 22 nt, Mycobacterium avium subsp. paratuberculosis
gcggccugcacccaggucaugg

SEQ ID NO: 2956388 - RNA, 14 nt, Mycobacterium avium subsp. paratuberculosis
gcggccugcaccuc

SEQ ID NO: 2956389 - RNA, 21 nt, Mycobacterium avium subsp. paratuberculosis
gcggccugcagcaccgaaccg

SEQ ID NO: 2956390 - RNA, 12 nt, Mycobacterium avium subsp. paratuberculosis
gcggccugccgg

SEQ ID NO: 2956391 - RNA, 13 nt, Mycobacterium avium subsp. paratuberculosis
gcggccugccggc

SEQ ID NO: 2956392 - RNA, 18 nt, Mycobacterium avium subsp. paratuberculosis
gcggccugccggccgccg

SEQ ID NO: 2956393 - RNA, 16 nt, Mycobacterium avium subsp. paratuberculosis
gcggccugcgccagga

SEQ ID NO: 2956394 - RNA, 17 nt, Mycobacterium avium subsp. paratuberculosis
gcggccugcgccaggau

SEQ ID NO: 2956395 - RNA, 13 nt, Mycobacterium avium subsp. paratuberculosis
gcggccugcggcg

SEQ ID NO: 2956396 - RNA, 14 nt, Mycobacterium avium subsp. paratuberculosis
gcggccugcgggcg

SEQ ID NO: 2956397 - RNA, 18 nt, Mycobacterium avium subsp. paratuberculosis
gcggccugcgggcgccgg

SEQ ID NO: 2956398 - RNA, 19 nt, Mycobacterium avium subsp. paratuberculosis
gcggccugcgggcgccggc

SEQ ID NO: 2956399 - RNA, 13 nt, Mycobacterium avium subsp. paratuberculosis
gcggccugcucga

SEQ ID NO: 2956400 - RNA, 15 nt, Mycobacterium avium subsp. paratuberculosis
gcggccugcucgaag

SEQ ID NO: 2956401 - RNA, 13 nt, Mycobacterium avium subsp. paratuberculosis
gcggccugcucgc

SEQ ID NO: 2956402 - RNA, 16 nt, Mycobacterium avium subsp. paratuberculosis
gcggccugcucgcaga

SEQ ID NO: 2956403 - RNA, 18 nt, Mycobacterium avium subsp. paratuberculosis
gcggccugcuucucgccg

SEQ ID NO: 2956404 - RNA, 16 nt, Mycobacterium avium subsp. paratuberculosis
gcggccugcuugaccg

SEQ ID NO: 2956405 - RNA, 15 nt, Mycobacterium avium subsp. paratuberculosis
gcggccuggccgucg

SEQ ID NO: 2956406 - RNA, 16 nt, Mycobacterium avium subsp. paratuberculosis
gcggccugggugaccg

SEQ ID NO: 2956407 - RNA, 21 nt, Mycobacterium avium subsp. paratuberculosis
gcggccuucuucugccacucg

SEQ ID NO: 2956408 - RNA, 16 nt, Mycobacterium avium subsp. paratuberculosis
gcggccuucuuggccg

SEQ ID NO: 2956409 - RNA, 18 nt, Mycobacterium avium subsp. paratuberculosis
gcggccuucuuggccgga

SEQ ID NO: 2956410 - RNA, 21 nt, Mycobacterium avium subsp. paratuberculosis
gcggccuucuuggccggagcc

SEQ ID NO: 2956411 - RNA, 23 nt, Mycobacterium avium subsp. paratuberculosis
gcggccuucuuggccggagccuu

SEQ ID NO: 2956412 - RNA, 16 nt, Mycobacterium avium subsp. paratuberculosis
gcggccuugaacgcgu

SEQ ID NO: 2956413 - RNA, 23 nt, Mycobacterium avium subsp. paratuberculosis
gcggccuugacgaguuccaccuc

SEQ ID NO: 2956414 - RNA, 16 nt, Mycobacterium avium subsp. paratuberculosis
gcggccuugcgagccg

SEQ ID NO: 2956415 - RNA, 18 nt, Mycobacterium avium subsp. paratuberculosis
gcggccuugcgagccgga

SEQ ID NO: 2956416 - RNA, 20 nt, Mycobacterium avium subsp. paratuberculosis
gcggccuugcgagccggagc

SEQ ID NO: 2956417 - RNA, 21 nt, Mycobacterium avium subsp. paratuberculosis
gcggccuugcgagccggagcc

SEQ ID NO: 2956418 - RNA, 17 nt, Mycobacterium avium subsp. paratuberculosis
gcggccuugcgcaccgg

SEQ ID NO: 2956419 - RNA, 19 nt, Mycobacterium avium subsp. paratuberculosis
gcggccuugcgcaccggag

SEQ ID NO: 2956420 - RNA, 21 nt, Mycobacterium avium subsp. paratuberculosis
gcggccuugcgcaccggagcc

SEQ ID NO: 2956421 - RNA, 14 nt, Mycobacterium avium subsp. paratuberculosis
gcggccuugcgggc

SEQ ID NO: 2956422 - RNA, 15 nt, Mycobacterium avium subsp. paratuberculosis
gcggccuugcgggcc

SEQ ID NO: 2956423 - RNA, 16 nt, Mycobacterium avium subsp. paratuberculosis
gcggccuugcgggccg

SEQ ID NO: 2956424 - RNA, 18 nt, Mycobacterium avium subsp. paratuberculosis
gcggccuugcgggccgga

SEQ ID NO: 2956425 - RNA, 20 nt, Mycobacterium avium subsp. paratuberculosis
gcggccuugcgggccggagc

SEQ ID NO: 2956426 - RNA, 21 nt, Mycobacterium avium subsp. paratuberculosis
gcggccuugcgggccggagcc

SEQ ID NO: 2956427 - RNA, 15 nt, Mycobacterium avium subsp. paratuberculosis
gcggccuuuuccggc

SEQ ID NO: 2956428 - RNA, 22 nt, Mycobacterium avium subsp. paratuberculosis
gcggccuuuuccggcgacaccg

SEQ ID NO: 2956429 - RNA, 19 nt, Mycobacterium avium subsp. paratuberculosis
gcggccuuuuucugcgccc

SEQ ID NO: 2956430 - RNA, 20 nt, Mycobacterium avium subsp. paratuberculosis
gcggccuuuuucugcgcccg

SEQ ID NO: 2956431 - RNA, 12 nt, Mycobacterium avium subsp. paratuberculosis
gcggcgacgucg

SEQ ID NO: 2956432 - RNA, 16 nt, Mycobacterium avium subsp. paratuberculosis
gcggcgacgucgacgg

SEQ ID NO: 2956433 - RNA, 17 nt, Mycobacterium avium subsp. paratuberculosis
gcggcgacgucgacggc

SEQ ID NO: 2956434 - RNA, 22 nt, Mycobacterium avium subsp. paratuberculosis
gcggcgacgucgacggcagcgc

SEQ ID NO: 2956435 - RNA, 14 nt, Mycobacterium avium subsp. paratuberculosis
gcggcgacgucgug

SEQ ID NO: 2956436 - RNA, 16 nt, Mycobacterium avium subsp. paratuberculosis
gcggcgacgucgugca

SEQ ID NO: 2956437 - RNA, 17 nt, Mycobacterium avium subsp. paratuberculosis
gcggcgacgucgugcac

SEQ ID NO: 2956438 - RNA, 20 nt, Mycobacterium avium subsp. paratuberculosis
gcggcgacgucgugcacgcc

SEQ ID NO: 2956439 - RNA, 18 nt, Mycobacterium avium subsp. paratuberculosis
gcggcgacgugaucggcg

SEQ ID NO: 2956440 - RNA, 21 nt, Mycobacterium avium subsp. paratuberculosis
gcggcgacgugaucggcggcc

SEQ ID NO: 2956441 - RNA, 23 nt, Mycobacterium avium subsp. paratuberculosis
gcggcgacgugaucggcggccug

SEQ ID NO: 2956442 - RNA, 17 nt, Mycobacterium avium subsp. paratuberculosis
gcggcgacgugccggcg

SEQ ID NO: 2956443 - RNA, 21 nt, Mycobacterium avium subsp. paratuberculosis
gcggcgagauuggccucggcg

SEQ ID NO: 2956444 - RNA, 14 nt, Mycobacterium avium subsp. paratuberculosis
gcggcgagcagcgc

SEQ ID NO: 2956445 - RNA, 15 nt, Mycobacterium avium subsp. paratuberculosis
gcggcgagcagcgcg

SEQ ID NO: 2956446 - RNA, 17 nt, Mycobacterium avium subsp. paratuberculosis
gcggcgagcagcgcgau

SEQ ID NO: 2956447 - RNA, 21 nt, Mycobacterium avium subsp. paratuberculosis
gcggcgagcagcgcgaugccg

SEQ ID NO: 2956448 - RNA, 15 nt, Mycobacterium avium subsp. paratuberculosis
gcggcgagccggccg

SEQ ID NO: 2956449 - RNA, 18 nt, Mycobacterium avium subsp. paratuberculosis
gcggcgagcugaucggcg

SEQ ID NO: 2956450 - RNA, 21 nt, Mycobacterium avium subsp. paratuberculosis
gcggcgagcugaucggcguug

SEQ ID NO: 2956451 - RNA, 22 nt, Mycobacterium avium subsp. paratuberculosis
gcggcgaggaacucagcgccca

SEQ ID NO: 2956452 - RNA, 23 nt, Mycobacterium avium subsp. paratuberculosis
gcggcgaggaacucagcgcccag

SEQ ID NO: 2956453 - RNA, 12 nt, Mycobacterium avium subsp. paratuberculosis
gcggcgaguccc

SEQ ID NO: 2956454 - RNA, 15 nt, Mycobacterium avium subsp. paratuberculosis
gcggcgagucccggc

SEQ ID NO: 2956455 - RNA, 19 nt, Mycobacterium avium subsp. paratuberculosis
gcggcgagucccggcgcac

SEQ ID NO: 2956456 - RNA, 21 nt, Mycobacterium avium subsp. paratuberculosis
gcggcgagucccggcgcacca

SEQ ID NO: 2956457 - RNA, 23 nt, Mycobacterium avium subsp. paratuberculosis
gcggcgagucccggcgcaccagg

SEQ ID NO: 2956458 - RNA, 15 nt, Mycobacterium avium subsp. paratuberculosis
gcggcgaguccggcc

SEQ ID NO: 2956459 - RNA, 16 nt, Mycobacterium avium subsp. paratuberculosis
gcggcgaguccggcca

SEQ ID NO: 2956460 - RNA, 17 nt, Mycobacterium avium subsp. paratuberculosis
gcggcgaguccggccag

SEQ ID NO: 2956461 - RNA, 19 nt, Mycobacterium avium subsp. paratuberculosis
gcggcgaguccggccaggu

SEQ ID NO: 2956462 - RNA, 15 nt, Mycobacterium avium subsp. paratuberculosis
gcggcgaguucggcg

SEQ ID NO: 2956463 - RNA, 20 nt, Mycobacterium avium subsp. paratuberculosis
gcggcgaguucggcggcccg

SEQ ID NO: 2956464 - RNA, 21 nt, Mycobacterium avium subsp. paratuberculosis
gcggcgaguucggcggcccgc

SEQ ID NO: 2956465 - RNA, 21 nt, Mycobacterium avium subsp. paratuberculosis
gcggcgaguucugguaggcgg

SEQ ID NO: 2956466 - RNA, 17 nt, Mycobacterium avium subsp. paratuberculosis
gcggcgaucaccgccgc

SEQ ID NO: 2956467 - RNA, 20 nt, Mycobacterium avium subsp. paratuberculosis
gcggcgaucaccgccgcggc

SEQ ID NO: 2956468 - RNA, 11 nt, Mycobacterium avium subsp. paratuberculosis
gcggcgaucag

SEQ ID NO: 2956469 - RNA, 16 nt, Mycobacterium avium subsp. paratuberculosis
gcggcgaucagcagca

SEQ ID NO: 2956470 - RNA, 18 nt, Mycobacterium avium subsp. paratuberculosis
gcggcgaucagcagcacc

SEQ ID NO: 2956471 - RNA, 21 nt, Mycobacterium avium subsp. paratuberculosis
gcggcgaucagcagcacccgg

SEQ ID NO: 2956472 - RNA, 23 nt, Mycobacterium avium subsp. paratuberculosis
gcggcgaucagcagcacccgggc

SEQ ID NO: 2956473 - RNA, 15 nt, Mycobacterium avium subsp. paratuberculosis
gcggcgaucagcccg

SEQ ID NO: 2956474 - RNA, 17 nt, Mycobacterium avium subsp. paratuberculosis
gcggcgaucagcccggc

SEQ ID NO: 2956475 - RNA, 20 nt, Mycobacterium avium subsp. paratuberculosis
gcggcgaucagcccggcccg

SEQ ID NO: 2956476 - RNA, 21 nt, Mycobacterium avium subsp. paratuberculosis
gcggcgaucagcccggcccgc

SEQ ID NO: 2956477 - RNA, 17 nt, Mycobacterium avium subsp. paratuberculosis
gcggcgaucagcugcuc

SEQ ID NO: 2956478 - RNA, 14 nt, Mycobacterium avium subsp. paratuberculosis
gcggcgauccggcc

SEQ ID NO: 2956479 - RNA, 17 nt, Mycobacterium avium subsp. paratuberculosis
gcggcgauccggccggc

SEQ ID NO: 2956480 - RNA, 23 nt, Mycobacterium avium subsp. paratuberculosis
gcggcgauccggccggcggcggu

SEQ ID NO: 2956481 - RNA, 22 nt, Mycobacterium avium subsp. paratuberculosis
gcggcgaucgagggggucauca

SEQ ID NO: 2956482 - RNA, 15 nt, Mycobacterium avium subsp. paratuberculosis
gcggcgaucgcgagc

SEQ ID NO: 2956483 - RNA, 13 nt, Mycobacterium avium subsp. paratuberculosis
gcggcgaucggcg

SEQ ID NO: 2956484 - RNA, 14 nt, Mycobacterium avium subsp. paratuberculosis
gcggcgaucggcgc

SEQ ID NO: 2956485 - RNA, 16 nt, Mycobacterium avium subsp. paratuberculosis
gcggcgaucggcgcgg

SEQ ID NO: 2956486 - RNA, 22 nt, Mycobacterium avium subsp. paratuberculosis
gcggcgaucgggucaccggccg

SEQ ID NO: 2956487 - RNA, 11 nt, Mycobacterium avium subsp. paratuberculosis
gcggcgaucgu

SEQ ID NO: 2956488 - RNA, 18 nt, Mycobacterium avium subsp. paratuberculosis
gcggcgaucucgaucgug

SEQ ID NO: 2956489 - RNA, 16 nt, Mycobacterium avium subsp. paratuberculosis
gcggcgaucucggcgg

SEQ ID NO: 2956490 - RNA, 19 nt, Mycobacterium avium subsp. paratuberculosis
gcggcgaucucggcggccg

SEQ ID NO: 2956491 - RNA, 20 nt, Mycobacterium avium subsp. paratuberculosis
gcggcgaucucggcggccgc

SEQ ID NO: 2956492 - RNA, 22 nt, Mycobacterium avium subsp. paratuberculosis
gcggcgaucucggcggccgcgu

SEQ ID NO: 2956493 - RNA, 23 nt, Mycobacterium avium subsp. paratuberculosis
gcggcgaucuugucccgcauggc

SEQ ID NO: 2956494 - RNA, 19 nt, Mycobacterium avium subsp. paratuberculosis
gcggcgaucuuugcggccg

SEQ ID NO: 2956495 - RNA, 21 nt, Mycobacterium avium subsp. paratuberculosis
gcggcgaucuuugcggccgug

SEQ ID NO: 2956496 - RNA, 22 nt, Mycobacterium avium subsp. paratuberculosis
gcggcgaugaagccccggaccg

SEQ ID NO: 2956497 - RNA, 13 nt, Mycobacterium avium subsp. paratuberculosis
gcggcgaugaccg

SEQ ID NO: 2956498 - RNA, 17 nt, Mycobacterium avium subsp. paratuberculosis
gcggcgaugaccgccug

SEQ ID NO: 2956499 - RNA, 13 nt, Mycobacterium avium subsp. paratuberculosis
gcggcgaugauca

SEQ ID NO: 2956500 - RNA, 15 nt, Mycobacterium avium subsp. paratuberculosis
gcggcgaugaucggg

SEQ ID NO: 2956501 - RNA, 17 nt, Mycobacterium avium subsp. paratuberculosis
gcggcgaugcccacagc

SEQ ID NO: 2956502 - RNA, 17 nt, Mycobacterium avium subsp. paratuberculosis
gcggcgaugcgcuccag

SEQ ID NO: 2956503 - RNA, 19 nt, Mycobacterium avium subsp. paratuberculosis
gcggcgaugcgcuccagca

SEQ ID NO: 2956504 - RNA, 22 nt, Mycobacterium avium subsp. paratuberculosis
gcggcgauggacguccagcggc

SEQ ID NO: 2956505 - RNA, 20 nt, Mycobacterium avium subsp. paratuberculosis
gcggcgauggugggcagccg

SEQ ID NO: 2956506 - RNA, 21 nt, Mycobacterium avium subsp. paratuberculosis
gcggcgauggugggcagccgg

SEQ ID NO: 2956507 - RNA, 22 nt, Mycobacterium avium subsp. paratuberculosis
gcggcgauggugggcagccggc

SEQ ID NO: 2956508 - RNA, 14 nt, Mycobacterium avium subsp. paratuberculosis
gcggcgaugguguc

SEQ ID NO: 2956509 - RNA, 14 nt, Mycobacterium avium subsp. paratuberculosis
gcggcgaugucguc

SEQ ID NO: 2956510 - RNA, 18 nt, Mycobacterium avium subsp. paratuberculosis
gcggcgaugucgucgacg

SEQ ID NO: 2956511 - RNA, 19 nt, Mycobacterium avium subsp. paratuberculosis
gcggcgaugucgucgacgc

SEQ ID NO: 2956512 - RNA, 18 nt, Mycobacterium avium subsp. paratuberculosis
gcggcgcaccccguccag

SEQ ID NO: 2956513 - RNA, 13 nt, Mycobacterium avium subsp. paratuberculosis
gcggcgcacccgg

SEQ ID NO: 2956514 - RNA, 17 nt, Mycobacterium avium subsp. paratuberculosis
gcggcgcacccgggcag

SEQ ID NO: 2956515 - RNA, 15 nt, Mycobacterium avium subsp. paratuberculosis
gcggcgccgccacgg

SEQ ID NO: 2956516 - RNA, 16 nt, Mycobacterium avium subsp. paratuberculosis
gcggcgccgccacggc

SEQ ID NO: 2956517 - RNA, 19 nt, Mycobacterium avium subsp. paratuberculosis
gcggcgccgccacggcacg

SEQ ID NO: 2956518 - RNA, 22 nt, Mycobacterium avium subsp. paratuberculosis
gcggcgccgccacggcacgucg

SEQ ID NO: 2956519 - RNA, 15 nt, Mycobacterium avium subsp. paratuberculosis
gcggcgccgcccggc

SEQ ID NO: 2956520 - RNA, 16 nt, Mycobacterium avium subsp. paratuberculosis
gcggcgccgcccggcg

SEQ ID NO: 2956521 - RNA, 13 nt, Mycobacterium avium subsp. paratuberculosis
gcggcgccgcggc

SEQ ID NO: 2956522 - RNA, 18 nt, Mycobacterium avium subsp. paratuberculosis
gcggcgccgcggcccugc

SEQ ID NO: 2956523 - RNA, 19 nt, Mycobacterium avium subsp. paratuberculosis
gcggcgccgcggcccugca

SEQ ID NO: 2956524 - RNA, 16 nt, Mycobacterium avium subsp. paratuberculosis
gcggcgccgcguacca

SEQ ID NO: 2956525 - RNA, 13 nt, Mycobacterium avium subsp. paratuberculosis
gcggcgccggaug

SEQ ID NO: 2956526 - RNA, 14 nt, Mycobacterium avium subsp. paratuberculosis
gcggcgccggaugc

SEQ ID NO: 2956527 - RNA, 23 nt, Mycobacterium avium subsp. paratuberculosis
gcggcgccggaugccagcagguc

SEQ ID NO: 2956528 - RNA, 17 nt, Mycobacterium avium subsp. paratuberculosis
gcggcgccggccgggcu

SEQ ID NO: 2956529 - RNA, 15 nt, Mycobacterium avium subsp. paratuberculosis
gcggcgccgggaucg

SEQ ID NO: 2956530 - RNA, 13 nt, Mycobacterium avium subsp. paratuberculosis
gcggcgccgggca

SEQ ID NO: 2956531 - RNA, 13 nt, Mycobacterium avium subsp. paratuberculosis
gcggcgccgggcg

SEQ ID NO: 2956532 - RNA, 17 nt, Mycobacterium avium subsp. paratuberculosis
gcggcgccgggcggccc

SEQ ID NO: 2956533 - RNA, 14 nt, Mycobacterium avium subsp. paratuberculosis
gcggcgccggggcu

SEQ ID NO: 2956534 - RNA, 17 nt, Mycobacterium avium subsp. paratuberculosis
gcggcgccgggucaccg

SEQ ID NO: 2956535 - RNA, 13 nt, Mycobacterium avium subsp. paratuberculosis
gcggcgccgucga

SEQ ID NO: 2956536 - RNA, 16 nt, Mycobacterium avium subsp. paratuberculosis
gcggcgccgucgaaca

SEQ ID NO: 2956537 - RNA, 15 nt, Mycobacterium avium subsp. paratuberculosis
gcggcgccgucgacc

SEQ ID NO: 2956538 - RNA, 16 nt, Mycobacterium avium subsp. paratuberculosis
gcggcgccgucgacca

SEQ ID NO: 2956539 - RNA, 14 nt, Mycobacterium avium subsp. paratuberculosis
gcggcgccgucgcc

SEQ ID NO: 2956540 - RNA, 19 nt, Mycobacterium avium subsp. paratuberculosis
gcggcgccgucgccgauca

SEQ ID NO: 2956541 - RNA, 15 nt, Mycobacterium avium subsp. paratuberculosis
gcggcgccguugacc

SEQ ID NO: 2956542 - RNA, 22 nt, Mycobacterium avium subsp. paratuberculosis
gcggcgccguugaccggccggu

SEQ ID NO: 2956543 - RNA, 22 nt, Mycobacterium avium subsp. paratuberculosis
gcggcgccguuucggacgagcc

SEQ ID NO: 2956544 - RNA, 14 nt, Mycobacterium avium subsp. paratuberculosis
gcggcgccugguca

SEQ ID NO: 2956545 - RNA, 14 nt, Mycobacterium avium subsp. paratuberculosis
gcggcgcgacaccg

SEQ ID NO: 2956546 - RNA, 15 nt, Mycobacterium avium subsp. paratuberculosis
gcggcgcgacaccgc

SEQ ID NO: 2956547 - RNA, 17 nt, Mycobacterium avium subsp. paratuberculosis
gcggcgcgacaccgcgg

SEQ ID NO: 2956548 - RNA, 18 nt, Mycobacterium avium subsp. paratuberculosis
gcggcgcgacaccgcggc

SEQ ID NO: 2956549 - RNA, 21 nt, Mycobacterium avium subsp. paratuberculosis
gcggcgcgaggcgcggggcgc

SEQ ID NO: 2956550 - RNA, 22 nt, Mycobacterium avium subsp. paratuberculosis
gcggcgcgaggcgcggggcgcg

SEQ ID NO: 2956551 - RNA, 21 nt, Mycobacterium avium subsp. paratuberculosis
gcggcgcgaucgucgaccacc

SEQ ID NO: 2956552 - RNA, 22 nt, Mycobacterium avium subsp. paratuberculosis
gcggcgcgaucgucgaccacca

SEQ ID NO: 2956553 - RNA, 21 nt, Mycobacterium avium subsp. paratuberculosis
gcggcgcgaugaucgccggcg

SEQ ID NO: 2956554 - RNA, 23 nt, Mycobacterium avium subsp. paratuberculosis
gcggcgcgaugaucgccggcgcc

SEQ ID NO: 2956555 - RNA, 13 nt, Mycobacterium avium subsp. paratuberculosis
gcggcgcgaugcu

SEQ ID NO: 2956556 - RNA, 23 nt, Mycobacterium avium subsp. paratuberculosis
gcggcgcgaugcuauucgggcca

SEQ ID NO: 2956557 - RNA, 14 nt, Mycobacterium avium subsp. paratuberculosis
gcggcgcgcacguc

SEQ ID NO: 2956558 - RNA, 20 nt, Mycobacterium avium subsp. paratuberculosis
gcggcgcgcacgucaccgcg

SEQ ID NO: 2956559 - RNA, 17 nt, Mycobacterium avium subsp. paratuberculosis
gcggcgcgcagccggcc

SEQ ID NO: 2956560 - RNA, 18 nt, Mycobacterium avium subsp. paratuberculosis
gcggcgcgcagccggccg

SEQ ID NO: 2956561 - RNA, 13 nt, Mycobacterium avium subsp. paratuberculosis
gcggcgcgcaggc

SEQ ID NO: 2956562 - RNA, 17 nt, Mycobacterium avium subsp. paratuberculosis
gcggcgcgcaggcgcgc

SEQ ID NO: 2956563 - RNA, 12 nt, Mycobacterium avium subsp. paratuberculosis
gcggcgcgcauc

SEQ ID NO: 2956564 - RNA, 14 nt, Mycobacterium avium subsp. paratuberculosis
gcggcgcgcauccc

SEQ ID NO: 2956565 - RNA, 14 nt, Mycobacterium avium subsp. paratuberculosis
gcggcgcgcaucgu

SEQ ID NO: 2956566 - RNA, 17 nt, Mycobacterium avium subsp. paratuberculosis
gcggcgcgcaucgucgc

SEQ ID NO: 2956567 - RNA, 20 nt, Mycobacterium avium subsp. paratuberculosis
gcggcgcgcaucgucgcggc

SEQ ID NO: 2956568 - RNA, 21 nt, Mycobacterium avium subsp. paratuberculosis
gcggcgcgcaucgucgcggcg

SEQ ID NO: 2956569 - RNA, 12 nt, Mycobacterium avium subsp. paratuberculosis
gcggcgcgccag

SEQ ID NO: 2956570 - RNA, 15 nt, Mycobacterium avium subsp. paratuberculosis
gcggcgcgccggccg

SEQ ID NO: 2956571 - RNA, 16 nt, Mycobacterium avium subsp. paratuberculosis
gcggcgcgccggccgg

SEQ ID NO: 2956572 - RNA, 14 nt, Mycobacterium avium subsp. paratuberculosis
gcggcgcgccgggc

SEQ ID NO: 2956573 - RNA, 15 nt, Mycobacterium avium subsp. paratuberculosis
gcggcgcgccgggca

SEQ ID NO: 2956574 - RNA, 14 nt, Mycobacterium avium subsp. paratuberculosis
gcggcgcgcgaugg

SEQ ID NO: 2956575 - RNA, 12 nt, Mycobacterium avium subsp. paratuberculosis
gcggcgcgcgcc

SEQ ID NO: 2956576 - RNA, 18 nt, Mycobacterium avium subsp. paratuberculosis
gcggcgcgcgccagcguc

SEQ ID NO: 2956577 - RNA, 22 nt, Mycobacterium avium subsp. paratuberculosis
gcggcgcgcgccagcgucugcu

SEQ ID NO: 2956578 - RNA, 16 nt, Mycobacterium avium subsp. paratuberculosis
gcggcgcgcgccgcag

SEQ ID NO: 2956579 - RNA, 23 nt, Mycobacterium avium subsp. paratuberculosis
gcggcgcgcgccgcagcgcgcgc

SEQ ID NO: 2956580 - RNA, 16 nt, Mycobacterium avium subsp. paratuberculosis
gcggcgcgcggccgcg

SEQ ID NO: 2956581 - RNA, 19 nt, Mycobacterium avium subsp. paratuberculosis
gcggcgcgcggccgcgacu

SEQ ID NO: 2956582 - RNA, 19 nt, Mycobacterium avium subsp. paratuberculosis
gcggcgcgcucgucgucgg

SEQ ID NO: 2956583 - RNA, 21 nt, Mycobacterium avium subsp. paratuberculosis
gcggcgcgcucgucgucggug

SEQ ID NO: 2956584 - RNA, 22 nt, Mycobacterium avium subsp. paratuberculosis
gcggcgcgcucgucgucgguga

SEQ ID NO: 2956585 - RNA, 18 nt, Mycobacterium avium subsp. paratuberculosis
gcggcgcggagccggccg

SEQ ID NO: 2956586 - RNA, 19 nt, Mycobacterium avium subsp. paratuberculosis
gcggcgcggagccggccgc

SEQ ID NO: 2956587 - RNA, 21 nt, Mycobacterium avium subsp. paratuberculosis
gcggcgcggagccggccgccg

SEQ ID NO: 2956588 - RNA, 16 nt, Mycobacterium avium subsp. paratuberculosis
gcggcgcggaucucgc

SEQ ID NO: 2956589 - RNA, 14 nt, Mycobacterium avium subsp. paratuberculosis
gcggcgcggccacc

SEQ ID NO: 2956590 - RNA, 17 nt, Mycobacterium avium subsp. paratuberculosis
gcggcgcggccaccccg

SEQ ID NO: 2956591 - RNA, 22 nt, Mycobacterium avium subsp. paratuberculosis
gcggcgcggccaccccggugac

SEQ ID NO: 2956592 - RNA, 13 nt, Mycobacterium avium subsp. paratuberculosis
gcggcgcggccca

SEQ ID NO: 2956593 - RNA, 14 nt, Mycobacterium avium subsp. paratuberculosis
gcggcgcggcccgg

SEQ ID NO: 2956594 - RNA, 16 nt, Mycobacterium avium subsp. paratuberculosis
gcggcgcggcccggcc

SEQ ID NO: 2956595 - RNA, 20 nt, Mycobacterium avium subsp. paratuberculosis
gcggcgcggccgauucggcg

SEQ ID NO: 2956596 - RNA, 15 nt, Mycobacterium avium subsp. paratuberculosis
gcggcgcggcgcagc

SEQ ID NO: 2956597 - RNA, 13 nt, Mycobacterium avium subsp. paratuberculosis
gcggcgcggcggu

SEQ ID NO: 2956598 - RNA, 14 nt, Mycobacterium avium subsp. paratuberculosis
gcggcgcggcggug

SEQ ID NO: 2956599 - RNA, 16 nt, Mycobacterium avium subsp. paratuberculosis
gcggcgcgggcggcgu

SEQ ID NO: 2956600 - RNA, 15 nt, Mycobacterium avium subsp. paratuberculosis
gcggcggcccgcgcg

SEQ ID NO: 2956601 - RNA, 20 nt, Mycobacterium avium subsp. paratuberculosis
gcggcggcccgcgcgggguc

SEQ ID NO: 2956602 - RNA, 15 nt, Mycobacterium avium subsp. paratuberculosis
gcggcggcccggcgu

SEQ ID NO: 2956603 - RNA, 16 nt, Mycobacterium avium subsp. paratuberculosis
gcggcggcccggcguc

SEQ ID NO: 2956604 - RNA, 17 nt, Mycobacterium avium subsp. paratuberculosis
gcggcggcccggcguca

SEQ ID NO: 2956605 - RNA, 20 nt, Mycobacterium avium subsp. paratuberculosis
gcggcggcccgucgccacca

SEQ ID NO: 2956606 - RNA, 17 nt, Mycobacterium avium subsp. paratuberculosis
gcggcggcccuucucgg

SEQ ID NO: 2956607 - RNA, 13 nt, Mycobacterium avium subsp. paratuberculosis
gcggcggccgacg

SEQ ID NO: 2956608 - RNA, 14 nt, Mycobacterium avium subsp. paratuberculosis
gcggcggccgacgc

SEQ ID NO: 2956609 - RNA, 16 nt, Mycobacterium avium subsp. paratuberculosis
gcggcggccgacgcgc

SEQ ID NO: 2956610 - RNA, 12 nt, Mycobacterium avium subsp. paratuberculosis
gcggcggccgca

SEQ ID NO: 2956611 - RNA, 13 nt, Mycobacterium avium subsp. paratuberculosis
gcggcggccgcag

SEQ ID NO: 2956612 - RNA, 14 nt, Mycobacterium avium subsp. paratuberculosis
gcggcggccgcagc

SEQ ID NO: 2956613 - RNA, 15 nt, Mycobacterium avium subsp. paratuberculosis
gcggcggccgcagcg

SEQ ID NO: 2956614 - RNA, 15 nt, Mycobacterium avium subsp. paratuberculosis
gcggcggccgcgucg

SEQ ID NO: 2956615 - RNA, 19 nt, Mycobacterium avium subsp. paratuberculosis
gcggcggccgcgucgccga

SEQ ID NO: 2956616 - RNA, 13 nt, Mycobacterium avium subsp. paratuberculosis
gcggcggccggcc

SEQ ID NO: 2956617 - RNA, 17 nt, Mycobacterium avium subsp. paratuberculosis
gcggcggccggccagcg

SEQ ID NO: 2956618 - RNA, 15 nt, Mycobacterium avium subsp. paratuberculosis
gcggcggccggcgau

SEQ ID NO: 2956619 - RNA, 16 nt, Mycobacterium avium subsp. paratuberculosis
gcggcggccggcgccg

SEQ ID NO: 2956620 - RNA, 12 nt, Mycobacterium avium subsp. paratuberculosis
gcggcggccugc

SEQ ID NO: 2956621 - RNA, 19 nt, Mycobacterium avium subsp. paratuberculosis
gcggcggccugcaccucgg

SEQ ID NO: 2956622 - RNA, 22 nt, Mycobacterium avium subsp. paratuberculosis
gcggcggccugcgcgucgucgc

SEQ ID NO: 2956623 - RNA, 22 nt, Mycobacterium avium subsp. paratuberculosis
gcggcggccugcuugaccgcca

SEQ ID NO: 2956624 - RNA, 19 nt, Mycobacterium avium subsp. paratuberculosis
gcggcggccuucuuggccg

SEQ ID NO: 2956625 - RNA, 21 nt, Mycobacterium avium subsp. paratuberculosis
gcggcggccuucuuggccgga

SEQ ID NO: 2956626 - RNA, 20 nt, Mycobacterium avium subsp. paratuberculosis
gcggcggccuuuuucugcgc

SEQ ID NO: 2956627 - RNA, 13 nt, Mycobacterium avium subsp. paratuberculosis
gcggcggcgacga

SEQ ID NO: 2956628 - RNA, 13 nt, Mycobacterium avium subsp. paratuberculosis
gcggcggcgccga

SEQ ID NO: 2956629 - RNA, 14 nt, Mycobacterium avium subsp. paratuberculosis
gcggcggcgccgac

SEQ ID NO: 2956630 - RNA, 22 nt, Mycobacterium avium subsp. paratuberculosis
gcggcggcgccgacgggcccgc

SEQ ID NO: 2956631 - RNA, 13 nt, Mycobacterium avium subsp. paratuberculosis
gcggcggcgccgc

SEQ ID NO: 2956632 - RNA, 14 nt, Mycobacterium avium subsp. paratuberculosis
gcggcggcgccgca

SEQ ID NO: 2956633 - RNA, 16 nt, Mycobacterium avium subsp. paratuberculosis
gcggcggcgccgcagc

SEQ ID NO: 2956634 - RNA, 15 nt, Mycobacterium avium subsp. paratuberculosis
gcggcggcgccgcgg

SEQ ID NO: 2956635 - RNA, 16 nt, Mycobacterium avium subsp. paratuberculosis
gcggcggcgccgcggu

SEQ ID NO: 2956636 - RNA, 14 nt, Mycobacterium avium subsp. paratuberculosis
gcggcggcgccggg

SEQ ID NO: 2956637 - RNA, 13 nt, Mycobacterium avium subsp. paratuberculosis
gcggcggcgccgu

SEQ ID NO: 2956638 - RNA, 16 nt, Mycobacterium avium subsp. paratuberculosis
gcggcggcgcgccggc

SEQ ID NO: 2956639 - RNA, 20 nt, Mycobacterium avium subsp. paratuberculosis
gcggcggcgcgccggccgga

SEQ ID NO: 2956640 - RNA, 15 nt, Mycobacterium avium subsp. paratuberculosis
gcggcggcgcgggcg

SEQ ID NO: 2956641 - RNA, 13 nt, Mycobacterium avium subsp. paratuberculosis
gcggcggcgcgug

SEQ ID NO: 2956642 - RNA, 21 nt, Mycobacterium avium subsp. paratuberculosis
gcggcggcgcgugcgccgcgg

SEQ ID NO: 2956643 - RNA, 15 nt, Mycobacterium avium subsp. paratuberculosis
gcggcggcgcugguc

SEQ ID NO: 2956644 - RNA, 14 nt, Mycobacterium avium subsp. paratuberculosis
gcggcggcggcccg

SEQ ID NO: 2956645 - RNA, 15 nt, Mycobacterium avium subsp. paratuberculosis
gcggcggcggcccgu

SEQ ID NO: 2956646 - RNA, 13 nt, Mycobacterium avium subsp. paratuberculosis
gcggcggcggccg

SEQ ID NO: 2956647 - RNA, 14 nt, Mycobacterium avium subsp. paratuberculosis
gcggcggcggccgc

SEQ ID NO: 2956648 - RNA, 16 nt, Mycobacterium avium subsp. paratuberculosis
gcggcggcggccgcgu

SEQ ID NO: 2956649 - RNA, 13 nt, Mycobacterium avium subsp. paratuberculosis
gcggcggcgggcc

SEQ ID NO: 2956650 - RNA, 15 nt, Mycobacterium avium subsp. paratuberculosis
gcggcggcgggccag

SEQ ID NO: 2956651 - RNA, 13 nt, Mycobacterium avium subsp. paratuberculosis
gcggcggcggucg

SEQ ID NO: 2956652 - RNA, 15 nt, Mycobacterium avium subsp. paratuberculosis
gcggcggcggucggc

SEQ ID NO: 2956653 - RNA, 12 nt, Mycobacterium avium subsp. paratuberculosis
gcggcggcggug

SEQ ID NO: 2956654 - RNA, 13 nt, Mycobacterium avium subsp. paratuberculosis
gcggcggcggugc

SEQ ID NO: 2956655 - RNA, 19 nt, Mycobacterium avium subsp. paratuberculosis
gcggcggcguccgcggccg

SEQ ID NO: 2956656 - RNA, 22 nt, Mycobacterium avium subsp. paratuberculosis
gcggcggcgucgaccgccccgc

SEQ ID NO: 2956657 - RNA, 14 nt, Mycobacterium avium subsp. paratuberculosis
gcggcggcgucggc

SEQ ID NO: 2956658 - RNA, 16 nt, Mycobacterium avium subsp. paratuberculosis
gcggcggcgucggcgu

SEQ ID NO: 2956659 - RNA, 21 nt, Mycobacterium avium subsp. paratuberculosis
gcggcggcguuggccgccgcc

SEQ ID NO: 2956660 - RNA, 14 nt, Mycobacterium avium subsp. paratuberculosis
gcggcggcucggcg

SEQ ID NO: 2956661 - RNA, 15 nt, Mycobacterium avium subsp. paratuberculosis
gcggcggcucguuga

SEQ ID NO: 2956662 - RNA, 13 nt, Mycobacterium avium subsp. paratuberculosis
gcggcggcugccu

SEQ ID NO: 2956663 - RNA, 18 nt, Mycobacterium avium subsp. paratuberculosis
gcggcggcugccucgacg

SEQ ID NO: 2956664 - RNA, 19 nt, Mycobacterium avium subsp. paratuberculosis
gcggcggcugccucgacga

SEQ ID NO: 2956665 - RNA, 15 nt, Mycobacterium avium subsp. paratuberculosis
gcggcggcugggccg

SEQ ID NO: 2956666 - RNA, 14 nt, Mycobacterium avium subsp. paratuberculosis
gcggcgggaaacca

SEQ ID NO: 2956667 - RNA, 19 nt, Mycobacterium avium subsp. paratuberculosis
gcggcgggaaaccaccugc

SEQ ID NO: 2956668 - RNA, 22 nt, Mycobacterium avium subsp. paratuberculosis
gcggcgggaaaccaccugccgc

SEQ ID NO: 2956669 - RNA, 23 nt, Mycobacterium avium subsp. paratuberculosis
gcggcgggaaaccaccugccgca

SEQ ID NO: 2956670 - RNA, 22 nt, Mycobacterium avium subsp. paratuberculosis
gcggcgggagcuaggcggccgg

SEQ ID NO: 2956671 - RNA, 17 nt, Mycobacterium avium subsp. paratuberculosis
gcggcgggccagcucgu

SEQ ID NO: 2956672 - RNA, 21 nt, Mycobacterium avium subsp. paratuberculosis
gcggcgggccagcucgucgag

SEQ ID NO: 2956673 - RNA, 17 nt, Mycobacterium avium subsp. paratuberculosis
gcggcgggccagggcga

SEQ ID NO: 2956674 - RNA, 22 nt, Mycobacterium avium subsp. paratuberculosis
gcggcgggccagggcgaggacg

SEQ ID NO: 2956675 - RNA, 13 nt, Mycobacterium avium subsp. paratuberculosis
gcggcgggccagu

SEQ ID NO: 2956676 - RNA, 21 nt, Mycobacterium avium subsp. paratuberculosis
gcggcgggccagucgccgcgc

SEQ ID NO: 2956677 - RNA, 13 nt, Mycobacterium avium subsp. paratuberculosis
gcggcgggcccag

SEQ ID NO: 2956678 - RNA, 15 nt, Mycobacterium avium subsp. paratuberculosis
gcggcgggcccagca

SEQ ID NO: 2956679 - RNA, 12 nt, Mycobacterium avium subsp. paratuberculosis
gcggcgggcccg

SEQ ID NO: 2956680 - RNA, 13 nt, Mycobacterium avium subsp. paratuberculosis
gcggcgggcccgc

SEQ ID NO: 2956681 - RNA, 18 nt, Mycobacterium avium subsp. paratuberculosis
gcggcgggcccgcagcuc

SEQ ID NO: 2956682 - RNA, 14 nt, Mycobacterium avium subsp. paratuberculosis
gcggcgggcccggc

SEQ ID NO: 2956683 - RNA, 15 nt, Mycobacterium avium subsp. paratuberculosis
gcggcgggcccggcg

SEQ ID NO: 2956684 - RNA, 18 nt, Mycobacterium avium subsp. paratuberculosis
gcggcgggcccggcgaug

SEQ ID NO: 2956685 - RNA, 20 nt, Mycobacterium avium subsp. paratuberculosis
gcggcgggcccggcgaugcg

SEQ ID NO: 2956686 - RNA, 14 nt, Mycobacterium avium subsp. paratuberculosis
gcggcguagcgcca

SEQ ID NO: 2956687 - RNA, 15 nt, Mycobacterium avium subsp. paratuberculosis
gcggcguagcgccag

SEQ ID NO: 2956688 - RNA, 15 nt, Mycobacterium avium subsp. paratuberculosis
gcggcguaggcggcc

SEQ ID NO: 2956689 - RNA, 22 nt, Mycobacterium avium subsp. paratuberculosis
gcggcguaggugggcagcgcgg

SEQ ID NO: 2956690 - RNA, 23 nt, Mycobacterium avium subsp. paratuberculosis
gcggcguaggugggcagcgcggc

SEQ ID NO: 2956691 - RNA, 16 nt, Mycobacterium avium subsp. paratuberculosis
gcggcguagucgccgg

SEQ ID NO: 2956692 - RNA, 15 nt, Mycobacterium avium subsp. paratuberculosis
gcggcguagucggcg

SEQ ID NO: 2956693 - RNA, 16 nt, Mycobacterium avium subsp. paratuberculosis
gcggcguagucggcgc

SEQ ID NO: 2956694 - RNA, 18 nt, Mycobacterium avium subsp. paratuberculosis
gcggcguagucggcgcag

SEQ ID NO: 2956695 - RNA, 17 nt, Mycobacterium avium subsp. paratuberculosis
gcggcguauucccgggg

SEQ ID NO: 2956696 - RNA, 15 nt, Mycobacterium avium subsp. paratuberculosis
gcggcgucaggaugg

SEQ ID NO: 2956697 - RNA, 18 nt, Mycobacterium avium subsp. paratuberculosis
gcggcgucaggggugcca

SEQ ID NO: 2956698 - RNA, 23 nt, Mycobacterium avium subsp. paratuberculosis
gcggcgucaggggugccagccgu

SEQ ID NO: 2956699 - RNA, 17 nt, Mycobacterium avium subsp. paratuberculosis
gcggcgucagguccgcg

SEQ ID NO: 2956700 - RNA, 23 nt, Mycobacterium avium subsp. paratuberculosis
gcggcgucaucccccgcagcuuc

SEQ ID NO: 2956701 - RNA, 17 nt, Mycobacterium avium subsp. paratuberculosis
gcggcguccaccagcac

SEQ ID NO: 2956702 - RNA, 17 nt, Mycobacterium avium subsp. paratuberculosis
gcggcgucccagugcuc

SEQ ID NO: 2956703 - RNA, 23 nt, Mycobacterium avium subsp. paratuberculosis
gcggcgucccagugcucgaccag

SEQ ID NO: 2956704 - RNA, 14 nt, Mycobacterium avium subsp. paratuberculosis
gcggcguccgcggc

SEQ ID NO: 2956705 - RNA, 16 nt, Mycobacterium avium subsp. paratuberculosis
gcggcguccgcggccg

SEQ ID NO: 2956706 - RNA, 18 nt, Mycobacterium avium subsp. paratuberculosis
gcggcguccgcggccgcg

SEQ ID NO: 2956707 - RNA, 19 nt, Mycobacterium avium subsp. paratuberculosis
gcggcguccgcggccgcgg

SEQ ID NO: 2956708 - RNA, 15 nt, Mycobacterium avium subsp. paratuberculosis
gcggcguccucgacc

SEQ ID NO: 2956709 - RNA, 16 nt, Mycobacterium avium subsp. paratuberculosis
gcggcguccucgacca

SEQ ID NO: 2956710 - RNA, 17 nt, Mycobacterium avium subsp. paratuberculosis
gcggcguccucgaccac

SEQ ID NO: 2956711 - RNA, 19 nt, Mycobacterium avium subsp. paratuberculosis
gcggcguccucgaccaccc

SEQ ID NO: 2956712 - RNA, 13 nt, Mycobacterium avium subsp. paratuberculosis
gcggcgucgagca

SEQ ID NO: 2956713 - RNA, 22 nt, Mycobacterium avium subsp. paratuberculosis
gcggcgucgaguucgccgucga

SEQ ID NO: 2956714 - RNA, 12 nt, Mycobacterium avium subsp. paratuberculosis
gcggcgucgaug

SEQ ID NO: 2956715 - RNA, 14 nt, Mycobacterium avium subsp. paratuberculosis
gcggcgucggccgg

SEQ ID NO: 2956716 - RNA, 12 nt, Mycobacterium avium subsp. paratuberculosis
gcggcgucggcg

SEQ ID NO: 2956717 - RNA, 15 nt, Mycobacterium avium subsp. paratuberculosis
gcggcgucggcgacg

SEQ ID NO: 2956718 - RNA, 16 nt, Mycobacterium avium subsp. paratuberculosis
gcggcgucggcgacgg

SEQ ID NO: 2956719 - RNA, 14 nt, Mycobacterium avium subsp. paratuberculosis
gcggcgucgggaug

SEQ ID NO: 2956720 - RNA, 18 nt, Mycobacterium avium subsp. paratuberculosis
gcggcgucgggauggucg

SEQ ID NO: 2956721 - RNA, 17 nt, Mycobacterium avium subsp. paratuberculosis
gcggcgucggguagggc

SEQ ID NO: 2956722 - RNA, 21 nt, Mycobacterium avium subsp. paratuberculosis
gcggcgucggguagggcgccg

SEQ ID NO: 2956723 - RNA, 23 nt, Mycobacterium avium subsp. paratuberculosis
gcggcgucggguagggcgccguc

SEQ ID NO: 2956724 - RNA, 23 nt, Mycobacterium avium subsp. paratuberculosis
gcggcgucguagacgcugccgcu

SEQ ID NO: 2956725 - RNA, 13 nt, Mycobacterium avium subsp. paratuberculosis
gcggcgucguagu

SEQ ID NO: 2956726 - RNA, 18 nt, Mycobacterium avium subsp. paratuberculosis
gcggcgucguaguugcgg

SEQ ID NO: 2956727 - RNA, 22 nt, Mycobacterium avium subsp. paratuberculosis
gcggcgucguaguugcggccgg

SEQ ID NO: 2956728 - RNA, 14 nt, Mycobacterium avium subsp. paratuberculosis
gcggcgucgucgcc

SEQ ID NO: 2956729 - RNA, 20 nt, Mycobacterium avium subsp. paratuberculosis
gcggcgucgucgccguggcg

SEQ ID NO: 2956730 - RNA, 21 nt, Mycobacterium avium subsp. paratuberculosis
gcggcgugcaacugcguggcc

SEQ ID NO: 2956731 - RNA, 14 nt, Mycobacterium avium subsp. paratuberculosis
gcggcgugcaccgc

SEQ ID NO: 2956732 - RNA, 15 nt, Mycobacterium avium subsp. paratuberculosis
gcggcgugcaccgcc

SEQ ID NO: 2956733 - RNA, 21 nt, Mycobacterium avium subsp. paratuberculosis
gcggcgugcaccgcccgcgcg

SEQ ID NO: 2956734 - RNA, 18 nt, Mycobacterium avium subsp. paratuberculosis
gcggcgugccagggcagc

SEQ ID NO: 2956735 - RNA, 14 nt, Mycobacterium avium subsp. paratuberculosis
gcggcgugcccgcu

SEQ ID NO: 2956736 - RNA, 18 nt, Mycobacterium avium subsp. paratuberculosis
gcggcgugcccgcucgcu

SEQ ID NO: 2956737 - RNA, 17 nt, Mycobacterium avium subsp. paratuberculosis
gcggcgugccgcccgga

SEQ ID NO: 2956738 - RNA, 14 nt, Mycobacterium avium subsp. paratuberculosis
gcggcgugcgccag

SEQ ID NO: 2956739 - RNA, 15 nt, Mycobacterium avium subsp. paratuberculosis
gcggcgugcggucgc

SEQ ID NO: 2956740 - RNA, 15 nt, Mycobacterium avium subsp. paratuberculosis
gcggcgugcugcgca

SEQ ID NO: 2956741 - RNA, 22 nt, Mycobacterium avium subsp. paratuberculosis
gcggcgugggguucccggccgg

SEQ ID NO: 2956742 - RNA, 24 nt, Mycobacterium avium subsp. paratuberculosis
gcggcgugggguucccggccggug

SEQ ID NO: 2956743 - RNA, 18 nt, Mycobacterium avium subsp. paratuberculosis
gcggcgugguagccgccg

SEQ ID NO: 2956744 - RNA, 18 nt, Mycobacterium avium subsp. paratuberculosis
gcggcguucagcagcgcg

SEQ ID NO: 2956745 - RNA, 21 nt, Mycobacterium avium subsp. paratuberculosis
gcggcguucagcagcgcgguc

SEQ ID NO: 2956746 - RNA, 17 nt, Mycobacterium avium subsp. paratuberculosis
gcggcguucagccggag

SEQ ID NO: 2956747 - RNA, 18 nt, Mycobacterium avium subsp. paratuberculosis
gcggcguucagccggagc

SEQ ID NO: 2956748 - RNA, 19 nt, Mycobacterium avium subsp. paratuberculosis
gcggcguucggugcccggg

SEQ ID NO: 2956749 - RNA, 22 nt, Mycobacterium avium subsp. paratuberculosis
gcggcguucggugcccgggguc

SEQ ID NO: 2956750 - RNA, 16 nt, Mycobacterium avium subsp. paratuberculosis
gcggcguucuccagca

SEQ ID NO: 2956751 - RNA, 18 nt, Mycobacterium avium subsp. paratuberculosis
gcggcguucuccagcacc

SEQ ID NO: 2956752 - RNA, 19 nt, Mycobacterium avium subsp. paratuberculosis
gcggcguucuccagcaccc

SEQ ID NO: 2956753 - RNA, 20 nt, Mycobacterium avium subsp. paratuberculosis
gcggcguucuccagcacccg

SEQ ID NO: 2956754 - RNA, 22 nt, Mycobacterium avium subsp. paratuberculosis
gcggcguucuccagcacccgca

SEQ ID NO: 2956755 - RNA, 20 nt, Mycobacterium avium subsp. paratuberculosis
gcggcguugaggcguugcgg

SEQ ID NO: 2956756 - RNA, 15 nt, Mycobacterium avium subsp. paratuberculosis
gcggcguugcccgcu

SEQ ID NO: 2956757 - RNA, 22 nt, Mycobacterium avium subsp. paratuberculosis
gcggcguugcccgcugcggcaa

SEQ ID NO: 2956758 - RNA, 15 nt, Mycobacterium avium subsp. paratuberculosis
gcggcguugccgccg

SEQ ID NO: 2956759 - RNA, 22 nt, Mycobacterium avium subsp. paratuberculosis
gcggcguugccgccggcgcggu

SEQ ID NO: 2956760 - RNA, 15 nt, Mycobacterium avium subsp. paratuberculosis
gcggcguugcgggug

SEQ ID NO: 2956761 - RNA, 17 nt, Mycobacterium avium subsp. paratuberculosis
gcggcguugcgggugga

SEQ ID NO: 2956762 - RNA, 19 nt, Mycobacterium avium subsp. paratuberculosis
gcggcguuguggccaccga

SEQ ID NO: 2956763 - RNA, 14 nt, Mycobacterium avium subsp. paratuberculosis
gcggcuaagccggc

SEQ ID NO: 2956764 - RNA, 15 nt, Mycobacterium avium subsp. paratuberculosis
gcggcuaagccggcg

SEQ ID NO: 2956765 - RNA, 18 nt, Mycobacterium avium subsp. paratuberculosis
gcggcuaagccggcgucg

SEQ ID NO: 2956766 - RNA, 20 nt, Mycobacterium avium subsp. paratuberculosis
gcggcuaauucagcugcgga

SEQ ID NO: 2956767 - RNA, 18 nt, Mycobacterium avium subsp. paratuberculosis
gcggcuaguuggccggcu

SEQ ID NO: 2956768 - RNA, 19 nt, Mycobacterium avium subsp. paratuberculosis
gcggcuaguuggccggcuu

SEQ ID NO: 2956769 - RNA, 18 nt, Mycobacterium avium subsp. paratuberculosis
gcggcucacagcgcggcg

SEQ ID NO: 2956770 - RNA, 22 nt, Mycobacterium avium subsp. paratuberculosis
gcggcuugaccggcucgccggc

SEQ ID NO: 2956771 - RNA, 18 nt, Mycobacterium avium subsp. paratuberculosis
gcggcuugagccggaucg

SEQ ID NO: 2956772 - RNA, 16 nt, Mycobacterium avium subsp. paratuberculosis
gcggcuugagcgccag

SEQ ID NO: 2956773 - RNA, 15 nt, Mycobacterium avium subsp. paratuberculosis
gcggcuugcccguuc

SEQ ID NO: 2956774 - RNA, 14 nt, Mycobacterium avium subsp. paratuberculosis
gcggcuugccgccg

SEQ ID NO: 2956775 - RNA, 20 nt, Mycobacterium avium subsp. paratuberculosis
gcggcuuggccaccaccacg

SEQ ID NO: 2956776 - RNA, 21 nt, Mycobacterium avium subsp. paratuberculosis
gcggcuuggccaccaccacgg

SEQ ID NO: 2956777 - RNA, 14 nt, Mycobacterium avium subsp. paratuberculosis
gcggcuuggccgug

SEQ ID NO: 2956778 - RNA, 23 nt, Mycobacterium avium subsp. paratuberculosis
gcggcuuggucaccagcucgccg

SEQ ID NO: 2956779 - RNA, 23 nt, Mycobacterium avium subsp. paratuberculosis
gcgggaaaccaccugccgcaacg

SEQ ID NO: 2956780 - RNA, 15 nt, Mycobacterium avium subsp. paratuberculosis
gcgggaacaccacgu

SEQ ID NO: 2956781 - RNA, 18 nt, Mycobacterium avium subsp. paratuberculosis
gcgggaacaccacgucgu

SEQ ID NO: 2956782 - RNA, 17 nt, Mycobacterium avium subsp. paratuberculosis
gcgggaacagcgggaac

SEQ ID NO: 2956783 - RNA, 24 nt, Mycobacterium avium subsp. paratuberculosis
gcgggaacgaucggcuccagcgcc

SEQ ID NO: 2956784 - RNA, 15 nt, Mycobacterium avium subsp. paratuberculosis
gcgggaacgcgucga

SEQ ID NO: 2956785 - RNA, 20 nt, Mycobacterium avium subsp. paratuberculosis
gcgggaacgucauggccagc

SEQ ID NO: 2956786 - RNA, 22 nt, Mycobacterium avium subsp. paratuberculosis
gcgggaacgucauggccagcuc

SEQ ID NO: 2956787 - RNA, 21 nt, Mycobacterium avium subsp. paratuberculosis
gcgggaacucgaugcggcagc

SEQ ID NO: 2956788 - RNA, 18 nt, Mycobacterium avium subsp. paratuberculosis
gcgggaagcccaccgcgg

SEQ ID NO: 2956789 - RNA, 17 nt, Mycobacterium avium subsp. paratuberculosis
gcgggaagccgaggucg

SEQ ID NO: 2956790 - RNA, 23 nt, Mycobacterium avium subsp. paratuberculosis
gcgggaagccgaguuuggcgucg

SEQ ID NO: 2956791 - RNA, 16 nt, Mycobacterium avium subsp. paratuberculosis
gcgggaagccgccgcc

SEQ ID NO: 2956792 - RNA, 21 nt, Mycobacterium avium subsp. paratuberculosis
gcgggaagccgccgcccugcg

SEQ ID NO: 2956793 - RNA, 12 nt, Mycobacterium avium subsp. paratuberculosis
gcgggaagcugc

SEQ ID NO: 2956794 - RNA, 15 nt, Mycobacterium avium subsp. paratuberculosis
gcgggaagggcccgg

SEQ ID NO: 2956795 - RNA, 16 nt, Mycobacterium avium subsp. paratuberculosis
gcgggaagggcccggg

SEQ ID NO: 2956796 - RNA, 20 nt, Mycobacterium avium subsp. paratuberculosis
gcgggaaguagugcaucggc

SEQ ID NO: 2956797 - RNA, 20 nt, Mycobacterium avium subsp. paratuberculosis
gcgggaaguugcccaacugg

SEQ ID NO: 2956798 - RNA, 17 nt, Mycobacterium avium subsp. paratuberculosis
gcgggaaucacgcccca

SEQ ID NO: 2956799 - RNA, 23 nt, Mycobacterium avium subsp. paratuberculosis
gcgggaaucacgccccaggcgcc

SEQ ID NO: 2956800 - RNA, 21 nt, Mycobacterium avium subsp. paratuberculosis
gcgggaaucccacccgcaacg

SEQ ID NO: 2956801 - RNA, 16 nt, Mycobacterium avium subsp. paratuberculosis
gcgggaauggccgcgc

SEQ ID NO: 2956802 - RNA, 19 nt, Mycobacterium avium subsp. paratuberculosis
gcgggaauuggcaccggac

SEQ ID NO: 2956803 - RNA, 14 nt, Mycobacterium avium subsp. paratuberculosis
gcgggacacggcgg

SEQ ID NO: 2956804 - RNA, 17 nt, Mycobacterium avium subsp. paratuberculosis
gcgggacacggcggcgc

SEQ ID NO: 2956805 - RNA, 19 nt, Mycobacterium avium subsp. paratuberculosis
gcgggacacggcggcgcgg

SEQ ID NO: 2956806 - RNA, 22 nt, Mycobacterium avium subsp. paratuberculosis
gcgggacacggcggcgcgggcg

SEQ ID NO: 2956807 - RNA, 17 nt, Mycobacterium avium subsp. paratuberculosis
gcgggacagcaccacca

SEQ ID NO: 2956808 - RNA, 21 nt, Mycobacterium avium subsp. paratuberculosis
gcgggacagcaccaccagguc

SEQ ID NO: 2956809 - RNA, 14 nt, Mycobacterium avium subsp. paratuberculosis
gcgggaccagcgcc

SEQ ID NO: 2956810 - RNA, 15 nt, Mycobacterium avium subsp. paratuberculosis
gcgggaccagcgccu

SEQ ID NO: 2956811 - RNA, 16 nt, Mycobacterium avium subsp. paratuberculosis
gcgggaccagcgccuc

SEQ ID NO: 2956812 - RNA, 20 nt, Mycobacterium avium subsp. paratuberculosis
gcgggaccagcgccucggcc

SEQ ID NO: 2956813 - RNA, 21 nt, Mycobacterium avium subsp. paratuberculosis
gcgggaccagcgccucggccu

SEQ ID NO: 2956814 - RNA, 15 nt, Mycobacterium avium subsp. paratuberculosis
gcgggacccgcgacc

SEQ ID NO: 2956815 - RNA, 17 nt, Mycobacterium avium subsp. paratuberculosis
gcgggaccgggcccggc

SEQ ID NO: 2956816 - RNA, 18 nt, Mycobacterium avium subsp. paratuberculosis
gcgggaccgggcccggcg

SEQ ID NO: 2956817 - RNA, 16 nt, Mycobacterium avium subsp. paratuberculosis
gcgggacgaggggcag

SEQ ID NO: 2956818 - RNA, 15 nt, Mycobacterium avium subsp. paratuberculosis
gcgggacgaucugcg

SEQ ID NO: 2956819 - RNA, 18 nt, Mycobacterium avium subsp. paratuberculosis
gcgggacgaucugcguca

SEQ ID NO: 2956820 - RNA, 14 nt, Mycobacterium avium subsp. paratuberculosis
gcgggacgccguug

SEQ ID NO: 2956821 - RNA, 22 nt, Mycobacterium avium subsp. paratuberculosis
gcgggacgccguugacaccggg

SEQ ID NO: 2956822 - RNA, 21 nt, Mycobacterium avium subsp. paratuberculosis
gcgggacgcgcagaucgucga

SEQ ID NO: 2956823 - RNA, 22 nt, Mycobacterium avium subsp. paratuberculosis
gcgggacggaaucacgcaccgu

SEQ ID NO: 2956824 - RNA, 23 nt, Mycobacterium avium subsp. paratuberculosis
gcgggacggaaucacgcaccguc

SEQ ID NO: 2956825 - RNA, 14 nt, Mycobacterium avium subsp. paratuberculosis
gcgggacggcggcg

SEQ ID NO: 2956826 - RNA, 15 nt, Mycobacterium avium subsp. paratuberculosis
gcgggacggcggcga

SEQ ID NO: 2956827 - RNA, 20 nt, Mycobacterium avium subsp. paratuberculosis
gcgggacguggcucagcggc

SEQ ID NO: 2956828 - RNA, 20 nt, Mycobacterium avium subsp. paratuberculosis
gcgggacguugucuguucac

SEQ ID NO: 2956829 - RNA, 22 nt, Mycobacterium avium subsp. paratuberculosis
gcgggacugcagcgcggugguc

SEQ ID NO: 2956830 - RNA, 18 nt, Mycobacterium avium subsp. paratuberculosis
gcgggagaaaugggccag

SEQ ID NO: 2956831 - RNA, 23 nt, Mycobacterium avium subsp. paratuberculosis
gcgggagaacagguaggacaccg

SEQ ID NO: 2956832 - RNA, 18 nt, Mycobacterium avium subsp. paratuberculosis
gcgggagagcgcgggcac

SEQ ID NO: 2956833 - RNA, 14 nt, Mycobacterium avium subsp. paratuberculosis
gcgggagccggcca

SEQ ID NO: 2956834 - RNA, 16 nt, Mycobacterium avium subsp. paratuberculosis
gcgggagccggccagg

SEQ ID NO: 2956835 - RNA, 17 nt, Mycobacterium avium subsp. paratuberculosis
gcgggagccggccaggu

SEQ ID NO: 2956836 - RNA, 13 nt, Mycobacterium avium subsp. paratuberculosis
gcgggagccggcg

SEQ ID NO: 2956837 - RNA, 13 nt, Mycobacterium avium subsp. paratuberculosis
gcgggagcgcugg

SEQ ID NO: 2956838 - RNA, 18 nt, Mycobacterium avium subsp. paratuberculosis
gcgggagcgcuggucggc

SEQ ID NO: 2956839 - RNA, 19 nt, Mycobacterium avium subsp. paratuberculosis
gcgggagcgcuggucggcg

SEQ ID NO: 2956840 - RNA, 22 nt, Mycobacterium avium subsp. paratuberculosis
gcgggagcgcuggucggcgaac

SEQ ID NO: 2956841 - RNA, 20 nt, Mycobacterium avium subsp. paratuberculosis
gcgggagcuaggcggccggg

SEQ ID NO: 2956842 - RNA, 19 nt, Mycobacterium avium subsp. paratuberculosis
gcgggaggacagcgcggug

SEQ ID NO: 2956843 - RNA, 17 nt, Mycobacterium avium subsp. paratuberculosis
gcgggaggcccaguagc

SEQ ID NO: 2956844 - RNA, 15 nt, Mycobacterium avium subsp. paratuberculosis
gcgggaguggccggc

SEQ ID NO: 2956845 - RNA, 17 nt, Mycobacterium avium subsp. paratuberculosis
gcgggaguggccggcgu

SEQ ID NO: 2956846 - RNA, 20 nt, Mycobacterium avium subsp. paratuberculosis
gcgggaucagcuccucgcgg

SEQ ID NO: 2956847 - RNA, 16 nt, Mycobacterium avium subsp. paratuberculosis
gcgggauccccaccgu

SEQ ID NO: 2956848 - RNA, 20 nt, Mycobacterium avium subsp. paratuberculosis
gcgggaucccgcagccgcga

SEQ ID NO: 2956849 - RNA, 22 nt, Mycobacterium avium subsp. paratuberculosis
gcgggaucccgcagccgcgacg

SEQ ID NO: 2956850 - RNA, 15 nt, Mycobacterium avium subsp. paratuberculosis
gcgggaucgcggcgg

SEQ ID NO: 2956851 - RNA, 16 nt, Mycobacterium avium subsp. paratuberculosis
gcgggaucggaccgca

SEQ ID NO: 2956852 - RNA, 22 nt, Mycobacterium avium subsp. paratuberculosis
gcgggaucggaccgcaccacca

SEQ ID NO: 2956853 - RNA, 15 nt, Mycobacterium avium subsp. paratuberculosis
gcgggaucggugccg

SEQ ID NO: 2956854 - RNA, 12 nt, Mycobacterium avium subsp. paratuberculosis
gcgggccagcuc

SEQ ID NO: 2956855 - RNA, 17 nt, Mycobacterium avium subsp. paratuberculosis
gcgggccagcucgaacc

SEQ ID NO: 2956856 - RNA, 15 nt, Mycobacterium avium subsp. paratuberculosis
gcgggccagcuuguu

SEQ ID NO: 2956857 - RNA, 13 nt, Mycobacterium avium subsp. paratuberculosis
gcgggccaggaug

SEQ ID NO: 2956858 - RNA, 23 nt, Mycobacterium avium subsp. paratuberculosis
gcgggccaggauguucaccccgg

SEQ ID NO: 2956859 - RNA, 19 nt, Mycobacterium avium subsp. paratuberculosis
gcgggccaggcacggcccg

SEQ ID NO: 2956860 - RNA, 20 nt, Mycobacterium avium subsp. paratuberculosis
gcgggccaggcacggcccgu

SEQ ID NO: 2956861 - RNA, 20 nt, Mycobacterium avium subsp. paratuberculosis
gcgggccaggcccaccgucg

SEQ ID NO: 2956862 - RNA, 12 nt, Mycobacterium avium subsp. paratuberculosis
gcgggccaggcg

SEQ ID NO: 2956863 - RNA, 17 nt, Mycobacterium avium subsp. paratuberculosis
gcgggccaggcggauca

SEQ ID NO: 2956864 - RNA, 15 nt, Mycobacterium avium subsp. paratuberculosis
gcgggccaggcggga

SEQ ID NO: 2956865 - RNA, 21 nt, Mycobacterium avium subsp. paratuberculosis
gcgggccaggcgggacguugu

SEQ ID NO: 2956866 - RNA, 13 nt, Mycobacterium avium subsp. paratuberculosis
gcgggccagggcg

SEQ ID NO: 2956867 - RNA, 17 nt, Mycobacterium avium subsp. paratuberculosis
gcgggccagggcgagga

SEQ ID NO: 2956868 - RNA, 20 nt, Mycobacterium avium subsp. paratuberculosis
gcgggccagggcgaggacgg

SEQ ID NO: 2956869 - RNA, 14 nt, Mycobacterium avium subsp. paratuberculosis
gcgggccaggucga

SEQ ID NO: 2956870 - RNA, 16 nt, Mycobacterium avium subsp. paratuberculosis
gcgggccaggucgagc

SEQ ID NO: 2956871 - RNA, 17 nt, Mycobacterium avium subsp. paratuberculosis
gcgggccaggucgagcg

SEQ ID NO: 2956872 - RNA, 18 nt, Mycobacterium avium subsp. paratuberculosis
gcgggccagucgccgcgc

SEQ ID NO: 2956873 - RNA, 21 nt, Mycobacterium avium subsp. paratuberculosis
gcgggccagucgccgcgcaga

SEQ ID NO: 2956874 - RNA, 22 nt, Mycobacterium avium subsp. paratuberculosis
gcgggccaucgacuccagcacc

SEQ ID NO: 2956875 - RNA, 14 nt, Mycobacterium avium subsp. paratuberculosis
gcgggcccaccgcc

SEQ ID NO: 2956876 - RNA, 18 nt, Mycobacterium avium subsp. paratuberculosis
gcgggcccaccgccacca

SEQ ID NO: 2956877 - RNA, 19 nt, Mycobacterium avium subsp. paratuberculosis
gcgggcccaccgccaccag

SEQ ID NO: 2956878 - RNA, 21 nt, Mycobacterium avium subsp. paratuberculosis
gcgggcccaccgccaccaggc

SEQ ID NO: 2956879 - RNA, 15 nt, Mycobacterium avium subsp. paratuberculosis
gcgggcccaccgcgc

SEQ ID NO: 2956880 - RNA, 16 nt, Mycobacterium avium subsp. paratuberculosis
gcgggcccaccgcgcg

SEQ ID NO: 2956881 - RNA, 19 nt, Mycobacterium avium subsp. paratuberculosis
gcgggcccaccgcgcgcug

SEQ ID NO: 2956882 - RNA, 23 nt, Mycobacterium avium subsp. paratuberculosis
gcgggcccagcagauagcccagc

SEQ ID NO: 2956883 - RNA, 12 nt, Mycobacterium avium subsp. paratuberculosis
gcgggcccagcu

SEQ ID NO: 2956884 - RNA, 13 nt, Mycobacterium avium subsp. paratuberculosis
gcgggcccagcuc

SEQ ID NO: 2956885 - RNA, 19 nt, Mycobacterium avium subsp. paratuberculosis
gcgggcccagcucggugcg

SEQ ID NO: 2956886 - RNA, 15 nt, Mycobacterium avium subsp. paratuberculosis
gcgggcccgcaacug

SEQ ID NO: 2956887 - RNA, 16 nt, Mycobacterium avium subsp. paratuberculosis
gcgggcccgcagcucg

SEQ ID NO: 2956888 - RNA, 17 nt, Mycobacterium avium subsp. paratuberculosis
gcgggcccgcagcucgg

SEQ ID NO: 2956889 - RNA, 12 nt, Mycobacterium avium subsp. paratuberculosis
gcgggcccgcgc

SEQ ID NO: 2956890 - RNA, 13 nt, Mycobacterium avium subsp. paratuberculosis
gcgggcccgcgcc

SEQ ID NO: 2956891 - RNA, 14 nt, Mycobacterium avium subsp. paratuberculosis
gcgggcccgcgccg

SEQ ID NO: 2956892 - RNA, 21 nt, Mycobacterium avium subsp. paratuberculosis
gcgggcccgcgccgcgucguc

SEQ ID NO: 2956893 - RNA, 15 nt, Mycobacterium avium subsp. paratuberculosis
gcgggcccgcgcggc

SEQ ID NO: 2956894 - RNA, 15 nt, Mycobacterium avium subsp. paratuberculosis
gcgggcccggcgaug

SEQ ID NO: 2956895 - RNA, 16 nt, Mycobacterium avium subsp. paratuberculosis
gcgggcccggcgaugc

SEQ ID NO: 2956896 - RNA, 11 nt, Mycobacterium avium subsp. paratuberculosis
gcgggcccggg

SEQ ID NO: 2956897 - RNA, 17 nt, Mycobacterium avium subsp. paratuberculosis
gcgggcccgggccaccc

SEQ ID NO: 2956898 - RNA, 13 nt, Mycobacterium avium subsp. paratuberculosis
gcgggcccgggcg

SEQ ID NO: 2956899 - RNA, 14 nt, Mycobacterium avium subsp. paratuberculosis
gcgggcccgggcgc

SEQ ID NO: 2956900 - RNA, 17 nt, Mycobacterium avium subsp. paratuberculosis
gcgggcccgggcgcuga

SEQ ID NO: 2956901 - RNA, 17 nt, Mycobacterium avium subsp. paratuberculosis
gcgggcccgucgccggc

SEQ ID NO: 2956902 - RNA, 20 nt, Mycobacterium avium subsp. paratuberculosis
gcgggcccgucgccggcgcg

SEQ ID NO: 2956903 - RNA, 14 nt, Mycobacterium avium subsp. paratuberculosis
gcgggccgaaccgg

SEQ ID NO: 2956904 - RNA, 13 nt, Mycobacterium avium subsp. paratuberculosis
gcgggccgaacug

SEQ ID NO: 2956905 - RNA, 18 nt, Mycobacterium avium subsp. paratuberculosis
gcgggccgaacugccgau

SEQ ID NO: 2956906 - RNA, 20 nt, Mycobacterium avium subsp. paratuberculosis
gcgggccgaagaccgggccg

SEQ ID NO: 2956907 - RNA, 16 nt, Mycobacterium avium subsp. paratuberculosis
gcgggccgacagcacg

SEQ ID NO: 2956908 - RNA, 19 nt, Mycobacterium avium subsp. paratuberculosis
gcgggccgacagcacgccg

SEQ ID NO: 2956909 - RNA, 20 nt, Mycobacterium avium subsp. paratuberculosis
gcgggccgacagcacgccgg

SEQ ID NO: 2956910 - RNA, 22 nt, Mycobacterium avium subsp. paratuberculosis
gcgggccgacagcacgccgggc

SEQ ID NO: 2956911 - RNA, 14 nt, Mycobacterium avium subsp. paratuberculosis
gcgggccgacccgg

SEQ ID NO: 2956912 - RNA, 17 nt, Mycobacterium avium subsp. paratuberculosis
gcgggccgacccggccg

SEQ ID NO: 2956913 - RNA, 18 nt, Mycobacterium avium subsp. paratuberculosis
gcgggccgacccggccga

SEQ ID NO: 2956914 - RNA, 23 nt, Mycobacterium avium subsp. paratuberculosis
gcgggccgacccggccgauggug

SEQ ID NO: 2956915 - RNA, 17 nt, Mycobacterium avium subsp. paratuberculosis
gcgggccgaccgucagc

SEQ ID NO: 2956916 - RNA, 15 nt, Mycobacterium avium subsp. paratuberculosis
gcgggccgaccuggc

SEQ ID NO: 2956917 - RNA, 16 nt, Mycobacterium avium subsp. paratuberculosis
gcgggccgaccuggcg

SEQ ID NO: 2956918 - RNA, 22 nt, Mycobacterium avium subsp. paratuberculosis
gcgggccgaccuggcggccgga

SEQ ID NO: 2956919 - RNA, 23 nt, Mycobacterium avium subsp. paratuberculosis
gcgggccgagcguucggcgcgga

SEQ ID NO: 2956920 - RNA, 21 nt, Mycobacterium avium subsp. paratuberculosis
gcgggccgaucagugccgcgc

SEQ ID NO: 2956921 - RNA, 16 nt, Mycobacterium avium subsp. paratuberculosis
gcgggccgcagcgcgc

SEQ ID NO: 2956922 - RNA, 18 nt, Mycobacterium avium subsp. paratuberculosis
gcgggccgcagcgcgcgg

SEQ ID NO: 2956923 - RNA, 12 nt, Mycobacterium avium subsp. paratuberculosis
gcgggccgccag

SEQ ID NO: 2956924 - RNA, 13 nt, Mycobacterium avium subsp. paratuberculosis
gcgggccgccagg

SEQ ID NO: 2956925 - RNA, 18 nt, Mycobacterium avium subsp. paratuberculosis
gcgggccgcccggcgcgc

SEQ ID NO: 2956926 - RNA, 19 nt, Mycobacterium avium subsp. paratuberculosis
gcgggccgcccggcgcgcc

SEQ ID NO: 2956927 - RNA, 21 nt, Mycobacterium avium subsp. paratuberculosis
gcgggccgcccggcgcgccgc

SEQ ID NO: 2956928 - RNA, 17 nt, Mycobacterium avium subsp. paratuberculosis
gcgggccgccgacgucg

SEQ ID NO: 2956929 - RNA, 20 nt, Mycobacterium avium subsp. paratuberculosis
gcgggccgccgacgucgugg

SEQ ID NO: 2956930 - RNA, 14 nt, Mycobacterium avium subsp. paratuberculosis
gcgggccgccgggu

SEQ ID NO: 2956931 - RNA, 17 nt, Mycobacterium avium subsp. paratuberculosis
gcgggccgccggguggc

SEQ ID NO: 2956932 - RNA, 14 nt, Mycobacterium avium subsp. paratuberculosis
gcgggccgcgucgg

SEQ ID NO: 2956933 - RNA, 16 nt, Mycobacterium avium subsp. paratuberculosis
gcgggccgcgucggcc

SEQ ID NO: 2956934 - RNA, 19 nt, Mycobacterium avium subsp. paratuberculosis
gcgggccgcgucggccaac

SEQ ID NO: 2956935 - RNA, 23 nt, Mycobacterium avium subsp. paratuberculosis
gcgggccgcuucgaggugcacgc

SEQ ID NO: 2956936 - RNA, 16 nt, Mycobacterium avium subsp. paratuberculosis
gcgggccgugccgcca

SEQ ID NO: 2956937 - RNA, 23 nt, Mycobacterium avium subsp. paratuberculosis
gcgggccgugccgccauacccac

SEQ ID NO: 2956938 - RNA, 12 nt, Mycobacterium avium subsp. paratuberculosis
gcgggccguugc

SEQ ID NO: 2956939 - RNA, 19 nt, Mycobacterium avium subsp. paratuberculosis
gcgggcguccucgucggcg

SEQ ID NO: 2956940 - RNA, 20 nt, Mycobacterium avium subsp. paratuberculosis
gcgggcguccuugaccagcu

SEQ ID NO: 2956941 - RNA, 21 nt, Mycobacterium avium subsp. paratuberculosis
gcgggcguccuugaccagcug

SEQ ID NO: 2956942 - RNA, 13 nt, Mycobacterium avium subsp. paratuberculosis
gcgggcgucgggc

SEQ ID NO: 2956943 - RNA, 21 nt, Mycobacterium avium subsp. paratuberculosis
gcgggcgugcgguuggcccgc

SEQ ID NO: 2956944 - RNA, 14 nt, Mycobacterium avium subsp. paratuberculosis
gcgggcguggcggu

SEQ ID NO: 2956945 - RNA, 19 nt, Mycobacterium avium subsp. paratuberculosis
gcgggcguggcggucggug

SEQ ID NO: 2956946 - RNA, 20 nt, Mycobacterium avium subsp. paratuberculosis
gcgggcguggcggucggugc

SEQ ID NO: 2956947 - RNA, 23 nt, Mycobacterium avium subsp. paratuberculosis
gcgggcguggcggucggugcgca

SEQ ID NO: 2956948 - RNA, 16 nt, Mycobacterium avium subsp. paratuberculosis
gcgggcguucaucacc

SEQ ID NO: 2956949 - RNA, 22 nt, Mycobacterium avium subsp. paratuberculosis
gcgggcuaaugcaucgaugccg

SEQ ID NO: 2956950 - RNA, 23 nt, Mycobacterium avium subsp. paratuberculosis
gcgggcucacuuuugacaggugg

SEQ ID NO: 2956951 - RNA, 17 nt, Mycobacterium avium subsp. paratuberculosis
gcgggcucccgcucgcc

SEQ ID NO: 2956952 - RNA, 13 nt, Mycobacterium avium subsp. paratuberculosis
gcgggcucgaaca

SEQ ID NO: 2956953 - RNA, 18 nt, Mycobacterium avium subsp. paratuberculosis
gcgggcucgaacaacccg

SEQ ID NO: 2956954 - RNA, 22 nt, Mycobacterium avium subsp. paratuberculosis
gcgggcucgaacaacccggccg

SEQ ID NO: 2956955 - RNA, 14 nt, Mycobacterium avium subsp. paratuberculosis
gcgggcucgccggc

SEQ ID NO: 2956956 - RNA, 15 nt, Mycobacterium avium subsp. paratuberculosis
gcgggcucgccggcc

SEQ ID NO: 2956957 - RNA, 21 nt, Mycobacterium avium subsp. paratuberculosis
gcgggcucgcgcuggcggcca

SEQ ID NO: 2956958 - RNA, 24 nt, Mycobacterium avium subsp. paratuberculosis
gcgggcucgcgcuggcggccaucg

SEQ ID NO: 2956959 - RNA, 16 nt, Mycobacterium avium subsp. paratuberculosis
gcgggcucggacgacu

SEQ ID NO: 2956960 - RNA, 16 nt, Mycobacterium avium subsp. paratuberculosis
gcgggcucggaguugc

SEQ ID NO: 2956961 - RNA, 22 nt, Mycobacterium avium subsp. paratuberculosis
gcgggcucggaguugcgcagcc

SEQ ID NO: 2956962 - RNA, 13 nt, Mycobacterium avium subsp. paratuberculosis
gcgggcugacguc

SEQ ID NO: 2956963 - RNA, 16 nt, Mycobacterium avium subsp. paratuberculosis
gcgggcugacgucgaa

SEQ ID NO: 2956964 - RNA, 14 nt, Mycobacterium avium subsp. paratuberculosis
gcgggcugcaccag

SEQ ID NO: 2956965 - RNA, 12 nt, Mycobacterium avium subsp. paratuberculosis
gcgggcugcagc

SEQ ID NO: 2956966 - RNA, 19 nt, Mycobacterium avium subsp. paratuberculosis
gcgggcugcagggccgggu

SEQ ID NO: 2956967 - RNA, 20 nt, Mycobacterium avium subsp. paratuberculosis
gcgggcugcagggccggguc

SEQ ID NO: 2956968 - RNA, 21 nt, Mycobacterium avium subsp. paratuberculosis
gcgggcugcagggccgggucg

SEQ ID NO: 2956969 - RNA, 12 nt, Mycobacterium avium subsp. paratuberculosis
gcgggcugcggg

SEQ ID NO: 2956970 - RNA, 16 nt, Mycobacterium avium subsp. paratuberculosis
gcgggcugcgggcauc

SEQ ID NO: 2956971 - RNA, 15 nt, Mycobacterium avium subsp. paratuberculosis
gcgggcuggugcgca

SEQ ID NO: 2956972 - RNA, 20 nt, Mycobacterium avium subsp. paratuberculosis
gcgggcuggugcgcagccgu

SEQ ID NO: 2956973 - RNA, 17 nt, Mycobacterium avium subsp. paratuberculosis
gcgggcuguccgcgugg

SEQ ID NO: 2956974 - RNA, 17 nt, Mycobacterium avium subsp. paratuberculosis
gcgggcugucggcgccc

SEQ ID NO: 2956975 - RNA, 18 nt, Mycobacterium avium subsp. paratuberculosis
gcgggcugucggcgccca

SEQ ID NO: 2956976 - RNA, 16 nt, Mycobacterium avium subsp. paratuberculosis
gcgggcugugccggcg

SEQ ID NO: 2956977 - RNA, 20 nt, Mycobacterium avium subsp. paratuberculosis
gcgggcugugccggcggguc

SEQ ID NO: 2956978 - RNA, 17 nt, Mycobacterium avium subsp. paratuberculosis
gcggggaaggugcgggc

SEQ ID NO: 2956979 - RNA, 18 nt, Mycobacterium avium subsp. paratuberculosis
gcggggaaggugcgggcg

SEQ ID NO: 2956980 - RNA, 15 nt, Mycobacterium avium subsp. paratuberculosis
gcggggacagugcgg

SEQ ID NO: 2956981 - RNA, 14 nt, Mycobacterium avium subsp. paratuberculosis
gcggggaggcccag

SEQ ID NO: 2956982 - RNA, 19 nt, Mycobacterium avium subsp. paratuberculosis
gcggggaggcccagcccgc

SEQ ID NO: 2956983 - RNA, 16 nt, Mycobacterium avium subsp. paratuberculosis
gcggggaggucgucgc

SEQ ID NO: 2956984 - RNA, 22 nt, Mycobacterium avium subsp. paratuberculosis
gcggggaggucgucgcguccag

SEQ ID NO: 2956985 - RNA, 21 nt, Mycobacterium avium subsp. paratuberculosis
gcggggcaagcagcggcagcc

SEQ ID NO: 2956986 - RNA, 21 nt, Mycobacterium avium subsp. paratuberculosis
gcggggcagcagugucgggcc

SEQ ID NO: 2956987 - RNA, 21 nt, Mycobacterium avium subsp. paratuberculosis
gcggggcauggugucaggauc

SEQ ID NO: 2956988 - RNA, 15 nt, Mycobacterium avium subsp. paratuberculosis
gcggggcccgggccg

SEQ ID NO: 2956989 - RNA, 16 nt, Mycobacterium avium subsp. paratuberculosis
gcggggcccgggccgg

SEQ ID NO: 2956990 - RNA, 18 nt, Mycobacterium avium subsp. paratuberculosis
gcggggccgcggccggca

SEQ ID NO: 2956991 - RNA, 14 nt, Mycobacterium avium subsp. paratuberculosis
gcggggccggcgcg

SEQ ID NO: 2956992 - RNA, 18 nt, Mycobacterium avium subsp. paratuberculosis
gcggggccggcgcuggcg

SEQ ID NO: 2956993 - RNA, 13 nt, Mycobacterium avium subsp. paratuberculosis
gcggggccggcgg

SEQ ID NO: 2956994 - RNA, 15 nt, Mycobacterium avium subsp. paratuberculosis
gcggggccggcggcg

SEQ ID NO: 2956995 - RNA, 20 nt, Mycobacterium avium subsp. paratuberculosis
gcggggccggcggcggccag

SEQ ID NO: 2956996 - RNA, 17 nt, Mycobacterium avium subsp. paratuberculosis
gcggggccggugauggu

SEQ ID NO: 2956997 - RNA, 15 nt, Mycobacterium avium subsp. paratuberculosis
gcggggccuccacca

SEQ ID NO: 2956998 - RNA, 18 nt, Mycobacterium avium subsp. paratuberculosis
gcggggccuccaccagcg

SEQ ID NO: 2956999 - RNA, 12 nt, Mycobacterium avium subsp. paratuberculosis
gcggggccucga

SEQ ID NO: 2957000 - RNA, 15 nt, Mycobacterium avium subsp. paratuberculosis
gcggggccucgucgc

SEQ ID NO: 2957001 - RNA, 22 nt, Mycobacterium avium subsp. paratuberculosis
gcggggcgaacccggcgcccgg

SEQ ID NO: 2957002 - RNA, 23 nt, Mycobacterium avium subsp. paratuberculosis
gcggggcgaacccggcgcccggc

SEQ ID NO: 2957003 - RNA, 17 nt, Mycobacterium avium subsp. paratuberculosis
gcggggcgagcuggccg

SEQ ID NO: 2957004 - RNA, 19 nt, Mycobacterium avium subsp. paratuberculosis
gcggggcgagcuggccgcc

SEQ ID NO: 2957005 - RNA, 13 nt, Mycobacterium avium subsp. paratuberculosis
gcggggcgccgac

SEQ ID NO: 2957006 - RNA, 16 nt, Mycobacterium avium subsp. paratuberculosis
gcggggcgccgacagu

SEQ ID NO: 2957007 - RNA, 13 nt, Mycobacterium avium subsp. paratuberculosis
gcggggcgcgagg

SEQ ID NO: 2957008 - RNA, 18 nt, Mycobacterium avium subsp. paratuberculosis
gcggggcgcgaggcgcga

SEQ ID NO: 2957009 - RNA, 18 nt, Mycobacterium avium subsp. paratuberculosis
gcggggcggaugcgcugg

SEQ ID NO: 2957010 - RNA, 20 nt, Mycobacterium avium subsp. paratuberculosis
gcggggcggaugcgcuggug

SEQ ID NO: 2957011 - RNA, 12 nt, Mycobacterium avium subsp. paratuberculosis
gcggggcggccg

SEQ ID NO: 2957012 - RNA, 13 nt, Mycobacterium avium subsp. paratuberculosis
gcggggcggccgc

SEQ ID NO: 2957013 - RNA, 14 nt, Mycobacterium avium subsp. paratuberculosis
gcggggcggccgcc

SEQ ID NO: 2957014 - RNA, 18 nt, Mycobacterium avium subsp. paratuberculosis
gcggggcggccgccgggc

SEQ ID NO: 2957015 - RNA, 22 nt, Mycobacterium avium subsp. paratuberculosis
gcggggcggcggcgccggggcu

SEQ ID NO: 2957016 - RNA, 18 nt, Mycobacterium avium subsp. paratuberculosis
gcggggcguccagcgagg

SEQ ID NO: 2957017 - RNA, 14 nt, Mycobacterium avium subsp. paratuberculosis
gcggggcgucgaug

SEQ ID NO: 2957018 - RNA, 16 nt, Mycobacterium avium subsp. paratuberculosis
gcggggcgucgaugcg

SEQ ID NO: 2957019 - RNA, 16 nt, Mycobacterium avium subsp. paratuberculosis
gcggggcgucgcccgc

SEQ ID NO: 2957020 - RNA, 11 nt, Mycobacterium avium subsp. paratuberculosis
gcggggcgucu

SEQ ID NO: 2957021 - RNA, 14 nt, Mycobacterium avium subsp. paratuberculosis
gcggggcugauguu

SEQ ID NO: 2957022 - RNA, 22 nt, Mycobacterium avium subsp. paratuberculosis
gcgggggauccgccugcgcggg

SEQ ID NO: 2957023 - RNA, 17 nt, Mycobacterium avium subsp. paratuberculosis
gcgggggaucgggaagu

SEQ ID NO: 2957024 - RNA, 14 nt, Mycobacterium avium subsp. paratuberculosis
gcgggucggcguca

SEQ ID NO: 2957025 - RNA, 12 nt, Mycobacterium avium subsp. paratuberculosis
gcgggucggugg

SEQ ID NO: 2957026 - RNA, 17 nt, Mycobacterium avium subsp. paratuberculosis
gcgggucguagccgucg

SEQ ID NO: 2957027 - RNA, 14 nt, Mycobacterium avium subsp. paratuberculosis
gcgggucgucgacg

SEQ ID NO: 2957028 - RNA, 14 nt, Mycobacterium avium subsp. paratuberculosis
gcgggucgucggcc

SEQ ID NO: 2957029 - RNA, 15 nt, Mycobacterium avium subsp. paratuberculosis
gcgggucgucggccu

SEQ ID NO: 2957030 - RNA, 13 nt, Mycobacterium avium subsp. paratuberculosis
gcgggucgucggg

SEQ ID NO: 2957031 - RNA, 15 nt, Mycobacterium avium subsp. paratuberculosis
gcgggucgucgggcc

SEQ ID NO: 2957032 - RNA, 23 nt, Mycobacterium avium subsp. paratuberculosis
gcgggucgucgggcggcaggaac

SEQ ID NO: 2957033 - RNA, 23 nt, Mycobacterium avium subsp. paratuberculosis
gcgggucgucguucucgggggcg

SEQ ID NO: 2957034 - RNA, 18 nt, Mycobacterium avium subsp. paratuberculosis
gcgggucgugcaucggcg

SEQ ID NO: 2957035 - RNA, 21 nt, Mycobacterium avium subsp. paratuberculosis
gcgggucgugcaucggcgccu

SEQ ID NO: 2957036 - RNA, 22 nt, Mycobacterium avium subsp. paratuberculosis
gcgggucgugcaucggcgccug

SEQ ID NO: 2957037 - RNA, 15 nt, Mycobacterium avium subsp. paratuberculosis
gcgggucguuggcgg

SEQ ID NO: 2957038 - RNA, 18 nt, Mycobacterium avium subsp. paratuberculosis
gcgggucguuugguggug

SEQ ID NO: 2957039 - RNA, 12 nt, Mycobacterium avium subsp. paratuberculosis
gcgggucucgcc

SEQ ID NO: 2957040 - RNA, 14 nt, Mycobacterium avium subsp. paratuberculosis
gcgggucucgccca

SEQ ID NO: 2957041 - RNA, 15 nt, Mycobacterium avium subsp. paratuberculosis
gcgggucucgcccac

SEQ ID NO: 2957042 - RNA, 18 nt, Mycobacterium avium subsp. paratuberculosis
gcgggucucgcccaccuu

SEQ ID NO: 2957043 - RNA, 23 nt, Mycobacterium avium subsp. paratuberculosis
gcgggugaaucgacaccgcacgg

SEQ ID NO: 2957044 - RNA, 15 nt, Mycobacterium avium subsp. paratuberculosis
gcgggugaccgacag

SEQ ID NO: 2957045 - RNA, 14 nt, Mycobacterium avium subsp. paratuberculosis
gcgggugaccggcg

SEQ ID NO: 2957046 - RNA, 17 nt, Mycobacterium avium subsp. paratuberculosis
gcgggugaccggcgccg

SEQ ID NO: 2957047 - RNA, 22 nt, Mycobacterium avium subsp. paratuberculosis
gcgggugaccggcgccgggucg

SEQ ID NO: 2957048 - RNA, 15 nt, Mycobacterium avium subsp. paratuberculosis
gcgggugacgaucac

SEQ ID NO: 2957049 - RNA, 17 nt, Mycobacterium avium subsp. paratuberculosis
gcgggugacgaucaccg

SEQ ID NO: 2957050 - RNA, 18 nt, Mycobacterium avium subsp. paratuberculosis
gcgggugacgaucaccgc

SEQ ID NO: 2957051 - RNA, 21 nt, Mycobacterium avium subsp. paratuberculosis
gcgggugacgaucaccgcugc

SEQ ID NO: 2957052 - RNA, 13 nt, Mycobacterium avium subsp. paratuberculosis
gcgggugacgcug

SEQ ID NO: 2957053 - RNA, 13 nt, Mycobacterium avium subsp. paratuberculosis
gcgggugaggacg

SEQ ID NO: 2957054 - RNA, 18 nt, Mycobacterium avium subsp. paratuberculosis
gcgggugaggacgcccgg

SEQ ID NO: 2957055 - RNA, 20 nt, Mycobacterium avium subsp. paratuberculosis
gcgggugaggacgcccggcg

SEQ ID NO: 2957056 - RNA, 21 nt, Mycobacterium avium subsp. paratuberculosis
gcgggugaggacgcccggcga

SEQ ID NO: 2957057 - RNA, 20 nt, Mycobacterium avium subsp. paratuberculosis
gcgggugaggggcgcgcgcc

SEQ ID NO: 2957058 - RNA, 22 nt, Mycobacterium avium subsp. paratuberculosis
gcgggugaucccgaugccgcgc

SEQ ID NO: 2957059 - RNA, 23 nt, Mycobacterium avium subsp. paratuberculosis
gcgggugaucuuggccuccaccg

SEQ ID NO: 2957060 - RNA, 24 nt, Mycobacterium avium subsp. paratuberculosis
gcgggugaucuuggccuccaccgg

SEQ ID NO: 2957061 - RNA, 11 nt, Mycobacterium avium subsp. paratuberculosis
gcgggugaugc

SEQ ID NO: 2957062 - RNA, 23 nt, Mycobacterium avium subsp. paratuberculosis
gcgggugaugccguacaugguga

SEQ ID NO: 2957063 - RNA, 22 nt, Mycobacterium avium subsp. paratuberculosis
gcgggugauggccgccgcaggc

SEQ ID NO: 2957064 - RNA, 14 nt, Mycobacterium avium subsp. paratuberculosis
gcgggugcaacgug

SEQ ID NO: 2957065 - RNA, 17 nt, Mycobacterium avium subsp. paratuberculosis
gcgggugcagccggauc

SEQ ID NO: 2957066 - RNA, 20 nt, Mycobacterium avium subsp. paratuberculosis
gcgggugccgaacacguaca

SEQ ID NO: 2957067 - RNA, 21 nt, Mycobacterium avium subsp. paratuberculosis
gcgggugccuucuuggcggcg

SEQ ID NO: 2957068 - RNA, 14 nt, Mycobacterium avium subsp. paratuberculosis
gcgggugcggccag

SEQ ID NO: 2957069 - RNA, 16 nt, Mycobacterium avium subsp. paratuberculosis
gcgggugcggccagcg

SEQ ID NO: 2957070 - RNA, 13 nt, Mycobacterium avium subsp. paratuberculosis
gcgggugcggccg

SEQ ID NO: 2957071 - RNA, 17 nt, Mycobacterium avium subsp. paratuberculosis
gcgggugcggccgguug

SEQ ID NO: 2957072 - RNA, 15 nt, Mycobacterium avium subsp. paratuberculosis
gcgggugcuggucag

SEQ ID NO: 2957073 - RNA, 22 nt, Mycobacterium avium subsp. paratuberculosis
gcgggugcuggucagcaucggc

SEQ ID NO: 2957074 - RNA, 21 nt, Mycobacterium avium subsp. paratuberculosis
gcggguggagaaguggcuggu

SEQ ID NO: 2957075 - RNA, 17 nt, Mycobacterium avium subsp. paratuberculosis
gcggguggaucuugacg

SEQ ID NO: 2957076 - RNA, 19 nt, Mycobacterium avium subsp. paratuberculosis
gcggguggaucuugacggc

SEQ ID NO: 2957077 - RNA, 20 nt, Mycobacterium avium subsp. paratuberculosis
gcggguggaucuugacggcg

SEQ ID NO: 2957078 - RNA, 13 nt, Mycobacterium avium subsp. paratuberculosis
gcggguggccagc

SEQ ID NO: 2957079 - RNA, 13 nt, Mycobacterium avium subsp. paratuberculosis
gcggguggccggg

SEQ ID NO: 2957080 - RNA, 16 nt, Mycobacterium avium subsp. paratuberculosis
gcggguggccgggucg

SEQ ID NO: 2957081 - RNA, 19 nt, Mycobacterium avium subsp. paratuberculosis
gcggguggccgggucgccg

SEQ ID NO: 2957082 - RNA, 14 nt, Mycobacterium avium subsp. paratuberculosis
gcggguggccuuca

SEQ ID NO: 2957083 - RNA, 16 nt, Mycobacterium avium subsp. paratuberculosis
gcggguggcgccacag

SEQ ID NO: 2957084 - RNA, 14 nt, Mycobacterium avium subsp. paratuberculosis
gcggguggcggccg

SEQ ID NO: 2957085 - RNA, 16 nt, Mycobacterium avium subsp. paratuberculosis
gcggguggcggccggg

SEQ ID NO: 2957086 - RNA, 19 nt, Mycobacterium avium subsp. paratuberculosis
gcggguggcggccggggug

SEQ ID NO: 2957087 - RNA, 16 nt, Mycobacterium avium subsp. paratuberculosis
gcgggugguccaccca

SEQ ID NO: 2957088 - RNA, 20 nt, Mycobacterium avium subsp. paratuberculosis
gcgggugguguggcgucggc

SEQ ID NO: 2957089 - RNA, 15 nt, Mycobacterium avium subsp. paratuberculosis
gcgggugguuggccg

SEQ ID NO: 2957090 - RNA, 17 nt, Mycobacterium avium subsp. paratuberculosis
gcggguguauucgccca

SEQ ID NO: 2957091 - RNA, 21 nt, Mycobacterium avium subsp. paratuberculosis
gcggguguauucgcccacccc

SEQ ID NO: 2957092 - RNA, 14 nt, Mycobacterium avium subsp. paratuberculosis
gcgggugucgagcc

SEQ ID NO: 2957093 - RNA, 14 nt, Mycobacterium avium subsp. paratuberculosis
gcgggugucgcccu

SEQ ID NO: 2957094 - RNA, 16 nt, Mycobacterium avium subsp. paratuberculosis
gcggguucacccuggc

SEQ ID NO: 2957095 - RNA, 20 nt, Mycobacterium avium subsp. paratuberculosis
gcggguucacccuggcgaac

SEQ ID NO: 2957096 - RNA, 21 nt, Mycobacterium avium subsp. paratuberculosis
gcggguuggccgucgaacugc

SEQ ID NO: 2957097 - RNA, 19 nt, Mycobacterium avium subsp. paratuberculosis
gcggguuggucccgaucac

SEQ ID NO: 2957098 - RNA, 23 nt, Mycobacterium avium subsp. paratuberculosis
gcggguuggucccgaucaccuug

SEQ ID NO: 2957099 - RNA, 15 nt, Mycobacterium avium subsp. paratuberculosis
gcggguuggugucga

SEQ ID NO: 2957100 - RNA, 20 nt, Mycobacterium avium subsp. paratuberculosis
gcggguugucgucgucggcg

SEQ ID NO: 2957101 - RNA, 23 nt, Mycobacterium avium subsp. paratuberculosis
gcggguugucgucgucggcgaac

SEQ ID NO: 2957102 - RNA, 20 nt, Mycobacterium avium subsp. paratuberculosis
gcggguuguucuccagcggc

SEQ ID NO: 2957103 - RNA, 21 nt, Mycobacterium avium subsp. paratuberculosis
gcggguuguucuccagcggcc

SEQ ID NO: 2957104 - RNA, 23 nt, Mycobacterium avium subsp. paratuberculosis
gcggguuguucuccagcggccgc

SEQ ID NO: 2957105 - RNA, 23 nt, Mycobacterium avium subsp. paratuberculosis
gcggguuucgaggaucugggcgg

SEQ ID NO: 2957106 - RNA, 13 nt, Mycobacterium avium subsp. paratuberculosis
gcggguuuggccg

SEQ ID NO: 2957107 - RNA, 19 nt, Mycobacterium avium subsp. paratuberculosis
gcggguuuggccgcgggcg

SEQ ID NO: 2957108 - RNA, 18 nt, Mycobacterium avium subsp. paratuberculosis
gcggucgacacgaucggc

SEQ ID NO: 2957109 - RNA, 21 nt, Mycobacterium avium subsp. paratuberculosis
gcggucgacacgaucggcaug

SEQ ID NO: 2957110 - RNA, 22 nt, Mycobacterium avium subsp. paratuberculosis
gcggucgacacgaucggcauga

SEQ ID NO: 2957111 - RNA, 16 nt, Mycobacterium avium subsp. paratuberculosis
gcggucgaccaagacg

SEQ ID NO: 2957112 - RNA, 22 nt, Mycobacterium avium subsp. paratuberculosis
gcggucgacggaagccgagcgg

SEQ ID NO: 2957113 - RNA, 23 nt, Mycobacterium avium subsp. paratuberculosis
gcggucgacggaagccgagcggu

SEQ ID NO: 2957114 - RNA, 22 nt, Mycobacterium avium subsp. paratuberculosis
gcggucgacgggaagaucgcag

SEQ ID NO: 2957115 - RNA, 12 nt, Mycobacterium avium subsp. paratuberculosis
gcggucgacugg

SEQ ID NO: 2957116 - RNA, 18 nt, Mycobacterium avium subsp. paratuberculosis
gcggucgacuggucgucg

SEQ ID NO: 2957117 - RNA, 19 nt, Mycobacterium avium subsp. paratuberculosis
gcggucgacuggucgucga

SEQ ID NO: 2957118 - RNA, 12 nt, Mycobacterium avium subsp. paratuberculosis
gcggucgagcgu

SEQ ID NO: 2957119 - RNA, 14 nt, Mycobacterium avium subsp. paratuberculosis
gcggucgaugacgc

SEQ ID NO: 2957120 - RNA, 20 nt, Mycobacterium avium subsp. paratuberculosis
gcggucgaugacgccgcgcc

SEQ ID NO: 2957121 - RNA, 21 nt, Mycobacterium avium subsp. paratuberculosis
gcggucgaugacgccgcgccg

SEQ ID NO: 2957122 - RNA, 17 nt, Mycobacterium avium subsp. paratuberculosis
gcggucgaugagcuggu

SEQ ID NO: 2957123 - RNA, 18 nt, Mycobacterium avium subsp. paratuberculosis
gcggucgaugagcuggug

SEQ ID NO: 2957124 - RNA, 20 nt, Mycobacterium avium subsp. paratuberculosis
gcggucgcaggccgcccggc

SEQ ID NO: 2957125 - RNA, 23 nt, Mycobacterium avium subsp. paratuberculosis
gcggucgcaggccgcccggccca

SEQ ID NO: 2957126 - RNA, 17 nt, Mycobacterium avium subsp. paratuberculosis
gcggucgcaggcgagcc

SEQ ID NO: 2957127 - RNA, 18 nt, Mycobacterium avium subsp. paratuberculosis
gcggucgccaccaccagc

SEQ ID NO: 2957128 - RNA, 19 nt, Mycobacterium avium subsp. paratuberculosis
gcggucgccaccaccagcg

SEQ ID NO: 2957129 - RNA, 15 nt, Mycobacterium avium subsp. paratuberculosis
gcggucgccacucgg

SEQ ID NO: 2957130 - RNA, 18 nt, Mycobacterium avium subsp. paratuberculosis
gcggucgccacucgggcg

SEQ ID NO: 2957131 - RNA, 19 nt, Mycobacterium avium subsp. paratuberculosis
gcggucgccacucgggcgg

SEQ ID NO: 2957132 - RNA, 14 nt, Mycobacterium avium subsp. paratuberculosis
gcggucgccagcgc

SEQ ID NO: 2957133 - RNA, 15 nt, Mycobacterium avium subsp. paratuberculosis
gcggucgccagcgcc

SEQ ID NO: 2957134 - RNA, 22 nt, Mycobacterium avium subsp. paratuberculosis
gcggucgccagcgccacgcuca

SEQ ID NO: 2957135 - RNA, 18 nt, Mycobacterium avium subsp. paratuberculosis
gcggucgccccggccgcg

SEQ ID NO: 2957136 - RNA, 20 nt, Mycobacterium avium subsp. paratuberculosis
gcggucgccccggccgcggu

SEQ ID NO: 2957137 - RNA, 19 nt, Mycobacterium avium subsp. paratuberculosis
gcggucgccgaaaggaucu

SEQ ID NO: 2957138 - RNA, 16 nt, Mycobacterium avium subsp. paratuberculosis
gcggucgccgcccacg

SEQ ID NO: 2957139 - RNA, 17 nt, Mycobacterium avium subsp. paratuberculosis
gcggucgccgcccacgc

SEQ ID NO: 2957140 - RNA, 13 nt, Mycobacterium avium subsp. paratuberculosis
gcggucgcgcagc

SEQ ID NO: 2957141 - RNA, 15 nt, Mycobacterium avium subsp. paratuberculosis
gcggucgcgcagccg

SEQ ID NO: 2957142 - RNA, 17 nt, Mycobacterium avium subsp. paratuberculosis
gcggucgcgcagccgcc

SEQ ID NO: 2957143 - RNA, 19 nt, Mycobacterium avium subsp. paratuberculosis
gcggucgcgcagccgccgg

SEQ ID NO: 2957144 - RNA, 22 nt, Mycobacterium avium subsp. paratuberculosis
gcggucgcgcagccgccgggcu

SEQ ID NO: 2957145 - RNA, 16 nt, Mycobacterium avium subsp. paratuberculosis
gcggucgcgcagccgg

SEQ ID NO: 2957146 - RNA, 17 nt, Mycobacterium avium subsp. paratuberculosis
gcggucgcgcagccggg

SEQ ID NO: 2957147 - RNA, 20 nt, Mycobacterium avium subsp. paratuberculosis
gcggucgcgcagccgggcgg

SEQ ID NO: 2957148 - RNA, 17 nt, Mycobacterium avium subsp. paratuberculosis
gcggucgcgccagacgu

SEQ ID NO: 2957149 - RNA, 22 nt, Mycobacterium avium subsp. paratuberculosis
gcggucgcgccagacguccagc

SEQ ID NO: 2957150 - RNA, 14 nt, Mycobacterium avium subsp. paratuberculosis
gcggucgcgcgccg

SEQ ID NO: 2957151 - RNA, 17 nt, Mycobacterium avium subsp. paratuberculosis
gcggucgcgcgccggcg

SEQ ID NO: 2957152 - RNA, 19 nt, Mycobacterium avium subsp. paratuberculosis
gcggucgcggaaccggccg

SEQ ID NO: 2957153 - RNA, 21 nt, Mycobacterium avium subsp. paratuberculosis
gcggucgcggaaccggccggg

SEQ ID NO: 2957154 - RNA, 15 nt, Mycobacterium avium subsp. paratuberculosis
gcggucgcggcgccg

SEQ ID NO: 2957155 - RNA, 16 nt, Mycobacterium avium subsp. paratuberculosis
gcggucgcggcgccgg

SEQ ID NO: 2957156 - RNA, 20 nt, Mycobacterium avium subsp. paratuberculosis
gcggucgcgggacaacacga

SEQ ID NO: 2957157 - RNA, 15 nt, Mycobacterium avium subsp. paratuberculosis
gcggucgcggugccc

SEQ ID NO: 2957158 - RNA, 21 nt, Mycobacterium avium subsp. paratuberculosis
gcggucgcggugcccagccgc

SEQ ID NO: 2957159 - RNA, 16 nt, Mycobacterium avium subsp. paratuberculosis
gcggucgcgucgucgg

SEQ ID NO: 2957160 - RNA, 21 nt, Mycobacterium avium subsp. paratuberculosis
gcggucgcgucgucggcgggc

SEQ ID NO: 2957161 - RNA, 18 nt, Mycobacterium avium subsp. paratuberculosis
gcggucgcugaccccgcu

SEQ ID NO: 2957162 - RNA, 23 nt, Mycobacterium avium subsp. paratuberculosis
gcggucgcugaccccgcucggcg

SEQ ID NO: 2957163 - RNA, 16 nt, Mycobacterium avium subsp. paratuberculosis
gcggucgcugacccgc

SEQ ID NO: 2957164 - RNA, 18 nt, Mycobacterium avium subsp. paratuberculosis
gcggucgcugacccgccg

SEQ ID NO: 2957165 - RNA, 16 nt, Mycobacterium avium subsp. paratuberculosis
gcggucgcugcagcgg

SEQ ID NO: 2957166 - RNA, 18 nt, Mycobacterium avium subsp. paratuberculosis
gcggucgcugcagcggcg

SEQ ID NO: 2957167 - RNA, 14 nt, Mycobacterium avium subsp. paratuberculosis
gcggucggacgcgg

SEQ ID NO: 2957168 - RNA, 15 nt, Mycobacterium avium subsp. paratuberculosis
gcggucggacgcggg

SEQ ID NO: 2957169 - RNA, 20 nt, Mycobacterium avium subsp. paratuberculosis
gcggucggcaacccgaccuc

SEQ ID NO: 2957170 - RNA, 23 nt, Mycobacterium avium subsp. paratuberculosis
gcggucggcaacccgaccucguc

SEQ ID NO: 2957171 - RNA, 13 nt, Mycobacterium avium subsp. paratuberculosis
gcggucggcauag

SEQ ID NO: 2957172 - RNA, 17 nt, Mycobacterium avium subsp. paratuberculosis
gcggucggcauagcgcc

SEQ ID NO: 2957173 - RNA, 20 nt, Mycobacterium avium subsp. paratuberculosis
gcggucggcauagcgccgcu

SEQ ID NO: 2957174 - RNA, 13 nt, Mycobacterium avium subsp. paratuberculosis
gcggucggcgccc

SEQ ID NO: 2957175 - RNA, 14 nt, Mycobacterium avium subsp. paratuberculosis
gcggucggcgcccg

SEQ ID NO: 2957176 - RNA, 16 nt, Mycobacterium avium subsp. paratuberculosis
gcggucggcgcccggc

SEQ ID NO: 2957177 - RNA, 19 nt, Mycobacterium avium subsp. paratuberculosis
gcggucggcgcccggccca

SEQ ID NO: 2957178 - RNA, 15 nt, Mycobacterium avium subsp. paratuberculosis
gcggucggcgccgau

SEQ ID NO: 2957179 - RNA, 16 nt, Mycobacterium avium subsp. paratuberculosis
gcggucggcgccgauc

SEQ ID NO: 2957180 - RNA, 13 nt, Mycobacterium avium subsp. paratuberculosis
gcggucggcgcgg

SEQ ID NO: 2957181 - RNA, 14 nt, Mycobacterium avium subsp. paratuberculosis
gcggucggcgcggg

SEQ ID NO: 2957182 - RNA, 17 nt, Mycobacterium avium subsp. paratuberculosis
gcggucggcgcggggcc

SEQ ID NO: 2957183 - RNA, 18 nt, Mycobacterium avium subsp. paratuberculosis
gcggucggcgcggggcca

SEQ ID NO: 2957184 - RNA, 11 nt, Mycobacterium avium subsp. paratuberculosis
gcggucggcgg

SEQ ID NO: 2957185 - RNA, 12 nt, Mycobacterium avium subsp. paratuberculosis
gcggucggcggu

SEQ ID NO: 2957186 - RNA, 14 nt, Mycobacterium avium subsp. paratuberculosis
gcggucggcgguuc

SEQ ID NO: 2957187 - RNA, 21 nt, Mycobacterium avium subsp. paratuberculosis
gcggucggcgguucgauaccg

SEQ ID NO: 2957188 - RNA, 13 nt, Mycobacterium avium subsp. paratuberculosis
gcggucggcgucg

SEQ ID NO: 2957189 - RNA, 15 nt, Mycobacterium avium subsp. paratuberculosis
gcggucggcgucgcu

SEQ ID NO: 2957190 - RNA, 19 nt, Mycobacterium avium subsp. paratuberculosis
gcggucggggaauuccggc

SEQ ID NO: 2957191 - RNA, 12 nt, Mycobacterium avium subsp. paratuberculosis
gcggucgggucc

SEQ ID NO: 2957192 - RNA, 16 nt, Mycobacterium avium subsp. paratuberculosis
gcggucgggucccggc

SEQ ID NO: 2957193 - RNA, 21 nt, Mycobacterium avium subsp. paratuberculosis
gcggugaugcgcgccgacgac

SEQ ID NO: 2957194 - RNA, 19 nt, Mycobacterium avium subsp. paratuberculosis
gcggugaugcgcggcgacg

SEQ ID NO: 2957195 - RNA, 20 nt, Mycobacterium avium subsp. paratuberculosis
gcggugaugcgcggcgacgg

SEQ ID NO: 2957196 - RNA, 21 nt, Mycobacterium avium subsp. paratuberculosis
gcggugaugcgcggcgacggc

SEQ ID NO: 2957197 - RNA, 16 nt, Mycobacterium avium subsp. paratuberculosis
gcggugauggacaucu

SEQ ID NO: 2957198 - RNA, 16 nt, Mycobacterium avium subsp. paratuberculosis
gcggugauggcgaugc

SEQ ID NO: 2957199 - RNA, 16 nt, Mycobacterium avium subsp. paratuberculosis
gcggugauggucaccg

SEQ ID NO: 2957200 - RNA, 20 nt, Mycobacterium avium subsp. paratuberculosis
gcggugcaacgccgccgaca

SEQ ID NO: 2957201 - RNA, 22 nt, Mycobacterium avium subsp. paratuberculosis
gcggugcaacgccgccgacagc

SEQ ID NO: 2957202 - RNA, 16 nt, Mycobacterium avium subsp. paratuberculosis
gcggugcaccaccgug

SEQ ID NO: 2957203 - RNA, 15 nt, Mycobacterium avium subsp. paratuberculosis
gcggugcaccaggac

SEQ ID NO: 2957204 - RNA, 16 nt, Mycobacterium avium subsp. paratuberculosis
gcggugcaccaggacg

SEQ ID NO: 2957205 - RNA, 14 nt, Mycobacterium avium subsp. paratuberculosis
gcggugcaccgcgg

SEQ ID NO: 2957206 - RNA, 22 nt, Mycobacterium avium subsp. paratuberculosis
gcggugcacggucagcucgcgc

SEQ ID NO: 2957207 - RNA, 16 nt, Mycobacterium avium subsp. paratuberculosis
gcggugcagccccgca

SEQ ID NO: 2957208 - RNA, 17 nt, Mycobacterium avium subsp. paratuberculosis
gcggugcagccgggggc

SEQ ID NO: 2957209 - RNA, 16 nt, Mycobacterium avium subsp. paratuberculosis
gcggugcagccgggug

SEQ ID NO: 2957210 - RNA, 18 nt, Mycobacterium avium subsp. paratuberculosis
gcggugcagccgggugcg

SEQ ID NO: 2957211 - RNA, 23 nt, Mycobacterium avium subsp. paratuberculosis
gcggugcagggucagcagcaccc

SEQ ID NO: 2957212 - RNA, 20 nt, Mycobacterium avium subsp. paratuberculosis
gcggugcagucggucgguca

SEQ ID NO: 2957213 - RNA, 16 nt, Mycobacterium avium subsp. paratuberculosis
gcggugcaucgucgcg

SEQ ID NO: 2957214 - RNA, 18 nt, Mycobacterium avium subsp. paratuberculosis
gcggugcaucgucgcggc

SEQ ID NO: 2957215 - RNA, 19 nt, Mycobacterium avium subsp. paratuberculosis
gcggugcaucgucgcggcg

SEQ ID NO: 2957216 - RNA, 13 nt, Mycobacterium avium subsp. paratuberculosis
gcggugcccagcc

SEQ ID NO: 2957217 - RNA, 15 nt, Mycobacterium avium subsp. paratuberculosis
gcggugcccagccag

SEQ ID NO: 2957218 - RNA, 22 nt, Mycobacterium avium subsp. paratuberculosis
gcggugcccagccaggccgccg

SEQ ID NO: 2957219 - RNA, 23 nt, Mycobacterium avium subsp. paratuberculosis
gcggugcccagccaggccgccgg

SEQ ID NO: 2957220 - RNA, 15 nt, Mycobacterium avium subsp. paratuberculosis
gcggugcccagccgc

SEQ ID NO: 2957221 - RNA, 16 nt, Mycobacterium avium subsp. paratuberculosis
gcggugcccagccgca

SEQ ID NO: 2957222 - RNA, 18 nt, Mycobacterium avium subsp. paratuberculosis
gcggugcccagccgcagg

SEQ ID NO: 2957223 - RNA, 15 nt, Mycobacterium avium subsp. paratuberculosis
gcggugcccggaacg

SEQ ID NO: 2957224 - RNA, 21 nt, Mycobacterium avium subsp. paratuberculosis
gcggugcccggaacggcgggc

SEQ ID NO: 2957225 - RNA, 15 nt, Mycobacterium avium subsp. paratuberculosis
gcggugccgaaccgg

SEQ ID NO: 2957226 - RNA, 16 nt, Mycobacterium avium subsp. paratuberculosis
gcggugccgagcccgc

SEQ ID NO: 2957227 - RNA, 17 nt, Mycobacterium avium subsp. paratuberculosis
gcggugccgagcccgcc

SEQ ID NO: 2957228 - RNA, 12 nt, Mycobacterium avium subsp. paratuberculosis
gcggugccgcag

SEQ ID NO: 2957229 - RNA, 17 nt, Mycobacterium avium subsp. paratuberculosis
gcggugccgcagcucga

SEQ ID NO: 2957230 - RNA, 13 nt, Mycobacterium avium subsp. paratuberculosis
gcggugccgcagg

SEQ ID NO: 2957231 - RNA, 14 nt, Mycobacterium avium subsp. paratuberculosis
gcggugccgcaggc

SEQ ID NO: 2957232 - RNA, 15 nt, Mycobacterium avium subsp. paratuberculosis
gcggugccgcccgga

SEQ ID NO: 2957233 - RNA, 13 nt, Mycobacterium avium subsp. paratuberculosis
gcggugccgcggc

SEQ ID NO: 2957234 - RNA, 17 nt, Mycobacterium avium subsp. paratuberculosis
gcggugccgcggcggcg

SEQ ID NO: 2957235 - RNA, 18 nt, Mycobacterium avium subsp. paratuberculosis
gcggugccgcggcggcgc

SEQ ID NO: 2957236 - RNA, 24 nt, Mycobacterium avium subsp. paratuberculosis
gcggugccgcggcggcgccgacgg

SEQ ID NO: 2957237 - RNA, 23 nt, Mycobacterium avium subsp. paratuberculosis
gcggugccggccagaucgacgcc

SEQ ID NO: 2957238 - RNA, 14 nt, Mycobacterium avium subsp. paratuberculosis
gcggugccgggcca

SEQ ID NO: 2957239 - RNA, 15 nt, Mycobacterium avium subsp. paratuberculosis
gcggugccgggccag

SEQ ID NO: 2957240 - RNA, 13 nt, Mycobacterium avium subsp. paratuberculosis
gcggugccgggug

SEQ ID NO: 2957241 - RNA, 13 nt, Mycobacterium avium subsp. paratuberculosis
gcggugcgcagcc

SEQ ID NO: 2957242 - RNA, 16 nt, Mycobacterium avium subsp. paratuberculosis
gcggugcgcagccgcu

SEQ ID NO: 2957243 - RNA, 14 nt, Mycobacterium avium subsp. paratuberculosis
gcggugcgccacgc

SEQ ID NO: 2957244 - RNA, 16 nt, Mycobacterium avium subsp. paratuberculosis
gcggugcgccagcgcc

SEQ ID NO: 2957245 - RNA, 14 nt, Mycobacterium avium subsp. paratuberculosis
gcggugcgccgaca

SEQ ID NO: 2957246 - RNA, 16 nt, Mycobacterium avium subsp. paratuberculosis
gcggugcgccgacagc

SEQ ID NO: 2957247 - RNA, 17 nt, Mycobacterium avium subsp. paratuberculosis
gcggugcgccgacagcu

SEQ ID NO: 2957248 - RNA, 15 nt, Mycobacterium avium subsp. paratuberculosis
gcggugcgcgcgcgc

SEQ ID NO: 2957249 - RNA, 21 nt, Mycobacterium avium subsp. paratuberculosis
gcggugcgcgcgcgcucggcg

SEQ ID NO: 2957250 - RNA, 12 nt, Mycobacterium avium subsp. paratuberculosis
gcggugcggccc

SEQ ID NO: 2957251 - RNA, 14 nt, Mycobacterium avium subsp. paratuberculosis
gcggugcggccgcg

SEQ ID NO: 2957252 - RNA, 20 nt, Mycobacterium avium subsp. paratuberculosis
gcggugcggccgcgcagcuc

SEQ ID NO: 2957253 - RNA, 13 nt, Mycobacterium avium subsp. paratuberculosis
gcggugcggcucg

SEQ ID NO: 2957254 - RNA, 16 nt, Mycobacterium avium subsp. paratuberculosis
gcggugcggcuuugcu

SEQ ID NO: 2957255 - RNA, 23 nt, Mycobacterium avium subsp. paratuberculosis
gcggugcggggccgcggccggca

SEQ ID NO: 2957256 - RNA, 21 nt, Mycobacterium avium subsp. paratuberculosis
gcggugcgggugguguggcgu

SEQ ID NO: 2957257 - RNA, 15 nt, Mycobacterium avium subsp. paratuberculosis
gcggugcggucgcgc

SEQ ID NO: 2957258 - RNA, 13 nt, Mycobacterium avium subsp. paratuberculosis
gcggugcgucggg

SEQ ID NO: 2957259 - RNA, 20 nt, Mycobacterium avium subsp. paratuberculosis
gcggugcgucgggcgccggc

SEQ ID NO: 2957260 - RNA, 21 nt, Mycobacterium avium subsp. paratuberculosis
gcggugcgucgggcgccggcg

SEQ ID NO: 2957261 - RNA, 19 nt, Mycobacterium avium subsp. paratuberculosis
gcggugcguuugaugacgc

SEQ ID NO: 2957262 - RNA, 15 nt, Mycobacterium avium subsp. paratuberculosis
gcggugcucgcgccg

SEQ ID NO: 2957263 - RNA, 16 nt, Mycobacterium avium subsp. paratuberculosis
gcggugcucgcgccgg

SEQ ID NO: 2957264 - RNA, 19 nt, Mycobacterium avium subsp. paratuberculosis
gcggugcucgcgccgggcg

SEQ ID NO: 2957265 - RNA, 22 nt, Mycobacterium avium subsp. paratuberculosis
gcggugcucgcgccgggcggcc

SEQ ID NO: 2957266 - RNA, 13 nt, Mycobacterium avium subsp. paratuberculosis
gcggugcucggcg

SEQ ID NO: 2957267 - RNA, 15 nt, Mycobacterium avium subsp. paratuberculosis
gcggugcucggcgcg

SEQ ID NO: 2957268 - RNA, 23 nt, Mycobacterium avium subsp. paratuberculosis
gcggugcucggcgcgcggggccg

SEQ ID NO: 2957269 - RNA, 19 nt, Mycobacterium avium subsp. paratuberculosis
gcggugcucgucgagcauc

SEQ ID NO: 2957270 - RNA, 24 nt, Mycobacterium avium subsp. paratuberculosis
gcggugcucgucgagcauccggcg

SEQ ID NO: 2957271 - RNA, 20 nt, Mycobacterium avium subsp. paratuberculosis
gcggugcucucgucgucggc

SEQ ID NO: 2957272 - RNA, 22 nt, Mycobacterium avium subsp. paratuberculosis
gcggugcucucgucgucggcgg

SEQ ID NO: 2957273 - RNA, 17 nt, Mycobacterium avium subsp. paratuberculosis
gcggugcugcagcgcga

SEQ ID NO: 2957274 - RNA, 21 nt, Mycobacterium avium subsp. paratuberculosis
gcggugcuuaccggccggccg

SEQ ID NO: 2957275 - RNA, 22 nt, Mycobacterium avium subsp. paratuberculosis
gcggugcuuaccggccggccgc

SEQ ID NO: 2957276 - RNA, 23 nt, Mycobacterium avium subsp. paratuberculosis
gcggugcuucaucccgucguuga

SEQ ID NO: 2957277 - RNA, 17 nt, Mycobacterium avium subsp. paratuberculosis
gcgguggccacgcccca

SEQ ID NO: 2957278 - RNA, 20 nt, Mycobacterium avium subsp. paratuberculosis
gcgguguuggcggcgucguc

SEQ ID NO: 2957279 - RNA, 14 nt, Mycobacterium avium subsp. paratuberculosis
gcgguguuuggccg

SEQ ID NO: 2957280 - RNA, 22 nt, Mycobacterium avium subsp. paratuberculosis
gcgguguuuggccgcgcagcuc

SEQ ID NO: 2957281 - RNA, 17 nt, Mycobacterium avium subsp. paratuberculosis
gcgguuccagaccggcg

SEQ ID NO: 2957282 - RNA, 18 nt, Mycobacterium avium subsp. paratuberculosis
gcgguuccagaccggcgg

SEQ ID NO: 2957283 - RNA, 20 nt, Mycobacterium avium subsp. paratuberculosis
gcgguuccagaccggcggcg

SEQ ID NO: 2957284 - RNA, 18 nt, Mycobacterium avium subsp. paratuberculosis
gcgguuccggcgugcagc

SEQ ID NO: 2957285 - RNA, 21 nt, Mycobacterium avium subsp. paratuberculosis
gcgguuccggcgugcagcacg

SEQ ID NO: 2957286 - RNA, 23 nt, Mycobacterium avium subsp. paratuberculosis
gcgguuccggcgugcagcacgcc

SEQ ID NO: 2957287 - RNA, 15 nt, Mycobacterium avium subsp. paratuberculosis
gcgguuccgguggcg

SEQ ID NO: 2957288 - RNA, 21 nt, Mycobacterium avium subsp. paratuberculosis
gcgguucgauaccguccgcgc

SEQ ID NO: 2957289 - RNA, 22 nt, Mycobacterium avium subsp. paratuberculosis
gcgguucgauaccguccgcgcc

SEQ ID NO: 2957290 - RNA, 18 nt, Mycobacterium avium subsp. paratuberculosis
gcgguucgaucuccucgg

SEQ ID NO: 2957291 - RNA, 20 nt, Mycobacterium avium subsp. paratuberculosis
gcgguucgaucuccucggcg

SEQ ID NO: 2957292 - RNA, 21 nt, Mycobacterium avium subsp. paratuberculosis
gcgguucgaucucgucgggug

SEQ ID NO: 2957293 - RNA, 20 nt, Mycobacterium avium subsp. paratuberculosis
gcgguucggaguccaccggc

SEQ ID NO: 2957294 - RNA, 21 nt, Mycobacterium avium subsp. paratuberculosis
gcgguucggaguccaccggcg

SEQ ID NO: 2957295 - RNA, 22 nt, Mycobacterium avium subsp. paratuberculosis
gcgguucggaguccaccggcgg

SEQ ID NO: 2957296 - RNA, 13 nt, Mycobacterium avium subsp. paratuberculosis
gcgguucggcgac

SEQ ID NO: 2957297 - RNA, 20 nt, Mycobacterium avium subsp. paratuberculosis
gcgguucggcgacgcuggug

SEQ ID NO: 2957298 - RNA, 16 nt, Mycobacterium avium subsp. paratuberculosis
gcgguucgggccccau

SEQ ID NO: 2957299 - RNA, 22 nt, Mycobacterium avium subsp. paratuberculosis
gcgguucgucgcggcggcccgu

SEQ ID NO: 2957300 - RNA, 15 nt, Mycobacterium avium subsp. paratuberculosis
gcgguugacguccgc

SEQ ID NO: 2957301 - RNA, 16 nt, Mycobacterium avium subsp. paratuberculosis
gcgguugacguccgcg

SEQ ID NO: 2957302 - RNA, 17 nt, Mycobacterium avium subsp. paratuberculosis
gcgguugacguccgcgg

SEQ ID NO: 2957303 - RNA, 17 nt, Mycobacterium avium subsp. paratuberculosis
gcgguugagcaccagcc

SEQ ID NO: 2957304 - RNA, 21 nt, Mycobacterium avium subsp. paratuberculosis
gcgguugagcaccagcccggc

SEQ ID NO: 2957305 - RNA, 22 nt, Mycobacterium avium subsp. paratuberculosis
gcgguugagcaccagcccggcc

SEQ ID NO: 2957306 - RNA, 18 nt, Mycobacterium avium subsp. paratuberculosis
gcgguugaucacaccguc

SEQ ID NO: 2957307 - RNA, 19 nt, Mycobacterium avium subsp. paratuberculosis
gcgguugaucacaccgucg

SEQ ID NO: 2957308 - RNA, 22 nt, Mycobacterium avium subsp. paratuberculosis
gcgguugaucacaccgucggcg

SEQ ID NO: 2957309 - RNA, 16 nt, Mycobacterium avium subsp. paratuberculosis
gcgguugccccacccc

SEQ ID NO: 2957310 - RNA, 15 nt, Mycobacterium avium subsp. paratuberculosis
gcgguugcccucggu

SEQ ID NO: 2957311 - RNA, 13 nt, Mycobacterium avium subsp. paratuberculosis
gcgguugcgggug

SEQ ID NO: 2957312 - RNA, 15 nt, Mycobacterium avium subsp. paratuberculosis
gcgguugcggguggc

SEQ ID NO: 2957313 - RNA, 19 nt, Mycobacterium avium subsp. paratuberculosis
gcgguugcggguggcggcc

SEQ ID NO: 2957314 - RNA, 15 nt, Mycobacterium avium subsp. paratuberculosis
gcgguugcucgucgg

SEQ ID NO: 2957315 - RNA, 17 nt, Mycobacterium avium subsp. paratuberculosis
gcgguugcucgucggcc

SEQ ID NO: 2957316 - RNA, 18 nt, Mycobacterium avium subsp. paratuberculosis
gcgguugcucgucggccg

SEQ ID NO: 2957317 - RNA, 16 nt, Mycobacterium avium subsp. paratuberculosis
gcgguuggacaggccg

SEQ ID NO: 2957318 - RNA, 18 nt, Mycobacterium avium subsp. paratuberculosis
gcgguuggacaggccggc

SEQ ID NO: 2957319 - RNA, 19 nt, Mycobacterium avium subsp. paratuberculosis
gcgguuggacaggccggcg

SEQ ID NO: 2957320 - RNA, 16 nt, Mycobacterium avium subsp. paratuberculosis
gcgguuggcccgcggc

SEQ ID NO: 2957321 - RNA, 17 nt, Mycobacterium avium subsp. paratuberculosis
gcgguuggcccgcggcg

SEQ ID NO: 2957322 - RNA, 20 nt, Mycobacterium avium subsp. paratuberculosis
gcgguuggcccgcggcgccc

SEQ ID NO: 2957323 - RNA, 22 nt, Mycobacterium avium subsp. paratuberculosis
gcgguuggcccuucgaccucga

SEQ ID NO: 2957324 - RNA, 14 nt, Mycobacterium avium subsp. paratuberculosis
gcgguugggccgcc

SEQ ID NO: 2957325 - RNA, 15 nt, Mycobacterium avium subsp. paratuberculosis
gcgguugggccgccg

SEQ ID NO: 2957326 - RNA, 16 nt, Mycobacterium avium subsp. paratuberculosis
gcgguugggccgccgg

SEQ ID NO: 2957327 - RNA, 21 nt, Mycobacterium avium subsp. paratuberculosis
gcgguugggccgccggccgcu

SEQ ID NO: 2957328 - RNA, 16 nt, Mycobacterium avium subsp. paratuberculosis
gcgguugggccggcgc

SEQ ID NO: 2957329 - RNA, 20 nt, Mycobacterium avium subsp. paratuberculosis
gcgguugggccggcgcccgu

SEQ ID NO: 2957330 - RNA, 19 nt, Mycobacterium avium subsp. paratuberculosis
gcgguuggucaccaggucg

SEQ ID NO: 2957331 - RNA, 14 nt, Mycobacterium avium subsp. paratuberculosis
gcgguugucgguca

SEQ ID NO: 2957332 - RNA, 17 nt, Mycobacterium avium subsp. paratuberculosis
gcgguugucggucaggc

SEQ ID NO: 2957333 - RNA, 23 nt, Mycobacterium avium subsp. paratuberculosis
gcgguugucggucaggcacucga

SEQ ID NO: 2957334 - RNA, 22 nt, Mycobacterium avium subsp. paratuberculosis
gcgguugucguugaacaguucg

SEQ ID NO: 2957335 - RNA, 16 nt, Mycobacterium avium subsp. paratuberculosis
gcgguuucaccgugcg

SEQ ID NO: 2957336 - RNA, 19 nt, Mycobacterium avium subsp. paratuberculosis
gcgguuucaccgugcgcgc

SEQ ID NO: 2957337 - RNA, 17 nt, Mycobacterium avium subsp. paratuberculosis
gcgguuucggcgucgcc

SEQ ID NO: 2957338 - RNA, 16 nt, Mycobacterium avium subsp. paratuberculosis
gcgguuucggugccgg

SEQ ID NO: 2957339 - RNA, 20 nt, Mycobacterium avium subsp. paratuberculosis
gcgguuucggugccggccca

SEQ ID NO: 2957340 - RNA, 16 nt, Mycobacterium avium subsp. paratuberculosis
gcgguuuuggucggca

SEQ ID NO: 2957341 - RNA, 13 nt, Mycobacterium avium subsp. paratuberculosis
gcguaaccggcgg

SEQ ID NO: 2957342 - RNA, 14 nt, Mycobacterium avium subsp. paratuberculosis
gcguaaccggcggc

SEQ ID NO: 2957343 - RNA, 21 nt, Mycobacterium avium subsp. paratuberculosis
gcguacaccagggugccgccg

SEQ ID NO: 2957344 - RNA, 22 nt, Mycobacterium avium subsp. paratuberculosis
gcguacaccagggugccgccgg

SEQ ID NO: 2957345 - RNA, 14 nt, Mycobacterium avium subsp. paratuberculosis
gcguacaccggcug

SEQ ID NO: 2957346 - RNA, 22 nt, Mycobacterium avium subsp. paratuberculosis
gcguacaccggcugaccggcgg

SEQ ID NO: 2957347 - RNA, 13 nt, Mycobacterium avium subsp. paratuberculosis
gcguacagcagcu

SEQ ID NO: 2957348 - RNA, 12 nt, Mycobacterium avium subsp. paratuberculosis
gcguacagccag

SEQ ID NO: 2957349 - RNA, 16 nt, Mycobacterium avium subsp. paratuberculosis
gcguacagcgcccgga

SEQ ID NO: 2957350 - RNA, 18 nt, Mycobacterium avium subsp. paratuberculosis
gcguacagcggcgccagg

SEQ ID NO: 2957351 - RNA, 17 nt, Mycobacterium avium subsp. paratuberculosis
gcguacagggcgucgga

SEQ ID NO: 2957352 - RNA, 14 nt, Mycobacterium avium subsp. paratuberculosis
gcguaccagcgcca

SEQ ID NO: 2957353 - RNA, 18 nt, Mycobacterium avium subsp. paratuberculosis
gcguacccaggucggcgu

SEQ ID NO: 2957354 - RNA, 16 nt, Mycobacterium avium subsp. paratuberculosis
gcguacccgcccaugc

SEQ ID NO: 2957355 - RNA, 13 nt, Mycobacterium avium subsp. paratuberculosis
gcguacccgcgcg

SEQ ID NO: 2957356 - RNA, 15 nt, Mycobacterium avium subsp. paratuberculosis
gcguacccgcgcggc

SEQ ID NO: 2957357 - RNA, 16 nt, Mycobacterium avium subsp. paratuberculosis
gcguacccgcgcggcg

SEQ ID NO: 2957358 - RNA, 15 nt, Mycobacterium avium subsp. paratuberculosis
gcguaccgcggcggc

SEQ ID NO: 2957359 - RNA, 19 nt, Mycobacterium avium subsp. paratuberculosis
gcguacgaccguagccggu

SEQ ID NO: 2957360 - RNA, 22 nt, Mycobacterium avium subsp. paratuberculosis
gcguacgccgccuugacgccgg

SEQ ID NO: 2957361 - RNA, 13 nt, Mycobacterium avium subsp. paratuberculosis
gcguacgcgcugc

SEQ ID NO: 2957362 - RNA, 20 nt, Mycobacterium avium subsp. paratuberculosis
gcgucacgcuggcgugacgc

SEQ ID NO: 2957363 - RNA, 14 nt, Mycobacterium avium subsp. paratuberculosis
gcgucacgcuggug

SEQ ID NO: 2957364 - RNA, 17 nt, Mycobacterium avium subsp. paratuberculosis
gcgucacgcuggugacg

SEQ ID NO: 2957365 - RNA, 23 nt, Mycobacterium avium subsp. paratuberculosis
gcgucacguccaucauggcgcug

SEQ ID NO: 2957366 - RNA, 15 nt, Mycobacterium avium subsp. paratuberculosis
gcgucacgucgacgg

SEQ ID NO: 2957367 - RNA, 13 nt, Mycobacterium avium subsp. paratuberculosis
gcgucacgucggc

SEQ ID NO: 2957368 - RNA, 14 nt, Mycobacterium avium subsp. paratuberculosis
gcgucacgucggcc

SEQ ID NO: 2957369 - RNA, 15 nt, Mycobacterium avium subsp. paratuberculosis
gcgucacgucggccu

SEQ ID NO: 2957370 - RNA, 17 nt, Mycobacterium avium subsp. paratuberculosis
gcgucacgucggccugc

SEQ ID NO: 2957371 - RNA, 16 nt, Mycobacterium avium subsp. paratuberculosis
gcgucacuccucgauc

SEQ ID NO: 2957372 - RNA, 19 nt, Mycobacterium avium subsp. paratuberculosis
gcgucacucuggcgugacg

SEQ ID NO: 2957373 - RNA, 20 nt, Mycobacterium avium subsp. paratuberculosis
gcgucacucuggcgugacgc

SEQ ID NO: 2957374 - RNA, 19 nt, Mycobacterium avium subsp. paratuberculosis
gcgucacugcccagccauc

SEQ ID NO: 2957375 - RNA, 13 nt, Mycobacterium avium subsp. paratuberculosis
gcgucagaaccgg

SEQ ID NO: 2957376 - RNA, 20 nt, Mycobacterium avium subsp. paratuberculosis
gcgucagaaccggggccagc

SEQ ID NO: 2957377 - RNA, 16 nt, Mycobacterium avium subsp. paratuberculosis
gcgucagagguuggcg

SEQ ID NO: 2957378 - RNA, 17 nt, Mycobacterium avium subsp. paratuberculosis
gcgucagcaccgcgacg

SEQ ID NO: 2957379 - RNA, 20 nt, Mycobacterium avium subsp. paratuberculosis
gcgucagcaccgcgacggug

SEQ ID NO: 2957380 - RNA, 22 nt, Mycobacterium avium subsp. paratuberculosis
gcgucagcaccgcgacggugag

SEQ ID NO: 2957381 - RNA, 15 nt, Mycobacterium avium subsp. paratuberculosis
gcgucagcagcgcga

SEQ ID NO: 2957382 - RNA, 14 nt, Mycobacterium avium subsp. paratuberculosis
gcgucagcaucgcc

SEQ ID NO: 2957383 - RNA, 15 nt, Mycobacterium avium subsp. paratuberculosis
gcgucagcaucgccg

SEQ ID NO: 2957384 - RNA, 16 nt, Mycobacterium avium subsp. paratuberculosis
gcgucagccccgaguc

SEQ ID NO: 2957385 - RNA, 21 nt, Mycobacterium avium subsp. paratuberculosis
gcgucagccccgaguccacga

SEQ ID NO: 2957386 - RNA, 17 nt, Mycobacterium avium subsp. paratuberculosis
gcgucagccgucgucgu

SEQ ID NO: 2957387 - RNA, 18 nt, Mycobacterium avium subsp. paratuberculosis
gcgucaggcgcugggugc

SEQ ID NO: 2957388 - RNA, 22 nt, Mycobacterium avium subsp. paratuberculosis
gcgucaggcgcugggugcgggc

SEQ ID NO: 2957389 - RNA, 14 nt, Mycobacterium avium subsp. paratuberculosis
gcgucaggcgucgu

SEQ ID NO: 2957390 - RNA, 14 nt, Mycobacterium avium subsp. paratuberculosis
gcgucagggcgacu

SEQ ID NO: 2957391 - RNA, 17 nt, Mycobacterium avium subsp. paratuberculosis
gcgucagggcgacuccg

SEQ ID NO: 2957392 - RNA, 18 nt, Mycobacterium avium subsp. paratuberculosis
gcgucagggcgacuccgg

SEQ ID NO: 2957393 - RNA, 19 nt, Mycobacterium avium subsp. paratuberculosis
gcgucagggcgacuccggc

SEQ ID NO: 2957394 - RNA, 20 nt, Mycobacterium avium subsp. paratuberculosis
gcgucagggguuggcgcgca

SEQ ID NO: 2957395 - RNA, 15 nt, Mycobacterium avium subsp. paratuberculosis
gcgucaggucaccga

SEQ ID NO: 2957396 - RNA, 17 nt, Mycobacterium avium subsp. paratuberculosis
gcgucaggucaccgagc

SEQ ID NO: 2957397 - RNA, 13 nt, Mycobacterium avium subsp. paratuberculosis
gcgucagguccgc

SEQ ID NO: 2957398 - RNA, 15 nt, Mycobacterium avium subsp. paratuberculosis
gcgucagguccgcga

SEQ ID NO: 2957399 - RNA, 18 nt, Mycobacterium avium subsp. paratuberculosis
gcgucaucacgugcuggc

SEQ ID NO: 2957400 - RNA, 17 nt, Mycobacterium avium subsp. paratuberculosis
gcgucaucccccgcagc

SEQ ID NO: 2957401 - RNA, 18 nt, Mycobacterium avium subsp. paratuberculosis
gcgucaucgacuugccgc

SEQ ID NO: 2957402 - RNA, 19 nt, Mycobacterium avium subsp. paratuberculosis
gcgucaucgacuugccgcc

SEQ ID NO: 2957403 - RNA, 20 nt, Mycobacterium avium subsp. paratuberculosis
gcgucaucgacuugccgccg

SEQ ID NO: 2957404 - RNA, 18 nt, Mycobacterium avium subsp. paratuberculosis
gcgucaucgggcccgacg

SEQ ID NO: 2957405 - RNA, 19 nt, Mycobacterium avium subsp. paratuberculosis
gcgucaucgggcccgacga

SEQ ID NO: 2957406 - RNA, 16 nt, Mycobacterium avium subsp. paratuberculosis
gcgucauggccgucgg

SEQ ID NO: 2957407 - RNA, 15 nt, Mycobacterium avium subsp. paratuberculosis
gcgucauggugcgcg

SEQ ID NO: 2957408 - RNA, 14 nt, Mycobacterium avium subsp. paratuberculosis
gcgucauuccgccg

SEQ ID NO: 2957409 - RNA, 18 nt, Mycobacterium avium subsp. paratuberculosis
gcgucauuccgccgcgcc

SEQ ID NO: 2957410 - RNA, 19 nt, Mycobacterium avium subsp. paratuberculosis
gcgucauuccgccgcgccc

SEQ ID NO: 2957411 - RNA, 21 nt, Mycobacterium avium subsp. paratuberculosis
gcgucauuccgccgcgcccgu

SEQ ID NO: 2957412 - RNA, 22 nt, Mycobacterium avium subsp. paratuberculosis
gcguccaaccgcggacuggcca

SEQ ID NO: 2957413 - RNA, 19 nt, Mycobacterium avium subsp. paratuberculosis
gcguccaccagcacgccgu

SEQ ID NO: 2957414 - RNA, 19 nt, Mycobacterium avium subsp. paratuberculosis
gcguccacgaccccggcgg

SEQ ID NO: 2957415 - RNA, 20 nt, Mycobacterium avium subsp. paratuberculosis
gcguccacgaccccggcggc

SEQ ID NO: 2957416 - RNA, 22 nt, Mycobacterium avium subsp. paratuberculosis
gcguccacuccaauacggcccg

SEQ ID NO: 2957417 - RNA, 21 nt, Mycobacterium avium subsp. paratuberculosis
gcguccagaccggccggggcg

SEQ ID NO: 2957418 - RNA, 12 nt, Mycobacterium avium subsp. paratuberculosis
gcguccagcaug

SEQ ID NO: 2957419 - RNA, 21 nt, Mycobacterium avium subsp. paratuberculosis
gcguccagcaugcccacgccg

SEQ ID NO: 2957420 - RNA, 12 nt, Mycobacterium avium subsp. paratuberculosis
gcguccagcgcc

SEQ ID NO: 2957421 - RNA, 16 nt, Mycobacterium avium subsp. paratuberculosis
gcguccagcgccgcca

SEQ ID NO: 2957422 - RNA, 13 nt, Mycobacterium avium subsp. paratuberculosis
gcguccagcgcgg

SEQ ID NO: 2957423 - RNA, 20 nt, Mycobacterium avium subsp. paratuberculosis
gcguccagcgcggugagcag

SEQ ID NO: 2957424 - RNA, 16 nt, Mycobacterium avium subsp. paratuberculosis
gcguccagcgcgucgc

SEQ ID NO: 2957425 - RNA, 18 nt, Mycobacterium avium subsp. paratuberculosis
gcguccagcgcgucgcug

SEQ ID NO: 2957426 - RNA, 20 nt, Mycobacterium avium subsp. paratuberculosis
gcguccagcgcgucgcugcc

SEQ ID NO: 2957427 - RNA, 16 nt, Mycobacterium avium subsp. paratuberculosis
gcguccagcugcgcgc

SEQ ID NO: 2957428 - RNA, 19 nt, Mycobacterium avium subsp. paratuberculosis
gcguccagcugcgcgccgg

SEQ ID NO: 2957429 - RNA, 20 nt, Mycobacterium avium subsp. paratuberculosis
gcguccagcugcgcgccggc

SEQ ID NO: 2957430 - RNA, 18 nt, Mycobacterium avium subsp. paratuberculosis
gcguccaggacucggggu

SEQ ID NO: 2957431 - RNA, 15 nt, Mycobacterium avium subsp. paratuberculosis
gcguccaggcgcacc

SEQ ID NO: 2957432 - RNA, 16 nt, Mycobacterium avium subsp. paratuberculosis
gcguccaggcgcaccg

SEQ ID NO: 2957433 - RNA, 21 nt, Mycobacterium avium subsp. paratuberculosis
gcguccaggcgcaccgccacc

SEQ ID NO: 2957434 - RNA, 15 nt, Mycobacterium avium subsp. paratuberculosis
gcguccagggccacc

SEQ ID NO: 2957435 - RNA, 18 nt, Mycobacterium avium subsp. paratuberculosis
gcguccagggccaccgcg

SEQ ID NO: 2957436 - RNA, 20 nt, Mycobacterium avium subsp. paratuberculosis
gcguccagggccaccgcguc

SEQ ID NO: 2957437 - RNA, 21 nt, Mycobacterium avium subsp. paratuberculosis
gcguccagggccaccgcgucg

SEQ ID NO: 2957438 - RNA, 15 nt, Mycobacterium avium subsp. paratuberculosis
gcguccaggucgccc

SEQ ID NO: 2957439 - RNA, 16 nt, Mycobacterium avium subsp. paratuberculosis
gcguccaggucgcccu

SEQ ID NO: 2957440 - RNA, 17 nt, Mycobacterium avium subsp. paratuberculosis
gcguccaggucgcccuc

SEQ ID NO: 2957441 - RNA, 16 nt, Mycobacterium avium subsp. paratuberculosis
gcguccaggugcgccg

SEQ ID NO: 2957442 - RNA, 17 nt, Mycobacterium avium subsp. paratuberculosis
gcguccaggugcgccgc

SEQ ID NO: 2957443 - RNA, 19 nt, Mycobacterium avium subsp. paratuberculosis
gcguccaggugcgccgccg

SEQ ID NO: 2957444 - RNA, 18 nt, Mycobacterium avium subsp. paratuberculosis
gcguccaguagccgccgg

SEQ ID NO: 2957445 - RNA, 20 nt, Mycobacterium avium subsp. paratuberculosis
gcguccaguagccgccgggc

SEQ ID NO: 2957446 - RNA, 14 nt, Mycobacterium avium subsp. paratuberculosis
gcguccagucgaug

SEQ ID NO: 2957447 - RNA, 20 nt, Mycobacterium avium subsp. paratuberculosis
gcgucgaaauccacgaugcc

SEQ ID NO: 2957448 - RNA, 22 nt, Mycobacterium avium subsp. paratuberculosis
gcgucgaaauccacgaugccgg

SEQ ID NO: 2957449 - RNA, 24 nt, Mycobacterium avium subsp. paratuberculosis
gcgucgaaauccacgaugccgggc

SEQ ID NO: 2957450 - RNA, 15 nt, Mycobacterium avium subsp. paratuberculosis
gcgucgaacagccgg

SEQ ID NO: 2957451 - RNA, 16 nt, Mycobacterium avium subsp. paratuberculosis
gcgucgaacagccggg

SEQ ID NO: 2957452 - RNA, 17 nt, Mycobacterium avium subsp. paratuberculosis
gcgucgaacagccgggc

SEQ ID NO: 2957453 - RNA, 21 nt, Mycobacterium avium subsp. paratuberculosis
gcgucgaacagccgggccgcc

SEQ ID NO: 2957454 - RNA, 19 nt, Mycobacterium avium subsp. paratuberculosis
gcgucgaacggcgucuggc

SEQ ID NO: 2957455 - RNA, 22 nt, Mycobacterium avium subsp. paratuberculosis
gcgucgaacggcgucuggccgg

SEQ ID NO: 2957456 - RNA, 15 nt, Mycobacterium avium subsp. paratuberculosis
gcgucgaacgggccg

SEQ ID NO: 2957457 - RNA, 18 nt, Mycobacterium avium subsp. paratuberculosis
gcgucgaacgggccgggc

SEQ ID NO: 2957458 - RNA, 15 nt, Mycobacterium avium subsp. paratuberculosis
gcgucgaagcgcaug

SEQ ID NO: 2957459 - RNA, 20 nt, Mycobacterium avium subsp. paratuberculosis
gcgucgacaccccgcucggc

SEQ ID NO: 2957460 - RNA, 22 nt, Mycobacterium avium subsp. paratuberculosis
gcgucgacaccccgcucggcca

SEQ ID NO: 2957461 - RNA, 23 nt, Mycobacterium avium subsp. paratuberculosis
gcgucgacaccccgcucggccag

SEQ ID NO: 2957462 - RNA, 16 nt, Mycobacterium avium subsp. paratuberculosis
gcgucgacacccgggc

SEQ ID NO: 2957463 - RNA, 17 nt, Mycobacterium avium subsp. paratuberculosis
gcgucgacacccgggcg

SEQ ID NO: 2957464 - RNA, 16 nt, Mycobacterium avium subsp. paratuberculosis
gcgucgacagccgguc

SEQ ID NO: 2957465 - RNA, 23 nt, Mycobacterium avium subsp. paratuberculosis
gcgucgacagccggucgcgcauc

SEQ ID NO: 2957466 - RNA, 12 nt, Mycobacterium avium subsp. paratuberculosis
gcgucgaccacc

SEQ ID NO: 2957467 - RNA, 16 nt, Mycobacterium avium subsp. paratuberculosis
gcgucgaccaccgccg

SEQ ID NO: 2957468 - RNA, 17 nt, Mycobacterium avium subsp. paratuberculosis
gcgucgaccaccgccgg

SEQ ID NO: 2957469 - RNA, 18 nt, Mycobacterium avium subsp. paratuberculosis
gcgucgaccaccgccggc

SEQ ID NO: 2957470 - RNA, 21 nt, Mycobacterium avium subsp. paratuberculosis
gcgucgaccaccgccggcccg

SEQ ID NO: 2957471 - RNA, 16 nt, Mycobacterium avium subsp. paratuberculosis
gcgucgaccagccgca

SEQ ID NO: 2957472 - RNA, 14 nt, Mycobacterium avium subsp. paratuberculosis
gcgucgaccgcccc

SEQ ID NO: 2957473 - RNA, 16 nt, Mycobacterium avium subsp. paratuberculosis
gcgucgaccgccccgc

SEQ ID NO: 2957474 - RNA, 19 nt, Mycobacterium avium subsp. paratuberculosis
gcgucgaccgccccgccgg

SEQ ID NO: 2957475 - RNA, 20 nt, Mycobacterium avium subsp. paratuberculosis
gcgucgaccgccccgccggu

SEQ ID NO: 2957476 - RNA, 21 nt, Mycobacterium avium subsp. paratuberculosis
gcgucgaccgccccgccggug

SEQ ID NO: 2957477 - RNA, 13 nt, Mycobacterium avium subsp. paratuberculosis
gcgucgaccgccg

SEQ ID NO: 2957478 - RNA, 19 nt, Mycobacterium avium subsp. paratuberculosis
gcgucgaccgccgcgaacg

SEQ ID NO: 2957479 - RNA, 20 nt, Mycobacterium avium subsp. paratuberculosis
gcgucgaccgccgcgaacgg

SEQ ID NO: 2957480 - RNA, 14 nt, Mycobacterium avium subsp. paratuberculosis
gcgucgacgacggc

SEQ ID NO: 2957481 - RNA, 22 nt, Mycobacterium avium subsp. paratuberculosis
gcgucgacgauggucuggauga

SEQ ID NO: 2957482 - RNA, 17 nt, Mycobacterium avium subsp. paratuberculosis
gcgucgacgccgcugcc

SEQ ID NO: 2957483 - RNA, 11 nt, Mycobacterium avium subsp. paratuberculosis
gcgucgacgcg

SEQ ID NO: 2957484 - RNA, 15 nt, Mycobacterium avium subsp. paratuberculosis
gcgucgacgcgcugc

SEQ ID NO: 2957485 - RNA, 12 nt, Mycobacterium avium subsp. paratuberculosis
gcgucgacgcgg

SEQ ID NO: 2957486 - RNA, 16 nt, Mycobacterium avium subsp. paratuberculosis
gcgucgacgcggucga

SEQ ID NO: 2957487 - RNA, 15 nt, Mycobacterium avium subsp. paratuberculosis
gcgucgacggcgccg

SEQ ID NO: 2957488 - RNA, 16 nt, Mycobacterium avium subsp. paratuberculosis
gcgucgacggcgccgg

SEQ ID NO: 2957489 - RNA, 18 nt, Mycobacterium avium subsp. paratuberculosis
gcgucgacggcgccggac

SEQ ID NO: 2957490 - RNA, 14 nt, Mycobacterium avium subsp. paratuberculosis
gcgucgacggcgug

SEQ ID NO: 2957491 - RNA, 16 nt, Mycobacterium avium subsp. paratuberculosis
gcgucgacggcgugga

SEQ ID NO: 2957492 - RNA, 12 nt, Mycobacterium avium subsp. paratuberculosis
gcgucgacgggc

SEQ ID NO: 2957493 - RNA, 19 nt, Mycobacterium avium subsp. paratuberculosis
gcgucgacgucgggcacgg

SEQ ID NO: 2957494 - RNA, 13 nt, Mycobacterium avium subsp. paratuberculosis
gcgucgacguucg

SEQ ID NO: 2957495 - RNA, 17 nt, Mycobacterium avium subsp. paratuberculosis
gcgucgacguucgccgc

SEQ ID NO: 2957496 - RNA, 18 nt, Mycobacterium avium subsp. paratuberculosis
gcgucgacguucgccgcc

SEQ ID NO: 2957497 - RNA, 14 nt, Mycobacterium avium subsp. paratuberculosis
gcgucgacugcacc

SEQ ID NO: 2957498 - RNA, 14 nt, Mycobacterium avium subsp. paratuberculosis
gcgucgagcaccuc

SEQ ID NO: 2957499 - RNA, 13 nt, Mycobacterium avium subsp. paratuberculosis
gcgucgagcagca

SEQ ID NO: 2957500 - RNA, 13 nt, Mycobacterium avium subsp. paratuberculosis
gcgucgagcgcgu

SEQ ID NO: 2957501 - RNA, 17 nt, Mycobacterium avium subsp. paratuberculosis
gcgucgagcguggggcc

SEQ ID NO: 2957502 - RNA, 21 nt, Mycobacterium avium subsp. paratuberculosis
gcgucgagcguggggccuggg

SEQ ID NO: 2957503 - RNA, 14 nt, Mycobacterium avium subsp. paratuberculosis
gcgucgaggucgcg

SEQ ID NO: 2957504 - RNA, 15 nt, Mycobacterium avium subsp. paratuberculosis
gcgucgaggucgcgc

SEQ ID NO: 2957505 - RNA, 16 nt, Mycobacterium avium subsp. paratuberculosis
gcgucgaggucgucgg

SEQ ID NO: 2957506 - RNA, 22 nt, Mycobacterium avium subsp. paratuberculosis
gcgucgaggucgucgggcgccg

SEQ ID NO: 2957507 - RNA, 21 nt, Mycobacterium avium subsp. paratuberculosis
gcgucgaguucgccgucgacg

SEQ ID NO: 2957508 - RNA, 22 nt, Mycobacterium avium subsp. paratuberculosis
gcgucgaguucgccgucgacgg

SEQ ID NO: 2957509 - RNA, 16 nt, Mycobacterium avium subsp. paratuberculosis
gcgucgaucagcgcgc

SEQ ID NO: 2957510 - RNA, 20 nt, Mycobacterium avium subsp. paratuberculosis
gcgucgaucagcgcgccgcc

SEQ ID NO: 2957511 - RNA, 13 nt, Mycobacterium avium subsp. paratuberculosis
gcgucgaucgccg

SEQ ID NO: 2957512 - RNA, 14 nt, Mycobacterium avium subsp. paratuberculosis
gcgucgaucgccgu

SEQ ID NO: 2957513 - RNA, 19 nt, Mycobacterium avium subsp. paratuberculosis
gcgucgaucgccgucacgu

SEQ ID NO: 2957514 - RNA, 19 nt, Mycobacterium avium subsp. paratuberculosis
gcgucgaugaccucgcgca

SEQ ID NO: 2957515 - RNA, 21 nt, Mycobacterium avium subsp. paratuberculosis
gcgucgaugaccucgcgcagc

SEQ ID NO: 2957516 - RNA, 23 nt, Mycobacterium avium subsp. paratuberculosis
gcgucgaugaugccggcggacag

SEQ ID NO: 2957517 - RNA, 14 nt, Mycobacterium avium subsp. paratuberculosis
gcgucgaugccgau

SEQ ID NO: 2957518 - RNA, 23 nt, Mycobacterium avium subsp. paratuberculosis
gcgucgaugccggcgauccgcgc

SEQ ID NO: 2957519 - RNA, 14 nt, Mycobacterium avium subsp. paratuberculosis
gcgucgaugcgcgc

SEQ ID NO: 2957520 - RNA, 16 nt, Mycobacterium avium subsp. paratuberculosis
gcgucgaugcgcgcca

SEQ ID NO: 2957521 - RNA, 18 nt, Mycobacterium avium subsp. paratuberculosis
gcgucgaugcgcgccacc

SEQ ID NO: 2957522 - RNA, 19 nt, Mycobacterium avium subsp. paratuberculosis
gcgucgaugcgcgccacca

SEQ ID NO: 2957523 - RNA, 22 nt, Mycobacterium avium subsp. paratuberculosis
gcgucgaugcgcgccaccaggc

SEQ ID NO: 2957524 - RNA, 23 nt, Mycobacterium avium subsp. paratuberculosis
gcgucgaugcgcgccaccaggcg

SEQ ID NO: 2957525 - RNA, 15 nt, Mycobacterium avium subsp. paratuberculosis
gcgucgaugcgggcc

SEQ ID NO: 2957526 - RNA, 19 nt, Mycobacterium avium subsp. paratuberculosis
gcgucgaugcgggcccgca

SEQ ID NO: 2957527 - RNA, 17 nt, Mycobacterium avium subsp. paratuberculosis
gcgucgaugcgugacac

SEQ ID NO: 2957528 - RNA, 20 nt, Mycobacterium avium subsp. paratuberculosis
gcgucgauggaaggugcuga

SEQ ID NO: 2957529 - RNA, 15 nt, Mycobacterium avium subsp. paratuberculosis
gcgucgaugucgccc

SEQ ID NO: 2957530 - RNA, 18 nt, Mycobacterium avium subsp. paratuberculosis
gcgucgaugucgcccggc

SEQ ID NO: 2957531 - RNA, 21 nt, Mycobacterium avium subsp. paratuberculosis
gcgucgaugucgcccggcgcg

SEQ ID NO: 2957532 - RNA, 15 nt, Mycobacterium avium subsp. paratuberculosis
gcgucggacgccagu

SEQ ID NO: 2957533 - RNA, 16 nt, Mycobacterium avium subsp. paratuberculosis
gcgucggaggccauga

SEQ ID NO: 2957534 - RNA, 18 nt, Mycobacterium avium subsp. paratuberculosis
gcgucggagucgcuguug

SEQ ID NO: 2957535 - RNA, 13 nt, Mycobacterium avium subsp. paratuberculosis
gcgucggcaauga

SEQ ID NO: 2957536 - RNA, 20 nt, Mycobacterium avium subsp. paratuberculosis
gcgucggcaaugaccggcac

SEQ ID NO: 2957537 - RNA, 15 nt, Mycobacterium avium subsp. paratuberculosis
gcgucggcaccagcg

SEQ ID NO: 2957538 - RNA, 17 nt, Mycobacterium avium subsp. paratuberculosis
gcgucggccaccgcgcc

SEQ ID NO: 2957539 - RNA, 19 nt, Mycobacterium avium subsp. paratuberculosis
gcgucggccaccgcgccuu

SEQ ID NO: 2957540 - RNA, 14 nt, Mycobacterium avium subsp. paratuberculosis
gcgucggccagcac

SEQ ID NO: 2957541 - RNA, 17 nt, Mycobacterium avium subsp. paratuberculosis
gcgucggccagcaccac

SEQ ID NO: 2957542 - RNA, 14 nt, Mycobacterium avium subsp. paratuberculosis
gcgucggccagcgc

SEQ ID NO: 2957543 - RNA, 15 nt, Mycobacterium avium subsp. paratuberculosis
gcgucggccagcgcg

SEQ ID NO: 2957544 - RNA, 15 nt, Mycobacterium avium subsp. paratuberculosis
gcgucggccagcggc

SEQ ID NO: 2957545 - RNA, 18 nt, Mycobacterium avium subsp. paratuberculosis
gcgucggccagcggcagc

SEQ ID NO: 2957546 - RNA, 12 nt, Mycobacterium avium subsp. paratuberculosis
gcgucggccccc

SEQ ID NO: 2957547 - RNA, 13 nt, Mycobacterium avium subsp. paratuberculosis
gcgucggccccca

SEQ ID NO: 2957548 - RNA, 15 nt, Mycobacterium avium subsp. paratuberculosis
gcgucggccgggcug

SEQ ID NO: 2957549 - RNA, 16 nt, Mycobacterium avium subsp. paratuberculosis
gcgucggccugcccgc

SEQ ID NO: 2957550 - RNA, 20 nt, Mycobacterium avium subsp. paratuberculosis
gcgucggccugcccgcgggu

SEQ ID NO: 2957551 - RNA, 21 nt, Mycobacterium avium subsp. paratuberculosis
gcgucggccugcccgcgggug

SEQ ID NO: 2957552 - RNA, 13 nt, Mycobacterium avium subsp. paratuberculosis
gcgucggcgaccg

SEQ ID NO: 2957553 - RNA, 16 nt, Mycobacterium avium subsp. paratuberculosis
gcgucggcgaccgcgc

SEQ ID NO: 2957554 - RNA, 17 nt, Mycobacterium avium subsp. paratuberculosis
gcgucggcgaccgcgcg

SEQ ID NO: 2957555 - RNA, 15 nt, Mycobacterium avium subsp. paratuberculosis
gcgucggcgacggcg

SEQ ID NO: 2957556 - RNA, 20 nt, Mycobacterium avium subsp. paratuberculosis
gcgucggcgacggcguccag

SEQ ID NO: 2957557 - RNA, 12 nt, Mycobacterium avium subsp. paratuberculosis
gcgucggcgauc

SEQ ID NO: 2957558 - RNA, 22 nt, Mycobacterium avium subsp. paratuberculosis
gcgucggcgaucucggucaccg

SEQ ID NO: 2957559 - RNA, 14 nt, Mycobacterium avium subsp. paratuberculosis
gcgucggcgccccc

SEQ ID NO: 2957560 - RNA, 12 nt, Mycobacterium avium subsp. paratuberculosis
gcgucggcgccg

SEQ ID NO: 2957561 - RNA, 19 nt, Mycobacterium avium subsp. paratuberculosis
gcgucggcgccggaucggc

SEQ ID NO: 2957562 - RNA, 17 nt, Mycobacterium avium subsp. paratuberculosis
gcgucggcgccggccaa

SEQ ID NO: 2957563 - RNA, 19 nt, Mycobacterium avium subsp. paratuberculosis
gcgucggcgccguagucga

SEQ ID NO: 2957564 - RNA, 12 nt, Mycobacterium avium subsp. paratuberculosis
gcgucggcgcgc

SEQ ID NO: 2957565 - RNA, 18 nt, Mycobacterium avium subsp. paratuberculosis
gcgucggcgcgcaccgcg

SEQ ID NO: 2957566 - RNA, 13 nt, Mycobacterium avium subsp. paratuberculosis
gcgucggcgcgug

SEQ ID NO: 2957567 - RNA, 17 nt, Mycobacterium avium subsp. paratuberculosis
gcgucggcgcuggccag

SEQ ID NO: 2957568 - RNA, 18 nt, Mycobacterium avium subsp. paratuberculosis
gcgucggcgcuggccagc

SEQ ID NO: 2957569 - RNA, 13 nt, Mycobacterium avium subsp. paratuberculosis
gcgucggcggccu

SEQ ID NO: 2957570 - RNA, 22 nt, Mycobacterium avium subsp. paratuberculosis
gcgucggcggccugcuccagcg

SEQ ID NO: 2957571 - RNA, 20 nt, Mycobacterium avium subsp. paratuberculosis
gcgucggcggccugcucgca

SEQ ID NO: 2957572 - RNA, 13 nt, Mycobacterium avium subsp. paratuberculosis
gcgucggcggcgg

SEQ ID NO: 2957573 - RNA, 15 nt, Mycobacterium avium subsp. paratuberculosis
gcgucggcggcggcg

SEQ ID NO: 2957574 - RNA, 20 nt, Mycobacterium avium subsp. paratuberculosis
gcgucggcggcggcggccgc

SEQ ID NO: 2957575 - RNA, 13 nt, Mycobacterium avium subsp. paratuberculosis
gcgucggcgggcg

SEQ ID NO: 2957576 - RNA, 13 nt, Mycobacterium avium subsp. paratuberculosis
gcgucggcggucg

SEQ ID NO: 2957577 - RNA, 18 nt, Mycobacterium avium subsp. paratuberculosis
gcgucggcggucgccagc

SEQ ID NO: 2957578 - RNA, 17 nt, Mycobacterium avium subsp. paratuberculosis
gcgucggcggugguccg

SEQ ID NO: 2957579 - RNA, 22 nt, Mycobacterium avium subsp. paratuberculosis
gcgucggcggugguccgcgcga

SEQ ID NO: 2957580 - RNA, 23 nt, Mycobacterium avium subsp. paratuberculosis
gcgucggcggugguccgcgcgac

SEQ ID NO: 2957581 - RNA, 18 nt, Mycobacterium avium subsp. paratuberculosis
gcgucggcguagggcagc

SEQ ID NO: 2957582 - RNA, 12 nt, Mycobacterium avium subsp. paratuberculosis
gcgucggcgucg

SEQ ID NO: 2957583 - RNA, 13 nt, Mycobacterium avium subsp. paratuberculosis
gcgucggcgucga

SEQ ID NO: 2957584 - RNA, 16 nt, Mycobacterium avium subsp. paratuberculosis
gcgucggcgucgggcg

SEQ ID NO: 2957585 - RNA, 17 nt, Mycobacterium avium subsp. paratuberculosis
gcgucggcgucgggcgg

SEQ ID NO: 2957586 - RNA, 18 nt, Mycobacterium avium subsp. paratuberculosis
gcgucggcgugcccgccg

SEQ ID NO: 2957587 - RNA, 20 nt, Mycobacterium avium subsp. paratuberculosis
gcgucggcgugcccgccgac

SEQ ID NO: 2957588 - RNA, 18 nt, Mycobacterium avium subsp. paratuberculosis
gcgucgggaccgucgcgc

SEQ ID NO: 2957589 - RNA, 21 nt, Mycobacterium avium subsp. paratuberculosis
gcgucgggaccgucgcgcagc

SEQ ID NO: 2957590 - RNA, 16 nt, Mycobacterium avium subsp. paratuberculosis
gcgucgggauggucga

SEQ ID NO: 2957591 - RNA, 13 nt, Mycobacterium avium subsp. paratuberculosis
gcgucgggcaccu

SEQ ID NO: 2957592 - RNA, 20 nt, Mycobacterium avium subsp. paratuberculosis
gcgucgggcaccugauaggg

SEQ ID NO: 2957593 - RNA, 20 nt, Mycobacterium avium subsp. paratuberculosis
gcgucgggccgggggcggcg

SEQ ID NO: 2957594 - RNA, 13 nt, Mycobacterium avium subsp. paratuberculosis
gcgucgggcgccg

SEQ ID NO: 2957595 - RNA, 15 nt, Mycobacterium avium subsp. paratuberculosis
gcgucgggcgccggc

SEQ ID NO: 2957596 - RNA, 17 nt, Mycobacterium avium subsp. paratuberculosis
gcgucgggcgccggcgc

SEQ ID NO: 2957597 - RNA, 18 nt, Mycobacterium avium subsp. paratuberculosis
gcgucgggcgccggcgcg

SEQ ID NO: 2957598 - RNA, 19 nt, Mycobacterium avium subsp. paratuberculosis
gcgucgggcgccggcgcgu

SEQ ID NO: 2957599 - RNA, 20 nt, Mycobacterium avium subsp. paratuberculosis
gcgucgggcgccggcgcguc

SEQ ID NO: 2957600 - RNA, 15 nt, Mycobacterium avium subsp. paratuberculosis
gcgucgggcggggug

SEQ ID NO: 2957601 - RNA, 22 nt, Mycobacterium avium subsp. paratuberculosis
gcgucgggcucgccucggggau

SEQ ID NO: 2957602 - RNA, 14 nt, Mycobacterium avium subsp. paratuberculosis
gcgucgggcucgcg

SEQ ID NO: 2957603 - RNA, 14 nt, Mycobacterium avium subsp. paratuberculosis
gcgucgggcucggc

SEQ ID NO: 2957604 - RNA, 11 nt, Mycobacterium avium subsp. paratuberculosis
gcgucgggggu

SEQ ID NO: 2957605 - RNA, 15 nt, Mycobacterium avium subsp. paratuberculosis
gcgucgggggugccg

SEQ ID NO: 2957606 - RNA, 20 nt, Mycobacterium avium subsp. paratuberculosis
gcgucgggggugccgcuccg

SEQ ID NO: 2957607 - RNA, 23 nt, Mycobacterium avium subsp. paratuberculosis
gcgucggguacaccgagccgggg

SEQ ID NO: 2957608 - RNA, 15 nt, Mycobacterium avium subsp. paratuberculosis
gcgucgguagguguc

SEQ ID NO: 2957609 - RNA, 18 nt, Mycobacterium avium subsp. paratuberculosis
gcgucgguaggugucgau

SEQ ID NO: 2957610 - RNA, 19 nt, Mycobacterium avium subsp. paratuberculosis
gcgucgguaggugucgaug

SEQ ID NO: 2957611 - RNA, 18 nt, Mycobacterium avium subsp. paratuberculosis
gcgucggucagcaggcgc

SEQ ID NO: 2957612 - RNA, 22 nt, Mycobacterium avium subsp. paratuberculosis
gcgucggucagcaggcgccgca

SEQ ID NO: 2957613 - RNA, 14 nt, Mycobacterium avium subsp. paratuberculosis
gcgucggucagcgc

SEQ ID NO: 2957614 - RNA, 16 nt, Mycobacterium avium subsp. paratuberculosis
gcgucggucagcgcca

SEQ ID NO: 2957615 - RNA, 17 nt, Mycobacterium avium subsp. paratuberculosis
gcgucggucagcgccac

SEQ ID NO: 2957616 - RNA, 19 nt, Mycobacterium avium subsp. paratuberculosis
gcgucggucucgacguugg

SEQ ID NO: 2957617 - RNA, 23 nt, Mycobacterium avium subsp. paratuberculosis
gcgucucgccggggaacaccggc

SEQ ID NO: 2957618 - RNA, 13 nt, Mycobacterium avium subsp. paratuberculosis
gcgucucggcgau

SEQ ID NO: 2957619 - RNA, 21 nt, Mycobacterium avium subsp. paratuberculosis
gcgucucggcgaucagcugcc

SEQ ID NO: 2957620 - RNA, 22 nt, Mycobacterium avium subsp. paratuberculosis
gcgucucggcgaucagcugccc

SEQ ID NO: 2957621 - RNA, 19 nt, Mycobacterium avium subsp. paratuberculosis
gcgucucggcggccgagcg

SEQ ID NO: 2957622 - RNA, 17 nt, Mycobacterium avium subsp. paratuberculosis
gcgucucggcgucucgg

SEQ ID NO: 2957623 - RNA, 18 nt, Mycobacterium avium subsp. paratuberculosis
gcgucucggcgucucggc

SEQ ID NO: 2957624 - RNA, 21 nt, Mycobacterium avium subsp. paratuberculosis
gcgucugcauccggaaccggg

SEQ ID NO: 2957625 - RNA, 16 nt, Mycobacterium avium subsp. paratuberculosis
gcgucugcgccagcug

SEQ ID NO: 2957626 - RNA, 19 nt, Mycobacterium avium subsp. paratuberculosis
gcgucugcgccagcugggu

SEQ ID NO: 2957627 - RNA, 18 nt, Mycobacterium avium subsp. paratuberculosis
gcgucugcgccccggcgu

SEQ ID NO: 2957628 - RNA, 20 nt, Mycobacterium avium subsp. paratuberculosis
gcgucugcgccccggcgucg

SEQ ID NO: 2957629 - RNA, 12 nt, Mycobacterium avium subsp. paratuberculosis
gcgucugcucgc

SEQ ID NO: 2957630 - RNA, 14 nt, Mycobacterium avium subsp. paratuberculosis
gcgucugcucgccg

SEQ ID NO: 2957631 - RNA, 16 nt, Mycobacterium avium subsp. paratuberculosis
gcgucugcucgccggc

SEQ ID NO: 2957632 - RNA, 15 nt, Mycobacterium avium subsp. paratuberculosis
gcgucugcucgccgu

SEQ ID NO: 2957633 - RNA, 17 nt, Mycobacterium avium subsp. paratuberculosis
gcgucugcucgccguca

SEQ ID NO: 2957634 - RNA, 15 nt, Mycobacterium avium subsp. paratuberculosis
gcgucugcucgcgcc

SEQ ID NO: 2957635 - RNA, 16 nt, Mycobacterium avium subsp. paratuberculosis
gcgucugcucgcgccc

SEQ ID NO: 2957636 - RNA, 17 nt, Mycobacterium avium subsp. paratuberculosis
gcgucugcucgcgguuc

SEQ ID NO: 2957637 - RNA, 13 nt, Mycobacterium avium subsp. paratuberculosis
gcgucugcucggc

SEQ ID NO: 2957638 - RNA, 15 nt, Mycobacterium avium subsp. paratuberculosis
gcgucugcucggcgg

SEQ ID NO: 2957639 - RNA, 16 nt, Mycobacterium avium subsp. paratuberculosis
gcgucugcucggcggc

SEQ ID NO: 2957640 - RNA, 18 nt, Mycobacterium avium subsp. paratuberculosis
gcgucugcucggcggcuc

SEQ ID NO: 2957641 - RNA, 15 nt, Mycobacterium avium subsp. paratuberculosis
gcgucuggcagccgg

SEQ ID NO: 2957642 - RNA, 17 nt, Mycobacterium avium subsp. paratuberculosis
gcgucuggcagccggcc

SEQ ID NO: 2957643 - RNA, 18 nt, Mycobacterium avium subsp. paratuberculosis
gcgucuggcagccggccg

SEQ ID NO: 2957644 - RNA, 20 nt, Mycobacterium avium subsp. paratuberculosis
gcgucuggcagccggccggc

SEQ ID NO: 2957645 - RNA, 21 nt, Mycobacterium avium subsp. paratuberculosis
gcgucuggcagccggccggca

SEQ ID NO: 2957646 - RNA, 14 nt, Mycobacterium avium subsp. paratuberculosis
gcgucuggccggag

SEQ ID NO: 2957647 - RNA, 21 nt, Mycobacterium avium subsp. paratuberculosis
gcgucuggccggagcggugcg

SEQ ID NO: 2957648 - RNA, 15 nt, Mycobacterium avium subsp. paratuberculosis
gcgucugugguggcg

SEQ ID NO: 2957649 - RNA, 17 nt, Mycobacterium avium subsp. paratuberculosis
gcgucuucuucucgccg

SEQ ID NO: 2957650 - RNA, 16 nt, Mycobacterium avium subsp. paratuberculosis
gcgucuugacgaacuc

SEQ ID NO: 2957651 - RNA, 14 nt, Mycobacterium avium subsp. paratuberculosis
gcgucuugcccagc

SEQ ID NO: 2957652 - RNA, 20 nt, Mycobacterium avium subsp. paratuberculosis
gcgucuugcccagcggggcg

SEQ ID NO: 2957653 - RNA, 21 nt, Mycobacterium avium subsp. paratuberculosis
gcgucuuggacgcccgcgacc

SEQ ID NO: 2957654 - RNA, 17 nt, Mycobacterium avium subsp. paratuberculosis
gcgucuuggacgcccgg

SEQ ID NO: 2957655 - RNA, 18 nt, Mycobacterium avium subsp. paratuberculosis
gcgucuuggacgcccggu

SEQ ID NO: 2957656 - RNA, 22 nt, Mycobacterium avium subsp. paratuberculosis
gcgucuuggggaugguccccgg

SEQ ID NO: 2957657 - RNA, 16 nt, Mycobacterium avium subsp. paratuberculosis
gcgucuuuucccacac

SEQ ID NO: 2957658 - RNA, 23 nt, Mycobacterium avium subsp. paratuberculosis
gcgucuuuucccacacgcucggc

SEQ ID NO: 2957659 - RNA, 22 nt, Mycobacterium avium subsp. paratuberculosis
gcgugaaaucguggcuuucggc

SEQ ID NO: 2957660 - RNA, 14 nt, Mycobacterium avium subsp. paratuberculosis
gcgugaacaccgcg

SEQ ID NO: 2957661 - RNA, 18 nt, Mycobacterium avium subsp. paratuberculosis
gcgugaacaccgcguugg

SEQ ID NO: 2957662 - RNA, 19 nt, Mycobacterium avium subsp. paratuberculosis
gcgugaacaccgcguuggc

SEQ ID NO: 2957663 - RNA, 19 nt, Mycobacterium avium subsp. paratuberculosis
gcgugaacagcgcccggcc

SEQ ID NO: 2957664 - RNA, 21 nt, Mycobacterium avium subsp. paratuberculosis
gcgugaacagcgcccggccgu

SEQ ID NO: 2957665 - RNA, 20 nt, Mycobacterium avium subsp. paratuberculosis
gcgugaacuuaacuucacgc

SEQ ID NO: 2957666 - RNA, 23 nt, Mycobacterium avium subsp. paratuberculosis
gcgugaacuuaacuucacgcucg

SEQ ID NO: 2957667 - RNA, 24 nt, Mycobacterium avium subsp. paratuberculosis
gcgugaacuuaacuucacgcucgg

SEQ ID NO: 2957668 - RNA, 20 nt, Mycobacterium avium subsp. paratuberculosis
gcgugaagcuagcuucacgc

SEQ ID NO: 2957669 - RNA, 20 nt, Mycobacterium avium subsp. paratuberculosis
gcgugaaguuaacuucacgc

SEQ ID NO: 2957670 - RNA, 19 nt, Mycobacterium avium subsp. paratuberculosis
gcgugaauccucagcacgg

SEQ ID NO: 2957671 - RNA, 19 nt, Mycobacterium avium subsp. paratuberculosis
gcgugaaucuuggccagca

SEQ ID NO: 2957672 - RNA, 17 nt, Mycobacterium avium subsp. paratuberculosis
gcgugaaugcccagcgg

SEQ ID NO: 2957673 - RNA, 20 nt, Mycobacterium avium subsp. paratuberculosis
gcgugacaagccggcgucga

SEQ ID NO: 2957674 - RNA, 23 nt, Mycobacterium avium subsp. paratuberculosis
gcgugacaagccggcgucgauga

SEQ ID NO: 2957675 - RNA, 16 nt, Mycobacterium avium subsp. paratuberculosis
gcgugacaggggcagc

SEQ ID NO: 2957676 - RNA, 17 nt, Mycobacterium avium subsp. paratuberculosis
gcgugacaggggcagca

SEQ ID NO: 2957677 - RNA, 22 nt, Mycobacterium avium subsp. paratuberculosis
gcgugacaggggcagcagcaga

SEQ ID NO: 2957678 - RNA, 19 nt, Mycobacterium avium subsp. paratuberculosis
gcgugacagucgaccucgc

SEQ ID NO: 2957679 - RNA, 13 nt, Mycobacterium avium subsp. paratuberculosis
gcgugaccccggc

SEQ ID NO: 2957680 - RNA, 14 nt, Mycobacterium avium subsp. paratuberculosis
gcgugaccccggcg

SEQ ID NO: 2957681 - RNA, 16 nt, Mycobacterium avium subsp. paratuberculosis
gcgugaccccggcgac

SEQ ID NO: 2957682 - RNA, 22 nt, Mycobacterium avium subsp. paratuberculosis
gcgugaccccggcgaccagcag

SEQ ID NO: 2957683 - RNA, 15 nt, Mycobacterium avium subsp. paratuberculosis
gcgugacccugccgu

SEQ ID NO: 2957684 - RNA, 22 nt, Mycobacterium avium subsp. paratuberculosis
gcgugacccugccgucaccggc

SEQ ID NO: 2957685 - RNA, 16 nt, Mycobacterium avium subsp. paratuberculosis
gcgugaccggcggugc

SEQ ID NO: 2957686 - RNA, 19 nt, Mycobacterium avium subsp. paratuberculosis
gcgugaccggcggugcgga

SEQ ID NO: 2957687 - RNA, 20 nt, Mycobacterium avium subsp. paratuberculosis
gcgugaccggcggugcggac

SEQ ID NO: 2957688 - RNA, 13 nt, Mycobacterium avium subsp. paratuberculosis
gcgugaccggcug

SEQ ID NO: 2957689 - RNA, 23 nt, Mycobacterium avium subsp. paratuberculosis
gcgugaccgggaaguagggcagc

SEQ ID NO: 2957690 - RNA, 16 nt, Mycobacterium avium subsp. paratuberculosis
gcgugaccucgacggu

SEQ ID NO: 2957691 - RNA, 14 nt, Mycobacterium avium subsp. paratuberculosis
gcgugaccugcugg

SEQ ID NO: 2957692 - RNA, 13 nt, Mycobacterium avium subsp. paratuberculosis
gcgugacgcccgg

SEQ ID NO: 2957693 - RNA, 14 nt, Mycobacterium avium subsp. paratuberculosis
gcgugacgcccggc

SEQ ID NO: 2957694 - RNA, 17 nt, Mycobacterium avium subsp. paratuberculosis
gcgugacgcccggcgcc

SEQ ID NO: 2957695 - RNA, 19 nt, Mycobacterium avium subsp. paratuberculosis
gcgugacgcccggcgccgg

SEQ ID NO: 2957696 - RNA, 22 nt, Mycobacterium avium subsp. paratuberculosis
gcgugacgcccggcgccggcgg

SEQ ID NO: 2957697 - RNA, 18 nt, Mycobacterium avium subsp. paratuberculosis
gcgugacgccgcugcgug

SEQ ID NO: 2957698 - RNA, 12 nt, Mycobacterium avium subsp. paratuberculosis
gcgugacgccgg

SEQ ID NO: 2957699 - RNA, 19 nt, Mycobacterium avium subsp. paratuberculosis
gcgugacgccgggccgccg

SEQ ID NO: 2957700 - RNA, 12 nt, Mycobacterium avium subsp. paratuberculosis
gcgugacgcucg

SEQ ID NO: 2957701 - RNA, 14 nt, Mycobacterium avium subsp. paratuberculosis
gcgugccgcccgga

SEQ ID NO: 2957702 - RNA, 16 nt, Mycobacterium avium subsp. paratuberculosis
gcgugccgcccggacc

SEQ ID NO: 2957703 - RNA, 12 nt, Mycobacterium avium subsp. paratuberculosis
gcgugccgccgg

SEQ ID NO: 2957704 - RNA, 18 nt, Mycobacterium avium subsp. paratuberculosis
gcgugccggacaccggca

SEQ ID NO: 2957705 - RNA, 13 nt, Mycobacterium avium subsp. paratuberculosis
gcgugccggcccg

SEQ ID NO: 2957706 - RNA, 17 nt, Mycobacterium avium subsp. paratuberculosis
gcgugccggcccggcgg

SEQ ID NO: 2957707 - RNA, 16 nt, Mycobacterium avium subsp. paratuberculosis
gcgugccggcgcugcc

SEQ ID NO: 2957708 - RNA, 15 nt, Mycobacterium avium subsp. paratuberculosis
gcgugccggcggcgg

SEQ ID NO: 2957709 - RNA, 20 nt, Mycobacterium avium subsp. paratuberculosis
gcgugccgggauagccggau

SEQ ID NO: 2957710 - RNA, 20 nt, Mycobacterium avium subsp. paratuberculosis
gcgugccgggcgguacgcgc

SEQ ID NO: 2957711 - RNA, 15 nt, Mycobacterium avium subsp. paratuberculosis
gcgugccguccagcu

SEQ ID NO: 2957712 - RNA, 16 nt, Mycobacterium avium subsp. paratuberculosis
gcgugccuugcaccca

SEQ ID NO: 2957713 - RNA, 20 nt, Mycobacterium avium subsp. paratuberculosis
gcgugccuugcacccagcgg

SEQ ID NO: 2957714 - RNA, 17 nt, Mycobacterium avium subsp. paratuberculosis
gcgugcgaaugacgcgc

SEQ ID NO: 2957715 - RNA, 16 nt, Mycobacterium avium subsp. paratuberculosis
gcgugcgagccgagca

SEQ ID NO: 2957716 - RNA, 17 nt, Mycobacterium avium subsp. paratuberculosis
gcgugcgagccgagcac

SEQ ID NO: 2957717 - RNA, 19 nt, Mycobacterium avium subsp. paratuberculosis
gcgugcgagccgagcacgc

SEQ ID NO: 2957718 - RNA, 12 nt, Mycobacterium avium subsp. paratuberculosis
gcgugcgcccga

SEQ ID NO: 2957719 - RNA, 11 nt, Mycobacterium avium subsp. paratuberculosis
gcgugcgccgc

SEQ ID NO: 2957720 - RNA, 13 nt, Mycobacterium avium subsp. paratuberculosis
gcgugcgccgcgg

SEQ ID NO: 2957721 - RNA, 14 nt, Mycobacterium avium subsp. paratuberculosis
gcgugcgccgcggc

SEQ ID NO: 2957722 - RNA, 17 nt, Mycobacterium avium subsp. paratuberculosis
gcgugcgccgcggcggc

SEQ ID NO: 2957723 - RNA, 18 nt, Mycobacterium avium subsp. paratuberculosis
gcgugcgccgcggcggcu

SEQ ID NO: 2957724 - RNA, 13 nt, Mycobacterium avium subsp. paratuberculosis
gcgugcgcgacga

SEQ ID NO: 2957725 - RNA, 17 nt, Mycobacterium avium subsp. paratuberculosis
gcgugcgcggccgccca

SEQ ID NO: 2957726 - RNA, 17 nt, Mycobacterium avium subsp. paratuberculosis
gcgugcgcguggguguc

SEQ ID NO: 2957727 - RNA, 18 nt, Mycobacterium avium subsp. paratuberculosis
gcgugcgcucgaccucgg

SEQ ID NO: 2957728 - RNA, 22 nt, Mycobacterium avium subsp. paratuberculosis
gcgugcggccgcagcgcccggc

SEQ ID NO: 2957729 - RNA, 12 nt, Mycobacterium avium subsp. paratuberculosis
gcgugcggccuc

SEQ ID NO: 2957730 - RNA, 20 nt, Mycobacterium avium subsp. paratuberculosis
gcgugcggccucggcaccgu

SEQ ID NO: 2957731 - RNA, 14 nt, Mycobacterium avium subsp. paratuberculosis
gcgugcggcgcggu

SEQ ID NO: 2957732 - RNA, 11 nt, Mycobacterium avium subsp. paratuberculosis
gcgugcgggug

SEQ ID NO: 2957733 - RNA, 20 nt, Mycobacterium avium subsp. paratuberculosis
gcgugcggguggccgggucg

SEQ ID NO: 2957734 - RNA, 17 nt, Mycobacterium avium subsp. paratuberculosis
gcgugcggucgcgggac

SEQ ID NO: 2957735 - RNA, 16 nt, Mycobacterium avium subsp. paratuberculosis
gcgugcgguggucggc

SEQ ID NO: 2957736 - RNA, 20 nt, Mycobacterium avium subsp. paratuberculosis
gcgugcgguuggcccgcggc

SEQ ID NO: 2957737 - RNA, 16 nt, Mycobacterium avium subsp. paratuberculosis
gcgugcgucacgcugg

SEQ ID NO: 2957738 - RNA, 17 nt, Mycobacterium avium subsp. paratuberculosis
gcgugcgucaucgcgcu

SEQ ID NO: 2957739 - RNA, 13 nt, Mycobacterium avium subsp. paratuberculosis
gcgugcucgaucg

SEQ ID NO: 2957740 - RNA, 21 nt, Mycobacterium avium subsp. paratuberculosis
gcgugcucgaucgcguucugc

SEQ ID NO: 2957741 - RNA, 14 nt, Mycobacterium avium subsp. paratuberculosis
gcgugcucgaugaa

SEQ ID NO: 2957742 - RNA, 21 nt, Mycobacterium avium subsp. paratuberculosis
gcgugcucggaguaguccagc

SEQ ID NO: 2957743 - RNA, 15 nt, Mycobacterium avium subsp. paratuberculosis
gcgugcucggccacg

SEQ ID NO: 2957744 - RNA, 18 nt, Mycobacterium avium subsp. paratuberculosis
gcgugcucgucgcggagg

SEQ ID NO: 2957745 - RNA, 18 nt, Mycobacterium avium subsp. paratuberculosis
gcgugcugacgucgucgc

SEQ ID NO: 2957746 - RNA, 21 nt, Mycobacterium avium subsp. paratuberculosis
gcgugcugacgucgucgccca

SEQ ID NO: 2957747 - RNA, 17 nt, Mycobacterium avium subsp. paratuberculosis
gcgugcugggcaccguc

SEQ ID NO: 2957748 - RNA, 17 nt, Mycobacterium avium subsp. paratuberculosis
gcgugcuguugcaggug

SEQ ID NO: 2957749 - RNA, 21 nt, Mycobacterium avium subsp. paratuberculosis
gcgugcuguugcaggugcgcg

SEQ ID NO: 2957750 - RNA, 20 nt, Mycobacterium avium subsp. paratuberculosis
gcgugcuugaacgccgcccc

SEQ ID NO: 2957751 - RNA, 13 nt, Mycobacterium avium subsp. paratuberculosis
gcgugcuugccga

SEQ ID NO: 2957752 - RNA, 16 nt, Mycobacterium avium subsp. paratuberculosis
gcgugcuugccgaugu

SEQ ID NO: 2957753 - RNA, 20 nt, Mycobacterium avium subsp. paratuberculosis
gcgugcuuuugcgucugcuc

SEQ ID NO: 2957754 - RNA, 22 nt, Mycobacterium avium subsp. paratuberculosis
gcgugcuuuugcgucugcucgc

SEQ ID NO: 2957755 - RNA, 18 nt, Mycobacterium avium subsp. paratuberculosis
gcguggaacacgcccagc

SEQ ID NO: 2957756 - RNA, 21 nt, Mycobacterium avium subsp. paratuberculosis
gcguggaacacgcccagcgcc

SEQ ID NO: 2957757 - RNA, 19 nt, Mycobacterium avium subsp. paratuberculosis
gcguggaacgcgucgcgcc

SEQ ID NO: 2957758 - RNA, 20 nt, Mycobacterium avium subsp. paratuberculosis
gcguggaacgcgucgcgcca

SEQ ID NO: 2957759 - RNA, 21 nt, Mycobacterium avium subsp. paratuberculosis
gcguggaacgcgucgcgccag

SEQ ID NO: 2957760 - RNA, 16 nt, Mycobacterium avium subsp. paratuberculosis
gcguggacaccgcacc

SEQ ID NO: 2957761 - RNA, 20 nt, Mycobacterium avium subsp. paratuberculosis
gcguggacaccgcacccaga

SEQ ID NO: 2957762 - RNA, 15 nt, Mycobacterium avium subsp. paratuberculosis
gcguggauggccggc

SEQ ID NO: 2957763 - RNA, 17 nt, Mycobacterium avium subsp. paratuberculosis
gcguggcaauucgaccg

SEQ ID NO: 2957764 - RNA, 19 nt, Mycobacterium avium subsp. paratuberculosis
gcguggcaauucgaccguc

SEQ ID NO: 2957765 - RNA, 16 nt, Mycobacterium avium subsp. paratuberculosis
gcguggcacccgggcg

SEQ ID NO: 2957766 - RNA, 18 nt, Mycobacterium avium subsp. paratuberculosis
gcguggcagcggucggcg

SEQ ID NO: 2957767 - RNA, 18 nt, Mycobacterium avium subsp. paratuberculosis
gcguggcaggccaucagc

SEQ ID NO: 2957768 - RNA, 19 nt, Mycobacterium avium subsp. paratuberculosis
gcguggcaggccaucagcc

SEQ ID NO: 2957769 - RNA, 19 nt, Mycobacterium avium subsp. paratuberculosis
gcguggcaggcgauggcgu

SEQ ID NO: 2957770 - RNA, 15 nt, Mycobacterium avium subsp. paratuberculosis
gcguggcccagccgg

SEQ ID NO: 2957771 - RNA, 16 nt, Mycobacterium avium subsp. paratuberculosis
gcguggcccagccggu

SEQ ID NO: 2957772 - RNA, 18 nt, Mycobacterium avium subsp. paratuberculosis
gcguggcccagccggugc

SEQ ID NO: 2957773 - RNA, 12 nt, Mycobacterium avium subsp. paratuberculosis
gcguggccggca

SEQ ID NO: 2957774 - RNA, 13 nt, Mycobacterium avium subsp. paratuberculosis
gcguggccggcag

SEQ ID NO: 2957775 - RNA, 15 nt, Mycobacterium avium subsp. paratuberculosis
gcguggccucccggu

SEQ ID NO: 2957776 - RNA, 19 nt, Mycobacterium avium subsp. paratuberculosis
gcguggccugggcgaccag

SEQ ID NO: 2957777 - RNA, 14 nt, Mycobacterium avium subsp. paratuberculosis
gcguggcgcacagc

SEQ ID NO: 2957778 - RNA, 13 nt, Mycobacterium avium subsp. paratuberculosis
gcguggcgccggc

SEQ ID NO: 2957779 - RNA, 14 nt, Mycobacterium avium subsp. paratuberculosis
gcguggcgccggcg

SEQ ID NO: 2957780 - RNA, 14 nt, Mycobacterium avium subsp. paratuberculosis
gcguggcgcgcccc

SEQ ID NO: 2957781 - RNA, 17 nt, Mycobacterium avium subsp. paratuberculosis
gcguggcggaagcgcgu

SEQ ID NO: 2957782 - RNA, 23 nt, Mycobacterium avium subsp. paratuberculosis
gcguggcggaagcgcguucaggg

SEQ ID NO: 2957783 - RNA, 14 nt, Mycobacterium avium subsp. paratuberculosis
gcguggcgggccag

SEQ ID NO: 2957784 - RNA, 17 nt, Mycobacterium avium subsp. paratuberculosis
gcguggcgggccaggcg

SEQ ID NO: 2957785 - RNA, 19 nt, Mycobacterium avium subsp. paratuberculosis
gcguggcggucggugcgca

SEQ ID NO: 2957786 - RNA, 23 nt, Mycobacterium avium subsp. paratuberculosis
gcguuccaucagcgcccgcgcgg

SEQ ID NO: 2957787 - RNA, 15 nt, Mycobacterium avium subsp. paratuberculosis
gcguucccagcccgg

SEQ ID NO: 2957788 - RNA, 15 nt, Mycobacterium avium subsp. paratuberculosis
gcguuccccggcgug

SEQ ID NO: 2957789 - RNA, 13 nt, Mycobacterium avium subsp. paratuberculosis
gcguucccgcgcg

SEQ ID NO: 2957790 - RNA, 15 nt, Mycobacterium avium subsp. paratuberculosis
gcguuccgccacggc

SEQ ID NO: 2957791 - RNA, 16 nt, Mycobacterium avium subsp. paratuberculosis
gcguuccgccacggcg

SEQ ID NO: 2957792 - RNA, 17 nt, Mycobacterium avium subsp. paratuberculosis
gcguuccgccacggcgg

SEQ ID NO: 2957793 - RNA, 15 nt, Mycobacterium avium subsp. paratuberculosis
gcguuccgccguccu

SEQ ID NO: 2957794 - RNA, 13 nt, Mycobacterium avium subsp. paratuberculosis
gcguuccgcgaca

SEQ ID NO: 2957795 - RNA, 13 nt, Mycobacterium avium subsp. paratuberculosis
gcguuccggcggc

SEQ ID NO: 2957796 - RNA, 17 nt, Mycobacterium avium subsp. paratuberculosis
gcguuccggcggccggc

SEQ ID NO: 2957797 - RNA, 17 nt, Mycobacterium avium subsp. paratuberculosis
gcguuccgucggcgagu

SEQ ID NO: 2957798 - RNA, 15 nt, Mycobacterium avium subsp. paratuberculosis
gcguuccucgacggc

SEQ ID NO: 2957799 - RNA, 18 nt, Mycobacterium avium subsp. paratuberculosis
gcguuccuuacgccgacg

SEQ ID NO: 2957800 - RNA, 15 nt, Mycobacterium avium subsp. paratuberculosis
gcguucgacccacac

SEQ ID NO: 2957801 - RNA, 19 nt, Mycobacterium avium subsp. paratuberculosis
gcguucgacccacaccucg

SEQ ID NO: 2957802 - RNA, 18 nt, Mycobacterium avium subsp. paratuberculosis
gcguucgaccuccacgag

SEQ ID NO: 2957803 - RNA, 22 nt, Mycobacterium avium subsp. paratuberculosis
gcguucgaccuccacgagccgg

SEQ ID NO: 2957804 - RNA, 19 nt, Mycobacterium avium subsp. paratuberculosis
gcguucgaguucgucgacc

SEQ ID NO: 2957805 - RNA, 17 nt, Mycobacterium avium subsp. paratuberculosis
gcguucgaugcccugcc

SEQ ID NO: 2957806 - RNA, 18 nt, Mycobacterium avium subsp. paratuberculosis
gcguucgauugccggacg

SEQ ID NO: 2957807 - RNA, 12 nt, Mycobacterium avium subsp. paratuberculosis
gcguucgccgag

SEQ ID NO: 2957808 - RNA, 16 nt, Mycobacterium avium subsp. paratuberculosis
gcguucgccgaggaag

SEQ ID NO: 2957809 - RNA, 22 nt, Mycobacterium avium subsp. paratuberculosis
gcguucgccggcguagaccagc

SEQ ID NO: 2957810 - RNA, 15 nt, Mycobacterium avium subsp. paratuberculosis
gcguucgcguucggg

SEQ ID NO: 2957811 - RNA, 18 nt, Mycobacterium avium subsp. paratuberculosis
gcguucgcguucgggcag

SEQ ID NO: 2957812 - RNA, 20 nt, Mycobacterium avium subsp. paratuberculosis
gcguucgcuuucgccgggcg

SEQ ID NO: 2957813 - RNA, 18 nt, Mycobacterium avium subsp. paratuberculosis
gcguucggacaccucggc

SEQ ID NO: 2957814 - RNA, 20 nt, Mycobacterium avium subsp. paratuberculosis
gcguucggacaccucggcca

SEQ ID NO: 2957815 - RNA, 21 nt, Mycobacterium avium subsp. paratuberculosis
gcguucggacaccucggccag

SEQ ID NO: 2957816 - RNA, 13 nt, Mycobacterium avium subsp. paratuberculosis
gcguucggccgca

SEQ ID NO: 2957817 - RNA, 17 nt, Mycobacterium avium subsp. paratuberculosis
gcguucggccgcagcgg

SEQ ID NO: 2957818 - RNA, 19 nt, Mycobacterium avium subsp. paratuberculosis
gcguucggccgcagcggga

SEQ ID NO: 2957819 - RNA, 18 nt, Mycobacterium avium subsp. paratuberculosis
gcguucggcgauccgggc

SEQ ID NO: 2957820 - RNA, 13 nt, Mycobacterium avium subsp. paratuberculosis
gcguucggcgcca

SEQ ID NO: 2957821 - RNA, 17 nt, Mycobacterium avium subsp. paratuberculosis
gcguucggcgcggaucg

SEQ ID NO: 2957822 - RNA, 23 nt, Mycobacterium avium subsp. paratuberculosis
gcguucggcgcggaucgucaccg

SEQ ID NO: 2957823 - RNA, 14 nt, Mycobacterium avium subsp. paratuberculosis
gcguucggcggcgc

SEQ ID NO: 2957824 - RNA, 18 nt, Mycobacterium avium subsp. paratuberculosis
gcguucgggauccucgcc

SEQ ID NO: 2957825 - RNA, 22 nt, Mycobacterium avium subsp. paratuberculosis
gcguucgggauccucgccgcgg

SEQ ID NO: 2957826 - RNA, 17 nt, Mycobacterium avium subsp. paratuberculosis
gcguucgggcagcgccu

SEQ ID NO: 2957827 - RNA, 15 nt, Mycobacterium avium subsp. paratuberculosis
gcguucgggcccggc

SEQ ID NO: 2957828 - RNA, 17 nt, Mycobacterium avium subsp. paratuberculosis
gcguucgggcccggccg

SEQ ID NO: 2957829 - RNA, 18 nt, Mycobacterium avium subsp. paratuberculosis
gcguucgggcccggccgc

SEQ ID NO: 2957830 - RNA, 20 nt, Mycobacterium avium subsp. paratuberculosis
gcguucgggcccggccgcca

SEQ ID NO: 2957831 - RNA, 22 nt, Mycobacterium avium subsp. paratuberculosis
gcguucgggcccggccgccagc

SEQ ID NO: 2957832 - RNA, 23 nt, Mycobacterium avium subsp. paratuberculosis
gcguucgggcccggccgccagca

SEQ ID NO: 2957833 - RNA, 15 nt, Mycobacterium avium subsp. paratuberculosis
gcguucggucagcac

SEQ ID NO: 2957834 - RNA, 17 nt, Mycobacterium avium subsp. paratuberculosis
gcguucggucagcacga

SEQ ID NO: 2957835 - RNA, 17 nt, Mycobacterium avium subsp. paratuberculosis
gcguucggugcccgggg

SEQ ID NO: 2957836 - RNA, 18 nt, Mycobacterium avium subsp. paratuberculosis
gcguucggugcccggggu

SEQ ID NO: 2957837 - RNA, 12 nt, Mycobacterium avium subsp. paratuberculosis
gcguucgucgcc

SEQ ID NO: 2957838 - RNA, 15 nt, Mycobacterium avium subsp. paratuberculosis
gcguucgucgccggu

SEQ ID NO: 2957839 - RNA, 19 nt, Mycobacterium avium subsp. paratuberculosis
gcguucgucgccggugagc

SEQ ID NO: 2957840 - RNA, 16 nt, Mycobacterium avium subsp. paratuberculosis
gcguucgucggcgcgu

SEQ ID NO: 2957841 - RNA, 17 nt, Mycobacterium avium subsp. paratuberculosis
gcguucuccacccgccc

SEQ ID NO: 2957842 - RNA, 17 nt, Mycobacterium avium subsp. paratuberculosis
gcguucuccaccgcgcg

SEQ ID NO: 2957843 - RNA, 20 nt, Mycobacterium avium subsp. paratuberculosis
gcguucuccaccgcgcgcgg

SEQ ID NO: 2957844 - RNA, 17 nt, Mycobacterium avium subsp. paratuberculosis
gcguucuccagcacccg

SEQ ID NO: 2957845 - RNA, 22 nt, Mycobacterium avium subsp. paratuberculosis
gcguucuccagcacccgcaacg

SEQ ID NO: 2957846 - RNA, 22 nt, Mycobacterium avium subsp. paratuberculosis
gcguucuccucgaacaccgcac

SEQ ID NO: 2957847 - RNA, 14 nt, Mycobacterium avium subsp. paratuberculosis
gcguucugcaccga

SEQ ID NO: 2957848 - RNA, 21 nt, Mycobacterium avium subsp. paratuberculosis
gcguugaaaguccuugcugcc

SEQ ID NO: 2957849 - RNA, 16 nt, Mycobacterium avium subsp. paratuberculosis
gcguugaccagaccga

SEQ ID NO: 2957850 - RNA, 21 nt, Mycobacterium avium subsp. paratuberculosis
gcguugaccgggccgcuggug

SEQ ID NO: 2957851 - RNA, 13 nt, Mycobacterium avium subsp. paratuberculosis
gcguugagccggc

SEQ ID NO: 2957852 - RNA, 20 nt, Mycobacterium avium subsp. paratuberculosis
gcguugagccggcgcaccgc

SEQ ID NO: 2957853 - RNA, 15 nt, Mycobacterium avium subsp. paratuberculosis
gcguugagcgucgcc

SEQ ID NO: 2957854 - RNA, 17 nt, Mycobacterium avium subsp. paratuberculosis
gcguugaggcguugcgg

SEQ ID NO: 2957855 - RNA, 16 nt, Mycobacterium avium subsp. paratuberculosis
gcguugaucagcgcca

SEQ ID NO: 2957856 - RNA, 18 nt, Mycobacterium avium subsp. paratuberculosis
gcguugaucagcgccagg

SEQ ID NO: 2957857 - RNA, 16 nt, Mycobacterium avium subsp. paratuberculosis
gcguugaucgacggau

SEQ ID NO: 2957858 - RNA, 21 nt, Mycobacterium avium subsp. paratuberculosis
gcguugaugcgggcgugcggu

SEQ ID NO: 2957859 - RNA, 17 nt, Mycobacterium avium subsp. paratuberculosis
gcguugaugucggccag

SEQ ID NO: 2957860 - RNA, 21 nt, Mycobacterium avium subsp. paratuberculosis
gcguugaugucggccaggauc

SEQ ID NO: 2957861 - RNA, 18 nt, Mycobacterium avium subsp. paratuberculosis
gcguugcagcgccgcggc

SEQ ID NO: 2957862 - RNA, 22 nt, Mycobacterium avium subsp. paratuberculosis
gcguugcagcgccgcggcgccc

SEQ ID NO: 2957863 - RNA, 16 nt, Mycobacterium avium subsp. paratuberculosis
gcguugcauuucggcg

SEQ ID NO: 2957864 - RNA, 18 nt, Mycobacterium avium subsp. paratuberculosis
gcguugcccgccgcggcg

SEQ ID NO: 2957865 - RNA, 17 nt, Mycobacterium avium subsp. paratuberculosis
gcguugccgccggcgcg

SEQ ID NO: 2957866 - RNA, 20 nt, Mycobacterium avium subsp. paratuberculosis
gcguugccgcgcgcccgcgg

SEQ ID NO: 2957867 - RNA, 15 nt, Mycobacterium avium subsp. paratuberculosis
gcguugcgcggaccg

SEQ ID NO: 2957868 - RNA, 17 nt, Mycobacterium avium subsp. paratuberculosis
gcguugcgcggaccggc

SEQ ID NO: 2957869 - RNA, 17 nt, Mycobacterium avium subsp. paratuberculosis
gcguugcgcggcggcca

SEQ ID NO: 2957870 - RNA, 18 nt, Mycobacterium avium subsp. paratuberculosis
gcguugcgcggcggccaa

SEQ ID NO: 2957871 - RNA, 13 nt, Mycobacterium avium subsp. paratuberculosis
gcucagcgcaccg

SEQ ID NO: 2957872 - RNA, 17 nt, Mycobacterium avium subsp. paratuberculosis
gcucagcgcaccgccgu

SEQ ID NO: 2957873 - RNA, 20 nt, Mycobacterium avium subsp. paratuberculosis
gcucagcgcaccgccgucgg

SEQ ID NO: 2957874 - RNA, 21 nt, Mycobacterium avium subsp. paratuberculosis
gcucagcgcaccgccgucggg

SEQ ID NO: 2957875 - RNA, 16 nt, Mycobacterium avium subsp. paratuberculosis
gcucagcgcgacgugc

SEQ ID NO: 2957876 - RNA, 20 nt, Mycobacterium avium subsp. paratuberculosis
gcucagcgcgacgugccggc

SEQ ID NO: 2957877 - RNA, 13 nt, Mycobacterium avium subsp. paratuberculosis
gcucagcgcggcc

SEQ ID NO: 2957878 - RNA, 16 nt, Mycobacterium avium subsp. paratuberculosis
gcucagcgcggccaca

SEQ ID NO: 2957879 - RNA, 23 nt, Mycobacterium avium subsp. paratuberculosis
gcucagcgcggccacaccgauca

SEQ ID NO: 2957880 - RNA, 15 nt, Mycobacterium avium subsp. paratuberculosis
gcucagcgcggcggg

SEQ ID NO: 2957881 - RNA, 17 nt, Mycobacterium avium subsp. paratuberculosis
gcucagcggaaccgaca

SEQ ID NO: 2957882 - RNA, 15 nt, Mycobacterium avium subsp. paratuberculosis
gcucagcggcaggug

SEQ ID NO: 2957883 - RNA, 19 nt, Mycobacterium avium subsp. paratuberculosis
gcucagcggcaggugcgcc

SEQ ID NO: 2957884 - RNA, 21 nt, Mycobacterium avium subsp. paratuberculosis
gcucagcggccaucgccgcca

SEQ ID NO: 2957885 - RNA, 22 nt, Mycobacterium avium subsp. paratuberculosis
gcucagcggccaucgccgccau

SEQ ID NO: 2957886 - RNA, 17 nt, Mycobacterium avium subsp. paratuberculosis
gcucagcgggaagccga

SEQ ID NO: 2957887 - RNA, 12 nt, Mycobacterium avium subsp. paratuberculosis
gcucagcgggcg

SEQ ID NO: 2957888 - RNA, 14 nt, Mycobacterium avium subsp. paratuberculosis
gcucagcgggcggc

SEQ ID NO: 2957889 - RNA, 16 nt, Mycobacterium avium subsp. paratuberculosis
gcucagcgggcggcca

SEQ ID NO: 2957890 - RNA, 17 nt, Mycobacterium avium subsp. paratuberculosis
gcucagcgggcggccag

SEQ ID NO: 2957891 - RNA, 19 nt, Mycobacterium avium subsp. paratuberculosis
gcucagcgggcggccagcc

SEQ ID NO: 2957892 - RNA, 17 nt, Mycobacterium avium subsp. paratuberculosis
gcucagcucccgagcau

SEQ ID NO: 2957893 - RNA, 20 nt, Mycobacterium avium subsp. paratuberculosis
gcucagcugcugcgcggcgg

SEQ ID NO: 2957894 - RNA, 21 nt, Mycobacterium avium subsp. paratuberculosis
gcucagcugcugcgcggcggc

SEQ ID NO: 2957895 - RNA, 22 nt, Mycobacterium avium subsp. paratuberculosis
gcucagcugcugcgcggcggcg

SEQ ID NO: 2957896 - RNA, 14 nt, Mycobacterium avium subsp. paratuberculosis
gcucaggaacggcc

SEQ ID NO: 2957897 - RNA, 18 nt, Mycobacterium avium subsp. paratuberculosis
gcucaggaacggccggau

SEQ ID NO: 2957898 - RNA, 19 nt, Mycobacterium avium subsp. paratuberculosis
gcucaggacgaacgcuggc

SEQ ID NO: 2957899 - RNA, 20 nt, Mycobacterium avium subsp. paratuberculosis
gcucaggacgaacgcuggcg

SEQ ID NO: 2957900 - RNA, 18 nt, Mycobacterium avium subsp. paratuberculosis
gcucaggaucagcagccg

SEQ ID NO: 2957901 - RNA, 14 nt, Mycobacterium avium subsp. paratuberculosis
gcucaggccggugg

SEQ ID NO: 2957902 - RNA, 16 nt, Mycobacterium avium subsp. paratuberculosis
gcucaggccgguggcg

SEQ ID NO: 2957903 - RNA, 17 nt, Mycobacterium avium subsp. paratuberculosis
gcucaggccgguggcga

SEQ ID NO: 2957904 - RNA, 17 nt, Mycobacterium avium subsp. paratuberculosis
gcucaggcguccagcca

SEQ ID NO: 2957905 - RNA, 20 nt, Mycobacterium avium subsp. paratuberculosis
gcucaggcguccagccagcg

SEQ ID NO: 2957906 - RNA, 21 nt, Mycobacterium avium subsp. paratuberculosis
gcucaggcguccagccagcgu

SEQ ID NO: 2957907 - RNA, 14 nt, Mycobacterium avium subsp. paratuberculosis
gcucagggugcgcu

SEQ ID NO: 2957908 - RNA, 19 nt, Mycobacterium avium subsp. paratuberculosis
gcucagggugcgcuggccg

SEQ ID NO: 2957909 - RNA, 15 nt, Mycobacterium avium subsp. paratuberculosis
gcucaggucggccgc

SEQ ID NO: 2957910 - RNA, 16 nt, Mycobacterium avium subsp. paratuberculosis
gcucaggucggccgcg

SEQ ID NO: 2957911 - RNA, 18 nt, Mycobacterium avium subsp. paratuberculosis
gcucaggucggccgcggc

SEQ ID NO: 2957912 - RNA, 15 nt, Mycobacterium avium subsp. paratuberculosis
gcucaggugcgacgc

SEQ ID NO: 2957913 - RNA, 14 nt, Mycobacterium avium subsp. paratuberculosis
gcucagguugcgca

SEQ ID NO: 2957914 - RNA, 19 nt, Mycobacterium avium subsp. paratuberculosis
gcucagguugcgcagcagc

SEQ ID NO: 2957915 - RNA, 20 nt, Mycobacterium avium subsp. paratuberculosis
gcucagguugcgcagcagcc

SEQ ID NO: 2957916 - RNA, 16 nt, Mycobacterium avium subsp. paratuberculosis
gcucaguccagcuccc

SEQ ID NO: 2957917 - RNA, 15 nt, Mycobacterium avium subsp. paratuberculosis
gcucagugcacgcuc

SEQ ID NO: 2957918 - RNA, 20 nt, Mycobacterium avium subsp. paratuberculosis
gcucagugcacgcucggcgc

SEQ ID NO: 2957919 - RNA, 15 nt, Mycobacterium avium subsp. paratuberculosis
gcucauacagcggcg

SEQ ID NO: 2957920 - RNA, 17 nt, Mycobacterium avium subsp. paratuberculosis
gcucauacagcggcgcg

SEQ ID NO: 2957921 - RNA, 14 nt, Mycobacterium avium subsp. paratuberculosis
gcucauacggcggc

SEQ ID NO: 2957922 - RNA, 19 nt, Mycobacterium avium subsp. paratuberculosis
gcucaucaccggcgcgccg

SEQ ID NO: 2957923 - RNA, 22 nt, Mycobacterium avium subsp. paratuberculosis
gcucaucaccggcgcgccgucc

SEQ ID NO: 2957924 - RNA, 16 nt, Mycobacterium avium subsp. paratuberculosis
gcucaucaggcggccg

SEQ ID NO: 2957925 - RNA, 19 nt, Mycobacterium avium subsp. paratuberculosis
gcucaucaggcggccggcc

SEQ ID NO: 2957926 - RNA, 17 nt, Mycobacterium avium subsp. paratuberculosis
gcucaucccgaugucgg

SEQ ID NO: 2957927 - RNA, 20 nt, Mycobacterium avium subsp. paratuberculosis
gcucaucccgaugucggcga

SEQ ID NO: 2957928 - RNA, 21 nt, Mycobacterium avium subsp. paratuberculosis
gcucaucccgaugucggcgaa

SEQ ID NO: 2957929 - RNA, 14 nt, Mycobacterium avium subsp. paratuberculosis
gcucaucccuagcg

SEQ ID NO: 2957930 - RNA, 18 nt, Mycobacterium avium subsp. paratuberculosis
gcucaucgaggucgaacc

SEQ ID NO: 2957931 - RNA, 18 nt, Mycobacterium avium subsp. paratuberculosis
gcucaucgucguuggcgc

SEQ ID NO: 2957932 - RNA, 19 nt, Mycobacterium avium subsp. paratuberculosis
gcucaucuacgucgucgcc

SEQ ID NO: 2957933 - RNA, 20 nt, Mycobacterium avium subsp. paratuberculosis
gcucaucuacgucgucgccg

SEQ ID NO: 2957934 - RNA, 21 nt, Mycobacterium avium subsp. paratuberculosis
gcucaucuacgucgucgccgg

SEQ ID NO: 2957935 - RNA, 18 nt, Mycobacterium avium subsp. paratuberculosis
gcucaugagcccuccagc

SEQ ID NO: 2957936 - RNA, 19 nt, Mycobacterium avium subsp. paratuberculosis
gcucaugagcccuccagcu

SEQ ID NO: 2957937 - RNA, 19 nt, Mycobacterium avium subsp. paratuberculosis
gcucaugcccgccacggcc

SEQ ID NO: 2957938 - RNA, 22 nt, Mycobacterium avium subsp. paratuberculosis
gcucaugcccgccacggccagc

SEQ ID NO: 2957939 - RNA, 19 nt, Mycobacterium avium subsp. paratuberculosis
gcucaugugauuacuccuc

SEQ ID NO: 2957940 - RNA, 21 nt, Mycobacterium avium subsp. paratuberculosis
gcucaugugauuacuccucgc

SEQ ID NO: 2957941 - RNA, 20 nt, Mycobacterium avium subsp. paratuberculosis
gcuccaaugcggccgacuug

SEQ ID NO: 2957942 - RNA, 13 nt, Mycobacterium avium subsp. paratuberculosis
gcuccacagcagu

SEQ ID NO: 2957943 - RNA, 15 nt, Mycobacterium avium subsp. paratuberculosis
gcuccacaucugccg

SEQ ID NO: 2957944 - RNA, 15 nt, Mycobacterium avium subsp. paratuberculosis
gcuccaccagcgcgg

SEQ ID NO: 2957945 - RNA, 13 nt, Mycobacterium avium subsp. paratuberculosis
gcuccaccagguu

SEQ ID NO: 2957946 - RNA, 18 nt, Mycobacterium avium subsp. paratuberculosis
gcuccaccgcgccggcgg

SEQ ID NO: 2957947 - RNA, 19 nt, Mycobacterium avium subsp. paratuberculosis
gcuccaccgcgccggcggc

SEQ ID NO: 2957948 - RNA, 16 nt, Mycobacterium avium subsp. paratuberculosis
gcuccaccgcguccug

SEQ ID NO: 2957949 - RNA, 19 nt, Mycobacterium avium subsp. paratuberculosis
gcuccaccgcguccugcag

SEQ ID NO: 2957950 - RNA, 20 nt, Mycobacterium avium subsp. paratuberculosis
gcuccaccugcggcaccucg

SEQ ID NO: 2957951 - RNA, 23 nt, Mycobacterium avium subsp. paratuberculosis
gcuccaccugcggcaccucggcc

SEQ ID NO: 2957952 - RNA, 17 nt, Mycobacterium avium subsp. paratuberculosis
gcuccacgaugcccguc

SEQ ID NO: 2957953 - RNA, 20 nt, Mycobacterium avium subsp. paratuberculosis
gcuccacgaugcccgucacg

SEQ ID NO: 2957954 - RNA, 17 nt, Mycobacterium avium subsp. paratuberculosis
gcuccacgcguagccga

SEQ ID NO: 2957955 - RNA, 11 nt, Mycobacterium avium subsp. paratuberculosis
gcuccagcagc

SEQ ID NO: 2957956 - RNA, 14 nt, Mycobacterium avium subsp. paratuberculosis
gcuccagcagcccg

SEQ ID NO: 2957957 - RNA, 13 nt, Mycobacterium avium subsp. paratuberculosis
gcuccagcaggcg

SEQ ID NO: 2957958 - RNA, 16 nt, Mycobacterium avium subsp. paratuberculosis
gcuccagcaggcgcgc

SEQ ID NO: 2957959 - RNA, 18 nt, Mycobacterium avium subsp. paratuberculosis
gcuccagcaggcgcgccg

SEQ ID NO: 2957960 - RNA, 19 nt, Mycobacterium avium subsp. paratuberculosis
gcuccagcaggcgcgccga

SEQ ID NO: 2957961 - RNA, 20 nt, Mycobacterium avium subsp. paratuberculosis
gcuccagcaggcgcgccgag

SEQ ID NO: 2957962 - RNA, 22 nt, Mycobacterium avium subsp. paratuberculosis
gcuccagcaggcgcgccgagcg

SEQ ID NO: 2957963 - RNA, 13 nt, Mycobacterium avium subsp. paratuberculosis
gcuccagcaggcu

SEQ ID NO: 2957964 - RNA, 13 nt, Mycobacterium avium subsp. paratuberculosis
gcuccagcgcccg

SEQ ID NO: 2957965 - RNA, 14 nt, Mycobacterium avium subsp. paratuberculosis
gcuccagcgcccgc

SEQ ID NO: 2957966 - RNA, 16 nt, Mycobacterium avium subsp. paratuberculosis
gcuccagcgcccgccg

SEQ ID NO: 2957967 - RNA, 18 nt, Mycobacterium avium subsp. paratuberculosis
gcuccagcgcccgccgca

SEQ ID NO: 2957968 - RNA, 23 nt, Mycobacterium avium subsp. paratuberculosis
gcuccagcgcccgccgcaacgcg

SEQ ID NO: 2957969 - RNA, 13 nt, Mycobacterium avium subsp. paratuberculosis
gcuccagcgggcg

SEQ ID NO: 2957970 - RNA, 16 nt, Mycobacterium avium subsp. paratuberculosis
gcuccagcgggcggcg

SEQ ID NO: 2957971 - RNA, 22 nt, Mycobacterium avium subsp. paratuberculosis
gcuccagcgggcggcgguggcc

SEQ ID NO: 2957972 - RNA, 18 nt, Mycobacterium avium subsp. paratuberculosis
gcuccagcggguccagcc

SEQ ID NO: 2957973 - RNA, 19 nt, Mycobacterium avium subsp. paratuberculosis
gcuccagcggguccagccg

SEQ ID NO: 2957974 - RNA, 20 nt, Mycobacterium avium subsp. paratuberculosis
gcuccagcggguccagccgc

SEQ ID NO: 2957975 - RNA, 21 nt, Mycobacterium avium subsp. paratuberculosis
gcuccagcggguccagccgcc

SEQ ID NO: 2957976 - RNA, 18 nt, Mycobacterium avium subsp. paratuberculosis
gcuccaggaugucgacga

SEQ ID NO: 2957977 - RNA, 21 nt, Mycobacterium avium subsp. paratuberculosis
gcuccaggaugucgacgacac

SEQ ID NO: 2957978 - RNA, 18 nt, Mycobacterium avium subsp. paratuberculosis
gcuccauguucggggcgg

SEQ ID NO: 2957979 - RNA, 12 nt, Mycobacterium avium subsp. paratuberculosis
gcucccaggccc

SEQ ID NO: 2957980 - RNA, 24 nt, Mycobacterium avium subsp. paratuberculosis
gcucccaggcccaucgcggucagc

SEQ ID NO: 2957981 - RNA, 15 nt, Mycobacterium avium subsp. paratuberculosis
gcucccaggcgucgu

SEQ ID NO: 2957982 - RNA, 18 nt, Mycobacterium avium subsp. paratuberculosis
gcucccaggcgucgucgu

SEQ ID NO: 2957983 - RNA, 12 nt, Mycobacterium avium subsp. paratuberculosis
gcucccaguccc

SEQ ID NO: 2957984 - RNA, 15 nt, Mycobacterium avium subsp. paratuberculosis
gcucccagucccagc

SEQ ID NO: 2957985 - RNA, 19 nt, Mycobacterium avium subsp. paratuberculosis
gcucccccgacaccgccag

SEQ ID NO: 2957986 - RNA, 19 nt, Mycobacterium avium subsp. paratuberculosis
gcucccccggaccugccgg

SEQ ID NO: 2957987 - RNA, 14 nt, Mycobacterium avium subsp. paratuberculosis
gcucccccggcgug

SEQ ID NO: 2957988 - RNA, 18 nt, Mycobacterium avium subsp. paratuberculosis
gcucccccggcgugagcg

SEQ ID NO: 2957989 - RNA, 15 nt, Mycobacterium avium subsp. paratuberculosis
gcucccccgucgggc

SEQ ID NO: 2957990 - RNA, 18 nt, Mycobacterium avium subsp. paratuberculosis
gcucccccgucgggccgu

SEQ ID NO: 2957991 - RNA, 15 nt, Mycobacterium avium subsp. paratuberculosis
gcuccccgagcacgu

SEQ ID NO: 2957992 - RNA, 14 nt, Mycobacterium avium subsp. paratuberculosis
gcuccccguugauc

SEQ ID NO: 2957993 - RNA, 21 nt, Mycobacterium avium subsp. paratuberculosis
gcuccccguugaucuugaccg

SEQ ID NO: 2957994 - RNA, 18 nt, Mycobacterium avium subsp. paratuberculosis
gcucccgagcaucgccga

SEQ ID NO: 2957995 - RNA, 17 nt, Mycobacterium avium subsp. paratuberculosis
gcucccgcagcggggcg

SEQ ID NO: 2957996 - RNA, 23 nt, Mycobacterium avium subsp. paratuberculosis
gcucccgcagcggggcgcugucc

SEQ ID NO: 2957997 - RNA, 21 nt, Mycobacterium avium subsp. paratuberculosis
gcucccgccaauaagaucgug

SEQ ID NO: 2957998 - RNA, 14 nt, Mycobacterium avium subsp. paratuberculosis
gcucccgcgcgggc

SEQ ID NO: 2957999 - RNA, 14 nt, Mycobacterium avium subsp. paratuberculosis
gcucccgcucgcca

SEQ ID NO: 2958000 - RNA, 23 nt, Mycobacterium avium subsp. paratuberculosis
gcucccggcagaucgcggcccgc

SEQ ID NO: 2958001 - RNA, 14 nt, Mycobacterium avium subsp. paratuberculosis
gcucccggcgcagc

SEQ ID NO: 2958002 - RNA, 15 nt, Mycobacterium avium subsp. paratuberculosis
gcucccggcgccgcc

SEQ ID NO: 2958003 - RNA, 17 nt, Mycobacterium avium subsp. paratuberculosis
gcucccggcgccgccgu

SEQ ID NO: 2958004 - RNA, 17 nt, Mycobacterium avium subsp. paratuberculosis
gcucccgggcggcgccg

SEQ ID NO: 2958005 - RNA, 18 nt, Mycobacterium avium subsp. paratuberculosis
gcucccgggcggcgccga

SEQ ID NO: 2958006 - RNA, 22 nt, Mycobacterium avium subsp. paratuberculosis
gcucccgguagagcggcaccag

SEQ ID NO: 2958007 - RNA, 23 nt, Mycobacterium avium subsp. paratuberculosis
gcucccggucguagucggcccgc

SEQ ID NO: 2958008 - RNA, 16 nt, Mycobacterium avium subsp. paratuberculosis
gcuccgacgcgguggc

SEQ ID NO: 2958009 - RNA, 12 nt, Mycobacterium avium subsp. paratuberculosis
gcuccgagcgga

SEQ ID NO: 2958010 - RNA, 15 nt, Mycobacterium avium subsp. paratuberculosis
gcuccgagcggaugc

SEQ ID NO: 2958011 - RNA, 15 nt, Mycobacterium avium subsp. paratuberculosis
gcuccgcacgaccug

SEQ ID NO: 2958012 - RNA, 19 nt, Mycobacterium avium subsp. paratuberculosis
gcuccgcaugcccgggcga

SEQ ID NO: 2958013 - RNA, 14 nt, Mycobacterium avium subsp. paratuberculosis
gcuccgccacccug

SEQ ID NO: 2958014 - RNA, 18 nt, Mycobacterium avium subsp. paratuberculosis
gcuccgcggccagcucgg

SEQ ID NO: 2958015 - RNA, 14 nt, Mycobacterium avium subsp. paratuberculosis
gcuccgcggcgggc

SEQ ID NO: 2958016 - RNA, 15 nt, Mycobacterium avium subsp. paratuberculosis
gcuccgcggcgggcg

SEQ ID NO: 2958017 - RNA, 17 nt, Mycobacterium avium subsp. paratuberculosis
gcuccgcgggcagcgag

SEQ ID NO: 2958018 - RNA, 16 nt, Mycobacterium avium subsp. paratuberculosis
gcuccgcggugcugca

SEQ ID NO: 2958019 - RNA, 21 nt, Mycobacterium avium subsp. paratuberculosis
gcuccgcggugcugcagcgcg

SEQ ID NO: 2958020 - RNA, 22 nt, Mycobacterium avium subsp. paratuberculosis
gcuccgcggugcugcagcgcga

SEQ ID NO: 2958021 - RNA, 20 nt, Mycobacterium avium subsp. paratuberculosis
gcuccgcguucgaccuccac

SEQ ID NO: 2958022 - RNA, 20 nt, Mycobacterium avium subsp. paratuberculosis
gcuccggcaacgaggccagg

SEQ ID NO: 2958023 - RNA, 23 nt, Mycobacterium avium subsp. paratuberculosis
gcuccggcaacgaggccagggcc

SEQ ID NO: 2958024 - RNA, 15 nt, Mycobacterium avium subsp. paratuberculosis
gcuccggcccgagca

SEQ ID NO: 2958025 - RNA, 13 nt, Mycobacterium avium subsp. paratuberculosis
gcuccggccgcgc

SEQ ID NO: 2958026 - RNA, 15 nt, Mycobacterium avium subsp. paratuberculosis
gcuccggccgcgccg

SEQ ID NO: 2958027 - RNA, 16 nt, Mycobacterium avium subsp. paratuberculosis
gcuccggccgcgccgg

SEQ ID NO: 2958028 - RNA, 13 nt, Mycobacterium avium subsp. paratuberculosis
gcuccggcggacc

SEQ ID NO: 2958029 - RNA, 12 nt, Mycobacterium avium subsp. paratuberculosis
gcuccggcgucg

SEQ ID NO: 2958030 - RNA, 18 nt, Mycobacterium avium subsp. paratuberculosis
gcuccgggggcaccgcca

SEQ ID NO: 2958031 - RNA, 16 nt, Mycobacterium avium subsp. paratuberculosis
gcuccggguccgcggu

SEQ ID NO: 2958032 - RNA, 17 nt, Mycobacterium avium subsp. paratuberculosis
gcuccggucgcgucgug

SEQ ID NO: 2958033 - RNA, 13 nt, Mycobacterium avium subsp. paratuberculosis
gcuccggucggcg

SEQ ID NO: 2958034 - RNA, 17 nt, Mycobacterium avium subsp. paratuberculosis
gcuccggugaaccgcug

SEQ ID NO: 2958035 - RNA, 21 nt, Mycobacterium avium subsp. paratuberculosis
gcuccggugauucgugcagug

SEQ ID NO: 2958036 - RNA, 14 nt, Mycobacterium avium subsp. paratuberculosis
gcuccguccaccgg

SEQ ID NO: 2958037 - RNA, 16 nt, Mycobacterium avium subsp. paratuberculosis
gcuccguccaccggca

SEQ ID NO: 2958038 - RNA, 20 nt, Mycobacterium avium subsp. paratuberculosis
gcuccguccaccggcacggc

SEQ ID NO: 2958039 - RNA, 20 nt, Mycobacterium avium subsp. paratuberculosis
gcuccgucuuguuggucagc

SEQ ID NO: 2958040 - RNA, 21 nt, Mycobacterium avium subsp. paratuberculosis
gcucgagcaacaccaccuugg

SEQ ID NO: 2958041 - RNA, 13 nt, Mycobacterium avium subsp. paratuberculosis
gcucgagcaucac

SEQ ID NO: 2958042 - RNA, 14 nt, Mycobacterium avium subsp. paratuberculosis
gcucgagcaucacg

SEQ ID NO: 2958043 - RNA, 17 nt, Mycobacterium avium subsp. paratuberculosis
gcucgagcaucuccagc

SEQ ID NO: 2958044 - RNA, 22 nt, Mycobacterium avium subsp. paratuberculosis
gcucgagcaucucggugccguc

SEQ ID NO: 2958045 - RNA, 13 nt, Mycobacterium avium subsp. paratuberculosis
gcucgagcucggc

SEQ ID NO: 2958046 - RNA, 14 nt, Mycobacterium avium subsp. paratuberculosis
gcucgagcucggcg

SEQ ID NO: 2958047 - RNA, 15 nt, Mycobacterium avium subsp. paratuberculosis
gcucgagcucggcga

SEQ ID NO: 2958048 - RNA, 15 nt, Mycobacterium avium subsp. paratuberculosis
gcucgagcucgucgg

SEQ ID NO: 2958049 - RNA, 23 nt, Mycobacterium avium subsp. paratuberculosis
gcucgaggccccgcgugacggcc

SEQ ID NO: 2958050 - RNA, 14 nt, Mycobacterium avium subsp. paratuberculosis
gcucgaggccgcgg

SEQ ID NO: 2958051 - RNA, 15 nt, Mycobacterium avium subsp. paratuberculosis
gcucgaggccgcggg

SEQ ID NO: 2958052 - RNA, 18 nt, Mycobacterium avium subsp. paratuberculosis
gcucgaggccgcgggcgu

SEQ ID NO: 2958053 - RNA, 16 nt, Mycobacterium avium subsp. paratuberculosis
gcucgagggccuccac

SEQ ID NO: 2958054 - RNA, 18 nt, Mycobacterium avium subsp. paratuberculosis
gcucgagggccuccacca

SEQ ID NO: 2958055 - RNA, 21 nt, Mycobacterium avium subsp. paratuberculosis
gcucgagggccuccaccacca

SEQ ID NO: 2958056 - RNA, 14 nt, Mycobacterium avium subsp. paratuberculosis
gcucgagggcggcg

SEQ ID NO: 2958057 - RNA, 14 nt, Mycobacterium avium subsp. paratuberculosis
gcucgagugccggc

SEQ ID NO: 2958058 - RNA, 17 nt, Mycobacterium avium subsp. paratuberculosis
gcucgagugccggcagc

SEQ ID NO: 2958059 - RNA, 20 nt, Mycobacterium avium subsp. paratuberculosis
gcucgagugccggcagcccg

SEQ ID NO: 2958060 - RNA, 16 nt, Mycobacterium avium subsp. paratuberculosis
gcucgaguuuggccag

SEQ ID NO: 2958061 - RNA, 16 nt, Mycobacterium avium subsp. paratuberculosis
gcucgaucgccgcgcc

SEQ ID NO: 2958062 - RNA, 13 nt, Mycobacterium avium subsp. paratuberculosis
gcucgaucgcguu

SEQ ID NO: 2958063 - RNA, 17 nt, Mycobacterium avium subsp. paratuberculosis
gcucgaucgcguucugc

SEQ ID NO: 2958064 - RNA, 23 nt, Mycobacterium avium subsp. paratuberculosis
gcucgaucgcguucugcaccagc

SEQ ID NO: 2958065 - RNA, 17 nt, Mycobacterium avium subsp. paratuberculosis
gcucgaucggcgcgccg

SEQ ID NO: 2958066 - RNA, 18 nt, Mycobacterium avium subsp. paratuberculosis
gcucgaucggcgcgccga

SEQ ID NO: 2958067 - RNA, 17 nt, Mycobacterium avium subsp. paratuberculosis
gcucgaucucggccacc

SEQ ID NO: 2958068 - RNA, 19 nt, Mycobacterium avium subsp. paratuberculosis
gcucgaucugcuccggggu

SEQ ID NO: 2958069 - RNA, 23 nt, Mycobacterium avium subsp. paratuberculosis
gcucgaucugcuccgggguggcc

SEQ ID NO: 2958070 - RNA, 19 nt, Mycobacterium avium subsp. paratuberculosis
gcucgaucuggcggacccg

SEQ ID NO: 2958071 - RNA, 20 nt, Mycobacterium avium subsp. paratuberculosis
gcucgaucuggcggacccgc

SEQ ID NO: 2958072 - RNA, 16 nt, Mycobacterium avium subsp. paratuberculosis
gcucgaugccguucgc

SEQ ID NO: 2958073 - RNA, 20 nt, Mycobacterium avium subsp. paratuberculosis
gcucgaugcgacgcaccucg

SEQ ID NO: 2958074 - RNA, 22 nt, Mycobacterium avium subsp. paratuberculosis
gcucgaugcgacgcaccucggc

SEQ ID NO: 2958075 - RNA, 17 nt, Mycobacterium avium subsp. paratuberculosis
gcucgaugcgcaccugc

SEQ ID NO: 2958076 - RNA, 12 nt, Mycobacterium avium subsp. paratuberculosis
gcucgaugcgcg

SEQ ID NO: 2958077 - RNA, 15 nt, Mycobacterium avium subsp. paratuberculosis
gcucgaugcgcgcca

SEQ ID NO: 2958078 - RNA, 18 nt, Mycobacterium avium subsp. paratuberculosis
gcucgaugcgcgccagca

SEQ ID NO: 2958079 - RNA, 21 nt, Mycobacterium avium subsp. paratuberculosis
gcucgaugcgcgccagcagcg

SEQ ID NO: 2958080 - RNA, 14 nt, Mycobacterium avium subsp. paratuberculosis
gcucgaugcggccc

SEQ ID NO: 2958081 - RNA, 15 nt, Mycobacterium avium subsp. paratuberculosis
gcucgaugcggcccu

SEQ ID NO: 2958082 - RNA, 21 nt, Mycobacterium avium subsp. paratuberculosis
gcucgauggaauucgucggcg

SEQ ID NO: 2958083 - RNA, 22 nt, Mycobacterium avium subsp. paratuberculosis
gcucgauggaauucgucggcgg

SEQ ID NO: 2958084 - RNA, 23 nt, Mycobacterium avium subsp. paratuberculosis
gcucgauggaauucgucggcggu

SEQ ID NO: 2958085 - RNA, 13 nt, Mycobacterium avium subsp. paratuberculosis
gcucgauggccag

SEQ ID NO: 2958086 - RNA, 17 nt, Mycobacterium avium subsp. paratuberculosis
gcucgauggccagcgcg

SEQ ID NO: 2958087 - RNA, 19 nt, Mycobacterium avium subsp. paratuberculosis
gcucgauggccagcgcguc

SEQ ID NO: 2958088 - RNA, 21 nt, Mycobacterium avium subsp. paratuberculosis
gcucgauggccagcgcgucgc

SEQ ID NO: 2958089 - RNA, 20 nt, Mycobacterium avium subsp. paratuberculosis
gcucgauggcgccgaucgcg

SEQ ID NO: 2958090 - RNA, 16 nt, Mycobacterium avium subsp. paratuberculosis
gcucgauggugccguc

SEQ ID NO: 2958091 - RNA, 20 nt, Mycobacterium avium subsp. paratuberculosis
gcucgauggugccgucggcg

SEQ ID NO: 2958092 - RNA, 21 nt, Mycobacterium avium subsp. paratuberculosis
gcucgauggugccgucggcgg

SEQ ID NO: 2958093 - RNA, 20 nt, Mycobacterium avium subsp. paratuberculosis
gcucgcaaacgaaucgagcc

SEQ ID NO: 2958094 - RNA, 21 nt, Mycobacterium avium subsp. paratuberculosis
gcucgcaaacgaaucgagccg

SEQ ID NO: 2958095 - RNA, 22 nt, Mycobacterium avium subsp. paratuberculosis
gcucgcaaacgaaucgagccgc

SEQ ID NO: 2958096 - RNA, 20 nt, Mycobacterium avium subsp. paratuberculosis
gcucgcacaacccgcccggg

SEQ ID NO: 2958097 - RNA, 21 nt, Mycobacterium avium subsp. paratuberculosis
gcucgcacaacccgcccgggu

SEQ ID NO: 2958098 - RNA, 16 nt, Mycobacterium avium subsp. paratuberculosis
gcucgcagauggucgg

SEQ ID NO: 2958099 - RNA, 18 nt, Mycobacterium avium subsp. paratuberculosis
gcucgcagauggucggga

SEQ ID NO: 2958100 - RNA, 13 nt, Mycobacterium avium subsp. paratuberculosis
gcucgcaggcgag

SEQ ID NO: 2958101 - RNA, 15 nt, Mycobacterium avium subsp. paratuberculosis
gcucgcagucgauca

SEQ ID NO: 2958102 - RNA, 17 nt, Mycobacterium avium subsp. paratuberculosis
gcucgccaccccgcgcc

SEQ ID NO: 2958103 - RNA, 20 nt, Mycobacterium avium subsp. paratuberculosis
gcucgccaccccgcgccacg

SEQ ID NO: 2958104 - RNA, 23 nt, Mycobacterium avium subsp. paratuberculosis
gcucgccaccccgcgccacgccg

SEQ ID NO: 2958105 - RNA, 24 nt, Mycobacterium avium subsp. paratuberculosis
gcucgccaccccgcgccacgccgc

SEQ ID NO: 2958106 - RNA, 22 nt, Mycobacterium avium subsp. paratuberculosis
gcucgccaccucggagaugaug

SEQ ID NO: 2958107 - RNA, 15 nt, Mycobacterium avium subsp. paratuberculosis
gcucgccagaccggu

SEQ ID NO: 2958108 - RNA, 21 nt, Mycobacterium avium subsp. paratuberculosis
gcucgccagacucacggcggc

SEQ ID NO: 2958109 - RNA, 22 nt, Mycobacterium avium subsp. paratuberculosis
gcucgccagacucacggcggca

SEQ ID NO: 2958110 - RNA, 18 nt, Mycobacterium avium subsp. paratuberculosis
gcucgccaugcgaccacg

SEQ ID NO: 2958111 - RNA, 12 nt, Mycobacterium avium subsp. paratuberculosis
gcucgcccagcg

SEQ ID NO: 2958112 - RNA, 15 nt, Mycobacterium avium subsp. paratuberculosis
gcucgcccgcgacug

SEQ ID NO: 2958113 - RNA, 22 nt, Mycobacterium avium subsp. paratuberculosis
gcucgccgaaaugccgugccag

SEQ ID NO: 2958114 - RNA, 20 nt, Mycobacterium avium subsp. paratuberculosis
gcucgccgaugucggccggu

SEQ ID NO: 2958115 - RNA, 21 nt, Mycobacterium avium subsp. paratuberculosis
gcucgccgaugucggccgguc

SEQ ID NO: 2958116 - RNA, 19 nt, Mycobacterium avium subsp. paratuberculosis
gcucgccgauguggcgggc

SEQ ID NO: 2958117 - RNA, 20 nt, Mycobacterium avium subsp. paratuberculosis
gcucgccgauguggcgggcg

SEQ ID NO: 2958118 - RNA, 14 nt, Mycobacterium avium subsp. paratuberculosis
gcucgccgcgcggc

SEQ ID NO: 2958119 - RNA, 15 nt, Mycobacterium avium subsp. paratuberculosis
gcucgccgcgcggcc

SEQ ID NO: 2958120 - RNA, 16 nt, Mycobacterium avium subsp. paratuberculosis
gcucgccgcgcggccc

SEQ ID NO: 2958121 - RNA, 15 nt, Mycobacterium avium subsp. paratuberculosis
gcucgccgcggccac

SEQ ID NO: 2958122 - RNA, 14 nt, Mycobacterium avium subsp. paratuberculosis
gcucgccgcgggug

SEQ ID NO: 2958123 - RNA, 17 nt, Mycobacterium avium subsp. paratuberculosis
gcucgccgcucguaacg

SEQ ID NO: 2958124 - RNA, 22 nt, Mycobacterium avium subsp. paratuberculosis
gcucgcgguugggccgccggcc

SEQ ID NO: 2958125 - RNA, 23 nt, Mycobacterium avium subsp. paratuberculosis
gcucgcgguugggccgccggccg

SEQ ID NO: 2958126 - RNA, 19 nt, Mycobacterium avium subsp. paratuberculosis
gcucgcgguugggccggcg

SEQ ID NO: 2958127 - RNA, 21 nt, Mycobacterium avium subsp. paratuberculosis
gcucgcgguugggccggcgcc

SEQ ID NO: 2958128 - RNA, 23 nt, Mycobacterium avium subsp. paratuberculosis
gcucgcgguugggccggcgcccg

SEQ ID NO: 2958129 - RNA, 21 nt, Mycobacterium avium subsp. paratuberculosis
gcucgcguacgaccguagccg

SEQ ID NO: 2958130 - RNA, 14 nt, Mycobacterium avium subsp. paratuberculosis
gcucgcgucgacgu

SEQ ID NO: 2958131 - RNA, 16 nt, Mycobacterium avium subsp. paratuberculosis
gcucgcgucgacgucg

SEQ ID NO: 2958132 - RNA, 17 nt, Mycobacterium avium subsp. paratuberculosis
gcucgcgucgacgucgg

SEQ ID NO: 2958133 - RNA, 18 nt, Mycobacterium avium subsp. paratuberculosis
gcucgcgugcgaacguga

SEQ ID NO: 2958134 - RNA, 13 nt, Mycobacterium avium subsp. paratuberculosis
gcucgcguucggg

SEQ ID NO: 2958135 - RNA, 20 nt, Mycobacterium avium subsp. paratuberculosis
gcucgcguucgggcccggcc

SEQ ID NO: 2958136 - RNA, 23 nt, Mycobacterium avium subsp. paratuberculosis
gcucgcguucgggcccggccgcc

SEQ ID NO: 2958137 - RNA, 20 nt, Mycobacterium avium subsp. paratuberculosis
gcucgcuauaucgcaccggc

SEQ ID NO: 2958138 - RNA, 21 nt, Mycobacterium avium subsp. paratuberculosis
gcucgcuauaucgcaccggcg

SEQ ID NO: 2958139 - RNA, 23 nt, Mycobacterium avium subsp. paratuberculosis
gcucgcugaucugcggcaccacg

SEQ ID NO: 2958140 - RNA, 17 nt, Mycobacterium avium subsp. paratuberculosis
gcucgcuguggcggacg

SEQ ID NO: 2958141 - RNA, 15 nt, Mycobacterium avium subsp. paratuberculosis
gcucgcuugccagcc

SEQ ID NO: 2958142 - RNA, 20 nt, Mycobacterium avium subsp. paratuberculosis
gcucgcuugccagccgggcc

SEQ ID NO: 2958143 - RNA, 21 nt, Mycobacterium avium subsp. paratuberculosis
gcucgcuugccagccgggccg

SEQ ID NO: 2958144 - RNA, 21 nt, Mycobacterium avium subsp. paratuberculosis
gcucggaaccguuggacugca

SEQ ID NO: 2958145 - RNA, 22 nt, Mycobacterium avium subsp. paratuberculosis
gcucggaaugaacugccgcggc

SEQ ID NO: 2958146 - RNA, 21 nt, Mycobacterium avium subsp. paratuberculosis
gcucggaggaaccgugcgucc

SEQ ID NO: 2958147 - RNA, 22 nt, Mycobacterium avium subsp. paratuberculosis
gcucggaguaguccagcaccgc

SEQ ID NO: 2958148 - RNA, 18 nt, Mycobacterium avium subsp. paratuberculosis
gcucggaguucgcccgca

SEQ ID NO: 2958149 - RNA, 18 nt, Mycobacterium avium subsp. paratuberculosis
gcucggaguugcgcagcc

SEQ ID NO: 2958150 - RNA, 19 nt, Mycobacterium avium subsp. paratuberculosis
gcucggaguugcgcagccg

SEQ ID NO: 2958151 - RNA, 22 nt, Mycobacterium avium subsp. paratuberculosis
gcucggaguugcgcagccgggc

SEQ ID NO: 2958152 - RNA, 13 nt, Mycobacterium avium subsp. paratuberculosis
gcucggcagcccc

SEQ ID NO: 2958153 - RNA, 21 nt, Mycobacterium avium subsp. paratuberculosis
gcucggcagccccgucggucc

SEQ ID NO: 2958154 - RNA, 13 nt, Mycobacterium avium subsp. paratuberculosis
gcucggccaccag

SEQ ID NO: 2958155 - RNA, 14 nt, Mycobacterium avium subsp. paratuberculosis
gcucggccaccagc

SEQ ID NO: 2958156 - RNA, 17 nt, Mycobacterium avium subsp. paratuberculosis
gcucggccaccagcgcc

SEQ ID NO: 2958157 - RNA, 14 nt, Mycobacterium avium subsp. paratuberculosis
gcucggccaccgcg

SEQ ID NO: 2958158 - RNA, 16 nt, Mycobacterium avium subsp. paratuberculosis
gcucggccaccgcgcg

SEQ ID NO: 2958159 - RNA, 18 nt, Mycobacterium avium subsp. paratuberculosis
gcucggccaccgcgcggu

SEQ ID NO: 2958160 - RNA, 19 nt, Mycobacterium avium subsp. paratuberculosis
gcucggccaccgcgcggug

SEQ ID NO: 2958161 - RNA, 20 nt, Mycobacterium avium subsp. paratuberculosis
gcucggccaccgcgcggugc

SEQ ID NO: 2958162 - RNA, 21 nt, Mycobacterium avium subsp. paratuberculosis
gcucggccacgacgcgccacg

SEQ ID NO: 2958163 - RNA, 17 nt, Mycobacterium avium subsp. paratuberculosis
gcucggccagcagcacc

SEQ ID NO: 2958164 - RNA, 16 nt, Mycobacterium avium subsp. paratuberculosis
gcucggccagcgcgcc

SEQ ID NO: 2958165 - RNA, 19 nt, Mycobacterium avium subsp. paratuberculosis
gcucggccagcgcgccgca

SEQ ID NO: 2958166 - RNA, 15 nt, Mycobacterium avium subsp. paratuberculosis
gcucggccagcgggu

SEQ ID NO: 2958167 - RNA, 16 nt, Mycobacterium avium subsp. paratuberculosis
gcucggccagcgggug

SEQ ID NO: 2958168 - RNA, 23 nt, Mycobacterium avium subsp. paratuberculosis
gcucggccagcgggugauggccg

SEQ ID NO: 2958169 - RNA, 20 nt, Mycobacterium avium subsp. paratuberculosis
gcucggccagggugacgguc

SEQ ID NO: 2958170 - RNA, 18 nt, Mycobacterium avium subsp. paratuberculosis
gcucggccaucccggugc

SEQ ID NO: 2958171 - RNA, 22 nt, Mycobacterium avium subsp. paratuberculosis
gcucggccauccgggcggcauc

SEQ ID NO: 2958172 - RNA, 13 nt, Mycobacterium avium subsp. paratuberculosis
gcucggcccgccg

SEQ ID NO: 2958173 - RNA, 18 nt, Mycobacterium avium subsp. paratuberculosis
gcucggcccgccgggcgc

SEQ ID NO: 2958174 - RNA, 23 nt, Mycobacterium avium subsp. paratuberculosis
gcucggcccgccgggcgccacgc

SEQ ID NO: 2958175 - RNA, 20 nt, Mycobacterium avium subsp. paratuberculosis
gcucggcccgcugcgcggcc

SEQ ID NO: 2958176 - RNA, 15 nt, Mycobacterium avium subsp. paratuberculosis
gcucggccgcaucgu

SEQ ID NO: 2958177 - RNA, 13 nt, Mycobacterium avium subsp. paratuberculosis
gcucggccgccga

SEQ ID NO: 2958178 - RNA, 15 nt, Mycobacterium avium subsp. paratuberculosis
gcucggccgccgaca

SEQ ID NO: 2958179 - RNA, 20 nt, Mycobacterium avium subsp. paratuberculosis
gcucggccgccgacaccacc

SEQ ID NO: 2958180 - RNA, 13 nt, Mycobacterium avium subsp. paratuberculosis
gcucggccggccg

SEQ ID NO: 2958181 - RNA, 14 nt, Mycobacterium avium subsp. paratuberculosis
gcucggccggccgg

SEQ ID NO: 2958182 - RNA, 18 nt, Mycobacterium avium subsp. paratuberculosis
gcucggccggccggccgu

SEQ ID NO: 2958183 - RNA, 14 nt, Mycobacterium avium subsp. paratuberculosis
gcucggccggggcg

SEQ ID NO: 2958184 - RNA, 14 nt, Mycobacterium avium subsp. paratuberculosis
gcucggccguggcc

SEQ ID NO: 2958185 - RNA, 20 nt, Mycobacterium avium subsp. paratuberculosis
gcucggccguggccgucacg

SEQ ID NO: 2958186 - RNA, 15 nt, Mycobacterium avium subsp. paratuberculosis
gcucggccucaggcg

SEQ ID NO: 2958187 - RNA, 16 nt, Mycobacterium avium subsp. paratuberculosis
gcucggccucaggcgu

SEQ ID NO: 2958188 - RNA, 21 nt, Mycobacterium avium subsp. paratuberculosis
gcucggccuucggggugguca

SEQ ID NO: 2958189 - RNA, 18 nt, Mycobacterium avium subsp. paratuberculosis
gcucggccuugagccggu

SEQ ID NO: 2958190 - RNA, 19 nt, Mycobacterium avium subsp. paratuberculosis
gcucggccuugagccgguc

SEQ ID NO: 2958191 - RNA, 15 nt, Mycobacterium avium subsp. paratuberculosis
gcucggcgacaacag

SEQ ID NO: 2958192 - RNA, 22 nt, Mycobacterium avium subsp. paratuberculosis
gcucggcgacaacagcgccgag

SEQ ID NO: 2958193 - RNA, 13 nt, Mycobacterium avium subsp. paratuberculosis
gcucggcgaccgc

SEQ ID NO: 2958194 - RNA, 15 nt, Mycobacterium avium subsp. paratuberculosis
gcucggcgaccgccg

SEQ ID NO: 2958195 - RNA, 17 nt, Mycobacterium avium subsp. paratuberculosis
gcucggcgaccgccggu

SEQ ID NO: 2958196 - RNA, 14 nt, Mycobacterium avium subsp. paratuberculosis
gcucggcgaccugc

SEQ ID NO: 2958197 - RNA, 16 nt, Mycobacterium avium subsp. paratuberculosis
gcucggcgaccugcgg

SEQ ID NO: 2958198 - RNA, 20 nt, Mycobacterium avium subsp. paratuberculosis
gcucggcgaccugcggcucg

SEQ ID NO: 2958199 - RNA, 14 nt, Mycobacterium avium subsp. paratuberculosis
gcucggcgacgcug

SEQ ID NO: 2958200 - RNA, 19 nt, Mycobacterium avium subsp. paratuberculosis
gcucggcgagcugcgggug

SEQ ID NO: 2958201 - RNA, 23 nt, Mycobacterium avium subsp. paratuberculosis
gcucggcgagguagaccgccgag

SEQ ID NO: 2958202 - RNA, 13 nt, Mycobacterium avium subsp. paratuberculosis
gcucggcgaucug

SEQ ID NO: 2958203 - RNA, 15 nt, Mycobacterium avium subsp. paratuberculosis
gcucggcgaucuggc

SEQ ID NO: 2958204 - RNA, 13 nt, Mycobacterium avium subsp. paratuberculosis
gcucggcgauggu

SEQ ID NO: 2958205 - RNA, 12 nt, Mycobacterium avium subsp. paratuberculosis
gcucggcgcccc

SEQ ID NO: 2958206 - RNA, 15 nt, Mycobacterium avium subsp. paratuberculosis
gcucggcgccccacg

SEQ ID NO: 2958207 - RNA, 22 nt, Mycobacterium avium subsp. paratuberculosis
gcucggcgccccacgccuggcg

SEQ ID NO: 2958208 - RNA, 19 nt, Mycobacterium avium subsp. paratuberculosis
gcucggucgccacggccgg

SEQ ID NO: 2958209 - RNA, 22 nt, Mycobacterium avium subsp. paratuberculosis
gcucggucgcgaagacgcuggc

SEQ ID NO: 2958210 - RNA, 20 nt, Mycobacterium avium subsp. paratuberculosis
gcucggucgcggucggcgcc

SEQ ID NO: 2958211 - RNA, 17 nt, Mycobacterium avium subsp. paratuberculosis
gcucggugaucaccaug

SEQ ID NO: 2958212 - RNA, 21 nt, Mycobacterium avium subsp. paratuberculosis
gcucggugaucaccaugauca

SEQ ID NO: 2958213 - RNA, 19 nt, Mycobacterium avium subsp. paratuberculosis
gcucggugaugaucgccgg

SEQ ID NO: 2958214 - RNA, 21 nt, Mycobacterium avium subsp. paratuberculosis
gcucggugaugaucgccgggu

SEQ ID NO: 2958215 - RNA, 22 nt, Mycobacterium avium subsp. paratuberculosis
gcucggugaugccgagcgccgc

SEQ ID NO: 2958216 - RNA, 12 nt, Mycobacterium avium subsp. paratuberculosis
gcucggugccgc

SEQ ID NO: 2958217 - RNA, 16 nt, Mycobacterium avium subsp. paratuberculosis
gcucggugcgcauggc

SEQ ID NO: 2958218 - RNA, 20 nt, Mycobacterium avium subsp. paratuberculosis
gcucggugcgcauggcgugc

SEQ ID NO: 2958219 - RNA, 15 nt, Mycobacterium avium subsp. paratuberculosis
gcucgguggcgucgg

SEQ ID NO: 2958220 - RNA, 18 nt, Mycobacterium avium subsp. paratuberculosis
gcucgguggcgucggcgg

SEQ ID NO: 2958221 - RNA, 19 nt, Mycobacterium avium subsp. paratuberculosis
gcucgguggcgucggcggc

SEQ ID NO: 2958222 - RNA, 20 nt, Mycobacterium avium subsp. paratuberculosis
gcucgguggcgucggcggcc

SEQ ID NO: 2958223 - RNA, 21 nt, Mycobacterium avium subsp. paratuberculosis
gcucgguggcgucggcggccu

SEQ ID NO: 2958224 - RNA, 14 nt, Mycobacterium avium subsp. paratuberculosis
gcucggugugcggu

SEQ ID NO: 2958225 - RNA, 20 nt, Mycobacterium avium subsp. paratuberculosis
gcucguaacgccacggcggc

SEQ ID NO: 2958226 - RNA, 23 nt, Mycobacterium avium subsp. paratuberculosis
gcucguagcuggugcgcagcccg

SEQ ID NO: 2958227 - RNA, 24 nt, Mycobacterium avium subsp. paratuberculosis
gcucguagcuggugcgcagcccgc

SEQ ID NO: 2958228 - RNA, 13 nt, Mycobacterium avium subsp. paratuberculosis
gcucgucagcgcg

SEQ ID NO: 2958229 - RNA, 14 nt, Mycobacterium avium subsp. paratuberculosis
gcucgucagcgcgg

SEQ ID NO: 2958230 - RNA, 16 nt, Mycobacterium avium subsp. paratuberculosis
gcucgucagcgcgggc

SEQ ID NO: 2958231 - RNA, 19 nt, Mycobacterium avium subsp. paratuberculosis
gcucgucagcgcgggccag

SEQ ID NO: 2958232 - RNA, 22 nt, Mycobacterium avium subsp. paratuberculosis
gcucgucagcgcgggccagcag

SEQ ID NO: 2958233 - RNA, 23 nt, Mycobacterium avium subsp. paratuberculosis
gcucgucagcgcgggccagcagu

SEQ ID NO: 2958234 - RNA, 15 nt, Mycobacterium avium subsp. paratuberculosis
gcucguccagcgugc

SEQ ID NO: 2958235 - RNA, 22 nt, Mycobacterium avium subsp. paratuberculosis
gcucguccucgaaagccgcugu

SEQ ID NO: 2958236 - RNA, 13 nt, Mycobacterium avium subsp. paratuberculosis
gcucguccuggcg

SEQ ID NO: 2958237 - RNA, 15 nt, Mycobacterium avium subsp. paratuberculosis
gcucguccuggcgcu

SEQ ID NO: 2958238 - RNA, 22 nt, Mycobacterium avium subsp. paratuberculosis
gcucgucgacgcugaccguggu

SEQ ID NO: 2958239 - RNA, 12 nt, Mycobacterium avium subsp. paratuberculosis
gcucgucgacgu

SEQ ID NO: 2958240 - RNA, 22 nt, Mycobacterium avium subsp. paratuberculosis
gcucgucgacguccucgcccgg

SEQ ID NO: 2958241 - RNA, 20 nt, Mycobacterium avium subsp. paratuberculosis
gcucgucgagcauccggcgc

SEQ ID NO: 2958242 - RNA, 12 nt, Mycobacterium avium subsp. paratuberculosis
gcucgucgaguc

SEQ ID NO: 2958243 - RNA, 21 nt, Mycobacterium avium subsp. paratuberculosis
gcucgucgcggaacagccggc

SEQ ID NO: 2958244 - RNA, 15 nt, Mycobacterium avium subsp. paratuberculosis
gcucgucgcggagga

SEQ ID NO: 2958245 - RNA, 14 nt, Mycobacterium avium subsp. paratuberculosis
gcucgucgcgggcg

SEQ ID NO: 2958246 - RNA, 15 nt, Mycobacterium avium subsp. paratuberculosis
gcucgucggccagcg

SEQ ID NO: 2958247 - RNA, 16 nt, Mycobacterium avium subsp. paratuberculosis
gcucgucggccagcga

SEQ ID NO: 2958248 - RNA, 18 nt, Mycobacterium avium subsp. paratuberculosis
gcucgucggccagcgagu

SEQ ID NO: 2958249 - RNA, 15 nt, Mycobacterium avium subsp. paratuberculosis
gcucgucggcgaaca

SEQ ID NO: 2958250 - RNA, 14 nt, Mycobacterium avium subsp. paratuberculosis
gcucgucggcgcgg

SEQ ID NO: 2958251 - RNA, 15 nt, Mycobacterium avium subsp. paratuberculosis
gcucgucggcgcggg

SEQ ID NO: 2958252 - RNA, 16 nt, Mycobacterium avium subsp. paratuberculosis
gcucgucggcgcgggc

SEQ ID NO: 2958253 - RNA, 14 nt, Mycobacterium avium subsp. paratuberculosis
gcucgucggcgggc

SEQ ID NO: 2958254 - RNA, 20 nt, Mycobacterium avium subsp. paratuberculosis
gcucgucggcgggcaccucg

SEQ ID NO: 2958255 - RNA, 15 nt, Mycobacterium avium subsp. paratuberculosis
gcucgucggggcagc

SEQ ID NO: 2958256 - RNA, 20 nt, Mycobacterium avium subsp. paratuberculosis
gcucgucggggcagccgucg

SEQ ID NO: 2958257 - RNA, 22 nt, Mycobacterium avium subsp. paratuberculosis
gcucgucggggcagccgucgau

SEQ ID NO: 2958258 - RNA, 19 nt, Mycobacterium avium subsp. paratuberculosis
gcucgucggguguggcgcc

SEQ ID NO: 2958259 - RNA, 21 nt, Mycobacterium avium subsp. paratuberculosis
gcucgucggguguggcgccgu

SEQ ID NO: 2958260 - RNA, 14 nt, Mycobacterium avium subsp. paratuberculosis
gcucgucggugacg

SEQ ID NO: 2958261 - RNA, 14 nt, Mycobacterium avium subsp. paratuberculosis
gcucgucgucgccg

SEQ ID NO: 2958262 - RNA, 15 nt, Mycobacterium avium subsp. paratuberculosis
gcucgucgucgccga

SEQ ID NO: 2958263 - RNA, 14 nt, Mycobacterium avium subsp. paratuberculosis
gcucgucgucggag

SEQ ID NO: 2958264 - RNA, 16 nt, Mycobacterium avium subsp. paratuberculosis
gcucgucgugauggcg

SEQ ID NO: 2958265 - RNA, 14 nt, Mycobacterium avium subsp. paratuberculosis
gcucgucgugggug

SEQ ID NO: 2958266 - RNA, 20 nt, Mycobacterium avium subsp. paratuberculosis
gcucgucgugggugacccgg

SEQ ID NO: 2958267 - RNA, 17 nt, Mycobacterium avium subsp. paratuberculosis
gcucgucguugaccugc

SEQ ID NO: 2958268 - RNA, 21 nt, Mycobacterium avium subsp. paratuberculosis
gcucgugaugguccagcaccg

SEQ ID NO: 2958269 - RNA, 17 nt, Mycobacterium avium subsp. paratuberculosis
gcucgugcaaaccggac

SEQ ID NO: 2958270 - RNA, 19 nt, Mycobacterium avium subsp. paratuberculosis
gcucgugcaaaccggaccg

SEQ ID NO: 2958271 - RNA, 20 nt, Mycobacterium avium subsp. paratuberculosis
gcucgugcaaaccggaccgc

SEQ ID NO: 2958272 - RNA, 23 nt, Mycobacterium avium subsp. paratuberculosis
gcucgugcaaaccggaccgccgc

SEQ ID NO: 2958273 - RNA, 13 nt, Mycobacterium avium subsp. paratuberculosis
gcucgugcagccg

SEQ ID NO: 2958274 - RNA, 14 nt, Mycobacterium avium subsp. paratuberculosis
gcucgugcagccgg

SEQ ID NO: 2958275 - RNA, 16 nt, Mycobacterium avium subsp. paratuberculosis
gcucgugcagccggcg

SEQ ID NO: 2958276 - RNA, 15 nt, Mycobacterium avium subsp. paratuberculosis
gcucguggcgggccc

SEQ ID NO: 2958277 - RNA, 20 nt, Mycobacterium avium subsp. paratuberculosis
gcucguggcgggcccgggcg

SEQ ID NO: 2958278 - RNA, 19 nt, Mycobacterium avium subsp. paratuberculosis
gcucgugggaaugcggcug

SEQ ID NO: 2958279 - RNA, 23 nt, Mycobacterium avium subsp. paratuberculosis
gcucguggguggucugcugggcg

SEQ ID NO: 2958280 - RNA, 18 nt, Mycobacterium avium subsp. paratuberculosis
gcucgugguucuccgcga

SEQ ID NO: 2958281 - RNA, 19 nt, Mycobacterium avium subsp. paratuberculosis
gcucgugguucuccgcgac

SEQ ID NO: 2958282 - RNA, 23 nt, Mycobacterium avium subsp. paratuberculosis
gcucguguccgaugacgagcagc

SEQ ID NO: 2958283 - RNA, 18 nt, Mycobacterium avium subsp. paratuberculosis
gcucguucucggcgaaca

SEQ ID NO: 2958284 - RNA, 22 nt, Mycobacterium avium subsp. paratuberculosis
gcucguugagcacacacagguc

SEQ ID NO: 2958285 - RNA, 13 nt, Mycobacterium avium subsp. paratuberculosis
gcucguugccggc

SEQ ID NO: 2958286 - RNA, 18 nt, Mycobacterium avium subsp. paratuberculosis
gcucguugccggcggcca

SEQ ID NO: 2958287 - RNA, 21 nt, Mycobacterium avium subsp. paratuberculosis
gcucguugccggcggccagca

SEQ ID NO: 2958288 - RNA, 21 nt, Mycobacterium avium subsp. paratuberculosis
gcucguugugaauccagccgu

SEQ ID NO: 2958289 - RNA, 22 nt, Mycobacterium avium subsp. paratuberculosis
gcucguugugaauccagccgug

SEQ ID NO: 2958290 - RNA, 14 nt, Mycobacterium avium subsp. paratuberculosis
gcucguugugcaug

SEQ ID NO: 2958291 - RNA, 20 nt, Mycobacterium avium subsp. paratuberculosis
gcucuccugcuugaccgugg

SEQ ID NO: 2958292 - RNA, 16 nt, Mycobacterium avium subsp. paratuberculosis
gcugaccggcggugcc

SEQ ID NO: 2958293 - RNA, 17 nt, Mycobacterium avium subsp. paratuberculosis
gcugaccggcggugccg

SEQ ID NO: 2958294 - RNA, 20 nt, Mycobacterium avium subsp. paratuberculosis
gcugaccggcggugccggcc

SEQ ID NO: 2958295 - RNA, 14 nt, Mycobacterium avium subsp. paratuberculosis
gcugaccgucgacc

SEQ ID NO: 2958296 - RNA, 15 nt, Mycobacterium avium subsp. paratuberculosis
gcugaccgucgacca

SEQ ID NO: 2958297 - RNA, 16 nt, Mycobacterium avium subsp. paratuberculosis
gcugaccgucgaccaa

SEQ ID NO: 2958298 - RNA, 13 nt, Mycobacterium avium subsp. paratuberculosis
gcugaccguggug

SEQ ID NO: 2958299 - RNA, 17 nt, Mycobacterium avium subsp. paratuberculosis
gcugaccguggugucgg

SEQ ID NO: 2958300 - RNA, 16 nt, Mycobacterium avium subsp. paratuberculosis
gcugaccucgccgccc

SEQ ID NO: 2958301 - RNA, 16 nt, Mycobacterium avium subsp. paratuberculosis
gcugaccucgcgcacc

SEQ ID NO: 2958302 - RNA, 20 nt, Mycobacterium avium subsp. paratuberculosis
gcugaccucgcgcaccggcu

SEQ ID NO: 2958303 - RNA, 22 nt, Mycobacterium avium subsp. paratuberculosis
gcugaccucgcgcaccggcugc

SEQ ID NO: 2958304 - RNA, 18 nt, Mycobacterium avium subsp. paratuberculosis
gcugaccugugcgcccca

SEQ ID NO: 2958305 - RNA, 19 nt, Mycobacterium avium subsp. paratuberculosis
gcugaccugugcgccccac

SEQ ID NO: 2958306 - RNA, 22 nt, Mycobacterium avium subsp. paratuberculosis
gcugaccugugcgccccacggc

SEQ ID NO: 2958307 - RNA, 22 nt, Mycobacterium avium subsp. paratuberculosis
gcugaccuucuuggucagcggc

SEQ ID NO: 2958308 - RNA, 16 nt, Mycobacterium avium subsp. paratuberculosis
gcugacgaacgcgccg

SEQ ID NO: 2958309 - RNA, 18 nt, Mycobacterium avium subsp. paratuberculosis
gcugacgaacgcgccgcc

SEQ ID NO: 2958310 - RNA, 21 nt, Mycobacterium avium subsp. paratuberculosis
gcugacgaugauccuggccug

SEQ ID NO: 2958311 - RNA, 16 nt, Mycobacterium avium subsp. paratuberculosis
gcugacgaugcggccg

SEQ ID NO: 2958312 - RNA, 15 nt, Mycobacterium avium subsp. paratuberculosis
gcugacgauggcgac

SEQ ID NO: 2958313 - RNA, 18 nt, Mycobacterium avium subsp. paratuberculosis
gcugacgauggcgaccgc

SEQ ID NO: 2958314 - RNA, 21 nt, Mycobacterium avium subsp. paratuberculosis
gcugacgauggcgaccgcgca

SEQ ID NO: 2958315 - RNA, 14 nt, Mycobacterium avium subsp. paratuberculosis
gcugacgccgagca

SEQ ID NO: 2958316 - RNA, 16 nt, Mycobacterium avium subsp. paratuberculosis
gcugacgccgcggugc

SEQ ID NO: 2958317 - RNA, 23 nt, Mycobacterium avium subsp. paratuberculosis
gcugacgccguugcggugcucgu

SEQ ID NO: 2958318 - RNA, 14 nt, Mycobacterium avium subsp. paratuberculosis
gcugacgcgaccgc

SEQ ID NO: 2958319 - RNA, 16 nt, Mycobacterium avium subsp. paratuberculosis
gcugacgcgaccgcgc

SEQ ID NO: 2958320 - RNA, 18 nt, Mycobacterium avium subsp. paratuberculosis
gcugacgcgaccgcgcgg

SEQ ID NO: 2958321 - RNA, 21 nt, Mycobacterium avium subsp. paratuberculosis
gcugacgcgaccgcgcggcga

SEQ ID NO: 2958322 - RNA, 11 nt, Mycobacterium avium subsp. paratuberculosis
gcugacggcca

SEQ ID NO: 2958323 - RNA, 14 nt, Mycobacterium avium subsp. paratuberculosis
gcugacggcgucgu

SEQ ID NO: 2958324 - RNA, 16 nt, Mycobacterium avium subsp. paratuberculosis
gcugacgggaccgcac

SEQ ID NO: 2958325 - RNA, 15 nt, Mycobacterium avium subsp. paratuberculosis
gcugacgggccggcg

SEQ ID NO: 2958326 - RNA, 13 nt, Mycobacterium avium subsp. paratuberculosis
gcugacggucgcc

SEQ ID NO: 2958327 - RNA, 15 nt, Mycobacterium avium subsp. paratuberculosis
gcugacggucgccga

SEQ ID NO: 2958328 - RNA, 16 nt, Mycobacterium avium subsp. paratuberculosis
gcugacgucgaugccg

SEQ ID NO: 2958329 - RNA, 14 nt, Mycobacterium avium subsp. paratuberculosis
gcugacgucgucgc

SEQ ID NO: 2958330 - RNA, 22 nt, Mycobacterium avium subsp. paratuberculosis
gcugacgucgucgcccaccgug

SEQ ID NO: 2958331 - RNA, 19 nt, Mycobacterium avium subsp. paratuberculosis
gcugacugccggcgacggu

SEQ ID NO: 2958332 - RNA, 16 nt, Mycobacterium avium subsp. paratuberculosis
gcugacugcgaucgcc

SEQ ID NO: 2958333 - RNA, 18 nt, Mycobacterium avium subsp. paratuberculosis
gcugacugcgaucgccga

SEQ ID NO: 2958334 - RNA, 23 nt, Mycobacterium avium subsp. paratuberculosis
gcugacugcgaucgccgacgcca

SEQ ID NO: 2958335 - RNA, 16 nt, Mycobacterium avium subsp. paratuberculosis
gcugagcaaccgccga

SEQ ID NO: 2958336 - RNA, 17 nt, Mycobacterium avium subsp. paratuberculosis
gcugagcaaccgccgaa

SEQ ID NO: 2958337 - RNA, 21 nt, Mycobacterium avium subsp. paratuberculosis
gcugagcaauucggugacggc

SEQ ID NO: 2958338 - RNA, 15 nt, Mycobacterium avium subsp. paratuberculosis
gcugagcacccgccc

SEQ ID NO: 2958339 - RNA, 21 nt, Mycobacterium avium subsp. paratuberculosis
gcugagcacccgcccggacgc

SEQ ID NO: 2958340 - RNA, 14 nt, Mycobacterium avium subsp. paratuberculosis
gcugagcaccgggg

SEQ ID NO: 2958341 - RNA, 17 nt, Mycobacterium avium subsp. paratuberculosis
gcugagcaccggggucu

SEQ ID NO: 2958342 - RNA, 16 nt, Mycobacterium avium subsp. paratuberculosis
gcugagcagcacccga

SEQ ID NO: 2958343 - RNA, 18 nt, Mycobacterium avium subsp. paratuberculosis
gcugagcagcacccgacu

SEQ ID NO: 2958344 - RNA, 14 nt, Mycobacterium avium subsp. paratuberculosis
gcugagcagcaggu

SEQ ID NO: 2958345 - RNA, 15 nt, Mycobacterium avium subsp. paratuberculosis
gcugagcagcagguc

SEQ ID NO: 2958346 - RNA, 19 nt, Mycobacterium avium subsp. paratuberculosis
gcugagcagcaggucggcg

SEQ ID NO: 2958347 - RNA, 14 nt, Mycobacterium avium subsp. paratuberculosis
gcugagcagcccga

SEQ ID NO: 2958348 - RNA, 23 nt, Mycobacterium avium subsp. paratuberculosis
gcugagcagcccgaccaccuccc

SEQ ID NO: 2958349 - RNA, 15 nt, Mycobacterium avium subsp. paratuberculosis
gcugagcagcucgcg

SEQ ID NO: 2958350 - RNA, 13 nt, Mycobacterium avium subsp. paratuberculosis
gcugagccgccga

SEQ ID NO: 2958351 - RNA, 14 nt, Mycobacterium avium subsp. paratuberculosis
gcugagccgccgag

SEQ ID NO: 2958352 - RNA, 16 nt, Mycobacterium avium subsp. paratuberculosis
gcugagccgccgagcc

SEQ ID NO: 2958353 - RNA, 17 nt, Mycobacterium avium subsp. paratuberculosis
gcugagccgccgagccg

SEQ ID NO: 2958354 - RNA, 18 nt, Mycobacterium avium subsp. paratuberculosis
gcugagccgccgagccgg

SEQ ID NO: 2958355 - RNA, 14 nt, Mycobacterium avium subsp. paratuberculosis
gcugagccggcccu

SEQ ID NO: 2958356 - RNA, 23 nt, Mycobacterium avium subsp. paratuberculosis
gcugagccggcccugcggccagu

SEQ ID NO: 2958357 - RNA, 17 nt, Mycobacterium avium subsp. paratuberculosis
gcugagcgacauggucg

SEQ ID NO: 2958358 - RNA, 14 nt, Mycobacterium avium subsp. paratuberculosis
gcugagcgccaggc

SEQ ID NO: 2958359 - RNA, 19 nt, Mycobacterium avium subsp. paratuberculosis
gcugagcgccaggccaugg

SEQ ID NO: 2958360 - RNA, 21 nt, Mycobacterium avium subsp. paratuberculosis
gcugagcgccaggccauggcg

SEQ ID NO: 2958361 - RNA, 21 nt, Mycobacterium avium subsp. paratuberculosis
gcugagcggguaaccgcagcc

SEQ ID NO: 2958362 - RNA, 17 nt, Mycobacterium avium subsp. paratuberculosis
gcugagcgggucggccg

SEQ ID NO: 2958363 - RNA, 20 nt, Mycobacterium avium subsp. paratuberculosis
gcugagcgggucggccggcg

SEQ ID NO: 2958364 - RNA, 21 nt, Mycobacterium avium subsp. paratuberculosis
gcugagcgggucggccggcgg

SEQ ID NO: 2958365 - RNA, 22 nt, Mycobacterium avium subsp. paratuberculosis
gcugagcgggucggccggcggg

SEQ ID NO: 2958366 - RNA, 13 nt, Mycobacterium avium subsp. paratuberculosis
gcugagcgucggu

SEQ ID NO: 2958367 - RNA, 23 nt, Mycobacterium avium subsp. paratuberculosis
gcugagcguggugaagcagaacg

SEQ ID NO: 2958368 - RNA, 16 nt, Mycobacterium avium subsp. paratuberculosis
gcugagcugcgcccac

SEQ ID NO: 2958369 - RNA, 18 nt, Mycobacterium avium subsp. paratuberculosis
gcugagcugcgcccacgu

SEQ ID NO: 2958370 - RNA, 19 nt, Mycobacterium avium subsp. paratuberculosis
gcugagcuucugcccggcc

SEQ ID NO: 2958371 - RNA, 21 nt, Mycobacterium avium subsp. paratuberculosis
gcugagcuucugcccggccag

SEQ ID NO: 2958372 - RNA, 22 nt, Mycobacterium avium subsp. paratuberculosis
gcugagcuucugcccggccagc

SEQ ID NO: 2958373 - RNA, 18 nt, Mycobacterium avium subsp. paratuberculosis
gcugaggaugguggugca

SEQ ID NO: 2958374 - RNA, 18 nt, Mycobacterium avium subsp. paratuberculosis
gcugaggccgccccggcc

SEQ ID NO: 2958375 - RNA, 22 nt, Mycobacterium avium subsp. paratuberculosis
gcugaggccgccccggccgcgc

SEQ ID NO: 2958376 - RNA, 15 nt, Mycobacterium avium subsp. paratuberculosis
gcugaggcugcgggu

SEQ ID NO: 2958377 - RNA, 14 nt, Mycobacterium avium subsp. paratuberculosis
gcugcagccggccg

SEQ ID NO: 2958378 - RNA, 15 nt, Mycobacterium avium subsp. paratuberculosis
gcugcagccggccgg

SEQ ID NO: 2958379 - RNA, 17 nt, Mycobacterium avium subsp. paratuberculosis
gcugcagccggccggcg

SEQ ID NO: 2958380 - RNA, 18 nt, Mycobacterium avium subsp. paratuberculosis
gcugcagccggccggcgg

SEQ ID NO: 2958381 - RNA, 20 nt, Mycobacterium avium subsp. paratuberculosis
gcugcagccggccggcggac

SEQ ID NO: 2958382 - RNA, 20 nt, Mycobacterium avium subsp. paratuberculosis
gcugcagccgggcggcggcc

SEQ ID NO: 2958383 - RNA, 21 nt, Mycobacterium avium subsp. paratuberculosis
gcugcagccgggcggcggccu

SEQ ID NO: 2958384 - RNA, 19 nt, Mycobacterium avium subsp. paratuberculosis
gcugcagccgguccggcgg

SEQ ID NO: 2958385 - RNA, 19 nt, Mycobacterium avium subsp. paratuberculosis
gcugcagcgacugcacccg

SEQ ID NO: 2958386 - RNA, 15 nt, Mycobacterium avium subsp. paratuberculosis
gcugcagcgagaccu

SEQ ID NO: 2958387 - RNA, 18 nt, Mycobacterium avium subsp. paratuberculosis
gcugcagcgagaccuccc

SEQ ID NO: 2958388 - RNA, 22 nt, Mycobacterium avium subsp. paratuberculosis
gcugcagcgagaccucccggcg

SEQ ID NO: 2958389 - RNA, 23 nt, Mycobacterium avium subsp. paratuberculosis
gcugcagcgagaccucccggcgc

SEQ ID NO: 2958390 - RNA, 13 nt, Mycobacterium avium subsp. paratuberculosis
gcugcagcgcccg

SEQ ID NO: 2958391 - RNA, 14 nt, Mycobacterium avium subsp. paratuberculosis
gcugcagcgcccgg

SEQ ID NO: 2958392 - RNA, 15 nt, Mycobacterium avium subsp. paratuberculosis
gcugcagcgcccggg

SEQ ID NO: 2958393 - RNA, 17 nt, Mycobacterium avium subsp. paratuberculosis
gcugcagcgcccgggcc

SEQ ID NO: 2958394 - RNA, 20 nt, Mycobacterium avium subsp. paratuberculosis
gcugcagcgccgaggccagc

SEQ ID NO: 2958395 - RNA, 22 nt, Mycobacterium avium subsp. paratuberculosis
gcugcagcgccgaggccagcac

SEQ ID NO: 2958396 - RNA, 14 nt, Mycobacterium avium subsp. paratuberculosis
gcugcagcgccgcc

SEQ ID NO: 2958397 - RNA, 15 nt, Mycobacterium avium subsp. paratuberculosis
gcugcagcgccgccc

SEQ ID NO: 2958398 - RNA, 17 nt, Mycobacterium avium subsp. paratuberculosis
gcugcagcgccgcccgc

SEQ ID NO: 2958399 - RNA, 16 nt, Mycobacterium avium subsp. paratuberculosis
gcugcagcgcgaagga

SEQ ID NO: 2958400 - RNA, 21 nt, Mycobacterium avium subsp. paratuberculosis
gcugcagcggaaacgacgucg

SEQ ID NO: 2958401 - RNA, 12 nt, Mycobacterium avium subsp. paratuberculosis
gcugcagcggcg

SEQ ID NO: 2958402 - RNA, 13 nt, Mycobacterium avium subsp. paratuberculosis
gcugcagcggcgg

SEQ ID NO: 2958403 - RNA, 14 nt, Mycobacterium avium subsp. paratuberculosis
gcugcagcggcggc

SEQ ID NO: 2958404 - RNA, 15 nt, Mycobacterium avium subsp. paratuberculosis
gcugcagcggcggcc

SEQ ID NO: 2958405 - RNA, 16 nt, Mycobacterium avium subsp. paratuberculosis
gcugcagcggcggcca

SEQ ID NO: 2958406 - RNA, 17 nt, Mycobacterium avium subsp. paratuberculosis
gcugcagcggcggccag

SEQ ID NO: 2958407 - RNA, 15 nt, Mycobacterium avium subsp. paratuberculosis
gcugcagcuccucgg

SEQ ID NO: 2958408 - RNA, 18 nt, Mycobacterium avium subsp. paratuberculosis
gcugcagcuccucggcgg

SEQ ID NO: 2958409 - RNA, 19 nt, Mycobacterium avium subsp. paratuberculosis
gcugcagcuccucggcggc

SEQ ID NO: 2958410 - RNA, 20 nt, Mycobacterium avium subsp. paratuberculosis
gcugcagcuccucggcggcc

SEQ ID NO: 2958411 - RNA, 21 nt, Mycobacterium avium subsp. paratuberculosis
gcugcagcuccucggcggccu

SEQ ID NO: 2958412 - RNA, 13 nt, Mycobacterium avium subsp. paratuberculosis
gcugcagcugcuc

SEQ ID NO: 2958413 - RNA, 15 nt, Mycobacterium avium subsp. paratuberculosis
gcugcagcugcucgu

SEQ ID NO: 2958414 - RNA, 15 nt, Mycobacterium avium subsp. paratuberculosis
gcugcaggcgacgaa

SEQ ID NO: 2958415 - RNA, 16 nt, Mycobacterium avium subsp. paratuberculosis
gcugcaggcuggucug

SEQ ID NO: 2958416 - RNA, 20 nt, Mycobacterium avium subsp. paratuberculosis
gcugcaggcuggucuggugg

SEQ ID NO: 2958417 - RNA, 13 nt, Mycobacterium avium subsp. paratuberculosis
gcugcagggccgg

SEQ ID NO: 2958418 - RNA, 18 nt, Mycobacterium avium subsp. paratuberculosis
gcugcagggccgggucga

SEQ ID NO: 2958419 - RNA, 23 nt, Mycobacterium avium subsp. paratuberculosis
gcugcagggccgggucgaacggc

SEQ ID NO: 2958420 - RNA, 18 nt, Mycobacterium avium subsp. paratuberculosis
gcugcagguggcccacac

SEQ ID NO: 2958421 - RNA, 22 nt, Mycobacterium avium subsp. paratuberculosis
gcugcagguugauccggauccg

SEQ ID NO: 2958422 - RNA, 15 nt, Mycobacterium avium subsp. paratuberculosis
gcugcaguagccggc

SEQ ID NO: 2958423 - RNA, 17 nt, Mycobacterium avium subsp. paratuberculosis
gcugcaguagccggcca

SEQ ID NO: 2958424 - RNA, 19 nt, Mycobacterium avium subsp. paratuberculosis
gcugcaguagccggccagc

SEQ ID NO: 2958425 - RNA, 14 nt, Mycobacterium avium subsp. paratuberculosis
gcugcauccgcagc

SEQ ID NO: 2958426 - RNA, 15 nt, Mycobacterium avium subsp. paratuberculosis
gcugcauccgcagca

SEQ ID NO: 2958427 - RNA, 20 nt, Mycobacterium avium subsp. paratuberculosis
gcugcauccgcagcaccagg

SEQ ID NO: 2958428 - RNA, 14 nt, Mycobacterium avium subsp. paratuberculosis
gcugcaucuccagc

SEQ ID NO: 2958429 - RNA, 17 nt, Mycobacterium avium subsp. paratuberculosis
gcugcaucuccagccgc

SEQ ID NO: 2958430 - RNA, 20 nt, Mycobacterium avium subsp. paratuberculosis
gcugcaucuccagccgcggc

SEQ ID NO: 2958431 - RNA, 22 nt, Mycobacterium avium subsp. paratuberculosis
gcugcaucuccguggacggcga

SEQ ID NO: 2958432 - RNA, 18 nt, Mycobacterium avium subsp. paratuberculosis
gcugcaugccggugucgg

SEQ ID NO: 2958433 - RNA, 15 nt, Mycobacterium avium subsp. paratuberculosis
gcugcaugccgucga

SEQ ID NO: 2958434 - RNA, 19 nt, Mycobacterium avium subsp. paratuberculosis
gcugccaagauugggccac

SEQ ID NO: 2958435 - RNA, 18 nt, Mycobacterium avium subsp. paratuberculosis
gcugccacgguuucgccg

SEQ ID NO: 2958436 - RNA, 12 nt, Mycobacterium avium subsp. paratuberculosis
gcugccagggcc

SEQ ID NO: 2958437 - RNA, 16 nt, Mycobacterium avium subsp. paratuberculosis
gcugccagggccgggc

SEQ ID NO: 2958438 - RNA, 13 nt, Mycobacterium avium subsp. paratuberculosis
gcugcccaaccgu

SEQ ID NO: 2958439 - RNA, 19 nt, Mycobacterium avium subsp. paratuberculosis
gcugcccaacgucgacuug

SEQ ID NO: 2958440 - RNA, 18 nt, Mycobacterium avium subsp. paratuberculosis
gcugcccaccaccagggg

SEQ ID NO: 2958441 - RNA, 21 nt, Mycobacterium avium subsp. paratuberculosis
gcugcccaccaccaggggcag

SEQ ID NO: 2958442 - RNA, 23 nt, Mycobacterium avium subsp. paratuberculosis
gcugcccaccaccaggggcagcu

SEQ ID NO: 2958443 - RNA, 21 nt, Mycobacterium avium subsp. paratuberculosis
gcugcccagauacgccgcgac

SEQ ID NO: 2958444 - RNA, 14 nt, Mycobacterium avium subsp. paratuberculosis
gcugcccagcgcgg

SEQ ID NO: 2958445 - RNA, 15 nt, Mycobacterium avium subsp. paratuberculosis
gcugcccagcgcggu

SEQ ID NO: 2958446 - RNA, 19 nt, Mycobacterium avium subsp. paratuberculosis
gcugcccagcgcggucgcc

SEQ ID NO: 2958447 - RNA, 22 nt, Mycobacterium avium subsp. paratuberculosis
gcugcccaggaucaccgggacg

SEQ ID NO: 2958448 - RNA, 23 nt, Mycobacterium avium subsp. paratuberculosis
gcugcccaggaucaccgggacgg

SEQ ID NO: 2958449 - RNA, 19 nt, Mycobacterium avium subsp. paratuberculosis
gcugcccauccaggccagc

SEQ ID NO: 2958450 - RNA, 20 nt, Mycobacterium avium subsp. paratuberculosis
gcugcccauccaggccagca

SEQ ID NO: 2958451 - RNA, 22 nt, Mycobacterium avium subsp. paratuberculosis
gcugcccauccaggccagcacc

SEQ ID NO: 2958452 - RNA, 21 nt, Mycobacterium avium subsp. paratuberculosis
gcugccccagccacagccgca

SEQ ID NO: 2958453 - RNA, 16 nt, Mycobacterium avium subsp. paratuberculosis
gcugccccggcgaggc

SEQ ID NO: 2958454 - RNA, 20 nt, Mycobacterium avium subsp. paratuberculosis
gcugccccggcgaggccagg

SEQ ID NO: 2958455 - RNA, 21 nt, Mycobacterium avium subsp. paratuberculosis
gcugccccggcgaggccaggc

SEQ ID NO: 2958456 - RNA, 12 nt, Mycobacterium avium subsp. paratuberculosis
gcugccccuucg

SEQ ID NO: 2958457 - RNA, 13 nt, Mycobacterium avium subsp. paratuberculosis
gcugcccgacccg

SEQ ID NO: 2958458 - RNA, 14 nt, Mycobacterium avium subsp. paratuberculosis
gcugcccgacccgc

SEQ ID NO: 2958459 - RNA, 19 nt, Mycobacterium avium subsp. paratuberculosis
gcugcccgacccgcaccac

SEQ ID NO: 2958460 - RNA, 22 nt, Mycobacterium avium subsp. paratuberculosis
gcugcccgacccgcaccaccgc

SEQ ID NO: 2958461 - RNA, 13 nt, Mycobacterium avium subsp. paratuberculosis
gcugcccgagcgg

SEQ ID NO: 2958462 - RNA, 17 nt, Mycobacterium avium subsp. paratuberculosis
gcugccguccacccggc

SEQ ID NO: 2958463 - RNA, 20 nt, Mycobacterium avium subsp. paratuberculosis
gcugccguccacccggccca

SEQ ID NO: 2958464 - RNA, 15 nt, Mycobacterium avium subsp. paratuberculosis
gcugccguccggcgg

SEQ ID NO: 2958465 - RNA, 15 nt, Mycobacterium avium subsp. paratuberculosis
gcugccguucgccgg

SEQ ID NO: 2958466 - RNA, 17 nt, Mycobacterium avium subsp. paratuberculosis
gcugccguugcgccagc

SEQ ID NO: 2958467 - RNA, 15 nt, Mycobacterium avium subsp. paratuberculosis
gcugccguugggcac

SEQ ID NO: 2958468 - RNA, 20 nt, Mycobacterium avium subsp. paratuberculosis
gcugccguugggcacggugu

SEQ ID NO: 2958469 - RNA, 17 nt, Mycobacterium avium subsp. paratuberculosis
gcugcgaaucgucggcg

SEQ ID NO: 2958470 - RNA, 20 nt, Mycobacterium avium subsp. paratuberculosis
gcugcgaaucgucggcgaug

SEQ ID NO: 2958471 - RNA, 22 nt, Mycobacterium avium subsp. paratuberculosis
gcugcgacagcacgggcgggca

SEQ ID NO: 2958472 - RNA, 17 nt, Mycobacterium avium subsp. paratuberculosis
gcugcgacaggucggcg

SEQ ID NO: 2958473 - RNA, 18 nt, Mycobacterium avium subsp. paratuberculosis
gcugcgacaggucggcgg

SEQ ID NO: 2958474 - RNA, 15 nt, Mycobacterium avium subsp. paratuberculosis
gcugcgagaucggca

SEQ ID NO: 2958475 - RNA, 15 nt, Mycobacterium avium subsp. paratuberculosis
gcugcgagcccggcc

SEQ ID NO: 2958476 - RNA, 15 nt, Mycobacterium avium subsp. paratuberculosis
gcugcgaggcgggca

SEQ ID NO: 2958477 - RNA, 17 nt, Mycobacterium avium subsp. paratuberculosis
gcugcgauugguggccc

SEQ ID NO: 2958478 - RNA, 20 nt, Mycobacterium avium subsp. paratuberculosis
gcugcgauugguggcccggu

SEQ ID NO: 2958479 - RNA, 16 nt, Mycobacterium avium subsp. paratuberculosis
gcugcgcaacaccucg

SEQ ID NO: 2958480 - RNA, 19 nt, Mycobacterium avium subsp. paratuberculosis
gcugcgcaacaccucggcg

SEQ ID NO: 2958481 - RNA, 20 nt, Mycobacterium avium subsp. paratuberculosis
gcugcgcaacaccucggcga

SEQ ID NO: 2958482 - RNA, 21 nt, Mycobacterium avium subsp. paratuberculosis
gcugcgcaacaccucggcgac

SEQ ID NO: 2958483 - RNA, 13 nt, Mycobacterium avium subsp. paratuberculosis
gcugcgcacccgg

SEQ ID NO: 2958484 - RNA, 14 nt, Mycobacterium avium subsp. paratuberculosis
gcugcgcacccggu

SEQ ID NO: 2958485 - RNA, 19 nt, Mycobacterium avium subsp. paratuberculosis
gcugcgcacguagcccagc

SEQ ID NO: 2958486 - RNA, 21 nt, Mycobacterium avium subsp. paratuberculosis
gcugcgcacguagcccagcgc

SEQ ID NO: 2958487 - RNA, 14 nt, Mycobacterium avium subsp. paratuberculosis
gcugcgcagacccg

SEQ ID NO: 2958488 - RNA, 20 nt, Mycobacterium avium subsp. paratuberculosis
gcugcgcagacccgguggcc

SEQ ID NO: 2958489 - RNA, 23 nt, Mycobacterium avium subsp. paratuberculosis
gcugcgcagacccgguggccgag

SEQ ID NO: 2958490 - RNA, 14 nt, Mycobacterium avium subsp. paratuberculosis
gcugcgcagcaccg

SEQ ID NO: 2958491 - RNA, 12 nt, Mycobacterium avium subsp. paratuberculosis
gcugcgcagcag

SEQ ID NO: 2958492 - RNA, 13 nt, Mycobacterium avium subsp. paratuberculosis
gcugcgcagcagc

SEQ ID NO: 2958493 - RNA, 16 nt, Mycobacterium avium subsp. paratuberculosis
gcugcgcagcagcgcc

SEQ ID NO: 2958494 - RNA, 21 nt, Mycobacterium avium subsp. paratuberculosis
gcugcgcagcagcgccagcag

SEQ ID NO: 2958495 - RNA, 15 nt, Mycobacterium avium subsp. paratuberculosis
gcugcgcagccgugc

SEQ ID NO: 2958496 - RNA, 17 nt, Mycobacterium avium subsp. paratuberculosis
gcugcgcagccgugccc

SEQ ID NO: 2958497 - RNA, 20 nt, Mycobacterium avium subsp. paratuberculosis
gcugcgccacaacuggccgg

SEQ ID NO: 2958498 - RNA, 23 nt, Mycobacterium avium subsp. paratuberculosis
gcugcgccacaacuggccgggau

SEQ ID NO: 2958499 - RNA, 13 nt, Mycobacterium avium subsp. paratuberculosis
gcugcgccagccg

SEQ ID NO: 2958500 - RNA, 18 nt, Mycobacterium avium subsp. paratuberculosis
gcugcgccagccgucgcc

SEQ ID NO: 2958501 - RNA, 19 nt, Mycobacterium avium subsp. paratuberculosis
gcugcgccagccgucgccg

SEQ ID NO: 2958502 - RNA, 24 nt, Mycobacterium avium subsp. paratuberculosis
gcugcgccaucuucacgugcgcgg

SEQ ID NO: 2958503 - RNA, 16 nt, Mycobacterium avium subsp. paratuberculosis
gcugcgcccacgugcc

SEQ ID NO: 2958504 - RNA, 19 nt, Mycobacterium avium subsp. paratuberculosis
gcugcgcccagcgcgcgau

SEQ ID NO: 2958505 - RNA, 13 nt, Mycobacterium avium subsp. paratuberculosis
gcugcgcccgccg

SEQ ID NO: 2958506 - RNA, 16 nt, Mycobacterium avium subsp. paratuberculosis
gcugcgcccgccgcca

SEQ ID NO: 2958507 - RNA, 22 nt, Mycobacterium avium subsp. paratuberculosis
gcugcgcccgccgccaccacgg

SEQ ID NO: 2958508 - RNA, 23 nt, Mycobacterium avium subsp. paratuberculosis
gcugcgcccgccgccaccacggc

SEQ ID NO: 2958509 - RNA, 12 nt, Mycobacterium avium subsp. paratuberculosis
gcugcgcccggu

SEQ ID NO: 2958510 - RNA, 12 nt, Mycobacterium avium subsp. paratuberculosis
gcugcgccgcgc

SEQ ID NO: 2958511 - RNA, 15 nt, Mycobacterium avium subsp. paratuberculosis
gcugcgccgcgucga

SEQ ID NO: 2958512 - RNA, 16 nt, Mycobacterium avium subsp. paratuberculosis
gcugcgccgcgucgac

SEQ ID NO: 2958513 - RNA, 19 nt, Mycobacterium avium subsp. paratuberculosis
gcugcgccgcgucgacgcc

SEQ ID NO: 2958514 - RNA, 20 nt, Mycobacterium avium subsp. paratuberculosis
gcugcgccgcgucgacgccg

SEQ ID NO: 2958515 - RNA, 21 nt, Mycobacterium avium subsp. paratuberculosis
gcugcgccgcgucgacgccgc

SEQ ID NO: 2958516 - RNA, 19 nt, Mycobacterium avium subsp. paratuberculosis
gcugcgccggcgcggccag

SEQ ID NO: 2958517 - RNA, 15 nt, Mycobacterium avium subsp. paratuberculosis
gcugcgccggcggua

SEQ ID NO: 2958518 - RNA, 17 nt, Mycobacterium avium subsp. paratuberculosis
gcugcgcgacaccugcu

SEQ ID NO: 2958519 - RNA, 14 nt, Mycobacterium avium subsp. paratuberculosis
gcugcgcgaccugc

SEQ ID NO: 2958520 - RNA, 16 nt, Mycobacterium avium subsp. paratuberculosis
gcugcgcgccccggcc

SEQ ID NO: 2958521 - RNA, 18 nt, Mycobacterium avium subsp. paratuberculosis
gcugcgcgccccggcccg

SEQ ID NO: 2958522 - RNA, 23 nt, Mycobacterium avium subsp. paratuberculosis
gcugcgcgccccggcccggcgaa

SEQ ID NO: 2958523 - RNA, 13 nt, Mycobacterium avium subsp. paratuberculosis
gcugcgcgccgcc

SEQ ID NO: 2958524 - RNA, 14 nt, Mycobacterium avium subsp. paratuberculosis
gcugcgcgccgccc

SEQ ID NO: 2958525 - RNA, 14 nt, Mycobacterium avium subsp. paratuberculosis
gcugcgcgccggcg

SEQ ID NO: 2958526 - RNA, 15 nt, Mycobacterium avium subsp. paratuberculosis
gcugcgcgccggcgg

SEQ ID NO: 2958527 - RNA, 15 nt, Mycobacterium avium subsp. paratuberculosis
gcugcgcgcgcgauc

SEQ ID NO: 2958528 - RNA, 17 nt, Mycobacterium avium subsp. paratuberculosis
gcugcgcgcgcgaucgg

SEQ ID NO: 2958529 - RNA, 19 nt, Mycobacterium avium subsp. paratuberculosis
gcugcgcgcgcgaucggug

SEQ ID NO: 2958530 - RNA, 21 nt, Mycobacterium avium subsp. paratuberculosis
gcugcgcgcguuguccagcag

SEQ ID NO: 2958531 - RNA, 13 nt, Mycobacterium avium subsp. paratuberculosis
gcugcgcggcacg

SEQ ID NO: 2958532 - RNA, 12 nt, Mycobacterium avium subsp. paratuberculosis
gcugcgcggccg

SEQ ID NO: 2958533 - RNA, 14 nt, Mycobacterium avium subsp. paratuberculosis
gcugcgcggcggcg

SEQ ID NO: 2958534 - RNA, 13 nt, Mycobacterium avium subsp. paratuberculosis
gcugcgcggcuug

SEQ ID NO: 2958535 - RNA, 15 nt, Mycobacterium avium subsp. paratuberculosis
gcugcgcgggcgcgg

SEQ ID NO: 2958536 - RNA, 17 nt, Mycobacterium avium subsp. paratuberculosis
gcugcgcgggcgcggcc

SEQ ID NO: 2958537 - RNA, 16 nt, Mycobacterium avium subsp. paratuberculosis
gcugcgcgggucggcg

SEQ ID NO: 2958538 - RNA, 19 nt, Mycobacterium avium subsp. paratuberculosis
gcugcgcgggucggcgccg

SEQ ID NO: 2958539 - RNA, 22 nt, Mycobacterium avium subsp. paratuberculosis
gcugcgcgggucggcgccggcc

SEQ ID NO: 2958540 - RNA, 14 nt, Mycobacterium avium subsp. paratuberculosis
gcugcgcgguggcg

SEQ ID NO: 2958541 - RNA, 12 nt, Mycobacterium avium subsp. paratuberculosis
gcugcgcgucga

SEQ ID NO: 2958542 - RNA, 15 nt, Mycobacterium avium subsp. paratuberculosis
gcugcgcgucgaaga

SEQ ID NO: 2958543 - RNA, 14 nt, Mycobacterium avium subsp. paratuberculosis
gcugcgcgucgagc

SEQ ID NO: 2958544 - RNA, 22 nt, Mycobacterium avium subsp. paratuberculosis
gcugcgcgucgagcagcaccac

SEQ ID NO: 2958545 - RNA, 14 nt, Mycobacterium avium subsp. paratuberculosis
gcugcgcgucggcc

SEQ ID NO: 2958546 - RNA, 19 nt, Mycobacterium avium subsp. paratuberculosis
gcugcgcgucggccgcaca

SEQ ID NO: 2958547 - RNA, 22 nt, Mycobacterium avium subsp. paratuberculosis
gcugcuuagccccucccaccac

SEQ ID NO: 2958548 - RNA, 14 nt, Mycobacterium avium subsp. paratuberculosis
gcugcuucgucgcc

SEQ ID NO: 2958549 - RNA, 19 nt, Mycobacterium avium subsp. paratuberculosis
gcugcuucgucgccgggcu

SEQ ID NO: 2958550 - RNA, 14 nt, Mycobacterium avium subsp. paratuberculosis
gcugcuugacccgc

SEQ ID NO: 2958551 - RNA, 17 nt, Mycobacterium avium subsp. paratuberculosis
gcuggaaauaggccggg

SEQ ID NO: 2958552 - RNA, 19 nt, Mycobacterium avium subsp. paratuberculosis
gcuggaaauaggccgggca

SEQ ID NO: 2958553 - RNA, 17 nt, Mycobacterium avium subsp. paratuberculosis
gcuggaacaccacggcc

SEQ ID NO: 2958554 - RNA, 19 nt, Mycobacterium avium subsp. paratuberculosis
gcuggaacaccacggccgg

SEQ ID NO: 2958555 - RNA, 21 nt, Mycobacterium avium subsp. paratuberculosis
gcuggaacaccacggccggca

SEQ ID NO: 2958556 - RNA, 18 nt, Mycobacterium avium subsp. paratuberculosis
gcuggaagucggucugcg

SEQ ID NO: 2958557 - RNA, 19 nt, Mycobacterium avium subsp. paratuberculosis
gcuggaaguucgcuggcgg

SEQ ID NO: 2958558 - RNA, 20 nt, Mycobacterium avium subsp. paratuberculosis
gcuggaaguucgcuggcggg

SEQ ID NO: 2958559 - RNA, 14 nt, Mycobacterium avium subsp. paratuberculosis
gcuggaauaccuug

SEQ ID NO: 2958560 - RNA, 17 nt, Mycobacterium avium subsp. paratuberculosis
gcuggaaucccgccucg

SEQ ID NO: 2958561 - RNA, 20 nt, Mycobacterium avium subsp. paratuberculosis
gcuggacaccacgucgucgg

SEQ ID NO: 2958562 - RNA, 21 nt, Mycobacterium avium subsp. paratuberculosis
gcuggacaccacgucgucggc

SEQ ID NO: 2958563 - RNA, 15 nt, Mycobacterium avium subsp. paratuberculosis
gcuggacacccccga

SEQ ID NO: 2958564 - RNA, 23 nt, Mycobacterium avium subsp. paratuberculosis
gcuggacacccccgauccgccgu

SEQ ID NO: 2958565 - RNA, 14 nt, Mycobacterium avium subsp. paratuberculosis
gcuggacggcccga

SEQ ID NO: 2958566 - RNA, 18 nt, Mycobacterium avium subsp. paratuberculosis
gcuggacggcccgacgac

SEQ ID NO: 2958567 - RNA, 16 nt, Mycobacterium avium subsp. paratuberculosis
gcuggagaggcccggc

SEQ ID NO: 2958568 - RNA, 16 nt, Mycobacterium avium subsp. paratuberculosis
gcuggagauguugauc

SEQ ID NO: 2958569 - RNA, 16 nt, Mycobacterium avium subsp. paratuberculosis
gcuggagcggaucccg

SEQ ID NO: 2958570 - RNA, 17 nt, Mycobacterium avium subsp. paratuberculosis
gcuggaguaggugcccg

SEQ ID NO: 2958571 - RNA, 13 nt, Mycobacterium avium subsp. paratuberculosis
gcuggagugguca

SEQ ID NO: 2958572 - RNA, 15 nt, Mycobacterium avium subsp. paratuberculosis
gcuggaguggucagg

SEQ ID NO: 2958573 - RNA, 17 nt, Mycobacterium avium subsp. paratuberculosis
gcuggaugaaggucgcg

SEQ ID NO: 2958574 - RNA, 18 nt, Mycobacterium avium subsp. paratuberculosis
gcuggaugaaggucgcgg

SEQ ID NO: 2958575 - RNA, 20 nt, Mycobacterium avium subsp. paratuberculosis
gcuggauggcgcccagcccg

SEQ ID NO: 2958576 - RNA, 21 nt, Mycobacterium avium subsp. paratuberculosis
gcuggauguccaggccgucga

SEQ ID NO: 2958577 - RNA, 20 nt, Mycobacterium avium subsp. paratuberculosis
gcuggaugugguugcuggcg

SEQ ID NO: 2958578 - RNA, 22 nt, Mycobacterium avium subsp. paratuberculosis
gcuggauucgucgcuggccagg

SEQ ID NO: 2958579 - RNA, 21 nt, Mycobacterium avium subsp. paratuberculosis
gcuggcaggacgggcaccagu

SEQ ID NO: 2958580 - RNA, 20 nt, Mycobacterium avium subsp. paratuberculosis
gcuggcaggucgcgccggag

SEQ ID NO: 2958581 - RNA, 23 nt, Mycobacterium avium subsp. paratuberculosis
gcuggcaggucgcgccggagccg

SEQ ID NO: 2958582 - RNA, 18 nt, Mycobacterium avium subsp. paratuberculosis
gcuggcaucgucggcgcc

SEQ ID NO: 2958583 - RNA, 14 nt, Mycobacterium avium subsp. paratuberculosis
gcuggccaccacgg

SEQ ID NO: 2958584 - RNA, 16 nt, Mycobacterium avium subsp. paratuberculosis
gcuggccaccacgggu

SEQ ID NO: 2958585 - RNA, 17 nt, Mycobacterium avium subsp. paratuberculosis
gcuggccaccacggguc

SEQ ID NO: 2958586 - RNA, 22 nt, Mycobacterium avium subsp. paratuberculosis
gcuggccaccacgggucggucg

SEQ ID NO: 2958587 - RNA, 11 nt, Mycobacterium avium subsp. paratuberculosis
gcuggccaccg

SEQ ID NO: 2958588 - RNA, 20 nt, Mycobacterium avium subsp. paratuberculosis
gcuggccaccgcaucgccga

SEQ ID NO: 2958589 - RNA, 20 nt, Mycobacterium avium subsp. paratuberculosis
gcuggccacgauccggggca

SEQ ID NO: 2958590 - RNA, 21 nt, Mycobacterium avium subsp. paratuberculosis
gcuggccacgauccggggcag

SEQ ID NO: 2958591 - RNA, 13 nt, Mycobacterium avium subsp. paratuberculosis
gcuggccagcacc

SEQ ID NO: 2958592 - RNA, 15 nt, Mycobacterium avium subsp. paratuberculosis
gcuggccagcaccag

SEQ ID NO: 2958593 - RNA, 17 nt, Mycobacterium avium subsp. paratuberculosis
gcuggccagcaccagcg

SEQ ID NO: 2958594 - RNA, 19 nt, Mycobacterium avium subsp. paratuberculosis
gcuggccagcaccagcgcg

SEQ ID NO: 2958595 - RNA, 20 nt, Mycobacterium avium subsp. paratuberculosis
gcuggccagcaccagcgcgc

SEQ ID NO: 2958596 - RNA, 24 nt, Mycobacterium avium subsp. paratuberculosis
gcuggccagcaccagcgcgcgggu

SEQ ID NO: 2958597 - RNA, 15 nt, Mycobacterium avium subsp. paratuberculosis
gcuggccaggcuggc

SEQ ID NO: 2958598 - RNA, 22 nt, Mycobacterium avium subsp. paratuberculosis
gcuggccaggcuggcgucgaac

SEQ ID NO: 2958599 - RNA, 18 nt, Mycobacterium avium subsp. paratuberculosis
gcuggccagguauucgcg

SEQ ID NO: 2958600 - RNA, 19 nt, Mycobacterium avium subsp. paratuberculosis
gcuggccaucgccgagccg

SEQ ID NO: 2958601 - RNA, 21 nt, Mycobacterium avium subsp. paratuberculosis
gcuggccaucgcgggugacgg

SEQ ID NO: 2958602 - RNA, 11 nt, Mycobacterium avium subsp. paratuberculosis
gcuggcccggc

SEQ ID NO: 2958603 - RNA, 12 nt, Mycobacterium avium subsp. paratuberculosis
gcuggcccggcg

SEQ ID NO: 2958604 - RNA, 13 nt, Mycobacterium avium subsp. paratuberculosis
gcuggcccggcgc

SEQ ID NO: 2958605 - RNA, 19 nt, Mycobacterium avium subsp. paratuberculosis
gcuggcccggcgcggcggc

SEQ ID NO: 2958606 - RNA, 20 nt, Mycobacterium avium subsp. paratuberculosis
gcuggcccggcgcggcggcg

SEQ ID NO: 2958607 - RNA, 23 nt, Mycobacterium avium subsp. paratuberculosis
gcuggcccggcgcggcggcgccg

SEQ ID NO: 2958608 - RNA, 13 nt, Mycobacterium avium subsp. paratuberculosis
gcuggcccggcgu

SEQ ID NO: 2958609 - RNA, 13 nt, Mycobacterium avium subsp. paratuberculosis
gcuggccgacccc

SEQ ID NO: 2958610 - RNA, 22 nt, Mycobacterium avium subsp. paratuberculosis
gcuggccgagagccgguagggc

SEQ ID NO: 2958611 - RNA, 17 nt, Mycobacterium avium subsp. paratuberculosis
gcuggccgaggccucca

SEQ ID NO: 2958612 - RNA, 19 nt, Mycobacterium avium subsp. paratuberculosis
gcuggccgaucccggccac

SEQ ID NO: 2958613 - RNA, 21 nt, Mycobacterium avium subsp. paratuberculosis
gcuggccgaucccggccacgu

SEQ ID NO: 2958614 - RNA, 12 nt, Mycobacterium avium subsp. paratuberculosis
gcuggccgcacg

SEQ ID NO: 2958615 - RNA, 15 nt, Mycobacterium avium subsp. paratuberculosis
gcuggccgcacggug

SEQ ID NO: 2958616 - RNA, 14 nt, Mycobacterium avium subsp. paratuberculosis
gcuggccgcccacc

SEQ ID NO: 2958617 - RNA, 22 nt, Mycobacterium avium subsp. paratuberculosis
gcuggccgccccgaacagcgcc

SEQ ID NO: 2958618 - RNA, 16 nt, Mycobacterium avium subsp. paratuberculosis
gcuggccgcgcagcgu

SEQ ID NO: 2958619 - RNA, 16 nt, Mycobacterium avium subsp. paratuberculosis
gcuggccgcgccacag

SEQ ID NO: 2958620 - RNA, 14 nt, Mycobacterium avium subsp. paratuberculosis
gcuggccgcggcca

SEQ ID NO: 2958621 - RNA, 15 nt, Mycobacterium avium subsp. paratuberculosis
gcuggccgcggccag

SEQ ID NO: 2958622 - RNA, 16 nt, Mycobacterium avium subsp. paratuberculosis
gcuggccgcggccagc

SEQ ID NO: 2958623 - RNA, 18 nt, Mycobacterium avium subsp. paratuberculosis
gcuggccgcggccagcug

SEQ ID NO: 2958624 - RNA, 19 nt, Mycobacterium avium subsp. paratuberculosis
gcuggccgcggccagcugc

SEQ ID NO: 2958625 - RNA, 21 nt, Mycobacterium avium subsp. paratuberculosis
gcuggccgcggccagcugccc

SEQ ID NO: 2958626 - RNA, 16 nt, Mycobacterium avium subsp. paratuberculosis
gcuggccgcggcgauc

SEQ ID NO: 2958627 - RNA, 22 nt, Mycobacterium avium subsp. paratuberculosis
gcuggccgcggcgaucggcggu

SEQ ID NO: 2958628 - RNA, 16 nt, Mycobacterium avium subsp. paratuberculosis
gcuggccggcagcguc

SEQ ID NO: 2958629 - RNA, 17 nt, Mycobacterium avium subsp. paratuberculosis
gcuggccggccaccagc

SEQ ID NO: 2958630 - RNA, 21 nt, Mycobacterium avium subsp. paratuberculosis
gcuggccggccaccagcggcc

SEQ ID NO: 2958631 - RNA, 18 nt, Mycobacterium avium subsp. paratuberculosis
gcugggccagcgcggugg

SEQ ID NO: 2958632 - RNA, 16 nt, Mycobacterium avium subsp. paratuberculosis
gcugggccccuccagc

SEQ ID NO: 2958633 - RNA, 17 nt, Mycobacterium avium subsp. paratuberculosis
gcugggccccuccagcc

SEQ ID NO: 2958634 - RNA, 19 nt, Mycobacterium avium subsp. paratuberculosis
gcugggccccuccagccgc

SEQ ID NO: 2958635 - RNA, 22 nt, Mycobacterium avium subsp. paratuberculosis
gcugggccccuccagccgccgg

SEQ ID NO: 2958636 - RNA, 23 nt, Mycobacterium avium subsp. paratuberculosis
gcugggccccuccagccgccggu

SEQ ID NO: 2958637 - RNA, 14 nt, Mycobacterium avium subsp. paratuberculosis
gcugggcccgcgca

SEQ ID NO: 2958638 - RNA, 23 nt, Mycobacterium avium subsp. paratuberculosis
gcugggcccgcgcaucccgucga

SEQ ID NO: 2958639 - RNA, 15 nt, Mycobacterium avium subsp. paratuberculosis
gcugggccgccagcc

SEQ ID NO: 2958640 - RNA, 20 nt, Mycobacterium avium subsp. paratuberculosis
gcugggccgccagccgguac

SEQ ID NO: 2958641 - RNA, 15 nt, Mycobacterium avium subsp. paratuberculosis
gcugggccgcggcgc

SEQ ID NO: 2958642 - RNA, 14 nt, Mycobacterium avium subsp. paratuberculosis
gcugggccgggcgg

SEQ ID NO: 2958643 - RNA, 16 nt, Mycobacterium avium subsp. paratuberculosis
gcugggccgggcgguu

SEQ ID NO: 2958644 - RNA, 15 nt, Mycobacterium avium subsp. paratuberculosis
gcugggcgaagccga

SEQ ID NO: 2958645 - RNA, 14 nt, Mycobacterium avium subsp. paratuberculosis
gcugggcgcccaga

SEQ ID NO: 2958646 - RNA, 18 nt, Mycobacterium avium subsp. paratuberculosis
gcugggcgcccagaugcc

SEQ ID NO: 2958647 - RNA, 22 nt, Mycobacterium avium subsp. paratuberculosis
gcugggcgcuagcugcgccggc

SEQ ID NO: 2958648 - RNA, 22 nt, Mycobacterium avium subsp. paratuberculosis
gcugggcggacgggaccacccg

SEQ ID NO: 2958649 - RNA, 16 nt, Mycobacterium avium subsp. paratuberculosis
gcugggcggauccgcg

SEQ ID NO: 2958650 - RNA, 19 nt, Mycobacterium avium subsp. paratuberculosis
gcugggcggauccgcgugg

SEQ ID NO: 2958651 - RNA, 15 nt, Mycobacterium avium subsp. paratuberculosis
gcugggcggcaccac

SEQ ID NO: 2958652 - RNA, 16 nt, Mycobacterium avium subsp. paratuberculosis
gcugggcggcaccacc

SEQ ID NO: 2958653 - RNA, 18 nt, Mycobacterium avium subsp. paratuberculosis
gcugggcggcaccacccg

SEQ ID NO: 2958654 - RNA, 14 nt, Mycobacterium avium subsp. paratuberculosis
gcugggcggcgcgc

SEQ ID NO: 2958655 - RNA, 20 nt, Mycobacterium avium subsp. paratuberculosis
gcugggcguacugcucggcg

SEQ ID NO: 2958656 - RNA, 22 nt, Mycobacterium avium subsp. paratuberculosis
gcugggcguacugcucggcgcg

SEQ ID NO: 2958657 - RNA, 23 nt, Mycobacterium avium subsp. paratuberculosis
gcugggcguacugcucggcgcgg

SEQ ID NO: 2958658 - RNA, 13 nt, Mycobacterium avium subsp. paratuberculosis
gcugggcguggug

SEQ ID NO: 2958659 - RNA, 15 nt, Mycobacterium avium subsp. paratuberculosis
gcugggcguggugcg

SEQ ID NO: 2958660 - RNA, 14 nt, Mycobacterium avium subsp. paratuberculosis
gcugggcuaccagc

SEQ ID NO: 2958661 - RNA, 20 nt, Mycobacterium avium subsp. paratuberculosis
gcugggcuaccagccccagg

SEQ ID NO: 2958662 - RNA, 21 nt, Mycobacterium avium subsp. paratuberculosis
gcugggcucgagugccggcag

SEQ ID NO: 2958663 - RNA, 22 nt, Mycobacterium avium subsp. paratuberculosis
gcugggcuggccguccggauag

SEQ ID NO: 2958664 - RNA, 19 nt, Mycobacterium avium subsp. paratuberculosis
gcugggcuuccacagcccg

SEQ ID NO: 2958665 - RNA, 18 nt, Mycobacterium avium subsp. paratuberculosis
gcuggggcgcaccgccug

SEQ ID NO: 2958666 - RNA, 13 nt, Mycobacterium avium subsp. paratuberculosis
gcuggggguggcg

SEQ ID NO: 2958667 - RNA, 12 nt, Mycobacterium avium subsp. paratuberculosis
gcugggucacca

SEQ ID NO: 2958668 - RNA, 21 nt, Mycobacterium avium subsp. paratuberculosis
gcuggguccgauugcccgacu

SEQ ID NO: 2958669 - RNA, 21 nt, Mycobacterium avium subsp. paratuberculosis
gcuggguccgauuucccgacu

SEQ ID NO: 2958670 - RNA, 16 nt, Mycobacterium avium subsp. paratuberculosis
gcugggucggucccga

SEQ ID NO: 2958671 - RNA, 16 nt, Mycobacterium avium subsp. paratuberculosis
gcugggugaacacccc

SEQ ID NO: 2958672 - RNA, 21 nt, Mycobacterium avium subsp. paratuberculosis
gcugggugccgcguuccccgg

SEQ ID NO: 2958673 - RNA, 20 nt, Mycobacterium avium subsp. paratuberculosis
gcugggugcgggcugcacca

SEQ ID NO: 2958674 - RNA, 22 nt, Mycobacterium avium subsp. paratuberculosis
gcuggguggucaccagcgcggu

SEQ ID NO: 2958675 - RNA, 18 nt, Mycobacterium avium subsp. paratuberculosis
gcuggguguaaccggcuu

SEQ ID NO: 2958676 - RNA, 15 nt, Mycobacterium avium subsp. paratuberculosis
gcuggguguuccccg

SEQ ID NO: 2958677 - RNA, 15 nt, Mycobacterium avium subsp. paratuberculosis
gcuggguugcucgcc

SEQ ID NO: 2958678 - RNA, 16 nt, Mycobacterium avium subsp. paratuberculosis
gcuggguugcucgccg

SEQ ID NO: 2958679 - RNA, 14 nt, Mycobacterium avium subsp. paratuberculosis
gcugguagacccgg

SEQ ID NO: 2958680 - RNA, 15 nt, Mycobacterium avium subsp. paratuberculosis
gcugguagacccggg

SEQ ID NO: 2958681 - RNA, 18 nt, Mycobacterium avium subsp. paratuberculosis
gcugguagaugguggccg

SEQ ID NO: 2958682 - RNA, 21 nt, Mycobacterium avium subsp. paratuberculosis
gcugguagaugguggccgucg

SEQ ID NO: 2958683 - RNA, 14 nt, Mycobacterium avium subsp. paratuberculosis
gcugguagcugcug

SEQ ID NO: 2958684 - RNA, 17 nt, Mycobacterium avium subsp. paratuberculosis
gcugguaguacaccggg

SEQ ID NO: 2958685 - RNA, 16 nt, Mycobacterium avium subsp. paratuberculosis
gcuggucaacucgacc

SEQ ID NO: 2958686 - RNA, 18 nt, Mycobacterium avium subsp. paratuberculosis
gcuggucaacucgacccg

SEQ ID NO: 2958687 - RNA, 19 nt, Mycobacterium avium subsp. paratuberculosis
gcuggucaacucgacccgc

SEQ ID NO: 2958688 - RNA, 23 nt, Mycobacterium avium subsp. paratuberculosis
gcuggucaaugcccucguagcgg

SEQ ID NO: 2958689 - RNA, 23 nt, Mycobacterium avium subsp. paratuberculosis
gcuggucacacccuugucgguga

SEQ ID NO: 2958690 - RNA, 18 nt, Mycobacterium avium subsp. paratuberculosis
gcuggucacccacuggcg

SEQ ID NO: 2958691 - RNA, 21 nt, Mycobacterium avium subsp. paratuberculosis
gcuggucacccacuggcggcc

SEQ ID NO: 2958692 - RNA, 22 nt, Mycobacterium avium subsp. paratuberculosis
gcuggucacccacuggcggccg

SEQ ID NO: 2958693 - RNA, 14 nt, Mycobacterium avium subsp. paratuberculosis
gcuggucaggccga

SEQ ID NO: 2958694 - RNA, 17 nt, Mycobacterium avium subsp. paratuberculosis
gcuggucaugccgucga

SEQ ID NO: 2958695 - RNA, 21 nt, Mycobacterium avium subsp. paratuberculosis
gcuggucaugccgucgacgac

SEQ ID NO: 2958696 - RNA, 22 nt, Mycobacterium avium subsp. paratuberculosis
gcuggucaugccgucgacgacg

SEQ ID NO: 2958697 - RNA, 24 nt, Mycobacterium avium subsp. paratuberculosis
gcuggucaugccgucgacgacggu

SEQ ID NO: 2958698 - RNA, 21 nt, Mycobacterium avium subsp. paratuberculosis
gcuggucccacagcggggucg

SEQ ID NO: 2958699 - RNA, 14 nt, Mycobacterium avium subsp. paratuberculosis
gcugguccggccgg

SEQ ID NO: 2958700 - RNA, 16 nt, Mycobacterium avium subsp. paratuberculosis
gcuggucgaaccgcga

SEQ ID NO: 2958701 - RNA, 18 nt, Mycobacterium avium subsp. paratuberculosis
gcuggucgaaccgcgagc

SEQ ID NO: 2958702 - RNA, 19 nt, Mycobacterium avium subsp. paratuberculosis
gcuggucgaaccgcgagcg

SEQ ID NO: 2958703 - RNA, 16 nt, Mycobacterium avium subsp. paratuberculosis
gcuggucgaacgccac

SEQ ID NO: 2958704 - RNA, 17 nt, Mycobacterium avium subsp. paratuberculosis
gcuggucgaacgccacc

SEQ ID NO: 2958705 - RNA, 18 nt, Mycobacterium avium subsp. paratuberculosis
gcuggucgaacgccaccu

SEQ ID NO: 2958706 - RNA, 14 nt, Mycobacterium avium subsp. paratuberculosis
gcuggucgacguca

SEQ ID NO: 2958707 - RNA, 15 nt, Mycobacterium avium subsp. paratuberculosis
gcuggucggccuggc

SEQ ID NO: 2958708 - RNA, 13 nt, Mycobacterium avium subsp. paratuberculosis
gcuggucggcgaa

SEQ ID NO: 2958709 - RNA, 17 nt, Mycobacterium avium subsp. paratuberculosis
gcuggucggcgggcagc

SEQ ID NO: 2958710 - RNA, 18 nt, Mycobacterium avium subsp. paratuberculosis
gcuggucggcgggcagcg

SEQ ID NO: 2958711 - RNA, 14 nt, Mycobacterium avium subsp. paratuberculosis
gcuggucggcgggu

SEQ ID NO: 2958712 - RNA, 17 nt, Mycobacterium avium subsp. paratuberculosis
gcuggucucgggcacca

SEQ ID NO: 2958713 - RNA, 22 nt, Mycobacterium avium subsp. paratuberculosis
gcuggucucgggcaccacgccg

SEQ ID NO: 2958714 - RNA, 15 nt, Mycobacterium avium subsp. paratuberculosis
gcuggucuucggugu

SEQ ID NO: 2958715 - RNA, 19 nt, Mycobacterium avium subsp. paratuberculosis
gcuguggaugacgcagccg

SEQ ID NO: 2958716 - RNA, 14 nt, Mycobacterium avium subsp. paratuberculosis
gcuguggccguuga

SEQ ID NO: 2958717 - RNA, 15 nt, Mycobacterium avium subsp. paratuberculosis
gcugugggccagcag

SEQ ID NO: 2958718 - RNA, 22 nt, Mycobacterium avium subsp. paratuberculosis
gcugugggccagcagcgucguc

SEQ ID NO: 2958719 - RNA, 18 nt, Mycobacterium avium subsp. paratuberculosis
gcugugggcgcagggccg

SEQ ID NO: 2958720 - RNA, 15 nt, Mycobacterium avium subsp. paratuberculosis
gcuguuaccgucggg

SEQ ID NO: 2958721 - RNA, 19 nt, Mycobacterium avium subsp. paratuberculosis
gcuguuccagacgucggcg

SEQ ID NO: 2958722 - RNA, 23 nt, Mycobacterium avium subsp. paratuberculosis
gcuguuccugguagucgucgugg

SEQ ID NO: 2958723 - RNA, 20 nt, Mycobacterium avium subsp. paratuberculosis
gcuguucgucgaguucgcgg

SEQ ID NO: 2958724 - RNA, 21 nt, Mycobacterium avium subsp. paratuberculosis
gcuguucgucgaguucgcggc

SEQ ID NO: 2958725 - RNA, 14 nt, Mycobacterium avium subsp. paratuberculosis
gcuguugaccacgg

SEQ ID NO: 2958726 - RNA, 16 nt, Mycobacterium avium subsp. paratuberculosis
gcuguugacgggccgc

SEQ ID NO: 2958727 - RNA, 18 nt, Mycobacterium avium subsp. paratuberculosis
gcuguugcucggggcucg

SEQ ID NO: 2958728 - RNA, 23 nt, Mycobacterium avium subsp. paratuberculosis
gcuguuggaaccggccaccacgu

SEQ ID NO: 2958729 - RNA, 14 nt, Mycobacterium avium subsp. paratuberculosis
gcuguuggcgacgg

SEQ ID NO: 2958730 - RNA, 23 nt, Mycobacterium avium subsp. paratuberculosis
gcuuaaucgcccaacaacucgac

SEQ ID NO: 2958731 - RNA, 20 nt, Mycobacterium avium subsp. paratuberculosis
gcuuaccgaccucgaggccg

SEQ ID NO: 2958732 - RNA, 23 nt, Mycobacterium avium subsp. paratuberculosis
gcuuaccggcgggcggcggcguu

SEQ ID NO: 2958733 - RNA, 20 nt, Mycobacterium avium subsp. paratuberculosis
gcuuagccccucccaccacg

SEQ ID NO: 2958734 - RNA, 22 nt, Mycobacterium avium subsp. paratuberculosis
gcuuagccccucccaccacggc

SEQ ID NO: 2958735 - RNA, 14 nt, Mycobacterium avium subsp. paratuberculosis
gcuucacgcucggc

SEQ ID NO: 2958736 - RNA, 15 nt, Mycobacterium avium subsp. paratuberculosis
gcuucacgcucggcg

SEQ ID NO: 2958737 - RNA, 18 nt, Mycobacterium avium subsp. paratuberculosis
gcuucacgcucggcgccg

SEQ ID NO: 2958738 - RNA, 19 nt, Mycobacterium avium subsp. paratuberculosis
gcuucacgcucggcgccga

SEQ ID NO: 2958739 - RNA, 19 nt, Mycobacterium avium subsp. paratuberculosis
gcuucacggucggagccca

SEQ ID NO: 2958740 - RNA, 22 nt, Mycobacterium avium subsp. paratuberculosis
gcuucacggucggagcccagcg

SEQ ID NO: 2958741 - RNA, 13 nt, Mycobacterium avium subsp. paratuberculosis
gcuucacguucgg

SEQ ID NO: 2958742 - RNA, 14 nt, Mycobacterium avium subsp. paratuberculosis
gcuucacguucggc

SEQ ID NO: 2958743 - RNA, 15 nt, Mycobacterium avium subsp. paratuberculosis
gcuucacguucggcg

SEQ ID NO: 2958744 - RNA, 16 nt, Mycobacterium avium subsp. paratuberculosis
gcuucacguucggcga

SEQ ID NO: 2958745 - RNA, 22 nt, Mycobacterium avium subsp. paratuberculosis
gcuucacguucggcgagugagg

SEQ ID NO: 2958746 - RNA, 16 nt, Mycobacterium avium subsp. paratuberculosis
gcuucaggcagcgcac

SEQ ID NO: 2958747 - RNA, 17 nt, Mycobacterium avium subsp. paratuberculosis
gcuucaggcagcgcacg

SEQ ID NO: 2958748 - RNA, 20 nt, Mycobacterium avium subsp. paratuberculosis
gcuucauaugacgccggccu

SEQ ID NO: 2958749 - RNA, 15 nt, Mycobacterium avium subsp. paratuberculosis
gcuucaugcccgcga

SEQ ID NO: 2958750 - RNA, 13 nt, Mycobacterium avium subsp. paratuberculosis
gcuuccaccugcg

SEQ ID NO: 2958751 - RNA, 21 nt, Mycobacterium avium subsp. paratuberculosis
gcuuccagaugcgucaacccg

SEQ ID NO: 2958752 - RNA, 23 nt, Mycobacterium avium subsp. paratuberculosis
gcuuccagaugcgucaacccguu

SEQ ID NO: 2958753 - RNA, 15 nt, Mycobacterium avium subsp. paratuberculosis
gcuuccagcaccacc

SEQ ID NO: 2958754 - RNA, 23 nt, Mycobacterium avium subsp. paratuberculosis
gcuuccagguguaggcguggcag

SEQ ID NO: 2958755 - RNA, 13 nt, Mycobacterium avium subsp. paratuberculosis
gcuucccacccgg

SEQ ID NO: 2958756 - RNA, 18 nt, Mycobacterium avium subsp. paratuberculosis
gcuuccccaaccuggacg

SEQ ID NO: 2958757 - RNA, 14 nt, Mycobacterium avium subsp. paratuberculosis
gcuucccggcgguc

SEQ ID NO: 2958758 - RNA, 19 nt, Mycobacterium avium subsp. paratuberculosis
gcuuccgaucaacggcagc

SEQ ID NO: 2958759 - RNA, 19 nt, Mycobacterium avium subsp. paratuberculosis
gcuuccgccgagacggcgu

SEQ ID NO: 2958760 - RNA, 22 nt, Mycobacterium avium subsp. paratuberculosis
gcuuccgccgagacggcguggc

SEQ ID NO: 2958761 - RNA, 20 nt, Mycobacterium avium subsp. paratuberculosis
gcuuccgccgagucgcgccg

SEQ ID NO: 2958762 - RNA, 23 nt, Mycobacterium avium subsp. paratuberculosis
gcuuccgccgagucgcgccgcgu

SEQ ID NO: 2958763 - RNA, 20 nt, Mycobacterium avium subsp. paratuberculosis
gcuuccggaugggagcgggg

SEQ ID NO: 2958764 - RNA, 18 nt, Mycobacterium avium subsp. paratuberculosis
gcuuccuccucggcgcgg

SEQ ID NO: 2958765 - RNA, 15 nt, Mycobacterium avium subsp. paratuberculosis
gcuucgaacgcccgc

SEQ ID NO: 2958766 - RNA, 19 nt, Mycobacterium avium subsp. paratuberculosis
gcuucgaacgcccgcacca

SEQ ID NO: 2958767 - RNA, 21 nt, Mycobacterium avium subsp. paratuberculosis
gcuucgaacgcccgcaccacg

SEQ ID NO: 2958768 - RNA, 17 nt, Mycobacterium avium subsp. paratuberculosis
gcuucgcccggcugcgc

SEQ ID NO: 2958769 - RNA, 21 nt, Mycobacterium avium subsp. paratuberculosis
gcuucgcccggcugcgccgcg

SEQ ID NO: 2958770 - RNA, 19 nt, Mycobacterium avium subsp. paratuberculosis
gcuucgccgccgcaccggc

SEQ ID NO: 2958771 - RNA, 21 nt, Mycobacterium avium subsp. paratuberculosis
gcuucgccgccgcaccggccg

SEQ ID NO: 2958772 - RNA, 15 nt, Mycobacterium avium subsp. paratuberculosis
gcuucgccgcgcuug

SEQ ID NO: 2958773 - RNA, 12 nt, Mycobacterium avium subsp. paratuberculosis
gcuucgcgcugu

SEQ ID NO: 2958774 - RNA, 16 nt, Mycobacterium avium subsp. paratuberculosis
gcuucgcugcgccggc

SEQ ID NO: 2958775 - RNA, 15 nt, Mycobacterium avium subsp. paratuberculosis
gcuucggccagcgcg

SEQ ID NO: 2958776 - RNA, 12 nt, Mycobacterium avium subsp. paratuberculosis
gcuucggcgccg

SEQ ID NO: 2958777 - RNA, 13 nt, Mycobacterium avium subsp. paratuberculosis
gcuucggcgccga

SEQ ID NO: 2958778 - RNA, 18 nt, Mycobacterium avium subsp. paratuberculosis
gcuucggcgccgagcacg

SEQ ID NO: 2958779 - RNA, 15 nt, Mycobacterium avium subsp. paratuberculosis
gcuucgggaucagcg

SEQ ID NO: 2958780 - RNA, 15 nt, Mycobacterium avium subsp. paratuberculosis
gcuucgggcgcgcgc

SEQ ID NO: 2958781 - RNA, 20 nt, Mycobacterium avium subsp. paratuberculosis
gcuucgggucgccggucugg

SEQ ID NO: 2958782 - RNA, 15 nt, Mycobacterium avium subsp. paratuberculosis
gcuucgggugcgggu

SEQ ID NO: 2958783 - RNA, 19 nt, Mycobacterium avium subsp. paratuberculosis
gcuucggguuguuguccga

SEQ ID NO: 2958784 - RNA, 19 nt, Mycobacterium avium subsp. paratuberculosis
gcuucguaacacccucggu

SEQ ID NO: 2958785 - RNA, 15 nt, Mycobacterium avium subsp. paratuberculosis
gcuucguacggcccg

SEQ ID NO: 2958786 - RNA, 16 nt, Mycobacterium avium subsp. paratuberculosis
gcuucguacggcccgg

SEQ ID NO: 2958787 - RNA, 16 nt, Mycobacterium avium subsp. paratuberculosis
gcuucgucgccggccg

SEQ ID NO: 2958788 - RNA, 14 nt, Mycobacterium avium subsp. paratuberculosis
gcuucuccucggua

SEQ ID NO: 2958789 - RNA, 19 nt, Mycobacterium avium subsp. paratuberculosis
gcuucucggugaucacccg

SEQ ID NO: 2958790 - RNA, 22 nt, Mycobacterium avium subsp. paratuberculosis
gcuucucggugaucacccgccg

SEQ ID NO: 2958791 - RNA, 17 nt, Mycobacterium avium subsp. paratuberculosis
gcuucugcagcucgcug

SEQ ID NO: 2958792 - RNA, 18 nt, Mycobacterium avium subsp. paratuberculosis
gcuucugcccggccagca

SEQ ID NO: 2958793 - RNA, 22 nt, Mycobacterium avium subsp. paratuberculosis
gcuucugcgccgguucgcuggc

SEQ ID NO: 2958794 - RNA, 19 nt, Mycobacterium avium subsp. paratuberculosis
gcuucuggaugcggucguc

SEQ ID NO: 2958795 - RNA, 18 nt, Mycobacterium avium subsp. paratuberculosis
gcuucuugaagaaccggg

SEQ ID NO: 2958796 - RNA, 18 nt, Mycobacterium avium subsp. paratuberculosis
gcuugaaaguccgccgac

SEQ ID NO: 2958797 - RNA, 13 nt, Mycobacterium avium subsp. paratuberculosis
gcuugaacagcac

SEQ ID NO: 2958798 - RNA, 18 nt, Mycobacterium avium subsp. paratuberculosis
gcuugaacagcacccccu

SEQ ID NO: 2958799 - RNA, 17 nt, Mycobacterium avium subsp. paratuberculosis
gcuuuccaaccaggcgc

SEQ ID NO: 2958800 - RNA, 17 nt, Mycobacterium avium subsp. paratuberculosis
gcuuuccaccccggcgg

SEQ ID NO: 2958801 - RNA, 22 nt, Mycobacterium avium subsp. paratuberculosis
gcuuuccaccucgagcaaccgc

SEQ ID NO: 2958802 - RNA, 22 nt, Mycobacterium avium subsp. paratuberculosis
gcuuucgcgcacgccaucgccu

SEQ ID NO: 2958803 - RNA, 19 nt, Mycobacterium avium subsp. paratuberculosis
gcuuucgcgucugcucgcg

SEQ ID NO: 2958804 - RNA, 19 nt, Mycobacterium avium subsp. paratuberculosis
gcuuugaucagcucgccga

SEQ ID NO: 2958805 - RNA, 18 nt, Mycobacterium avium subsp. paratuberculosis
gcuuuggucgccagcacc

SEQ ID NO: 2958806 - RNA, 15 nt, Mycobacterium avium subsp. paratuberculosis
gcuuugugaggcgcg

SEQ ID NO: 2958807 - RNA, 20 nt, Mycobacterium avium subsp. paratuberculosis
gcuuuucgucggugcgcgcc

SEQ ID NO: 2958808 - RNA, 16 nt, Mycobacterium avium subsp. paratuberculosis
gcuuuugccgucggug

SEQ ID NO: 2958809 - RNA, 22 nt, Mycobacterium avium subsp. paratuberculosis
gcuuuugcgggucugcucacgc

SEQ ID NO: 2958810 - RNA, 13 nt, Mycobacterium avium subsp. paratuberculosis
gcuuuugcgucug

SEQ ID NO: 2958811 - RNA, 20 nt, Mycobacterium avium subsp. paratuberculosis
gcuuuugcgucugcucgccg

SEQ ID NO: 2958812 - RNA, 19 nt, Mycobacterium avium subsp. paratuberculosis
gcuuuugcgucugcucgcg

SEQ ID NO: 2958813 - RNA, 18 nt, Mycobacterium avium subsp. paratuberculosis
gcuuuugugucugcucgc

SEQ ID NO: 2958814 - RNA, 19 nt, Mycobacterium avium subsp. paratuberculosis
gcuuuugugucugcucgcc

SEQ ID NO: 2958815 - RNA, 15 nt, Mycobacterium avium subsp. paratuberculosis
gcuuuuugaccaccg

SEQ ID NO: 2958816 - RNA, 23 nt, Mycobacterium avium subsp. paratuberculosis
gcuuuuugaccaccggcaccacg

SEQ ID NO: 2958817 - RNA, 19 nt, Mycobacterium avium subsp. paratuberculosis
ggaaaaccccaccccgagc

SEQ ID NO: 2958818 - RNA, 22 nt, Mycobacterium avium subsp. paratuberculosis
ggaaaaccccaccccgagcagg

SEQ ID NO: 2958819 - RNA, 17 nt, Mycobacterium avium subsp. paratuberculosis
ggaaaagugggucagcc

SEQ ID NO: 2958820 - RNA, 18 nt, Mycobacterium avium subsp. paratuberculosis
ggaaaccccucagccgga

SEQ ID NO: 2958821 - RNA, 17 nt, Mycobacterium avium subsp. paratuberculosis
ggaaaccucuugcggcg

SEQ ID NO: 2958822 - RNA, 18 nt, Mycobacterium avium subsp. paratuberculosis
ggaaaccucuugcggcgc

SEQ ID NO: 2958823 - RNA, 14 nt, Mycobacterium avium subsp. paratuberculosis
ggaaacgacgucgc

SEQ ID NO: 2958824 - RNA, 21 nt, Mycobacterium avium subsp. paratuberculosis
ggaaacgacgucgccaccaga

SEQ ID NO: 2958825 - RNA, 16 nt, Mycobacterium avium subsp. paratuberculosis
ggaaagcgcgggcagc

SEQ ID NO: 2958826 - RNA, 16 nt, Mycobacterium avium subsp. paratuberculosis
ggaaauaggccgggca

SEQ ID NO: 2958827 - RNA, 16 nt, Mycobacterium avium subsp. paratuberculosis
ggaaaucggacccagc

SEQ ID NO: 2958828 - RNA, 12 nt, Mycobacterium avium subsp. paratuberculosis
ggaaaugcgucg

SEQ ID NO: 2958829 - RNA, 14 nt, Mycobacterium avium subsp. paratuberculosis
ggaaaugcgucggc

SEQ ID NO: 2958830 - RNA, 12 nt, Mycobacterium avium subsp. paratuberculosis
ggaacaacgcgc

SEQ ID NO: 2958831 - RNA, 16 nt, Mycobacterium avium subsp. paratuberculosis
ggaacaccacggccgg

SEQ ID NO: 2958832 - RNA, 18 nt, Mycobacterium avium subsp. paratuberculosis
ggaacaccacggccggca

SEQ ID NO: 2958833 - RNA, 17 nt, Mycobacterium avium subsp. paratuberculosis
ggaacaccacgucgucc

SEQ ID NO: 2958834 - RNA, 20 nt, Mycobacterium avium subsp. paratuberculosis
ggaacaccacgucguccagc

SEQ ID NO: 2958835 - RNA, 15 nt, Mycobacterium avium subsp. paratuberculosis
ggaacaccgagccgg

SEQ ID NO: 2958836 - RNA, 19 nt, Mycobacterium avium subsp. paratuberculosis
ggaacaccgagccggcggc

SEQ ID NO: 2958837 - RNA, 14 nt, Mycobacterium avium subsp. paratuberculosis
ggaacaccgccuug

SEQ ID NO: 2958838 - RNA, 19 nt, Mycobacterium avium subsp. paratuberculosis
ggaacaccggcgaggugaa

SEQ ID NO: 2958839 - RNA, 19 nt, Mycobacterium avium subsp. paratuberculosis
ggaacacgcccagcgccgc

SEQ ID NO: 2958840 - RNA, 14 nt, Mycobacterium avium subsp. paratuberculosis
ggaacacgucggcg

SEQ ID NO: 2958841 - RNA, 16 nt, Mycobacterium avium subsp. paratuberculosis
ggaacacgugauccag

SEQ ID NO: 2958842 - RNA, 18 nt, Mycobacterium avium subsp. paratuberculosis
ggaacacgugauccaggu

SEQ ID NO: 2958843 - RNA, 15 nt, Mycobacterium avium subsp. paratuberculosis
ggaacagacacagca

SEQ ID NO: 2958844 - RNA, 14 nt, Mycobacterium avium subsp. paratuberculosis
ggaacagacucagc

SEQ ID NO: 2958845 - RNA, 21 nt, Mycobacterium avium subsp. paratuberculosis
ggaacagacucagcccggccc

SEQ ID NO: 2958846 - RNA, 14 nt, Mycobacterium avium subsp. paratuberculosis
ggaacagccaggcg

SEQ ID NO: 2958847 - RNA, 14 nt, Mycobacterium avium subsp. paratuberculosis
ggaacagcccgccc

SEQ ID NO: 2958848 - RNA, 15 nt, Mycobacterium avium subsp. paratuberculosis
ggaacagcgacccga

SEQ ID NO: 2958849 - RNA, 19 nt, Mycobacterium avium subsp. paratuberculosis
ggaacagcgggccggcguc

SEQ ID NO: 2958850 - RNA, 13 nt, Mycobacterium avium subsp. paratuberculosis
ggaacagcgucgc

SEQ ID NO: 2958851 - RNA, 21 nt, Mycobacterium avium subsp. paratuberculosis
ggaacagcgucgccgacgggc

SEQ ID NO: 2958852 - RNA, 20 nt, Mycobacterium avium subsp. paratuberculosis
ggaacagcuggucccacagc

SEQ ID NO: 2958853 - RNA, 14 nt, Mycobacterium avium subsp. paratuberculosis
ggaacagcuuggcg

SEQ ID NO: 2958854 - RNA, 22 nt, Mycobacterium avium subsp. paratuberculosis
ggaacagguaguagcgcgccgg

SEQ ID NO: 2958855 - RNA, 19 nt, Mycobacterium avium subsp. paratuberculosis
ggaacaucccggagccguc

SEQ ID NO: 2958856 - RNA, 16 nt, Mycobacterium avium subsp. paratuberculosis
ggaacaucuccagcgc

SEQ ID NO: 2958857 - RNA, 12 nt, Mycobacterium avium subsp. paratuberculosis
ggaacauggccu

SEQ ID NO: 2958858 - RNA, 19 nt, Mycobacterium avium subsp. paratuberculosis
ggaaccacaccccggccac

SEQ ID NO: 2958859 - RNA, 16 nt, Mycobacterium avium subsp. paratuberculosis
ggaaccagcccagguc

SEQ ID NO: 2958860 - RNA, 15 nt, Mycobacterium avium subsp. paratuberculosis
ggaacccacgugcgg

SEQ ID NO: 2958861 - RNA, 21 nt, Mycobacterium avium subsp. paratuberculosis
ggaacccacgugcggcgcccu

SEQ ID NO: 2958862 - RNA, 13 nt, Mycobacterium avium subsp. paratuberculosis
ggaacccugcccc

SEQ ID NO: 2958863 - RNA, 20 nt, Mycobacterium avium subsp. paratuberculosis
ggaaccgcccuuccagcacc

SEQ ID NO: 2958864 - RNA, 23 nt, Mycobacterium avium subsp. paratuberculosis
ggaaccgcgccuucgacccggug

SEQ ID NO: 2958865 - RNA, 16 nt, Mycobacterium avium subsp. paratuberculosis
ggaaccgcucggcucg

SEQ ID NO: 2958866 - RNA, 19 nt, Mycobacterium avium subsp. paratuberculosis
ggaaccgcugcaugccguc

SEQ ID NO: 2958867 - RNA, 12 nt, Mycobacterium avium subsp. paratuberculosis
ggaaccggccac

SEQ ID NO: 2958868 - RNA, 14 nt, Mycobacterium avium subsp. paratuberculosis
ggaaccggccacca

SEQ ID NO: 2958869 - RNA, 17 nt, Mycobacterium avium subsp. paratuberculosis
ggaaccggccaccacgu

SEQ ID NO: 2958870 - RNA, 18 nt, Mycobacterium avium subsp. paratuberculosis
ggaaccgggcacccggcg

SEQ ID NO: 2958871 - RNA, 23 nt, Mycobacterium avium subsp. paratuberculosis
ggaaccgggggccgucacaggcc

SEQ ID NO: 2958872 - RNA, 18 nt, Mycobacterium avium subsp. paratuberculosis
ggaaccgggucagcacca

SEQ ID NO: 2958873 - RNA, 20 nt, Mycobacterium avium subsp. paratuberculosis
ggaaccgggucagcaccacc

SEQ ID NO: 2958874 - RNA, 21 nt, Mycobacterium avium subsp. paratuberculosis
ggaacgacacguggaccgagc

SEQ ID NO: 2958875 - RNA, 14 nt, Mycobacterium avium subsp. paratuberculosis
ggaacgagccggac

SEQ ID NO: 2958876 - RNA, 14 nt, Mycobacterium avium subsp. paratuberculosis
ggaacgccgaucac

SEQ ID NO: 2958877 - RNA, 17 nt, Mycobacterium avium subsp. paratuberculosis
ggaacgccgaucaccgc

SEQ ID NO: 2958878 - RNA, 19 nt, Mycobacterium avium subsp. paratuberculosis
ggaacgccgaucaccggca

SEQ ID NO: 2958879 - RNA, 20 nt, Mycobacterium avium subsp. paratuberculosis
ggaacgcgacgguggcggcg

SEQ ID NO: 2958880 - RNA, 17 nt, Mycobacterium avium subsp. paratuberculosis
ggaacgcgcccggcggg

SEQ ID NO: 2958881 - RNA, 14 nt, Mycobacterium avium subsp. paratuberculosis
ggaacgcgccggcg

SEQ ID NO: 2958882 - RNA, 16 nt, Mycobacterium avium subsp. paratuberculosis
ggaacgcgccggcgca

SEQ ID NO: 2958883 - RNA, 14 nt, Mycobacterium avium subsp. paratuberculosis
ggaacgcgccgggc

SEQ ID NO: 2958884 - RNA, 18 nt, Mycobacterium avium subsp. paratuberculosis
ggaauucgggugcggcgu

SEQ ID NO: 2958885 - RNA, 18 nt, Mycobacterium avium subsp. paratuberculosis
ggaauucgucggcggugu

SEQ ID NO: 2958886 - RNA, 19 nt, Mycobacterium avium subsp. paratuberculosis
ggaauucuggccgaccgcc

SEQ ID NO: 2958887 - RNA, 20 nt, Mycobacterium avium subsp. paratuberculosis
ggaauugaagcccugcucgg

SEQ ID NO: 2958888 - RNA, 13 nt, Mycobacterium avium subsp. paratuberculosis
ggaauuugcggcc

SEQ ID NO: 2958889 - RNA, 16 nt, Mycobacterium avium subsp. paratuberculosis
ggaauuugcggcccgg

SEQ ID NO: 2958890 - RNA, 20 nt, Mycobacterium avium subsp. paratuberculosis
ggaauuuucgccgucacugc

SEQ ID NO: 2958891 - RNA, 19 nt, Mycobacterium avium subsp. paratuberculosis
ggacaacacgaucgucacc

SEQ ID NO: 2958892 - RNA, 21 nt, Mycobacterium avium subsp. paratuberculosis
ggacaacggaucgagcgcacc

SEQ ID NO: 2958893 - RNA, 22 nt, Mycobacterium avium subsp. paratuberculosis
ggacaacgggauaugcgccugc

SEQ ID NO: 2958894 - RNA, 18 nt, Mycobacterium avium subsp. paratuberculosis
ggacaagucaugccgcgc

SEQ ID NO: 2958895 - RNA, 20 nt, Mycobacterium avium subsp. paratuberculosis
ggacaagucaugccgcgcuc

SEQ ID NO: 2958896 - RNA, 21 nt, Mycobacterium avium subsp. paratuberculosis
ggacaccaccgcggugggcca

SEQ ID NO: 2958897 - RNA, 17 nt, Mycobacterium avium subsp. paratuberculosis
ggacaccacgucgucgg

SEQ ID NO: 2958898 - RNA, 14 nt, Mycobacterium avium subsp. paratuberculosis
ggacaccagguugg

SEQ ID NO: 2958899 - RNA, 11 nt, Mycobacterium avium subsp. paratuberculosis
ggacacccccg

SEQ ID NO: 2958900 - RNA, 13 nt, Mycobacterium avium subsp. paratuberculosis
ggacaccccggcc

SEQ ID NO: 2958901 - RNA, 15 nt, Mycobacterium avium subsp. paratuberculosis
ggacaccccggccag

SEQ ID NO: 2958902 - RNA, 17 nt, Mycobacterium avium subsp. paratuberculosis
ggacaccccggcgauga

SEQ ID NO: 2958903 - RNA, 15 nt, Mycobacterium avium subsp. paratuberculosis
ggacacccgcgcggu

SEQ ID NO: 2958904 - RNA, 12 nt, Mycobacterium avium subsp. paratuberculosis
ggacacccucgg

SEQ ID NO: 2958905 - RNA, 23 nt, Mycobacterium avium subsp. paratuberculosis
ggacaccgaacccggaucggcca

SEQ ID NO: 2958906 - RNA, 23 nt, Mycobacterium avium subsp. paratuberculosis
ggacaccgaaccgccccgcgcga

SEQ ID NO: 2958907 - RNA, 13 nt, Mycobacterium avium subsp. paratuberculosis
ggacaccgcaccc

SEQ ID NO: 2958908 - RNA, 16 nt, Mycobacterium avium subsp. paratuberculosis
ggacaccgcacccaga

SEQ ID NO: 2958909 - RNA, 23 nt, Mycobacterium avium subsp. paratuberculosis
ggacaccgcacccagaaacgaca

SEQ ID NO: 2958910 - RNA, 14 nt, Mycobacterium avium subsp. paratuberculosis
ggacaccgcgauca

SEQ ID NO: 2958911 - RNA, 15 nt, Mycobacterium avium subsp. paratuberculosis
ggacaccgcgaucac

SEQ ID NO: 2958912 - RNA, 14 nt, Mycobacterium avium subsp. paratuberculosis
ggacaccgcuggcc

SEQ ID NO: 2958913 - RNA, 16 nt, Mycobacterium avium subsp. paratuberculosis
ggacaccgcuggccga

SEQ ID NO: 2958914 - RNA, 21 nt, Mycobacterium avium subsp. paratuberculosis
ggacaccgcuggccgaggccu

SEQ ID NO: 2958915 - RNA, 19 nt, Mycobacterium avium subsp. paratuberculosis
ggacaccggcacgucggcc

SEQ ID NO: 2958916 - RNA, 21 nt, Mycobacterium avium subsp. paratuberculosis
ggacaccucggccagcgccgc

SEQ ID NO: 2958917 - RNA, 16 nt, Mycobacterium avium subsp. paratuberculosis
ggacaccuuggcggcc

SEQ ID NO: 2958918 - RNA, 19 nt, Mycobacterium avium subsp. paratuberculosis
ggacaccuuggcggccacc

SEQ ID NO: 2958919 - RNA, 15 nt, Mycobacterium avium subsp. paratuberculosis
ggacacgcugccgag

SEQ ID NO: 2958920 - RNA, 14 nt, Mycobacterium avium subsp. paratuberculosis
ggacacggcgccgu

SEQ ID NO: 2958921 - RNA, 13 nt, Mycobacterium avium subsp. paratuberculosis
ggacacggcggcg

SEQ ID NO: 2958922 - RNA, 22 nt, Mycobacterium avium subsp. paratuberculosis
ggacacggcggcgcgggcggcg

SEQ ID NO: 2958923 - RNA, 12 nt, Mycobacterium avium subsp. paratuberculosis
ggacacggcugc

SEQ ID NO: 2958924 - RNA, 16 nt, Mycobacterium avium subsp. paratuberculosis
ggacacggcugcaccc

SEQ ID NO: 2958925 - RNA, 23 nt, Mycobacterium avium subsp. paratuberculosis
ggacacggcugcacccucugcca

SEQ ID NO: 2958926 - RNA, 22 nt, Mycobacterium avium subsp. paratuberculosis
ggacagaucgcccaucaccgca

SEQ ID NO: 2958927 - RNA, 13 nt, Mycobacterium avium subsp. paratuberculosis
ggacagcaccaca

SEQ ID NO: 2958928 - RNA, 15 nt, Mycobacterium avium subsp. paratuberculosis
ggacagcaccaccag

SEQ ID NO: 2958929 - RNA, 14 nt, Mycobacterium avium subsp. paratuberculosis
ggacagcaccgcca

SEQ ID NO: 2958930 - RNA, 17 nt, Mycobacterium avium subsp. paratuberculosis
ggacagcagcaccggca

SEQ ID NO: 2958931 - RNA, 14 nt, Mycobacterium avium subsp. paratuberculosis
ggacagcagcagcu

SEQ ID NO: 2958932 - RNA, 23 nt, Mycobacterium avium subsp. paratuberculosis
ggacagcagccagguccgggcac

SEQ ID NO: 2958933 - RNA, 15 nt, Mycobacterium avium subsp. paratuberculosis
ggacagcagccgcuc

SEQ ID NO: 2958934 - RNA, 19 nt, Mycobacterium avium subsp. paratuberculosis
ggacagcagccgcucacac

SEQ ID NO: 2958935 - RNA, 17 nt, Mycobacterium avium subsp. paratuberculosis
ggacagccacagcucgg

SEQ ID NO: 2958936 - RNA, 20 nt, Mycobacterium avium subsp. paratuberculosis
ggacagccacagcucgggca

SEQ ID NO: 2958937 - RNA, 22 nt, Mycobacterium avium subsp. paratuberculosis
ggacagccacagcucgggcagc

SEQ ID NO: 2958938 - RNA, 14 nt, Mycobacterium avium subsp. paratuberculosis
ggacagccggggca

SEQ ID NO: 2958939 - RNA, 13 nt, Mycobacterium avium subsp. paratuberculosis
ggacagccggucg

SEQ ID NO: 2958940 - RNA, 17 nt, Mycobacterium avium subsp. paratuberculosis
ggacagccggucgacga

SEQ ID NO: 2958941 - RNA, 15 nt, Mycobacterium avium subsp. paratuberculosis
ggacagcgcgacgca

SEQ ID NO: 2958942 - RNA, 23 nt, Mycobacterium avium subsp. paratuberculosis
ggacagcgcggugauguugucga

SEQ ID NO: 2958943 - RNA, 14 nt, Mycobacterium avium subsp. paratuberculosis
ggacagcgggccga

SEQ ID NO: 2958944 - RNA, 17 nt, Mycobacterium avium subsp. paratuberculosis
ggacagcgggccgaccc

SEQ ID NO: 2958945 - RNA, 14 nt, Mycobacterium avium subsp. paratuberculosis
ggacagcgucacca

SEQ ID NO: 2958946 - RNA, 14 nt, Mycobacterium avium subsp. paratuberculosis
ggacagcucaccgg

SEQ ID NO: 2958947 - RNA, 15 nt, Mycobacterium avium subsp. paratuberculosis
ggacagcucaccggg

SEQ ID NO: 2958948 - RNA, 13 nt, Mycobacterium avium subsp. paratuberculosis
ggacagcucgccg

SEQ ID NO: 2958949 - RNA, 16 nt, Mycobacterium avium subsp. paratuberculosis
ggacagcucgccggcc

SEQ ID NO: 2958950 - RNA, 17 nt, Mycobacterium avium subsp. paratuberculosis
ggacagcucgccggccg

SEQ ID NO: 2958951 - RNA, 18 nt, Mycobacterium avium subsp. paratuberculosis
ggacagcucgccggccgc

SEQ ID NO: 2958952 - RNA, 14 nt, Mycobacterium avium subsp. paratuberculosis
ggacagcugacgau

SEQ ID NO: 2958953 - RNA, 20 nt, Mycobacterium avium subsp. paratuberculosis
ggacagcugcgcgggcgcgg

SEQ ID NO: 2958954 - RNA, 22 nt, Mycobacterium avium subsp. paratuberculosis
ggacagcugcgcgggcgcggcc

SEQ ID NO: 2958955 - RNA, 16 nt, Mycobacterium avium subsp. paratuberculosis
ggacagcuggcggucg

SEQ ID NO: 2958956 - RNA, 16 nt, Mycobacterium avium subsp. paratuberculosis
ggacaggaacgggccg

SEQ ID NO: 2958957 - RNA, 23 nt, Mycobacterium avium subsp. paratuberculosis
ggacaggcacucgcccagggcgu

SEQ ID NO: 2958958 - RNA, 13 nt, Mycobacterium avium subsp. paratuberculosis
ggacaggcccagc

SEQ ID NO: 2958959 - RNA, 16 nt, Mycobacterium avium subsp. paratuberculosis
ggacaggcccagcggc

SEQ ID NO: 2958960 - RNA, 11 nt, Mycobacterium avium subsp. paratuberculosis
ggacaggccgg

SEQ ID NO: 2958961 - RNA, 17 nt, Mycobacterium avium subsp. paratuberculosis
ggacaggccggcgacgg

SEQ ID NO: 2958962 - RNA, 17 nt, Mycobacterium avium subsp. paratuberculosis
ggacagggaggacagca

SEQ ID NO: 2958963 - RNA, 21 nt, Mycobacterium avium subsp. paratuberculosis
ggacagggaggacagcaccgc

SEQ ID NO: 2958964 - RNA, 20 nt, Mycobacterium avium subsp. paratuberculosis
ggacagggcggcgaccuucg

SEQ ID NO: 2958965 - RNA, 16 nt, Mycobacterium avium subsp. paratuberculosis
ggacagguagcggugc

SEQ ID NO: 2958966 - RNA, 23 nt, Mycobacterium avium subsp. paratuberculosis
ggacagguagcggugcucgaugu

SEQ ID NO: 2958967 - RNA, 12 nt, Mycobacterium avium subsp. paratuberculosis
ggacaggucgag

SEQ ID NO: 2958968 - RNA, 15 nt, Mycobacterium avium subsp. paratuberculosis
ggacaggucgcggua

SEQ ID NO: 2958969 - RNA, 20 nt, Mycobacterium avium subsp. paratuberculosis
ggaccgggugaccggcgcgc

SEQ ID NO: 2958970 - RNA, 23 nt, Mycobacterium avium subsp. paratuberculosis
ggaccgggugaccggcgcgcagc

SEQ ID NO: 2958971 - RNA, 14 nt, Mycobacterium avium subsp. paratuberculosis
ggaccgguaggcgc

SEQ ID NO: 2958972 - RNA, 18 nt, Mycobacterium avium subsp. paratuberculosis
ggaccgguaggcgcaccg

SEQ ID NO: 2958973 - RNA, 18 nt, Mycobacterium avium subsp. paratuberculosis
ggaccggugcggucccgg

SEQ ID NO: 2958974 - RNA, 22 nt, Mycobacterium avium subsp. paratuberculosis
ggaccgguuuuccgucuucgac

SEQ ID NO: 2958975 - RNA, 17 nt, Mycobacterium avium subsp. paratuberculosis
ggaccgucaccguggcg

SEQ ID NO: 2958976 - RNA, 13 nt, Mycobacterium avium subsp. paratuberculosis
ggaccguccccgu

SEQ ID NO: 2958977 - RNA, 14 nt, Mycobacterium avium subsp. paratuberculosis
ggaccguccccguc

SEQ ID NO: 2958978 - RNA, 14 nt, Mycobacterium avium subsp. paratuberculosis
ggaccgucgcgcag

SEQ ID NO: 2958979 - RNA, 15 nt, Mycobacterium avium subsp. paratuberculosis
ggaccgucgcgcagc

SEQ ID NO: 2958980 - RNA, 14 nt, Mycobacterium avium subsp. paratuberculosis
ggaccgucgguguc

SEQ ID NO: 2958981 - RNA, 13 nt, Mycobacterium avium subsp. paratuberculosis
ggaccgugccgga

SEQ ID NO: 2958982 - RNA, 21 nt, Mycobacterium avium subsp. paratuberculosis
ggaccgugcgacuugguggcc

SEQ ID NO: 2958983 - RNA, 17 nt, Mycobacterium avium subsp. paratuberculosis
ggaccguucgguccgga

SEQ ID NO: 2958984 - RNA, 14 nt, Mycobacterium avium subsp. paratuberculosis
ggaccucgaagcag

SEQ ID NO: 2958985 - RNA, 14 nt, Mycobacterium avium subsp. paratuberculosis
ggaccucgaccagc

SEQ ID NO: 2958986 - RNA, 16 nt, Mycobacterium avium subsp. paratuberculosis
ggaccucgaccagccg

SEQ ID NO: 2958987 - RNA, 19 nt, Mycobacterium avium subsp. paratuberculosis
ggaccucgaccagccggug

SEQ ID NO: 2958988 - RNA, 13 nt, Mycobacterium avium subsp. paratuberculosis
ggaccugaccgaa

SEQ ID NO: 2958989 - RNA, 22 nt, Mycobacterium avium subsp. paratuberculosis
ggaccugccggcgaucaccggg

SEQ ID NO: 2958990 - RNA, 19 nt, Mycobacterium avium subsp. paratuberculosis
ggaccugcugcucgucgcg

SEQ ID NO: 2958991 - RNA, 18 nt, Mycobacterium avium subsp. paratuberculosis
ggaccuuggugucggcga

SEQ ID NO: 2958992 - RNA, 17 nt, Mycobacterium avium subsp. paratuberculosis
ggaccuugucgggccgc

SEQ ID NO: 2958993 - RNA, 18 nt, Mycobacterium avium subsp. paratuberculosis
ggaccuugucgggccgcg

SEQ ID NO: 2958994 - RNA, 19 nt, Mycobacterium avium subsp. paratuberculosis
ggacgaaaaccaggaacga

SEQ ID NO: 2958995 - RNA, 15 nt, Mycobacterium avium subsp. paratuberculosis
ggacgaaacccggcg

SEQ ID NO: 2958996 - RNA, 18 nt, Mycobacterium avium subsp. paratuberculosis
ggacgaaacccggcggac

SEQ ID NO: 2958997 - RNA, 15 nt, Mycobacterium avium subsp. paratuberculosis
ggacgaaccagugcc

SEQ ID NO: 2958998 - RNA, 17 nt, Mycobacterium avium subsp. paratuberculosis
ggacgaagugcccgccu

SEQ ID NO: 2958999 - RNA, 22 nt, Mycobacterium avium subsp. paratuberculosis
ggacgacaccacggucgccgcg

SEQ ID NO: 2959000 - RNA, 14 nt, Mycobacterium avium subsp. paratuberculosis
ggacgaccugggcg

SEQ ID NO: 2959001 - RNA, 18 nt, Mycobacterium avium subsp. paratuberculosis
ggacgaccugggcgccgu

SEQ ID NO: 2959002 - RNA, 23 nt, Mycobacterium avium subsp. paratuberculosis
ggacgaccugggcgccgucgccg

SEQ ID NO: 2959003 - RNA, 22 nt, Mycobacterium avium subsp. paratuberculosis
ggacgacgccgaacugccggac

SEQ ID NO: 2959004 - RNA, 14 nt, Mycobacterium avium subsp. paratuberculosis
ggacgacggccagc

SEQ ID NO: 2959005 - RNA, 16 nt, Mycobacterium avium subsp. paratuberculosis
ggacgacggccagcug

SEQ ID NO: 2959006 - RNA, 16 nt, Mycobacterium avium subsp. paratuberculosis
ggacgacggcgccgcc

SEQ ID NO: 2959007 - RNA, 17 nt, Mycobacterium avium subsp. paratuberculosis
ggacgacggcgccgccc

SEQ ID NO: 2959008 - RNA, 19 nt, Mycobacterium avium subsp. paratuberculosis
ggacgacggcgccgcccgg

SEQ ID NO: 2959009 - RNA, 20 nt, Mycobacterium avium subsp. paratuberculosis
ggacgacggcgccgcccggg

SEQ ID NO: 2959010 - RNA, 23 nt, Mycobacterium avium subsp. paratuberculosis
ggacgacgugcccuuccccggcg

SEQ ID NO: 2959011 - RNA, 17 nt, Mycobacterium avium subsp. paratuberculosis
ggacgacucguucgacg

SEQ ID NO: 2959012 - RNA, 18 nt, Mycobacterium avium subsp. paratuberculosis
ggacgaggugaccggcga

SEQ ID NO: 2959013 - RNA, 19 nt, Mycobacterium avium subsp. paratuberculosis
ggacgaggugaccggcgag

SEQ ID NO: 2959014 - RNA, 19 nt, Mycobacterium avium subsp. paratuberculosis
ggacgagucccaugggcug

SEQ ID NO: 2959015 - RNA, 18 nt, Mycobacterium avium subsp. paratuberculosis
ggacgaguggucggccgc

SEQ ID NO: 2959016 - RNA, 16 nt, Mycobacterium avium subsp. paratuberculosis
ggacgaugacccagcc

SEQ ID NO: 2959017 - RNA, 22 nt, Mycobacterium avium subsp. paratuberculosis
ggacgaugacccagcccagcug

SEQ ID NO: 2959018 - RNA, 11 nt, Mycobacterium avium subsp. paratuberculosis
ggacgaugccg

SEQ ID NO: 2959019 - RNA, 16 nt, Mycobacterium avium subsp. paratuberculosis
ggacgaugccgcggcg

SEQ ID NO: 2959020 - RNA, 20 nt, Mycobacterium avium subsp. paratuberculosis
ggacgaugccgcggcguccc

SEQ ID NO: 2959021 - RNA, 14 nt, Mycobacterium avium subsp. paratuberculosis
ggacgaugcgcacc

SEQ ID NO: 2959022 - RNA, 17 nt, Mycobacterium avium subsp. paratuberculosis
ggacgaugcgcaccccc

SEQ ID NO: 2959023 - RNA, 13 nt, Mycobacterium avium subsp. paratuberculosis
ggacgaugcgcgc

SEQ ID NO: 2959024 - RNA, 22 nt, Mycobacterium avium subsp. paratuberculosis
ggacgaugcggggccggcggcg

SEQ ID NO: 2959025 - RNA, 19 nt, Mycobacterium avium subsp. paratuberculosis
ggacgauguccgccggccg

SEQ ID NO: 2959026 - RNA, 16 nt, Mycobacterium avium subsp. paratuberculosis
ggacgauucgcgauca

SEQ ID NO: 2959027 - RNA, 23 nt, Mycobacterium avium subsp. paratuberculosis
ggacgcagcgaucggcggcucgc

SEQ ID NO: 2959028 - RNA, 15 nt, Mycobacterium avium subsp. paratuberculosis
ggacgccacaacaua

SEQ ID NO: 2959029 - RNA, 18 nt, Mycobacterium avium subsp. paratuberculosis
ggacgccagcaugaucac

SEQ ID NO: 2959030 - RNA, 23 nt, Mycobacterium avium subsp. paratuberculosis
ggacgccagcaugaucaccgcca

SEQ ID NO: 2959031 - RNA, 23 nt, Mycobacterium avium subsp. paratuberculosis
ggacgcccagaacugggccgccg

SEQ ID NO: 2959032 - RNA, 14 nt, Mycobacterium avium subsp. paratuberculosis
ggacgcccggcgag

SEQ ID NO: 2959033 - RNA, 16 nt, Mycobacterium avium subsp. paratuberculosis
ggacgcccggcgagug

SEQ ID NO: 2959034 - RNA, 17 nt, Mycobacterium avium subsp. paratuberculosis
ggacgcccggucgacca

SEQ ID NO: 2959035 - RNA, 15 nt, Mycobacterium avium subsp. paratuberculosis
ggacgccgcaccgca

SEQ ID NO: 2959036 - RNA, 13 nt, Mycobacterium avium subsp. paratuberculosis
ggacgccgcgcac

SEQ ID NO: 2959037 - RNA, 16 nt, Mycobacterium avium subsp. paratuberculosis
ggacgccggcagccgc

SEQ ID NO: 2959038 - RNA, 14 nt, Mycobacterium avium subsp. paratuberculosis
ggacgccgugcagg

SEQ ID NO: 2959039 - RNA, 22 nt, Mycobacterium avium subsp. paratuberculosis
ggacgccguugacaccgggugc

SEQ ID NO: 2959040 - RNA, 16 nt, Mycobacterium avium subsp. paratuberculosis
ggacgccucgcgcagc

SEQ ID NO: 2959041 - RNA, 19 nt, Mycobacterium avium subsp. paratuberculosis
ggacgccucgcgcagcgcg

SEQ ID NO: 2959042 - RNA, 13 nt, Mycobacterium avium subsp. paratuberculosis
ggacgccugccgc

SEQ ID NO: 2959043 - RNA, 14 nt, Mycobacterium avium subsp. paratuberculosis
ggacgccugccgcc

SEQ ID NO: 2959044 - RNA, 15 nt, Mycobacterium avium subsp. paratuberculosis
ggacgccugccgccu

SEQ ID NO: 2959045 - RNA, 13 nt, Mycobacterium avium subsp. paratuberculosis
ggacgcgaccagg

SEQ ID NO: 2959046 - RNA, 14 nt, Mycobacterium avium subsp. paratuberculosis
ggacgcgaccaggc

SEQ ID NO: 2959047 - RNA, 15 nt, Mycobacterium avium subsp. paratuberculosis
ggacgcgaccaggcc

SEQ ID NO: 2959048 - RNA, 22 nt, Mycobacterium avium subsp. paratuberculosis
ggacgcgaccaggcccagcgga

SEQ ID NO: 2959049 - RNA, 23 nt, Mycobacterium avium subsp. paratuberculosis
ggacgcgaccaggcccagcggau

SEQ ID NO: 2959050 - RNA, 18 nt, Mycobacterium avium subsp. paratuberculosis
ggacgcgauggcgcuggc

SEQ ID NO: 2959051 - RNA, 14 nt, Mycobacterium avium subsp. paratuberculosis
ggacgcgcccggcg

SEQ ID NO: 2959052 - RNA, 15 nt, Mycobacterium avium subsp. paratuberculosis
ggacgcgcgcggcgu

SEQ ID NO: 2959053 - RNA, 18 nt, Mycobacterium avium subsp. paratuberculosis
ggacgcggcaggcgcccc

SEQ ID NO: 2959054 - RNA, 20 nt, Mycobacterium avium subsp. paratuberculosis
ggacucccccaccacguagg

SEQ ID NO: 2959055 - RNA, 23 nt, Mycobacterium avium subsp. paratuberculosis
ggacuccuccugcgacggcagca

SEQ ID NO: 2959056 - RNA, 22 nt, Mycobacterium avium subsp. paratuberculosis
ggacuccuucaucgaucgggug

SEQ ID NO: 2959057 - RNA, 17 nt, Mycobacterium avium subsp. paratuberculosis
ggacucgaagaucgccu

SEQ ID NO: 2959058 - RNA, 18 nt, Mycobacterium avium subsp. paratuberculosis
ggacucgaagaucgccug

SEQ ID NO: 2959059 - RNA, 15 nt, Mycobacterium avium subsp. paratuberculosis
ggacucgaucgccac

SEQ ID NO: 2959060 - RNA, 17 nt, Mycobacterium avium subsp. paratuberculosis
ggacucgaucgccaccg

SEQ ID NO: 2959061 - RNA, 19 nt, Mycobacterium avium subsp. paratuberculosis
ggacucguuggggccacca

SEQ ID NO: 2959062 - RNA, 17 nt, Mycobacterium avium subsp. paratuberculosis
ggacuggccaccgcgau

SEQ ID NO: 2959063 - RNA, 16 nt, Mycobacterium avium subsp. paratuberculosis
ggacuggugggcgucg

SEQ ID NO: 2959064 - RNA, 20 nt, Mycobacterium avium subsp. paratuberculosis
ggacuucugguugacgccga

SEQ ID NO: 2959065 - RNA, 23 nt, Mycobacterium avium subsp. paratuberculosis
ggacuugcgucgcgaugcccaag

SEQ ID NO: 2959066 - RNA, 20 nt, Mycobacterium avium subsp. paratuberculosis
ggacuuucgcgucugcucgc

SEQ ID NO: 2959067 - RNA, 22 nt, Mycobacterium avium subsp. paratuberculosis
ggacuuucgcgucugcucgccg

SEQ ID NO: 2959068 - RNA, 14 nt, Mycobacterium avium subsp. paratuberculosis
ggagaaaccgucgg

SEQ ID NO: 2959069 - RNA, 22 nt, Mycobacterium avium subsp. paratuberculosis
ggagaaaccgucggcccgccaa

SEQ ID NO: 2959070 - RNA, 20 nt, Mycobacterium avium subsp. paratuberculosis
ggagaaaugggccagguccu

SEQ ID NO: 2959071 - RNA, 22 nt, Mycobacterium avium subsp. paratuberculosis
ggagaaccgcucgauggcgccg

SEQ ID NO: 2959072 - RNA, 23 nt, Mycobacterium avium subsp. paratuberculosis
ggagaacgucaggcccagcgagg

SEQ ID NO: 2959073 - RNA, 16 nt, Mycobacterium avium subsp. paratuberculosis
ggagaaggccgcgcgc

SEQ ID NO: 2959074 - RNA, 16 nt, Mycobacterium avium subsp. paratuberculosis
ggagaaggugucgcac

SEQ ID NO: 2959075 - RNA, 19 nt, Mycobacterium avium subsp. paratuberculosis
ggagaaggugucgcacugc

SEQ ID NO: 2959076 - RNA, 18 nt, Mycobacterium avium subsp. paratuberculosis
ggagaaguccuuguggcc

SEQ ID NO: 2959077 - RNA, 23 nt, Mycobacterium avium subsp. paratuberculosis
ggagaaguccuuguggcccaggc

SEQ ID NO: 2959078 - RNA, 17 nt, Mycobacterium avium subsp. paratuberculosis
ggagaaguggcugguca

SEQ ID NO: 2959079 - RNA, 16 nt, Mycobacterium avium subsp. paratuberculosis
ggagaccagcagcuug

SEQ ID NO: 2959080 - RNA, 19 nt, Mycobacterium avium subsp. paratuberculosis
ggagaccaggucggccuuc

SEQ ID NO: 2959081 - RNA, 16 nt, Mycobacterium avium subsp. paratuberculosis
ggagacgaccaggucc

SEQ ID NO: 2959082 - RNA, 23 nt, Mycobacterium avium subsp. paratuberculosis
ggagacgaccagguccaccccgc

SEQ ID NO: 2959083 - RNA, 13 nt, Mycobacterium avium subsp. paratuberculosis
ggagacgucggcc

SEQ ID NO: 2959084 - RNA, 16 nt, Mycobacterium avium subsp. paratuberculosis
ggagacgucggccggg

SEQ ID NO: 2959085 - RNA, 15 nt, Mycobacterium avium subsp. paratuberculosis
ggagacguggcggcg

SEQ ID NO: 2959086 - RNA, 17 nt, Mycobacterium avium subsp. paratuberculosis
ggagacguggcggcggu

SEQ ID NO: 2959087 - RNA, 17 nt, Mycobacterium avium subsp. paratuberculosis
ggagacguugccgcaca

SEQ ID NO: 2959088 - RNA, 21 nt, Mycobacterium avium subsp. paratuberculosis
ggagacugcgacccaccgucg

SEQ ID NO: 2959089 - RNA, 20 nt, Mycobacterium avium subsp. paratuberculosis
ggagagcgcgggcaccgucg

SEQ ID NO: 2959090 - RNA, 23 nt, Mycobacterium avium subsp. paratuberculosis
ggagagcgcgggcaccgucgucg

SEQ ID NO: 2959091 - RNA, 16 nt, Mycobacterium avium subsp. paratuberculosis
ggagagcuugccgcgg

SEQ ID NO: 2959092 - RNA, 17 nt, Mycobacterium avium subsp. paratuberculosis
ggagagcuugccgcgga

SEQ ID NO: 2959093 - RNA, 13 nt, Mycobacterium avium subsp. paratuberculosis
ggagaggcccggc

SEQ ID NO: 2959094 - RNA, 14 nt, Mycobacterium avium subsp. paratuberculosis
ggagaggcccggca

SEQ ID NO: 2959095 - RNA, 19 nt, Mycobacterium avium subsp. paratuberculosis
ggagaggcgcggcgcgagg

SEQ ID NO: 2959096 - RNA, 21 nt, Mycobacterium avium subsp. paratuberculosis
ggagauacggucgcaccgcgg

SEQ ID NO: 2959097 - RNA, 22 nt, Mycobacterium avium subsp. paratuberculosis
ggagauacggucgcaccgcggc

SEQ ID NO: 2959098 - RNA, 23 nt, Mycobacterium avium subsp. paratuberculosis
ggagauacggucgcaccgcggcg

SEQ ID NO: 2959099 - RNA, 22 nt, Mycobacterium avium subsp. paratuberculosis
ggagaucaccccuggcggguac

SEQ ID NO: 2959100 - RNA, 13 nt, Mycobacterium avium subsp. paratuberculosis
ggagaucaccggc

SEQ ID NO: 2959101 - RNA, 13 nt, Mycobacterium avium subsp. paratuberculosis
ggagaucggcgag

SEQ ID NO: 2959102 - RNA, 16 nt, Mycobacterium avium subsp. paratuberculosis
ggagaucggcgagugc

SEQ ID NO: 2959103 - RNA, 14 nt, Mycobacterium avium subsp. paratuberculosis
ggagauggccagca

SEQ ID NO: 2959104 - RNA, 20 nt, Mycobacterium avium subsp. paratuberculosis
ggagauggccagcaccaccg

SEQ ID NO: 2959105 - RNA, 23 nt, Mycobacterium avium subsp. paratuberculosis
ggagauguugaugaucgagccgc

SEQ ID NO: 2959106 - RNA, 15 nt, Mycobacterium avium subsp. paratuberculosis
ggagcaaauccggca

SEQ ID NO: 2959107 - RNA, 17 nt, Mycobacterium avium subsp. paratuberculosis
ggagcaaauccggcagc

SEQ ID NO: 2959108 - RNA, 17 nt, Mycobacterium avium subsp. paratuberculosis
ggagcaaggucgucgcg

SEQ ID NO: 2959109 - RNA, 17 nt, Mycobacterium avium subsp. paratuberculosis
ggagcaccugcgcgacg

SEQ ID NO: 2959110 - RNA, 17 nt, Mycobacterium avium subsp. paratuberculosis
ggagcacgugaugagcg

SEQ ID NO: 2959111 - RNA, 15 nt, Mycobacterium avium subsp. paratuberculosis
ggagcacucgauggc

SEQ ID NO: 2959112 - RNA, 20 nt, Mycobacterium avium subsp. paratuberculosis
ggagcacucgauggcggcga

SEQ ID NO: 2959113 - RNA, 21 nt, Mycobacterium avium subsp. paratuberculosis
ggagcagcacgaucgagccgg

SEQ ID NO: 2959114 - RNA, 17 nt, Mycobacterium avium subsp. paratuberculosis
ggagcaggacgguggcc

SEQ ID NO: 2959115 - RNA, 13 nt, Mycobacterium avium subsp. paratuberculosis
ggagcaucggggu

SEQ ID NO: 2959116 - RNA, 19 nt, Mycobacterium avium subsp. paratuberculosis
ggagcccagcuuggcgccc

SEQ ID NO: 2959117 - RNA, 13 nt, Mycobacterium avium subsp. paratuberculosis
ggagccgaccagc

SEQ ID NO: 2959118 - RNA, 16 nt, Mycobacterium avium subsp. paratuberculosis
ggagccgaccagcgcg

SEQ ID NO: 2959119 - RNA, 20 nt, Mycobacterium avium subsp. paratuberculosis
ggagccgaccucggcgacga

SEQ ID NO: 2959120 - RNA, 20 nt, Mycobacterium avium subsp. paratuberculosis
ggagccgacgaagaucccgc

SEQ ID NO: 2959121 - RNA, 18 nt, Mycobacterium avium subsp. paratuberculosis
ggagccgagcaccaggcg

SEQ ID NO: 2959122 - RNA, 19 nt, Mycobacterium avium subsp. paratuberculosis
ggagccgagcaccaggcgc

SEQ ID NO: 2959123 - RNA, 20 nt, Mycobacterium avium subsp. paratuberculosis
ggagccgagcaccaggcgca

SEQ ID NO: 2959124 - RNA, 16 nt, Mycobacterium avium subsp. paratuberculosis
ggagccgagcaccggg

SEQ ID NO: 2959125 - RNA, 16 nt, Mycobacterium avium subsp. paratuberculosis
ggagccgaucgccucc

SEQ ID NO: 2959126 - RNA, 14 nt, Mycobacterium avium subsp. paratuberculosis
ggagccgcccaugc

SEQ ID NO: 2959127 - RNA, 20 nt, Mycobacterium avium subsp. paratuberculosis
ggagccggagaacuaucugg

SEQ ID NO: 2959128 - RNA, 14 nt, Mycobacterium avium subsp. paratuberculosis
ggagccggccaggu

SEQ ID NO: 2959129 - RNA, 20 nt, Mycobacterium avium subsp. paratuberculosis
ggagccggccagguugacca

SEQ ID NO: 2959130 - RNA, 13 nt, Mycobacterium avium subsp. paratuberculosis
ggagccggccgcc

SEQ ID NO: 2959131 - RNA, 16 nt, Mycobacterium avium subsp. paratuberculosis
ggagccggccgccgaa

SEQ ID NO: 2959132 - RNA, 16 nt, Mycobacterium avium subsp. paratuberculosis
ggagccggccucgccg

SEQ ID NO: 2959133 - RNA, 19 nt, Mycobacterium avium subsp. paratuberculosis
ggagccggccucgccggcg

SEQ ID NO: 2959134 - RNA, 13 nt, Mycobacterium avium subsp. paratuberculosis
ggagccggcggcg

SEQ ID NO: 2959135 - RNA, 16 nt, Mycobacterium avium subsp. paratuberculosis
ggagccggcggcggug

SEQ ID NO: 2959136 - RNA, 17 nt, Mycobacterium avium subsp. paratuberculosis
ggagccggcggcggugc

SEQ ID NO: 2959137 - RNA, 19 nt, Mycobacterium avium subsp. paratuberculosis
ggagccggcggcggugcgu

SEQ ID NO: 2959138 - RNA, 23 nt, Mycobacterium avium subsp. paratuberculosis
ggaggucgucgcguccagcaugc

SEQ ID NO: 2959139 - RNA, 17 nt, Mycobacterium avium subsp. paratuberculosis
ggaggugaucgccagcc

SEQ ID NO: 2959140 - RNA, 22 nt, Mycobacterium avium subsp. paratuberculosis
ggaggugaucgccagcccggcg

SEQ ID NO: 2959141 - RNA, 14 nt, Mycobacterium avium subsp. paratuberculosis
ggaggugccgcgcg

SEQ ID NO: 2959142 - RNA, 14 nt, Mycobacterium avium subsp. paratuberculosis
ggaggugccggccg

SEQ ID NO: 2959143 - RNA, 15 nt, Mycobacterium avium subsp. paratuberculosis
ggaggugcgggucuc

SEQ ID NO: 2959144 - RNA, 17 nt, Mycobacterium avium subsp. paratuberculosis
ggaggugguccgcgaaa

SEQ ID NO: 2959145 - RNA, 20 nt, Mycobacterium avium subsp. paratuberculosis
ggagguucgccggaauggca

SEQ ID NO: 2959146 - RNA, 20 nt, Mycobacterium avium subsp. paratuberculosis
ggaguaguccagcaccgcca

SEQ ID NO: 2959147 - RNA, 22 nt, Mycobacterium avium subsp. paratuberculosis
ggaguaguccagcaccgccacg

SEQ ID NO: 2959148 - RNA, 14 nt, Mycobacterium avium subsp. paratuberculosis
ggaguccaccggcg

SEQ ID NO: 2959149 - RNA, 13 nt, Mycobacterium avium subsp. paratuberculosis
ggaguccacgccg

SEQ ID NO: 2959150 - RNA, 23 nt, Mycobacterium avium subsp. paratuberculosis
ggagucgaagcggugcaccaccg

SEQ ID NO: 2959151 - RNA, 16 nt, Mycobacterium avium subsp. paratuberculosis
ggagucgcuguuggcg

SEQ ID NO: 2959152 - RNA, 21 nt, Mycobacterium avium subsp. paratuberculosis
ggagucgcuguuggcgacggu

SEQ ID NO: 2959153 - RNA, 13 nt, Mycobacterium avium subsp. paratuberculosis
ggagucggggugc

SEQ ID NO: 2959154 - RNA, 17 nt, Mycobacterium avium subsp. paratuberculosis
ggagucgguuucgaccu

SEQ ID NO: 2959155 - RNA, 17 nt, Mycobacterium avium subsp. paratuberculosis
ggagucgucggcgcggu

SEQ ID NO: 2959156 - RNA, 14 nt, Mycobacterium avium subsp. paratuberculosis
ggagugaccgccag

SEQ ID NO: 2959157 - RNA, 15 nt, Mycobacterium avium subsp. paratuberculosis
ggagugaccgccagc

SEQ ID NO: 2959158 - RNA, 16 nt, Mycobacterium avium subsp. paratuberculosis
ggagugaccgccagca

SEQ ID NO: 2959159 - RNA, 22 nt, Mycobacterium avium subsp. paratuberculosis
ggagugaggggauccagcggcg

SEQ ID NO: 2959160 - RNA, 12 nt, Mycobacterium avium subsp. paratuberculosis
ggagugcucggc

SEQ ID NO: 2959161 - RNA, 17 nt, Mycobacterium avium subsp. paratuberculosis
ggagugcucggcguuga

SEQ ID NO: 2959162 - RNA, 21 nt, Mycobacterium avium subsp. paratuberculosis
ggaguggccggcguccaggcg

SEQ ID NO: 2959163 - RNA, 19 nt, Mycobacterium avium subsp. paratuberculosis
ggaguugcgcagccgggcg

SEQ ID NO: 2959164 - RNA, 17 nt, Mycobacterium avium subsp. paratuberculosis
ggaguuggaucgccgca

SEQ ID NO: 2959165 - RNA, 18 nt, Mycobacterium avium subsp. paratuberculosis
ggaguuggaucgccgcaa

SEQ ID NO: 2959166 - RNA, 21 nt, Mycobacterium avium subsp. paratuberculosis
ggaguuuuucgggguggugga

SEQ ID NO: 2959167 - RNA, 22 nt, Mycobacterium avium subsp. paratuberculosis
ggauaacccagcaccaccacgc

SEQ ID NO: 2959168 - RNA, 21 nt, Mycobacterium avium subsp. paratuberculosis
ggauaacgcaaaacggugcgg

SEQ ID NO: 2959169 - RNA, 19 nt, Mycobacterium avium subsp. paratuberculosis
ggauacccaugaucgccag

SEQ ID NO: 2959170 - RNA, 14 nt, Mycobacterium avium subsp. paratuberculosis
ggauacccgcggcc

SEQ ID NO: 2959171 - RNA, 16 nt, Mycobacterium avium subsp. paratuberculosis
ggauacccgcggccuc

SEQ ID NO: 2959172 - RNA, 18 nt, Mycobacterium avium subsp. paratuberculosis
ggauagauguugcggccg

SEQ ID NO: 2959173 - RNA, 19 nt, Mycobacterium avium subsp. paratuberculosis
ggauagccgagcggcgcca

SEQ ID NO: 2959174 - RNA, 17 nt, Mycobacterium avium subsp. paratuberculosis
ggauagcguccgcccac

SEQ ID NO: 2959175 - RNA, 20 nt, Mycobacterium avium subsp. paratuberculosis
ggauaguucgccgccgccag

SEQ ID NO: 2959176 - RNA, 22 nt, Mycobacterium avium subsp. paratuberculosis
ggauaguucgccgccgccagca

SEQ ID NO: 2959177 - RNA, 18 nt, Mycobacterium avium subsp. paratuberculosis
ggauauuucgcggccgaa

SEQ ID NO: 2959178 - RNA, 18 nt, Mycobacterium avium subsp. paratuberculosis
ggaucaaccacaccagca

SEQ ID NO: 2959179 - RNA, 16 nt, Mycobacterium avium subsp. paratuberculosis
ggaucaacucgucggg

SEQ ID NO: 2959180 - RNA, 23 nt, Mycobacterium avium subsp. paratuberculosis
ggaucacaucggacaucggcagc

SEQ ID NO: 2959181 - RNA, 18 nt, Mycobacterium avium subsp. paratuberculosis
ggaucacccucggcgucc

SEQ ID NO: 2959182 - RNA, 15 nt, Mycobacterium avium subsp. paratuberculosis
ggaucaccgggacgg

SEQ ID NO: 2959183 - RNA, 20 nt, Mycobacterium avium subsp. paratuberculosis
ggaucaccucaucgcccagc

SEQ ID NO: 2959184 - RNA, 23 nt, Mycobacterium avium subsp. paratuberculosis
ggaucaccuggugcucgcgcucg

SEQ ID NO: 2959185 - RNA, 13 nt, Mycobacterium avium subsp. paratuberculosis
ggaucacgcggcg

SEQ ID NO: 2959186 - RNA, 14 nt, Mycobacterium avium subsp. paratuberculosis
ggaucacgcggcgg

SEQ ID NO: 2959187 - RNA, 21 nt, Mycobacterium avium subsp. paratuberculosis
ggaucagcaccgacgcggcga

SEQ ID NO: 2959188 - RNA, 22 nt, Mycobacterium avium subsp. paratuberculosis
ggaucagcagaugcgcgucgcg

SEQ ID NO: 2959189 - RNA, 20 nt, Mycobacterium avium subsp. paratuberculosis
ggaucagcagcaccggcgcc

SEQ ID NO: 2959190 - RNA, 14 nt, Mycobacterium avium subsp. paratuberculosis
ggaucagcgggacg

SEQ ID NO: 2959191 - RNA, 23 nt, Mycobacterium avium subsp. paratuberculosis
ggaucagcguuccggcggccggc

SEQ ID NO: 2959192 - RNA, 16 nt, Mycobacterium avium subsp. paratuberculosis
ggaucagcuccucgcg

SEQ ID NO: 2959193 - RNA, 22 nt, Mycobacterium avium subsp. paratuberculosis
ggaucagcugaccggcgaucgu

SEQ ID NO: 2959194 - RNA, 19 nt, Mycobacterium avium subsp. paratuberculosis
ggaucaucucguagccgug

SEQ ID NO: 2959195 - RNA, 20 nt, Mycobacterium avium subsp. paratuberculosis
ggauccaccaauucgcgcug

SEQ ID NO: 2959196 - RNA, 21 nt, Mycobacterium avium subsp. paratuberculosis
ggauccaccaauucgcgcugc

SEQ ID NO: 2959197 - RNA, 14 nt, Mycobacterium avium subsp. paratuberculosis
ggauccagcggcgg

SEQ ID NO: 2959198 - RNA, 15 nt, Mycobacterium avium subsp. paratuberculosis
ggauccagcggcggc

SEQ ID NO: 2959199 - RNA, 15 nt, Mycobacterium avium subsp. paratuberculosis
ggauccagguggggc

SEQ ID NO: 2959200 - RNA, 23 nt, Mycobacterium avium subsp. paratuberculosis
ggaucccagaauucgccggggca

SEQ ID NO: 2959201 - RNA, 21 nt, Mycobacterium avium subsp. paratuberculosis
ggaucccagucguuggugcgc

SEQ ID NO: 2959202 - RNA, 15 nt, Mycobacterium avium subsp. paratuberculosis
ggauccccgcgcugg

SEQ ID NO: 2959203 - RNA, 18 nt, Mycobacterium avium subsp. paratuberculosis
ggauccccgcgcugggcu

SEQ ID NO: 2959204 - RNA, 19 nt, Mycobacterium avium subsp. paratuberculosis
ggauccccucacuccagcg

SEQ ID NO: 2959205 - RNA, 21 nt, Mycobacterium avium subsp. paratuberculosis
ggauccccucacuccagcggc

SEQ ID NO: 2959206 - RNA, 22 nt, Mycobacterium avium subsp. paratuberculosis
ggauccccucacuccagcggcg

SEQ ID NO: 2959207 - RNA, 14 nt, Mycobacterium avium subsp. paratuberculosis
ggaucccgaaaccg

SEQ ID NO: 2959208 - RNA, 14 nt, Mycobacterium avium subsp. paratuberculosis
ggaucccgaacugc

SEQ ID NO: 2959209 - RNA, 17 nt, Mycobacterium avium subsp. paratuberculosis
ggaucccgaacugccgc

SEQ ID NO: 2959210 - RNA, 20 nt, Mycobacterium avium subsp. paratuberculosis
ggaucccgaacugccgcgca

SEQ ID NO: 2959211 - RNA, 15 nt, Mycobacterium avium subsp. paratuberculosis
ggaucccgcagccgc

SEQ ID NO: 2959212 - RNA, 17 nt, Mycobacterium avium subsp. paratuberculosis
ggaucccgcagccgcga

SEQ ID NO: 2959213 - RNA, 15 nt, Mycobacterium avium subsp. paratuberculosis
ggaucccgguacggc

SEQ ID NO: 2959214 - RNA, 18 nt, Mycobacterium avium subsp. paratuberculosis
ggaucccgguacggcuca

SEQ ID NO: 2959215 - RNA, 21 nt, Mycobacterium avium subsp. paratuberculosis
ggaucccggugagcgugucgc

SEQ ID NO: 2959216 - RNA, 18 nt, Mycobacterium avium subsp. paratuberculosis
ggauccgaggcgucaggg

SEQ ID NO: 2959217 - RNA, 14 nt, Mycobacterium avium subsp. paratuberculosis
ggauccgaugacgc

SEQ ID NO: 2959218 - RNA, 21 nt, Mycobacterium avium subsp. paratuberculosis
ggauccgaugacgcugccgcg

SEQ ID NO: 2959219 - RNA, 17 nt, Mycobacterium avium subsp. paratuberculosis
ggauccgcaccgggcag

SEQ ID NO: 2959220 - RNA, 18 nt, Mycobacterium avium subsp. paratuberculosis
ggauccgcaccgggcagc

SEQ ID NO: 2959221 - RNA, 12 nt, Mycobacterium avium subsp. paratuberculosis
ggauccgcagcu

SEQ ID NO: 2959222 - RNA, 14 nt, Mycobacterium avium subsp. paratuberculosis
ggaucugcgccgcc

SEQ ID NO: 2959223 - RNA, 16 nt, Mycobacterium avium subsp. paratuberculosis
ggaucugcggugagcg

SEQ ID NO: 2959224 - RNA, 14 nt, Mycobacterium avium subsp. paratuberculosis
ggaucuggccggug

SEQ ID NO: 2959225 - RNA, 17 nt, Mycobacterium avium subsp. paratuberculosis
ggaucuggccggugagc

SEQ ID NO: 2959226 - RNA, 16 nt, Mycobacterium avium subsp. paratuberculosis
ggaucugggcggcggg

SEQ ID NO: 2959227 - RNA, 14 nt, Mycobacterium avium subsp. paratuberculosis
ggaucugggugagc

SEQ ID NO: 2959228 - RNA, 23 nt, Mycobacterium avium subsp. paratuberculosis
ggaucuugaucgcgaagaccagc

SEQ ID NO: 2959229 - RNA, 23 nt, Mycobacterium avium subsp. paratuberculosis
ggaucuugccgucggccgccgac

SEQ ID NO: 2959230 - RNA, 16 nt, Mycobacterium avium subsp. paratuberculosis
ggaucuugucggcggc

SEQ ID NO: 2959231 - RNA, 23 nt, Mycobacterium avium subsp. paratuberculosis
ggaugaacagcacgugcccgccg

SEQ ID NO: 2959232 - RNA, 17 nt, Mycobacterium avium subsp. paratuberculosis
ggaugaacucgugcggc

SEQ ID NO: 2959233 - RNA, 18 nt, Mycobacterium avium subsp. paratuberculosis
ggaugaacucgugcggcg

SEQ ID NO: 2959234 - RNA, 21 nt, Mycobacterium avium subsp. paratuberculosis
ggaugaacucgugcggcgccg

SEQ ID NO: 2959235 - RNA, 20 nt, Mycobacterium avium subsp. paratuberculosis
ggaugaaggucgcggacugg

SEQ ID NO: 2959236 - RNA, 16 nt, Mycobacterium avium subsp. paratuberculosis
ggaugaccaagccccg

SEQ ID NO: 2959237 - RNA, 15 nt, Mycobacterium avium subsp. paratuberculosis
ggaugaccagggugg

SEQ ID NO: 2959238 - RNA, 20 nt, Mycobacterium avium subsp. paratuberculosis
ggaugaccaggucgccggcg

SEQ ID NO: 2959239 - RNA, 16 nt, Mycobacterium avium subsp. paratuberculosis
ggaugaccgcccagga

SEQ ID NO: 2959240 - RNA, 19 nt, Mycobacterium avium subsp. paratuberculosis
ggaugaccgcgucggcgcc

SEQ ID NO: 2959241 - RNA, 17 nt, Mycobacterium avium subsp. paratuberculosis
ggaugacgacggucacc

SEQ ID NO: 2959242 - RNA, 17 nt, Mycobacterium avium subsp. paratuberculosis
ggaugacgccgcgguug

SEQ ID NO: 2959243 - RNA, 17 nt, Mycobacterium avium subsp. paratuberculosis
ggaugacgugcaccacc

SEQ ID NO: 2959244 - RNA, 18 nt, Mycobacterium avium subsp. paratuberculosis
ggaugacgugcaccaccg

SEQ ID NO: 2959245 - RNA, 20 nt, Mycobacterium avium subsp. paratuberculosis
ggaugacgugcaccaccgcg

SEQ ID NO: 2959246 - RNA, 22 nt, Mycobacterium avium subsp. paratuberculosis
ggaugagcugggcggcgcgcug

SEQ ID NO: 2959247 - RNA, 23 nt, Mycobacterium avium subsp. paratuberculosis
ggaugagcugggcggcgcgcugc

SEQ ID NO: 2959248 - RNA, 21 nt, Mycobacterium avium subsp. paratuberculosis
ggaugauguucuccggcccgg

SEQ ID NO: 2959249 - RNA, 16 nt, Mycobacterium avium subsp. paratuberculosis
ggaugauuucggcgug

SEQ ID NO: 2959250 - RNA, 14 nt, Mycobacterium avium subsp. paratuberculosis
ggaugcaccggcag

SEQ ID NO: 2959251 - RNA, 15 nt, Mycobacterium avium subsp. paratuberculosis
ggaugcagccggcca

SEQ ID NO: 2959252 - RNA, 16 nt, Mycobacterium avium subsp. paratuberculosis
ggaugccaguccuggg

SEQ ID NO: 2959253 - RNA, 20 nt, Mycobacterium avium subsp. paratuberculosis
ggaugccaguccugggccgg

SEQ ID NO: 2959254 - RNA, 15 nt, Mycobacterium avium subsp. paratuberculosis
ggaugcccagcacca

SEQ ID NO: 2959255 - RNA, 11 nt, Mycobacterium avium subsp. paratuberculosis
ggaugcccagg

SEQ ID NO: 2959256 - RNA, 12 nt, Mycobacterium avium subsp. paratuberculosis
ggaugcccagga

SEQ ID NO: 2959257 - RNA, 16 nt, Mycobacterium avium subsp. paratuberculosis
ggaugcccaggccggc

SEQ ID NO: 2959258 - RNA, 17 nt, Mycobacterium avium subsp. paratuberculosis
ggaugcccaggccggcg

SEQ ID NO: 2959259 - RNA, 19 nt, Mycobacterium avium subsp. paratuberculosis
ggaugcccaggccggcgag

SEQ ID NO: 2959260 - RNA, 22 nt, Mycobacterium avium subsp. paratuberculosis
ggaugcccgggccguccgggug

SEQ ID NO: 2959261 - RNA, 15 nt, Mycobacterium avium subsp. paratuberculosis
ggaugccgaaccgcu

SEQ ID NO: 2959262 - RNA, 16 nt, Mycobacterium avium subsp. paratuberculosis
ggaugccgaaccgcug

SEQ ID NO: 2959263 - RNA, 19 nt, Mycobacterium avium subsp. paratuberculosis
ggaugccgaaccgcugcgg

SEQ ID NO: 2959264 - RNA, 22 nt, Mycobacterium avium subsp. paratuberculosis
ggaugccgaacgcgauccacug

SEQ ID NO: 2959265 - RNA, 16 nt, Mycobacterium avium subsp. paratuberculosis
ggaugccgaugucgga

SEQ ID NO: 2959266 - RNA, 13 nt, Mycobacterium avium subsp. paratuberculosis
ggaugccgcccac

SEQ ID NO: 2959267 - RNA, 21 nt, Mycobacterium avium subsp. paratuberculosis
ggaugccgcccaccaccggcu

SEQ ID NO: 2959268 - RNA, 14 nt, Mycobacterium avium subsp. paratuberculosis
ggaugccgccgguc

SEQ ID NO: 2959269 - RNA, 19 nt, Mycobacterium avium subsp. paratuberculosis
ggaugccgccggucacggc

SEQ ID NO: 2959270 - RNA, 16 nt, Mycobacterium avium subsp. paratuberculosis
ggaugccgcgcggcgc

SEQ ID NO: 2959271 - RNA, 18 nt, Mycobacterium avium subsp. paratuberculosis
ggaugccgcgcggcgcca

SEQ ID NO: 2959272 - RNA, 20 nt, Mycobacterium avium subsp. paratuberculosis
ggaugccgcgcggcgccagc

SEQ ID NO: 2959273 - RNA, 14 nt, Mycobacterium avium subsp. paratuberculosis
ggaugccggcgccc

SEQ ID NO: 2959274 - RNA, 17 nt, Mycobacterium avium subsp. paratuberculosis
ggaugccggcgcccagc

SEQ ID NO: 2959275 - RNA, 19 nt, Mycobacterium avium subsp. paratuberculosis
ggaugccggggcagcaccc

SEQ ID NO: 2959276 - RNA, 16 nt, Mycobacterium avium subsp. paratuberculosis
ggaugcgagccagcug

SEQ ID NO: 2959277 - RNA, 18 nt, Mycobacterium avium subsp. paratuberculosis
ggaugcgagccagcugcg

SEQ ID NO: 2959278 - RNA, 22 nt, Mycobacterium avium subsp. paratuberculosis
ggaugcgcuggugcacccgaug

SEQ ID NO: 2959279 - RNA, 15 nt, Mycobacterium avium subsp. paratuberculosis
ggaugcggccgaagu

SEQ ID NO: 2959280 - RNA, 19 nt, Mycobacterium avium subsp. paratuberculosis
ggaugcggcgcccacagca

SEQ ID NO: 2959281 - RNA, 16 nt, Mycobacterium avium subsp. paratuberculosis
ggaugcgggccacaca

SEQ ID NO: 2959282 - RNA, 23 nt, Mycobacterium avium subsp. paratuberculosis
ggaugcgggccacacacugcugc

SEQ ID NO: 2959283 - RNA, 16 nt, Mycobacterium avium subsp. paratuberculosis
ggaugcggucgaugag

SEQ ID NO: 2959284 - RNA, 19 nt, Mycobacterium avium subsp. paratuberculosis
ggaugcggucgucgcccac

SEQ ID NO: 2959285 - RNA, 16 nt, Mycobacterium avium subsp. paratuberculosis
ggaugcguucggccag

SEQ ID NO: 2959286 - RNA, 23 nt, Mycobacterium avium subsp. paratuberculosis
ggaugcguuggccgagcagccgg

SEQ ID NO: 2959287 - RNA, 21 nt, Mycobacterium avium subsp. paratuberculosis
ggaugcucaccggucagcugg

SEQ ID NO: 2959288 - RNA, 16 nt, Mycobacterium avium subsp. paratuberculosis
ggaugcuggggucggc

SEQ ID NO: 2959289 - RNA, 20 nt, Mycobacterium avium subsp. paratuberculosis
ggaugcuggggucggccagc

SEQ ID NO: 2959290 - RNA, 15 nt, Mycobacterium avium subsp. paratuberculosis
ggaugcuuggucgcg

SEQ ID NO: 2959291 - RNA, 17 nt, Mycobacterium avium subsp. paratuberculosis
ggaugcuuggucgcggc

SEQ ID NO: 2959292 - RNA, 18 nt, Mycobacterium avium subsp. paratuberculosis
ggaugcuuggucgcggcg

SEQ ID NO: 2959293 - RNA, 23 nt, Mycobacterium avium subsp. paratuberculosis
ggauggagcgcgacgggcugcug

SEQ ID NO: 2959294 - RNA, 15 nt, Mycobacterium avium subsp. paratuberculosis
ggauggccagcaggu

SEQ ID NO: 2959295 - RNA, 13 nt, Mycobacterium avium subsp. paratuberculosis
ggauggcccgcca

SEQ ID NO: 2959296 - RNA, 14 nt, Mycobacterium avium subsp. paratuberculosis
ggauggcccgccag

SEQ ID NO: 2959297 - RNA, 13 nt, Mycobacterium avium subsp. paratuberculosis
ggauggccgggca

SEQ ID NO: 2959298 - RNA, 12 nt, Mycobacterium avium subsp. paratuberculosis
ggauggcgaugg

SEQ ID NO: 2959299 - RNA, 12 nt, Mycobacterium avium subsp. paratuberculosis
ggauggcgccca

SEQ ID NO: 2959300 - RNA, 14 nt, Mycobacterium avium subsp. paratuberculosis
ggauggcgcccagc

SEQ ID NO: 2959301 - RNA, 16 nt, Mycobacterium avium subsp. paratuberculosis
ggauggcgcccggcag

SEQ ID NO: 2959302 - RNA, 22 nt, Mycobacterium avium subsp. paratuberculosis
ggauggcgcccggcagccgcuc

SEQ ID NO: 2959303 - RNA, 14 nt, Mycobacterium avium subsp. paratuberculosis
ggauggcgcccuug

SEQ ID NO: 2959304 - RNA, 14 nt, Mycobacterium avium subsp. paratuberculosis
ggauggcgccgucg

SEQ ID NO: 2959305 - RNA, 15 nt, Mycobacterium avium subsp. paratuberculosis
ggauggcgccgucga

SEQ ID NO: 2959306 - RNA, 12 nt, Mycobacterium avium subsp. paratuberculosis
ggauggcggucg

SEQ ID NO: 2959307 - RNA, 20 nt, Mycobacterium avium subsp. paratuberculosis
ggcaagcaguaugcccgccg

SEQ ID NO: 2959308 - RNA, 17 nt, Mycobacterium avium subsp. paratuberculosis
ggcaaggagguggucga

SEQ ID NO: 2959309 - RNA, 13 nt, Mycobacterium avium subsp. paratuberculosis
ggcaaggccagca

SEQ ID NO: 2959310 - RNA, 15 nt, Mycobacterium avium subsp. paratuberculosis
ggcaaggccagcaac

SEQ ID NO: 2959311 - RNA, 18 nt, Mycobacterium avium subsp. paratuberculosis
ggcaaggugccguccggg

SEQ ID NO: 2959312 - RNA, 15 nt, Mycobacterium avium subsp. paratuberculosis
ggcaauaccggcagc

SEQ ID NO: 2959313 - RNA, 19 nt, Mycobacterium avium subsp. paratuberculosis
ggcaauaccggcagcaggu

SEQ ID NO: 2959314 - RNA, 19 nt, Mycobacterium avium subsp. paratuberculosis
ggcaaucaggcggucgaac

SEQ ID NO: 2959315 - RNA, 15 nt, Mycobacterium avium subsp. paratuberculosis
ggcaauccggccccg

SEQ ID NO: 2959316 - RNA, 18 nt, Mycobacterium avium subsp. paratuberculosis
ggcaaucgagcgggcggg

SEQ ID NO: 2959317 - RNA, 16 nt, Mycobacterium avium subsp. paratuberculosis
ggcaaucgcugcgccc

SEQ ID NO: 2959318 - RNA, 18 nt, Mycobacterium avium subsp. paratuberculosis
ggcaaucgcugcgcccgc

SEQ ID NO: 2959319 - RNA, 16 nt, Mycobacterium avium subsp. paratuberculosis
ggcaaucggacccagc

SEQ ID NO: 2959320 - RNA, 23 nt, Mycobacterium avium subsp. paratuberculosis
ggcaaucgguuaagugcccgccu

SEQ ID NO: 2959321 - RNA, 24 nt, Mycobacterium avium subsp. paratuberculosis
ggcaaucugcccugcacuucggga

SEQ ID NO: 2959322 - RNA, 13 nt, Mycobacterium avium subsp. paratuberculosis
ggcaaugaccggc

SEQ ID NO: 2959323 - RNA, 17 nt, Mycobacterium avium subsp. paratuberculosis
ggcaaugaccggcacca

SEQ ID NO: 2959324 - RNA, 19 nt, Mycobacterium avium subsp. paratuberculosis
ggcaaugaccggcaccagc

SEQ ID NO: 2959325 - RNA, 14 nt, Mycobacterium avium subsp. paratuberculosis
ggcaauggccgcga

SEQ ID NO: 2959326 - RNA, 20 nt, Mycobacterium avium subsp. paratuberculosis
ggcaauugaauucgaccacg

SEQ ID NO: 2959327 - RNA, 22 nt, Mycobacterium avium subsp. paratuberculosis
ggcacaccagcguucgucgccg

SEQ ID NO: 2959328 - RNA, 22 nt, Mycobacterium avium subsp. paratuberculosis
ggcacaccagguaggcgguggc

SEQ ID NO: 2959329 - RNA, 24 nt, Mycobacterium avium subsp. paratuberculosis
ggcacaccgagcgagcgcaccaga

SEQ ID NO: 2959330 - RNA, 16 nt, Mycobacterium avium subsp. paratuberculosis
ggcacaccggugcucu

SEQ ID NO: 2959331 - RNA, 21 nt, Mycobacterium avium subsp. paratuberculosis
ggcacaccggugcucuccugc

SEQ ID NO: 2959332 - RNA, 16 nt, Mycobacterium avium subsp. paratuberculosis
ggcacaccgucgucca

SEQ ID NO: 2959333 - RNA, 17 nt, Mycobacterium avium subsp. paratuberculosis
ggcacacgaacaccggc

SEQ ID NO: 2959334 - RNA, 22 nt, Mycobacterium avium subsp. paratuberculosis
ggcacacgcggacagggcggcg

SEQ ID NO: 2959335 - RNA, 22 nt, Mycobacterium avium subsp. paratuberculosis
ggcacagcagcacguugucgcc

SEQ ID NO: 2959336 - RNA, 19 nt, Mycobacterium avium subsp. paratuberculosis
ggcacagcagggcaccgac

SEQ ID NO: 2959337 - RNA, 20 nt, Mycobacterium avium subsp. paratuberculosis
ggcacagcagggcaccgacg

SEQ ID NO: 2959338 - RNA, 23 nt, Mycobacterium avium subsp. paratuberculosis
ggcacagcagggcaccgacggcc

SEQ ID NO: 2959339 - RNA, 15 nt, Mycobacterium avium subsp. paratuberculosis
ggcacagccagcgcc

SEQ ID NO: 2959340 - RNA, 20 nt, Mycobacterium avium subsp. paratuberculosis
ggcacagccagcgcccggcg

SEQ ID NO: 2959341 - RNA, 21 nt, Mycobacterium avium subsp. paratuberculosis
ggcacagccagcgcccggcga

SEQ ID NO: 2959342 - RNA, 23 nt, Mycobacterium avium subsp. paratuberculosis
ggcacagccagcgcccggcgacc

SEQ ID NO: 2959343 - RNA, 22 nt, Mycobacterium avium subsp. paratuberculosis
ggcaccaacccgaucggcccgg

SEQ ID NO: 2959344 - RNA, 17 nt, Mycobacterium avium subsp. paratuberculosis
ggcaccaccacccccga

SEQ ID NO: 2959345 - RNA, 14 nt, Mycobacterium avium subsp. paratuberculosis
ggcaccaccaccga

SEQ ID NO: 2959346 - RNA, 22 nt, Mycobacterium avium subsp. paratuberculosis
ggcaccaccaccgacaccccga

SEQ ID NO: 2959347 - RNA, 14 nt, Mycobacterium avium subsp. paratuberculosis
ggcaccaccagcgu

SEQ ID NO: 2959348 - RNA, 17 nt, Mycobacterium avium subsp. paratuberculosis
ggcaccacccgcggccg

SEQ ID NO: 2959349 - RNA, 13 nt, Mycobacterium avium subsp. paratuberculosis
ggcaccacgccga

SEQ ID NO: 2959350 - RNA, 15 nt, Mycobacterium avium subsp. paratuberculosis
ggcaccacggcggca

SEQ ID NO: 2959351 - RNA, 17 nt, Mycobacterium avium subsp. paratuberculosis
ggcaccacguccaccag

SEQ ID NO: 2959352 - RNA, 18 nt, Mycobacterium avium subsp. paratuberculosis
ggcaccacguccaccagc

SEQ ID NO: 2959353 - RNA, 13 nt, Mycobacterium avium subsp. paratuberculosis
ggcaccagcaccg

SEQ ID NO: 2959354 - RNA, 13 nt, Mycobacterium avium subsp. paratuberculosis
ggcaccagcagcc

SEQ ID NO: 2959355 - RNA, 16 nt, Mycobacterium avium subsp. paratuberculosis
ggcaccagcagccagc

SEQ ID NO: 2959356 - RNA, 21 nt, Mycobacterium avium subsp. paratuberculosis
ggcaccagcagccagcccagc

SEQ ID NO: 2959357 - RNA, 21 nt, Mycobacterium avium subsp. paratuberculosis
ggcaccagcagccgcagcgcg

SEQ ID NO: 2959358 - RNA, 15 nt, Mycobacterium avium subsp. paratuberculosis
ggcaccagcagcgcg

SEQ ID NO: 2959359 - RNA, 18 nt, Mycobacterium avium subsp. paratuberculosis
ggcaccagcagcgcgacg

SEQ ID NO: 2959360 - RNA, 22 nt, Mycobacterium avium subsp. paratuberculosis
ggcaccagcagcgcgacgccga

SEQ ID NO: 2959361 - RNA, 13 nt, Mycobacterium avium subsp. paratuberculosis
ggcaccagcaggc

SEQ ID NO: 2959362 - RNA, 17 nt, Mycobacterium avium subsp. paratuberculosis
ggcaccagcccgccguc

SEQ ID NO: 2959363 - RNA, 22 nt, Mycobacterium avium subsp. paratuberculosis
ggcaccagcccgccgucggcau

SEQ ID NO: 2959364 - RNA, 13 nt, Mycobacterium avium subsp. paratuberculosis
ggcaccagcgaca

SEQ ID NO: 2959365 - RNA, 22 nt, Mycobacterium avium subsp. paratuberculosis
ggcaccagcgacagcacccgcu

SEQ ID NO: 2959366 - RNA, 13 nt, Mycobacterium avium subsp. paratuberculosis
ggcaccagcgcga

SEQ ID NO: 2959367 - RNA, 21 nt, Mycobacterium avium subsp. paratuberculosis
ggcaccagcggaucggcgguc

SEQ ID NO: 2959368 - RNA, 13 nt, Mycobacterium avium subsp. paratuberculosis
ggcaccagcggca

SEQ ID NO: 2959369 - RNA, 19 nt, Mycobacterium avium subsp. paratuberculosis
ggcaccagcggcaucgccg

SEQ ID NO: 2959370 - RNA, 18 nt, Mycobacterium avium subsp. paratuberculosis
ggcaccagguucacgucg

SEQ ID NO: 2959371 - RNA, 21 nt, Mycobacterium avium subsp. paratuberculosis
ggcaccaguaggucacccggu

SEQ ID NO: 2959372 - RNA, 14 nt, Mycobacterium avium subsp. paratuberculosis
ggcaccagucgcgc

SEQ ID NO: 2959373 - RNA, 19 nt, Mycobacterium avium subsp. paratuberculosis
ggcacccccaauugccggg

SEQ ID NO: 2959374 - RNA, 22 nt, Mycobacterium avium subsp. paratuberculosis
ggcacccccaauugccgggcca

SEQ ID NO: 2959375 - RNA, 21 nt, Mycobacterium avium subsp. paratuberculosis
ggcacccccgggguggugugc

SEQ ID NO: 2959376 - RNA, 22 nt, Mycobacterium avium subsp. paratuberculosis
ggcacccccgggguggugugca

SEQ ID NO: 2959377 - RNA, 14 nt, Mycobacterium avium subsp. paratuberculosis
ggcaccccgaucag

SEQ ID NO: 2959378 - RNA, 16 nt, Mycobacterium avium subsp. paratuberculosis
ggcaccccgcgccggg

SEQ ID NO: 2959379 - RNA, 21 nt, Mycobacterium avium subsp. paratuberculosis
ggcaccccgcgccgggcguug

SEQ ID NO: 2959380 - RNA, 13 nt, Mycobacterium avium subsp. paratuberculosis
ggcaccccgcggu

SEQ ID NO: 2959381 - RNA, 21 nt, Mycobacterium avium subsp. paratuberculosis
ggcaccccgcggucggcggcg

SEQ ID NO: 2959382 - RNA, 15 nt, Mycobacterium avium subsp. paratuberculosis
ggcaccccggucacc

SEQ ID NO: 2959383 - RNA, 17 nt, Mycobacterium avium subsp. paratuberculosis
ggcaccccggucaccgg

SEQ ID NO: 2959384 - RNA, 18 nt, Mycobacterium avium subsp. paratuberculosis
ggcaccccggucaccggu

SEQ ID NO: 2959385 - RNA, 16 nt, Mycobacterium avium subsp. paratuberculosis
ggcaccccugccgcca

SEQ ID NO: 2959386 - RNA, 21 nt, Mycobacterium avium subsp. paratuberculosis
ggcacccgaccgacgcccggc

SEQ ID NO: 2959387 - RNA, 20 nt, Mycobacterium avium subsp. paratuberculosis
ggcacccgacgucgacgcgg

SEQ ID NO: 2959388 - RNA, 22 nt, Mycobacterium avium subsp. paratuberculosis
ggcacccgcaacaccacgucgg

SEQ ID NO: 2959389 - RNA, 19 nt, Mycobacterium avium subsp. paratuberculosis
ggcacccgcagcuccagcg

SEQ ID NO: 2959390 - RNA, 13 nt, Mycobacterium avium subsp. paratuberculosis
ggcacccgccagc

SEQ ID NO: 2959391 - RNA, 16 nt, Mycobacterium avium subsp. paratuberculosis
ggcacgaucggcagcg

SEQ ID NO: 2959392 - RNA, 22 nt, Mycobacterium avium subsp. paratuberculosis
ggcacgaucggcagcgccaaca

SEQ ID NO: 2959393 - RNA, 19 nt, Mycobacterium avium subsp. paratuberculosis
ggcacgaucgucgccgcca

SEQ ID NO: 2959394 - RNA, 16 nt, Mycobacterium avium subsp. paratuberculosis
ggcacgaucucgacca

SEQ ID NO: 2959395 - RNA, 22 nt, Mycobacterium avium subsp. paratuberculosis
ggcacgaucucgaccaggccgu

SEQ ID NO: 2959396 - RNA, 22 nt, Mycobacterium avium subsp. paratuberculosis
ggcacgaugaacuccucgaucg

SEQ ID NO: 2959397 - RNA, 14 nt, Mycobacterium avium subsp. paratuberculosis
ggcacgauggcgcg

SEQ ID NO: 2959398 - RNA, 17 nt, Mycobacterium avium subsp. paratuberculosis
ggcacgauggcgcggcg

SEQ ID NO: 2959399 - RNA, 13 nt, Mycobacterium avium subsp. paratuberculosis
ggcacgcagcggc

SEQ ID NO: 2959400 - RNA, 20 nt, Mycobacterium avium subsp. paratuberculosis
ggcacgcagcggcgucacgc

SEQ ID NO: 2959401 - RNA, 23 nt, Mycobacterium avium subsp. paratuberculosis
ggcacgccacucgucgacguucg

SEQ ID NO: 2959402 - RNA, 24 nt, Mycobacterium avium subsp. paratuberculosis
ggcacgccacucgucgacguucga

SEQ ID NO: 2959403 - RNA, 21 nt, Mycobacterium avium subsp. paratuberculosis
ggcacgcccguucgagcgccg

SEQ ID NO: 2959404 - RNA, 15 nt, Mycobacterium avium subsp. paratuberculosis
ggcacgccgaccacc

SEQ ID NO: 2959405 - RNA, 13 nt, Mycobacterium avium subsp. paratuberculosis
ggcacgccgccgc

SEQ ID NO: 2959406 - RNA, 15 nt, Mycobacterium avium subsp. paratuberculosis
ggcacgccgcucguc

SEQ ID NO: 2959407 - RNA, 20 nt, Mycobacterium avium subsp. paratuberculosis
ggcacgccgcucgucgggca

SEQ ID NO: 2959408 - RNA, 14 nt, Mycobacterium avium subsp. paratuberculosis
ggcacgccggggcc

SEQ ID NO: 2959409 - RNA, 21 nt, Mycobacterium avium subsp. paratuberculosis
ggcacgcgagacgagccgccg

SEQ ID NO: 2959410 - RNA, 18 nt, Mycobacterium avium subsp. paratuberculosis
ggcacgcgcgcccggcac

SEQ ID NO: 2959411 - RNA, 23 nt, Mycobacterium avium subsp. paratuberculosis
ggcacgcgcgcccggcaccgcgg

SEQ ID NO: 2959412 - RNA, 14 nt, Mycobacterium avium subsp. paratuberculosis
ggcacgcugcgcca

SEQ ID NO: 2959413 - RNA, 16 nt, Mycobacterium avium subsp. paratuberculosis
ggcacgcugcgccagc

SEQ ID NO: 2959414 - RNA, 17 nt, Mycobacterium avium subsp. paratuberculosis
ggcacgcugcgccagcc

SEQ ID NO: 2959415 - RNA, 18 nt, Mycobacterium avium subsp. paratuberculosis
ggcacgcugcgccagccg

SEQ ID NO: 2959416 - RNA, 13 nt, Mycobacterium avium subsp. paratuberculosis
ggcacggcaccgc

SEQ ID NO: 2959417 - RNA, 13 nt, Mycobacterium avium subsp. paratuberculosis
ggcacggcccgcu

SEQ ID NO: 2959418 - RNA, 16 nt, Mycobacterium avium subsp. paratuberculosis
ggcacggcccgcucgg

SEQ ID NO: 2959419 - RNA, 16 nt, Mycobacterium avium subsp. paratuberculosis
ggcacggccggccggc

SEQ ID NO: 2959420 - RNA, 19 nt, Mycobacterium avium subsp. paratuberculosis
ggcacggccggccggccga

SEQ ID NO: 2959421 - RNA, 19 nt, Mycobacterium avium subsp. paratuberculosis
ggcacggcgaggucgggau

SEQ ID NO: 2959422 - RNA, 14 nt, Mycobacterium avium subsp. paratuberculosis
ggcacgggcccgcg

SEQ ID NO: 2959423 - RNA, 15 nt, Mycobacterium avium subsp. paratuberculosis
ggcacgggcccgcgg

SEQ ID NO: 2959424 - RNA, 22 nt, Mycobacterium avium subsp. paratuberculosis
ggcacgggcccgcgggaucagc

SEQ ID NO: 2959425 - RNA, 15 nt, Mycobacterium avium subsp. paratuberculosis
ggcacggucaggugg

SEQ ID NO: 2959426 - RNA, 22 nt, Mycobacterium avium subsp. paratuberculosis
ggcacggugcacacgccgaggc

SEQ ID NO: 2959427 - RNA, 16 nt, Mycobacterium avium subsp. paratuberculosis
ggcacggugcgggugc

SEQ ID NO: 2959428 - RNA, 13 nt, Mycobacterium avium subsp. paratuberculosis
ggcacggugggac

SEQ ID NO: 2959429 - RNA, 19 nt, Mycobacterium avium subsp. paratuberculosis
ggcacggugggacggcggg

SEQ ID NO: 2959430 - RNA, 20 nt, Mycobacterium avium subsp. paratuberculosis
ggcacggugggacggcgggu

SEQ ID NO: 2959431 - RNA, 16 nt, Mycobacterium avium subsp. paratuberculosis
ggcacggugucgauag

SEQ ID NO: 2959432 - RNA, 20 nt, Mycobacterium avium subsp. paratuberculosis
ggcacgguuggccggcccgc

SEQ ID NO: 2959433 - RNA, 22 nt, Mycobacterium avium subsp. paratuberculosis
ggcacgguuggccggcccgccc

SEQ ID NO: 2959434 - RNA, 12 nt, Mycobacterium avium subsp. paratuberculosis
ggcacguacgcg

SEQ ID NO: 2959435 - RNA, 13 nt, Mycobacterium avium subsp. paratuberculosis
ggcacguacgcgc

SEQ ID NO: 2959436 - RNA, 15 nt, Mycobacterium avium subsp. paratuberculosis
ggcacguacgcgcug

SEQ ID NO: 2959437 - RNA, 16 nt, Mycobacterium avium subsp. paratuberculosis
ggcacguacgcgcuga

SEQ ID NO: 2959438 - RNA, 15 nt, Mycobacterium avium subsp. paratuberculosis
ggcacguccagcccg

SEQ ID NO: 2959439 - RNA, 16 nt, Mycobacterium avium subsp. paratuberculosis
ggcacguccagcccgc

SEQ ID NO: 2959440 - RNA, 17 nt, Mycobacterium avium subsp. paratuberculosis
ggcacguccagcccgcg

SEQ ID NO: 2959441 - RNA, 22 nt, Mycobacterium avium subsp. paratuberculosis
ggcacguccccgugcagccggg

SEQ ID NO: 2959442 - RNA, 23 nt, Mycobacterium avium subsp. paratuberculosis
ggcacguccccgugcagccgggc

SEQ ID NO: 2959443 - RNA, 15 nt, Mycobacterium avium subsp. paratuberculosis
ggcacgucgacgccc

SEQ ID NO: 2959444 - RNA, 18 nt, Mycobacterium avium subsp. paratuberculosis
ggcacgucgacgcccugc

SEQ ID NO: 2959445 - RNA, 19 nt, Mycobacterium avium subsp. paratuberculosis
ggcacgucgagcuccucgg

SEQ ID NO: 2959446 - RNA, 19 nt, Mycobacterium avium subsp. paratuberculosis
ggcacgucgagggugaugu

SEQ ID NO: 2959447 - RNA, 21 nt, Mycobacterium avium subsp. paratuberculosis
ggcacgucgagggugaugucg

SEQ ID NO: 2959448 - RNA, 12 nt, Mycobacterium avium subsp. paratuberculosis
ggcacgucgcgc

SEQ ID NO: 2959449 - RNA, 12 nt, Mycobacterium avium subsp. paratuberculosis
ggcacgucggcc

SEQ ID NO: 2959450 - RNA, 14 nt, Mycobacterium avium subsp. paratuberculosis
ggcacgucggccac

SEQ ID NO: 2959451 - RNA, 16 nt, Mycobacterium avium subsp. paratuberculosis
ggcacgucggccacgc

SEQ ID NO: 2959452 - RNA, 19 nt, Mycobacterium avium subsp. paratuberculosis
ggcacgucggccacgccgg

SEQ ID NO: 2959453 - RNA, 16 nt, Mycobacterium avium subsp. paratuberculosis
ggcacgugcggguugg

SEQ ID NO: 2959454 - RNA, 20 nt, Mycobacterium avium subsp. paratuberculosis
ggcacguguccgacgccguc

SEQ ID NO: 2959455 - RNA, 19 nt, Mycobacterium avium subsp. paratuberculosis
ggcacguugacguagacga

SEQ ID NO: 2959456 - RNA, 16 nt, Mycobacterium avium subsp. paratuberculosis
ggcacguugcccagga

SEQ ID NO: 2959457 - RNA, 14 nt, Mycobacterium avium subsp. paratuberculosis
ggcacuaccgccuc

SEQ ID NO: 2959458 - RNA, 20 nt, Mycobacterium avium subsp. paratuberculosis
ggcacuaccgccucgccagc

SEQ ID NO: 2959459 - RNA, 21 nt, Mycobacterium avium subsp. paratuberculosis
ggcacuaccgccucgccagcc

SEQ ID NO: 2959460 - RNA, 20 nt, Mycobacterium avium subsp. paratuberculosis
ggcacucccuuguugccgag

SEQ ID NO: 2959461 - RNA, 19 nt, Mycobacterium avium subsp. paratuberculosis
ggcacucgaucagcaccgc

SEQ ID NO: 2959462 - RNA, 21 nt, Mycobacterium avium subsp. paratuberculosis
ggcacucgaucagcaccgcca

SEQ ID NO: 2959463 - RNA, 23 nt, Mycobacterium avium subsp. paratuberculosis
ggcacucgucguggcggugcucu

SEQ ID NO: 2959464 - RNA, 12 nt, Mycobacterium avium subsp. paratuberculosis
ggcacugcccgc

SEQ ID NO: 2959465 - RNA, 14 nt, Mycobacterium avium subsp. paratuberculosis
ggcacuggcgcugc

SEQ ID NO: 2959466 - RNA, 19 nt, Mycobacterium avium subsp. paratuberculosis
ggcacuuaacaccucgccu

SEQ ID NO: 2959467 - RNA, 20 nt, Mycobacterium avium subsp. paratuberculosis
ggcacuuaacaccucgccuc

SEQ ID NO: 2959468 - RNA, 21 nt, Mycobacterium avium subsp. paratuberculosis
ggcacuuaacaccucgccucc

SEQ ID NO: 2959469 - RNA, 22 nt, Mycobacterium avium subsp. paratuberculosis
ggcacuucgaucaucuccaccc

SEQ ID NO: 2959470 - RNA, 18 nt, Mycobacterium avium subsp. paratuberculosis
ggcacuucguccaucguc

SEQ ID NO: 2959471 - RNA, 20 nt, Mycobacterium avium subsp. paratuberculosis
ggcagaagcuccacgccgcc

SEQ ID NO: 2959472 - RNA, 21 nt, Mycobacterium avium subsp. paratuberculosis
ggcagaagcuccacgccgccg

SEQ ID NO: 2959473 - RNA, 22 nt, Mycobacterium avium subsp. paratuberculosis
ggcagaagcuccacgccgccgg

SEQ ID NO: 2959474 - RNA, 12 nt, Mycobacterium avium subsp. paratuberculosis
ggcagaccagga

SEQ ID NO: 2959475 - RNA, 23 nt, Mycobacterium avium subsp. paratuberculosis
ggcagccgcuccggcccgagcac

SEQ ID NO: 2959476 - RNA, 18 nt, Mycobacterium avium subsp. paratuberculosis
ggcagccgcuuggccggg

SEQ ID NO: 2959477 - RNA, 20 nt, Mycobacterium avium subsp. paratuberculosis
ggcagccgcuuggccgggcg

SEQ ID NO: 2959478 - RNA, 14 nt, Mycobacterium avium subsp. paratuberculosis
ggcagccggccacc

SEQ ID NO: 2959479 - RNA, 20 nt, Mycobacterium avium subsp. paratuberculosis
ggcagccggccggcaggucg

SEQ ID NO: 2959480 - RNA, 17 nt, Mycobacterium avium subsp. paratuberculosis
ggcagccggcgcgguga

SEQ ID NO: 2959481 - RNA, 21 nt, Mycobacterium avium subsp. paratuberculosis
ggcagccgggcgaucauccag

SEQ ID NO: 2959482 - RNA, 13 nt, Mycobacterium avium subsp. paratuberculosis
ggcagccggggug

SEQ ID NO: 2959483 - RNA, 18 nt, Mycobacterium avium subsp. paratuberculosis
ggcagccggggugcccgg

SEQ ID NO: 2959484 - RNA, 20 nt, Mycobacterium avium subsp. paratuberculosis
ggcagccggggugcccgggc

SEQ ID NO: 2959485 - RNA, 21 nt, Mycobacterium avium subsp. paratuberculosis
ggcagccgucccuguucgcgc

SEQ ID NO: 2959486 - RNA, 15 nt, Mycobacterium avium subsp. paratuberculosis
ggcagccgucgaugc

SEQ ID NO: 2959487 - RNA, 19 nt, Mycobacterium avium subsp. paratuberculosis
ggcagccgucgaugccggc

SEQ ID NO: 2959488 - RNA, 20 nt, Mycobacterium avium subsp. paratuberculosis
ggcagccgucgaugccggcg

SEQ ID NO: 2959489 - RNA, 18 nt, Mycobacterium avium subsp. paratuberculosis
ggcagccguuguccacga

SEQ ID NO: 2959490 - RNA, 23 nt, Mycobacterium avium subsp. paratuberculosis
ggcagccguuguccacgaucaau

SEQ ID NO: 2959491 - RNA, 18 nt, Mycobacterium avium subsp. paratuberculosis
ggcagcgaacugccggca

SEQ ID NO: 2959492 - RNA, 23 nt, Mycobacterium avium subsp. paratuberculosis
ggcagcgaaucggggucgaucac

SEQ ID NO: 2959493 - RNA, 16 nt, Mycobacterium avium subsp. paratuberculosis
ggcagcgacagcgcgu

SEQ ID NO: 2959494 - RNA, 21 nt, Mycobacterium avium subsp. paratuberculosis
ggcagcgacagcgcgucggcc

SEQ ID NO: 2959495 - RNA, 22 nt, Mycobacterium avium subsp. paratuberculosis
ggcagcgacagcgcgucggcca

SEQ ID NO: 2959496 - RNA, 22 nt, Mycobacterium avium subsp. paratuberculosis
ggcagcgacgcggugagcgcgc

SEQ ID NO: 2959497 - RNA, 18 nt, Mycobacterium avium subsp. paratuberculosis
ggcagcgacucgggcagg

SEQ ID NO: 2959498 - RNA, 17 nt, Mycobacterium avium subsp. paratuberculosis
ggcagcgagcacagcgg

SEQ ID NO: 2959499 - RNA, 18 nt, Mycobacterium avium subsp. paratuberculosis
ggcagcgagcacagcggc

SEQ ID NO: 2959500 - RNA, 21 nt, Mycobacterium avium subsp. paratuberculosis
ggcagcgagcacagcggcgga

SEQ ID NO: 2959501 - RNA, 16 nt, Mycobacterium avium subsp. paratuberculosis
ggcagcgagucgaagg

SEQ ID NO: 2959502 - RNA, 20 nt, Mycobacterium avium subsp. paratuberculosis
ggcagcgcacgaugugaugg

SEQ ID NO: 2959503 - RNA, 16 nt, Mycobacterium avium subsp. paratuberculosis
ggcagcgccaccagcu

SEQ ID NO: 2959504 - RNA, 16 nt, Mycobacterium avium subsp. paratuberculosis
ggcagcgccagcggga

SEQ ID NO: 2959505 - RNA, 18 nt, Mycobacterium avium subsp. paratuberculosis
ggcagcgccucccggacc

SEQ ID NO: 2959506 - RNA, 21 nt, Mycobacterium avium subsp. paratuberculosis
ggcagcgccucccggaccacc

SEQ ID NO: 2959507 - RNA, 15 nt, Mycobacterium avium subsp. paratuberculosis
ggcagcgccucgagc

SEQ ID NO: 2959508 - RNA, 13 nt, Mycobacterium avium subsp. paratuberculosis
ggcagcgccucgg

SEQ ID NO: 2959509 - RNA, 15 nt, Mycobacterium avium subsp. paratuberculosis
ggcagcgcgaccagc

SEQ ID NO: 2959510 - RNA, 21 nt, Mycobacterium avium subsp. paratuberculosis
ggcagcgcgaccagcccggcc

SEQ ID NO: 2959511 - RNA, 22 nt, Mycobacterium avium subsp. paratuberculosis
ggcagcgcgaccagcccggccg

SEQ ID NO: 2959512 - RNA, 23 nt, Mycobacterium avium subsp. paratuberculosis
ggcagcgcgaccagcccggccgc

SEQ ID NO: 2959513 - RNA, 14 nt, Mycobacterium avium subsp. paratuberculosis
ggcagcgcgauccg

SEQ ID NO: 2959514 - RNA, 18 nt, Mycobacterium avium subsp. paratuberculosis
ggcagcgcgauccgcgcg

SEQ ID NO: 2959515 - RNA, 22 nt, Mycobacterium avium subsp. paratuberculosis
ggcagcgcgauccgcgcgucgg

SEQ ID NO: 2959516 - RNA, 19 nt, Mycobacterium avium subsp. paratuberculosis
ggcagcgcgauccgggggg

SEQ ID NO: 2959517 - RNA, 16 nt, Mycobacterium avium subsp. paratuberculosis
ggcagcgcgcccucga

SEQ ID NO: 2959518 - RNA, 20 nt, Mycobacterium avium subsp. paratuberculosis
ggcagcgcgcccugaggccc

SEQ ID NO: 2959519 - RNA, 23 nt, Mycobacterium avium subsp. paratuberculosis
ggcagcgcgcccugaggcccggu

SEQ ID NO: 2959520 - RNA, 13 nt, Mycobacterium avium subsp. paratuberculosis
ggcagcgcggcca

SEQ ID NO: 2959521 - RNA, 16 nt, Mycobacterium avium subsp. paratuberculosis
ggcagcgcggccagca

SEQ ID NO: 2959522 - RNA, 13 nt, Mycobacterium avium subsp. paratuberculosis
ggcagcgcggcgu

SEQ ID NO: 2959523 - RNA, 16 nt, Mycobacterium avium subsp. paratuberculosis
ggcagcgcggcguuca

SEQ ID NO: 2959524 - RNA, 13 nt, Mycobacterium avium subsp. paratuberculosis
ggcagcgcguuga

SEQ ID NO: 2959525 - RNA, 22 nt, Mycobacterium avium subsp. paratuberculosis
ggcagcgcuccugcagcgcggc

SEQ ID NO: 2959526 - RNA, 23 nt, Mycobacterium avium subsp. paratuberculosis
ggcagcgcuccugcagcgcggcg

SEQ ID NO: 2959527 - RNA, 14 nt, Mycobacterium avium subsp. paratuberculosis
ggcagcgcucgucg

SEQ ID NO: 2959528 - RNA, 16 nt, Mycobacterium avium subsp. paratuberculosis
ggcagcgcucgucguc

SEQ ID NO: 2959529 - RNA, 21 nt, Mycobacterium avium subsp. paratuberculosis
ggcagcgcucgucgucggaga

SEQ ID NO: 2959530 - RNA, 20 nt, Mycobacterium avium subsp. paratuberculosis
ggcagcggacccggucggcc

SEQ ID NO: 2959531 - RNA, 23 nt, Mycobacterium avium subsp. paratuberculosis
ggcagcggacccggucggccgcg

SEQ ID NO: 2959532 - RNA, 13 nt, Mycobacterium avium subsp. paratuberculosis
ggcagcggccgca

SEQ ID NO: 2959533 - RNA, 20 nt, Mycobacterium avium subsp. paratuberculosis
ggcagcggcgucgucgucga

SEQ ID NO: 2959534 - RNA, 14 nt, Mycobacterium avium subsp. paratuberculosis
ggcagcggugccgc

SEQ ID NO: 2959535 - RNA, 16 nt, Mycobacterium avium subsp. paratuberculosis
ggcagcggugccgccc

SEQ ID NO: 2959536 - RNA, 18 nt, Mycobacterium avium subsp. paratuberculosis
ggcagcggugccgcccgg

SEQ ID NO: 2959537 - RNA, 19 nt, Mycobacterium avium subsp. paratuberculosis
ggcagcggugucaccgacg

SEQ ID NO: 2959538 - RNA, 22 nt, Mycobacterium avium subsp. paratuberculosis
ggcagcggugucaccgacgcca

SEQ ID NO: 2959539 - RNA, 15 nt, Mycobacterium avium subsp. paratuberculosis
ggcagcgucccgucg

SEQ ID NO: 2959540 - RNA, 15 nt, Mycobacterium avium subsp. paratuberculosis
ggcagcgucgccagc

SEQ ID NO: 2959541 - RNA, 16 nt, Mycobacterium avium subsp. paratuberculosis
ggcagcgucgccagcc

SEQ ID NO: 2959542 - RNA, 20 nt, Mycobacterium avium subsp. paratuberculosis
ggcagcgucgccagccgccg

SEQ ID NO: 2959543 - RNA, 19 nt, Mycobacterium avium subsp. paratuberculosis
ggcagcgucgggcucgccu

SEQ ID NO: 2959544 - RNA, 14 nt, Mycobacterium avium subsp. paratuberculosis
ggcagcucggcggg

SEQ ID NO: 2959545 - RNA, 15 nt, Mycobacterium avium subsp. paratuberculosis
ggcagcucggcgggc

SEQ ID NO: 2959546 - RNA, 19 nt, Mycobacterium avium subsp. paratuberculosis
ggcagcucgggcagcccgc

SEQ ID NO: 2959547 - RNA, 21 nt, Mycobacterium avium subsp. paratuberculosis
ggcagcucgggcagcccgccg

SEQ ID NO: 2959548 - RNA, 17 nt, Mycobacterium avium subsp. paratuberculosis
ggcagcucgguggccgg

SEQ ID NO: 2959549 - RNA, 13 nt, Mycobacterium avium subsp. paratuberculosis
ggcagcucgucga

SEQ ID NO: 2959550 - RNA, 14 nt, Mycobacterium avium subsp. paratuberculosis
ggcagcucgucgac

SEQ ID NO: 2959551 - RNA, 15 nt, Mycobacterium avium subsp. paratuberculosis
ggcagcucgucgacg

SEQ ID NO: 2959552 - RNA, 17 nt, Mycobacterium avium subsp. paratuberculosis
ggcagcucgucgacguc

SEQ ID NO: 2959553 - RNA, 16 nt, Mycobacterium avium subsp. paratuberculosis
ggcagcucgucggcgc

SEQ ID NO: 2959554 - RNA, 20 nt, Mycobacterium avium subsp. paratuberculosis
ggcagcucgucggcgcgcca

SEQ ID NO: 2959555 - RNA, 21 nt, Mycobacterium avium subsp. paratuberculosis
ggcagcucgucggcgcgccac

SEQ ID NO: 2959556 - RNA, 22 nt, Mycobacterium avium subsp. paratuberculosis
ggcagcugaagugcacucggcg

SEQ ID NO: 2959557 - RNA, 23 nt, Mycobacterium avium subsp. paratuberculosis
ggcagcugaagugcacucggcga

SEQ ID NO: 2959558 - RNA, 24 nt, Mycobacterium avium subsp. paratuberculosis
ggcagcugaagugcacucggcgau

SEQ ID NO: 2959559 - RNA, 13 nt, Mycobacterium avium subsp. paratuberculosis
ggcagugaucggc

SEQ ID NO: 2959560 - RNA, 15 nt, Mycobacterium avium subsp. paratuberculosis
ggcagugcacgacga

SEQ ID NO: 2959561 - RNA, 15 nt, Mycobacterium avium subsp. paratuberculosis
ggcagugcgcggcgu

SEQ ID NO: 2959562 - RNA, 14 nt, Mycobacterium avium subsp. paratuberculosis
ggcaguuccucgcc

SEQ ID NO: 2959563 - RNA, 15 nt, Mycobacterium avium subsp. paratuberculosis
ggcaguuccucgccg

SEQ ID NO: 2959564 - RNA, 17 nt, Mycobacterium avium subsp. paratuberculosis
ggcaguucgaugccggg

SEQ ID NO: 2959565 - RNA, 22 nt, Mycobacterium avium subsp. paratuberculosis
ggcauacugcuugccgucgacg

SEQ ID NO: 2959566 - RNA, 23 nt, Mycobacterium avium subsp. paratuberculosis
ggcauagagcuggugggccaucg

SEQ ID NO: 2959567 - RNA, 15 nt, Mycobacterium avium subsp. paratuberculosis
ggcauaggccagcac

SEQ ID NO: 2959568 - RNA, 15 nt, Mycobacterium avium subsp. paratuberculosis
ggcauaguccagcuc

SEQ ID NO: 2959569 - RNA, 19 nt, Mycobacterium avium subsp. paratuberculosis
ggcauaguccagcucgcga

SEQ ID NO: 2959570 - RNA, 23 nt, Mycobacterium avium subsp. paratuberculosis
ggcaucaucgcuacaccccaccg

SEQ ID NO: 2959571 - RNA, 18 nt, Mycobacterium avium subsp. paratuberculosis
ggcaucaucggcacgccg

SEQ ID NO: 2959572 - RNA, 13 nt, Mycobacterium avium subsp. paratuberculosis
ggcauccacccgu

SEQ ID NO: 2959573 - RNA, 16 nt, Mycobacterium avium subsp. paratuberculosis
ggcauccaggaucgcc

SEQ ID NO: 2959574 - RNA, 14 nt, Mycobacterium avium subsp. paratuberculosis
ggcaucccacccgg

SEQ ID NO: 2959575 - RNA, 12 nt, Mycobacterium avium subsp. paratuberculosis
ggcauccccagc

SEQ ID NO: 2959576 - RNA, 15 nt, Mycobacterium avium subsp. paratuberculosis
ggcauccccagcugg

SEQ ID NO: 2959577 - RNA, 22 nt, Mycobacterium avium subsp. paratuberculosis
ggcauccccagcugggccgcca

SEQ ID NO: 2959578 - RNA, 15 nt, Mycobacterium avium subsp. paratuberculosis
ggcaucccgccgaac

SEQ ID NO: 2959579 - RNA, 13 nt, Mycobacterium avium subsp. paratuberculosis
ggcaucccgcgcc

SEQ ID NO: 2959580 - RNA, 16 nt, Mycobacterium avium subsp. paratuberculosis
ggcaucccgcgccugc

SEQ ID NO: 2959581 - RNA, 23 nt, Mycobacterium avium subsp. paratuberculosis
ggcaucccgcgccugccuggcca

SEQ ID NO: 2959582 - RNA, 18 nt, Mycobacterium avium subsp. paratuberculosis
ggcaucccgcuucuggcg

SEQ ID NO: 2959583 - RNA, 16 nt, Mycobacterium avium subsp. paratuberculosis
ggcaucccggagaaca

SEQ ID NO: 2959584 - RNA, 19 nt, Mycobacterium avium subsp. paratuberculosis
ggcaucccugacacgaccg

SEQ ID NO: 2959585 - RNA, 21 nt, Mycobacterium avium subsp. paratuberculosis
ggcaucccugacacgaccgcc

SEQ ID NO: 2959586 - RNA, 13 nt, Mycobacterium avium subsp. paratuberculosis
ggcauccgcccgu

SEQ ID NO: 2959587 - RNA, 16 nt, Mycobacterium avium subsp. paratuberculosis
ggcauccgcucgccgc

SEQ ID NO: 2959588 - RNA, 19 nt, Mycobacterium avium subsp. paratuberculosis
ggcauccggcucagaaggc

SEQ ID NO: 2959589 - RNA, 11 nt, Mycobacterium avium subsp. paratuberculosis
ggcauccggga

SEQ ID NO: 2959590 - RNA, 18 nt, Mycobacterium avium subsp. paratuberculosis
ggcauccgggaggccagc

SEQ ID NO: 2959591 - RNA, 19 nt, Mycobacterium avium subsp. paratuberculosis
ggcauccgggaggccagca

SEQ ID NO: 2959592 - RNA, 21 nt, Mycobacterium avium subsp. paratuberculosis
ggcauccgggaggccagcacc

SEQ ID NO: 2959593 - RNA, 22 nt, Mycobacterium avium subsp. paratuberculosis
ggcauccgggaggccagcaccu

SEQ ID NO: 2959594 - RNA, 16 nt, Mycobacterium avium subsp. paratuberculosis
ggcauccgggccgccg

SEQ ID NO: 2959595 - RNA, 19 nt, Mycobacterium avium subsp. paratuberculosis
ggcauccgggccgccgcgg

SEQ ID NO: 2959596 - RNA, 14 nt, Mycobacterium avium subsp. paratuberculosis
ggcauccgucggcc

SEQ ID NO: 2959597 - RNA, 20 nt, Mycobacterium avium subsp. paratuberculosis
ggcauccucggcgcgucggu

SEQ ID NO: 2959598 - RNA, 17 nt, Mycobacterium avium subsp. paratuberculosis
ggcauccugcuggccgg

SEQ ID NO: 2959599 - RNA, 18 nt, Mycobacterium avium subsp. paratuberculosis
ggcauccugcuggccggg

SEQ ID NO: 2959600 - RNA, 19 nt, Mycobacterium avium subsp. paratuberculosis
ggcauccugcuggccgggc

SEQ ID NO: 2959601 - RNA, 20 nt, Mycobacterium avium subsp. paratuberculosis
ggcaucgacaugcccggcga

SEQ ID NO: 2959602 - RNA, 20 nt, Mycobacterium avium subsp. paratuberculosis
ggcaucgauggcgggcgcgc

SEQ ID NO: 2959603 - RNA, 15 nt, Mycobacterium avium subsp. paratuberculosis
ggcaucgcagcgcgc

SEQ ID NO: 2959604 - RNA, 20 nt, Mycobacterium avium subsp. paratuberculosis
ggcaucgcagcgcgcggcgc

SEQ ID NO: 2959605 - RNA, 11 nt, Mycobacterium avium subsp. paratuberculosis
ggcaucgccaa

SEQ ID NO: 2959606 - RNA, 20 nt, Mycobacterium avium subsp. paratuberculosis
ggcaucgccgucaugguguc

SEQ ID NO: 2959607 - RNA, 14 nt, Mycobacterium avium subsp. paratuberculosis
ggcaucgcgcgcgg

SEQ ID NO: 2959608 - RNA, 15 nt, Mycobacterium avium subsp. paratuberculosis
ggcaucgcgcgcggc

SEQ ID NO: 2959609 - RNA, 19 nt, Mycobacterium avium subsp. paratuberculosis
ggcaucgcgcgcggcggcc

SEQ ID NO: 2959610 - RNA, 22 nt, Mycobacterium avium subsp. paratuberculosis
ggcaucgcgcgcggcggccacc

SEQ ID NO: 2959611 - RNA, 14 nt, Mycobacterium avium subsp. paratuberculosis
ggcaucgcgugccg

SEQ ID NO: 2959612 - RNA, 15 nt, Mycobacterium avium subsp. paratuberculosis
ggcaucgcgugccga

SEQ ID NO: 2959613 - RNA, 20 nt, Mycobacterium avium subsp. paratuberculosis
ggcaucgcgugccgaccagc

SEQ ID NO: 2959614 - RNA, 23 nt, Mycobacterium avium subsp. paratuberculosis
ggcaucgcgugccgaccagccga

SEQ ID NO: 2959615 - RNA, 20 nt, Mycobacterium avium subsp. paratuberculosis
ggcaucgcugguggccgacg

SEQ ID NO: 2959616 - RNA, 22 nt, Mycobacterium avium subsp. paratuberculosis
ggcaucgcugguggccgacgug

SEQ ID NO: 2959617 - RNA, 20 nt, Mycobacterium avium subsp. paratuberculosis
ggcaucggcgcccucgccga

SEQ ID NO: 2959618 - RNA, 14 nt, Mycobacterium avium subsp. paratuberculosis
ggcaucggcugguc

SEQ ID NO: 2959619 - RNA, 13 nt, Mycobacterium avium subsp. paratuberculosis
ggcaucgggucgu

SEQ ID NO: 2959620 - RNA, 21 nt, Mycobacterium avium subsp. paratuberculosis
ggcaucgggucguagagcgcg

SEQ ID NO: 2959621 - RNA, 13 nt, Mycobacterium avium subsp. paratuberculosis
ggcaucgguggca

SEQ ID NO: 2959622 - RNA, 18 nt, Mycobacterium avium subsp. paratuberculosis
ggcaucgguggcaccccg

SEQ ID NO: 2959623 - RNA, 19 nt, Mycobacterium avium subsp. paratuberculosis
ggcaucgguggcaccccgc

SEQ ID NO: 2959624 - RNA, 20 nt, Mycobacterium avium subsp. paratuberculosis
ggcaucgguggcaccccgcg

SEQ ID NO: 2959625 - RNA, 13 nt, Mycobacterium avium subsp. paratuberculosis
ggcaucgucggcg

SEQ ID NO: 2959626 - RNA, 18 nt, Mycobacterium avium subsp. paratuberculosis
ggcaucgucggcgccggc

SEQ ID NO: 2959627 - RNA, 20 nt, Mycobacterium avium subsp. paratuberculosis
ggcaucgucggcgccggcgc

SEQ ID NO: 2959628 - RNA, 15 nt, Mycobacterium avium subsp. paratuberculosis
ggcaucucccgcgcg

SEQ ID NO: 2959629 - RNA, 18 nt, Mycobacterium avium subsp. paratuberculosis
ggcaugaaccaggccgcg

SEQ ID NO: 2959630 - RNA, 19 nt, Mycobacterium avium subsp. paratuberculosis
ggcaugaaccaggccgcgc

SEQ ID NO: 2959631 - RNA, 22 nt, Mycobacterium avium subsp. paratuberculosis
ggcaugaaccaggccgcgcugg

SEQ ID NO: 2959632 - RNA, 23 nt, Mycobacterium avium subsp. paratuberculosis
ggcaugaaccaggccgcgcuggc

SEQ ID NO: 2959633 - RNA, 16 nt, Mycobacterium avium subsp. paratuberculosis
ggcaugccgcccgggc

SEQ ID NO: 2959634 - RNA, 20 nt, Mycobacterium avium subsp. paratuberculosis
ggcaugccggaacaccucga

SEQ ID NO: 2959635 - RNA, 17 nt, Mycobacterium avium subsp. paratuberculosis
ggcaugccggccggcac

SEQ ID NO: 2959636 - RNA, 15 nt, Mycobacterium avium subsp. paratuberculosis
ggcaugccgggccag

SEQ ID NO: 2959637 - RNA, 16 nt, Mycobacterium avium subsp. paratuberculosis
ggcaugccgggccagc

SEQ ID NO: 2959638 - RNA, 13 nt, Mycobacterium avium subsp. paratuberculosis
ggcaugccgucgg

SEQ ID NO: 2959639 - RNA, 21 nt, Mycobacterium avium subsp. paratuberculosis
ggcaugccgucggcgcccggc

SEQ ID NO: 2959640 - RNA, 19 nt, Mycobacterium avium subsp. paratuberculosis
ggcauggacacgcccuggu

SEQ ID NO: 2959641 - RNA, 24 nt, Mycobacterium avium subsp. paratuberculosis
ggcauggcgaacacgucggccagc

SEQ ID NO: 2959642 - RNA, 22 nt, Mycobacterium avium subsp. paratuberculosis
ggcauggcgaugaccagcgcga

SEQ ID NO: 2959643 - RNA, 20 nt, Mycobacterium avium subsp. paratuberculosis
ggccaccaggucgcacacca

SEQ ID NO: 2959644 - RNA, 22 nt, Mycobacterium avium subsp. paratuberculosis
ggccaccaggucgcacaccagc

SEQ ID NO: 2959645 - RNA, 23 nt, Mycobacterium avium subsp. paratuberculosis
ggccaccaggucgcacaccagca

SEQ ID NO: 2959646 - RNA, 21 nt, Mycobacterium avium subsp. paratuberculosis
ggccaccaucaggccggccug

SEQ ID NO: 2959647 - RNA, 19 nt, Mycobacterium avium subsp. paratuberculosis
ggccaccaucuccgcggcg

SEQ ID NO: 2959648 - RNA, 20 nt, Mycobacterium avium subsp. paratuberculosis
ggccaccaucuccgcggcgc

SEQ ID NO: 2959649 - RNA, 15 nt, Mycobacterium avium subsp. paratuberculosis
ggccaccaugccggc

SEQ ID NO: 2959650 - RNA, 19 nt, Mycobacterium avium subsp. paratuberculosis
ggccaccaugccggcgucc

SEQ ID NO: 2959651 - RNA, 16 nt, Mycobacterium avium subsp. paratuberculosis
ggccaccaugggcggg

SEQ ID NO: 2959652 - RNA, 16 nt, Mycobacterium avium subsp. paratuberculosis
ggccaccaugucggcg

SEQ ID NO: 2959653 - RNA, 17 nt, Mycobacterium avium subsp. paratuberculosis
ggccaccaugucggcgu

SEQ ID NO: 2959654 - RNA, 22 nt, Mycobacterium avium subsp. paratuberculosis
ggccaccaugucggcgucgccg

SEQ ID NO: 2959655 - RNA, 23 nt, Mycobacterium avium subsp. paratuberculosis
ggccaccaugucggcgucgccga

SEQ ID NO: 2959656 - RNA, 22 nt, Mycobacterium avium subsp. paratuberculosis
ggccaccccgcagaacaccagc

SEQ ID NO: 2959657 - RNA, 23 nt, Mycobacterium avium subsp. paratuberculosis
ggccaccccgcagaacaccagcg

SEQ ID NO: 2959658 - RNA, 14 nt, Mycobacterium avium subsp. paratuberculosis
ggccaccccgguga

SEQ ID NO: 2959659 - RNA, 18 nt, Mycobacterium avium subsp. paratuberculosis
ggccacccgggcgccggc

SEQ ID NO: 2959660 - RNA, 19 nt, Mycobacterium avium subsp. paratuberculosis
ggccacccgggcgccggcg

SEQ ID NO: 2959661 - RNA, 21 nt, Mycobacterium avium subsp. paratuberculosis
ggccacccgggcgccggcgau

SEQ ID NO: 2959662 - RNA, 14 nt, Mycobacterium avium subsp. paratuberculosis
ggccacccucgccg

SEQ ID NO: 2959663 - RNA, 15 nt, Mycobacterium avium subsp. paratuberculosis
ggccacccucgccgc

SEQ ID NO: 2959664 - RNA, 16 nt, Mycobacterium avium subsp. paratuberculosis
ggccacccucgccgcc

SEQ ID NO: 2959665 - RNA, 21 nt, Mycobacterium avium subsp. paratuberculosis
ggccacccucgccgccgccga

SEQ ID NO: 2959666 - RNA, 15 nt, Mycobacterium avium subsp. paratuberculosis
ggccaccgaagccga

SEQ ID NO: 2959667 - RNA, 14 nt, Mycobacterium avium subsp. paratuberculosis
ggccaccgacugcg

SEQ ID NO: 2959668 - RNA, 19 nt, Mycobacterium avium subsp. paratuberculosis
ggccaccgaugcccgacac

SEQ ID NO: 2959669 - RNA, 17 nt, Mycobacterium avium subsp. paratuberculosis
ggccaccgcaucgccga

SEQ ID NO: 2959670 - RNA, 17 nt, Mycobacterium avium subsp. paratuberculosis
ggccaccgccccagccg

SEQ ID NO: 2959671 - RNA, 16 nt, Mycobacterium avium subsp. paratuberculosis
ggccaccgccgccagc

SEQ ID NO: 2959672 - RNA, 17 nt, Mycobacterium avium subsp. paratuberculosis
ggccaccgccgccagca

SEQ ID NO: 2959673 - RNA, 13 nt, Mycobacterium avium subsp. paratuberculosis
ggccaccgccugc

SEQ ID NO: 2959674 - RNA, 16 nt, Mycobacterium avium subsp. paratuberculosis
ggccaccgccugcgcg

SEQ ID NO: 2959675 - RNA, 22 nt, Mycobacterium avium subsp. paratuberculosis
ggccaccgccugcgcgaucgcc

SEQ ID NO: 2959676 - RNA, 17 nt, Mycobacterium avium subsp. paratuberculosis
ggccaccgcgacgccca

SEQ ID NO: 2959677 - RNA, 19 nt, Mycobacterium avium subsp. paratuberculosis
ggccaccgcgacgcugccg

SEQ ID NO: 2959678 - RNA, 23 nt, Mycobacterium avium subsp. paratuberculosis
ggccaccgcgacgcugccggggc

SEQ ID NO: 2959679 - RNA, 18 nt, Mycobacterium avium subsp. paratuberculosis
ggccaccgcgaucucgau

SEQ ID NO: 2959680 - RNA, 12 nt, Mycobacterium avium subsp. paratuberculosis
ggccaccgcgcc

SEQ ID NO: 2959681 - RNA, 20 nt, Mycobacterium avium subsp. paratuberculosis
ggccaccgcgccccggcgca

SEQ ID NO: 2959682 - RNA, 18 nt, Mycobacterium avium subsp. paratuberculosis
ggccaccgcgccgucuuc

SEQ ID NO: 2959683 - RNA, 13 nt, Mycobacterium avium subsp. paratuberculosis
ggccaccgcgcgc

SEQ ID NO: 2959684 - RNA, 16 nt, Mycobacterium avium subsp. paratuberculosis
ggccaccgcgcgcugc

SEQ ID NO: 2959685 - RNA, 14 nt, Mycobacterium avium subsp. paratuberculosis
ggccaccgcgcggc

SEQ ID NO: 2959686 - RNA, 18 nt, Mycobacterium avium subsp. paratuberculosis
ggccaccgcgcggcgguc

SEQ ID NO: 2959687 - RNA, 23 nt, Mycobacterium avium subsp. paratuberculosis
ggccaccgcgcggcgguccagcg

SEQ ID NO: 2959688 - RNA, 15 nt, Mycobacterium avium subsp. paratuberculosis
ggccaccgcgcggug

SEQ ID NO: 2959689 - RNA, 20 nt, Mycobacterium avium subsp. paratuberculosis
ggccaccgcgcggugcacca

SEQ ID NO: 2959690 - RNA, 17 nt, Mycobacterium avium subsp. paratuberculosis
ggccaccgcggccagcu

SEQ ID NO: 2959691 - RNA, 15 nt, Mycobacterium avium subsp. paratuberculosis
ggccaccgcggcguu

SEQ ID NO: 2959692 - RNA, 16 nt, Mycobacterium avium subsp. paratuberculosis
ggccaccgcggucgac

SEQ ID NO: 2959693 - RNA, 12 nt, Mycobacterium avium subsp. paratuberculosis
ggccaccgcguc

SEQ ID NO: 2959694 - RNA, 17 nt, Mycobacterium avium subsp. paratuberculosis
ggccaccgcguccgcgg

SEQ ID NO: 2959695 - RNA, 17 nt, Mycobacterium avium subsp. paratuberculosis
ggccaccgcgucgcugc

SEQ ID NO: 2959696 - RNA, 22 nt, Mycobacterium avium subsp. paratuberculosis
ggccaccgcgucgcugcccaga

SEQ ID NO: 2959697 - RNA, 14 nt, Mycobacterium avium subsp. paratuberculosis
ggccaccggcgcca

SEQ ID NO: 2959698 - RNA, 14 nt, Mycobacterium avium subsp. paratuberculosis
ggccaccggcgcga

SEQ ID NO: 2959699 - RNA, 18 nt, Mycobacterium avium subsp. paratuberculosis
ggccaccggcgcgacggc

SEQ ID NO: 2959700 - RNA, 19 nt, Mycobacterium avium subsp. paratuberculosis
ggccaccggcgcgacggcg

SEQ ID NO: 2959701 - RNA, 13 nt, Mycobacterium avium subsp. paratuberculosis
ggccaccggcucc

SEQ ID NO: 2959702 - RNA, 17 nt, Mycobacterium avium subsp. paratuberculosis
ggccaccgggaccgucg

SEQ ID NO: 2959703 - RNA, 13 nt, Mycobacterium avium subsp. paratuberculosis
ggccaccgggccg

SEQ ID NO: 2959704 - RNA, 13 nt, Mycobacterium avium subsp. paratuberculosis
ggccaccgggucg

SEQ ID NO: 2959705 - RNA, 16 nt, Mycobacterium avium subsp. paratuberculosis
ggccaccgggucgcca

SEQ ID NO: 2959706 - RNA, 23 nt, Mycobacterium avium subsp. paratuberculosis
ggccaccgucagcgucagcacgu

SEQ ID NO: 2959707 - RNA, 14 nt, Mycobacterium avium subsp. paratuberculosis
ggccaccgucaggg

SEQ ID NO: 2959708 - RNA, 20 nt, Mycobacterium avium subsp. paratuberculosis
ggccaccgucaggguggugc

SEQ ID NO: 2959709 - RNA, 23 nt, Mycobacterium avium subsp. paratuberculosis
ggccaccgucuucggggccgccg

SEQ ID NO: 2959710 - RNA, 15 nt, Mycobacterium avium subsp. paratuberculosis
ggccaccucgacggc

SEQ ID NO: 2959711 - RNA, 16 nt, Mycobacterium avium subsp. paratuberculosis
ggccaccucgacggcg

SEQ ID NO: 2959712 - RNA, 13 nt, Mycobacterium avium subsp. paratuberculosis
ggccaccucgccg

SEQ ID NO: 2959713 - RNA, 14 nt, Mycobacterium avium subsp. paratuberculosis
ggccaccucgccgc

SEQ ID NO: 2959714 - RNA, 18 nt, Mycobacterium avium subsp. paratuberculosis
ggccaccucgccgcaggc

SEQ ID NO: 2959715 - RNA, 20 nt, Mycobacterium avium subsp. paratuberculosis
ggccaccucgccgcaggcgu

SEQ ID NO: 2959716 - RNA, 14 nt, Mycobacterium avium subsp. paratuberculosis
ggccaccucggcgg

SEQ ID NO: 2959717 - RNA, 15 nt, Mycobacterium avium subsp. paratuberculosis
ggccaccucggcggc

SEQ ID NO: 2959718 - RNA, 18 nt, Mycobacterium avium subsp. paratuberculosis
ggccaccucggcggcacc

SEQ ID NO: 2959719 - RNA, 19 nt, Mycobacterium avium subsp. paratuberculosis
ggccaccucggcggcaccg

SEQ ID NO: 2959720 - RNA, 12 nt, Mycobacterium avium subsp. paratuberculosis
ggccaccucguc

SEQ ID NO: 2959721 - RNA, 14 nt, Mycobacterium avium subsp. paratuberculosis
ggccaccucguccc

SEQ ID NO: 2959722 - RNA, 15 nt, Mycobacterium avium subsp. paratuberculosis
ggccaccucguccca

SEQ ID NO: 2959723 - RNA, 17 nt, Mycobacterium avium subsp. paratuberculosis
ggccaccucgucccagc

SEQ ID NO: 2959724 - RNA, 20 nt, Mycobacterium avium subsp. paratuberculosis
ggccaccucgucccagcgca

SEQ ID NO: 2959725 - RNA, 14 nt, Mycobacterium avium subsp. paratuberculosis
ggccaccucgucgg

SEQ ID NO: 2959726 - RNA, 20 nt, Mycobacterium avium subsp. paratuberculosis
ggccaccucgucggcgguca

SEQ ID NO: 2959727 - RNA, 15 nt, Mycobacterium avium subsp. paratuberculosis
ggccaccuggccggu

SEQ ID NO: 2959728 - RNA, 23 nt, Mycobacterium avium subsp. paratuberculosis
ggccagcaccagcagccggucga

SEQ ID NO: 2959729 - RNA, 22 nt, Mycobacterium avium subsp. paratuberculosis
ggccagcaccagcccgaugccg

SEQ ID NO: 2959730 - RNA, 14 nt, Mycobacterium avium subsp. paratuberculosis
ggccagcaccagcg

SEQ ID NO: 2959731 - RNA, 16 nt, Mycobacterium avium subsp. paratuberculosis
ggccagcaccagcgcg

SEQ ID NO: 2959732 - RNA, 19 nt, Mycobacterium avium subsp. paratuberculosis
ggccagcaccagcgcgcgg

SEQ ID NO: 2959733 - RNA, 20 nt, Mycobacterium avium subsp. paratuberculosis
ggccagcaccagcgcgcggg

SEQ ID NO: 2959734 - RNA, 22 nt, Mycobacterium avium subsp. paratuberculosis
ggccagcaccagcgcgcgggug

SEQ ID NO: 2959735 - RNA, 17 nt, Mycobacterium avium subsp. paratuberculosis
ggccagcaccaggaagg

SEQ ID NO: 2959736 - RNA, 19 nt, Mycobacterium avium subsp. paratuberculosis
ggccagcaccaguucgcgu

SEQ ID NO: 2959737 - RNA, 16 nt, Mycobacterium avium subsp. paratuberculosis
ggccagcaccauccag

SEQ ID NO: 2959738 - RNA, 19 nt, Mycobacterium avium subsp. paratuberculosis
ggccagcaccaugaucagg

SEQ ID NO: 2959739 - RNA, 22 nt, Mycobacterium avium subsp. paratuberculosis
ggccagcaccaugaucaggccc

SEQ ID NO: 2959740 - RNA, 11 nt, Mycobacterium avium subsp. paratuberculosis
ggccagcaccc

SEQ ID NO: 2959741 - RNA, 23 nt, Mycobacterium avium subsp. paratuberculosis
ggccagcacccgcucgcgggccc

SEQ ID NO: 2959742 - RNA, 15 nt, Mycobacterium avium subsp. paratuberculosis
ggccagcacccgcug

SEQ ID NO: 2959743 - RNA, 22 nt, Mycobacterium avium subsp. paratuberculosis
ggccagcacccgcugauccagc

SEQ ID NO: 2959744 - RNA, 20 nt, Mycobacterium avium subsp. paratuberculosis
ggccagcacccggucgguga

SEQ ID NO: 2959745 - RNA, 15 nt, Mycobacterium avium subsp. paratuberculosis
ggccagcaccgccag

SEQ ID NO: 2959746 - RNA, 19 nt, Mycobacterium avium subsp. paratuberculosis
ggccagcaccgccagcgcc

SEQ ID NO: 2959747 - RNA, 23 nt, Mycobacterium avium subsp. paratuberculosis
ggccagcaccgccagcgccggca

SEQ ID NO: 2959748 - RNA, 13 nt, Mycobacterium avium subsp. paratuberculosis
ggccagcaccgcg

SEQ ID NO: 2959749 - RNA, 17 nt, Mycobacterium avium subsp. paratuberculosis
ggccagcaccgcggccg

SEQ ID NO: 2959750 - RNA, 20 nt, Mycobacterium avium subsp. paratuberculosis
ggccagcaccgcggccgucg

SEQ ID NO: 2959751 - RNA, 22 nt, Mycobacterium avium subsp. paratuberculosis
ggccagcaccgcggcgaucgcc

SEQ ID NO: 2959752 - RNA, 15 nt, Mycobacterium avium subsp. paratuberculosis
ggccagcaccgcggu

SEQ ID NO: 2959753 - RNA, 21 nt, Mycobacterium avium subsp. paratuberculosis
ggccagcaccgucagccaggu

SEQ ID NO: 2959754 - RNA, 23 nt, Mycobacterium avium subsp. paratuberculosis
ggccagcaccuggcgcaccgccg

SEQ ID NO: 2959755 - RNA, 18 nt, Mycobacterium avium subsp. paratuberculosis
ggccagcaccuucagcgg

SEQ ID NO: 2959756 - RNA, 20 nt, Mycobacterium avium subsp. paratuberculosis
ggccagcacgaacaccacgu

SEQ ID NO: 2959757 - RNA, 21 nt, Mycobacterium avium subsp. paratuberculosis
ggccagcacgaccccgcccac

SEQ ID NO: 2959758 - RNA, 17 nt, Mycobacterium avium subsp. paratuberculosis
ggccagcacgcaggcgu

SEQ ID NO: 2959759 - RNA, 19 nt, Mycobacterium avium subsp. paratuberculosis
ggccagcacgcaggcgugg

SEQ ID NO: 2959760 - RNA, 23 nt, Mycobacterium avium subsp. paratuberculosis
ggccagcacgcaggcguggccca

SEQ ID NO: 2959761 - RNA, 16 nt, Mycobacterium avium subsp. paratuberculosis
ggccagcacgcccccg

SEQ ID NO: 2959762 - RNA, 17 nt, Mycobacterium avium subsp. paratuberculosis
ggccagcacgcccccgc

SEQ ID NO: 2959763 - RNA, 15 nt, Mycobacterium avium subsp. paratuberculosis
ggccagcacgccggu

SEQ ID NO: 2959764 - RNA, 16 nt, Mycobacterium avium subsp. paratuberculosis
ggccagcacgccgguc

SEQ ID NO: 2959765 - RNA, 19 nt, Mycobacterium avium subsp. paratuberculosis
ggccagcacgccggucagc

SEQ ID NO: 2959766 - RNA, 20 nt, Mycobacterium avium subsp. paratuberculosis
ggccagcacgccggucagca

SEQ ID NO: 2959767 - RNA, 15 nt, Mycobacterium avium subsp. paratuberculosis
ggccagcacgccguc

SEQ ID NO: 2959768 - RNA, 13 nt, Mycobacterium avium subsp. paratuberculosis
ggccagcacgccu

SEQ ID NO: 2959769 - RNA, 14 nt, Mycobacterium avium subsp. paratuberculosis
ggccagcacgccuu

SEQ ID NO: 2959770 - RNA, 21 nt, Mycobacterium avium subsp. paratuberculosis
ggccagcacgccuuccacgac

SEQ ID NO: 2959771 - RNA, 22 nt, Mycobacterium avium subsp. paratuberculosis
ggccagcacgcugcggaugucg

SEQ ID NO: 2959772 - RNA, 19 nt, Mycobacterium avium subsp. paratuberculosis
ggccagcacggccagccag

SEQ ID NO: 2959773 - RNA, 13 nt, Mycobacterium avium subsp. paratuberculosis
ggccagcacggcg

SEQ ID NO: 2959774 - RNA, 19 nt, Mycobacterium avium subsp. paratuberculosis
ggccagcacggcggcgugc

SEQ ID NO: 2959775 - RNA, 16 nt, Mycobacterium avium subsp. paratuberculosis
ggccagcacggucagc

SEQ ID NO: 2959776 - RNA, 20 nt, Mycobacterium avium subsp. paratuberculosis
ggccagcagauacuccucgc

SEQ ID NO: 2959777 - RNA, 21 nt, Mycobacterium avium subsp. paratuberculosis
ggccagcagauacuccucgcg

SEQ ID NO: 2959778 - RNA, 20 nt, Mycobacterium avium subsp. paratuberculosis
ggccagcagcaccagggcgu

SEQ ID NO: 2959779 - RNA, 16 nt, Mycobacterium avium subsp. paratuberculosis
ggccagcagcaccgcg

SEQ ID NO: 2959780 - RNA, 23 nt, Mycobacterium avium subsp. paratuberculosis
ggccagcagcagcaggucgucga

SEQ ID NO: 2959781 - RNA, 17 nt, Mycobacterium avium subsp. paratuberculosis
ggccagcagcagcccgc

SEQ ID NO: 2959782 - RNA, 19 nt, Mycobacterium avium subsp. paratuberculosis
ggccagcagcagcccgccg

SEQ ID NO: 2959783 - RNA, 13 nt, Mycobacterium avium subsp. paratuberculosis
ggccagcagcagg

SEQ ID NO: 2959784 - RNA, 12 nt, Mycobacterium avium subsp. paratuberculosis
ggccagcagcca

SEQ ID NO: 2959785 - RNA, 17 nt, Mycobacterium avium subsp. paratuberculosis
ggccagcagccagcugg

SEQ ID NO: 2959786 - RNA, 20 nt, Mycobacterium avium subsp. paratuberculosis
ggccagcagccagcugguga

SEQ ID NO: 2959787 - RNA, 22 nt, Mycobacterium avium subsp. paratuberculosis
ggccagcagcccggguccuggc

SEQ ID NO: 2959788 - RNA, 15 nt, Mycobacterium avium subsp. paratuberculosis
ggccagcagccgcga

SEQ ID NO: 2959789 - RNA, 17 nt, Mycobacterium avium subsp. paratuberculosis
ggccagcagccgcgaca

SEQ ID NO: 2959790 - RNA, 18 nt, Mycobacterium avium subsp. paratuberculosis
ggccagcagccgcgacac

SEQ ID NO: 2959791 - RNA, 19 nt, Mycobacterium avium subsp. paratuberculosis
ggccagcagccgcgacacg

SEQ ID NO: 2959792 - RNA, 15 nt, Mycobacterium avium subsp. paratuberculosis
ggccagcagccgcgc

SEQ ID NO: 2959793 - RNA, 16 nt, Mycobacterium avium subsp. paratuberculosis
ggccagcagccgcgcg

SEQ ID NO: 2959794 - RNA, 19 nt, Mycobacterium avium subsp. paratuberculosis
ggccagcagccgcgcgagc

SEQ ID NO: 2959795 - RNA, 14 nt, Mycobacterium avium subsp. paratuberculosis
ggccagcagccgcu

SEQ ID NO: 2959796 - RNA, 11 nt, Mycobacterium avium subsp. paratuberculosis
ggccagcagcg

SEQ ID NO: 2959797 - RNA, 15 nt, Mycobacterium avium subsp. paratuberculosis
ggccagcagcgcggc

SEQ ID NO: 2959798 - RNA, 17 nt, Mycobacterium avium subsp. paratuberculosis
ggccagcagcgcggcga

SEQ ID NO: 2959799 - RNA, 18 nt, Mycobacterium avium subsp. paratuberculosis
ggccagcagcgcggcgau

SEQ ID NO: 2959800 - RNA, 22 nt, Mycobacterium avium subsp. paratuberculosis
ggccagcagcgcggcgaucucg

SEQ ID NO: 2959801 - RNA, 14 nt, Mycobacterium avium subsp. paratuberculosis
ggccagcagcgcgu

SEQ ID NO: 2959802 - RNA, 16 nt, Mycobacterium avium subsp. paratuberculosis
ggccagcagcgcgucg

SEQ ID NO: 2959803 - RNA, 13 nt, Mycobacterium avium subsp. paratuberculosis
ggccagcagcggc

SEQ ID NO: 2959804 - RNA, 12 nt, Mycobacterium avium subsp. paratuberculosis
ggccagcagcgu

SEQ ID NO: 2959805 - RNA, 14 nt, Mycobacterium avium subsp. paratuberculosis
ggccagcagcgucg

SEQ ID NO: 2959806 - RNA, 15 nt, Mycobacterium avium subsp. paratuberculosis
ggccagcagcgucgu

SEQ ID NO: 2959807 - RNA, 16 nt, Mycobacterium avium subsp. paratuberculosis
ggccagcagcgucguc

SEQ ID NO: 2959808 - RNA, 15 nt, Mycobacterium avium subsp. paratuberculosis
ggccagcagggcgcc

SEQ ID NO: 2959809 - RNA, 19 nt, Mycobacterium avium subsp. paratuberculosis
ggccagcagggcgccgacg

SEQ ID NO: 2959810 - RNA, 22 nt, Mycobacterium avium subsp. paratuberculosis
ggccagcagguagaagccgcga

SEQ ID NO: 2959811 - RNA, 21 nt, Mycobacterium avium subsp. paratuberculosis
ggccagcagguagaucgccag

SEQ ID NO: 2959812 - RNA, 17 nt, Mycobacterium avium subsp. paratuberculosis
ggccagcgccuucucca

SEQ ID NO: 2959813 - RNA, 23 nt, Mycobacterium avium subsp. paratuberculosis
ggccagcgccuucuccagcuccu

SEQ ID NO: 2959814 - RNA, 17 nt, Mycobacterium avium subsp. paratuberculosis
ggccagcgcgacgcgca

SEQ ID NO: 2959815 - RNA, 16 nt, Mycobacterium avium subsp. paratuberculosis
ggccagcgcgacggcc

SEQ ID NO: 2959816 - RNA, 16 nt, Mycobacterium avium subsp. paratuberculosis
ggccagcgcgaucgcc

SEQ ID NO: 2959817 - RNA, 17 nt, Mycobacterium avium subsp. paratuberculosis
ggccagcgcgaucgccg

SEQ ID NO: 2959818 - RNA, 12 nt, Mycobacterium avium subsp. paratuberculosis
ggccagcgcgcc

SEQ ID NO: 2959819 - RNA, 14 nt, Mycobacterium avium subsp. paratuberculosis
ggccagcgcgccgc

SEQ ID NO: 2959820 - RNA, 15 nt, Mycobacterium avium subsp. paratuberculosis
ggccagcgcgccgca

SEQ ID NO: 2959821 - RNA, 24 nt, Mycobacterium avium subsp. paratuberculosis
ggccagcgcgccgcacagccggcg

SEQ ID NO: 2959822 - RNA, 15 nt, Mycobacterium avium subsp. paratuberculosis
ggccagcgcgccgcc

SEQ ID NO: 2959823 - RNA, 21 nt, Mycobacterium avium subsp. paratuberculosis
ggccagcgcgccgccgaugug

SEQ ID NO: 2959824 - RNA, 16 nt, Mycobacterium avium subsp. paratuberculosis
ggccagcgcgcgcagc

SEQ ID NO: 2959825 - RNA, 19 nt, Mycobacterium avium subsp. paratuberculosis
ggccagcgcgcgcagcgcu

SEQ ID NO: 2959826 - RNA, 14 nt, Mycobacterium avium subsp. paratuberculosis
ggccagcgcgcggg

SEQ ID NO: 2959827 - RNA, 15 nt, Mycobacterium avium subsp. paratuberculosis
ggccagcgcgcgggc

SEQ ID NO: 2959828 - RNA, 21 nt, Mycobacterium avium subsp. paratuberculosis
ggccagcgcgcgggcgcgcgc

SEQ ID NO: 2959829 - RNA, 23 nt, Mycobacterium avium subsp. paratuberculosis
ggccagcgcgcgggcgcgcgccg

SEQ ID NO: 2959830 - RNA, 14 nt, Mycobacterium avium subsp. paratuberculosis
ggccagcgcggccg

SEQ ID NO: 2959831 - RNA, 16 nt, Mycobacterium avium subsp. paratuberculosis
ggccagcgcggccggg

SEQ ID NO: 2959832 - RNA, 19 nt, Mycobacterium avium subsp. paratuberculosis
ggccagcgcggccgggcgc

SEQ ID NO: 2959833 - RNA, 13 nt, Mycobacterium avium subsp. paratuberculosis
ggccagcgcggcg

SEQ ID NO: 2959834 - RNA, 16 nt, Mycobacterium avium subsp. paratuberculosis
ggccagcgcggcggcc

SEQ ID NO: 2959835 - RNA, 16 nt, Mycobacterium avium subsp. paratuberculosis
ggccagcgcggcgguc

SEQ ID NO: 2959836 - RNA, 17 nt, Mycobacterium avium subsp. paratuberculosis
ggccagcgcggcggucg

SEQ ID NO: 2959837 - RNA, 20 nt, Mycobacterium avium subsp. paratuberculosis
ggccagcgcggcggucgcgc

SEQ ID NO: 2959838 - RNA, 23 nt, Mycobacterium avium subsp. paratuberculosis
ggccagcgcggcgucacccugga

SEQ ID NO: 2959839 - RNA, 12 nt, Mycobacterium avium subsp. paratuberculosis
ggccagcgcggu

SEQ ID NO: 2959840 - RNA, 16 nt, Mycobacterium avium subsp. paratuberculosis
ggccagcgcgguggcc

SEQ ID NO: 2959841 - RNA, 22 nt, Mycobacterium avium subsp. paratuberculosis
ggccagcgcgguggccagcagg

SEQ ID NO: 2959842 - RNA, 20 nt, Mycobacterium avium subsp. paratuberculosis
ggccagcgcggugugcggcg

SEQ ID NO: 2959843 - RNA, 17 nt, Mycobacterium avium subsp. paratuberculosis
ggccagcgcgucgcaca

SEQ ID NO: 2959844 - RNA, 22 nt, Mycobacterium avium subsp. paratuberculosis
ggccagcgcgucgcacagcgcc

SEQ ID NO: 2959845 - RNA, 15 nt, Mycobacterium avium subsp. paratuberculosis
ggccagcgcgucggc

SEQ ID NO: 2959846 - RNA, 17 nt, Mycobacterium avium subsp. paratuberculosis
ggccagcgcgucggcca

SEQ ID NO: 2959847 - RNA, 13 nt, Mycobacterium avium subsp. paratuberculosis
ggccagcgcguga

SEQ ID NO: 2959848 - RNA, 23 nt, Mycobacterium avium subsp. paratuberculosis
ggccagcgcgugaugggugggca

SEQ ID NO: 2959849 - RNA, 20 nt, Mycobacterium avium subsp. paratuberculosis
ggccagcggcaacugggcgg

SEQ ID NO: 2959850 - RNA, 22 nt, Mycobacterium avium subsp. paratuberculosis
ggccagcggcaacugggcggcc

SEQ ID NO: 2959851 - RNA, 23 nt, Mycobacterium avium subsp. paratuberculosis
ggccagcggcaacugggcggccu

SEQ ID NO: 2959852 - RNA, 13 nt, Mycobacterium avium subsp. paratuberculosis
ggccagcggcagc

SEQ ID NO: 2959853 - RNA, 14 nt, Mycobacterium avium subsp. paratuberculosis
ggccagcggcagcg

SEQ ID NO: 2959854 - RNA, 20 nt, Mycobacterium avium subsp. paratuberculosis
ggccagcggcagcgacagcg

SEQ ID NO: 2959855 - RNA, 23 nt, Mycobacterium avium subsp. paratuberculosis
ggccagcggcagcgacagcgcgu

SEQ ID NO: 2959856 - RNA, 17 nt, Mycobacterium avium subsp. paratuberculosis
ggccagcggcagcggcg

SEQ ID NO: 2959857 - RNA, 18 nt, Mycobacterium avium subsp. paratuberculosis
ggccagcggcagcggcgu

SEQ ID NO: 2959858 - RNA, 19 nt, Mycobacterium avium subsp. paratuberculosis
ggccagcggcagcggcguc

SEQ ID NO: 2959859 - RNA, 20 nt, Mycobacterium avium subsp. paratuberculosis
ggccagcggcagcggcgucg

SEQ ID NO: 2959860 - RNA, 14 nt, Mycobacterium avium subsp. paratuberculosis
ggccagcggcaucc

SEQ ID NO: 2959861 - RNA, 16 nt, Mycobacterium avium subsp. paratuberculosis
ggccagcggcaucccu

SEQ ID NO: 2959862 - RNA, 12 nt, Mycobacterium avium subsp. paratuberculosis
ggccagcggcgc

SEQ ID NO: 2959863 - RNA, 13 nt, Mycobacterium avium subsp. paratuberculosis
ggccagcggcgcc

SEQ ID NO: 2959864 - RNA, 14 nt, Mycobacterium avium subsp. paratuberculosis
ggccagcggcgccg

SEQ ID NO: 2959865 - RNA, 16 nt, Mycobacterium avium subsp. paratuberculosis
ggccagcggcgccgaa

SEQ ID NO: 2959866 - RNA, 17 nt, Mycobacterium avium subsp. paratuberculosis
ggccagcggcgccgggu

SEQ ID NO: 2959867 - RNA, 15 nt, Mycobacterium avium subsp. paratuberculosis
ggccagcgggcggcc

SEQ ID NO: 2959868 - RNA, 16 nt, Mycobacterium avium subsp. paratuberculosis
ggccagcgggcggccc

SEQ ID NO: 2959869 - RNA, 23 nt, Mycobacterium avium subsp. paratuberculosis
ggccagcgggucgugcaucggcg

SEQ ID NO: 2959870 - RNA, 18 nt, Mycobacterium avium subsp. paratuberculosis
ggccagcgggugauggcc

SEQ ID NO: 2959871 - RNA, 22 nt, Mycobacterium avium subsp. paratuberculosis
ggccagcgggugauggccgccg

SEQ ID NO: 2959872 - RNA, 20 nt, Mycobacterium avium subsp. paratuberculosis
ggccagcgguugcacggucu

SEQ ID NO: 2959873 - RNA, 17 nt, Mycobacterium avium subsp. paratuberculosis
ggccagcgucagggcga

SEQ ID NO: 2959874 - RNA, 14 nt, Mycobacterium avium subsp. paratuberculosis
ggccagcgucgcgc

SEQ ID NO: 2959875 - RNA, 17 nt, Mycobacterium avium subsp. paratuberculosis
ggccagcgucuccggcg

SEQ ID NO: 2959876 - RNA, 19 nt, Mycobacterium avium subsp. paratuberculosis
ggccagcgugaacaccgcg

SEQ ID NO: 2959877 - RNA, 14 nt, Mycobacterium avium subsp. paratuberculosis
ggccagcguggcgc

SEQ ID NO: 2959878 - RNA, 23 nt, Mycobacterium avium subsp. paratuberculosis
ggccagcguggcgcgccccggcc

SEQ ID NO: 2959879 - RNA, 20 nt, Mycobacterium avium subsp. paratuberculosis
ggccagcguuuccagcgccg

SEQ ID NO: 2959880 - RNA, 21 nt, Mycobacterium avium subsp. paratuberculosis
ggccagcguuuccagcgccgg

SEQ ID NO: 2959881 - RNA, 22 nt, Mycobacterium avium subsp. paratuberculosis
ggccagcguuuccagcgccggc

SEQ ID NO: 2959882 - RNA, 16 nt, Mycobacterium avium subsp. paratuberculosis
ggccagcucaccggcc

SEQ ID NO: 2959883 - RNA, 21 nt, Mycobacterium avium subsp. paratuberculosis
ggccagcucaccggccagggc

SEQ ID NO: 2959884 - RNA, 19 nt, Mycobacterium avium subsp. paratuberculosis
ggccagcucccgggcggcg

SEQ ID NO: 2959885 - RNA, 20 nt, Mycobacterium avium subsp. paratuberculosis
ggccagcucccgggcggcgc

SEQ ID NO: 2959886 - RNA, 21 nt, Mycobacterium avium subsp. paratuberculosis
ggccagcucccgggcggcgcc

SEQ ID NO: 2959887 - RNA, 22 nt, Mycobacterium avium subsp. paratuberculosis
ggccagcucccgggcggcgccg

SEQ ID NO: 2959888 - RNA, 23 nt, Mycobacterium avium subsp. paratuberculosis
ggccagcucccgggcggcgccga

SEQ ID NO: 2959889 - RNA, 14 nt, Mycobacterium avium subsp. paratuberculosis
ggccagcuccgcca

SEQ ID NO: 2959890 - RNA, 16 nt, Mycobacterium avium subsp. paratuberculosis
ggccagcuccgggucg

SEQ ID NO: 2959891 - RNA, 17 nt, Mycobacterium avium subsp. paratuberculosis
ggccagcuccgggucga

SEQ ID NO: 2959892 - RNA, 22 nt, Mycobacterium avium subsp. paratuberculosis
ggccagcuccgggucgaccgcc

SEQ ID NO: 2959893 - RNA, 20 nt, Mycobacterium avium subsp. paratuberculosis
ggccagcucgaacaccgucg

SEQ ID NO: 2959894 - RNA, 22 nt, Mycobacterium avium subsp. paratuberculosis
ggccagcucgaacaccgucgag

SEQ ID NO: 2959895 - RNA, 15 nt, Mycobacterium avium subsp. paratuberculosis
ggccagcucgaccgc

SEQ ID NO: 2959896 - RNA, 19 nt, Mycobacterium avium subsp. paratuberculosis
ggccagggugucccagcgc

SEQ ID NO: 2959897 - RNA, 22 nt, Mycobacterium avium subsp. paratuberculosis
ggccagggugucccagcgccac

SEQ ID NO: 2959898 - RNA, 17 nt, Mycobacterium avium subsp. paratuberculosis
ggccagguacaccacca

SEQ ID NO: 2959899 - RNA, 16 nt, Mycobacterium avium subsp. paratuberculosis
ggccagguacuccucg

SEQ ID NO: 2959900 - RNA, 21 nt, Mycobacterium avium subsp. paratuberculosis
ggccagguacugaucaccgcg

SEQ ID NO: 2959901 - RNA, 23 nt, Mycobacterium avium subsp. paratuberculosis
ggccagguacugaucaccgcgcu

SEQ ID NO: 2959902 - RNA, 18 nt, Mycobacterium avium subsp. paratuberculosis
ggccagguccucgcuggc

SEQ ID NO: 2959903 - RNA, 20 nt, Mycobacterium avium subsp. paratuberculosis
ggccagguccucgcuggcga

SEQ ID NO: 2959904 - RNA, 21 nt, Mycobacterium avium subsp. paratuberculosis
ggccagguccucgcuggcgau

SEQ ID NO: 2959905 - RNA, 19 nt, Mycobacterium avium subsp. paratuberculosis
ggccaggucgacggggucg

SEQ ID NO: 2959906 - RNA, 14 nt, Mycobacterium avium subsp. paratuberculosis
ggccaggucgccgc

SEQ ID NO: 2959907 - RNA, 15 nt, Mycobacterium avium subsp. paratuberculosis
ggccaggucgccgcg

SEQ ID NO: 2959908 - RNA, 19 nt, Mycobacterium avium subsp. paratuberculosis
ggccaggucgccgcgcagc

SEQ ID NO: 2959909 - RNA, 20 nt, Mycobacterium avium subsp. paratuberculosis
ggccaggucgcugacgauga

SEQ ID NO: 2959910 - RNA, 16 nt, Mycobacterium avium subsp. paratuberculosis
ggccaggugcacgccg

SEQ ID NO: 2959911 - RNA, 17 nt, Mycobacterium avium subsp. paratuberculosis
ggccaggugcacgccga

SEQ ID NO: 2959912 - RNA, 19 nt, Mycobacterium avium subsp. paratuberculosis
ggccaggugcacgccgagc

SEQ ID NO: 2959913 - RNA, 20 nt, Mycobacterium avium subsp. paratuberculosis
ggccaggugcacgccgagca

SEQ ID NO: 2959914 - RNA, 15 nt, Mycobacterium avium subsp. paratuberculosis
ggccaggugcagcug

SEQ ID NO: 2959915 - RNA, 16 nt, Mycobacterium avium subsp. paratuberculosis
ggccaggugugcccgc

SEQ ID NO: 2959916 - RNA, 19 nt, Mycobacterium avium subsp. paratuberculosis
ggccagguucaggcccgcg

SEQ ID NO: 2959917 - RNA, 24 nt, Mycobacterium avium subsp. paratuberculosis
ggccagguucaggcccgcgccgac

SEQ ID NO: 2959918 - RNA, 22 nt, Mycobacterium avium subsp. paratuberculosis
ggccagguuccaccgggcgucg

SEQ ID NO: 2959919 - RNA, 19 nt, Mycobacterium avium subsp. paratuberculosis
ggccagguugaccaccagc

SEQ ID NO: 2959920 - RNA, 20 nt, Mycobacterium avium subsp. paratuberculosis
ggccagguugaccaccagcg

SEQ ID NO: 2959921 - RNA, 21 nt, Mycobacterium avium subsp. paratuberculosis
ggccagguugaccaccagcgu

SEQ ID NO: 2959922 - RNA, 18 nt, Mycobacterium avium subsp. paratuberculosis
ggccagguugcgccgucc

SEQ ID NO: 2959923 - RNA, 19 nt, Mycobacterium avium subsp. paratuberculosis
ggccagguugcgccguccg

SEQ ID NO: 2959924 - RNA, 21 nt, Mycobacterium avium subsp. paratuberculosis
ggccagguugcgccguccggc

SEQ ID NO: 2959925 - RNA, 23 nt, Mycobacterium avium subsp. paratuberculosis
ggccagguugcgccguccggcca

SEQ ID NO: 2959926 - RNA, 17 nt, Mycobacterium avium subsp. paratuberculosis
ggccagguuggucagca

SEQ ID NO: 2959927 - RNA, 18 nt, Mycobacterium avium subsp. paratuberculosis
ggccagguuggucagcag

SEQ ID NO: 2959928 - RNA, 16 nt, Mycobacterium avium subsp. paratuberculosis
ggccagguugucgucg

SEQ ID NO: 2959929 - RNA, 18 nt, Mycobacterium avium subsp. paratuberculosis
ggccagguugucgucggg

SEQ ID NO: 2959930 - RNA, 20 nt, Mycobacterium avium subsp. paratuberculosis
ggccagguugucgucgggca

SEQ ID NO: 2959931 - RNA, 23 nt, Mycobacterium avium subsp. paratuberculosis
ggccagguugucgucgggcacca

SEQ ID NO: 2959932 - RNA, 13 nt, Mycobacterium avium subsp. paratuberculosis
ggccaguccagcg

SEQ ID NO: 2959933 - RNA, 17 nt, Mycobacterium avium subsp. paratuberculosis
ggccaguccgcgugaca

SEQ ID NO: 2959934 - RNA, 21 nt, Mycobacterium avium subsp. paratuberculosis
ggccaguccgcgugacaagcc

SEQ ID NO: 2959935 - RNA, 20 nt, Mycobacterium avium subsp. paratuberculosis
ggccaguccggcagcagcga

SEQ ID NO: 2959936 - RNA, 20 nt, Mycobacterium avium subsp. paratuberculosis
ggccaguccugggccagauc

SEQ ID NO: 2959937 - RNA, 12 nt, Mycobacterium avium subsp. paratuberculosis
ggccagucgccg

SEQ ID NO: 2959938 - RNA, 16 nt, Mycobacterium avium subsp. paratuberculosis
ggccagucgccgcgca

SEQ ID NO: 2959939 - RNA, 23 nt, Mycobacterium avium subsp. paratuberculosis
ggccagucguacucccaggccgc

SEQ ID NO: 2959940 - RNA, 15 nt, Mycobacterium avium subsp. paratuberculosis
ggccaguucaccgcg

SEQ ID NO: 2959941 - RNA, 16 nt, Mycobacterium avium subsp. paratuberculosis
ggccaguucaccgcgc

SEQ ID NO: 2959942 - RNA, 18 nt, Mycobacterium avium subsp. paratuberculosis
ggccaguucaccgcgcuc

SEQ ID NO: 2959943 - RNA, 14 nt, Mycobacterium avium subsp. paratuberculosis
ggccaguucccggg

SEQ ID NO: 2959944 - RNA, 15 nt, Mycobacterium avium subsp. paratuberculosis
ggccaguucgagcgc

SEQ ID NO: 2959945 - RNA, 18 nt, Mycobacterium avium subsp. paratuberculosis
ggccaguucgagcgccgc

SEQ ID NO: 2959946 - RNA, 19 nt, Mycobacterium avium subsp. paratuberculosis
ggccaguucgagcgccgcg

SEQ ID NO: 2959947 - RNA, 23 nt, Mycobacterium avium subsp. paratuberculosis
ggccaguucgagcgccgcggcca

SEQ ID NO: 2959948 - RNA, 23 nt, Mycobacterium avium subsp. paratuberculosis
ggccaguucggguccgcgguccu

SEQ ID NO: 2959949 - RNA, 18 nt, Mycobacterium avium subsp. paratuberculosis
ggccaguucgucgcgcga

SEQ ID NO: 2959950 - RNA, 19 nt, Mycobacterium avium subsp. paratuberculosis
ggccaguucgucgcgcgac

SEQ ID NO: 2959951 - RNA, 20 nt, Mycobacterium avium subsp. paratuberculosis
ggccaguucgucgcgcgacu

SEQ ID NO: 2959952 - RNA, 23 nt, Mycobacterium avium subsp. paratuberculosis
ggccaguucgucgcgcgacuggg

SEQ ID NO: 2959953 - RNA, 22 nt, Mycobacterium avium subsp. paratuberculosis
ggccaguugacguugaucgcgc

SEQ ID NO: 2959954 - RNA, 16 nt, Mycobacterium avium subsp. paratuberculosis
ggccauaaagccgucg

SEQ ID NO: 2959955 - RNA, 20 nt, Mycobacterium avium subsp. paratuberculosis
ggccauauaggggugggcga

SEQ ID NO: 2959956 - RNA, 23 nt, Mycobacterium avium subsp. paratuberculosis
ggccauauaggggugggcgaacg

SEQ ID NO: 2959957 - RNA, 18 nt, Mycobacterium avium subsp. paratuberculosis
ggccaucacggugccgag

SEQ ID NO: 2959958 - RNA, 23 nt, Mycobacterium avium subsp. paratuberculosis
ggccaucagcaccgaaucgccga

SEQ ID NO: 2959959 - RNA, 16 nt, Mycobacterium avium subsp. paratuberculosis
ggccaucagcccggcg

SEQ ID NO: 2959960 - RNA, 18 nt, Mycobacterium avium subsp. paratuberculosis
ggccaucagcccggcguc

SEQ ID NO: 2959961 - RNA, 19 nt, Mycobacterium avium subsp. paratuberculosis
ggccaucagcccggcgucc

SEQ ID NO: 2959962 - RNA, 22 nt, Mycobacterium avium subsp. paratuberculosis
ggccaucagcccggcguccugc

SEQ ID NO: 2959963 - RNA, 15 nt, Mycobacterium avium subsp. paratuberculosis
ggccaucagccgccg

SEQ ID NO: 2959964 - RNA, 17 nt, Mycobacterium avium subsp. paratuberculosis
ggccaucagccgccguc

SEQ ID NO: 2959965 - RNA, 18 nt, Mycobacterium avium subsp. paratuberculosis
ggccauccccgcguuggc

SEQ ID NO: 2959966 - RNA, 12 nt, Mycobacterium avium subsp. paratuberculosis
ggccaucccggu

SEQ ID NO: 2959967 - RNA, 17 nt, Mycobacterium avium subsp. paratuberculosis
ggccauccggccggcga

SEQ ID NO: 2959968 - RNA, 19 nt, Mycobacterium avium subsp. paratuberculosis
ggccauccggccggcgagg

SEQ ID NO: 2959969 - RNA, 20 nt, Mycobacterium avium subsp. paratuberculosis
ggccauccggccggcgagga

SEQ ID NO: 2959970 - RNA, 19 nt, Mycobacterium avium subsp. paratuberculosis
ggccauccgggcggcaucg

SEQ ID NO: 2959971 - RNA, 17 nt, Mycobacterium avium subsp. paratuberculosis
ggccaucgacuccacca

SEQ ID NO: 2959972 - RNA, 16 nt, Mycobacterium avium subsp. paratuberculosis
ggccaucgacuccagc

SEQ ID NO: 2959973 - RNA, 20 nt, Mycobacterium avium subsp. paratuberculosis
ggccaucgacuccagcaccg

SEQ ID NO: 2959974 - RNA, 22 nt, Mycobacterium avium subsp. paratuberculosis
ggccaucgacuccagcaccggc

SEQ ID NO: 2959975 - RNA, 23 nt, Mycobacterium avium subsp. paratuberculosis
ggccaucgacuccagcaccggcg

SEQ ID NO: 2959976 - RNA, 14 nt, Mycobacterium avium subsp. paratuberculosis
ggccaucgccgagc

SEQ ID NO: 2959977 - RNA, 15 nt, Mycobacterium avium subsp. paratuberculosis
ggccaucgccgagcc

SEQ ID NO: 2959978 - RNA, 18 nt, Mycobacterium avium subsp. paratuberculosis
ggccaucgccgcgguggc

SEQ ID NO: 2959979 - RNA, 21 nt, Mycobacterium avium subsp. paratuberculosis
ggccaucgccgcgguggcgcc

SEQ ID NO: 2959980 - RNA, 22 nt, Mycobacterium avium subsp. paratuberculosis
ggcccagcccggccagcacccg

SEQ ID NO: 2959981 - RNA, 16 nt, Mycobacterium avium subsp. paratuberculosis
ggcccagccgcgucac

SEQ ID NO: 2959982 - RNA, 23 nt, Mycobacterium avium subsp. paratuberculosis
ggcccagccgcgucacgucggcc

SEQ ID NO: 2959983 - RNA, 21 nt, Mycobacterium avium subsp. paratuberculosis
ggcccagccgcugcgacaggu

SEQ ID NO: 2959984 - RNA, 14 nt, Mycobacterium avium subsp. paratuberculosis
ggcccagccggccg

SEQ ID NO: 2959985 - RNA, 17 nt, Mycobacterium avium subsp. paratuberculosis
ggcccagccggccgacg

SEQ ID NO: 2959986 - RNA, 19 nt, Mycobacterium avium subsp. paratuberculosis
ggcccagccggccgacgcg

SEQ ID NO: 2959987 - RNA, 16 nt, Mycobacterium avium subsp. paratuberculosis
ggcccagccggcggug

SEQ ID NO: 2959988 - RNA, 14 nt, Mycobacterium avium subsp. paratuberculosis
ggcccagccggugc

SEQ ID NO: 2959989 - RNA, 22 nt, Mycobacterium avium subsp. paratuberculosis
ggcccagccggugcgagccgcu

SEQ ID NO: 2959990 - RNA, 12 nt, Mycobacterium avium subsp. paratuberculosis
ggcccagcgcgg

SEQ ID NO: 2959991 - RNA, 21 nt, Mycobacterium avium subsp. paratuberculosis
ggcccagcgcgguguacagcg

SEQ ID NO: 2959992 - RNA, 16 nt, Mycobacterium avium subsp. paratuberculosis
ggcccagcggaucgag

SEQ ID NO: 2959993 - RNA, 13 nt, Mycobacterium avium subsp. paratuberculosis
ggcccagcggcug

SEQ ID NO: 2959994 - RNA, 21 nt, Mycobacterium avium subsp. paratuberculosis
ggcccagcgucaacucgucgg

SEQ ID NO: 2959995 - RNA, 23 nt, Mycobacterium avium subsp. paratuberculosis
ggcccagcgucaacucgucggcg

SEQ ID NO: 2959996 - RNA, 20 nt, Mycobacterium avium subsp. paratuberculosis
ggcccagcuccaaugcggcc

SEQ ID NO: 2959997 - RNA, 22 nt, Mycobacterium avium subsp. paratuberculosis
ggcccagcuccaaugcggccga

SEQ ID NO: 2959998 - RNA, 15 nt, Mycobacterium avium subsp. paratuberculosis
ggcccagcucgguga

SEQ ID NO: 2959999 - RNA, 23 nt, Mycobacterium avium subsp. paratuberculosis
ggcccagcucggugaugaucgcc

SEQ ID NO: 2960000 - RNA, 15 nt, Mycobacterium avium subsp. paratuberculosis
ggcccagcucggugc

SEQ ID NO: 2960001 - RNA, 20 nt, Mycobacterium avium subsp. paratuberculosis
ggcccagcucggugcgcaug

SEQ ID NO: 2960002 - RNA, 20 nt, Mycobacterium avium subsp. paratuberculosis
ggcccagcucguugccggcg

SEQ ID NO: 2960003 - RNA, 23 nt, Mycobacterium avium subsp. paratuberculosis
ggcccagcucguugccggcggcc

SEQ ID NO: 2960004 - RNA, 15 nt, Mycobacterium avium subsp. paratuberculosis
ggcccagcugcugga

SEQ ID NO: 2960005 - RNA, 23 nt, Mycobacterium avium subsp. paratuberculosis
ggcccagcugcuggaaucgcgga

SEQ ID NO: 2960006 - RNA, 16 nt, Mycobacterium avium subsp. paratuberculosis
ggcccaggcaguagcc

SEQ ID NO: 2960007 - RNA, 23 nt, Mycobacterium avium subsp. paratuberculosis
ggcccaggcaguagccgaucucc

SEQ ID NO: 2960008 - RNA, 15 nt, Mycobacterium avium subsp. paratuberculosis
ggcccaggccaacag

SEQ ID NO: 2960009 - RNA, 19 nt, Mycobacterium avium subsp. paratuberculosis
ggcccaggccaacagcagc

SEQ ID NO: 2960010 - RNA, 19 nt, Mycobacterium avium subsp. paratuberculosis
ggcccaggccgacgccggc

SEQ ID NO: 2960011 - RNA, 20 nt, Mycobacterium avium subsp. paratuberculosis
ggcccaggccgacgccggcc

SEQ ID NO: 2960012 - RNA, 22 nt, Mycobacterium avium subsp. paratuberculosis
ggcccaggccgacgccggccac

SEQ ID NO: 2960013 - RNA, 13 nt, Mycobacterium avium subsp. paratuberculosis
ggcccaggccgcg

SEQ ID NO: 2960014 - RNA, 15 nt, Mycobacterium avium subsp. paratuberculosis
ggcccaggccgcggu

SEQ ID NO: 2960015 - RNA, 14 nt, Mycobacterium avium subsp. paratuberculosis
ggcccaggccggcg

SEQ ID NO: 2960016 - RNA, 16 nt, Mycobacterium avium subsp. paratuberculosis
ggcccaggccggcggu

SEQ ID NO: 2960017 - RNA, 19 nt, Mycobacterium avium subsp. paratuberculosis
ggcccagguucuccggccc

SEQ ID NO: 2960018 - RNA, 21 nt, Mycobacterium avium subsp. paratuberculosis
ggcccaguccagucgcgccga

SEQ ID NO: 2960019 - RNA, 23 nt, Mycobacterium avium subsp. paratuberculosis
ggcccaguccagucgcgccgagg

SEQ ID NO: 2960020 - RNA, 20 nt, Mycobacterium avium subsp. paratuberculosis
ggcccaguggaucggcccga

SEQ ID NO: 2960021 - RNA, 21 nt, Mycobacterium avium subsp. paratuberculosis
ggcccaguucgcaccccaccg

SEQ ID NO: 2960022 - RNA, 13 nt, Mycobacterium avium subsp. paratuberculosis
ggcccaucaccag

SEQ ID NO: 2960023 - RNA, 17 nt, Mycobacterium avium subsp. paratuberculosis
ggcccaucaccagcggc

SEQ ID NO: 2960024 - RNA, 20 nt, Mycobacterium avium subsp. paratuberculosis
ggcccaucaccagcggcugc

SEQ ID NO: 2960025 - RNA, 21 nt, Mycobacterium avium subsp. paratuberculosis
ggcccaucaccggaccggcca

SEQ ID NO: 2960026 - RNA, 23 nt, Mycobacterium avium subsp. paratuberculosis
ggcccaucaccggaccggccagc

SEQ ID NO: 2960027 - RNA, 13 nt, Mycobacterium avium subsp. paratuberculosis
ggcccaucgcggu

SEQ ID NO: 2960028 - RNA, 15 nt, Mycobacterium avium subsp. paratuberculosis
ggcccaucgcgguca

SEQ ID NO: 2960029 - RNA, 19 nt, Mycobacterium avium subsp. paratuberculosis
ggcccaucgcggucagcgu

SEQ ID NO: 2960030 - RNA, 20 nt, Mycobacterium avium subsp. paratuberculosis
ggcccaucgcggucagcguc

SEQ ID NO: 2960031 - RNA, 21 nt, Mycobacterium avium subsp. paratuberculosis
ggcccaucgcggucagcgucu

SEQ ID NO: 2960032 - RNA, 15 nt, Mycobacterium avium subsp. paratuberculosis
ggcccauggcgaaca

SEQ ID NO: 2960033 - RNA, 16 nt, Mycobacterium avium subsp. paratuberculosis
ggccccaacggcgugc

SEQ ID NO: 2960034 - RNA, 16 nt, Mycobacterium avium subsp. paratuberculosis
ggccccaccgccgcug

SEQ ID NO: 2960035 - RNA, 19 nt, Mycobacterium avium subsp. paratuberculosis
ggccccacgcgcucagcgc

SEQ ID NO: 2960036 - RNA, 21 nt, Mycobacterium avium subsp. paratuberculosis
ggccccacgcgcucagcgcgg

SEQ ID NO: 2960037 - RNA, 14 nt, Mycobacterium avium subsp. paratuberculosis
ggccccacgggcca

SEQ ID NO: 2960038 - RNA, 21 nt, Mycobacterium avium subsp. paratuberculosis
ggccccacguugaucaugucg

SEQ ID NO: 2960039 - RNA, 12 nt, Mycobacterium avium subsp. paratuberculosis
ggccccagccac

SEQ ID NO: 2960040 - RNA, 14 nt, Mycobacterium avium subsp. paratuberculosis
ggccccagccaccg

SEQ ID NO: 2960041 - RNA, 14 nt, Mycobacterium avium subsp. paratuberculosis
ggccccagcccggg

SEQ ID NO: 2960042 - RNA, 13 nt, Mycobacterium avium subsp. paratuberculosis
ggccccagccgcc

SEQ ID NO: 2960043 - RNA, 21 nt, Mycobacterium avium subsp. paratuberculosis
ggccccccgggcaccagcgcg

SEQ ID NO: 2960044 - RNA, 17 nt, Mycobacterium avium subsp. paratuberculosis
ggcccccgccccagccc

SEQ ID NO: 2960045 - RNA, 19 nt, Mycobacterium avium subsp. paratuberculosis
ggcccccgccccagcccgg

SEQ ID NO: 2960046 - RNA, 21 nt, Mycobacterium avium subsp. paratuberculosis
ggcccccgccccagcccggcu

SEQ ID NO: 2960047 - RNA, 16 nt, Mycobacterium avium subsp. paratuberculosis
ggcccccgccucgccg

SEQ ID NO: 2960048 - RNA, 19 nt, Mycobacterium avium subsp. paratuberculosis
ggcccccgccucgccgguc

SEQ ID NO: 2960049 - RNA, 22 nt, Mycobacterium avium subsp. paratuberculosis
ggcccccggcucgaucgcgguc

SEQ ID NO: 2960050 - RNA, 13 nt, Mycobacterium avium subsp. paratuberculosis
ggccccgccagau

SEQ ID NO: 2960051 - RNA, 12 nt, Mycobacterium avium subsp. paratuberculosis
ggccccgccagc

SEQ ID NO: 2960052 - RNA, 13 nt, Mycobacterium avium subsp. paratuberculosis
ggccccgcccggc

SEQ ID NO: 2960053 - RNA, 15 nt, Mycobacterium avium subsp. paratuberculosis
ggccccgcccggcgc

SEQ ID NO: 2960054 - RNA, 18 nt, Mycobacterium avium subsp. paratuberculosis
ggccccgcccggcgcgca

SEQ ID NO: 2960055 - RNA, 19 nt, Mycobacterium avium subsp. paratuberculosis
ggccccgcccggggcggcg

SEQ ID NO: 2960056 - RNA, 21 nt, Mycobacterium avium subsp. paratuberculosis
ggccccgcgugacggccgcgg

SEQ ID NO: 2960057 - RNA, 23 nt, Mycobacterium avium subsp. paratuberculosis
ggccccgcugccguccggcggca

SEQ ID NO: 2960058 - RNA, 14 nt, Mycobacterium avium subsp. paratuberculosis
ggccccggauccgu

SEQ ID NO: 2960059 - RNA, 16 nt, Mycobacterium avium subsp. paratuberculosis
ggccccggccgagccg

SEQ ID NO: 2960060 - RNA, 17 nt, Mycobacterium avium subsp. paratuberculosis
ggccccggccgagccgg

SEQ ID NO: 2960061 - RNA, 20 nt, Mycobacterium avium subsp. paratuberculosis
ggccccggccgagcgcagcg

SEQ ID NO: 2960062 - RNA, 13 nt, Mycobacterium avium subsp. paratuberculosis
ggccccggccggc

SEQ ID NO: 2960063 - RNA, 15 nt, Mycobacterium avium subsp. paratuberculosis
ggccccggccggcgg

SEQ ID NO: 2960064 - RNA, 24 nt, Mycobacterium avium subsp. paratuberculosis
ggcccgccgcggcuccagcagcgg

SEQ ID NO: 2960065 - RNA, 15 nt, Mycobacterium avium subsp. paratuberculosis
ggcccgccgcucacc

SEQ ID NO: 2960066 - RNA, 23 nt, Mycobacterium avium subsp. paratuberculosis
ggcccgccgcucaccgccgagcc

SEQ ID NO: 2960067 - RNA, 24 nt, Mycobacterium avium subsp. paratuberculosis
ggcccgccgcucaccgccgagccg

SEQ ID NO: 2960068 - RNA, 17 nt, Mycobacterium avium subsp. paratuberculosis
ggcccgccgcugcagcu

SEQ ID NO: 2960069 - RNA, 18 nt, Mycobacterium avium subsp. paratuberculosis
ggcccgccgcugcagcug

SEQ ID NO: 2960070 - RNA, 17 nt, Mycobacterium avium subsp. paratuberculosis
ggcccgccggagccgau

SEQ ID NO: 2960071 - RNA, 21 nt, Mycobacterium avium subsp. paratuberculosis
ggcccgccggagccgaucgcc

SEQ ID NO: 2960072 - RNA, 14 nt, Mycobacterium avium subsp. paratuberculosis
ggcccgccgggccg

SEQ ID NO: 2960073 - RNA, 19 nt, Mycobacterium avium subsp. paratuberculosis
ggcccgccgggccggaucg

SEQ ID NO: 2960074 - RNA, 22 nt, Mycobacterium avium subsp. paratuberculosis
ggcccgccgggccggaucgcgc

SEQ ID NO: 2960075 - RNA, 23 nt, Mycobacterium avium subsp. paratuberculosis
ggcccgccgggccggaucgcgca

SEQ ID NO: 2960076 - RNA, 13 nt, Mycobacterium avium subsp. paratuberculosis
ggcccgccgggcg

SEQ ID NO: 2960077 - RNA, 19 nt, Mycobacterium avium subsp. paratuberculosis
ggcccgccgggcgccacgc

SEQ ID NO: 2960078 - RNA, 20 nt, Mycobacterium avium subsp. paratuberculosis
ggcccgccgggcgucgcgcu

SEQ ID NO: 2960079 - RNA, 15 nt, Mycobacterium avium subsp. paratuberculosis
ggcccgccgguggcc

SEQ ID NO: 2960080 - RNA, 22 nt, Mycobacterium avium subsp. paratuberculosis
ggcccgccgguggccgcgcugg

SEQ ID NO: 2960081 - RNA, 19 nt, Mycobacterium avium subsp. paratuberculosis
ggcccgccguagcgccggc

SEQ ID NO: 2960082 - RNA, 14 nt, Mycobacterium avium subsp. paratuberculosis
ggcccgccgucgac

SEQ ID NO: 2960083 - RNA, 16 nt, Mycobacterium avium subsp. paratuberculosis
ggcccgccucggcggc

SEQ ID NO: 2960084 - RNA, 14 nt, Mycobacterium avium subsp. paratuberculosis
ggcccgcgacgucg

SEQ ID NO: 2960085 - RNA, 18 nt, Mycobacterium avium subsp. paratuberculosis
ggcccgcgcaccgucauc

SEQ ID NO: 2960086 - RNA, 22 nt, Mycobacterium avium subsp. paratuberculosis
ggcccgcgcaccgucaucgcgg

SEQ ID NO: 2960087 - RNA, 17 nt, Mycobacterium avium subsp. paratuberculosis
ggcccgcgcaucccguc

SEQ ID NO: 2960088 - RNA, 20 nt, Mycobacterium avium subsp. paratuberculosis
ggcccgcgcaucccgucgac

SEQ ID NO: 2960089 - RNA, 15 nt, Mycobacterium avium subsp. paratuberculosis
ggcccgcgccccggc

SEQ ID NO: 2960090 - RNA, 17 nt, Mycobacterium avium subsp. paratuberculosis
ggcccgcgccccggcgg

SEQ ID NO: 2960091 - RNA, 19 nt, Mycobacterium avium subsp. paratuberculosis
ggcccgcgccccggcggcc

SEQ ID NO: 2960092 - RNA, 20 nt, Mycobacterium avium subsp. paratuberculosis
ggcccgcgccccggcggcca

SEQ ID NO: 2960093 - RNA, 21 nt, Mycobacterium avium subsp. paratuberculosis
ggcccgcgccccggcggccac

SEQ ID NO: 2960094 - RNA, 22 nt, Mycobacterium avium subsp. paratuberculosis
ggcccgcgccccggcggccacg

SEQ ID NO: 2960095 - RNA, 18 nt, Mycobacterium avium subsp. paratuberculosis
ggcccgcgccgacggccg

SEQ ID NO: 2960096 - RNA, 16 nt, Mycobacterium avium subsp. paratuberculosis
ggcccgcgccgcgucg

SEQ ID NO: 2960097 - RNA, 13 nt, Mycobacterium avium subsp. paratuberculosis
ggcccgcgccggc

SEQ ID NO: 2960098 - RNA, 14 nt, Mycobacterium avium subsp. paratuberculosis
ggcccgcgccggcg

SEQ ID NO: 2960099 - RNA, 22 nt, Mycobacterium avium subsp. paratuberculosis
ggcccgcgccggcgugucggcg

SEQ ID NO: 2960100 - RNA, 23 nt, Mycobacterium avium subsp. paratuberculosis
ggcccgcgccggcgugucggcgc

SEQ ID NO: 2960101 - RNA, 14 nt, Mycobacterium avium subsp. paratuberculosis
ggcccgcgcgcuga

SEQ ID NO: 2960102 - RNA, 19 nt, Mycobacterium avium subsp. paratuberculosis
ggcccgcgcggccgccagg

SEQ ID NO: 2960103 - RNA, 17 nt, Mycobacterium avium subsp. paratuberculosis
ggcccgcgcggcggugu

SEQ ID NO: 2960104 - RNA, 19 nt, Mycobacterium avium subsp. paratuberculosis
ggcccgcgcggcggugucg

SEQ ID NO: 2960105 - RNA, 21 nt, Mycobacterium avium subsp. paratuberculosis
ggcccgcggcacgcugcgcca

SEQ ID NO: 2960106 - RNA, 14 nt, Mycobacterium avium subsp. paratuberculosis
ggcccgcggcaucg

SEQ ID NO: 2960107 - RNA, 20 nt, Mycobacterium avium subsp. paratuberculosis
ggcccgcggcaucgucgggg

SEQ ID NO: 2960108 - RNA, 12 nt, Mycobacterium avium subsp. paratuberculosis
ggcccgcggcgc

SEQ ID NO: 2960109 - RNA, 13 nt, Mycobacterium avium subsp. paratuberculosis
ggcccgcggcgcc

SEQ ID NO: 2960110 - RNA, 22 nt, Mycobacterium avium subsp. paratuberculosis
ggcccgcggcggauccagcacc

SEQ ID NO: 2960111 - RNA, 13 nt, Mycobacterium avium subsp. paratuberculosis
ggcccgcggcguc

SEQ ID NO: 2960112 - RNA, 20 nt, Mycobacterium avium subsp. paratuberculosis
ggcccgcgggaucagcgugu

SEQ ID NO: 2960113 - RNA, 23 nt, Mycobacterium avium subsp. paratuberculosis
ggcccgcgggaucagcguguugg

SEQ ID NO: 2960114 - RNA, 13 nt, Mycobacterium avium subsp. paratuberculosis
ggcccgcggggcg

SEQ ID NO: 2960115 - RNA, 17 nt, Mycobacterium avium subsp. paratuberculosis
ggcccgcggggcguacg

SEQ ID NO: 2960116 - RNA, 22 nt, Mycobacterium avium subsp. paratuberculosis
ggcccgcggggcguacgcgcug

SEQ ID NO: 2960117 - RNA, 20 nt, Mycobacterium avium subsp. paratuberculosis
ggcccgcguaaccggcggcg

SEQ ID NO: 2960118 - RNA, 17 nt, Mycobacterium avium subsp. paratuberculosis
ggcccgcucaccugcgg

SEQ ID NO: 2960119 - RNA, 18 nt, Mycobacterium avium subsp. paratuberculosis
ggcccgcucaccugcggc

SEQ ID NO: 2960120 - RNA, 21 nt, Mycobacterium avium subsp. paratuberculosis
ggcccgcucaccugcggcccg

SEQ ID NO: 2960121 - RNA, 22 nt, Mycobacterium avium subsp. paratuberculosis
ggcccgcucaccugcggcccgu

SEQ ID NO: 2960122 - RNA, 16 nt, Mycobacterium avium subsp. paratuberculosis
ggcccgcucgaugucg

SEQ ID NO: 2960123 - RNA, 12 nt, Mycobacterium avium subsp. paratuberculosis
ggcccgcucggc

SEQ ID NO: 2960124 - RNA, 14 nt, Mycobacterium avium subsp. paratuberculosis
ggcccgcucggcgg

SEQ ID NO: 2960125 - RNA, 15 nt, Mycobacterium avium subsp. paratuberculosis
ggcccgcucggcggg

SEQ ID NO: 2960126 - RNA, 13 nt, Mycobacterium avium subsp. paratuberculosis
ggcccgcucgggc

SEQ ID NO: 2960127 - RNA, 14 nt, Mycobacterium avium subsp. paratuberculosis
ggcccgcucgggcc

SEQ ID NO: 2960128 - RNA, 16 nt, Mycobacterium avium subsp. paratuberculosis
ggcccgcugcagcgcc

SEQ ID NO: 2960129 - RNA, 14 nt, Mycobacterium avium subsp. paratuberculosis
ggcccgcugcgcgg

SEQ ID NO: 2960130 - RNA, 17 nt, Mycobacterium avium subsp. paratuberculosis
ggcccgcugcgcggccg

SEQ ID NO: 2960131 - RNA, 17 nt, Mycobacterium avium subsp. paratuberculosis
ggcccgcugcggcuggg

SEQ ID NO: 2960132 - RNA, 14 nt, Mycobacterium avium subsp. paratuberculosis
ggcccgcuggccgc

SEQ ID NO: 2960133 - RNA, 16 nt, Mycobacterium avium subsp. paratuberculosis
ggcccgcuucaggcag

SEQ ID NO: 2960134 - RNA, 22 nt, Mycobacterium avium subsp. paratuberculosis
ggcccgcuucaggcagcgcacg

SEQ ID NO: 2960135 - RNA, 19 nt, Mycobacterium avium subsp. paratuberculosis
ggcccgcuugccgacguga

SEQ ID NO: 2960136 - RNA, 16 nt, Mycobacterium avium subsp. paratuberculosis
ggcccggaacgcgucg

SEQ ID NO: 2960137 - RNA, 20 nt, Mycobacterium avium subsp. paratuberculosis
ggcccggaacgcgucgccca

SEQ ID NO: 2960138 - RNA, 23 nt, Mycobacterium avium subsp. paratuberculosis
ggcccggaacgcgucgcccacgc

SEQ ID NO: 2960139 - RNA, 18 nt, Mycobacterium avium subsp. paratuberculosis
ggcccggaccgccgcggc

SEQ ID NO: 2960140 - RNA, 20 nt, Mycobacterium avium subsp. paratuberculosis
ggcccggaccgccgcggcgg

SEQ ID NO: 2960141 - RNA, 21 nt, Mycobacterium avium subsp. paratuberculosis
ggcccggaccgccgcggcggc

SEQ ID NO: 2960142 - RNA, 17 nt, Mycobacterium avium subsp. paratuberculosis
ggcccggacggagccgu

SEQ ID NO: 2960143 - RNA, 15 nt, Mycobacterium avium subsp. paratuberculosis
ggcccggacggccac

SEQ ID NO: 2960144 - RNA, 17 nt, Mycobacterium avium subsp. paratuberculosis
ggcccggacggccaccu

SEQ ID NO: 2960145 - RNA, 12 nt, Mycobacterium avium subsp. paratuberculosis
ggcccggcaccg

SEQ ID NO: 2960146 - RNA, 13 nt, Mycobacterium avium subsp. paratuberculosis
ggcccggcagccg

SEQ ID NO: 2960147 - RNA, 16 nt, Mycobacterium avium subsp. paratuberculosis
ggcccggccaccaggg

SEQ ID NO: 2960148 - RNA, 16 nt, Mycobacterium avium subsp. paratuberculosis
ggcccucggaggugcc

SEQ ID NO: 2960149 - RNA, 12 nt, Mycobacterium avium subsp. paratuberculosis
ggcccucggcca

SEQ ID NO: 2960150 - RNA, 14 nt, Mycobacterium avium subsp. paratuberculosis
ggcccucggccagc

SEQ ID NO: 2960151 - RNA, 17 nt, Mycobacterium avium subsp. paratuberculosis
ggcccucggccagccag

SEQ ID NO: 2960152 - RNA, 20 nt, Mycobacterium avium subsp. paratuberculosis
ggcccucggccagccaggcc

SEQ ID NO: 2960153 - RNA, 12 nt, Mycobacterium avium subsp. paratuberculosis
ggcccucguccg

SEQ ID NO: 2960154 - RNA, 20 nt, Mycobacterium avium subsp. paratuberculosis
ggcccucguccgacagcgcc

SEQ ID NO: 2960155 - RNA, 21 nt, Mycobacterium avium subsp. paratuberculosis
ggcccucguccgacagcgccu

SEQ ID NO: 2960156 - RNA, 14 nt, Mycobacterium avium subsp. paratuberculosis
ggcccucgucggcg

SEQ ID NO: 2960157 - RNA, 17 nt, Mycobacterium avium subsp. paratuberculosis
ggcccucgucggcgagc

SEQ ID NO: 2960158 - RNA, 15 nt, Mycobacterium avium subsp. paratuberculosis
ggcccugcagcgccu

SEQ ID NO: 2960159 - RNA, 16 nt, Mycobacterium avium subsp. paratuberculosis
ggcccugcagcgccuu

SEQ ID NO: 2960160 - RNA, 13 nt, Mycobacterium avium subsp. paratuberculosis
ggcccugcgcggc

SEQ ID NO: 2960161 - RNA, 14 nt, Mycobacterium avium subsp. paratuberculosis
ggcccugcgcggcc

SEQ ID NO: 2960162 - RNA, 15 nt, Mycobacterium avium subsp. paratuberculosis
ggcccugcgcggccu

SEQ ID NO: 2960163 - RNA, 18 nt, Mycobacterium avium subsp. paratuberculosis
ggcccugcgcggccugca

SEQ ID NO: 2960164 - RNA, 20 nt, Mycobacterium avium subsp. paratuberculosis
ggcccugcgcggccugcagc

SEQ ID NO: 2960165 - RNA, 18 nt, Mycobacterium avium subsp. paratuberculosis
ggcccugcggccagugcc

SEQ ID NO: 2960166 - RNA, 12 nt, Mycobacterium avium subsp. paratuberculosis
ggcccugcucgu

SEQ ID NO: 2960167 - RNA, 15 nt, Mycobacterium avium subsp. paratuberculosis
ggcccugcugcagcg

SEQ ID NO: 2960168 - RNA, 17 nt, Mycobacterium avium subsp. paratuberculosis
ggcccuggucggccagg

SEQ ID NO: 2960169 - RNA, 22 nt, Mycobacterium avium subsp. paratuberculosis
ggcccugguugagcaccgcgau

SEQ ID NO: 2960170 - RNA, 21 nt, Mycobacterium avium subsp. paratuberculosis
ggcccuguucgccgucgcggg

SEQ ID NO: 2960171 - RNA, 14 nt, Mycobacterium avium subsp. paratuberculosis
ggcccuugaccgcc

SEQ ID NO: 2960172 - RNA, 16 nt, Mycobacterium avium subsp. paratuberculosis
ggcccuugccccacca

SEQ ID NO: 2960173 - RNA, 19 nt, Mycobacterium avium subsp. paratuberculosis
ggcccuugccccaccaccg

SEQ ID NO: 2960174 - RNA, 22 nt, Mycobacterium avium subsp. paratuberculosis
ggcccuugccccaccaccgccg

SEQ ID NO: 2960175 - RNA, 18 nt, Mycobacterium avium subsp. paratuberculosis
ggccgaaaaaccugcggu

SEQ ID NO: 2960176 - RNA, 22 nt, Mycobacterium avium subsp. paratuberculosis
ggccgaaaaaccugcggugcca

SEQ ID NO: 2960177 - RNA, 14 nt, Mycobacterium avium subsp. paratuberculosis
ggccgaaaaacggc

SEQ ID NO: 2960178 - RNA, 18 nt, Mycobacterium avium subsp. paratuberculosis
ggccgaaacgcccggcuc

SEQ ID NO: 2960179 - RNA, 15 nt, Mycobacterium avium subsp. paratuberculosis
ggccgaacaccguca

SEQ ID NO: 2960180 - RNA, 20 nt, Mycobacterium avium subsp. paratuberculosis
ggccgaacaccgucaucgug

SEQ ID NO: 2960181 - RNA, 17 nt, Mycobacterium avium subsp. paratuberculosis
ggccgaacacggccgcc

SEQ ID NO: 2960182 - RNA, 16 nt, Mycobacterium avium subsp. paratuberculosis
ggccgaaccgcagccg

SEQ ID NO: 2960183 - RNA, 20 nt, Mycobacterium avium subsp. paratuberculosis
ggccgaaccgcucgucggga

SEQ ID NO: 2960184 - RNA, 14 nt, Mycobacterium avium subsp. paratuberculosis
ggccgaaccggaag

SEQ ID NO: 2960185 - RNA, 16 nt, Mycobacterium avium subsp. paratuberculosis
ggccgaacgauggugu

SEQ ID NO: 2960186 - RNA, 14 nt, Mycobacterium avium subsp. paratuberculosis
ggccgaacggcaug

SEQ ID NO: 2960187 - RNA, 18 nt, Mycobacterium avium subsp. paratuberculosis
ggccgaacgggucggcga

SEQ ID NO: 2960188 - RNA, 20 nt, Mycobacterium avium subsp. paratuberculosis
ggccgaacgggucggcgacc

SEQ ID NO: 2960189 - RNA, 17 nt, Mycobacterium avium subsp. paratuberculosis
ggccgaacucucccagg

SEQ ID NO: 2960190 - RNA, 20 nt, Mycobacterium avium subsp. paratuberculosis
ggccgaagaacucagccgaa

SEQ ID NO: 2960191 - RNA, 18 nt, Mycobacterium avium subsp. paratuberculosis
ggccgaagaccgggccga

SEQ ID NO: 2960192 - RNA, 15 nt, Mycobacterium avium subsp. paratuberculosis
ggccgaagccgacac

SEQ ID NO: 2960193 - RNA, 17 nt, Mycobacterium avium subsp. paratuberculosis
ggccgaagccgacaccg

SEQ ID NO: 2960194 - RNA, 19 nt, Mycobacterium avium subsp. paratuberculosis
ggccgaagcguuccgccgu

SEQ ID NO: 2960195 - RNA, 16 nt, Mycobacterium avium subsp. paratuberculosis
ggccgaaggcggcgcc

SEQ ID NO: 2960196 - RNA, 17 nt, Mycobacterium avium subsp. paratuberculosis
ggccgaaggcggcgccg

SEQ ID NO: 2960197 - RNA, 20 nt, Mycobacterium avium subsp. paratuberculosis
ggccgaaggcggcgccggcc

SEQ ID NO: 2960198 - RNA, 19 nt, Mycobacterium avium subsp. paratuberculosis
ggccgaaguccaagucgag

SEQ ID NO: 2960199 - RNA, 15 nt, Mycobacterium avium subsp. paratuberculosis
ggccgaauccggccg

SEQ ID NO: 2960200 - RNA, 19 nt, Mycobacterium avium subsp. paratuberculosis
ggccgacaacauccgcgac

SEQ ID NO: 2960201 - RNA, 20 nt, Mycobacterium avium subsp. paratuberculosis
ggccgacaacauccgcgacg

SEQ ID NO: 2960202 - RNA, 14 nt, Mycobacterium avium subsp. paratuberculosis
ggccgacaccccga

SEQ ID NO: 2960203 - RNA, 16 nt, Mycobacterium avium subsp. paratuberculosis
ggccgacaccccgaug

SEQ ID NO: 2960204 - RNA, 19 nt, Mycobacterium avium subsp. paratuberculosis
ggccgacaccccgaugccg

SEQ ID NO: 2960205 - RNA, 23 nt, Mycobacterium avium subsp. paratuberculosis
ggccgacaccccgaugccgaacu

SEQ ID NO: 2960206 - RNA, 22 nt, Mycobacterium avium subsp. paratuberculosis
ggccgacacguaggccgccugc

SEQ ID NO: 2960207 - RNA, 20 nt, Mycobacterium avium subsp. paratuberculosis
ggccgacagcacgccgggca

SEQ ID NO: 2960208 - RNA, 13 nt, Mycobacterium avium subsp. paratuberculosis
ggccgacagcgcg

SEQ ID NO: 2960209 - RNA, 20 nt, Mycobacterium avium subsp. paratuberculosis
ggccgacagcgcgucggcga

SEQ ID NO: 2960210 - RNA, 23 nt, Mycobacterium avium subsp. paratuberculosis
ggccgacagcgcgucggcgaugu

SEQ ID NO: 2960211 - RNA, 14 nt, Mycobacterium avium subsp. paratuberculosis
ggccgacaucgucg

SEQ ID NO: 2960212 - RNA, 18 nt, Mycobacterium avium subsp. paratuberculosis
ggccgacaucgucggcuc

SEQ ID NO: 2960213 - RNA, 19 nt, Mycobacterium avium subsp. paratuberculosis
ggccgacaucgucggcucg

SEQ ID NO: 2960214 - RNA, 20 nt, Mycobacterium avium subsp. paratuberculosis
ggccgacauggacgcggccu

SEQ ID NO: 2960215 - RNA, 18 nt, Mycobacterium avium subsp. paratuberculosis
ggccgaccccgaugcgcu

SEQ ID NO: 2960216 - RNA, 14 nt, Mycobacterium avium subsp. paratuberculosis
ggccgacccggccg

SEQ ID NO: 2960217 - RNA, 21 nt, Mycobacterium avium subsp. paratuberculosis
ggccgacccugcguccggccc

SEQ ID NO: 2960218 - RNA, 22 nt, Mycobacterium avium subsp. paratuberculosis
ggccgacccugcguccggcccg

SEQ ID NO: 2960219 - RNA, 22 nt, Mycobacterium avium subsp. paratuberculosis
ggccgaccgacaguucggcgcg

SEQ ID NO: 2960220 - RNA, 24 nt, Mycobacterium avium subsp. paratuberculosis
ggccgaccgacaguucggcgcgca

SEQ ID NO: 2960221 - RNA, 12 nt, Mycobacterium avium subsp. paratuberculosis
ggccgaccgccg

SEQ ID NO: 2960222 - RNA, 15 nt, Mycobacterium avium subsp. paratuberculosis
ggccgaccgccgcca

SEQ ID NO: 2960223 - RNA, 18 nt, Mycobacterium avium subsp. paratuberculosis
ggccgaccgccucgaugg

SEQ ID NO: 2960224 - RNA, 13 nt, Mycobacterium avium subsp. paratuberculosis
ggccgaccggccg

SEQ ID NO: 2960225 - RNA, 14 nt, Mycobacterium avium subsp. paratuberculosis
ggccgaccggccgg

SEQ ID NO: 2960226 - RNA, 21 nt, Mycobacterium avium subsp. paratuberculosis
ggccgaccggucucgaccgcg

SEQ ID NO: 2960227 - RNA, 22 nt, Mycobacterium avium subsp. paratuberculosis
ggccgaccggucucgaccgcgg

SEQ ID NO: 2960228 - RNA, 14 nt, Mycobacterium avium subsp. paratuberculosis
ggccgaccgucagc

SEQ ID NO: 2960229 - RNA, 21 nt, Mycobacterium avium subsp. paratuberculosis
ggccgaccgucagccaaaccg

SEQ ID NO: 2960230 - RNA, 14 nt, Mycobacterium avium subsp. paratuberculosis
ggccgaccuggcgg

SEQ ID NO: 2960231 - RNA, 17 nt, Mycobacterium avium subsp. paratuberculosis
ggccgaccuggcggccg

SEQ ID NO: 2960232 - RNA, 23 nt, Mycobacterium avium subsp. paratuberculosis
ggccgacgaugaacagucggccg

SEQ ID NO: 2960233 - RNA, 15 nt, Mycobacterium avium subsp. paratuberculosis
ggccgauggcgccca

SEQ ID NO: 2960234 - RNA, 17 nt, Mycobacterium avium subsp. paratuberculosis
ggccgauggcgcccagc

SEQ ID NO: 2960235 - RNA, 15 nt, Mycobacterium avium subsp. paratuberculosis
ggccgauggucagcu

SEQ ID NO: 2960236 - RNA, 14 nt, Mycobacterium avium subsp. paratuberculosis
ggccgauucggcgc

SEQ ID NO: 2960237 - RNA, 15 nt, Mycobacterium avium subsp. paratuberculosis
ggccgauucggcgcc

SEQ ID NO: 2960238 - RNA, 16 nt, Mycobacterium avium subsp. paratuberculosis
ggccgauucggcgccg

SEQ ID NO: 2960239 - RNA, 18 nt, Mycobacterium avium subsp. paratuberculosis
ggccgauucggcgccgcg

SEQ ID NO: 2960240 - RNA, 19 nt, Mycobacterium avium subsp. paratuberculosis
ggccgauucggcgccgcga

SEQ ID NO: 2960241 - RNA, 15 nt, Mycobacterium avium subsp. paratuberculosis
ggccgcaacggcggu

SEQ ID NO: 2960242 - RNA, 16 nt, Mycobacterium avium subsp. paratuberculosis
ggccgcaacggcgguc

SEQ ID NO: 2960243 - RNA, 17 nt, Mycobacterium avium subsp. paratuberculosis
ggccgcaacggcggucg

SEQ ID NO: 2960244 - RNA, 22 nt, Mycobacterium avium subsp. paratuberculosis
ggccgcaacggcggucgugcgg

SEQ ID NO: 2960245 - RNA, 16 nt, Mycobacterium avium subsp. paratuberculosis
ggccgcaagcgaagcc

SEQ ID NO: 2960246 - RNA, 23 nt, Mycobacterium avium subsp. paratuberculosis
ggccgcaauacggugcccgccgc

SEQ ID NO: 2960247 - RNA, 16 nt, Mycobacterium avium subsp. paratuberculosis
ggccgcaaucggcgcc

SEQ ID NO: 2960248 - RNA, 22 nt, Mycobacterium avium subsp. paratuberculosis
ggccgcaaucggcgccggcucc

SEQ ID NO: 2960249 - RNA, 19 nt, Mycobacterium avium subsp. paratuberculosis
ggccgcacaccaccacgug

SEQ ID NO: 2960250 - RNA, 14 nt, Mycobacterium avium subsp. paratuberculosis
ggccgcacaccugc

SEQ ID NO: 2960251 - RNA, 22 nt, Mycobacterium avium subsp. paratuberculosis
ggccgcacaccugcaucacgau

SEQ ID NO: 2960252 - RNA, 12 nt, Mycobacterium avium subsp. paratuberculosis
ggccgcacccca

SEQ ID NO: 2960253 - RNA, 16 nt, Mycobacterium avium subsp. paratuberculosis
ggccgcaccccacccg

SEQ ID NO: 2960254 - RNA, 20 nt, Mycobacterium avium subsp. paratuberculosis
ggccgcaccccacccgcgcg

SEQ ID NO: 2960255 - RNA, 23 nt, Mycobacterium avium subsp. paratuberculosis
ggccgcacccccuccacacggca

SEQ ID NO: 2960256 - RNA, 18 nt, Mycobacterium avium subsp. paratuberculosis
ggccgcacggugcagcag

SEQ ID NO: 2960257 - RNA, 19 nt, Mycobacterium avium subsp. paratuberculosis
ggccgcacggugcagcagc

SEQ ID NO: 2960258 - RNA, 18 nt, Mycobacterium avium subsp. paratuberculosis
ggccgcacguauccgcgg

SEQ ID NO: 2960259 - RNA, 20 nt, Mycobacterium avium subsp. paratuberculosis
ggccgcacgucccgcccggc

SEQ ID NO: 2960260 - RNA, 20 nt, Mycobacterium avium subsp. paratuberculosis
ggccgcacugcaucucgacc

SEQ ID NO: 2960261 - RNA, 13 nt, Mycobacterium avium subsp. paratuberculosis
ggccgcagcacgg

SEQ ID NO: 2960262 - RNA, 15 nt, Mycobacterium avium subsp. paratuberculosis
ggccgcagccgcgcg

SEQ ID NO: 2960263 - RNA, 16 nt, Mycobacterium avium subsp. paratuberculosis
ggccgcagccgcgcgg

SEQ ID NO: 2960264 - RNA, 18 nt, Mycobacterium avium subsp. paratuberculosis
ggccgcagccgcgcggcc

SEQ ID NO: 2960265 - RNA, 19 nt, Mycobacterium avium subsp. paratuberculosis
ggccgcagccgcgcggccg

SEQ ID NO: 2960266 - RNA, 23 nt, Mycobacterium avium subsp. paratuberculosis
ggccgcagccgcgcggccggcca

SEQ ID NO: 2960267 - RNA, 18 nt, Mycobacterium avium subsp. paratuberculosis
ggccgcagcgacuccugg

SEQ ID NO: 2960268 - RNA, 12 nt, Mycobacterium avium subsp. paratuberculosis
ggccgcagcgca

SEQ ID NO: 2960269 - RNA, 19 nt, Mycobacterium avium subsp. paratuberculosis
ggccgcagcgcaucgccgg

SEQ ID NO: 2960270 - RNA, 20 nt, Mycobacterium avium subsp. paratuberculosis
ggccgcagcgcaucgccggc

SEQ ID NO: 2960271 - RNA, 16 nt, Mycobacterium avium subsp. paratuberculosis
ggccgcagcgcccggc

SEQ ID NO: 2960272 - RNA, 20 nt, Mycobacterium avium subsp. paratuberculosis
ggccgcagcgcccggcagcg

SEQ ID NO: 2960273 - RNA, 13 nt, Mycobacterium avium subsp. paratuberculosis
ggccgcagcgcga

SEQ ID NO: 2960274 - RNA, 13 nt, Mycobacterium avium subsp. paratuberculosis
ggccgcagcgcgc

SEQ ID NO: 2960275 - RNA, 15 nt, Mycobacterium avium subsp. paratuberculosis
ggccgcagcgcgcgg

SEQ ID NO: 2960276 - RNA, 16 nt, Mycobacterium avium subsp. paratuberculosis
ggccgcagcgcgcggg

SEQ ID NO: 2960277 - RNA, 16 nt, Mycobacterium avium subsp. paratuberculosis
ggccgcagcgcggcga

SEQ ID NO: 2960278 - RNA, 18 nt, Mycobacterium avium subsp. paratuberculosis
ggccgcagcgcggcgaca

SEQ ID NO: 2960279 - RNA, 14 nt, Mycobacterium avium subsp. paratuberculosis
ggccgcagcggcag

SEQ ID NO: 2960280 - RNA, 12 nt, Mycobacterium avium subsp. paratuberculosis
ggccgcagcggg

SEQ ID NO: 2960281 - RNA, 19 nt, Mycobacterium avium subsp. paratuberculosis
ggccgcagcgugggcaccg

SEQ ID NO: 2960282 - RNA, 21 nt, Mycobacterium avium subsp. paratuberculosis
ggccgcagcgugggcaccggc

SEQ ID NO: 2960283 - RNA, 22 nt, Mycobacterium avium subsp. paratuberculosis
ggccgcagcgugggcaccggca

SEQ ID NO: 2960284 - RNA, 15 nt, Mycobacterium avium subsp. paratuberculosis
ggccgcagcucgccc

SEQ ID NO: 2960285 - RNA, 18 nt, Mycobacterium avium subsp. paratuberculosis
ggccgcagcucgcccagc

SEQ ID NO: 2960286 - RNA, 12 nt, Mycobacterium avium subsp. paratuberculosis
ggccgcaggcgg

SEQ ID NO: 2960287 - RNA, 14 nt, Mycobacterium avium subsp. paratuberculosis
ggccgcaggcggcc

SEQ ID NO: 2960288 - RNA, 18 nt, Mycobacterium avium subsp. paratuberculosis
ggccgcaggcggccagca

SEQ ID NO: 2960289 - RNA, 19 nt, Mycobacterium avium subsp. paratuberculosis
ggccgcaggcggccagcac

SEQ ID NO: 2960290 - RNA, 15 nt, Mycobacterium avium subsp. paratuberculosis
ggccgcaggguggcc

SEQ ID NO: 2960291 - RNA, 18 nt, Mycobacterium avium subsp. paratuberculosis
ggccgcaggguggccagc

SEQ ID NO: 2960292 - RNA, 20 nt, Mycobacterium avium subsp. paratuberculosis
ggccgcaggguggccagcac

SEQ ID NO: 2960293 - RNA, 14 nt, Mycobacterium avium subsp. paratuberculosis
ggccgcauccagcg

SEQ ID NO: 2960294 - RNA, 15 nt, Mycobacterium avium subsp. paratuberculosis
ggccgcauccagcgc

SEQ ID NO: 2960295 - RNA, 16 nt, Mycobacterium avium subsp. paratuberculosis
ggccgcauccagcgcc

SEQ ID NO: 2960296 - RNA, 19 nt, Mycobacterium avium subsp. paratuberculosis
ggccgcauccagcgccgcc

SEQ ID NO: 2960297 - RNA, 20 nt, Mycobacterium avium subsp. paratuberculosis
ggccgcauccagcgccgcca

SEQ ID NO: 2960298 - RNA, 23 nt, Mycobacterium avium subsp. paratuberculosis
ggccgcauccagcgccgccaacc

SEQ ID NO: 2960299 - RNA, 16 nt, Mycobacterium avium subsp. paratuberculosis
ggccgcauccgcgagc

SEQ ID NO: 2960300 - RNA, 17 nt, Mycobacterium avium subsp. paratuberculosis
ggccgcauccgcgagcc

SEQ ID NO: 2960301 - RNA, 18 nt, Mycobacterium avium subsp. paratuberculosis
ggccgcauccgcgagccg

SEQ ID NO: 2960302 - RNA, 22 nt, Mycobacterium avium subsp. paratuberculosis
ggccgcauccgcgagccgagcc

SEQ ID NO: 2960303 - RNA, 23 nt, Mycobacterium avium subsp. paratuberculosis
ggccgcauccgcgagccgagccg

SEQ ID NO: 2960304 - RNA, 23 nt, Mycobacterium avium subsp. paratuberculosis
ggccgccaacggauucagcgucg

SEQ ID NO: 2960305 - RNA, 22 nt, Mycobacterium avium subsp. paratuberculosis
ggccgccaccaacaucgacgug

SEQ ID NO: 2960306 - RNA, 12 nt, Mycobacterium avium subsp. paratuberculosis
ggccgccaccag

SEQ ID NO: 2960307 - RNA, 20 nt, Mycobacterium avium subsp. paratuberculosis
ggccgccaccaggcugaacg

SEQ ID NO: 2960308 - RNA, 12 nt, Mycobacterium avium subsp. paratuberculosis
ggccgccaccgc

SEQ ID NO: 2960309 - RNA, 14 nt, Mycobacterium avium subsp. paratuberculosis
ggccgccacgaugc

SEQ ID NO: 2960310 - RNA, 14 nt, Mycobacterium avium subsp. paratuberculosis
ggccgccacgcugg

SEQ ID NO: 2960311 - RNA, 14 nt, Mycobacterium avium subsp. paratuberculosis
ggccgccacggcgc

SEQ ID NO: 2960312 - RNA, 15 nt, Mycobacterium avium subsp. paratuberculosis
ggccgccacggcgcc

SEQ ID NO: 2960313 - RNA, 16 nt, Mycobacterium avium subsp. paratuberculosis
ggccgccacggcgcca

SEQ ID NO: 2960314 - RNA, 11 nt, Mycobacterium avium subsp. paratuberculosis
ggccgccagca

SEQ ID NO: 2960315 - RNA, 13 nt, Mycobacterium avium subsp. paratuberculosis
ggccgccagcacc

SEQ ID NO: 2960316 - RNA, 16 nt, Mycobacterium avium subsp. paratuberculosis
ggccgccagcaccucc

SEQ ID NO: 2960317 - RNA, 12 nt, Mycobacterium avium subsp. paratuberculosis
ggccgccagcag

SEQ ID NO: 2960318 - RNA, 19 nt, Mycobacterium avium subsp. paratuberculosis
ggccgccgcuagucgccca

SEQ ID NO: 2960319 - RNA, 21 nt, Mycobacterium avium subsp. paratuberculosis
ggccgccgcuagucgcccagc

SEQ ID NO: 2960320 - RNA, 23 nt, Mycobacterium avium subsp. paratuberculosis
ggccgccggaaggucuuucgucg

SEQ ID NO: 2960321 - RNA, 19 nt, Mycobacterium avium subsp. paratuberculosis
ggccgccggaucguguccc

SEQ ID NO: 2960322 - RNA, 11 nt, Mycobacterium avium subsp. paratuberculosis
ggccgccggcc

SEQ ID NO: 2960323 - RNA, 14 nt, Mycobacterium avium subsp. paratuberculosis
ggccgccggccagc

SEQ ID NO: 2960324 - RNA, 16 nt, Mycobacterium avium subsp. paratuberculosis
ggccgccggccgcgca

SEQ ID NO: 2960325 - RNA, 23 nt, Mycobacterium avium subsp. paratuberculosis
ggccgccggccgcucgcgggcca

SEQ ID NO: 2960326 - RNA, 13 nt, Mycobacterium avium subsp. paratuberculosis
ggccgccggcggc

SEQ ID NO: 2960327 - RNA, 15 nt, Mycobacterium avium subsp. paratuberculosis
ggccgccggcggcca

SEQ ID NO: 2960328 - RNA, 12 nt, Mycobacterium avium subsp. paratuberculosis
ggccgccgggac

SEQ ID NO: 2960329 - RNA, 14 nt, Mycobacterium avium subsp. paratuberculosis
ggccgccgggccgc

SEQ ID NO: 2960330 - RNA, 17 nt, Mycobacterium avium subsp. paratuberculosis
ggccgccgggccgccga

SEQ ID NO: 2960331 - RNA, 18 nt, Mycobacterium avium subsp. paratuberculosis
ggccgccgggccggcggc

SEQ ID NO: 2960332 - RNA, 22 nt, Mycobacterium avium subsp. paratuberculosis
ggccgccgggccggcggccagu

SEQ ID NO: 2960333 - RNA, 17 nt, Mycobacterium avium subsp. paratuberculosis
ggccgccggggccccaa

SEQ ID NO: 2960334 - RNA, 14 nt, Mycobacterium avium subsp. paratuberculosis
ggccgccgucggua

SEQ ID NO: 2960335 - RNA, 23 nt, Mycobacterium avium subsp. paratuberculosis
ggccgccgucuucccagugccgc

SEQ ID NO: 2960336 - RNA, 13 nt, Mycobacterium avium subsp. paratuberculosis
ggccgccgugcug

SEQ ID NO: 2960337 - RNA, 19 nt, Mycobacterium avium subsp. paratuberculosis
ggccgccgugcugacguga

SEQ ID NO: 2960338 - RNA, 15 nt, Mycobacterium avium subsp. paratuberculosis
ggccgccguggccca

SEQ ID NO: 2960339 - RNA, 13 nt, Mycobacterium avium subsp. paratuberculosis
ggccgccucacgc

SEQ ID NO: 2960340 - RNA, 15 nt, Mycobacterium avium subsp. paratuberculosis
ggccgccuccagcac

SEQ ID NO: 2960341 - RNA, 17 nt, Mycobacterium avium subsp. paratuberculosis
ggccgccuccagcacgu

SEQ ID NO: 2960342 - RNA, 20 nt, Mycobacterium avium subsp. paratuberculosis
ggccgccuccagcacgucgg

SEQ ID NO: 2960343 - RNA, 20 nt, Mycobacterium avium subsp. paratuberculosis
ggccgccucccgcagcgcca

SEQ ID NO: 2960344 - RNA, 16 nt, Mycobacterium avium subsp. paratuberculosis
ggccgccucgaagucg

SEQ ID NO: 2960345 - RNA, 21 nt, Mycobacterium avium subsp. paratuberculosis
ggccgccucgaagucgccggc

SEQ ID NO: 2960346 - RNA, 23 nt, Mycobacterium avium subsp. paratuberculosis
ggccgccucgaagucgccggccu

SEQ ID NO: 2960347 - RNA, 15 nt, Mycobacterium avium subsp. paratuberculosis
ggccgccucgucgag

SEQ ID NO: 2960348 - RNA, 16 nt, Mycobacterium avium subsp. paratuberculosis
ggccgccugcccgggc

SEQ ID NO: 2960349 - RNA, 19 nt, Mycobacterium avium subsp. paratuberculosis
ggccgccugcccgggcgcc

SEQ ID NO: 2960350 - RNA, 21 nt, Mycobacterium avium subsp. paratuberculosis
ggccgccugcccgggcgccga

SEQ ID NO: 2960351 - RNA, 22 nt, Mycobacterium avium subsp. paratuberculosis
ggccgccugcccgggcgccgag

SEQ ID NO: 2960352 - RNA, 13 nt, Mycobacterium avium subsp. paratuberculosis
ggccgccugcggg

SEQ ID NO: 2960353 - RNA, 14 nt, Mycobacterium avium subsp. paratuberculosis
ggccgccugcgggu

SEQ ID NO: 2960354 - RNA, 23 nt, Mycobacterium avium subsp. paratuberculosis
ggccgccugcggguucuggccgu

SEQ ID NO: 2960355 - RNA, 22 nt, Mycobacterium avium subsp. paratuberculosis
ggccgccuggacgacgucgaug

SEQ ID NO: 2960356 - RNA, 15 nt, Mycobacterium avium subsp. paratuberculosis
ggccgccuucacgac

SEQ ID NO: 2960357 - RNA, 17 nt, Mycobacterium avium subsp. paratuberculosis
ggccgccuucacgaccg

SEQ ID NO: 2960358 - RNA, 18 nt, Mycobacterium avium subsp. paratuberculosis
ggccgccuucacgaccgg

SEQ ID NO: 2960359 - RNA, 22 nt, Mycobacterium avium subsp. paratuberculosis
ggccgccuucacgaccggcagc

SEQ ID NO: 2960360 - RNA, 19 nt, Mycobacterium avium subsp. paratuberculosis
ggccgccuucuccgggucg

SEQ ID NO: 2960361 - RNA, 19 nt, Mycobacterium avium subsp. paratuberculosis
ggccgccuugggccggucg

SEQ ID NO: 2960362 - RNA, 12 nt, Mycobacterium avium subsp. paratuberculosis
ggccgccuuggu

SEQ ID NO: 2960363 - RNA, 23 nt, Mycobacterium avium subsp. paratuberculosis
ggccgcgaaaauaccgccggccg

SEQ ID NO: 2960364 - RNA, 19 nt, Mycobacterium avium subsp. paratuberculosis
ggccgcgaacggcccgccg

SEQ ID NO: 2960365 - RNA, 17 nt, Mycobacterium avium subsp. paratuberculosis
ggccgcgaacgggugac

SEQ ID NO: 2960366 - RNA, 21 nt, Mycobacterium avium subsp. paratuberculosis
ggccgcgaacgggugaccggc

SEQ ID NO: 2960367 - RNA, 22 nt, Mycobacterium avium subsp. paratuberculosis
ggccgcgaacgggugaccggcg

SEQ ID NO: 2960368 - RNA, 16 nt, Mycobacterium avium subsp. paratuberculosis
ggccgcgaagaugucg

SEQ ID NO: 2960369 - RNA, 23 nt, Mycobacterium avium subsp. paratuberculosis
ggccgcgaaggcggcgucgaugu

SEQ ID NO: 2960370 - RNA, 13 nt, Mycobacterium avium subsp. paratuberculosis
ggccgcgacagcc

SEQ ID NO: 2960371 - RNA, 16 nt, Mycobacterium avium subsp. paratuberculosis
ggccgcgacgccgccg

SEQ ID NO: 2960372 - RNA, 20 nt, Mycobacterium avium subsp. paratuberculosis
ggccgcgacgccgccgccga

SEQ ID NO: 2960373 - RNA, 22 nt, Mycobacterium avium subsp. paratuberculosis
ggccgcgacgccgccgccgagc

SEQ ID NO: 2960374 - RNA, 12 nt, Mycobacterium avium subsp. paratuberculosis
ggccgcgacgcg

SEQ ID NO: 2960375 - RNA, 15 nt, Mycobacterium avium subsp. paratuberculosis
ggccgcgacgcgcgg

SEQ ID NO: 2960376 - RNA, 13 nt, Mycobacterium avium subsp. paratuberculosis
ggccgcgacgggc

SEQ ID NO: 2960377 - RNA, 16 nt, Mycobacterium avium subsp. paratuberculosis
ggccgcgagcacgacg

SEQ ID NO: 2960378 - RNA, 19 nt, Mycobacterium avium subsp. paratuberculosis
ggccgcgagcacgacgucg

SEQ ID NO: 2960379 - RNA, 21 nt, Mycobacterium avium subsp. paratuberculosis
ggccgcgagcacgacgucgac

SEQ ID NO: 2960380 - RNA, 23 nt, Mycobacterium avium subsp. paratuberculosis
ggccgcgagcacgacgucgacgu

SEQ ID NO: 2960381 - RNA, 19 nt, Mycobacterium avium subsp. paratuberculosis
ggccgcgagcccggcgacg

SEQ ID NO: 2960382 - RNA, 22 nt, Mycobacterium avium subsp. paratuberculosis
ggccgcgagcccggcgacgucg

SEQ ID NO: 2960383 - RNA, 19 nt, Mycobacterium avium subsp. paratuberculosis
ggccgcgagcgcuaccgcg

SEQ ID NO: 2960384 - RNA, 22 nt, Mycobacterium avium subsp. paratuberculosis
ggccgcgagcgcuaccgcgcuc

SEQ ID NO: 2960385 - RNA, 16 nt, Mycobacterium avium subsp. paratuberculosis
ggccgcgauccagcgc

SEQ ID NO: 2960386 - RNA, 17 nt, Mycobacterium avium subsp. paratuberculosis
ggccgcgauccagcgcu

SEQ ID NO: 2960387 - RNA, 19 nt, Mycobacterium avium subsp. paratuberculosis
ggccgcgauccagcgcugg

SEQ ID NO: 2960388 - RNA, 22 nt, Mycobacterium avium subsp. paratuberculosis
ggccgcgauccagcgcuggccg

SEQ ID NO: 2960389 - RNA, 13 nt, Mycobacterium avium subsp. paratuberculosis
ggccgcgaucgcc

SEQ ID NO: 2960390 - RNA, 23 nt, Mycobacterium avium subsp. paratuberculosis
ggccgcgaugucggugggccgca

SEQ ID NO: 2960391 - RNA, 13 nt, Mycobacterium avium subsp. paratuberculosis
ggccgcgcaccgc

SEQ ID NO: 2960392 - RNA, 14 nt, Mycobacterium avium subsp. paratuberculosis
ggccgcgcaccgcc

SEQ ID NO: 2960393 - RNA, 16 nt, Mycobacterium avium subsp. paratuberculosis
ggccgcgcagaucgag

SEQ ID NO: 2960394 - RNA, 21 nt, Mycobacterium avium subsp. paratuberculosis
ggccgcgcagcgugucggggu

SEQ ID NO: 2960395 - RNA, 12 nt, Mycobacterium avium subsp. paratuberculosis
ggccgcgcagcu

SEQ ID NO: 2960396 - RNA, 19 nt, Mycobacterium avium subsp. paratuberculosis
ggccgcgcagcucgacgac

SEQ ID NO: 2960397 - RNA, 21 nt, Mycobacterium avium subsp. paratuberculosis
ggccgcgcagcucgacgaccu

SEQ ID NO: 2960398 - RNA, 17 nt, Mycobacterium avium subsp. paratuberculosis
ggccgcgcagcucgggg

SEQ ID NO: 2960399 - RNA, 18 nt, Mycobacterium avium subsp. paratuberculosis
ggccgcgcagcucggggu

SEQ ID NO: 2960400 - RNA, 13 nt, Mycobacterium avium subsp. paratuberculosis
ggccgcgccacag

SEQ ID NO: 2960401 - RNA, 20 nt, Mycobacterium avium subsp. paratuberculosis
ggccgcgcccaucgcggccg

SEQ ID NO: 2960402 - RNA, 18 nt, Mycobacterium avium subsp. paratuberculosis
ggccgcggucgccccggc

SEQ ID NO: 2960403 - RNA, 20 nt, Mycobacterium avium subsp. paratuberculosis
ggccgcggucgccccggccg

SEQ ID NO: 2960404 - RNA, 14 nt, Mycobacterium avium subsp. paratuberculosis
ggccgcggucucga

SEQ ID NO: 2960405 - RNA, 12 nt, Mycobacterium avium subsp. paratuberculosis
ggccgcggugac

SEQ ID NO: 2960406 - RNA, 17 nt, Mycobacterium avium subsp. paratuberculosis
ggccgcggugaccgcgc

SEQ ID NO: 2960407 - RNA, 13 nt, Mycobacterium avium subsp. paratuberculosis
ggccgcggugcgu

SEQ ID NO: 2960408 - RNA, 17 nt, Mycobacterium avium subsp. paratuberculosis
ggccgcggugugcccgg

SEQ ID NO: 2960409 - RNA, 20 nt, Mycobacterium avium subsp. paratuberculosis
ggccgcguagcucgccgcgg

SEQ ID NO: 2960410 - RNA, 21 nt, Mycobacterium avium subsp. paratuberculosis
ggccgcguagcucgccgcggc

SEQ ID NO: 2960411 - RNA, 23 nt, Mycobacterium avium subsp. paratuberculosis
ggccgcguccucgccguacgcgc

SEQ ID NO: 2960412 - RNA, 16 nt, Mycobacterium avium subsp. paratuberculosis
ggccgcgucgaccagc

SEQ ID NO: 2960413 - RNA, 16 nt, Mycobacterium avium subsp. paratuberculosis
ggccgcgucgccgacc

SEQ ID NO: 2960414 - RNA, 19 nt, Mycobacterium avium subsp. paratuberculosis
ggccgcgucgccgaccagc

SEQ ID NO: 2960415 - RNA, 20 nt, Mycobacterium avium subsp. paratuberculosis
ggccgcgucgccgaccagca

SEQ ID NO: 2960416 - RNA, 21 nt, Mycobacterium avium subsp. paratuberculosis
ggccgcgucgccgaccagcag

SEQ ID NO: 2960417 - RNA, 23 nt, Mycobacterium avium subsp. paratuberculosis
ggccgcgucgccgaccagcagga

SEQ ID NO: 2960418 - RNA, 13 nt, Mycobacterium avium subsp. paratuberculosis
ggccgcgucggcc

SEQ ID NO: 2960419 - RNA, 14 nt, Mycobacterium avium subsp. paratuberculosis
ggccgcgucggcca

SEQ ID NO: 2960420 - RNA, 14 nt, Mycobacterium avium subsp. paratuberculosis
ggccgcgucggcgg

SEQ ID NO: 2960421 - RNA, 15 nt, Mycobacterium avium subsp. paratuberculosis
ggccgcgucggcggc

SEQ ID NO: 2960422 - RNA, 16 nt, Mycobacterium avium subsp. paratuberculosis
ggccgcgucggcggcg

SEQ ID NO: 2960423 - RNA, 17 nt, Mycobacterium avium subsp. paratuberculosis
ggccgcgucggcggucg

SEQ ID NO: 2960424 - RNA, 23 nt, Mycobacterium avium subsp. paratuberculosis
ggccgcgucggcggucgccagcg

SEQ ID NO: 2960425 - RNA, 12 nt, Mycobacterium avium subsp. paratuberculosis
ggccgcgucggg

SEQ ID NO: 2960426 - RNA, 19 nt, Mycobacterium avium subsp. paratuberculosis
ggccgcguuccaggaccug

SEQ ID NO: 2960427 - RNA, 19 nt, Mycobacterium avium subsp. paratuberculosis
ggccgcguugucgaccacc

SEQ ID NO: 2960428 - RNA, 23 nt, Mycobacterium avium subsp. paratuberculosis
ggccgcguugucgaccaccaggu

SEQ ID NO: 2960429 - RNA, 14 nt, Mycobacterium avium subsp. paratuberculosis
ggccgcuacccggc

SEQ ID NO: 2960430 - RNA, 17 nt, Mycobacterium avium subsp. paratuberculosis
ggccgcuacgccgaggc

SEQ ID NO: 2960431 - RNA, 14 nt, Mycobacterium avium subsp. paratuberculosis
ggccgcucagcggg

SEQ ID NO: 2960432 - RNA, 20 nt, Mycobacterium avium subsp. paratuberculosis
ggccgcucagcgggcggcca

SEQ ID NO: 2960433 - RNA, 23 nt, Mycobacterium avium subsp. paratuberculosis
ggccgcucagcgggcggccagcc

SEQ ID NO: 2960434 - RNA, 13 nt, Mycobacterium avium subsp. paratuberculosis
ggccgcucgcggg

SEQ ID NO: 2960435 - RNA, 20 nt, Mycobacterium avium subsp. paratuberculosis
ggccgcucgcgggccacagc

SEQ ID NO: 2960436 - RNA, 22 nt, Mycobacterium avium subsp. paratuberculosis
ggccgcucgggugucgccgagc

SEQ ID NO: 2960437 - RNA, 23 nt, Mycobacterium avium subsp. paratuberculosis
ggccgcucgggugucgccgagcc

SEQ ID NO: 2960438 - RNA, 16 nt, Mycobacterium avium subsp. paratuberculosis
ggccgcugaggauggu

SEQ ID NO: 2960439 - RNA, 20 nt, Mycobacterium avium subsp. paratuberculosis
ggccgcugaggaugguggug

SEQ ID NO: 2960440 - RNA, 21 nt, Mycobacterium avium subsp. paratuberculosis
ggccgcugaggaugguggugc

SEQ ID NO: 2960441 - RNA, 14 nt, Mycobacterium avium subsp. paratuberculosis
ggccgcugcccggc

SEQ ID NO: 2960442 - RNA, 15 nt, Mycobacterium avium subsp. paratuberculosis
ggccgcugcccggcg

SEQ ID NO: 2960443 - RNA, 16 nt, Mycobacterium avium subsp. paratuberculosis
ggccgcugcccggcgc

SEQ ID NO: 2960444 - RNA, 18 nt, Mycobacterium avium subsp. paratuberculosis
ggccgcugcccggcgcua

SEQ ID NO: 2960445 - RNA, 15 nt, Mycobacterium avium subsp. paratuberculosis
ggccgcugcccgggc

SEQ ID NO: 2960446 - RNA, 19 nt, Mycobacterium avium subsp. paratuberculosis
ggccgcugcgcccagcgcg

SEQ ID NO: 2960447 - RNA, 20 nt, Mycobacterium avium subsp. paratuberculosis
ggccgcugcgcccagcgcgc

SEQ ID NO: 2960448 - RNA, 20 nt, Mycobacterium avium subsp. paratuberculosis
ggccgcugcgggcgggccgc

SEQ ID NO: 2960449 - RNA, 12 nt, Mycobacterium avium subsp. paratuberculosis
ggccgcuggccg

SEQ ID NO: 2960450 - RNA, 14 nt, Mycobacterium avium subsp. paratuberculosis
ggccgcuggccgcc

SEQ ID NO: 2960451 - RNA, 21 nt, Mycobacterium avium subsp. paratuberculosis
ggccgcuggcguugagcacgc

SEQ ID NO: 2960452 - RNA, 21 nt, Mycobacterium avium subsp. paratuberculosis
ggccgcuggugaggucgcgca

SEQ ID NO: 2960453 - RNA, 17 nt, Mycobacterium avium subsp. paratuberculosis
ggccgcugguggugauc

SEQ ID NO: 2960454 - RNA, 21 nt, Mycobacterium avium subsp. paratuberculosis
ggccgcugguggugaucaccc

SEQ ID NO: 2960455 - RNA, 15 nt, Mycobacterium avium subsp. paratuberculosis
ggccgcuucccaccc

SEQ ID NO: 2960456 - RNA, 16 nt, Mycobacterium avium subsp. paratuberculosis
ggccgcuucccacccg

SEQ ID NO: 2960457 - RNA, 18 nt, Mycobacterium avium subsp. paratuberculosis
ggccgcuucccacccggu

SEQ ID NO: 2960458 - RNA, 19 nt, Mycobacterium avium subsp. paratuberculosis
ggccgcuucggggugguug

SEQ ID NO: 2960459 - RNA, 18 nt, Mycobacterium avium subsp. paratuberculosis
ggccgcuuguucgggccc

SEQ ID NO: 2960460 - RNA, 15 nt, Mycobacterium avium subsp. paratuberculosis
ggccgcuuuccaccc

SEQ ID NO: 2960461 - RNA, 20 nt, Mycobacterium avium subsp. paratuberculosis
ggccgcuuuccaccccggcg

SEQ ID NO: 2960462 - RNA, 21 nt, Mycobacterium avium subsp. paratuberculosis
ggccgcuuuccaccccggcgg

SEQ ID NO: 2960463 - RNA, 23 nt, Mycobacterium avium subsp. paratuberculosis
ggccgcuuuccaccccggcgguc

SEQ ID NO: 2960464 - RNA, 24 nt, Mycobacterium avium subsp. paratuberculosis
ggccgcuuuccaccccggcggucg

SEQ ID NO: 2960465 - RNA, 16 nt, Mycobacterium avium subsp. paratuberculosis
ggccggaaaggcguga

SEQ ID NO: 2960466 - RNA, 19 nt, Mycobacterium avium subsp. paratuberculosis
ggccggaacagcugguccc

SEQ ID NO: 2960467 - RNA, 17 nt, Mycobacterium avium subsp. paratuberculosis
ggccggaaggucauagg

SEQ ID NO: 2960468 - RNA, 21 nt, Mycobacterium avium subsp. paratuberculosis
ggccggaaggucauagggcuc

SEQ ID NO: 2960469 - RNA, 14 nt, Mycobacterium avium subsp. paratuberculosis
ggccggaaucgcgg

SEQ ID NO: 2960470 - RNA, 13 nt, Mycobacterium avium subsp. paratuberculosis
ggccggacagcgg

SEQ ID NO: 2960471 - RNA, 15 nt, Mycobacterium avium subsp. paratuberculosis
ggccggacagcggcc

SEQ ID NO: 2960472 - RNA, 16 nt, Mycobacterium avium subsp. paratuberculosis
ggccggacagcggccc

SEQ ID NO: 2960473 - RNA, 15 nt, Mycobacterium avium subsp. paratuberculosis
ggccggacaggucga

SEQ ID NO: 2960474 - RNA, 22 nt, Mycobacterium avium subsp. paratuberculosis
ggccggaccacccagguggaug

SEQ ID NO: 2960475 - RNA, 14 nt, Mycobacterium avium subsp. paratuberculosis
ggccggacgggucg

SEQ ID NO: 2960476 - RNA, 21 nt, Mycobacterium avium subsp. paratuberculosis
ggccggacgggucgaccgccg

SEQ ID NO: 2960477 - RNA, 15 nt, Mycobacterium avium subsp. paratuberculosis
ggccggagaccgccg

SEQ ID NO: 2960478 - RNA, 19 nt, Mycobacterium avium subsp. paratuberculosis
ggccggagaccgccguggc

SEQ ID NO: 2960479 - RNA, 14 nt, Mycobacterium avium subsp. paratuberculosis
ggccggagaucccg

SEQ ID NO: 2960480 - RNA, 20 nt, Mycobacterium avium subsp. paratuberculosis
ggccggagccgaccucggcg

SEQ ID NO: 2960481 - RNA, 23 nt, Mycobacterium avium subsp. paratuberculosis
ggccggagccgaccucggcgacg

SEQ ID NO: 2960482 - RNA, 12 nt, Mycobacterium avium subsp. paratuberculosis
ggccggagccuu

SEQ ID NO: 2960483 - RNA, 22 nt, Mycobacterium avium subsp. paratuberculosis
ggccggagccuucuucgccgca

SEQ ID NO: 2960484 - RNA, 22 nt, Mycobacterium avium subsp. paratuberculosis
ggccggagccuuggucgcggcc

SEQ ID NO: 2960485 - RNA, 23 nt, Mycobacterium avium subsp. paratuberculosis
ggccggagccuuggucgcggccu

SEQ ID NO: 2960486 - RNA, 20 nt, Mycobacterium avium subsp. paratuberculosis
ggccggcgaggugggcacca

SEQ ID NO: 2960487 - RNA, 17 nt, Mycobacterium avium subsp. paratuberculosis
ggccggcgagucgcgga

SEQ ID NO: 2960488 - RNA, 23 nt, Mycobacterium avium subsp. paratuberculosis
ggccggcgaugcccgugaucgcc

SEQ ID NO: 2960489 - RNA, 16 nt, Mycobacterium avium subsp. paratuberculosis
ggccggcgauggcgcg

SEQ ID NO: 2960490 - RNA, 20 nt, Mycobacterium avium subsp. paratuberculosis
ggccggcgauggcgcggccg

SEQ ID NO: 2960491 - RNA, 14 nt, Mycobacterium avium subsp. paratuberculosis
ggccggcgcagccg

SEQ ID NO: 2960492 - RNA, 20 nt, Mycobacterium avium subsp. paratuberculosis
ggccggcgcagccggccacc

SEQ ID NO: 2960493 - RNA, 21 nt, Mycobacterium avium subsp. paratuberculosis
ggccggcgcagccggccaccg

SEQ ID NO: 2960494 - RNA, 21 nt, Mycobacterium avium subsp. paratuberculosis
ggccggcgccgaagccgucga

SEQ ID NO: 2960495 - RNA, 17 nt, Mycobacterium avium subsp. paratuberculosis
ggccggcgccgaccgag

SEQ ID NO: 2960496 - RNA, 20 nt, Mycobacterium avium subsp. paratuberculosis
ggccggcgccgaccgagggc

SEQ ID NO: 2960497 - RNA, 16 nt, Mycobacterium avium subsp. paratuberculosis
ggccggcgccgacgac

SEQ ID NO: 2960498 - RNA, 17 nt, Mycobacterium avium subsp. paratuberculosis
ggccggcgccgacgacg

SEQ ID NO: 2960499 - RNA, 17 nt, Mycobacterium avium subsp. paratuberculosis
ggccggcgccgccgggg

SEQ ID NO: 2960500 - RNA, 13 nt, Mycobacterium avium subsp. paratuberculosis
ggccggcgccgcg

SEQ ID NO: 2960501 - RNA, 15 nt, Mycobacterium avium subsp. paratuberculosis
ggccggcgccgcggg

SEQ ID NO: 2960502 - RNA, 18 nt, Mycobacterium avium subsp. paratuberculosis
ggccggcgccgcgggugc

SEQ ID NO: 2960503 - RNA, 22 nt, Mycobacterium avium subsp. paratuberculosis
ggccggcgccgcgggugcggca

SEQ ID NO: 2960504 - RNA, 23 nt, Mycobacterium avium subsp. paratuberculosis
ggccggcgccgcgggugcggcac

SEQ ID NO: 2960505 - RNA, 14 nt, Mycobacterium avium subsp. paratuberculosis
ggccggcgccggcg

SEQ ID NO: 2960506 - RNA, 16 nt, Mycobacterium avium subsp. paratuberculosis
ggccggcgccggcggu

SEQ ID NO: 2960507 - RNA, 17 nt, Mycobacterium avium subsp. paratuberculosis
ggccggcgccggcgguc

SEQ ID NO: 2960508 - RNA, 18 nt, Mycobacterium avium subsp. paratuberculosis
ggccggcgccggcgguca

SEQ ID NO: 2960509 - RNA, 20 nt, Mycobacterium avium subsp. paratuberculosis
ggccggcgccggcggucagc

SEQ ID NO: 2960510 - RNA, 15 nt, Mycobacterium avium subsp. paratuberculosis
ggccggcgccggugc

SEQ ID NO: 2960511 - RNA, 19 nt, Mycobacterium avium subsp. paratuberculosis
ggccggcgccggugccgca

SEQ ID NO: 2960512 - RNA, 17 nt, Mycobacterium avium subsp. paratuberculosis
ggccggcgcgaccagcg

SEQ ID NO: 2960513 - RNA, 16 nt, Mycobacterium avium subsp. paratuberculosis
ggccggcgcgcacggc

SEQ ID NO: 2960514 - RNA, 15 nt, Mycobacterium avium subsp. paratuberculosis
ggccggcgcggcggc

SEQ ID NO: 2960515 - RNA, 16 nt, Mycobacterium avium subsp. paratuberculosis
ggccggcgcggcggcg

SEQ ID NO: 2960516 - RNA, 22 nt, Mycobacterium avium subsp. paratuberculosis
ggccggcgcggcggcgacgucg

SEQ ID NO: 2960517 - RNA, 20 nt, Mycobacterium avium subsp. paratuberculosis
ggccggcgcgugcgcgacga

SEQ ID NO: 2960518 - RNA, 21 nt, Mycobacterium avium subsp. paratuberculosis
ggccggcgcuggcgugcuuga

SEQ ID NO: 2960519 - RNA, 11 nt, Mycobacterium avium subsp. paratuberculosis
ggccggcggac

SEQ ID NO: 2960520 - RNA, 15 nt, Mycobacterium avium subsp. paratuberculosis
ggccggcggacgcgg

SEQ ID NO: 2960521 - RNA, 13 nt, Mycobacterium avium subsp. paratuberculosis
ggccggcggcggc

SEQ ID NO: 2960522 - RNA, 15 nt, Mycobacterium avium subsp. paratuberculosis
ggccggcggcggcca

SEQ ID NO: 2960523 - RNA, 21 nt, Mycobacterium avium subsp. paratuberculosis
ggccggcggcggccagcgagu

SEQ ID NO: 2960524 - RNA, 15 nt, Mycobacterium avium subsp. paratuberculosis
ggccggcgggcagca

SEQ ID NO: 2960525 - RNA, 12 nt, Mycobacterium avium subsp. paratuberculosis
ggccggcggggc

SEQ ID NO: 2960526 - RNA, 18 nt, Mycobacterium avium subsp. paratuberculosis
ggccggcggggcgggggc

SEQ ID NO: 2960527 - RNA, 14 nt, Mycobacterium avium subsp. paratuberculosis
ggccggcgggggcg

SEQ ID NO: 2960528 - RNA, 23 nt, Mycobacterium avium subsp. paratuberculosis
ggccggcgggggcgcguccgcgg

SEQ ID NO: 2960529 - RNA, 22 nt, Mycobacterium avium subsp. paratuberculosis
ggccggcggugauccgcccggc

SEQ ID NO: 2960530 - RNA, 13 nt, Mycobacterium avium subsp. paratuberculosis
ggccggcgguguc

SEQ ID NO: 2960531 - RNA, 14 nt, Mycobacterium avium subsp. paratuberculosis
ggccggcggugucg

SEQ ID NO: 2960532 - RNA, 22 nt, Mycobacterium avium subsp. paratuberculosis
ggccggcgucacucuggcguga

SEQ ID NO: 2960533 - RNA, 15 nt, Mycobacterium avium subsp. paratuberculosis
ggccggcguccaggc

SEQ ID NO: 2960534 - RNA, 21 nt, Mycobacterium avium subsp. paratuberculosis
ggccggcguccaguugcggca

SEQ ID NO: 2960535 - RNA, 22 nt, Mycobacterium avium subsp. paratuberculosis
ggccggcguccaguugcggcac

SEQ ID NO: 2960536 - RNA, 14 nt, Mycobacterium avium subsp. paratuberculosis
ggccggcgucgcgg

SEQ ID NO: 2960537 - RNA, 19 nt, Mycobacterium avium subsp. paratuberculosis
ggccggcgucgucgagcac

SEQ ID NO: 2960538 - RNA, 17 nt, Mycobacterium avium subsp. paratuberculosis
ggccggcuaccgcgcgg

SEQ ID NO: 2960539 - RNA, 19 nt, Mycobacterium avium subsp. paratuberculosis
ggccggcucgaccucaccc

SEQ ID NO: 2960540 - RNA, 16 nt, Mycobacterium avium subsp. paratuberculosis
ggccggcugcagccgg

SEQ ID NO: 2960541 - RNA, 17 nt, Mycobacterium avium subsp. paratuberculosis
ggccggcuucucggcgu

SEQ ID NO: 2960542 - RNA, 18 nt, Mycobacterium avium subsp. paratuberculosis
ggccggcuucucggcgug

SEQ ID NO: 2960543 - RNA, 23 nt, Mycobacterium avium subsp. paratuberculosis
ggccggcuucucggcgugcccgc

SEQ ID NO: 2960544 - RNA, 17 nt, Mycobacterium avium subsp. paratuberculosis
ggccgggaaugucgcgc

SEQ ID NO: 2960545 - RNA, 20 nt, Mycobacterium avium subsp. paratuberculosis
ggccgggaaugucgcgcagc

SEQ ID NO: 2960546 - RNA, 22 nt, Mycobacterium avium subsp. paratuberculosis
ggccgggagugcuggacggccc

SEQ ID NO: 2960547 - RNA, 18 nt, Mycobacterium avium subsp. paratuberculosis
ggccgggauagagcaccg

SEQ ID NO: 2960548 - RNA, 16 nt, Mycobacterium avium subsp. paratuberculosis
ggccgggaucuggccg

SEQ ID NO: 2960549 - RNA, 22 nt, Mycobacterium avium subsp. paratuberculosis
ggccgggaucuggccggugagc

SEQ ID NO: 2960550 - RNA, 16 nt, Mycobacterium avium subsp. paratuberculosis
ggccgggaugccaguc

SEQ ID NO: 2960551 - RNA, 16 nt, Mycobacterium avium subsp. paratuberculosis
ggccgggaugccgccg

SEQ ID NO: 2960552 - RNA, 20 nt, Mycobacterium avium subsp. paratuberculosis
ggccgggaugccgccgguca

SEQ ID NO: 2960553 - RNA, 18 nt, Mycobacterium avium subsp. paratuberculosis
ggccgggauuucccgggc

SEQ ID NO: 2960554 - RNA, 14 nt, Mycobacterium avium subsp. paratuberculosis
ggccgggcaccgcg

SEQ ID NO: 2960555 - RNA, 15 nt, Mycobacterium avium subsp. paratuberculosis
ggccgggcacgucga

SEQ ID NO: 2960556 - RNA, 18 nt, Mycobacterium avium subsp. paratuberculosis
ggccgggcacgucgacgc

SEQ ID NO: 2960557 - RNA, 23 nt, Mycobacterium avium subsp. paratuberculosis
ggccgggcacgucgacgcccugc

SEQ ID NO: 2960558 - RNA, 13 nt, Mycobacterium avium subsp. paratuberculosis
ggccgggcagugc

SEQ ID NO: 2960559 - RNA, 15 nt, Mycobacterium avium subsp. paratuberculosis
ggccgggcagugcgc

SEQ ID NO: 2960560 - RNA, 20 nt, Mycobacterium avium subsp. paratuberculosis
ggccgggcagugcgcggcgu

SEQ ID NO: 2960561 - RNA, 15 nt, Mycobacterium avium subsp. paratuberculosis
ggccgggccgcggcg

SEQ ID NO: 2960562 - RNA, 15 nt, Mycobacterium avium subsp. paratuberculosis
ggccgggcgacugcg

SEQ ID NO: 2960563 - RNA, 17 nt, Mycobacterium avium subsp. paratuberculosis
ggccgggcgccccgaca

SEQ ID NO: 2960564 - RNA, 13 nt, Mycobacterium avium subsp. paratuberculosis
ggccgggcgcugg

SEQ ID NO: 2960565 - RNA, 13 nt, Mycobacterium avium subsp. paratuberculosis
ggccgggcggaag

SEQ ID NO: 2960566 - RNA, 20 nt, Mycobacterium avium subsp. paratuberculosis
ggccgggcggaagucggugc

SEQ ID NO: 2960567 - RNA, 16 nt, Mycobacterium avium subsp. paratuberculosis
ggccgggcggacggca

SEQ ID NO: 2960568 - RNA, 19 nt, Mycobacterium avium subsp. paratuberculosis
ggccgggcggccggagccg

SEQ ID NO: 2960569 - RNA, 18 nt, Mycobacterium avium subsp. paratuberculosis
ggccgggcgggcacccca

SEQ ID NO: 2960570 - RNA, 14 nt, Mycobacterium avium subsp. paratuberculosis
ggccgggcgguuuc

SEQ ID NO: 2960571 - RNA, 21 nt, Mycobacterium avium subsp. paratuberculosis
ggccguagcguugccggccga

SEQ ID NO: 2960572 - RNA, 18 nt, Mycobacterium avium subsp. paratuberculosis
ggccguaggucgggucga

SEQ ID NO: 2960573 - RNA, 16 nt, Mycobacterium avium subsp. paratuberculosis
ggccguauacgccaga

SEQ ID NO: 2960574 - RNA, 17 nt, Mycobacterium avium subsp. paratuberculosis
ggccguauacgccagau

SEQ ID NO: 2960575 - RNA, 18 nt, Mycobacterium avium subsp. paratuberculosis
ggccguauacgccagaug

SEQ ID NO: 2960576 - RNA, 20 nt, Mycobacterium avium subsp. paratuberculosis
ggccguauacgccagaugcg

SEQ ID NO: 2960577 - RNA, 23 nt, Mycobacterium avium subsp. paratuberculosis
ggccguaucccaccacgaagucg

SEQ ID NO: 2960578 - RNA, 14 nt, Mycobacterium avium subsp. paratuberculosis
ggccguaucggccc

SEQ ID NO: 2960579 - RNA, 22 nt, Mycobacterium avium subsp. paratuberculosis
ggccguaucggccccggccgag

SEQ ID NO: 2960580 - RNA, 18 nt, Mycobacterium avium subsp. paratuberculosis
ggccgucacaggccgccu

SEQ ID NO: 2960581 - RNA, 22 nt, Mycobacterium avium subsp. paratuberculosis
ggccgucacaggccgccugcgg

SEQ ID NO: 2960582 - RNA, 19 nt, Mycobacterium avium subsp. paratuberculosis
ggccgucaggagugcucgg

SEQ ID NO: 2960583 - RNA, 21 nt, Mycobacterium avium subsp. paratuberculosis
ggccgucaggagugcucggcg

SEQ ID NO: 2960584 - RNA, 16 nt, Mycobacterium avium subsp. paratuberculosis
ggccgucaucgccgac

SEQ ID NO: 2960585 - RNA, 19 nt, Mycobacterium avium subsp. paratuberculosis
ggccgucaucgccgacggu

SEQ ID NO: 2960586 - RNA, 15 nt, Mycobacterium avium subsp. paratuberculosis
ggccguccaccacca

SEQ ID NO: 2960587 - RNA, 22 nt, Mycobacterium avium subsp. paratuberculosis
ggccguccaccaccaacccggu

SEQ ID NO: 2960588 - RNA, 13 nt, Mycobacterium avium subsp. paratuberculosis
ggccguccaccag

SEQ ID NO: 2960589 - RNA, 23 nt, Mycobacterium avium subsp. paratuberculosis
ggccguccaccagaucgccccgc

SEQ ID NO: 2960590 - RNA, 14 nt, Mycobacterium avium subsp. paratuberculosis
ggccguccacggcg

SEQ ID NO: 2960591 - RNA, 15 nt, Mycobacterium avium subsp. paratuberculosis
ggccguccacggcgg

SEQ ID NO: 2960592 - RNA, 16 nt, Mycobacterium avium subsp. paratuberculosis
ggccguccacggcggu

SEQ ID NO: 2960593 - RNA, 18 nt, Mycobacterium avium subsp. paratuberculosis
ggccguccacggcggugg

SEQ ID NO: 2960594 - RNA, 17 nt, Mycobacterium avium subsp. paratuberculosis
ggccguccagcgucugg

SEQ ID NO: 2960595 - RNA, 16 nt, Mycobacterium avium subsp. paratuberculosis
ggccguccaggcgcca

SEQ ID NO: 2960596 - RNA, 13 nt, Mycobacterium avium subsp. paratuberculosis
ggccguccauccc

SEQ ID NO: 2960597 - RNA, 14 nt, Mycobacterium avium subsp. paratuberculosis
ggccguccgccggc

SEQ ID NO: 2960598 - RNA, 16 nt, Mycobacterium avium subsp. paratuberculosis
ggccguccgccggcug

SEQ ID NO: 2960599 - RNA, 23 nt, Mycobacterium avium subsp. paratuberculosis
ggccguccggauagccgucggcg

SEQ ID NO: 2960600 - RNA, 15 nt, Mycobacterium avium subsp. paratuberculosis
ggccguccgggugcg

SEQ ID NO: 2960601 - RNA, 19 nt, Mycobacterium avium subsp. paratuberculosis
ggccgucgaacugcagccg

SEQ ID NO: 2960602 - RNA, 15 nt, Mycobacterium avium subsp. paratuberculosis
ggccgucgccgggcg

SEQ ID NO: 2960603 - RNA, 13 nt, Mycobacterium avium subsp. paratuberculosis
ggccgucgccggu

SEQ ID NO: 2960604 - RNA, 14 nt, Mycobacterium avium subsp. paratuberculosis
ggccgucgccgguc

SEQ ID NO: 2960605 - RNA, 16 nt, Mycobacterium avium subsp. paratuberculosis
ggccgucgccucgccc

SEQ ID NO: 2960606 - RNA, 18 nt, Mycobacterium avium subsp. paratuberculosis
ggccgucgcgcaccaccu

SEQ ID NO: 2960607 - RNA, 16 nt, Mycobacterium avium subsp. paratuberculosis
ggccgucgcgcagccu

SEQ ID NO: 2960608 - RNA, 13 nt, Mycobacterium avium subsp. paratuberculosis
ggccgucgcggcg

SEQ ID NO: 2960609 - RNA, 22 nt, Mycobacterium avium subsp. paratuberculosis
ggccgucgcggcgaucgcgagc

SEQ ID NO: 2960610 - RNA, 14 nt, Mycobacterium avium subsp. paratuberculosis
ggccgucgcggcgc

SEQ ID NO: 2960611 - RNA, 11 nt, Mycobacterium avium subsp. paratuberculosis
ggccgucggcc

SEQ ID NO: 2960612 - RNA, 12 nt, Mycobacterium avium subsp. paratuberculosis
ggccgucggcga

SEQ ID NO: 2960613 - RNA, 13 nt, Mycobacterium avium subsp. paratuberculosis
ggccgucggcgau

SEQ ID NO: 2960614 - RNA, 15 nt, Mycobacterium avium subsp. paratuberculosis
ggccgucggcgaugg

SEQ ID NO: 2960615 - RNA, 12 nt, Mycobacterium avium subsp. paratuberculosis
ggccgucggcgc

SEQ ID NO: 2960616 - RNA, 14 nt, Mycobacterium avium subsp. paratuberculosis
ggccgucggcgccg

SEQ ID NO: 2960617 - RNA, 15 nt, Mycobacterium avium subsp. paratuberculosis
ggccgucggcgccgc

SEQ ID NO: 2960618 - RNA, 16 nt, Mycobacterium avium subsp. paratuberculosis
ggccgucggcgccgcc

SEQ ID NO: 2960619 - RNA, 17 nt, Mycobacterium avium subsp. paratuberculosis
ggccgucggcgccgccg

SEQ ID NO: 2960620 - RNA, 18 nt, Mycobacterium avium subsp. paratuberculosis
ggccgucggcgccgccga

SEQ ID NO: 2960621 - RNA, 17 nt, Mycobacterium avium subsp. paratuberculosis
ggccgucggcgcggccg

SEQ ID NO: 2960622 - RNA, 22 nt, Mycobacterium avium subsp. paratuberculosis
ggccgucggcgcggccggaucg

SEQ ID NO: 2960623 - RNA, 21 nt, Mycobacterium avium subsp. paratuberculosis
ggccgucggggaugccgaacc

SEQ ID NO: 2960624 - RNA, 20 nt, Mycobacterium avium subsp. paratuberculosis
ggccgucgggucggcgagca

SEQ ID NO: 2960625 - RNA, 21 nt, Mycobacterium avium subsp. paratuberculosis
ggccgucgggucggcgagcag

SEQ ID NO: 2960626 - RNA, 22 nt, Mycobacterium avium subsp. paratuberculosis
ggccgucgggucggcgagcagc

SEQ ID NO: 2960627 - RNA, 20 nt, Mycobacterium avium subsp. paratuberculosis
ggccgucgguggccgguauc

SEQ ID NO: 2960628 - RNA, 21 nt, Mycobacterium avium subsp. paratuberculosis
ggccgucgucgaggccgaacc

SEQ ID NO: 2960629 - RNA, 15 nt, Mycobacterium avium subsp. paratuberculosis
ggccgucgucgugca

SEQ ID NO: 2960630 - RNA, 21 nt, Mycobacterium avium subsp. paratuberculosis
ggccgucgucgugcaccacga

SEQ ID NO: 2960631 - RNA, 14 nt, Mycobacterium avium subsp. paratuberculosis
ggccgucucgagcc

SEQ ID NO: 2960632 - RNA, 19 nt, Mycobacterium avium subsp. paratuberculosis
ggccgucucgagccggcgc

SEQ ID NO: 2960633 - RNA, 19 nt, Mycobacterium avium subsp. paratuberculosis
ggccgucucgucggccgcg

SEQ ID NO: 2960634 - RNA, 20 nt, Mycobacterium avium subsp. paratuberculosis
ggccgucucgucggccgcga

SEQ ID NO: 2960635 - RNA, 16 nt, Mycobacterium avium subsp. paratuberculosis
ggccgucuugcccggc

SEQ ID NO: 2960636 - RNA, 18 nt, Mycobacterium avium subsp. paratuberculosis
ggccgucuugcccggcga

SEQ ID NO: 2960637 - RNA, 19 nt, Mycobacterium avium subsp. paratuberculosis
ggccgucuugcccggcgag

SEQ ID NO: 2960638 - RNA, 20 nt, Mycobacterium avium subsp. paratuberculosis
ggccgucuugcccggcgagc

SEQ ID NO: 2960639 - RNA, 19 nt, Mycobacterium avium subsp. paratuberculosis
ggccgugaaauaucccgau

SEQ ID NO: 2960640 - RNA, 18 nt, Mycobacterium avium subsp. paratuberculosis
ggccgugaaccggcguug

SEQ ID NO: 2960641 - RNA, 19 nt, Mycobacterium avium subsp. paratuberculosis
ggccgugaaccggcguugc

SEQ ID NO: 2960642 - RNA, 17 nt, Mycobacterium avium subsp. paratuberculosis
ggccgugaagggguccg

SEQ ID NO: 2960643 - RNA, 13 nt, Mycobacterium avium subsp. paratuberculosis
ggccgugaucggc

SEQ ID NO: 2960644 - RNA, 18 nt, Mycobacterium avium subsp. paratuberculosis
ggccgugaucggccagcc

SEQ ID NO: 2960645 - RNA, 20 nt, Mycobacterium avium subsp. paratuberculosis
ggccgugaucggccagccac

SEQ ID NO: 2960646 - RNA, 20 nt, Mycobacterium avium subsp. paratuberculosis
ggccgugaucucgugccgca

SEQ ID NO: 2960647 - RNA, 23 nt, Mycobacterium avium subsp. paratuberculosis
ggccgugaucucgugccgcaccc

SEQ ID NO: 2960648 - RNA, 16 nt, Mycobacterium avium subsp. paratuberculosis
ggccgugaugccgggc

SEQ ID NO: 2960649 - RNA, 20 nt, Mycobacterium avium subsp. paratuberculosis
ggccgugaugcgccggcggu

SEQ ID NO: 2960650 - RNA, 21 nt, Mycobacterium avium subsp. paratuberculosis
ggccgugaugcgccggcgguc

SEQ ID NO: 2960651 - RNA, 19 nt, Mycobacterium avium subsp. paratuberculosis
ggccgugcaccgucgccgg

SEQ ID NO: 2960652 - RNA, 21 nt, Mycobacterium avium subsp. paratuberculosis
ggccgugcaccgucgccggcg

SEQ ID NO: 2960653 - RNA, 22 nt, Mycobacterium avium subsp. paratuberculosis
ggccgugcagggggcgcagccg

SEQ ID NO: 2960654 - RNA, 22 nt, Mycobacterium avium subsp. paratuberculosis
ggccgugccgccauacccacaa

SEQ ID NO: 2960655 - RNA, 14 nt, Mycobacterium avium subsp. paratuberculosis
ggccucgggcgacg

SEQ ID NO: 2960656 - RNA, 17 nt, Mycobacterium avium subsp. paratuberculosis
ggccucgggggugaagg

SEQ ID NO: 2960657 - RNA, 19 nt, Mycobacterium avium subsp. paratuberculosis
ggccucggugcucaucagc

SEQ ID NO: 2960658 - RNA, 16 nt, Mycobacterium avium subsp. paratuberculosis
ggccucgguggcggug

SEQ ID NO: 2960659 - RNA, 17 nt, Mycobacterium avium subsp. paratuberculosis
ggccucgguggcggugg

SEQ ID NO: 2960660 - RNA, 19 nt, Mycobacterium avium subsp. paratuberculosis
ggccucgguggcgguggcc

SEQ ID NO: 2960661 - RNA, 24 nt, Mycobacterium avium subsp. paratuberculosis
ggccucgguuucgaacugggucug

SEQ ID NO: 2960662 - RNA, 14 nt, Mycobacterium avium subsp. paratuberculosis
ggccucgucgaugu

SEQ ID NO: 2960663 - RNA, 15 nt, Mycobacterium avium subsp. paratuberculosis
ggccucgucgauguc

SEQ ID NO: 2960664 - RNA, 20 nt, Mycobacterium avium subsp. paratuberculosis
ggccucgucgaugucggcgg

SEQ ID NO: 2960665 - RNA, 16 nt, Mycobacterium avium subsp. paratuberculosis
ggccucgucgccgcgg

SEQ ID NO: 2960666 - RNA, 13 nt, Mycobacterium avium subsp. paratuberculosis
ggccucgucggcg

SEQ ID NO: 2960667 - RNA, 14 nt, Mycobacterium avium subsp. paratuberculosis
ggccucgucggcga

SEQ ID NO: 2960668 - RNA, 16 nt, Mycobacterium avium subsp. paratuberculosis
ggccucgucggcgagc

SEQ ID NO: 2960669 - RNA, 14 nt, Mycobacterium avium subsp. paratuberculosis
ggccucgucgucgu

SEQ ID NO: 2960670 - RNA, 17 nt, Mycobacterium avium subsp. paratuberculosis
ggccucgucgucgucga

SEQ ID NO: 2960671 - RNA, 22 nt, Mycobacterium avium subsp. paratuberculosis
ggccucgucgucgucgagcacg

SEQ ID NO: 2960672 - RNA, 23 nt, Mycobacterium avium subsp. paratuberculosis
ggccucguggaaaucgagcgcgc

SEQ ID NO: 2960673 - RNA, 17 nt, Mycobacterium avium subsp. paratuberculosis
ggccucguugaccgggu

SEQ ID NO: 2960674 - RNA, 23 nt, Mycobacterium avium subsp. paratuberculosis
ggccucguugaccgggucgccga

SEQ ID NO: 2960675 - RNA, 16 nt, Mycobacterium avium subsp. paratuberculosis
ggccucucgucgacga

SEQ ID NO: 2960676 - RNA, 17 nt, Mycobacterium avium subsp. paratuberculosis
ggccucucgucgacgau

SEQ ID NO: 2960677 - RNA, 15 nt, Mycobacterium avium subsp. paratuberculosis
ggccugacugaguca

SEQ ID NO: 2960678 - RNA, 22 nt, Mycobacterium avium subsp. paratuberculosis
ggccugacugagucaagccggc

SEQ ID NO: 2960679 - RNA, 16 nt, Mycobacterium avium subsp. paratuberculosis
ggccugagacgacgcc

SEQ ID NO: 2960680 - RNA, 18 nt, Mycobacterium avium subsp. paratuberculosis
ggccugagacgacgccac

SEQ ID NO: 2960681 - RNA, 21 nt, Mycobacterium avium subsp. paratuberculosis
ggccugagccgccggggcgcc

SEQ ID NO: 2960682 - RNA, 19 nt, Mycobacterium avium subsp. paratuberculosis
ggccugauugacggcccac

SEQ ID NO: 2960683 - RNA, 17 nt, Mycobacterium avium subsp. paratuberculosis
ggccugcaacuggucgu

SEQ ID NO: 2960684 - RNA, 13 nt, Mycobacterium avium subsp. paratuberculosis
ggccugcaccacc

SEQ ID NO: 2960685 - RNA, 13 nt, Mycobacterium avium subsp. paratuberculosis
ggccugcaccucg

SEQ ID NO: 2960686 - RNA, 20 nt, Mycobacterium avium subsp. paratuberculosis
ggccugcacggugcgccggc

SEQ ID NO: 2960687 - RNA, 22 nt, Mycobacterium avium subsp. paratuberculosis
ggccugcacggugcgccggcag

SEQ ID NO: 2960688 - RNA, 14 nt, Mycobacterium avium subsp. paratuberculosis
ggccugcacgucgg

SEQ ID NO: 2960689 - RNA, 16 nt, Mycobacterium avium subsp. paratuberculosis
ggccugcacgucggcg

SEQ ID NO: 2960690 - RNA, 23 nt, Mycobacterium avium subsp. paratuberculosis
ggccugcacgucggcgcgcaggc

SEQ ID NO: 2960691 - RNA, 21 nt, Mycobacterium avium subsp. paratuberculosis
ggccugcagcaacucgcgcuc

SEQ ID NO: 2960692 - RNA, 13 nt, Mycobacterium avium subsp. paratuberculosis
ggccugcagcacc

SEQ ID NO: 2960693 - RNA, 16 nt, Mycobacterium avium subsp. paratuberculosis
ggccugcagcaccagg

SEQ ID NO: 2960694 - RNA, 16 nt, Mycobacterium avium subsp. paratuberculosis
ggccugcagcaccgaa

SEQ ID NO: 2960695 - RNA, 22 nt, Mycobacterium avium subsp. paratuberculosis
ggccugcagcucggugcgcacc

SEQ ID NO: 2960696 - RNA, 14 nt, Mycobacterium avium subsp. paratuberculosis
ggccugccaccgcg

SEQ ID NO: 2960697 - RNA, 15 nt, Mycobacterium avium subsp. paratuberculosis
ggccugcccgccgcg

SEQ ID NO: 2960698 - RNA, 16 nt, Mycobacterium avium subsp. paratuberculosis
ggccugcccgccgcgg

SEQ ID NO: 2960699 - RNA, 21 nt, Mycobacterium avium subsp. paratuberculosis
ggccugcccgccgcggccgcu

SEQ ID NO: 2960700 - RNA, 18 nt, Mycobacterium avium subsp. paratuberculosis
ggccugcccgcggguggc

SEQ ID NO: 2960701 - RNA, 21 nt, Mycobacterium avium subsp. paratuberculosis
ggccugcccgcggguggccuu

SEQ ID NO: 2960702 - RNA, 15 nt, Mycobacterium avium subsp. paratuberculosis
ggccugcccggcggu

SEQ ID NO: 2960703 - RNA, 20 nt, Mycobacterium avium subsp. paratuberculosis
ggccugcccggcggugccga

SEQ ID NO: 2960704 - RNA, 16 nt, Mycobacterium avium subsp. paratuberculosis
ggccugccggccgccg

SEQ ID NO: 2960705 - RNA, 20 nt, Mycobacterium avium subsp. paratuberculosis
ggccugccggccgccgcgca

SEQ ID NO: 2960706 - RNA, 19 nt, Mycobacterium avium subsp. paratuberculosis
ggccugcgacuucuacggc

SEQ ID NO: 2960707 - RNA, 21 nt, Mycobacterium avium subsp. paratuberculosis
ggccugcgacuucuacggcgg

SEQ ID NO: 2960708 - RNA, 22 nt, Mycobacterium avium subsp. paratuberculosis
ggccugcgacuucuacggcggg

SEQ ID NO: 2960709 - RNA, 23 nt, Mycobacterium avium subsp. paratuberculosis
ggccugcgacuucuacggcgggc

SEQ ID NO: 2960710 - RNA, 17 nt, Mycobacterium avium subsp. paratuberculosis
ggccugcgccuuggccu

SEQ ID NO: 2960711 - RNA, 14 nt, Mycobacterium avium subsp. paratuberculosis
ggccugcgcgccga

SEQ ID NO: 2960712 - RNA, 18 nt, Mycobacterium avium subsp. paratuberculosis
ggccugcgcgccgaugug

SEQ ID NO: 2960713 - RNA, 15 nt, Mycobacterium avium subsp. paratuberculosis
ggccugcgcggccgc

SEQ ID NO: 2960714 - RNA, 19 nt, Mycobacterium avium subsp. paratuberculosis
ggccugcgcggccgcgucg

SEQ ID NO: 2960715 - RNA, 18 nt, Mycobacterium avium subsp. paratuberculosis
ggccugcgcgucgucgcc

SEQ ID NO: 2960716 - RNA, 14 nt, Mycobacterium avium subsp. paratuberculosis
ggccugcgcugcgg

SEQ ID NO: 2960717 - RNA, 13 nt, Mycobacterium avium subsp. paratuberculosis
ggccugcggcggc

SEQ ID NO: 2960718 - RNA, 17 nt, Mycobacterium avium subsp. paratuberculosis
ggccugcggcggcaacg

SEQ ID NO: 2960719 - RNA, 14 nt, Mycobacterium avium subsp. paratuberculosis
ggccugcggcggcc

SEQ ID NO: 2960720 - RNA, 15 nt, Mycobacterium avium subsp. paratuberculosis
ggccugcggcggccg

SEQ ID NO: 2960721 - RNA, 17 nt, Mycobacterium avium subsp. paratuberculosis
ggccugcggcggccgca

SEQ ID NO: 2960722 - RNA, 20 nt, Mycobacterium avium subsp. paratuberculosis
ggccugcgggacgccguuga

SEQ ID NO: 2960723 - RNA, 17 nt, Mycobacterium avium subsp. paratuberculosis
ggccugcgggcgccggc

SEQ ID NO: 2960724 - RNA, 19 nt, Mycobacterium avium subsp. paratuberculosis
ggccugcgggcgccggcug

SEQ ID NO: 2960725 - RNA, 21 nt, Mycobacterium avium subsp. paratuberculosis
ggccugcgggcgccggcugcc

SEQ ID NO: 2960726 - RNA, 19 nt, Mycobacterium avium subsp. paratuberculosis
ggccugcgucacuccucga

SEQ ID NO: 2960727 - RNA, 20 nt, Mycobacterium avium subsp. paratuberculosis
ggccugcucgcuugccagcc

SEQ ID NO: 2960728 - RNA, 19 nt, Mycobacterium avium subsp. paratuberculosis
ggccugcuguuccucgaac

SEQ ID NO: 2960729 - RNA, 16 nt, Mycobacterium avium subsp. paratuberculosis
ggccugcuucucgccg

SEQ ID NO: 2960730 - RNA, 17 nt, Mycobacterium avium subsp. paratuberculosis
ggccugcuucucgccgu

SEQ ID NO: 2960731 - RNA, 17 nt, Mycobacterium avium subsp. paratuberculosis
ggccugcuugaccgcca

SEQ ID NO: 2960732 - RNA, 20 nt, Mycobacterium avium subsp. paratuberculosis
ggccugcuugaccgccagac

SEQ ID NO: 2960733 - RNA, 18 nt, Mycobacterium avium subsp. paratuberculosis
ggccugcuugggcagcag

SEQ ID NO: 2960734 - RNA, 21 nt, Mycobacterium avium subsp. paratuberculosis
ggccugcuugggcagcagcuc

SEQ ID NO: 2960735 - RNA, 18 nt, Mycobacterium avium subsp. paratuberculosis
ggccugcuuuucggccga

SEQ ID NO: 2960736 - RNA, 20 nt, Mycobacterium avium subsp. paratuberculosis
ggccugcuuuucggccgagu

SEQ ID NO: 2960737 - RNA, 14 nt, Mycobacterium avium subsp. paratuberculosis
ggccuggaaccggg

SEQ ID NO: 2960738 - RNA, 23 nt, Mycobacterium avium subsp. paratuberculosis
ggccuggcccaaaaacaucguca

SEQ ID NO: 2960739 - RNA, 23 nt, Mycobacterium avium subsp. paratuberculosis
ggcgaacuccacccugccgaccu

SEQ ID NO: 2960740 - RNA, 15 nt, Mycobacterium avium subsp. paratuberculosis
ggcgaacucgcggcg

SEQ ID NO: 2960741 - RNA, 16 nt, Mycobacterium avium subsp. paratuberculosis
ggcgaacuugcuggcc

SEQ ID NO: 2960742 - RNA, 18 nt, Mycobacterium avium subsp. paratuberculosis
ggcgaacuuggccgacac

SEQ ID NO: 2960743 - RNA, 22 nt, Mycobacterium avium subsp. paratuberculosis
ggcgaagcacgaccacacccgc

SEQ ID NO: 2960744 - RNA, 20 nt, Mycobacterium avium subsp. paratuberculosis
ggcgaagcaggggucguugu

SEQ ID NO: 2960745 - RNA, 13 nt, Mycobacterium avium subsp. paratuberculosis
ggcgaagccgagg

SEQ ID NO: 2960746 - RNA, 22 nt, Mycobacterium avium subsp. paratuberculosis
ggcgaagccggccccgcccggg

SEQ ID NO: 2960747 - RNA, 13 nt, Mycobacterium avium subsp. paratuberculosis
ggcgaagccggcg

SEQ ID NO: 2960748 - RNA, 14 nt, Mycobacterium avium subsp. paratuberculosis
ggcgaagcucgacg

SEQ ID NO: 2960749 - RNA, 13 nt, Mycobacterium avium subsp. paratuberculosis
ggcgaaggcgcgc

SEQ ID NO: 2960750 - RNA, 14 nt, Mycobacterium avium subsp. paratuberculosis
ggcgaaggucagau

SEQ ID NO: 2960751 - RNA, 21 nt, Mycobacterium avium subsp. paratuberculosis
ggcgaaggugggcagcgccac

SEQ ID NO: 2960752 - RNA, 17 nt, Mycobacterium avium subsp. paratuberculosis
ggcgaaguagccggcga

SEQ ID NO: 2960753 - RNA, 18 nt, Mycobacterium avium subsp. paratuberculosis
ggcgaaguagccggcgau

SEQ ID NO: 2960754 - RNA, 17 nt, Mycobacterium avium subsp. paratuberculosis
ggcgaaguagucggcgu

SEQ ID NO: 2960755 - RNA, 15 nt, Mycobacterium avium subsp. paratuberculosis
ggcgaagucaucacc

SEQ ID NO: 2960756 - RNA, 13 nt, Mycobacterium avium subsp. paratuberculosis
ggcgaagucaucg

SEQ ID NO: 2960757 - RNA, 14 nt, Mycobacterium avium subsp. paratuberculosis
ggcgaagucgccgg

SEQ ID NO: 2960758 - RNA, 15 nt, Mycobacterium avium subsp. paratuberculosis
ggcgaagucgccggc

SEQ ID NO: 2960759 - RNA, 19 nt, Mycobacterium avium subsp. paratuberculosis
ggcgaagucgccggccagg

SEQ ID NO: 2960760 - RNA, 21 nt, Mycobacterium avium subsp. paratuberculosis
ggcgaagucgccggccaggau

SEQ ID NO: 2960761 - RNA, 12 nt, Mycobacterium avium subsp. paratuberculosis
ggcgaaguucgg

SEQ ID NO: 2960762 - RNA, 15 nt, Mycobacterium avium subsp. paratuberculosis
ggcgaaguucggcau

SEQ ID NO: 2960763 - RNA, 14 nt, Mycobacterium avium subsp. paratuberculosis
ggcgaaguugaucg

SEQ ID NO: 2960764 - RNA, 19 nt, Mycobacterium avium subsp. paratuberculosis
ggcgaaguugaucgguucg

SEQ ID NO: 2960765 - RNA, 16 nt, Mycobacterium avium subsp. paratuberculosis
ggcgaaguugcgguug

SEQ ID NO: 2960766 - RNA, 21 nt, Mycobacterium avium subsp. paratuberculosis
ggcgaauaaggggguagaugu

SEQ ID NO: 2960767 - RNA, 14 nt, Mycobacterium avium subsp. paratuberculosis
ggcgaauauuucgc

SEQ ID NO: 2960768 - RNA, 18 nt, Mycobacterium avium subsp. paratuberculosis
ggcgaauauuucgccgau

SEQ ID NO: 2960769 - RNA, 19 nt, Mycobacterium avium subsp. paratuberculosis
ggcgaauauuucgccgauc

SEQ ID NO: 2960770 - RNA, 23 nt, Mycobacterium avium subsp. paratuberculosis
ggcgaaucagcagcuugaucgcc

SEQ ID NO: 2960771 - RNA, 15 nt, Mycobacterium avium subsp. paratuberculosis
ggcgaauccgaccgg

SEQ ID NO: 2960772 - RNA, 17 nt, Mycobacterium avium subsp. paratuberculosis
ggcgaauccgagcaucg

SEQ ID NO: 2960773 - RNA, 19 nt, Mycobacterium avium subsp. paratuberculosis
ggcgaauccgagcaucggg

SEQ ID NO: 2960774 - RNA, 22 nt, Mycobacterium avium subsp. paratuberculosis
ggcgaauccgaguuggccggca

SEQ ID NO: 2960775 - RNA, 13 nt, Mycobacterium avium subsp. paratuberculosis
ggcgaauccgggc

SEQ ID NO: 2960776 - RNA, 14 nt, Mycobacterium avium subsp. paratuberculosis
ggcgaauccgggcc

SEQ ID NO: 2960777 - RNA, 17 nt, Mycobacterium avium subsp. paratuberculosis
ggcgaaucugucgaugg

SEQ ID NO: 2960778 - RNA, 21 nt, Mycobacterium avium subsp. paratuberculosis
ggcgaaucugucgauggcgga

SEQ ID NO: 2960779 - RNA, 13 nt, Mycobacterium avium subsp. paratuberculosis
ggcgaaugcggcc

SEQ ID NO: 2960780 - RNA, 14 nt, Mycobacterium avium subsp. paratuberculosis
ggcgaaugcggcca

SEQ ID NO: 2960781 - RNA, 21 nt, Mycobacterium avium subsp. paratuberculosis
ggcgaauucggugaucgcggu

SEQ ID NO: 2960782 - RNA, 17 nt, Mycobacterium avium subsp. paratuberculosis
ggcgacacccagcggcg

SEQ ID NO: 2960783 - RNA, 16 nt, Mycobacterium avium subsp. paratuberculosis
ggcgacaccccgcgag

SEQ ID NO: 2960784 - RNA, 21 nt, Mycobacterium avium subsp. paratuberculosis
ggcgacaccgcauggccggcg

SEQ ID NO: 2960785 - RNA, 22 nt, Mycobacterium avium subsp. paratuberculosis
ggcgacaccgcauggccggcga

SEQ ID NO: 2960786 - RNA, 16 nt, Mycobacterium avium subsp. paratuberculosis
ggcgacacguccagcu

SEQ ID NO: 2960787 - RNA, 13 nt, Mycobacterium avium subsp. paratuberculosis
ggcgacaucgccg

SEQ ID NO: 2960788 - RNA, 16 nt, Mycobacterium avium subsp. paratuberculosis
ggcgacaucgccgaga

SEQ ID NO: 2960789 - RNA, 15 nt, Mycobacterium avium subsp. paratuberculosis
ggcgacaucgccgcg

SEQ ID NO: 2960790 - RNA, 19 nt, Mycobacterium avium subsp. paratuberculosis
ggcgacaucgccgcggccg

SEQ ID NO: 2960791 - RNA, 20 nt, Mycobacterium avium subsp. paratuberculosis
ggcgacaucgccgcggccgg

SEQ ID NO: 2960792 - RNA, 22 nt, Mycobacterium avium subsp. paratuberculosis
ggcgacaucgccgcggccggag

SEQ ID NO: 2960793 - RNA, 19 nt, Mycobacterium avium subsp. paratuberculosis
ggcgacaugcccgcggugc

SEQ ID NO: 2960794 - RNA, 15 nt, Mycobacterium avium subsp. paratuberculosis
ggcgacaugcgcagc

SEQ ID NO: 2960795 - RNA, 19 nt, Mycobacterium avium subsp. paratuberculosis
ggcgacauuggccgcgcgc

SEQ ID NO: 2960796 - RNA, 23 nt, Mycobacterium avium subsp. paratuberculosis
ggcgaccaaugcccugaccccgg

SEQ ID NO: 2960797 - RNA, 23 nt, Mycobacterium avium subsp. paratuberculosis
ggcgaccaauugcgagcaggccg

SEQ ID NO: 2960798 - RNA, 16 nt, Mycobacterium avium subsp. paratuberculosis
ggcgaccacaccgccg

SEQ ID NO: 2960799 - RNA, 17 nt, Mycobacterium avium subsp. paratuberculosis
ggcgaccacaccgccgg

SEQ ID NO: 2960800 - RNA, 20 nt, Mycobacterium avium subsp. paratuberculosis
ggcgaccacaccgccggcca

SEQ ID NO: 2960801 - RNA, 21 nt, Mycobacterium avium subsp. paratuberculosis
ggcgaccacaccgccggccac

SEQ ID NO: 2960802 - RNA, 23 nt, Mycobacterium avium subsp. paratuberculosis
ggcgaccacaccgccggccacgu

SEQ ID NO: 2960803 - RNA, 15 nt, Mycobacterium avium subsp. paratuberculosis
ggcgaccacaccguc

SEQ ID NO: 2960804 - RNA, 19 nt, Mycobacterium avium subsp. paratuberculosis
ggcgaccacaccgucgacg

SEQ ID NO: 2960805 - RNA, 21 nt, Mycobacterium avium subsp. paratuberculosis
ggcgaccacaccgucgacgac

SEQ ID NO: 2960806 - RNA, 19 nt, Mycobacterium avium subsp. paratuberculosis
ggcgaccaccacggccgca

SEQ ID NO: 2960807 - RNA, 21 nt, Mycobacterium avium subsp. paratuberculosis
ggcgaccaccacggccgcagc

SEQ ID NO: 2960808 - RNA, 17 nt, Mycobacterium avium subsp. paratuberculosis
ggcgaccaccagccgca

SEQ ID NO: 2960809 - RNA, 22 nt, Mycobacterium avium subsp. paratuberculosis
ggcgaccaccagccgcaggugc

SEQ ID NO: 2960810 - RNA, 12 nt, Mycobacterium avium subsp. paratuberculosis
ggcgaccaccga

SEQ ID NO: 2960811 - RNA, 17 nt, Mycobacterium avium subsp. paratuberculosis
ggcgaccaccgaccccu

SEQ ID NO: 2960812 - RNA, 18 nt, Mycobacterium avium subsp. paratuberculosis
ggcgaccaccgaccccug

SEQ ID NO: 2960813 - RNA, 19 nt, Mycobacterium avium subsp. paratuberculosis
ggcgaccacguccagcugg

SEQ ID NO: 2960814 - RNA, 20 nt, Mycobacterium avium subsp. paratuberculosis
ggcgaccagcgagcccagcu

SEQ ID NO: 2960815 - RNA, 21 nt, Mycobacterium avium subsp. paratuberculosis
ggcgaccaucagccugcggug

SEQ ID NO: 2960816 - RNA, 16 nt, Mycobacterium avium subsp. paratuberculosis
ggcgaccaugcccagc

SEQ ID NO: 2960817 - RNA, 17 nt, Mycobacterium avium subsp. paratuberculosis
ggcgaccaugcccagca

SEQ ID NO: 2960818 - RNA, 16 nt, Mycobacterium avium subsp. paratuberculosis
ggcgaccaugccgcgg

SEQ ID NO: 2960819 - RNA, 17 nt, Mycobacterium avium subsp. paratuberculosis
ggcgaccaugccgcggg

SEQ ID NO: 2960820 - RNA, 23 nt, Mycobacterium avium subsp. paratuberculosis
ggcgaccaugccgcgggccagca

SEQ ID NO: 2960821 - RNA, 16 nt, Mycobacterium avium subsp. paratuberculosis
ggcgacccccgguguc

SEQ ID NO: 2960822 - RNA, 18 nt, Mycobacterium avium subsp. paratuberculosis
ggcgacccccggugucug

SEQ ID NO: 2960823 - RNA, 19 nt, Mycobacterium avium subsp. paratuberculosis
ggcgacggcgcucaccggc

SEQ ID NO: 2960824 - RNA, 23 nt, Mycobacterium avium subsp. paratuberculosis
ggcgacggcgcuguggccguuga

SEQ ID NO: 2960825 - RNA, 16 nt, Mycobacterium avium subsp. paratuberculosis
ggcgacggcggccguc

SEQ ID NO: 2960826 - RNA, 21 nt, Mycobacterium avium subsp. paratuberculosis
ggcgacggcggccgucuugcc

SEQ ID NO: 2960827 - RNA, 14 nt, Mycobacterium avium subsp. paratuberculosis
ggcgacggcggcga

SEQ ID NO: 2960828 - RNA, 18 nt, Mycobacterium avium subsp. paratuberculosis
ggcgacggcggcgacgug

SEQ ID NO: 2960829 - RNA, 15 nt, Mycobacterium avium subsp. paratuberculosis
ggcgacggcgguucg

SEQ ID NO: 2960830 - RNA, 11 nt, Mycobacterium avium subsp. paratuberculosis
ggcgacggcgu

SEQ ID NO: 2960831 - RNA, 13 nt, Mycobacterium avium subsp. paratuberculosis
ggcgacggcgucc

SEQ ID NO: 2960832 - RNA, 17 nt, Mycobacterium avium subsp. paratuberculosis
ggcgacggcguccagcu

SEQ ID NO: 2960833 - RNA, 18 nt, Mycobacterium avium subsp. paratuberculosis
ggcgacggcguccgggcg

SEQ ID NO: 2960834 - RNA, 22 nt, Mycobacterium avium subsp. paratuberculosis
ggcgacggcguccgggcgcugc

SEQ ID NO: 2960835 - RNA, 20 nt, Mycobacterium avium subsp. paratuberculosis
ggcgacggcgucggcggccu

SEQ ID NO: 2960836 - RNA, 21 nt, Mycobacterium avium subsp. paratuberculosis
ggcgacggcguugcuggcgcg

SEQ ID NO: 2960837 - RNA, 13 nt, Mycobacterium avium subsp. paratuberculosis
ggcgacgggccga

SEQ ID NO: 2960838 - RNA, 19 nt, Mycobacterium avium subsp. paratuberculosis
ggcgacgggccgaucacgc

SEQ ID NO: 2960839 - RNA, 19 nt, Mycobacterium avium subsp. paratuberculosis
ggcgacggugcaugcgcug

SEQ ID NO: 2960840 - RNA, 19 nt, Mycobacterium avium subsp. paratuberculosis
ggcgacgguggcgcccagc

SEQ ID NO: 2960841 - RNA, 16 nt, Mycobacterium avium subsp. paratuberculosis
ggcgacgguggcgggc

SEQ ID NO: 2960842 - RNA, 19 nt, Mycobacterium avium subsp. paratuberculosis
ggcgacgguguccgcggcg

SEQ ID NO: 2960843 - RNA, 18 nt, Mycobacterium avium subsp. paratuberculosis
ggcgacguacagcgagcc

SEQ ID NO: 2960844 - RNA, 21 nt, Mycobacterium avium subsp. paratuberculosis
ggcgacguacagcgagccguc

SEQ ID NO: 2960845 - RNA, 16 nt, Mycobacterium avium subsp. paratuberculosis
ggcgacgucgaacgcg

SEQ ID NO: 2960846 - RNA, 13 nt, Mycobacterium avium subsp. paratuberculosis
ggcgacgucgacg

SEQ ID NO: 2960847 - RNA, 18 nt, Mycobacterium avium subsp. paratuberculosis
ggcgacgucgacggcagc

SEQ ID NO: 2960848 - RNA, 13 nt, Mycobacterium avium subsp. paratuberculosis
ggcgacgucgccg

SEQ ID NO: 2960849 - RNA, 16 nt, Mycobacterium avium subsp. paratuberculosis
ggcgacgucgccggcc

SEQ ID NO: 2960850 - RNA, 17 nt, Mycobacterium avium subsp. paratuberculosis
ggcgacgucgccggccu

SEQ ID NO: 2960851 - RNA, 19 nt, Mycobacterium avium subsp. paratuberculosis
ggcgacgucggggucgucg

SEQ ID NO: 2960852 - RNA, 16 nt, Mycobacterium avium subsp. paratuberculosis
ggcgacgucggucggc

SEQ ID NO: 2960853 - RNA, 14 nt, Mycobacterium avium subsp. paratuberculosis
ggcgacgucgucga

SEQ ID NO: 2960854 - RNA, 16 nt, Mycobacterium avium subsp. paratuberculosis
ggcgacgucgucgaug

SEQ ID NO: 2960855 - RNA, 17 nt, Mycobacterium avium subsp. paratuberculosis
ggcgacgucgucgaugc

SEQ ID NO: 2960856 - RNA, 23 nt, Mycobacterium avium subsp. paratuberculosis
ggcgacgucgucgaugccgaucg

SEQ ID NO: 2960857 - RNA, 19 nt, Mycobacterium avium subsp. paratuberculosis
ggcgacgucgucgcccacc

SEQ ID NO: 2960858 - RNA, 20 nt, Mycobacterium avium subsp. paratuberculosis
ggcgacgucgucgcccaccc

SEQ ID NO: 2960859 - RNA, 22 nt, Mycobacterium avium subsp. paratuberculosis
ggcgacgucgucgcccacccgc

SEQ ID NO: 2960860 - RNA, 20 nt, Mycobacterium avium subsp. paratuberculosis
ggcgacgucgugcacgccgu

SEQ ID NO: 2960861 - RNA, 21 nt, Mycobacterium avium subsp. paratuberculosis
ggcgacguucgauugcaccac

SEQ ID NO: 2960862 - RNA, 16 nt, Mycobacterium avium subsp. paratuberculosis
ggcgacuccggcgccg

SEQ ID NO: 2960863 - RNA, 23 nt, Mycobacterium avium subsp. paratuberculosis
ggcgacuccggcgccggucagcg

SEQ ID NO: 2960864 - RNA, 17 nt, Mycobacterium avium subsp. paratuberculosis
ggcgacugcgugcuggg

SEQ ID NO: 2960865 - RNA, 19 nt, Mycobacterium avium subsp. paratuberculosis
ggcgacugcgugcugggca

SEQ ID NO: 2960866 - RNA, 23 nt, Mycobacterium avium subsp. paratuberculosis
ggcgacuguccaggccgaggcug

SEQ ID NO: 2960867 - RNA, 21 nt, Mycobacterium avium subsp. paratuberculosis
ggcgacuucguugguggucga

SEQ ID NO: 2960868 - RNA, 19 nt, Mycobacterium avium subsp. paratuberculosis
ggcgacuucuucgccggcg

SEQ ID NO: 2960869 - RNA, 12 nt, Mycobacterium avium subsp. paratuberculosis
ggcgagaccguc

SEQ ID NO: 2960870 - RNA, 18 nt, Mycobacterium avium subsp. paratuberculosis
ggcgagaucaacaccgcg

SEQ ID NO: 2960871 - RNA, 20 nt, Mycobacterium avium subsp. paratuberculosis
ggcgagaucaacaccgcgca

SEQ ID NO: 2960872 - RNA, 22 nt, Mycobacterium avium subsp. paratuberculosis
ggcgagaucaacaccgcgcaug

SEQ ID NO: 2960873 - RNA, 18 nt, Mycobacterium avium subsp. paratuberculosis
ggcgagaucccugcgcuc

SEQ ID NO: 2960874 - RNA, 17 nt, Mycobacterium avium subsp. paratuberculosis
ggcgagcaaggcgagca

SEQ ID NO: 2960875 - RNA, 22 nt, Mycobacterium avium subsp. paratuberculosis
ggcgagcaauuaaccggcaggc

SEQ ID NO: 2960876 - RNA, 14 nt, Mycobacterium avium subsp. paratuberculosis
ggcgagcacccgga

SEQ ID NO: 2960877 - RNA, 23 nt, Mycobacterium avium subsp. paratuberculosis
ggcgagcacccggauggucugca

SEQ ID NO: 2960878 - RNA, 18 nt, Mycobacterium avium subsp. paratuberculosis
ggcgagcaccgugccguc

SEQ ID NO: 2960879 - RNA, 22 nt, Mycobacterium avium subsp. paratuberculosis
ggcgagcaccgugccgucggcg

SEQ ID NO: 2960880 - RNA, 15 nt, Mycobacterium avium subsp. paratuberculosis
ggcgagcacgccgcc

SEQ ID NO: 2960881 - RNA, 19 nt, Mycobacterium avium subsp. paratuberculosis
ggcgagcagacacaaaagc

SEQ ID NO: 2960882 - RNA, 17 nt, Mycobacterium avium subsp. paratuberculosis
ggcgagcagcagcgcgg

SEQ ID NO: 2960883 - RNA, 21 nt, Mycobacterium avium subsp. paratuberculosis
ggcgagcagcagcgcggugcc

SEQ ID NO: 2960884 - RNA, 16 nt, Mycobacterium avium subsp. paratuberculosis
ggcgagcagcccggcg

SEQ ID NO: 2960885 - RNA, 12 nt, Mycobacterium avium subsp. paratuberculosis
ggcgagcagcgc

SEQ ID NO: 2960886 - RNA, 14 nt, Mycobacterium avium subsp. paratuberculosis
ggcgagcagcgccc

SEQ ID NO: 2960887 - RNA, 16 nt, Mycobacterium avium subsp. paratuberculosis
ggcgagcagcgcccgg

SEQ ID NO: 2960888 - RNA, 17 nt, Mycobacterium avium subsp. paratuberculosis
ggcgagcagcgcccggg

SEQ ID NO: 2960889 - RNA, 17 nt, Mycobacterium avium subsp. paratuberculosis
ggcgagcagcugcagcg

SEQ ID NO: 2960890 - RNA, 22 nt, Mycobacterium avium subsp. paratuberculosis
ggcgagcagcugcagcgucggg

SEQ ID NO: 2960891 - RNA, 15 nt, Mycobacterium avium subsp. paratuberculosis
ggcgagccgcucccg

SEQ ID NO: 2960892 - RNA, 15 nt, Mycobacterium avium subsp. paratuberculosis
ggcgagccggcccgg

SEQ ID NO: 2960893 - RNA, 16 nt, Mycobacterium avium subsp. paratuberculosis
ggcgagccggcccggg

SEQ ID NO: 2960894 - RNA, 18 nt, Mycobacterium avium subsp. paratuberculosis
ggcgagccggccguagcg

SEQ ID NO: 2960895 - RNA, 13 nt, Mycobacterium avium subsp. paratuberculosis
ggcgagccgggcc

SEQ ID NO: 2960896 - RNA, 15 nt, Mycobacterium avium subsp. paratuberculosis
ggcgagccgggccgg

SEQ ID NO: 2960897 - RNA, 13 nt, Mycobacterium avium subsp. paratuberculosis
ggcgagcgcgcug

SEQ ID NO: 2960898 - RNA, 14 nt, Mycobacterium avium subsp. paratuberculosis
ggcgagcgcgcuga

SEQ ID NO: 2960899 - RNA, 21 nt, Mycobacterium avium subsp. paratuberculosis
ggcgagcgcgcugaucgccgc

SEQ ID NO: 2960900 - RNA, 22 nt, Mycobacterium avium subsp. paratuberculosis
ggcgagcgcgcugaucgccgcu

SEQ ID NO: 2960901 - RNA, 13 nt, Mycobacterium avium subsp. paratuberculosis
ggcgagcgcgugc

SEQ ID NO: 2960902 - RNA, 17 nt, Mycobacterium avium subsp. paratuberculosis
ggcgagcgcgugcacga

SEQ ID NO: 2960903 - RNA, 21 nt, Mycobacterium avium subsp. paratuberculosis
ggcgagcgcguucuccaccgc

SEQ ID NO: 2960904 - RNA, 22 nt, Mycobacterium avium subsp. paratuberculosis
ggcgagcgcguucuccaccgcg

SEQ ID NO: 2960905 - RNA, 14 nt, Mycobacterium avium subsp. paratuberculosis
ggcgagcggcaccu

SEQ ID NO: 2960906 - RNA, 12 nt, Mycobacterium avium subsp. paratuberculosis
ggcgagcggccc

SEQ ID NO: 2960907 - RNA, 22 nt, Mycobacterium avium subsp. paratuberculosis
ggcgaucgaucccuuggcggcg

SEQ ID NO: 2960908 - RNA, 13 nt, Mycobacterium avium subsp. paratuberculosis
ggcgaucgaugcc

SEQ ID NO: 2960909 - RNA, 14 nt, Mycobacterium avium subsp. paratuberculosis
ggcgaucgaugccc

SEQ ID NO: 2960910 - RNA, 18 nt, Mycobacterium avium subsp. paratuberculosis
ggcgaucgaugcccagcg

SEQ ID NO: 2960911 - RNA, 24 nt, Mycobacterium avium subsp. paratuberculosis
ggcgaucgaugcccagcgcgcggu

SEQ ID NO: 2960912 - RNA, 14 nt, Mycobacterium avium subsp. paratuberculosis
ggcgaucgccgcga

SEQ ID NO: 2960913 - RNA, 15 nt, Mycobacterium avium subsp. paratuberculosis
ggcgaucgccgggga

SEQ ID NO: 2960914 - RNA, 15 nt, Mycobacterium avium subsp. paratuberculosis
ggcgaucgccguggu

SEQ ID NO: 2960915 - RNA, 12 nt, Mycobacterium avium subsp. paratuberculosis
ggcgaucgccuc

SEQ ID NO: 2960916 - RNA, 17 nt, Mycobacterium avium subsp. paratuberculosis
ggcgaucgccucggccu

SEQ ID NO: 2960917 - RNA, 16 nt, Mycobacterium avium subsp. paratuberculosis
ggcgaucgcgagcagg

SEQ ID NO: 2960918 - RNA, 15 nt, Mycobacterium avium subsp. paratuberculosis
ggcgaucgcgcgcac

SEQ ID NO: 2960919 - RNA, 15 nt, Mycobacterium avium subsp. paratuberculosis
ggcgaucgcggccac

SEQ ID NO: 2960920 - RNA, 17 nt, Mycobacterium avium subsp. paratuberculosis
ggcgaucgcggccacca

SEQ ID NO: 2960921 - RNA, 19 nt, Mycobacterium avium subsp. paratuberculosis
ggcgaucgcggugcggggc

SEQ ID NO: 2960922 - RNA, 19 nt, Mycobacterium avium subsp. paratuberculosis
ggcgaucggccgcugcggg

SEQ ID NO: 2960923 - RNA, 18 nt, Mycobacterium avium subsp. paratuberculosis
ggcgaucggcgguccgcc

SEQ ID NO: 2960924 - RNA, 16 nt, Mycobacterium avium subsp. paratuberculosis
ggcgaucggcgugccg

SEQ ID NO: 2960925 - RNA, 20 nt, Mycobacterium avium subsp. paratuberculosis
ggcgaucgggaacagcccgc

SEQ ID NO: 2960926 - RNA, 14 nt, Mycobacterium avium subsp. paratuberculosis
ggcgaucgggucac

SEQ ID NO: 2960927 - RNA, 22 nt, Mycobacterium avium subsp. paratuberculosis
ggcgaucgggucaccggccgag

SEQ ID NO: 2960928 - RNA, 13 nt, Mycobacterium avium subsp. paratuberculosis
ggcgaucgucgcc

SEQ ID NO: 2960929 - RNA, 19 nt, Mycobacterium avium subsp. paratuberculosis
ggcgaucuccagcggccgg

SEQ ID NO: 2960930 - RNA, 22 nt, Mycobacterium avium subsp. paratuberculosis
ggcgaucuccagcggccgggcg

SEQ ID NO: 2960931 - RNA, 23 nt, Mycobacterium avium subsp. paratuberculosis
ggcgaucucgaucgugggcaaca

SEQ ID NO: 2960932 - RNA, 16 nt, Mycobacterium avium subsp. paratuberculosis
ggcgaucucgauggcc

SEQ ID NO: 2960933 - RNA, 19 nt, Mycobacterium avium subsp. paratuberculosis
ggcgaucucgauggccacg

SEQ ID NO: 2960934 - RNA, 14 nt, Mycobacterium avium subsp. paratuberculosis
ggcgaucucgaugu

SEQ ID NO: 2960935 - RNA, 14 nt, Mycobacterium avium subsp. paratuberculosis
ggcgaucucgccga

SEQ ID NO: 2960936 - RNA, 22 nt, Mycobacterium avium subsp. paratuberculosis
ggcgaucucggagaccuuggcg

SEQ ID NO: 2960937 - RNA, 13 nt, Mycobacterium avium subsp. paratuberculosis
ggcgaucucggcg

SEQ ID NO: 2960938 - RNA, 16 nt, Mycobacterium avium subsp. paratuberculosis
ggcgaucucggcggcc

SEQ ID NO: 2960939 - RNA, 18 nt, Mycobacterium avium subsp. paratuberculosis
ggcgaucucggcggccgc

SEQ ID NO: 2960940 - RNA, 18 nt, Mycobacterium avium subsp. paratuberculosis
ggcgaucucggucaccga

SEQ ID NO: 2960941 - RNA, 20 nt, Mycobacterium avium subsp. paratuberculosis
ggcgaucucggucaccgagc

SEQ ID NO: 2960942 - RNA, 23 nt, Mycobacterium avium subsp. paratuberculosis
ggcgaucucgguuuccacgucgc

SEQ ID NO: 2960943 - RNA, 20 nt, Mycobacterium avium subsp. paratuberculosis
ggcgaucucgucgcgcagcu

SEQ ID NO: 2960944 - RNA, 18 nt, Mycobacterium avium subsp. paratuberculosis
ggcgaucucuucgaugcc

SEQ ID NO: 2960945 - RNA, 19 nt, Mycobacterium avium subsp. paratuberculosis
ggcgaucucuucgaugccg

SEQ ID NO: 2960946 - RNA, 14 nt, Mycobacterium avium subsp. paratuberculosis
ggcgaucuggcggu

SEQ ID NO: 2960947 - RNA, 18 nt, Mycobacterium avium subsp. paratuberculosis
ggcgaugaccagcgcgaa

SEQ ID NO: 2960948 - RNA, 20 nt, Mycobacterium avium subsp. paratuberculosis
ggcgaugaccgccugcggca

SEQ ID NO: 2960949 - RNA, 23 nt, Mycobacterium avium subsp. paratuberculosis
ggcgaugacgaauuccgcaccgg

SEQ ID NO: 2960950 - RNA, 19 nt, Mycobacterium avium subsp. paratuberculosis
ggcgaugauccgcggcgcc

SEQ ID NO: 2960951 - RNA, 20 nt, Mycobacterium avium subsp. paratuberculosis
ggcgaugauccgcggcgccg

SEQ ID NO: 2960952 - RNA, 18 nt, Mycobacterium avium subsp. paratuberculosis
ggcgaugcagaucaccac

SEQ ID NO: 2960953 - RNA, 20 nt, Mycobacterium avium subsp. paratuberculosis
ggcgaugcagaucaccacgg

SEQ ID NO: 2960954 - RNA, 21 nt, Mycobacterium avium subsp. paratuberculosis
ggcgaugccagcgcaccgggc

SEQ ID NO: 2960955 - RNA, 14 nt, Mycobacterium avium subsp. paratuberculosis
ggcgaugcccagcc

SEQ ID NO: 2960956 - RNA, 14 nt, Mycobacterium avium subsp. paratuberculosis
ggcgaugcccguga

SEQ ID NO: 2960957 - RNA, 21 nt, Mycobacterium avium subsp. paratuberculosis
ggcgaugcccgugaucgccac

SEQ ID NO: 2960958 - RNA, 23 nt, Mycobacterium avium subsp. paratuberculosis
ggcgaugccgacaccccacaccg

SEQ ID NO: 2960959 - RNA, 12 nt, Mycobacterium avium subsp. paratuberculosis
ggcgaugccgag

SEQ ID NO: 2960960 - RNA, 14 nt, Mycobacterium avium subsp. paratuberculosis
ggcgaugccgagcc

SEQ ID NO: 2960961 - RNA, 13 nt, Mycobacterium avium subsp. paratuberculosis
ggcgaugccgagg

SEQ ID NO: 2960962 - RNA, 14 nt, Mycobacterium avium subsp. paratuberculosis
ggcgaugccgccga

SEQ ID NO: 2960963 - RNA, 16 nt, Mycobacterium avium subsp. paratuberculosis
ggcgaugccgccgacg

SEQ ID NO: 2960964 - RNA, 15 nt, Mycobacterium avium subsp. paratuberculosis
ggcgaugccgugcug

SEQ ID NO: 2960965 - RNA, 19 nt, Mycobacterium avium subsp. paratuberculosis
ggcgaugccgugcugggcg

SEQ ID NO: 2960966 - RNA, 23 nt, Mycobacterium avium subsp. paratuberculosis
ggcgaugccgugcugggcggacg

SEQ ID NO: 2960967 - RNA, 21 nt, Mycobacterium avium subsp. paratuberculosis
ggcgaugcgcacgucggccgc

SEQ ID NO: 2960968 - RNA, 13 nt, Mycobacterium avium subsp. paratuberculosis
ggcgaugcgcgcc

SEQ ID NO: 2960969 - RNA, 14 nt, Mycobacterium avium subsp. paratuberculosis
ggcgaugcgcgccu

SEQ ID NO: 2960970 - RNA, 17 nt, Mycobacterium avium subsp. paratuberculosis
ggcgaugcgcggcccgu

SEQ ID NO: 2960971 - RNA, 15 nt, Mycobacterium avium subsp. paratuberculosis
ggcgaugcgcuccag

SEQ ID NO: 2960972 - RNA, 13 nt, Mycobacterium avium subsp. paratuberculosis
ggcgaugcggccc

SEQ ID NO: 2960973 - RNA, 16 nt, Mycobacterium avium subsp. paratuberculosis
ggcgaugcggcccggc

SEQ ID NO: 2960974 - RNA, 20 nt, Mycobacterium avium subsp. paratuberculosis
ggcgaugcggcccggccacu

SEQ ID NO: 2960975 - RNA, 21 nt, Mycobacterium avium subsp. paratuberculosis
ggcgaugcgggucacggucag

SEQ ID NO: 2960976 - RNA, 17 nt, Mycobacterium avium subsp. paratuberculosis
ggcgaugcgguggucga

SEQ ID NO: 2960977 - RNA, 16 nt, Mycobacterium avium subsp. paratuberculosis
ggcgaugcguugcgcc

SEQ ID NO: 2960978 - RNA, 24 nt, Mycobacterium avium subsp. paratuberculosis
ggcgauggaguagcugaccgaucg

SEQ ID NO: 2960979 - RNA, 22 nt, Mycobacterium avium subsp. paratuberculosis
ggcgauggccauggccaggaac

SEQ ID NO: 2960980 - RNA, 13 nt, Mycobacterium avium subsp. paratuberculosis
ggcgauggcccgc

SEQ ID NO: 2960981 - RNA, 14 nt, Mycobacterium avium subsp. paratuberculosis
ggcgauggccgaca

SEQ ID NO: 2960982 - RNA, 13 nt, Mycobacterium avium subsp. paratuberculosis
ggcgauggcggcg

SEQ ID NO: 2960983 - RNA, 14 nt, Mycobacterium avium subsp. paratuberculosis
ggcgauggcggcgu

SEQ ID NO: 2960984 - RNA, 16 nt, Mycobacterium avium subsp. paratuberculosis
ggcgauggcggcgucg

SEQ ID NO: 2960985 - RNA, 15 nt, Mycobacterium avium subsp. paratuberculosis
ggcgauggcgucggc

SEQ ID NO: 2960986 - RNA, 16 nt, Mycobacterium avium subsp. paratuberculosis
ggcgauggcgucggcc

SEQ ID NO: 2960987 - RNA, 23 nt, Mycobacterium avium subsp. paratuberculosis
ggcgaugggcaauaccggcagca

SEQ ID NO: 2960988 - RNA, 18 nt, Mycobacterium avium subsp. paratuberculosis
ggcgauggugaugcggau

SEQ ID NO: 2960989 - RNA, 12 nt, Mycobacterium avium subsp. paratuberculosis
ggcgauggugcc

SEQ ID NO: 2960990 - RNA, 14 nt, Mycobacterium avium subsp. paratuberculosis
ggcgauggugccga

SEQ ID NO: 2960991 - RNA, 15 nt, Mycobacterium avium subsp. paratuberculosis
ggcgauggugccgcc

SEQ ID NO: 2960992 - RNA, 19 nt, Mycobacterium avium subsp. paratuberculosis
ggcgcagcgccgucucgac

SEQ ID NO: 2960993 - RNA, 12 nt, Mycobacterium avium subsp. paratuberculosis
ggcgcagcgcga

SEQ ID NO: 2960994 - RNA, 17 nt, Mycobacterium avium subsp. paratuberculosis
ggcgcagcgcgaugucc

SEQ ID NO: 2960995 - RNA, 13 nt, Mycobacterium avium subsp. paratuberculosis
ggcgcagcggccc

SEQ ID NO: 2960996 - RNA, 15 nt, Mycobacterium avium subsp. paratuberculosis
ggcgcagcgucucga

SEQ ID NO: 2960997 - RNA, 23 nt, Mycobacterium avium subsp. paratuberculosis
ggcgcagcgucucgaucgacgac

SEQ ID NO: 2960998 - RNA, 23 nt, Mycobacterium avium subsp. paratuberculosis
ggcgcagcucgcgcagcuggccg

SEQ ID NO: 2960999 - RNA, 12 nt, Mycobacterium avium subsp. paratuberculosis
ggcgcagcucgu

SEQ ID NO: 2961000 - RNA, 14 nt, Mycobacterium avium subsp. paratuberculosis
ggcgcagcucgucg

SEQ ID NO: 2961001 - RNA, 17 nt, Mycobacterium avium subsp. paratuberculosis
ggcgcagcucgucgugg

SEQ ID NO: 2961002 - RNA, 17 nt, Mycobacterium avium subsp. paratuberculosis
ggcgcaggaggcggcca

SEQ ID NO: 2961003 - RNA, 14 nt, Mycobacterium avium subsp. paratuberculosis
ggcgcaggcgcugg

SEQ ID NO: 2961004 - RNA, 15 nt, Mycobacterium avium subsp. paratuberculosis
ggcgcagggccgcua

SEQ ID NO: 2961005 - RNA, 14 nt, Mycobacterium avium subsp. paratuberculosis
ggcgcagggcggcc

SEQ ID NO: 2961006 - RNA, 16 nt, Mycobacterium avium subsp. paratuberculosis
ggcgcagggcggccgg

SEQ ID NO: 2961007 - RNA, 20 nt, Mycobacterium avium subsp. paratuberculosis
ggcgcagggcggccggccag

SEQ ID NO: 2961008 - RNA, 15 nt, Mycobacterium avium subsp. paratuberculosis
ggcgcagguccaccc

SEQ ID NO: 2961009 - RNA, 16 nt, Mycobacterium avium subsp. paratuberculosis
ggcgcagguccacccg

SEQ ID NO: 2961010 - RNA, 20 nt, Mycobacterium avium subsp. paratuberculosis
ggcgcagguccacccgcccc

SEQ ID NO: 2961011 - RNA, 18 nt, Mycobacterium avium subsp. paratuberculosis
ggcgcagguccggcagcg

SEQ ID NO: 2961012 - RNA, 21 nt, Mycobacterium avium subsp. paratuberculosis
ggcgcagguccggcagcgcgc

SEQ ID NO: 2961013 - RNA, 12 nt, Mycobacterium avium subsp. paratuberculosis
ggcgcaggugau

SEQ ID NO: 2961014 - RNA, 19 nt, Mycobacterium avium subsp. paratuberculosis
ggcgcagguguccagcccu

SEQ ID NO: 2961015 - RNA, 18 nt, Mycobacterium avium subsp. paratuberculosis
ggcgcagguuguccagcc

SEQ ID NO: 2961016 - RNA, 21 nt, Mycobacterium avium subsp. paratuberculosis
ggcgcagucgaucucgucgca

SEQ ID NO: 2961017 - RNA, 20 nt, Mycobacterium avium subsp. paratuberculosis
ggcgcaguuaccggcguaga

SEQ ID NO: 2961018 - RNA, 16 nt, Mycobacterium avium subsp. paratuberculosis
ggcgcauaaaccuggu

SEQ ID NO: 2961019 - RNA, 17 nt, Mycobacterium avium subsp. paratuberculosis
ggcgcauaccagcgcug

SEQ ID NO: 2961020 - RNA, 20 nt, Mycobacterium avium subsp. paratuberculosis
ggcgcauaccagcgcuggua

SEQ ID NO: 2961021 - RNA, 19 nt, Mycobacterium avium subsp. paratuberculosis
ggcgcaucaccuucugcgu

SEQ ID NO: 2961022 - RNA, 15 nt, Mycobacterium avium subsp. paratuberculosis
ggcgcaucagcgggg

SEQ ID NO: 2961023 - RNA, 20 nt, Mycobacterium avium subsp. paratuberculosis
ggcgccaacaacucagaaca

SEQ ID NO: 2961024 - RNA, 16 nt, Mycobacterium avium subsp. paratuberculosis
ggcgccaacaacucga

SEQ ID NO: 2961025 - RNA, 21 nt, Mycobacterium avium subsp. paratuberculosis
ggcgccaacaacucgacgcuc

SEQ ID NO: 2961026 - RNA, 16 nt, Mycobacterium avium subsp. paratuberculosis
ggcgccacaacugguc

SEQ ID NO: 2961027 - RNA, 20 nt, Mycobacterium avium subsp. paratuberculosis
ggcgccacaacuggucgugc

SEQ ID NO: 2961028 - RNA, 17 nt, Mycobacterium avium subsp. paratuberculosis
ggcgccacagcagcacc

SEQ ID NO: 2961029 - RNA, 23 nt, Mycobacterium avium subsp. paratuberculosis
ggcgccacagcagcaccagcgcg

SEQ ID NO: 2961030 - RNA, 22 nt, Mycobacterium avium subsp. paratuberculosis
ggcgccaccagccacaccgccg

SEQ ID NO: 2961031 - RNA, 17 nt, Mycobacterium avium subsp. paratuberculosis
ggcgccaccggcuggcc

SEQ ID NO: 2961032 - RNA, 19 nt, Mycobacterium avium subsp. paratuberculosis
ggcgccaccggcuggccgg

SEQ ID NO: 2961033 - RNA, 20 nt, Mycobacterium avium subsp. paratuberculosis
ggcgccaccggcuggccgga

SEQ ID NO: 2961034 - RNA, 19 nt, Mycobacterium avium subsp. paratuberculosis
ggcgccaccgggaccugcu

SEQ ID NO: 2961035 - RNA, 15 nt, Mycobacterium avium subsp. paratuberculosis
ggcgccacgaccagc

SEQ ID NO: 2961036 - RNA, 17 nt, Mycobacterium avium subsp. paratuberculosis
ggcgccacgaccagcgg

SEQ ID NO: 2961037 - RNA, 19 nt, Mycobacterium avium subsp. paratuberculosis
ggcgccacgaccagcggca

SEQ ID NO: 2961038 - RNA, 24 nt, Mycobacterium avium subsp. paratuberculosis
ggcgccacgacugcgcggccggcg

SEQ ID NO: 2961039 - RNA, 13 nt, Mycobacterium avium subsp. paratuberculosis
ggcgccacgcaca

SEQ ID NO: 2961040 - RNA, 16 nt, Mycobacterium avium subsp. paratuberculosis
ggcgccacgcacaccg

SEQ ID NO: 2961041 - RNA, 19 nt, Mycobacterium avium subsp. paratuberculosis
ggcgccacgcacaccgcgc

SEQ ID NO: 2961042 - RNA, 16 nt, Mycobacterium avium subsp. paratuberculosis
ggcgccacguggucga

SEQ ID NO: 2961043 - RNA, 23 nt, Mycobacterium avium subsp. paratuberculosis
ggcgccacuucuccacgccgacg

SEQ ID NO: 2961044 - RNA, 16 nt, Mycobacterium avium subsp. paratuberculosis
ggcgccagcagcaccu

SEQ ID NO: 2961045 - RNA, 12 nt, Mycobacterium avium subsp. paratuberculosis
ggcgccagcccg

SEQ ID NO: 2961046 - RNA, 15 nt, Mycobacterium avium subsp. paratuberculosis
ggcgccagcccgccg

SEQ ID NO: 2961047 - RNA, 13 nt, Mycobacterium avium subsp. paratuberculosis
ggcgccagcccgg

SEQ ID NO: 2961048 - RNA, 14 nt, Mycobacterium avium subsp. paratuberculosis
ggcgccagcccggu

SEQ ID NO: 2961049 - RNA, 18 nt, Mycobacterium avium subsp. paratuberculosis
ggcgccagcccggugauc

SEQ ID NO: 2961050 - RNA, 21 nt, Mycobacterium avium subsp. paratuberculosis
ggcgccagcccggugaucgcc

SEQ ID NO: 2961051 - RNA, 11 nt, Mycobacterium avium subsp. paratuberculosis
ggcgccagccg

SEQ ID NO: 2961052 - RNA, 12 nt, Mycobacterium avium subsp. paratuberculosis
ggcgccagccgc

SEQ ID NO: 2961053 - RNA, 17 nt, Mycobacterium avium subsp. paratuberculosis
ggcgccagccgcaccgc

SEQ ID NO: 2961054 - RNA, 18 nt, Mycobacterium avium subsp. paratuberculosis
ggcgccagccgcaccgcg

SEQ ID NO: 2961055 - RNA, 13 nt, Mycobacterium avium subsp. paratuberculosis
ggcgccagcggcc

SEQ ID NO: 2961056 - RNA, 11 nt, Mycobacterium avium subsp. paratuberculosis
ggcgccaggcc

SEQ ID NO: 2961057 - RNA, 13 nt, Mycobacterium avium subsp. paratuberculosis
ggcgccaggccgg

SEQ ID NO: 2961058 - RNA, 16 nt, Mycobacterium avium subsp. paratuberculosis
ggcgccaggccggcga

SEQ ID NO: 2961059 - RNA, 18 nt, Mycobacterium avium subsp. paratuberculosis
ggcgccaggccggcgacg

SEQ ID NO: 2961060 - RNA, 21 nt, Mycobacterium avium subsp. paratuberculosis
ggcgccaguaguggaucagcc

SEQ ID NO: 2961061 - RNA, 19 nt, Mycobacterium avium subsp. paratuberculosis
ggcgccauccgcagcccgu

SEQ ID NO: 2961062 - RNA, 19 nt, Mycobacterium avium subsp. paratuberculosis
ggcgccauccgccacccgc

SEQ ID NO: 2961063 - RNA, 14 nt, Mycobacterium avium subsp. paratuberculosis
ggcgcccacagcag

SEQ ID NO: 2961064 - RNA, 12 nt, Mycobacterium avium subsp. paratuberculosis
ggcgcccacccg

SEQ ID NO: 2961065 - RNA, 16 nt, Mycobacterium avium subsp. paratuberculosis
ggcgcccacccguugg

SEQ ID NO: 2961066 - RNA, 23 nt, Mycobacterium avium subsp. paratuberculosis
ggcgcccacccguuggcaggccc

SEQ ID NO: 2961067 - RNA, 12 nt, Mycobacterium avium subsp. paratuberculosis
ggcgcccaccgc

SEQ ID NO: 2961068 - RNA, 13 nt, Mycobacterium avium subsp. paratuberculosis
ggcgcccaccgcg

SEQ ID NO: 2961069 - RNA, 16 nt, Mycobacterium avium subsp. paratuberculosis
ggcgcccaccgcggcg

SEQ ID NO: 2961070 - RNA, 13 nt, Mycobacterium avium subsp. paratuberculosis
ggcgcccacggcc

SEQ ID NO: 2961071 - RNA, 22 nt, Mycobacterium avium subsp. paratuberculosis
ggcgcccacggccaccacggca

SEQ ID NO: 2961072 - RNA, 18 nt, Mycobacterium avium subsp. paratuberculosis
ggcgcccagaagccccgg

SEQ ID NO: 2961073 - RNA, 13 nt, Mycobacterium avium subsp. paratuberculosis
ggcgcccagaucg

SEQ ID NO: 2961074 - RNA, 18 nt, Mycobacterium avium subsp. paratuberculosis
ggcgcccagaucggccag

SEQ ID NO: 2961075 - RNA, 19 nt, Mycobacterium avium subsp. paratuberculosis
ggcgcccagaucggccagc

SEQ ID NO: 2961076 - RNA, 20 nt, Mycobacterium avium subsp. paratuberculosis
ggcgcccagaugccgccgcc

SEQ ID NO: 2961077 - RNA, 23 nt, Mycobacterium avium subsp. paratuberculosis
ggcgccgacgaucccggcgagca

SEQ ID NO: 2961078 - RNA, 16 nt, Mycobacterium avium subsp. paratuberculosis
ggcgccgacgaugcug

SEQ ID NO: 2961079 - RNA, 15 nt, Mycobacterium avium subsp. paratuberculosis
ggcgccgacggccag

SEQ ID NO: 2961080 - RNA, 16 nt, Mycobacterium avium subsp. paratuberculosis
ggcgccgacggccagc

SEQ ID NO: 2961081 - RNA, 17 nt, Mycobacterium avium subsp. paratuberculosis
ggcgccgacggccagca

SEQ ID NO: 2961082 - RNA, 20 nt, Mycobacterium avium subsp. paratuberculosis
ggcgccgacggccagcagga

SEQ ID NO: 2961083 - RNA, 21 nt, Mycobacterium avium subsp. paratuberculosis
ggcgccgacggccagcaggau

SEQ ID NO: 2961084 - RNA, 14 nt, Mycobacterium avium subsp. paratuberculosis
ggcgccgacgggcc

SEQ ID NO: 2961085 - RNA, 17 nt, Mycobacterium avium subsp. paratuberculosis
ggcgccgacgggcccgc

SEQ ID NO: 2961086 - RNA, 20 nt, Mycobacterium avium subsp. paratuberculosis
ggcgccgacgggcccgcgcc

SEQ ID NO: 2961087 - RNA, 14 nt, Mycobacterium avium subsp. paratuberculosis
ggcgccgagcguca

SEQ ID NO: 2961088 - RNA, 18 nt, Mycobacterium avium subsp. paratuberculosis
ggcgccgagcgucacgcu

SEQ ID NO: 2961089 - RNA, 19 nt, Mycobacterium avium subsp. paratuberculosis
ggcgccgagcgucacgcug

SEQ ID NO: 2961090 - RNA, 20 nt, Mycobacterium avium subsp. paratuberculosis
ggcgccgagcgucacgcugg

SEQ ID NO: 2961091 - RNA, 16 nt, Mycobacterium avium subsp. paratuberculosis
ggcgccgaggaucuug

SEQ ID NO: 2961092 - RNA, 21 nt, Mycobacterium avium subsp. paratuberculosis
ggcgccgaggaucuugaucgc

SEQ ID NO: 2961093 - RNA, 17 nt, Mycobacterium avium subsp. paratuberculosis
ggcgccgaguccgggcc

SEQ ID NO: 2961094 - RNA, 14 nt, Mycobacterium avium subsp. paratuberculosis
ggcgccgaucacgc

SEQ ID NO: 2961095 - RNA, 15 nt, Mycobacterium avium subsp. paratuberculosis
ggcgccgaucgcgcg

SEQ ID NO: 2961096 - RNA, 20 nt, Mycobacterium avium subsp. paratuberculosis
ggcgccgaucgcgcgcagga

SEQ ID NO: 2961097 - RNA, 17 nt, Mycobacterium avium subsp. paratuberculosis
ggcgccgaucugcucgg

SEQ ID NO: 2961098 - RNA, 15 nt, Mycobacterium avium subsp. paratuberculosis
ggcgccgaugcagca

SEQ ID NO: 2961099 - RNA, 20 nt, Mycobacterium avium subsp. paratuberculosis
ggcgccgaugcccgccccgg

SEQ ID NO: 2961100 - RNA, 22 nt, Mycobacterium avium subsp. paratuberculosis
ggcgccgaugcccgccccggac

SEQ ID NO: 2961101 - RNA, 22 nt, Mycobacterium avium subsp. paratuberculosis
ggcgccgauuccgucgguggcg

SEQ ID NO: 2961102 - RNA, 17 nt, Mycobacterium avium subsp. paratuberculosis
ggcgccgcagcaggugc

SEQ ID NO: 2961103 - RNA, 16 nt, Mycobacterium avium subsp. paratuberculosis
ggcgccgcagcggcgc

SEQ ID NO: 2961104 - RNA, 13 nt, Mycobacterium avium subsp. paratuberculosis
ggcgccgcagcuc

SEQ ID NO: 2961105 - RNA, 15 nt, Mycobacterium avium subsp. paratuberculosis
ggcgccgccaccacg

SEQ ID NO: 2961106 - RNA, 16 nt, Mycobacterium avium subsp. paratuberculosis
ggcgccgccaccacga

SEQ ID NO: 2961107 - RNA, 12 nt, Mycobacterium avium subsp. paratuberculosis
ggcgccgcccac

SEQ ID NO: 2961108 - RNA, 15 nt, Mycobacterium avium subsp. paratuberculosis
ggcgccgcccaccag

SEQ ID NO: 2961109 - RNA, 16 nt, Mycobacterium avium subsp. paratuberculosis
ggcgccgcccaccagc

SEQ ID NO: 2961110 - RNA, 12 nt, Mycobacterium avium subsp. paratuberculosis
ggcgccgcccgg

SEQ ID NO: 2961111 - RNA, 14 nt, Mycobacterium avium subsp. paratuberculosis
ggcgccgcccggcg

SEQ ID NO: 2961112 - RNA, 13 nt, Mycobacterium avium subsp. paratuberculosis
ggcgccgcccggg

SEQ ID NO: 2961113 - RNA, 14 nt, Mycobacterium avium subsp. paratuberculosis
ggcgccgcccgggc

SEQ ID NO: 2961114 - RNA, 17 nt, Mycobacterium avium subsp. paratuberculosis
ggcgccgcccgggcccg

SEQ ID NO: 2961115 - RNA, 19 nt, Mycobacterium avium subsp. paratuberculosis
ggcgccgccgaccgcccgc

SEQ ID NO: 2961116 - RNA, 20 nt, Mycobacterium avium subsp. paratuberculosis
ggcgccgccgaccgcccgcu

SEQ ID NO: 2961117 - RNA, 14 nt, Mycobacterium avium subsp. paratuberculosis
ggcgccgccgagcc

SEQ ID NO: 2961118 - RNA, 16 nt, Mycobacterium avium subsp. paratuberculosis
ggcgccgccgagccgc

SEQ ID NO: 2961119 - RNA, 13 nt, Mycobacterium avium subsp. paratuberculosis
ggcgccgccggcg

SEQ ID NO: 2961120 - RNA, 16 nt, Mycobacterium avium subsp. paratuberculosis
ggcgccgccggcgucg

SEQ ID NO: 2961121 - RNA, 19 nt, Mycobacterium avium subsp. paratuberculosis
ggcgccgccggcgucgacg

SEQ ID NO: 2961122 - RNA, 20 nt, Mycobacterium avium subsp. paratuberculosis
ggcgccgccggcgucgacgu

SEQ ID NO: 2961123 - RNA, 14 nt, Mycobacterium avium subsp. paratuberculosis
ggcgccgccggggc

SEQ ID NO: 2961124 - RNA, 12 nt, Mycobacterium avium subsp. paratuberculosis
ggcgccgccggu

SEQ ID NO: 2961125 - RNA, 19 nt, Mycobacterium avium subsp. paratuberculosis
ggcgccgccggucgccccc

SEQ ID NO: 2961126 - RNA, 17 nt, Mycobacterium avium subsp. paratuberculosis
ggcgccgccguucgccg

SEQ ID NO: 2961127 - RNA, 21 nt, Mycobacterium avium subsp. paratuberculosis
ggcgccgccguucgccggcga

SEQ ID NO: 2961128 - RNA, 17 nt, Mycobacterium avium subsp. paratuberculosis
ggcgccgcgaccccgga

SEQ ID NO: 2961129 - RNA, 13 nt, Mycobacterium avium subsp. paratuberculosis
ggcgccgcgcagc

SEQ ID NO: 2961130 - RNA, 14 nt, Mycobacterium avium subsp. paratuberculosis
ggcgccgcgcagcc

SEQ ID NO: 2961131 - RNA, 15 nt, Mycobacterium avium subsp. paratuberculosis
ggcgccgcgcagcca

SEQ ID NO: 2961132 - RNA, 19 nt, Mycobacterium avium subsp. paratuberculosis
ggcgccgcgcagccagacc

SEQ ID NO: 2961133 - RNA, 13 nt, Mycobacterium avium subsp. paratuberculosis
ggcgccgcgcgcc

SEQ ID NO: 2961134 - RNA, 13 nt, Mycobacterium avium subsp. paratuberculosis
ggcgccgcggccc

SEQ ID NO: 2961135 - RNA, 19 nt, Mycobacterium avium subsp. paratuberculosis
ggcgccgcggcccugcagc

SEQ ID NO: 2961136 - RNA, 20 nt, Mycobacterium avium subsp. paratuberculosis
ggcgccgcggcccugcagcg

SEQ ID NO: 2961137 - RNA, 14 nt, Mycobacterium avium subsp. paratuberculosis
ggcgccgcggcgcc

SEQ ID NO: 2961138 - RNA, 19 nt, Mycobacterium avium subsp. paratuberculosis
ggcgccgcggcggcaccca

SEQ ID NO: 2961139 - RNA, 12 nt, Mycobacterium avium subsp. paratuberculosis
ggcgccgcgggc

SEQ ID NO: 2961140 - RNA, 13 nt, Mycobacterium avium subsp. paratuberculosis
ggcgccgcgggcg

SEQ ID NO: 2961141 - RNA, 23 nt, Mycobacterium avium subsp. paratuberculosis
ggcgccgcgggcggucgcgcagc

SEQ ID NO: 2961142 - RNA, 14 nt, Mycobacterium avium subsp. paratuberculosis
ggcgccgcggggcg

SEQ ID NO: 2961143 - RNA, 17 nt, Mycobacterium avium subsp. paratuberculosis
ggcgccgcgggugcggc

SEQ ID NO: 2961144 - RNA, 19 nt, Mycobacterium avium subsp. paratuberculosis
ggcgccgcgguagcggacc

SEQ ID NO: 2961145 - RNA, 20 nt, Mycobacterium avium subsp. paratuberculosis
ggcgccgcgguagcggaccu

SEQ ID NO: 2961146 - RNA, 17 nt, Mycobacterium avium subsp. paratuberculosis
ggcgccgcguaccagcg

SEQ ID NO: 2961147 - RNA, 20 nt, Mycobacterium avium subsp. paratuberculosis
ggcgccgcguaccagcgcca

SEQ ID NO: 2961148 - RNA, 17 nt, Mycobacterium avium subsp. paratuberculosis
ggcgccgcugcgggcca

SEQ ID NO: 2961149 - RNA, 21 nt, Mycobacterium avium subsp. paratuberculosis
ggcgccgcugcgggccaucga

SEQ ID NO: 2961150 - RNA, 17 nt, Mycobacterium avium subsp. paratuberculosis
ggcgccggacggcccgc

SEQ ID NO: 2961151 - RNA, 18 nt, Mycobacterium avium subsp. paratuberculosis
ggcgccggaggggcgacg

SEQ ID NO: 2961152 - RNA, 22 nt, Mycobacterium avium subsp. paratuberculosis
ggcgccggaggggcgacgggcc

SEQ ID NO: 2961153 - RNA, 19 nt, Mycobacterium avium subsp. paratuberculosis
ggcgccggcauccagcacg

SEQ ID NO: 2961154 - RNA, 22 nt, Mycobacterium avium subsp. paratuberculosis
ggcgccggcaucgaccgcccgc

SEQ ID NO: 2961155 - RNA, 13 nt, Mycobacterium avium subsp. paratuberculosis
ggcgccggccagc

SEQ ID NO: 2961156 - RNA, 16 nt, Mycobacterium avium subsp. paratuberculosis
ggcgccggccagcacc

SEQ ID NO: 2961157 - RNA, 14 nt, Mycobacterium avium subsp. paratuberculosis
ggcgccggccagcg

SEQ ID NO: 2961158 - RNA, 13 nt, Mycobacterium avium subsp. paratuberculosis
ggcgccggcccgc

SEQ ID NO: 2961159 - RNA, 14 nt, Mycobacterium avium subsp. paratuberculosis
ggcgccggcccgcg

SEQ ID NO: 2961160 - RNA, 17 nt, Mycobacterium avium subsp. paratuberculosis
ggcgccggcccgcggcg

SEQ ID NO: 2961161 - RNA, 18 nt, Mycobacterium avium subsp. paratuberculosis
ggcgccggcccgcggcgg

SEQ ID NO: 2961162 - RNA, 16 nt, Mycobacterium avium subsp. paratuberculosis
ggcgccugauccgcgg

SEQ ID NO: 2961163 - RNA, 19 nt, Mycobacterium avium subsp. paratuberculosis
ggcgccugauccgcgguca

SEQ ID NO: 2961164 - RNA, 22 nt, Mycobacterium avium subsp. paratuberculosis
ggcgccuucuuggccgcgcccu

SEQ ID NO: 2961165 - RNA, 20 nt, Mycobacterium avium subsp. paratuberculosis
ggcgccuucuuggcggcggu

SEQ ID NO: 2961166 - RNA, 19 nt, Mycobacterium avium subsp. paratuberculosis
ggcgccuugaaccggcugg

SEQ ID NO: 2961167 - RNA, 20 nt, Mycobacterium avium subsp. paratuberculosis
ggcgccuugaaccggcugga

SEQ ID NO: 2961168 - RNA, 23 nt, Mycobacterium avium subsp. paratuberculosis
ggcgccuugaaccggcuggacac

SEQ ID NO: 2961169 - RNA, 14 nt, Mycobacterium avium subsp. paratuberculosis
ggcgcgaaccgggc

SEQ ID NO: 2961170 - RNA, 16 nt, Mycobacterium avium subsp. paratuberculosis
ggcgcgaaccgggcca

SEQ ID NO: 2961171 - RNA, 16 nt, Mycobacterium avium subsp. paratuberculosis
ggcgcgaacgcagucc

SEQ ID NO: 2961172 - RNA, 19 nt, Mycobacterium avium subsp. paratuberculosis
ggcgcgaagguggcgccgg

SEQ ID NO: 2961173 - RNA, 17 nt, Mycobacterium avium subsp. paratuberculosis
ggcgcgaaucccggccu

SEQ ID NO: 2961174 - RNA, 18 nt, Mycobacterium avium subsp. paratuberculosis
ggcgcgaaucccggccuc

SEQ ID NO: 2961175 - RNA, 22 nt, Mycobacterium avium subsp. paratuberculosis
ggcgcgaaucccggccucgugc

SEQ ID NO: 2961176 - RNA, 21 nt, Mycobacterium avium subsp. paratuberculosis
ggcgcgaauuccucagcgccc

SEQ ID NO: 2961177 - RNA, 14 nt, Mycobacterium avium subsp. paratuberculosis
ggcgcgacaccgcg

SEQ ID NO: 2961178 - RNA, 15 nt, Mycobacterium avium subsp. paratuberculosis
ggcgcgacaccgcgg

SEQ ID NO: 2961179 - RNA, 17 nt, Mycobacterium avium subsp. paratuberculosis
ggcgcgacaccgcggcg

SEQ ID NO: 2961180 - RNA, 22 nt, Mycobacterium avium subsp. paratuberculosis
ggcgcgaccagcggcagcagca

SEQ ID NO: 2961181 - RNA, 14 nt, Mycobacterium avium subsp. paratuberculosis
ggcgcgacggcggc

SEQ ID NO: 2961182 - RNA, 16 nt, Mycobacterium avium subsp. paratuberculosis
ggcgcgacggcggcga

SEQ ID NO: 2961183 - RNA, 14 nt, Mycobacterium avium subsp. paratuberculosis
ggcgcgacggucac

SEQ ID NO: 2961184 - RNA, 17 nt, Mycobacterium avium subsp. paratuberculosis
ggcgcgacggucacgcu

SEQ ID NO: 2961185 - RNA, 18 nt, Mycobacterium avium subsp. paratuberculosis
ggcgcgacggucacgcug

SEQ ID NO: 2961186 - RNA, 12 nt, Mycobacterium avium subsp. paratuberculosis
ggcgcgaggcgc

SEQ ID NO: 2961187 - RNA, 15 nt, Mycobacterium avium subsp. paratuberculosis
ggcgcgaggcgggua

SEQ ID NO: 2961188 - RNA, 19 nt, Mycobacterium avium subsp. paratuberculosis
ggcgcgauagccggugauc

SEQ ID NO: 2961189 - RNA, 23 nt, Mycobacterium avium subsp. paratuberculosis
ggcgcgauagccggugaucgcgg

SEQ ID NO: 2961190 - RNA, 19 nt, Mycobacterium avium subsp. paratuberculosis
ggcgcgaucaggcugccgc

SEQ ID NO: 2961191 - RNA, 22 nt, Mycobacterium avium subsp. paratuberculosis
ggcgcgaucggcaggucgucga

SEQ ID NO: 2961192 - RNA, 16 nt, Mycobacterium avium subsp. paratuberculosis
ggcgcgaucggccgcu

SEQ ID NO: 2961193 - RNA, 23 nt, Mycobacterium avium subsp. paratuberculosis
ggcgcgaucggccgcugcccggg

SEQ ID NO: 2961194 - RNA, 16 nt, Mycobacterium avium subsp. paratuberculosis
ggcgcgaucgucgacc

SEQ ID NO: 2961195 - RNA, 19 nt, Mycobacterium avium subsp. paratuberculosis
ggcgcgaugaucgccggcg

SEQ ID NO: 2961196 - RNA, 21 nt, Mycobacterium avium subsp. paratuberculosis
ggcgcgaugaucgccggcgcc

SEQ ID NO: 2961197 - RNA, 22 nt, Mycobacterium avium subsp. paratuberculosis
ggcgcgaugaucgccggcgccg

SEQ ID NO: 2961198 - RNA, 21 nt, Mycobacterium avium subsp. paratuberculosis
ggcgcgaugcuauucgggcca

SEQ ID NO: 2961199 - RNA, 17 nt, Mycobacterium avium subsp. paratuberculosis
ggcgcgcaacucgucca

SEQ ID NO: 2961200 - RNA, 21 nt, Mycobacterium avium subsp. paratuberculosis
ggcgcgcaacucguccaccag

SEQ ID NO: 2961201 - RNA, 22 nt, Mycobacterium avium subsp. paratuberculosis
ggcgcgcaacucguccaccagc

SEQ ID NO: 2961202 - RNA, 13 nt, Mycobacterium avium subsp. paratuberculosis
ggcgcgcaccagc

SEQ ID NO: 2961203 - RNA, 17 nt, Mycobacterium avium subsp. paratuberculosis
ggcgcgcaccagcucgg

SEQ ID NO: 2961204 - RNA, 22 nt, Mycobacterium avium subsp. paratuberculosis
ggcgcgcaccagcucggcgcug

SEQ ID NO: 2961205 - RNA, 13 nt, Mycobacterium avium subsp. paratuberculosis
ggcgcgcaccauc

SEQ ID NO: 2961206 - RNA, 15 nt, Mycobacterium avium subsp. paratuberculosis
ggcgcgcaccccggc

SEQ ID NO: 2961207 - RNA, 22 nt, Mycobacterium avium subsp. paratuberculosis
ggcgcgcaccgcgaaacgcaac

SEQ ID NO: 2961208 - RNA, 14 nt, Mycobacterium avium subsp. paratuberculosis
ggcgcgcaccgcgg

SEQ ID NO: 2961209 - RNA, 17 nt, Mycobacterium avium subsp. paratuberculosis
ggcgcgcaccgcgggca

SEQ ID NO: 2961210 - RNA, 12 nt, Mycobacterium avium subsp. paratuberculosis
ggcgcgcaccgg

SEQ ID NO: 2961211 - RNA, 15 nt, Mycobacterium avium subsp. paratuberculosis
ggcgcgcacggcagc

SEQ ID NO: 2961212 - RNA, 16 nt, Mycobacterium avium subsp. paratuberculosis
ggcgcgcacggcagcc

SEQ ID NO: 2961213 - RNA, 21 nt, Mycobacterium avium subsp. paratuberculosis
ggcgcgcacggcagcccgacg

SEQ ID NO: 2961214 - RNA, 23 nt, Mycobacterium avium subsp. paratuberculosis
ggcgcgcacggcagcccgacguc

SEQ ID NO: 2961215 - RNA, 18 nt, Mycobacterium avium subsp. paratuberculosis
ggcgcgcacgucaccgcg

SEQ ID NO: 2961216 - RNA, 19 nt, Mycobacterium avium subsp. paratuberculosis
ggcgcgcacguuggcggcc

SEQ ID NO: 2961217 - RNA, 20 nt, Mycobacterium avium subsp. paratuberculosis
ggcgcgcacguuggcggcca

SEQ ID NO: 2961218 - RNA, 20 nt, Mycobacterium avium subsp. paratuberculosis
ggcgcgcagaucgucgaccu

SEQ ID NO: 2961219 - RNA, 23 nt, Mycobacterium avium subsp. paratuberculosis
ggcgcgcagaucgucgaccugcu

SEQ ID NO: 2961220 - RNA, 14 nt, Mycobacterium avium subsp. paratuberculosis
ggcgcgcagcaauu

SEQ ID NO: 2961221 - RNA, 20 nt, Mycobacterium avium subsp. paratuberculosis
ggcgcgcagcaauugacgcc

SEQ ID NO: 2961222 - RNA, 23 nt, Mycobacterium avium subsp. paratuberculosis
ggcgcgcagcaauugacgccgac

SEQ ID NO: 2961223 - RNA, 12 nt, Mycobacterium avium subsp. paratuberculosis
ggcgcgcagcag

SEQ ID NO: 2961224 - RNA, 20 nt, Mycobacterium avium subsp. paratuberculosis
ggcgcgcagcaggcgccggu

SEQ ID NO: 2961225 - RNA, 22 nt, Mycobacterium avium subsp. paratuberculosis
ggcgcgcagccacgagcccagc

SEQ ID NO: 2961226 - RNA, 23 nt, Mycobacterium avium subsp. paratuberculosis
ggcgcgcagccacgagcccagcc

SEQ ID NO: 2961227 - RNA, 14 nt, Mycobacterium avium subsp. paratuberculosis
ggcgcgcagccagu

SEQ ID NO: 2961228 - RNA, 15 nt, Mycobacterium avium subsp. paratuberculosis
ggcgcgcagcccagc

SEQ ID NO: 2961229 - RNA, 18 nt, Mycobacterium avium subsp. paratuberculosis
ggcgcgcagcccagccag

SEQ ID NO: 2961230 - RNA, 20 nt, Mycobacterium avium subsp. paratuberculosis
ggcgcgcagccggccgucca

SEQ ID NO: 2961231 - RNA, 11 nt, Mycobacterium avium subsp. paratuberculosis
ggcgcgcagcu

SEQ ID NO: 2961232 - RNA, 20 nt, Mycobacterium avium subsp. paratuberculosis
ggcgcgcagcucgcgcagcc

SEQ ID NO: 2961233 - RNA, 21 nt, Mycobacterium avium subsp. paratuberculosis
ggcgcgcagcucgcgcagccg

SEQ ID NO: 2961234 - RNA, 20 nt, Mycobacterium avium subsp. paratuberculosis
ggcgcgcaggcgcaccacca

SEQ ID NO: 2961235 - RNA, 17 nt, Mycobacterium avium subsp. paratuberculosis
ggcgcgcaggcgcgcgg

SEQ ID NO: 2961236 - RNA, 21 nt, Mycobacterium avium subsp. paratuberculosis
ggcgcgcaggcgcgcggccag

SEQ ID NO: 2961237 - RNA, 17 nt, Mycobacterium avium subsp. paratuberculosis
ggcgcgcaggcuggcau

SEQ ID NO: 2961238 - RNA, 19 nt, Mycobacterium avium subsp. paratuberculosis
ggcgcgcagguagccgccg

SEQ ID NO: 2961239 - RNA, 22 nt, Mycobacterium avium subsp. paratuberculosis
ggcgcgcagucgcaggccccgg

SEQ ID NO: 2961240 - RNA, 17 nt, Mycobacterium avium subsp. paratuberculosis
ggcgcgcaucccgaucg

SEQ ID NO: 2961241 - RNA, 14 nt, Mycobacterium avium subsp. paratuberculosis
ggcgcgcaucgccg

SEQ ID NO: 2961242 - RNA, 18 nt, Mycobacterium avium subsp. paratuberculosis
ggcgcgcaucgccgucca

SEQ ID NO: 2961243 - RNA, 19 nt, Mycobacterium avium subsp. paratuberculosis
ggcgcgcaucgucgcggcg

SEQ ID NO: 2961244 - RNA, 22 nt, Mycobacterium avium subsp. paratuberculosis
ggcgcgcaucgucgcggcgcua

SEQ ID NO: 2961245 - RNA, 19 nt, Mycobacterium avium subsp. paratuberculosis
ggcgcgcaucguggcuuug

SEQ ID NO: 2961246 - RNA, 12 nt, Mycobacterium avium subsp. paratuberculosis
ggcgcgcaucug

SEQ ID NO: 2961247 - RNA, 17 nt, Mycobacterium avium subsp. paratuberculosis
ggcgcgcaucugcucgg

SEQ ID NO: 2961248 - RNA, 19 nt, Mycobacterium avium subsp. paratuberculosis
ggcgcgcaucugcucggcg

SEQ ID NO: 2961249 - RNA, 13 nt, Mycobacterium avium subsp. paratuberculosis
ggcgcgccacccg

SEQ ID NO: 2961250 - RNA, 14 nt, Mycobacterium avium subsp. paratuberculosis
ggcgcgccacccga

SEQ ID NO: 2961251 - RNA, 17 nt, Mycobacterium avium subsp. paratuberculosis
ggcgcgccagcguggcg

SEQ ID NO: 2961252 - RNA, 18 nt, Mycobacterium avium subsp. paratuberculosis
ggcgcgcccacccgcgcc

SEQ ID NO: 2961253 - RNA, 20 nt, Mycobacterium avium subsp. paratuberculosis
ggcgcgcccacccgcgccgg

SEQ ID NO: 2961254 - RNA, 23 nt, Mycobacterium avium subsp. paratuberculosis
ggcgcgcccacccgcgccggcag

SEQ ID NO: 2961255 - RNA, 13 nt, Mycobacterium avium subsp. paratuberculosis
ggcgcgcccgacg

SEQ ID NO: 2961256 - RNA, 19 nt, Mycobacterium avium subsp. paratuberculosis
ggcgcgcccgagucacccg

SEQ ID NO: 2961257 - RNA, 20 nt, Mycobacterium avium subsp. paratuberculosis
ggcgcgcccggaaagcgcgg

SEQ ID NO: 2961258 - RNA, 21 nt, Mycobacterium avium subsp. paratuberculosis
ggcgcgcccggaaagcgcggg

SEQ ID NO: 2961259 - RNA, 21 nt, Mycobacterium avium subsp. paratuberculosis
ggcgcgccgaagauggccagc

SEQ ID NO: 2961260 - RNA, 13 nt, Mycobacterium avium subsp. paratuberculosis
ggcgcgccgagcg

SEQ ID NO: 2961261 - RNA, 18 nt, Mycobacterium avium subsp. paratuberculosis
ggcgcgccgagcgcuggu

SEQ ID NO: 2961262 - RNA, 12 nt, Mycobacterium avium subsp. paratuberculosis
ggcgcgccgcac

SEQ ID NO: 2961263 - RNA, 19 nt, Mycobacterium avium subsp. paratuberculosis
ggcgcgccgcaccucgccg

SEQ ID NO: 2961264 - RNA, 20 nt, Mycobacterium avium subsp. paratuberculosis
ggcgcgccgcaccucgccga

SEQ ID NO: 2961265 - RNA, 21 nt, Mycobacterium avium subsp. paratuberculosis
ggcgcgccgcguucggcggcg

SEQ ID NO: 2961266 - RNA, 23 nt, Mycobacterium avium subsp. paratuberculosis
ggcgcgccgcguucggcggcgcg

SEQ ID NO: 2961267 - RNA, 15 nt, Mycobacterium avium subsp. paratuberculosis
ggcgcgccggccgga

SEQ ID NO: 2961268 - RNA, 12 nt, Mycobacterium avium subsp. paratuberculosis
ggcgcgccggcg

SEQ ID NO: 2961269 - RNA, 13 nt, Mycobacterium avium subsp. paratuberculosis
ggcgcgccggcga

SEQ ID NO: 2961270 - RNA, 23 nt, Mycobacterium avium subsp. paratuberculosis
ggcgcgccggcgauaggcggcca

SEQ ID NO: 2961271 - RNA, 13 nt, Mycobacterium avium subsp. paratuberculosis
ggcgcgccgggca

SEQ ID NO: 2961272 - RNA, 21 nt, Mycobacterium avium subsp. paratuberculosis
ggcgcgccgggcagcccgccg

SEQ ID NO: 2961273 - RNA, 14 nt, Mycobacterium avium subsp. paratuberculosis
ggcgcgccugcgcg

SEQ ID NO: 2961274 - RNA, 15 nt, Mycobacterium avium subsp. paratuberculosis
ggcgcgccugcgcgg

SEQ ID NO: 2961275 - RNA, 17 nt, Mycobacterium avium subsp. paratuberculosis
ggcgcgccugcgcggcg

SEQ ID NO: 2961276 - RNA, 18 nt, Mycobacterium avium subsp. paratuberculosis
ggcgcgccugcgcggcgg

SEQ ID NO: 2961277 - RNA, 19 nt, Mycobacterium avium subsp. paratuberculosis
ggcgcgccugcgcggcggc

SEQ ID NO: 2961278 - RNA, 20 nt, Mycobacterium avium subsp. paratuberculosis
ggcgcgccugcgcggcggcg

SEQ ID NO: 2961279 - RNA, 23 nt, Mycobacterium avium subsp. paratuberculosis
ggcgcgccugcgcggcggcgucc

SEQ ID NO: 2961280 - RNA, 22 nt, Mycobacterium avium subsp. paratuberculosis
ggcgcgcgaaaaaacggcggcg

SEQ ID NO: 2961281 - RNA, 18 nt, Mycobacterium avium subsp. paratuberculosis
ggcgcgcgauggacagca

SEQ ID NO: 2961282 - RNA, 23 nt, Mycobacterium avium subsp. paratuberculosis
ggcgcgcgauggacagcagccag

SEQ ID NO: 2961283 - RNA, 15 nt, Mycobacterium avium subsp. paratuberculosis
ggcgcgcgccagcgu

SEQ ID NO: 2961284 - RNA, 20 nt, Mycobacterium avium subsp. paratuberculosis
ggcgcgcgccagcgucugcu

SEQ ID NO: 2961285 - RNA, 15 nt, Mycobacterium avium subsp. paratuberculosis
ggcgcgcgccgauca

SEQ ID NO: 2961286 - RNA, 16 nt, Mycobacterium avium subsp. paratuberculosis
ggcgcgcgccgcagcg

SEQ ID NO: 2961287 - RNA, 18 nt, Mycobacterium avium subsp. paratuberculosis
ggcgcgcgccgcccccgc

SEQ ID NO: 2961288 - RNA, 20 nt, Mycobacterium avium subsp. paratuberculosis
ggcgcgcgccgcccccgcgg

SEQ ID NO: 2961289 - RNA, 22 nt, Mycobacterium avium subsp. paratuberculosis
ggcgcgcgccgcccccgcggcg

SEQ ID NO: 2961290 - RNA, 18 nt, Mycobacterium avium subsp. paratuberculosis
ggcgcgcgcgccccagcc

SEQ ID NO: 2961291 - RNA, 21 nt, Mycobacterium avium subsp. paratuberculosis
ggcgcgcgcgccccagccccu

SEQ ID NO: 2961292 - RNA, 21 nt, Mycobacterium avium subsp. paratuberculosis
ggcgcgcggagaucaccccug

SEQ ID NO: 2961293 - RNA, 14 nt, Mycobacterium avium subsp. paratuberculosis
ggcgcgcggccagc

SEQ ID NO: 2961294 - RNA, 13 nt, Mycobacterium avium subsp. paratuberculosis
ggcgcgcggggcc

SEQ ID NO: 2961295 - RNA, 14 nt, Mycobacterium avium subsp. paratuberculosis
ggcgcgcggggccg

SEQ ID NO: 2961296 - RNA, 12 nt, Mycobacterium avium subsp. paratuberculosis
ggcgcgcggugg

SEQ ID NO: 2961297 - RNA, 20 nt, Mycobacterium avium subsp. paratuberculosis
ggcgcgcguauuccagcgcc

SEQ ID NO: 2961298 - RNA, 21 nt, Mycobacterium avium subsp. paratuberculosis
ggcgcgcguauuccagcgcca

SEQ ID NO: 2961299 - RNA, 17 nt, Mycobacterium avium subsp. paratuberculosis
ggcgcgcuaacggcgcg

SEQ ID NO: 2961300 - RNA, 18 nt, Mycobacterium avium subsp. paratuberculosis
ggcgcgcuaacggcgcgg

SEQ ID NO: 2961301 - RNA, 22 nt, Mycobacterium avium subsp. paratuberculosis
ggcgcgcuaacggcgcggcagu

SEQ ID NO: 2961302 - RNA, 17 nt, Mycobacterium avium subsp. paratuberculosis
ggcgcgcucgguggaca

SEQ ID NO: 2961303 - RNA, 20 nt, Mycobacterium avium subsp. paratuberculosis
ggcgcgcucgguggacaggu

SEQ ID NO: 2961304 - RNA, 13 nt, Mycobacterium avium subsp. paratuberculosis
ggcgcgcucgucg

SEQ ID NO: 2961305 - RNA, 20 nt, Mycobacterium avium subsp. paratuberculosis
ggcgcgcucgucgucgguga

SEQ ID NO: 2961306 - RNA, 22 nt, Mycobacterium avium subsp. paratuberculosis
ggcgcgcucgucgucggugaac

SEQ ID NO: 2961307 - RNA, 18 nt, Mycobacterium avium subsp. paratuberculosis
ggcgcgcucuaacuccgc

SEQ ID NO: 2961308 - RNA, 19 nt, Mycobacterium avium subsp. paratuberculosis
ggcgcgcugaagcgcgacc

SEQ ID NO: 2961309 - RNA, 22 nt, Mycobacterium avium subsp. paratuberculosis
ggcgcgcugaagcgcgaccccu

SEQ ID NO: 2961310 - RNA, 14 nt, Mycobacterium avium subsp. paratuberculosis
ggcgcgcugcaggc

SEQ ID NO: 2961311 - RNA, 16 nt, Mycobacterium avium subsp. paratuberculosis
ggcgcgcugcaggccc

SEQ ID NO: 2961312 - RNA, 17 nt, Mycobacterium avium subsp. paratuberculosis
ggcgcgcugucgacgcg

SEQ ID NO: 2961313 - RNA, 22 nt, Mycobacterium avium subsp. paratuberculosis
ggcgcgcuuggucuuucgcgcu

SEQ ID NO: 2961314 - RNA, 23 nt, Mycobacterium avium subsp. paratuberculosis
ggcgcggaacagcgucgccgacg

SEQ ID NO: 2961315 - RNA, 21 nt, Mycobacterium avium subsp. paratuberculosis
ggcgcggacagcgcggugaug

SEQ ID NO: 2961316 - RNA, 19 nt, Mycobacterium avium subsp. paratuberculosis
ggcgcggacagcugcgcgg

SEQ ID NO: 2961317 - RNA, 15 nt, Mycobacterium avium subsp. paratuberculosis
ggcgcggaccgcacc

SEQ ID NO: 2961318 - RNA, 18 nt, Mycobacterium avium subsp. paratuberculosis
ggcgcggaccgcaccccc

SEQ ID NO: 2961319 - RNA, 21 nt, Mycobacterium avium subsp. paratuberculosis
ggcgcggaccgcacccccagc

SEQ ID NO: 2961320 - RNA, 16 nt, Mycobacterium avium subsp. paratuberculosis
ggcgcggacggaucga

SEQ ID NO: 2961321 - RNA, 13 nt, Mycobacterium avium subsp. paratuberculosis
ggcgcggacguga

SEQ ID NO: 2961322 - RNA, 19 nt, Mycobacterium avium subsp. paratuberculosis
ggcgcggagaaggugucgc

SEQ ID NO: 2961323 - RNA, 17 nt, Mycobacterium avium subsp. paratuberculosis
ggcgcggagccggccgc

SEQ ID NO: 2961324 - RNA, 19 nt, Mycobacterium avium subsp. paratuberculosis
ggcgcggagccggccgccg

SEQ ID NO: 2961325 - RNA, 15 nt, Mycobacterium avium subsp. paratuberculosis
ggcgcggagcgucgc

SEQ ID NO: 2961326 - RNA, 14 nt, Mycobacterium avium subsp. paratuberculosis
ggcgcggaucguca

SEQ ID NO: 2961327 - RNA, 18 nt, Mycobacterium avium subsp. paratuberculosis
ggcgcggaucgucaccga

SEQ ID NO: 2961328 - RNA, 17 nt, Mycobacterium avium subsp. paratuberculosis
ggcgcggaugacgugca

SEQ ID NO: 2961329 - RNA, 21 nt, Mycobacterium avium subsp. paratuberculosis
ggcgcggauggguggcgauca

SEQ ID NO: 2961330 - RNA, 14 nt, Mycobacterium avium subsp. paratuberculosis
ggcgcguugaugcc

SEQ ID NO: 2961331 - RNA, 19 nt, Mycobacterium avium subsp. paratuberculosis
ggcgcguugaugccgugcg

SEQ ID NO: 2961332 - RNA, 22 nt, Mycobacterium avium subsp. paratuberculosis
ggcgcguugaugccgugcgcgc

SEQ ID NO: 2961333 - RNA, 19 nt, Mycobacterium avium subsp. paratuberculosis
ggcgcguuggccggcugga

SEQ ID NO: 2961334 - RNA, 17 nt, Mycobacterium avium subsp. paratuberculosis
ggcgcuaaagccaccag

SEQ ID NO: 2961335 - RNA, 19 nt, Mycobacterium avium subsp. paratuberculosis
ggcgcuaaagccgaccgcc

SEQ ID NO: 2961336 - RNA, 16 nt, Mycobacterium avium subsp. paratuberculosis
ggcgcuacgccggcuc

SEQ ID NO: 2961337 - RNA, 21 nt, Mycobacterium avium subsp. paratuberculosis
ggcgcuacgccggcucggucu

SEQ ID NO: 2961338 - RNA, 23 nt, Mycobacterium avium subsp. paratuberculosis
ggcgcuacgccggcucggucucc

SEQ ID NO: 2961339 - RNA, 13 nt, Mycobacterium avium subsp. paratuberculosis
ggcgcuacgcgcc

SEQ ID NO: 2961340 - RNA, 18 nt, Mycobacterium avium subsp. paratuberculosis
ggcgcuagcugcgccggc

SEQ ID NO: 2961341 - RNA, 13 nt, Mycobacterium avium subsp. paratuberculosis
ggcgcucaccgcg

SEQ ID NO: 2961342 - RNA, 14 nt, Mycobacterium avium subsp. paratuberculosis
ggcgcucagcgcgg

SEQ ID NO: 2961343 - RNA, 16 nt, Mycobacterium avium subsp. paratuberculosis
ggcgcucagcgcggcg

SEQ ID NO: 2961344 - RNA, 21 nt, Mycobacterium avium subsp. paratuberculosis
ggcgcucagcgcggcgggcca

SEQ ID NO: 2961345 - RNA, 14 nt, Mycobacterium avium subsp. paratuberculosis
ggcgcucagcggca

SEQ ID NO: 2961346 - RNA, 15 nt, Mycobacterium avium subsp. paratuberculosis
ggcgcucagcggcag

SEQ ID NO: 2961347 - RNA, 16 nt, Mycobacterium avium subsp. paratuberculosis
ggcgcucaucaggcgg

SEQ ID NO: 2961348 - RNA, 19 nt, Mycobacterium avium subsp. paratuberculosis
ggcgcucaucaggcggccg

SEQ ID NO: 2961349 - RNA, 20 nt, Mycobacterium avium subsp. paratuberculosis
ggcgcuccagccacuccacc

SEQ ID NO: 2961350 - RNA, 12 nt, Mycobacterium avium subsp. paratuberculosis
ggcgcuccagcg

SEQ ID NO: 2961351 - RNA, 14 nt, Mycobacterium avium subsp. paratuberculosis
ggcgcuccagcggg

SEQ ID NO: 2961352 - RNA, 21 nt, Mycobacterium avium subsp. paratuberculosis
ggcgcuccagcgggcggcggu

SEQ ID NO: 2961353 - RNA, 13 nt, Mycobacterium avium subsp. paratuberculosis
ggcgcucccgaug

SEQ ID NO: 2961354 - RNA, 20 nt, Mycobacterium avium subsp. paratuberculosis
ggcgcucccgauggcucgcg

SEQ ID NO: 2961355 - RNA, 11 nt, Mycobacterium avium subsp. paratuberculosis
ggcgcucgccg

SEQ ID NO: 2961356 - RNA, 12 nt, Mycobacterium avium subsp. paratuberculosis
ggcgcucgccgc

SEQ ID NO: 2961357 - RNA, 19 nt, Mycobacterium avium subsp. paratuberculosis
ggcgcucgccgcgcggccc

SEQ ID NO: 2961358 - RNA, 17 nt, Mycobacterium avium subsp. paratuberculosis
ggcgcucgucgucgccg

SEQ ID NO: 2961359 - RNA, 18 nt, Mycobacterium avium subsp. paratuberculosis
ggcgcucgucgucgccga

SEQ ID NO: 2961360 - RNA, 21 nt, Mycobacterium avium subsp. paratuberculosis
ggcgcugaacugcucgaccag

SEQ ID NO: 2961361 - RNA, 23 nt, Mycobacterium avium subsp. paratuberculosis
ggcgcugaacugcucgaccagcg

SEQ ID NO: 2961362 - RNA, 14 nt, Mycobacterium avium subsp. paratuberculosis
ggcgcugaagugca

SEQ ID NO: 2961363 - RNA, 17 nt, Mycobacterium avium subsp. paratuberculosis
ggcgcugaagugcagcg

SEQ ID NO: 2961364 - RNA, 14 nt, Mycobacterium avium subsp. paratuberculosis
ggcgcugagcgggu

SEQ ID NO: 2961365 - RNA, 17 nt, Mycobacterium avium subsp. paratuberculosis
ggcgcugagcggguaac

SEQ ID NO: 2961366 - RNA, 13 nt, Mycobacterium avium subsp. paratuberculosis
ggcgcugaucgag

SEQ ID NO: 2961367 - RNA, 15 nt, Mycobacterium avium subsp. paratuberculosis
ggcgcugcagcagcc

SEQ ID NO: 2961368 - RNA, 16 nt, Mycobacterium avium subsp. paratuberculosis
ggcgcugcagcagccc

SEQ ID NO: 2961369 - RNA, 17 nt, Mycobacterium avium subsp. paratuberculosis
ggcgcugcagcagcccg

SEQ ID NO: 2961370 - RNA, 23 nt, Mycobacterium avium subsp. paratuberculosis
ggcgcugcccgucgaccuccucg

SEQ ID NO: 2961371 - RNA, 15 nt, Mycobacterium avium subsp. paratuberculosis
ggcgcugccgagcac

SEQ ID NO: 2961372 - RNA, 13 nt, Mycobacterium avium subsp. paratuberculosis
ggcgcugccgccg

SEQ ID NO: 2961373 - RNA, 15 nt, Mycobacterium avium subsp. paratuberculosis
ggcgcugccggcgca

SEQ ID NO: 2961374 - RNA, 22 nt, Mycobacterium avium subsp. paratuberculosis
ggcgcugccggugcugcucgag

SEQ ID NO: 2961375 - RNA, 13 nt, Mycobacterium avium subsp. paratuberculosis
ggcgcugcgcccg

SEQ ID NO: 2961376 - RNA, 15 nt, Mycobacterium avium subsp. paratuberculosis
ggcgcugcgcccggu

SEQ ID NO: 2961377 - RNA, 14 nt, Mycobacterium avium subsp. paratuberculosis
ggcgcugcgcgaca

SEQ ID NO: 2961378 - RNA, 14 nt, Mycobacterium avium subsp. paratuberculosis
ggcgcugcgcggug

SEQ ID NO: 2961379 - RNA, 16 nt, Mycobacterium avium subsp. paratuberculosis
ggcgcugcgcgguggc

SEQ ID NO: 2961380 - RNA, 17 nt, Mycobacterium avium subsp. paratuberculosis
ggcgcugcgcgguggcg

SEQ ID NO: 2961381 - RNA, 18 nt, Mycobacterium avium subsp. paratuberculosis
ggcgcugcgcgguggcgc

SEQ ID NO: 2961382 - RNA, 20 nt, Mycobacterium avium subsp. paratuberculosis
ggcgcugcgcuucgagcaga

SEQ ID NO: 2961383 - RNA, 12 nt, Mycobacterium avium subsp. paratuberculosis
ggcgcugcucgg

SEQ ID NO: 2961384 - RNA, 14 nt, Mycobacterium avium subsp. paratuberculosis
ggcgcuggccagcg

SEQ ID NO: 2961385 - RNA, 15 nt, Mycobacterium avium subsp. paratuberculosis
ggcgcuggccagcgc

SEQ ID NO: 2961386 - RNA, 19 nt, Mycobacterium avium subsp. paratuberculosis
ggcgcuggccagcgcgacg

SEQ ID NO: 2961387 - RNA, 13 nt, Mycobacterium avium subsp. paratuberculosis
ggcgcuggccgcg

SEQ ID NO: 2961388 - RNA, 15 nt, Mycobacterium avium subsp. paratuberculosis
ggcgcuggccgcggc

SEQ ID NO: 2961389 - RNA, 13 nt, Mycobacterium avium subsp. paratuberculosis
ggcgcuggcgcgc

SEQ ID NO: 2961390 - RNA, 15 nt, Mycobacterium avium subsp. paratuberculosis
ggcgcuggcgcgccg

SEQ ID NO: 2961391 - RNA, 13 nt, Mycobacterium avium subsp. paratuberculosis
ggcgcuggcgugc

SEQ ID NO: 2961392 - RNA, 14 nt, Mycobacterium avium subsp. paratuberculosis
ggcgcuggcgugcu

SEQ ID NO: 2961393 - RNA, 23 nt, Mycobacterium avium subsp. paratuberculosis
ggcgcugggagcgggccacgcag

SEQ ID NO: 2961394 - RNA, 16 nt, Mycobacterium avium subsp. paratuberculosis
ggcgcugggugcgggc

SEQ ID NO: 2961395 - RNA, 22 nt, Mycobacterium avium subsp. paratuberculosis
ggcgcuggguguuccccgggcg

SEQ ID NO: 2961396 - RNA, 16 nt, Mycobacterium avium subsp. paratuberculosis
ggcgcuggucggcggg

SEQ ID NO: 2961397 - RNA, 14 nt, Mycobacterium avium subsp. paratuberculosis
ggcgcuguaccgcg

SEQ ID NO: 2961398 - RNA, 21 nt, Mycobacterium avium subsp. paratuberculosis
ggcgcuguaccgcgagaucag

SEQ ID NO: 2961399 - RNA, 23 nt, Mycobacterium avium subsp. paratuberculosis
ggcgcuguaccgcgagaucagcg

SEQ ID NO: 2961400 - RNA, 16 nt, Mycobacterium avium subsp. paratuberculosis
ggcgcuguaggcggcg

SEQ ID NO: 2961401 - RNA, 19 nt, Mycobacterium avium subsp. paratuberculosis
ggcgcuguaggcggcgugc

SEQ ID NO: 2961402 - RNA, 15 nt, Mycobacterium avium subsp. paratuberculosis
ggcgcugucggcggg

SEQ ID NO: 2961403 - RNA, 16 nt, Mycobacterium avium subsp. paratuberculosis
ggcgcuguugcccaau

SEQ ID NO: 2961404 - RNA, 15 nt, Mycobacterium avium subsp. paratuberculosis
ggcgcuucgggugcg

SEQ ID NO: 2961405 - RNA, 21 nt, Mycobacterium avium subsp. paratuberculosis
ggcgcuugaccucgccgagca

SEQ ID NO: 2961406 - RNA, 23 nt, Mycobacterium avium subsp. paratuberculosis
ggcgcuugaccucgccgagcagc

SEQ ID NO: 2961407 - RNA, 20 nt, Mycobacterium avium subsp. paratuberculosis
ggcgcuugcguucccagccc

SEQ ID NO: 2961408 - RNA, 17 nt, Mycobacterium avium subsp. paratuberculosis
ggcgcuuuccaccucga

SEQ ID NO: 2961409 - RNA, 21 nt, Mycobacterium avium subsp. paratuberculosis
ggcgcuuuccaccucgagcaa

SEQ ID NO: 2961410 - RNA, 17 nt, Mycobacterium avium subsp. paratuberculosis
ggcggaacccggguggc

SEQ ID NO: 2961411 - RNA, 18 nt, Mycobacterium avium subsp. paratuberculosis
ggcggaacccggguggcc

SEQ ID NO: 2961412 - RNA, 22 nt, Mycobacterium avium subsp. paratuberculosis
ggcggaaccgggccgcuggccg

SEQ ID NO: 2961413 - RNA, 18 nt, Mycobacterium avium subsp. paratuberculosis
ggcggaacggucggggcg

SEQ ID NO: 2961414 - RNA, 23 nt, Mycobacterium avium subsp. paratuberculosis
ggcggaacggucggggcggcggg

SEQ ID NO: 2961415 - RNA, 17 nt, Mycobacterium avium subsp. paratuberculosis
ggcggcagggccagcac

SEQ ID NO: 2961416 - RNA, 16 nt, Mycobacterium avium subsp. paratuberculosis
ggcggcaggucggcgg

SEQ ID NO: 2961417 - RNA, 20 nt, Mycobacterium avium subsp. paratuberculosis
ggcggcagguggggcagcac

SEQ ID NO: 2961418 - RNA, 14 nt, Mycobacterium avium subsp. paratuberculosis
ggcggcagguuggg

SEQ ID NO: 2961419 - RNA, 15 nt, Mycobacterium avium subsp. paratuberculosis
ggcggcaguccggcg

SEQ ID NO: 2961420 - RNA, 22 nt, Mycobacterium avium subsp. paratuberculosis
ggcggcagucgcagcagcagcc

SEQ ID NO: 2961421 - RNA, 15 nt, Mycobacterium avium subsp. paratuberculosis
ggcggcauccccagc

SEQ ID NO: 2961422 - RNA, 16 nt, Mycobacterium avium subsp. paratuberculosis
ggcggcauccccagcu

SEQ ID NO: 2961423 - RNA, 18 nt, Mycobacterium avium subsp. paratuberculosis
ggcggcauccccagcugg

SEQ ID NO: 2961424 - RNA, 14 nt, Mycobacterium avium subsp. paratuberculosis
ggcggcaucgcgcc

SEQ ID NO: 2961425 - RNA, 16 nt, Mycobacterium avium subsp. paratuberculosis
ggcggcaucgcgcgcg

SEQ ID NO: 2961426 - RNA, 20 nt, Mycobacterium avium subsp. paratuberculosis
ggcggcaucgcgcgcggcgg

SEQ ID NO: 2961427 - RNA, 21 nt, Mycobacterium avium subsp. paratuberculosis
ggcggcaucgcgcgcggcggc

SEQ ID NO: 2961428 - RNA, 16 nt, Mycobacterium avium subsp. paratuberculosis
ggcggcauguucgaug

SEQ ID NO: 2961429 - RNA, 19 nt, Mycobacterium avium subsp. paratuberculosis
ggcggccaacgccucgucg

SEQ ID NO: 2961430 - RNA, 21 nt, Mycobacterium avium subsp. paratuberculosis
ggcggccaacgccucgucgac

SEQ ID NO: 2961431 - RNA, 22 nt, Mycobacterium avium subsp. paratuberculosis
ggcggccaacgccucgucgacc

SEQ ID NO: 2961432 - RNA, 19 nt, Mycobacterium avium subsp. paratuberculosis
ggcggccaaucccaccaug

SEQ ID NO: 2961433 - RNA, 20 nt, Mycobacterium avium subsp. paratuberculosis
ggcggccacacuggccaugc

SEQ ID NO: 2961434 - RNA, 11 nt, Mycobacterium avium subsp. paratuberculosis
ggcggccacca

SEQ ID NO: 2961435 - RNA, 13 nt, Mycobacterium avium subsp. paratuberculosis
ggcggccaccagc

SEQ ID NO: 2961436 - RNA, 14 nt, Mycobacterium avium subsp. paratuberculosis
ggcggccaccagcc

SEQ ID NO: 2961437 - RNA, 22 nt, Mycobacterium avium subsp. paratuberculosis
ggcggccaccaucuccgcggcg

SEQ ID NO: 2961438 - RNA, 15 nt, Mycobacterium avium subsp. paratuberculosis
ggcggccaccaugcc

SEQ ID NO: 2961439 - RNA, 19 nt, Mycobacterium avium subsp. paratuberculosis
ggcggccaccaugccggcg

SEQ ID NO: 2961440 - RNA, 20 nt, Mycobacterium avium subsp. paratuberculosis
ggcggccaccaugccggcgu

SEQ ID NO: 2961441 - RNA, 24 nt, Mycobacterium avium subsp. paratuberculosis
ggcggccaccaugccggcguccag

SEQ ID NO: 2961442 - RNA, 14 nt, Mycobacterium avium subsp. paratuberculosis
ggcggccaccaugg

SEQ ID NO: 2961443 - RNA, 19 nt, Mycobacterium avium subsp. paratuberculosis
ggcggccaccaugggcggg

SEQ ID NO: 2961444 - RNA, 20 nt, Mycobacterium avium subsp. paratuberculosis
ggcggccaccaugggcggga

SEQ ID NO: 2961445 - RNA, 21 nt, Mycobacterium avium subsp. paratuberculosis
ggcggccaccaugggcgggac

SEQ ID NO: 2961446 - RNA, 19 nt, Mycobacterium avium subsp. paratuberculosis
ggcggccaccgcgccccgg

SEQ ID NO: 2961447 - RNA, 21 nt, Mycobacterium avium subsp. paratuberculosis
ggcggccaccgcgccccggcg

SEQ ID NO: 2961448 - RNA, 14 nt, Mycobacterium avium subsp. paratuberculosis
ggcggccaccgcgg

SEQ ID NO: 2961449 - RNA, 17 nt, Mycobacterium avium subsp. paratuberculosis
ggcggccaccgcggcca

SEQ ID NO: 2961450 - RNA, 19 nt, Mycobacterium avium subsp. paratuberculosis
ggcggccaccgcggccagc

SEQ ID NO: 2961451 - RNA, 15 nt, Mycobacterium avium subsp. paratuberculosis
ggcggccaccucgcc

SEQ ID NO: 2961452 - RNA, 18 nt, Mycobacterium avium subsp. paratuberculosis
ggcggccaccucgccgca

SEQ ID NO: 2961453 - RNA, 16 nt, Mycobacterium avium subsp. paratuberculosis
ggcggccaccucggcg

SEQ ID NO: 2961454 - RNA, 16 nt, Mycobacterium avium subsp. paratuberculosis
ggcggccacgacggcg

SEQ ID NO: 2961455 - RNA, 18 nt, Mycobacterium avium subsp. paratuberculosis
ggcggccacgacggcgcu

SEQ ID NO: 2961456 - RNA, 20 nt, Mycobacterium avium subsp. paratuberculosis
ggcggccacgaucgcggcca

SEQ ID NO: 2961457 - RNA, 20 nt, Mycobacterium avium subsp. paratuberculosis
ggcggccacgcuagcgugac

SEQ ID NO: 2961458 - RNA, 12 nt, Mycobacterium avium subsp. paratuberculosis
ggcggccagcac

SEQ ID NO: 2961459 - RNA, 19 nt, Mycobacterium avium subsp. paratuberculosis
ggcggccagcaccaguucg

SEQ ID NO: 2961460 - RNA, 13 nt, Mycobacterium avium subsp. paratuberculosis
ggcggccagcagc

SEQ ID NO: 2961461 - RNA, 14 nt, Mycobacterium avium subsp. paratuberculosis
ggcggccagcagca

SEQ ID NO: 2961462 - RNA, 17 nt, Mycobacterium avium subsp. paratuberculosis
ggcggccagcagcacca

SEQ ID NO: 2961463 - RNA, 16 nt, Mycobacterium avium subsp. paratuberculosis
ggcggccagccgcgcg

SEQ ID NO: 2961464 - RNA, 15 nt, Mycobacterium avium subsp. paratuberculosis
ggcggccagccgcuc

SEQ ID NO: 2961465 - RNA, 21 nt, Mycobacterium avium subsp. paratuberculosis
ggcggccagccgcucccggcg

SEQ ID NO: 2961466 - RNA, 11 nt, Mycobacterium avium subsp. paratuberculosis
ggcggccagcg

SEQ ID NO: 2961467 - RNA, 23 nt, Mycobacterium avium subsp. paratuberculosis
ggcggccagcgagaagucgcuca

SEQ ID NO: 2961468 - RNA, 20 nt, Mycobacterium avium subsp. paratuberculosis
ggcggccagcgaggacccgu

SEQ ID NO: 2961469 - RNA, 13 nt, Mycobacterium avium subsp. paratuberculosis
ggcggccagcgcc

SEQ ID NO: 2961470 - RNA, 14 nt, Mycobacterium avium subsp. paratuberculosis
ggcggccagcgccc

SEQ ID NO: 2961471 - RNA, 17 nt, Mycobacterium avium subsp. paratuberculosis
ggcggccagcgcccgcg

SEQ ID NO: 2961472 - RNA, 18 nt, Mycobacterium avium subsp. paratuberculosis
ggcggccagcgcccgcgg

SEQ ID NO: 2961473 - RNA, 20 nt, Mycobacterium avium subsp. paratuberculosis
ggcggccagcgcccgcgggu

SEQ ID NO: 2961474 - RNA, 20 nt, Mycobacterium avium subsp. paratuberculosis
ggcggccagcgcgacgcgca

SEQ ID NO: 2961475 - RNA, 12 nt, Mycobacterium avium subsp. paratuberculosis
ggcggccagcgg

SEQ ID NO: 2961476 - RNA, 12 nt, Mycobacterium avium subsp. paratuberculosis
ggcggccagcgu

SEQ ID NO: 2961477 - RNA, 14 nt, Mycobacterium avium subsp. paratuberculosis
ggcggccagcuccc

SEQ ID NO: 2961478 - RNA, 17 nt, Mycobacterium avium subsp. paratuberculosis
ggcggccaggccggcga

SEQ ID NO: 2961479 - RNA, 23 nt, Mycobacterium avium subsp. paratuberculosis
ggcggccaguucgagcgccgcgg

SEQ ID NO: 2961480 - RNA, 17 nt, Mycobacterium avium subsp. paratuberculosis
ggcggccaucgccgcgg

SEQ ID NO: 2961481 - RNA, 22 nt, Mycobacterium avium subsp. paratuberculosis
ggcggccaucgccgcgguggcg

SEQ ID NO: 2961482 - RNA, 20 nt, Mycobacterium avium subsp. paratuberculosis
ggcggccaucucgugcccgg

SEQ ID NO: 2961483 - RNA, 21 nt, Mycobacterium avium subsp. paratuberculosis
ggcggccaucucgugcccggg

SEQ ID NO: 2961484 - RNA, 16 nt, Mycobacterium avium subsp. paratuberculosis
ggcggccauggucgcg

SEQ ID NO: 2961485 - RNA, 19 nt, Mycobacterium avium subsp. paratuberculosis
ggcggccaugucggagcug

SEQ ID NO: 2961486 - RNA, 14 nt, Mycobacterium avium subsp. paratuberculosis
ggcggcccagaucg

SEQ ID NO: 2961487 - RNA, 17 nt, Mycobacterium avium subsp. paratuberculosis
ggcggcccagaucgcgg

SEQ ID NO: 2961488 - RNA, 18 nt, Mycobacterium avium subsp. paratuberculosis
ggcggcccagaucgcggu

SEQ ID NO: 2961489 - RNA, 14 nt, Mycobacterium avium subsp. paratuberculosis
ggcggccccgggcg

SEQ ID NO: 2961490 - RNA, 18 nt, Mycobacterium avium subsp. paratuberculosis
ggcggccccgggcgcugg

SEQ ID NO: 2961491 - RNA, 22 nt, Mycobacterium avium subsp. paratuberculosis
ggcggccccgggcgcuggcgau

SEQ ID NO: 2961492 - RNA, 16 nt, Mycobacterium avium subsp. paratuberculosis
ggcggccccgguagcc

SEQ ID NO: 2961493 - RNA, 19 nt, Mycobacterium avium subsp. paratuberculosis
ggcggccccgguagccagc

SEQ ID NO: 2961494 - RNA, 20 nt, Mycobacterium avium subsp. paratuberculosis
ggcggcccgcacggccgcca

SEQ ID NO: 2961495 - RNA, 21 nt, Mycobacterium avium subsp. paratuberculosis
ggcggcccgcaggaucgagcc

SEQ ID NO: 2961496 - RNA, 22 nt, Mycobacterium avium subsp. paratuberculosis
ggcggcccgccgcgcccggcuu

SEQ ID NO: 2961497 - RNA, 17 nt, Mycobacterium avium subsp. paratuberculosis
ggcggcccgccucggcg

SEQ ID NO: 2961498 - RNA, 18 nt, Mycobacterium avium subsp. paratuberculosis
ggcggcccgccucggcgg

SEQ ID NO: 2961499 - RNA, 13 nt, Mycobacterium avium subsp. paratuberculosis
ggcggcgacccgg

SEQ ID NO: 2961500 - RNA, 21 nt, Mycobacterium avium subsp. paratuberculosis
ggcggcgaccgcgacgaucac

SEQ ID NO: 2961501 - RNA, 22 nt, Mycobacterium avium subsp. paratuberculosis
ggcggcgaccuguuuggccagc

SEQ ID NO: 2961502 - RNA, 14 nt, Mycobacterium avium subsp. paratuberculosis
ggcggcgacggccg

SEQ ID NO: 2961503 - RNA, 16 nt, Mycobacterium avium subsp. paratuberculosis
ggcggcgacggcgacg

SEQ ID NO: 2961504 - RNA, 14 nt, Mycobacterium avium subsp. paratuberculosis
ggcggcgacggcgu

SEQ ID NO: 2961505 - RNA, 20 nt, Mycobacterium avium subsp. paratuberculosis
ggcggcgacggcgucggcgg

SEQ ID NO: 2961506 - RNA, 15 nt, Mycobacterium avium subsp. paratuberculosis
ggcggcgacgguguc

SEQ ID NO: 2961507 - RNA, 19 nt, Mycobacterium avium subsp. paratuberculosis
ggcggcgacgguguccgcg

SEQ ID NO: 2961508 - RNA, 19 nt, Mycobacterium avium subsp. paratuberculosis
ggcggcgacgucgacggca

SEQ ID NO: 2961509 - RNA, 20 nt, Mycobacterium avium subsp. paratuberculosis
ggcggcgacgucgacggcag

SEQ ID NO: 2961510 - RNA, 18 nt, Mycobacterium avium subsp. paratuberculosis
ggcggcgacgugaucggc

SEQ ID NO: 2961511 - RNA, 19 nt, Mycobacterium avium subsp. paratuberculosis
ggcggcgacgugaucggcg

SEQ ID NO: 2961512 - RNA, 20 nt, Mycobacterium avium subsp. paratuberculosis
ggcggcgacgugaucggcgg

SEQ ID NO: 2961513 - RNA, 23 nt, Mycobacterium avium subsp. paratuberculosis
ggcggcgacgugaucggcggccu

SEQ ID NO: 2961514 - RNA, 17 nt, Mycobacterium avium subsp. paratuberculosis
ggcggcgacgugccggc

SEQ ID NO: 2961515 - RNA, 19 nt, Mycobacterium avium subsp. paratuberculosis
ggcggcgacgugccggcgg

SEQ ID NO: 2961516 - RNA, 22 nt, Mycobacterium avium subsp. paratuberculosis
ggcggcgagauuggccucggcg

SEQ ID NO: 2961517 - RNA, 20 nt, Mycobacterium avium subsp. paratuberculosis
ggcggcgaguccggccaggu

SEQ ID NO: 2961518 - RNA, 12 nt, Mycobacterium avium subsp. paratuberculosis
ggcggcgaucac

SEQ ID NO: 2961519 - RNA, 17 nt, Mycobacterium avium subsp. paratuberculosis
ggcggcgaucaccgccg

SEQ ID NO: 2961520 - RNA, 16 nt, Mycobacterium avium subsp. paratuberculosis
ggcggcgauccggccg

SEQ ID NO: 2961521 - RNA, 13 nt, Mycobacterium avium subsp. paratuberculosis
ggcggcgaucgag

SEQ ID NO: 2961522 - RNA, 15 nt, Mycobacterium avium subsp. paratuberculosis
ggcggcgaucgccgc

SEQ ID NO: 2961523 - RNA, 16 nt, Mycobacterium avium subsp. paratuberculosis
ggcggcgaucgccgcg

SEQ ID NO: 2961524 - RNA, 17 nt, Mycobacterium avium subsp. paratuberculosis
ggcggcgaucgccgcga

SEQ ID NO: 2961525 - RNA, 21 nt, Mycobacterium avium subsp. paratuberculosis
ggcggcgaucgccgcgaacaa

SEQ ID NO: 2961526 - RNA, 20 nt, Mycobacterium avium subsp. paratuberculosis
ggcggcgaucggcgcggcga

SEQ ID NO: 2961527 - RNA, 21 nt, Mycobacterium avium subsp. paratuberculosis
ggcggcgaugaucgggauguc

SEQ ID NO: 2961528 - RNA, 12 nt, Mycobacterium avium subsp. paratuberculosis
ggcggcgaugcg

SEQ ID NO: 2961529 - RNA, 13 nt, Mycobacterium avium subsp. paratuberculosis
ggcggcgaugucg

SEQ ID NO: 2961530 - RNA, 12 nt, Mycobacterium avium subsp. paratuberculosis
ggcggcgcaggc

SEQ ID NO: 2961531 - RNA, 20 nt, Mycobacterium avium subsp. paratuberculosis
ggcggcgcaggcgcgcacca

SEQ ID NO: 2961532 - RNA, 17 nt, Mycobacterium avium subsp. paratuberculosis
ggcggcgcagucggccg

SEQ ID NO: 2961533 - RNA, 20 nt, Mycobacterium avium subsp. paratuberculosis
ggcggcgcaugaucgcccgc

SEQ ID NO: 2961534 - RNA, 13 nt, Mycobacterium avium subsp. paratuberculosis
ggcggcgcccagg

SEQ ID NO: 2961535 - RNA, 14 nt, Mycobacterium avium subsp. paratuberculosis
ggcggcgcccagga

SEQ ID NO: 2961536 - RNA, 21 nt, Mycobacterium avium subsp. paratuberculosis
ggcggcgccgaacucggcgcc

SEQ ID NO: 2961537 - RNA, 22 nt, Mycobacterium avium subsp. paratuberculosis
ggcggcgccgaacucggcgccg

SEQ ID NO: 2961538 - RNA, 13 nt, Mycobacterium avium subsp. paratuberculosis
ggcggcgccgacg

SEQ ID NO: 2961539 - RNA, 16 nt, Mycobacterium avium subsp. paratuberculosis
ggcggcgccgcggccc

SEQ ID NO: 2961540 - RNA, 14 nt, Mycobacterium avium subsp. paratuberculosis
ggcggcgccgcggu

SEQ ID NO: 2961541 - RNA, 12 nt, Mycobacterium avium subsp. paratuberculosis
ggcggcgccgga

SEQ ID NO: 2961542 - RNA, 23 nt, Mycobacterium avium subsp. paratuberculosis
ggcggcgccggaggccagcucga

SEQ ID NO: 2961543 - RNA, 20 nt, Mycobacterium avium subsp. paratuberculosis
ggcggcgccggaugccagca

SEQ ID NO: 2961544 - RNA, 13 nt, Mycobacterium avium subsp. paratuberculosis
ggcggcgccggca

SEQ ID NO: 2961545 - RNA, 14 nt, Mycobacterium avium subsp. paratuberculosis
ggcggcgccggccg

SEQ ID NO: 2961546 - RNA, 23 nt, Mycobacterium avium subsp. paratuberculosis
ggcggcgccggccgggcugcgca

SEQ ID NO: 2961547 - RNA, 19 nt, Mycobacterium avium subsp. paratuberculosis
ggcggcgccgucgaccagc

SEQ ID NO: 2961548 - RNA, 20 nt, Mycobacterium avium subsp. paratuberculosis
ggcggcgccgucgaccagcu

SEQ ID NO: 2961549 - RNA, 15 nt, Mycobacterium avium subsp. paratuberculosis
ggcggcgccgucgcc

SEQ ID NO: 2961550 - RNA, 15 nt, Mycobacterium avium subsp. paratuberculosis
ggcggcgccgucguc

SEQ ID NO: 2961551 - RNA, 17 nt, Mycobacterium avium subsp. paratuberculosis
ggcggcgccuugccggu

SEQ ID NO: 2961552 - RNA, 13 nt, Mycobacterium avium subsp. paratuberculosis
ggcggcgcgaucg

SEQ ID NO: 2961553 - RNA, 20 nt, Mycobacterium avium subsp. paratuberculosis
ggcggcgcgcacgucaccgc

SEQ ID NO: 2961554 - RNA, 12 nt, Mycobacterium avium subsp. paratuberculosis
ggcggcgcgcag

SEQ ID NO: 2961555 - RNA, 19 nt, Mycobacterium avium subsp. paratuberculosis
ggcggcgcgcagccggccg

SEQ ID NO: 2961556 - RNA, 23 nt, Mycobacterium avium subsp. paratuberculosis
ggcggcgcgcagccggccgucca

SEQ ID NO: 2961557 - RNA, 14 nt, Mycobacterium avium subsp. paratuberculosis
ggcggcgcgcaggc

SEQ ID NO: 2961558 - RNA, 15 nt, Mycobacterium avium subsp. paratuberculosis
ggcggcgcgccagcg

SEQ ID NO: 2961559 - RNA, 18 nt, Mycobacterium avium subsp. paratuberculosis
ggcggcgcgccggccgga

SEQ ID NO: 2961560 - RNA, 21 nt, Mycobacterium avium subsp. paratuberculosis
ggcggcgcgccggccggagcg

SEQ ID NO: 2961561 - RNA, 12 nt, Mycobacterium avium subsp. paratuberculosis
ggcggcgcgcgc

SEQ ID NO: 2961562 - RNA, 16 nt, Mycobacterium avium subsp. paratuberculosis
ggcggcgcgcgccagc

SEQ ID NO: 2961563 - RNA, 17 nt, Mycobacterium avium subsp. paratuberculosis
ggcggcgcgcgccagcg

SEQ ID NO: 2961564 - RNA, 12 nt, Mycobacterium avium subsp. paratuberculosis
ggcggcgcgcug

SEQ ID NO: 2961565 - RNA, 19 nt, Mycobacterium avium subsp. paratuberculosis
ggcggcgcgcugcaggccc

SEQ ID NO: 2961566 - RNA, 13 nt, Mycobacterium avium subsp. paratuberculosis
ggcggcgcggauc

SEQ ID NO: 2961567 - RNA, 13 nt, Mycobacterium avium subsp. paratuberculosis
ggcggcgcggcag

SEQ ID NO: 2961568 - RNA, 14 nt, Mycobacterium avium subsp. paratuberculosis
ggcggcgcggccca

SEQ ID NO: 2961569 - RNA, 14 nt, Mycobacterium avium subsp. paratuberculosis
ggcggcgcggcggu

SEQ ID NO: 2961570 - RNA, 15 nt, Mycobacterium avium subsp. paratuberculosis
ggcggcgcgggcgcc

SEQ ID NO: 2961571 - RNA, 17 nt, Mycobacterium avium subsp. paratuberculosis
ggcggcgcgggcggcgu

SEQ ID NO: 2961572 - RNA, 15 nt, Mycobacterium avium subsp. paratuberculosis
ggcggcgcgguugcg

SEQ ID NO: 2961573 - RNA, 23 nt, Mycobacterium avium subsp. paratuberculosis
ggcggcgcgugcgccgcggcggc

SEQ ID NO: 2961574 - RNA, 20 nt, Mycobacterium avium subsp. paratuberculosis
ggcggcgcucagcgcggcgg

SEQ ID NO: 2961575 - RNA, 21 nt, Mycobacterium avium subsp. paratuberculosis
ggcggcgcucagcgcggcggg

SEQ ID NO: 2961576 - RNA, 13 nt, Mycobacterium avium subsp. paratuberculosis
ggcggcgcugaug

SEQ ID NO: 2961577 - RNA, 18 nt, Mycobacterium avium subsp. paratuberculosis
ggcggcgcugccccagcc

SEQ ID NO: 2961578 - RNA, 15 nt, Mycobacterium avium subsp. paratuberculosis
ggcggcgcuggucgg

SEQ ID NO: 2961579 - RNA, 18 nt, Mycobacterium avium subsp. paratuberculosis
ggcggcgcuggucggcgg

SEQ ID NO: 2961580 - RNA, 21 nt, Mycobacterium avium subsp. paratuberculosis
ggcggcgcuggucggcgggca

SEQ ID NO: 2961581 - RNA, 22 nt, Mycobacterium avium subsp. paratuberculosis
ggcggcggaccgucggugucga

SEQ ID NO: 2961582 - RNA, 15 nt, Mycobacterium avium subsp. paratuberculosis
ggcggcggaucagca

SEQ ID NO: 2961583 - RNA, 19 nt, Mycobacterium avium subsp. paratuberculosis
ggcggcggaucagcaccga

SEQ ID NO: 2961584 - RNA, 21 nt, Mycobacterium avium subsp. paratuberculosis
ggcggguaugucggcgacccg

SEQ ID NO: 2961585 - RNA, 14 nt, Mycobacterium avium subsp. paratuberculosis
ggcgggucacucga

SEQ ID NO: 2961586 - RNA, 12 nt, Mycobacterium avium subsp. paratuberculosis
ggcgggucagca

SEQ ID NO: 2961587 - RNA, 13 nt, Mycobacterium avium subsp. paratuberculosis
ggcgggucgucga

SEQ ID NO: 2961588 - RNA, 14 nt, Mycobacterium avium subsp. paratuberculosis
ggcgggucugugac

SEQ ID NO: 2961589 - RNA, 22 nt, Mycobacterium avium subsp. paratuberculosis
ggcgggucugugaccacgguca

SEQ ID NO: 2961590 - RNA, 21 nt, Mycobacterium avium subsp. paratuberculosis
ggcgggugaggacgcccggcg

SEQ ID NO: 2961591 - RNA, 23 nt, Mycobacterium avium subsp. paratuberculosis
ggcgggugaggacgcccggcgag

SEQ ID NO: 2961592 - RNA, 20 nt, Mycobacterium avium subsp. paratuberculosis
ggcgggugaucccgaugccg

SEQ ID NO: 2961593 - RNA, 13 nt, Mycobacterium avium subsp. paratuberculosis
ggcggguggcgau

SEQ ID NO: 2961594 - RNA, 21 nt, Mycobacterium avium subsp. paratuberculosis
ggcggguguauucgcccaccc

SEQ ID NO: 2961595 - RNA, 19 nt, Mycobacterium avium subsp. paratuberculosis
ggcggguuggccgucgaac

SEQ ID NO: 2961596 - RNA, 20 nt, Mycobacterium avium subsp. paratuberculosis
ggcggguuggucccgaucac

SEQ ID NO: 2961597 - RNA, 15 nt, Mycobacterium avium subsp. paratuberculosis
ggcgguacgcgccgc

SEQ ID NO: 2961598 - RNA, 16 nt, Mycobacterium avium subsp. paratuberculosis
ggcgguacgcgccgcg

SEQ ID NO: 2961599 - RNA, 18 nt, Mycobacterium avium subsp. paratuberculosis
ggcgguagcggcagaugg

SEQ ID NO: 2961600 - RNA, 22 nt, Mycobacterium avium subsp. paratuberculosis
ggcgguauucgucaccccacca

SEQ ID NO: 2961601 - RNA, 21 nt, Mycobacterium avium subsp. paratuberculosis
ggcggucagcaccgucaccgc

SEQ ID NO: 2961602 - RNA, 22 nt, Mycobacterium avium subsp. paratuberculosis
ggcggucagcauggcgaugacg

SEQ ID NO: 2961603 - RNA, 14 nt, Mycobacterium avium subsp. paratuberculosis
ggcggucagcgggu

SEQ ID NO: 2961604 - RNA, 13 nt, Mycobacterium avium subsp. paratuberculosis
ggcgguccaccac

SEQ ID NO: 2961605 - RNA, 15 nt, Mycobacterium avium subsp. paratuberculosis
ggcgguccaccgacg

SEQ ID NO: 2961606 - RNA, 17 nt, Mycobacterium avium subsp. paratuberculosis
ggcgguccaccgacgcc

SEQ ID NO: 2961607 - RNA, 19 nt, Mycobacterium avium subsp. paratuberculosis
ggcgguccagcgagcccuu

SEQ ID NO: 2961608 - RNA, 22 nt, Mycobacterium avium subsp. paratuberculosis
ggcggucccgcauguccggggu

SEQ ID NO: 2961609 - RNA, 14 nt, Mycobacterium avium subsp. paratuberculosis
ggcggucccgugcg

SEQ ID NO: 2961610 - RNA, 16 nt, Mycobacterium avium subsp. paratuberculosis
ggcggucccgugcgcc

SEQ ID NO: 2961611 - RNA, 20 nt, Mycobacterium avium subsp. paratuberculosis
ggcggucccgugcgccgccc

SEQ ID NO: 2961612 - RNA, 14 nt, Mycobacterium avium subsp. paratuberculosis
ggcgguccgccgca

SEQ ID NO: 2961613 - RNA, 17 nt, Mycobacterium avium subsp. paratuberculosis
ggcgguccgccgcagcg

SEQ ID NO: 2961614 - RNA, 23 nt, Mycobacterium avium subsp. paratuberculosis
ggcgguccgccgcagcggcgccg

SEQ ID NO: 2961615 - RNA, 15 nt, Mycobacterium avium subsp. paratuberculosis
ggcgguccgcuccac

SEQ ID NO: 2961616 - RNA, 22 nt, Mycobacterium avium subsp. paratuberculosis
ggcgguccgcuccaccagcgcg

SEQ ID NO: 2961617 - RNA, 24 nt, Mycobacterium avium subsp. paratuberculosis
ggcgguccgcuccaccagcgcggu

SEQ ID NO: 2961618 - RNA, 21 nt, Mycobacterium avium subsp. paratuberculosis
ggcgguccguucggcgguucg

SEQ ID NO: 2961619 - RNA, 12 nt, Mycobacterium avium subsp. paratuberculosis
ggcggucgaacg

SEQ ID NO: 2961620 - RNA, 13 nt, Mycobacterium avium subsp. paratuberculosis
ggcggucgaacgc

SEQ ID NO: 2961621 - RNA, 15 nt, Mycobacterium avium subsp. paratuberculosis
ggcggucgaacgcgg

SEQ ID NO: 2961622 - RNA, 17 nt, Mycobacterium avium subsp. paratuberculosis
ggcggucgaacgcggcg

SEQ ID NO: 2961623 - RNA, 19 nt, Mycobacterium avium subsp. paratuberculosis
ggcggucgaacgcggcgcc

SEQ ID NO: 2961624 - RNA, 20 nt, Mycobacterium avium subsp. paratuberculosis
ggcggucgaacgcggcgccg

SEQ ID NO: 2961625 - RNA, 23 nt, Mycobacterium avium subsp. paratuberculosis
ggcggucgaacgcggcgccgacg

SEQ ID NO: 2961626 - RNA, 17 nt, Mycobacterium avium subsp. paratuberculosis
ggcggucgacacgaucg

SEQ ID NO: 2961627 - RNA, 22 nt, Mycobacterium avium subsp. paratuberculosis
ggcggucgacacgaucggcaug

SEQ ID NO: 2961628 - RNA, 20 nt, Mycobacterium avium subsp. paratuberculosis
ggcggucgccacucgggcgg

SEQ ID NO: 2961629 - RNA, 13 nt, Mycobacterium avium subsp. paratuberculosis
ggcggucgccgaa

SEQ ID NO: 2961630 - RNA, 16 nt, Mycobacterium avium subsp. paratuberculosis
ggcggucgcgcagccg

SEQ ID NO: 2961631 - RNA, 19 nt, Mycobacterium avium subsp. paratuberculosis
ggcggucgcgcagccgccg

SEQ ID NO: 2961632 - RNA, 13 nt, Mycobacterium avium subsp. paratuberculosis
ggcggucgcgcca

SEQ ID NO: 2961633 - RNA, 14 nt, Mycobacterium avium subsp. paratuberculosis
ggcggucgcgccag

SEQ ID NO: 2961634 - RNA, 15 nt, Mycobacterium avium subsp. paratuberculosis
ggcggucgcgccaga

SEQ ID NO: 2961635 - RNA, 12 nt, Mycobacterium avium subsp. paratuberculosis
ggcggucgcggu

SEQ ID NO: 2961636 - RNA, 23 nt, Mycobacterium avium subsp. paratuberculosis
ggcggucgcggugcccagccgca

SEQ ID NO: 2961637 - RNA, 20 nt, Mycobacterium avium subsp. paratuberculosis
ggcggucgcgucgucggcgg

SEQ ID NO: 2961638 - RNA, 19 nt, Mycobacterium avium subsp. paratuberculosis
ggcggucgcugaccccgcu

SEQ ID NO: 2961639 - RNA, 15 nt, Mycobacterium avium subsp. paratuberculosis
ggcggucggacgcgg

SEQ ID NO: 2961640 - RNA, 17 nt, Mycobacterium avium subsp. paratuberculosis
ggcggucggcggaggcg

SEQ ID NO: 2961641 - RNA, 15 nt, Mycobacterium avium subsp. paratuberculosis
ggcggucggugcgca

SEQ ID NO: 2961642 - RNA, 18 nt, Mycobacterium avium subsp. paratuberculosis
ggcggucggugcgcagca

SEQ ID NO: 2961643 - RNA, 19 nt, Mycobacterium avium subsp. paratuberculosis
ggcggucugcgcccgaucg

SEQ ID NO: 2961644 - RNA, 23 nt, Mycobacterium avium subsp. paratuberculosis
ggcggucuucuuggccgcgccgc

SEQ ID NO: 2961645 - RNA, 15 nt, Mycobacterium avium subsp. paratuberculosis
ggcggugaccacgcc

SEQ ID NO: 2961646 - RNA, 16 nt, Mycobacterium avium subsp. paratuberculosis
ggcggugaccggaucg

SEQ ID NO: 2961647 - RNA, 22 nt, Mycobacterium avium subsp. paratuberculosis
ggcggugaccggaucggccagc

SEQ ID NO: 2961648 - RNA, 15 nt, Mycobacterium avium subsp. paratuberculosis
ggcggugagccgcca

SEQ ID NO: 2961649 - RNA, 18 nt, Mycobacterium avium subsp. paratuberculosis
ggcggugauccgcccggc

SEQ ID NO: 2961650 - RNA, 22 nt, Mycobacterium avium subsp. paratuberculosis
ggcggugauccgcccggcccgc

SEQ ID NO: 2961651 - RNA, 23 nt, Mycobacterium avium subsp. paratuberculosis
ggcggugauccgcccggcccgca

SEQ ID NO: 2961652 - RNA, 14 nt, Mycobacterium avium subsp. paratuberculosis
ggcggugaucgccg

SEQ ID NO: 2961653 - RNA, 17 nt, Mycobacterium avium subsp. paratuberculosis
ggcggugaugcgcgccg

SEQ ID NO: 2961654 - RNA, 20 nt, Mycobacterium avium subsp. paratuberculosis
ggcggugaugcgcgccgacg

SEQ ID NO: 2961655 - RNA, 12 nt, Mycobacterium avium subsp. paratuberculosis
ggcggugcagcc

SEQ ID NO: 2961656 - RNA, 14 nt, Mycobacterium avium subsp. paratuberculosis
ggcggugcagccgg

SEQ ID NO: 2961657 - RNA, 19 nt, Mycobacterium avium subsp. paratuberculosis
ggcggugcagccgggugcg

SEQ ID NO: 2961658 - RNA, 16 nt, Mycobacterium avium subsp. paratuberculosis
ggcggugccgagcccg

SEQ ID NO: 2961659 - RNA, 19 nt, Mycobacterium avium subsp. paratuberculosis
ggcggugccgagcccgccg

SEQ ID NO: 2961660 - RNA, 15 nt, Mycobacterium avium subsp. paratuberculosis
ggcggugccgcaggc

SEQ ID NO: 2961661 - RNA, 21 nt, Mycobacterium avium subsp. paratuberculosis
ggcggugccgcggcggcgccg

SEQ ID NO: 2961662 - RNA, 21 nt, Mycobacterium avium subsp. paratuberculosis
ggcggugccguccucggccgc

SEQ ID NO: 2961663 - RNA, 14 nt, Mycobacterium avium subsp. paratuberculosis
ggcggugcgcagcc

SEQ ID NO: 2961664 - RNA, 15 nt, Mycobacterium avium subsp. paratuberculosis
ggcggugcgcagccg

SEQ ID NO: 2961665 - RNA, 18 nt, Mycobacterium avium subsp. paratuberculosis
ggcggugcgcagccgcug

SEQ ID NO: 2961666 - RNA, 13 nt, Mycobacterium avium subsp. paratuberculosis
ggcggugcggacc

SEQ ID NO: 2961667 - RNA, 16 nt, Mycobacterium avium subsp. paratuberculosis
ggcggugcggacccgu

SEQ ID NO: 2961668 - RNA, 20 nt, Mycobacterium avium subsp. paratuberculosis
ggcgucacucuggcgugacg

SEQ ID NO: 2961669 - RNA, 22 nt, Mycobacterium avium subsp. paratuberculosis
ggcgucacucuggcgugacgcu

SEQ ID NO: 2961670 - RNA, 22 nt, Mycobacterium avium subsp. paratuberculosis
ggcgucaggaccucgaagcagc

SEQ ID NO: 2961671 - RNA, 15 nt, Mycobacterium avium subsp. paratuberculosis
ggcgucaggcgcugg

SEQ ID NO: 2961672 - RNA, 17 nt, Mycobacterium avium subsp. paratuberculosis
ggcgucaggcgcugggu

SEQ ID NO: 2961673 - RNA, 12 nt, Mycobacterium avium subsp. paratuberculosis
ggcgucaggggu

SEQ ID NO: 2961674 - RNA, 20 nt, Mycobacterium avium subsp. paratuberculosis
ggcgucaggggugccagccg

SEQ ID NO: 2961675 - RNA, 21 nt, Mycobacterium avium subsp. paratuberculosis
ggcgucaggggugccagccgu

SEQ ID NO: 2961676 - RNA, 19 nt, Mycobacterium avium subsp. paratuberculosis
ggcgucagggguuggcgcg

SEQ ID NO: 2961677 - RNA, 19 nt, Mycobacterium avium subsp. paratuberculosis
ggcgucaucccccgcagcu

SEQ ID NO: 2961678 - RNA, 20 nt, Mycobacterium avium subsp. paratuberculosis
ggcgucaucccccgcagcuu

SEQ ID NO: 2961679 - RNA, 19 nt, Mycobacterium avium subsp. paratuberculosis
ggcgucaucgacuugccgc

SEQ ID NO: 2961680 - RNA, 21 nt, Mycobacterium avium subsp. paratuberculosis
ggcgucaucgacuugccgccg

SEQ ID NO: 2961681 - RNA, 13 nt, Mycobacterium avium subsp. paratuberculosis
ggcgucaucgugg

SEQ ID NO: 2961682 - RNA, 20 nt, Mycobacterium avium subsp. paratuberculosis
ggcgucaucguggacaggag

SEQ ID NO: 2961683 - RNA, 15 nt, Mycobacterium avium subsp. paratuberculosis
ggcguccacgaaacc

SEQ ID NO: 2961684 - RNA, 14 nt, Mycobacterium avium subsp. paratuberculosis
ggcguccacgccgu

SEQ ID NO: 2961685 - RNA, 16 nt, Mycobacterium avium subsp. paratuberculosis
ggcguccagcaccugc

SEQ ID NO: 2961686 - RNA, 14 nt, Mycobacterium avium subsp. paratuberculosis
ggcguccagccagc

SEQ ID NO: 2961687 - RNA, 16 nt, Mycobacterium avium subsp. paratuberculosis
ggcguccagccagcgu

SEQ ID NO: 2961688 - RNA, 17 nt, Mycobacterium avium subsp. paratuberculosis
ggcguccagcgccgcca

SEQ ID NO: 2961689 - RNA, 22 nt, Mycobacterium avium subsp. paratuberculosis
ggcguccagcgccgccacggcc

SEQ ID NO: 2961690 - RNA, 15 nt, Mycobacterium avium subsp. paratuberculosis
ggcguccagcgcggu

SEQ ID NO: 2961691 - RNA, 16 nt, Mycobacterium avium subsp. paratuberculosis
ggcguccagcgcggug

SEQ ID NO: 2961692 - RNA, 17 nt, Mycobacterium avium subsp. paratuberculosis
ggcguccagcgcgguga

SEQ ID NO: 2961693 - RNA, 17 nt, Mycobacterium avium subsp. paratuberculosis
ggcguccaggcgcaccg

SEQ ID NO: 2961694 - RNA, 20 nt, Mycobacterium avium subsp. paratuberculosis
ggcguccaggcgcaccgcca

SEQ ID NO: 2961695 - RNA, 23 nt, Mycobacterium avium subsp. paratuberculosis
ggcguccaggcgcaccgccaccg

SEQ ID NO: 2961696 - RNA, 19 nt, Mycobacterium avium subsp. paratuberculosis
ggcguccagggccaccgcg

SEQ ID NO: 2961697 - RNA, 20 nt, Mycobacterium avium subsp. paratuberculosis
ggcguccagggccaccgcgu

SEQ ID NO: 2961698 - RNA, 18 nt, Mycobacterium avium subsp. paratuberculosis
ggcguccaggucgcccuc

SEQ ID NO: 2961699 - RNA, 18 nt, Mycobacterium avium subsp. paratuberculosis
ggcguccaguagccgccg

SEQ ID NO: 2961700 - RNA, 15 nt, Mycobacterium avium subsp. paratuberculosis
ggcguccagugcaug

SEQ ID NO: 2961701 - RNA, 22 nt, Mycobacterium avium subsp. paratuberculosis
ggcguccagugcaugccggccu

SEQ ID NO: 2961702 - RNA, 13 nt, Mycobacterium avium subsp. paratuberculosis
ggcguccaguucg

SEQ ID NO: 2961703 - RNA, 19 nt, Mycobacterium avium subsp. paratuberculosis
ggcguccaguucggccagc

SEQ ID NO: 2961704 - RNA, 22 nt, Mycobacterium avium subsp. paratuberculosis
ggcguccaguucggccagcgcg

SEQ ID NO: 2961705 - RNA, 14 nt, Mycobacterium avium subsp. paratuberculosis
ggcgucccagugcu

SEQ ID NO: 2961706 - RNA, 16 nt, Mycobacterium avium subsp. paratuberculosis
ggcguccccggcgguu

SEQ ID NO: 2961707 - RNA, 21 nt, Mycobacterium avium subsp. paratuberculosis
ggcguccgagaagggccgccg

SEQ ID NO: 2961708 - RNA, 18 nt, Mycobacterium avium subsp. paratuberculosis
ggcguccgcaagcaccuc

SEQ ID NO: 2961709 - RNA, 19 nt, Mycobacterium avium subsp. paratuberculosis
ggcguccgcgaacgggugc

SEQ ID NO: 2961710 - RNA, 23 nt, Mycobacterium avium subsp. paratuberculosis
ggcguccgcgaacgggugcggcg

SEQ ID NO: 2961711 - RNA, 16 nt, Mycobacterium avium subsp. paratuberculosis
ggcguccgcggccgcg

SEQ ID NO: 2961712 - RNA, 18 nt, Mycobacterium avium subsp. paratuberculosis
ggcguccgcggccgcggc

SEQ ID NO: 2961713 - RNA, 23 nt, Mycobacterium avium subsp. paratuberculosis
ggcguccgcggccgcggcgcgca

SEQ ID NO: 2961714 - RNA, 16 nt, Mycobacterium avium subsp. paratuberculosis
ggcguccgcggcggag

SEQ ID NO: 2961715 - RNA, 15 nt, Mycobacterium avium subsp. paratuberculosis
ggcguccgugccguc

SEQ ID NO: 2961716 - RNA, 23 nt, Mycobacterium avium subsp. paratuberculosis
ggcguccgugccguccggccggu

SEQ ID NO: 2961717 - RNA, 14 nt, Mycobacterium avium subsp. paratuberculosis
ggcguccuccucgu

SEQ ID NO: 2961718 - RNA, 19 nt, Mycobacterium avium subsp. paratuberculosis
ggcguccuccucguccgcg

SEQ ID NO: 2961719 - RNA, 22 nt, Mycobacterium avium subsp. paratuberculosis
ggcguccuccucguccgcggcg

SEQ ID NO: 2961720 - RNA, 19 nt, Mycobacterium avium subsp. paratuberculosis
ggcguccucgaccacccgc

SEQ ID NO: 2961721 - RNA, 20 nt, Mycobacterium avium subsp. paratuberculosis
ggcguccucgaccacccgcu

SEQ ID NO: 2961722 - RNA, 14 nt, Mycobacterium avium subsp. paratuberculosis
ggcguccucgacgc

SEQ ID NO: 2961723 - RNA, 22 nt, Mycobacterium avium subsp. paratuberculosis
ggcguccucgacgccgcgcacc

SEQ ID NO: 2961724 - RNA, 19 nt, Mycobacterium avium subsp. paratuberculosis
ggcguccucgacgguggag

SEQ ID NO: 2961725 - RNA, 17 nt, Mycobacterium avium subsp. paratuberculosis
ggcguccugcagcagcc

SEQ ID NO: 2961726 - RNA, 16 nt, Mycobacterium avium subsp. paratuberculosis
ggcguccuugaccagc

SEQ ID NO: 2961727 - RNA, 17 nt, Mycobacterium avium subsp. paratuberculosis
ggcguccuugaccagcu

SEQ ID NO: 2961728 - RNA, 19 nt, Mycobacterium avium subsp. paratuberculosis
ggcguccuugaccagcugc

SEQ ID NO: 2961729 - RNA, 23 nt, Mycobacterium avium subsp. paratuberculosis
ggcguccuugauccgggcgccau

SEQ ID NO: 2961730 - RNA, 14 nt, Mycobacterium avium subsp. paratuberculosis
ggcguccuugccga

SEQ ID NO: 2961731 - RNA, 16 nt, Mycobacterium avium subsp. paratuberculosis
ggcguccuugccgauc

SEQ ID NO: 2961732 - RNA, 22 nt, Mycobacterium avium subsp. paratuberculosis
ggcgucgaaauccacgaugccg

SEQ ID NO: 2961733 - RNA, 19 nt, Mycobacterium avium subsp. paratuberculosis
ggcgucgaacgggccgggc

SEQ ID NO: 2961734 - RNA, 18 nt, Mycobacterium avium subsp. paratuberculosis
ggcgucgaagcgcaugcc

SEQ ID NO: 2961735 - RNA, 18 nt, Mycobacterium avium subsp. paratuberculosis
ggcgucgacacccgggcg

SEQ ID NO: 2961736 - RNA, 15 nt, Mycobacterium avium subsp. paratuberculosis
ggcgucgacagccgg

SEQ ID NO: 2961737 - RNA, 17 nt, Mycobacterium avium subsp. paratuberculosis
ggcgucgaccgccccgc

SEQ ID NO: 2961738 - RNA, 18 nt, Mycobacterium avium subsp. paratuberculosis
ggcgucgacgacggcgcc

SEQ ID NO: 2961739 - RNA, 20 nt, Mycobacterium avium subsp. paratuberculosis
ggcgucgacgacggcgccgc

SEQ ID NO: 2961740 - RNA, 22 nt, Mycobacterium avium subsp. paratuberculosis
ggcgucgacgacggcgccgcgu

SEQ ID NO: 2961741 - RNA, 13 nt, Mycobacterium avium subsp. paratuberculosis
ggcgucgacgaug

SEQ ID NO: 2961742 - RNA, 16 nt, Mycobacterium avium subsp. paratuberculosis
ggcgucgacgaugguc

SEQ ID NO: 2961743 - RNA, 12 nt, Mycobacterium avium subsp. paratuberculosis
ggcgucgacgcg

SEQ ID NO: 2961744 - RNA, 16 nt, Mycobacterium avium subsp. paratuberculosis
ggcgucgacgcgcugc

SEQ ID NO: 2961745 - RNA, 13 nt, Mycobacterium avium subsp. paratuberculosis
ggcgucgacgucg

SEQ ID NO: 2961746 - RNA, 19 nt, Mycobacterium avium subsp. paratuberculosis
ggcgucgacgugcgcggcg

SEQ ID NO: 2961747 - RNA, 13 nt, Mycobacterium avium subsp. paratuberculosis
ggcgucgagcgcg

SEQ ID NO: 2961748 - RNA, 13 nt, Mycobacterium avium subsp. paratuberculosis
ggcgucgaucagc

SEQ ID NO: 2961749 - RNA, 20 nt, Mycobacterium avium subsp. paratuberculosis
ggcgucgaucagcgcgccgc

SEQ ID NO: 2961750 - RNA, 12 nt, Mycobacterium avium subsp. paratuberculosis
ggcgucgaucgc

SEQ ID NO: 2961751 - RNA, 16 nt, Mycobacterium avium subsp. paratuberculosis
ggcgucgaucgccguc

SEQ ID NO: 2961752 - RNA, 20 nt, Mycobacterium avium subsp. paratuberculosis
ggcgucguuggcgccguccg

SEQ ID NO: 2961753 - RNA, 17 nt, Mycobacterium avium subsp. paratuberculosis
ggcgucucagucggcca

SEQ ID NO: 2961754 - RNA, 20 nt, Mycobacterium avium subsp. paratuberculosis
ggcgucucagucggccaccg

SEQ ID NO: 2961755 - RNA, 22 nt, Mycobacterium avium subsp. paratuberculosis
ggcgucucagucggccaccgcg

SEQ ID NO: 2961756 - RNA, 23 nt, Mycobacterium avium subsp. paratuberculosis
ggcgucucagucggccaccgcga

SEQ ID NO: 2961757 - RNA, 19 nt, Mycobacterium avium subsp. paratuberculosis
ggcgucucgaugagcgaga

SEQ ID NO: 2961758 - RNA, 15 nt, Mycobacterium avium subsp. paratuberculosis
ggcgucucggcccga

SEQ ID NO: 2961759 - RNA, 13 nt, Mycobacterium avium subsp. paratuberculosis
ggcgucucggcgu

SEQ ID NO: 2961760 - RNA, 14 nt, Mycobacterium avium subsp. paratuberculosis
ggcgucucggcguc

SEQ ID NO: 2961761 - RNA, 15 nt, Mycobacterium avium subsp. paratuberculosis
ggcgucucggcgucu

SEQ ID NO: 2961762 - RNA, 21 nt, Mycobacterium avium subsp. paratuberculosis
ggcgucucggcgucucggccc

SEQ ID NO: 2961763 - RNA, 21 nt, Mycobacterium avium subsp. paratuberculosis
ggcgucucggcgucucggcgu

SEQ ID NO: 2961764 - RNA, 13 nt, Mycobacterium avium subsp. paratuberculosis
ggcgucuggccgg

SEQ ID NO: 2961765 - RNA, 18 nt, Mycobacterium avium subsp. paratuberculosis
ggcgucuugaucucggcg

SEQ ID NO: 2961766 - RNA, 20 nt, Mycobacterium avium subsp. paratuberculosis
ggcgucuugaucucggcggc

SEQ ID NO: 2961767 - RNA, 21 nt, Mycobacterium avium subsp. paratuberculosis
ggcgucuugaucucggcggcg

SEQ ID NO: 2961768 - RNA, 20 nt, Mycobacterium avium subsp. paratuberculosis
ggcgugaaucuuggccagca

SEQ ID NO: 2961769 - RNA, 22 nt, Mycobacterium avium subsp. paratuberculosis
ggcgugaaucuuggccagcagc

SEQ ID NO: 2961770 - RNA, 20 nt, Mycobacterium avium subsp. paratuberculosis
ggcgugacacucggucaccg

SEQ ID NO: 2961771 - RNA, 22 nt, Mycobacterium avium subsp. paratuberculosis
ggcgugacaggguaacccggga

SEQ ID NO: 2961772 - RNA, 12 nt, Mycobacterium avium subsp. paratuberculosis
ggcgugaccggc

SEQ ID NO: 2961773 - RNA, 19 nt, Mycobacterium avium subsp. paratuberculosis
ggcgugaccggcugcucgc

SEQ ID NO: 2961774 - RNA, 22 nt, Mycobacterium avium subsp. paratuberculosis
ggcgugaccggcugcucgcgcu

SEQ ID NO: 2961775 - RNA, 16 nt, Mycobacterium avium subsp. paratuberculosis
ggcgugacgcucgacg

SEQ ID NO: 2961776 - RNA, 23 nt, Mycobacterium avium subsp. paratuberculosis
ggcgugacgcucgacggccggcg

SEQ ID NO: 2961777 - RNA, 18 nt, Mycobacterium avium subsp. paratuberculosis
ggcgugacgcucgaggcc

SEQ ID NO: 2961778 - RNA, 15 nt, Mycobacterium avium subsp. paratuberculosis
ggcgugacgcucgcc

SEQ ID NO: 2961779 - RNA, 16 nt, Mycobacterium avium subsp. paratuberculosis
ggcgugacgcucgccg

SEQ ID NO: 2961780 - RNA, 17 nt, Mycobacterium avium subsp. paratuberculosis
ggcgugacgcucgccgg

SEQ ID NO: 2961781 - RNA, 19 nt, Mycobacterium avium subsp. paratuberculosis
ggcgugacgcucgccggcg

SEQ ID NO: 2961782 - RNA, 23 nt, Mycobacterium avium subsp. paratuberculosis
ggcgugacgcucgccggcggccg

SEQ ID NO: 2961783 - RNA, 18 nt, Mycobacterium avium subsp. paratuberculosis
ggcgugacgcucggccgu

SEQ ID NO: 2961784 - RNA, 17 nt, Mycobacterium avium subsp. paratuberculosis
ggcgugacgcucggcgc

SEQ ID NO: 2961785 - RNA, 18 nt, Mycobacterium avium subsp. paratuberculosis
ggcgugacgcucggcgcc

SEQ ID NO: 2961786 - RNA, 19 nt, Mycobacterium avium subsp. paratuberculosis
ggcgugacgcucggcgccg

SEQ ID NO: 2961787 - RNA, 22 nt, Mycobacterium avium subsp. paratuberculosis
ggcgugacgcucggcgccgcgg

SEQ ID NO: 2961788 - RNA, 16 nt, Mycobacterium avium subsp. paratuberculosis
ggcgugacgcucgggg

SEQ ID NO: 2961789 - RNA, 17 nt, Mycobacterium avium subsp. paratuberculosis
ggcgugacggucgaccu

SEQ ID NO: 2961790 - RNA, 21 nt, Mycobacterium avium subsp. paratuberculosis
ggcgugaucuguucggcggcg

SEQ ID NO: 2961791 - RNA, 20 nt, Mycobacterium avium subsp. paratuberculosis
ggcgugaugacggcggcggu

SEQ ID NO: 2961792 - RNA, 22 nt, Mycobacterium avium subsp. paratuberculosis
ggcgugaugacggcggcggugc

SEQ ID NO: 2961793 - RNA, 19 nt, Mycobacterium avium subsp. paratuberculosis
ggcgugcaacugcguggcc

SEQ ID NO: 2961794 - RNA, 18 nt, Mycobacterium avium subsp. paratuberculosis
ggcgugcacaggccgccg

SEQ ID NO: 2961795 - RNA, 23 nt, Mycobacterium avium subsp. paratuberculosis
ggcgugcaccgcccgcgcgaugc

SEQ ID NO: 2961796 - RNA, 21 nt, Mycobacterium avium subsp. paratuberculosis
ggcgugcagcacgcccucggc

SEQ ID NO: 2961797 - RNA, 18 nt, Mycobacterium avium subsp. paratuberculosis
ggcgugcagcacggggac

SEQ ID NO: 2961798 - RNA, 19 nt, Mycobacterium avium subsp. paratuberculosis
ggcgugcagcacggggacg

SEQ ID NO: 2961799 - RNA, 14 nt, Mycobacterium avium subsp. paratuberculosis
ggcgugcagcccgc

SEQ ID NO: 2961800 - RNA, 18 nt, Mycobacterium avium subsp. paratuberculosis
ggcgugcagcgcggcgau

SEQ ID NO: 2961801 - RNA, 15 nt, Mycobacterium avium subsp. paratuberculosis
ggcgugcaggccgcg

SEQ ID NO: 2961802 - RNA, 18 nt, Mycobacterium avium subsp. paratuberculosis
ggcgugcaggccgcgggu

SEQ ID NO: 2961803 - RNA, 20 nt, Mycobacterium avium subsp. paratuberculosis
ggcgugcaggccgcgggugg

SEQ ID NO: 2961804 - RNA, 13 nt, Mycobacterium avium subsp. paratuberculosis
ggcgugccacagc

SEQ ID NO: 2961805 - RNA, 14 nt, Mycobacterium avium subsp. paratuberculosis
ggcgugccacagca

SEQ ID NO: 2961806 - RNA, 13 nt, Mycobacterium avium subsp. paratuberculosis
ggcgugccaccgc

SEQ ID NO: 2961807 - RNA, 16 nt, Mycobacterium avium subsp. paratuberculosis
ggcgugccaccgcugg

SEQ ID NO: 2961808 - RNA, 22 nt, Mycobacterium avium subsp. paratuberculosis
ggcgugccaccgcugggcggcg

SEQ ID NO: 2961809 - RNA, 15 nt, Mycobacterium avium subsp. paratuberculosis
ggcgugcccgccgaa

SEQ ID NO: 2961810 - RNA, 13 nt, Mycobacterium avium subsp. paratuberculosis
ggcgugcccggcg

SEQ ID NO: 2961811 - RNA, 16 nt, Mycobacterium avium subsp. paratuberculosis
ggcgugcccggcgccg

SEQ ID NO: 2961812 - RNA, 18 nt, Mycobacterium avium subsp. paratuberculosis
ggcgugccgaacggcgcu

SEQ ID NO: 2961813 - RNA, 20 nt, Mycobacterium avium subsp. paratuberculosis
ggcgugccgcccggaccgcg

SEQ ID NO: 2961814 - RNA, 16 nt, Mycobacterium avium subsp. paratuberculosis
ggcgugccggacaccg

SEQ ID NO: 2961815 - RNA, 19 nt, Mycobacterium avium subsp. paratuberculosis
ggcgugccggacaccggca

SEQ ID NO: 2961816 - RNA, 13 nt, Mycobacterium avium subsp. paratuberculosis
ggcgugccggccc

SEQ ID NO: 2961817 - RNA, 18 nt, Mycobacterium avium subsp. paratuberculosis
ggcgugccggcccggcgg

SEQ ID NO: 2961818 - RNA, 19 nt, Mycobacterium avium subsp. paratuberculosis
ggcgugcgaaugacgcgca

SEQ ID NO: 2961819 - RNA, 16 nt, Mycobacterium avium subsp. paratuberculosis
ggcgugcgcggccgcc

SEQ ID NO: 2961820 - RNA, 16 nt, Mycobacterium avium subsp. paratuberculosis
ggcgugcgcguggggc

SEQ ID NO: 2961821 - RNA, 15 nt, Mycobacterium avium subsp. paratuberculosis
ggcgugcggccgcag

SEQ ID NO: 2961822 - RNA, 17 nt, Mycobacterium avium subsp. paratuberculosis
ggcgugcggccgcagcg

SEQ ID NO: 2961823 - RNA, 16 nt, Mycobacterium avium subsp. paratuberculosis
ggcgugcggcgcgguc

SEQ ID NO: 2961824 - RNA, 19 nt, Mycobacterium avium subsp. paratuberculosis
ggcgugcggcgcggucgca

SEQ ID NO: 2961825 - RNA, 17 nt, Mycobacterium avium subsp. paratuberculosis
ggcgugcgguuggcccg

SEQ ID NO: 2961826 - RNA, 20 nt, Mycobacterium avium subsp. paratuberculosis
ggcgugcgguuggcccgcgg

SEQ ID NO: 2961827 - RNA, 16 nt, Mycobacterium avium subsp. paratuberculosis
ggcgugcuccagcagg

SEQ ID NO: 2961828 - RNA, 15 nt, Mycobacterium avium subsp. paratuberculosis
ggcgugcucgaucgc

SEQ ID NO: 2961829 - RNA, 23 nt, Mycobacterium avium subsp. paratuberculosis
ggcgugcuugaacgccgcccccg

SEQ ID NO: 2961830 - RNA, 19 nt, Mycobacterium avium subsp. paratuberculosis
ggcguggaacacgcccagc

SEQ ID NO: 2961831 - RNA, 20 nt, Mycobacterium avium subsp. paratuberculosis
ggcguggaacacgcccagcg

SEQ ID NO: 2961832 - RNA, 22 nt, Mycobacterium avium subsp. paratuberculosis
ggcguggaacgcgucgcgccag

SEQ ID NO: 2961833 - RNA, 22 nt, Mycobacterium avium subsp. paratuberculosis
ggcguggauggccggccggguc

SEQ ID NO: 2961834 - RNA, 16 nt, Mycobacterium avium subsp. paratuberculosis
ggcguggcacccgggc

SEQ ID NO: 2961835 - RNA, 22 nt, Mycobacterium avium subsp. paratuberculosis
ggcguggcacccgggcgcgacg

SEQ ID NO: 2961836 - RNA, 16 nt, Mycobacterium avium subsp. paratuberculosis
ggcuagacgcgcacca

SEQ ID NO: 2961837 - RNA, 20 nt, Mycobacterium avium subsp. paratuberculosis
ggcuagacgcgcaccagggc

SEQ ID NO: 2961838 - RNA, 17 nt, Mycobacterium avium subsp. paratuberculosis
ggcuagcagcuccgguc

SEQ ID NO: 2961839 - RNA, 12 nt, Mycobacterium avium subsp. paratuberculosis
ggcuagcgggcg

SEQ ID NO: 2961840 - RNA, 15 nt, Mycobacterium avium subsp. paratuberculosis
ggcuagcgggcgcgc

SEQ ID NO: 2961841 - RNA, 16 nt, Mycobacterium avium subsp. paratuberculosis
ggcuagcgggcgcgca

SEQ ID NO: 2961842 - RNA, 19 nt, Mycobacterium avium subsp. paratuberculosis
ggcuagcgggcgcgcagcc

SEQ ID NO: 2961843 - RNA, 15 nt, Mycobacterium avium subsp. paratuberculosis
ggcuaucgcccggcg

SEQ ID NO: 2961844 - RNA, 16 nt, Mycobacterium avium subsp. paratuberculosis
ggcuaucgcccggcgc

SEQ ID NO: 2961845 - RNA, 18 nt, Mycobacterium avium subsp. paratuberculosis
ggcuaucgcccggcgccc

SEQ ID NO: 2961846 - RNA, 17 nt, Mycobacterium avium subsp. paratuberculosis
ggcucaacacguccugg

SEQ ID NO: 2961847 - RNA, 22 nt, Mycobacterium avium subsp. paratuberculosis
ggcucaacacguccuggcgcca

SEQ ID NO: 2961848 - RNA, 15 nt, Mycobacterium avium subsp. paratuberculosis
ggcucaacggccggc

SEQ ID NO: 2961849 - RNA, 16 nt, Mycobacterium avium subsp. paratuberculosis
ggcucaacggccggcg

SEQ ID NO: 2961850 - RNA, 14 nt, Mycobacterium avium subsp. paratuberculosis
ggcucacagcgcgg

SEQ ID NO: 2961851 - RNA, 16 nt, Mycobacterium avium subsp. paratuberculosis
ggcucacagcgcggcg

SEQ ID NO: 2961852 - RNA, 20 nt, Mycobacterium avium subsp. paratuberculosis
ggcucacgacuccuggccga

SEQ ID NO: 2961853 - RNA, 18 nt, Mycobacterium avium subsp. paratuberculosis
ggcucacuuuugacaggu

SEQ ID NO: 2961854 - RNA, 17 nt, Mycobacterium avium subsp. paratuberculosis
ggcucagcaacccgccg

SEQ ID NO: 2961855 - RNA, 21 nt, Mycobacterium avium subsp. paratuberculosis
ggcucagcaacccgccgagcg

SEQ ID NO: 2961856 - RNA, 14 nt, Mycobacterium avium subsp. paratuberculosis
ggcucagcaccaca

SEQ ID NO: 2961857 - RNA, 15 nt, Mycobacterium avium subsp. paratuberculosis
ggcucagcagcaccg

SEQ ID NO: 2961858 - RNA, 21 nt, Mycobacterium avium subsp. paratuberculosis
ggcucagcccggcgcucaccg

SEQ ID NO: 2961859 - RNA, 19 nt, Mycobacterium avium subsp. paratuberculosis
ggcucagccgaagccggcg

SEQ ID NO: 2961860 - RNA, 20 nt, Mycobacterium avium subsp. paratuberculosis
ggcucagccgaagccggcgc

SEQ ID NO: 2961861 - RNA, 21 nt, Mycobacterium avium subsp. paratuberculosis
ggcucagccgaagccggcgca

SEQ ID NO: 2961862 - RNA, 14 nt, Mycobacterium avium subsp. paratuberculosis
ggcucagcgcaccg

SEQ ID NO: 2961863 - RNA, 17 nt, Mycobacterium avium subsp. paratuberculosis
ggcucagcgcaccgccg

SEQ ID NO: 2961864 - RNA, 12 nt, Mycobacterium avium subsp. paratuberculosis
ggcucagcggca

SEQ ID NO: 2961865 - RNA, 15 nt, Mycobacterium avium subsp. paratuberculosis
ggcucaggaucagca

SEQ ID NO: 2961866 - RNA, 19 nt, Mycobacterium avium subsp. paratuberculosis
ggcucaggaucagcagccg

SEQ ID NO: 2961867 - RNA, 18 nt, Mycobacterium avium subsp. paratuberculosis
ggcucaggggaucucggg

SEQ ID NO: 2961868 - RNA, 18 nt, Mycobacterium avium subsp. paratuberculosis
ggcucagggugcgcuggc

SEQ ID NO: 2961869 - RNA, 13 nt, Mycobacterium avium subsp. paratuberculosis
ggcuccacagcag

SEQ ID NO: 2961870 - RNA, 14 nt, Mycobacterium avium subsp. paratuberculosis
ggcuccaccgcgcc

SEQ ID NO: 2961871 - RNA, 18 nt, Mycobacterium avium subsp. paratuberculosis
ggcuccaccgcgccggcg

SEQ ID NO: 2961872 - RNA, 21 nt, Mycobacterium avium subsp. paratuberculosis
ggcuccaccgcgccggcggcg

SEQ ID NO: 2961873 - RNA, 18 nt, Mycobacterium avium subsp. paratuberculosis
ggcuccacgaugcccguc

SEQ ID NO: 2961874 - RNA, 13 nt, Mycobacterium avium subsp. paratuberculosis
ggcuccagcagcg

SEQ ID NO: 2961875 - RNA, 16 nt, Mycobacterium avium subsp. paratuberculosis
ggcuccagcgggucca

SEQ ID NO: 2961876 - RNA, 16 nt, Mycobacterium avium subsp. paratuberculosis
ggcucccagucccagc

SEQ ID NO: 2961877 - RNA, 21 nt, Mycobacterium avium subsp. paratuberculosis
ggcucccagucccagcacagc

SEQ ID NO: 2961878 - RNA, 22 nt, Mycobacterium avium subsp. paratuberculosis
ggcuccccgaccacaccggcgc

SEQ ID NO: 2961879 - RNA, 19 nt, Mycobacterium avium subsp. paratuberculosis
ggcuccccggacagccacu

SEQ ID NO: 2961880 - RNA, 18 nt, Mycobacterium avium subsp. paratuberculosis
ggcuccccggcgaucucg

SEQ ID NO: 2961881 - RNA, 23 nt, Mycobacterium avium subsp. paratuberculosis
ggcuccccggcgaucucgagcau

SEQ ID NO: 2961882 - RNA, 21 nt, Mycobacterium avium subsp. paratuberculosis
ggcucccgcuccauggcggcg

SEQ ID NO: 2961883 - RNA, 23 nt, Mycobacterium avium subsp. paratuberculosis
ggcucccgcuccauggcggcgac

SEQ ID NO: 2961884 - RNA, 17 nt, Mycobacterium avium subsp. paratuberculosis
ggcucccucgucgcuac

SEQ ID NO: 2961885 - RNA, 16 nt, Mycobacterium avium subsp. paratuberculosis
ggcuccgaucuccugg

SEQ ID NO: 2961886 - RNA, 22 nt, Mycobacterium avium subsp. paratuberculosis
ggcuccgcaugcccgggcgacu

SEQ ID NO: 2961887 - RNA, 21 nt, Mycobacterium avium subsp. paratuberculosis
ggcuccgccgauguacuccug

SEQ ID NO: 2961888 - RNA, 22 nt, Mycobacterium avium subsp. paratuberculosis
ggcuccgccgauguacuccugg

SEQ ID NO: 2961889 - RNA, 13 nt, Mycobacterium avium subsp. paratuberculosis
ggcuccgcgcuga

SEQ ID NO: 2961890 - RNA, 23 nt, Mycobacterium avium subsp. paratuberculosis
ggcuccgcgcugaccagcgugac

SEQ ID NO: 2961891 - RNA, 22 nt, Mycobacterium avium subsp. paratuberculosis
ggcuccgcguucgaccuccacg

SEQ ID NO: 2961892 - RNA, 15 nt, Mycobacterium avium subsp. paratuberculosis
ggcuccggccgcgcc

SEQ ID NO: 2961893 - RNA, 17 nt, Mycobacterium avium subsp. paratuberculosis
ggcuccugccguucggc

SEQ ID NO: 2961894 - RNA, 20 nt, Mycobacterium avium subsp. paratuberculosis
ggcucgaaaugccuuggcgg

SEQ ID NO: 2961895 - RNA, 22 nt, Mycobacterium avium subsp. paratuberculosis
ggcucgaaaugccuuggcggcg

SEQ ID NO: 2961896 - RNA, 21 nt, Mycobacterium avium subsp. paratuberculosis
ggcucgaacaacccggccgcg

SEQ ID NO: 2961897 - RNA, 17 nt, Mycobacterium avium subsp. paratuberculosis
ggcucgaaguggcagcg

SEQ ID NO: 2961898 - RNA, 15 nt, Mycobacterium avium subsp. paratuberculosis
ggcucgacaggcagc

SEQ ID NO: 2961899 - RNA, 19 nt, Mycobacterium avium subsp. paratuberculosis
ggcucgacaggcagcccgg

SEQ ID NO: 2961900 - RNA, 20 nt, Mycobacterium avium subsp. paratuberculosis
ggcucgacaggcagcccggc

SEQ ID NO: 2961901 - RNA, 19 nt, Mycobacterium avium subsp. paratuberculosis
ggcucgaccacgccguaca

SEQ ID NO: 2961902 - RNA, 19 nt, Mycobacterium avium subsp. paratuberculosis
ggcucgagcaacaccaccu

SEQ ID NO: 2961903 - RNA, 15 nt, Mycobacterium avium subsp. paratuberculosis
ggcucgagcucgucg

SEQ ID NO: 2961904 - RNA, 15 nt, Mycobacterium avium subsp. paratuberculosis
ggcucgagggcggcg

SEQ ID NO: 2961905 - RNA, 19 nt, Mycobacterium avium subsp. paratuberculosis
ggcucgagugccggcagcc

SEQ ID NO: 2961906 - RNA, 18 nt, Mycobacterium avium subsp. paratuberculosis
ggcucgaguuuggccagc

SEQ ID NO: 2961907 - RNA, 17 nt, Mycobacterium avium subsp. paratuberculosis
ggcucgaucgcggucac

SEQ ID NO: 2961908 - RNA, 20 nt, Mycobacterium avium subsp. paratuberculosis
ggcucgauguugaucgccau

SEQ ID NO: 2961909 - RNA, 22 nt, Mycobacterium avium subsp. paratuberculosis
ggcucgcccgcgacugucggcu

SEQ ID NO: 2961910 - RNA, 22 nt, Mycobacterium avium subsp. paratuberculosis
ggcucgcccgggcuaucgcccg

SEQ ID NO: 2961911 - RNA, 21 nt, Mycobacterium avium subsp. paratuberculosis
ggcucgccgcgcaucaucgcc

SEQ ID NO: 2961912 - RNA, 23 nt, Mycobacterium avium subsp. paratuberculosis
ggcucgccggcccgaccggagcc

SEQ ID NO: 2961913 - RNA, 14 nt, Mycobacterium avium subsp. paratuberculosis
ggcucgccggcgcg

SEQ ID NO: 2961914 - RNA, 16 nt, Mycobacterium avium subsp. paratuberculosis
ggcucgccggcgcgca

SEQ ID NO: 2961915 - RNA, 23 nt, Mycobacterium avium subsp. paratuberculosis
ggcucgccggcgcgcaccccggc

SEQ ID NO: 2961916 - RNA, 18 nt, Mycobacterium avium subsp. paratuberculosis
ggcucgccguugcggguc

SEQ ID NO: 2961917 - RNA, 23 nt, Mycobacterium avium subsp. paratuberculosis
ggcucgccguugcgggucggcgu

SEQ ID NO: 2961918 - RNA, 20 nt, Mycobacterium avium subsp. paratuberculosis
ggcucgccuuugaugacgac

SEQ ID NO: 2961919 - RNA, 23 nt, Mycobacterium avium subsp. paratuberculosis
ggcucgcgacgcggcucgcgcgg

SEQ ID NO: 2961920 - RNA, 17 nt, Mycobacterium avium subsp. paratuberculosis
ggcugacgcgaccgcgc

SEQ ID NO: 2961921 - RNA, 20 nt, Mycobacterium avium subsp. paratuberculosis
ggcugacgcgaccgcgcggc

SEQ ID NO: 2961922 - RNA, 15 nt, Mycobacterium avium subsp. paratuberculosis
ggcugacgucgaagg

SEQ ID NO: 2961923 - RNA, 13 nt, Mycobacterium avium subsp. paratuberculosis
ggcugacugccgg

SEQ ID NO: 2961924 - RNA, 14 nt, Mycobacterium avium subsp. paratuberculosis
ggcugacugccggc

SEQ ID NO: 2961925 - RNA, 15 nt, Mycobacterium avium subsp. paratuberculosis
ggcugacugccggcg

SEQ ID NO: 2961926 - RNA, 14 nt, Mycobacterium avium subsp. paratuberculosis
ggcugagcaccggg

SEQ ID NO: 2961927 - RNA, 16 nt, Mycobacterium avium subsp. paratuberculosis
ggcugagcaccggggu

SEQ ID NO: 2961928 - RNA, 17 nt, Mycobacterium avium subsp. paratuberculosis
ggcugagcaccgggguc

SEQ ID NO: 2961929 - RNA, 21 nt, Mycobacterium avium subsp. paratuberculosis
ggcugagcaccggggucugca

SEQ ID NO: 2961930 - RNA, 12 nt, Mycobacterium avium subsp. paratuberculosis
ggcugagcagcu

SEQ ID NO: 2961931 - RNA, 17 nt, Mycobacterium avium subsp. paratuberculosis
ggcugagcagcucgcgg

SEQ ID NO: 2961932 - RNA, 14 nt, Mycobacterium avium subsp. paratuberculosis
ggcugagcgucggu

SEQ ID NO: 2961933 - RNA, 14 nt, Mycobacterium avium subsp. paratuberculosis
ggcugaggcaaggc

SEQ ID NO: 2961934 - RNA, 16 nt, Mycobacterium avium subsp. paratuberculosis
ggcugaucagccggcg

SEQ ID NO: 2961935 - RNA, 17 nt, Mycobacterium avium subsp. paratuberculosis
ggcugaucagccggcga

SEQ ID NO: 2961936 - RNA, 22 nt, Mycobacterium avium subsp. paratuberculosis
ggcugaucagccggcgagcgcg

SEQ ID NO: 2961937 - RNA, 17 nt, Mycobacterium avium subsp. paratuberculosis
ggcugauccgcgacgcc

SEQ ID NO: 2961938 - RNA, 16 nt, Mycobacterium avium subsp. paratuberculosis
ggcugaucucggcggu

SEQ ID NO: 2961939 - RNA, 13 nt, Mycobacterium avium subsp. paratuberculosis
ggcugauguucag

SEQ ID NO: 2961940 - RNA, 17 nt, Mycobacterium avium subsp. paratuberculosis
ggcugauguucaguucg

SEQ ID NO: 2961941 - RNA, 16 nt, Mycobacterium avium subsp. paratuberculosis
ggcugcacgcugcgca

SEQ ID NO: 2961942 - RNA, 22 nt, Mycobacterium avium subsp. paratuberculosis
ggcugcacgucacgggccaggc

SEQ ID NO: 2961943 - RNA, 19 nt, Mycobacterium avium subsp. paratuberculosis
ggcugcagcagaugcgccu

SEQ ID NO: 2961944 - RNA, 22 nt, Mycobacterium avium subsp. paratuberculosis
ggcugcagccgggcggcggccu

SEQ ID NO: 2961945 - RNA, 21 nt, Mycobacterium avium subsp. paratuberculosis
ggcugcaucuccagccgcggc

SEQ ID NO: 2961946 - RNA, 14 nt, Mycobacterium avium subsp. paratuberculosis
ggcugcccaccacc

SEQ ID NO: 2961947 - RNA, 15 nt, Mycobacterium avium subsp. paratuberculosis
ggcugcccaccacca

SEQ ID NO: 2961948 - RNA, 22 nt, Mycobacterium avium subsp. paratuberculosis
ggcugcccaggaucaccgggac

SEQ ID NO: 2961949 - RNA, 18 nt, Mycobacterium avium subsp. paratuberculosis
ggcugcccagguccaccg

SEQ ID NO: 2961950 - RNA, 22 nt, Mycobacterium avium subsp. paratuberculosis
ggcugcccgacccgcaccaccg

SEQ ID NO: 2961951 - RNA, 16 nt, Mycobacterium avium subsp. paratuberculosis
ggcugcccggcaaccg

SEQ ID NO: 2961952 - RNA, 17 nt, Mycobacterium avium subsp. paratuberculosis
ggcugcccggcccgccg

SEQ ID NO: 2961953 - RNA, 18 nt, Mycobacterium avium subsp. paratuberculosis
ggcugcccggcccgccgc

SEQ ID NO: 2961954 - RNA, 20 nt, Mycobacterium avium subsp. paratuberculosis
ggcugcccggcccgccgcug

SEQ ID NO: 2961955 - RNA, 22 nt, Mycobacterium avium subsp. paratuberculosis
ggcugcccggcccgccgcugca

SEQ ID NO: 2961956 - RNA, 15 nt, Mycobacterium avium subsp. paratuberculosis
ggcugcccggcgccg

SEQ ID NO: 2961957 - RNA, 21 nt, Mycobacterium avium subsp. paratuberculosis
ggcugcccgggcuguugacca

SEQ ID NO: 2961958 - RNA, 22 nt, Mycobacterium avium subsp. paratuberculosis
ggcugcccucuuccucgcuguc

SEQ ID NO: 2961959 - RNA, 12 nt, Mycobacterium avium subsp. paratuberculosis
ggcugcccuggg

SEQ ID NO: 2961960 - RNA, 15 nt, Mycobacterium avium subsp. paratuberculosis
ggcugcccugggagg

SEQ ID NO: 2961961 - RNA, 18 nt, Mycobacterium avium subsp. paratuberculosis
ggcugccgaccucgaugg

SEQ ID NO: 2961962 - RNA, 22 nt, Mycobacterium avium subsp. paratuberculosis
ggcugccgaccucgauggcgac

SEQ ID NO: 2961963 - RNA, 19 nt, Mycobacterium avium subsp. paratuberculosis
ggcugccgcugcgccggcg

SEQ ID NO: 2961964 - RNA, 16 nt, Mycobacterium avium subsp. paratuberculosis
ggcugccggccaaggc

SEQ ID NO: 2961965 - RNA, 19 nt, Mycobacterium avium subsp. paratuberculosis
ggcugccggugcugcugua

SEQ ID NO: 2961966 - RNA, 14 nt, Mycobacterium avium subsp. paratuberculosis
ggcugccucgacga

SEQ ID NO: 2961967 - RNA, 20 nt, Mycobacterium avium subsp. paratuberculosis
ggcugcgcacguagcccagc

SEQ ID NO: 2961968 - RNA, 21 nt, Mycobacterium avium subsp. paratuberculosis
ggcugcgcacguagcccagcg

SEQ ID NO: 2961969 - RNA, 19 nt, Mycobacterium avium subsp. paratuberculosis
ggcugcgccgcgcuugcga

SEQ ID NO: 2961970 - RNA, 13 nt, Mycobacterium avium subsp. paratuberculosis
ggcugcgcggcuu

SEQ ID NO: 2961971 - RNA, 14 nt, Mycobacterium avium subsp. paratuberculosis
ggcugcgcggcuug

SEQ ID NO: 2961972 - RNA, 18 nt, Mycobacterium avium subsp. paratuberculosis
ggcugcgcguucggcgcc

SEQ ID NO: 2961973 - RNA, 13 nt, Mycobacterium avium subsp. paratuberculosis
ggcugcggccccg

SEQ ID NO: 2961974 - RNA, 19 nt, Mycobacterium avium subsp. paratuberculosis
ggcugcggcgagucccggc

SEQ ID NO: 2961975 - RNA, 15 nt, Mycobacterium avium subsp. paratuberculosis
ggcugcgggccagcg

SEQ ID NO: 2961976 - RNA, 15 nt, Mycobacterium avium subsp. paratuberculosis
ggcugcgggugggga

SEQ ID NO: 2961977 - RNA, 16 nt, Mycobacterium avium subsp. paratuberculosis
ggcugcgguuggccgg

SEQ ID NO: 2961978 - RNA, 17 nt, Mycobacterium avium subsp. paratuberculosis
ggcugcgguuggccggc

SEQ ID NO: 2961979 - RNA, 19 nt, Mycobacterium avium subsp. paratuberculosis
ggcugcgguuggccggccg

SEQ ID NO: 2961980 - RNA, 23 nt, Mycobacterium avium subsp. paratuberculosis
ggcugcgguuggccggccgggcg

SEQ ID NO: 2961981 - RNA, 16 nt, Mycobacterium avium subsp. paratuberculosis
ggcugcucgaaccgcg

SEQ ID NO: 2961982 - RNA, 19 nt, Mycobacterium avium subsp. paratuberculosis
ggcugcucgcgcugccgcg

SEQ ID NO: 2961983 - RNA, 15 nt, Mycobacterium avium subsp. paratuberculosis
ggcugcucggcgggc

SEQ ID NO: 2961984 - RNA, 21 nt, Mycobacterium avium subsp. paratuberculosis
ggcugcucggcgggcucgcgc

SEQ ID NO: 2961985 - RNA, 22 nt, Mycobacterium avium subsp. paratuberculosis
ggcugcugcacgacgaccgcga

SEQ ID NO: 2961986 - RNA, 17 nt, Mycobacterium avium subsp. paratuberculosis
ggcugcugcacgucgcc

SEQ ID NO: 2961987 - RNA, 18 nt, Mycobacterium avium subsp. paratuberculosis
ggcugcugcacgucgccg

SEQ ID NO: 2961988 - RNA, 20 nt, Mycobacterium avium subsp. paratuberculosis
ggcugcugcagcgcccgggc

SEQ ID NO: 2961989 - RNA, 16 nt, Mycobacterium avium subsp. paratuberculosis
ggcugcuggucgacgu

SEQ ID NO: 2961990 - RNA, 17 nt, Mycobacterium avium subsp. paratuberculosis
ggcugcuggucgacguc

SEQ ID NO: 2961991 - RNA, 18 nt, Mycobacterium avium subsp. paratuberculosis
ggcugcuggucgacguca

SEQ ID NO: 2961992 - RNA, 14 nt, Mycobacterium avium subsp. paratuberculosis
ggcuggaaguucgc

SEQ ID NO: 2961993 - RNA, 20 nt, Mycobacterium avium subsp. paratuberculosis
ggcuggaaguucgcuggcgg

SEQ ID NO: 2961994 - RNA, 23 nt, Mycobacterium avium subsp. paratuberculosis
ggcuggaaguucgcuggcggggc

SEQ ID NO: 2961995 - RNA, 13 nt, Mycobacterium avium subsp. paratuberculosis
ggcuggaaucccg

SEQ ID NO: 2961996 - RNA, 23 nt, Mycobacterium avium subsp. paratuberculosis
ggcuggaaucccgccucggcgga

SEQ ID NO: 2961997 - RNA, 15 nt, Mycobacterium avium subsp. paratuberculosis
ggcuggacaccacgu

SEQ ID NO: 2961998 - RNA, 23 nt, Mycobacterium avium subsp. paratuberculosis
ggcuggacaccacgucgucggcc

SEQ ID NO: 2961999 - RNA, 16 nt, Mycobacterium avium subsp. paratuberculosis
ggcuggacacccccga

SEQ ID NO: 2962000 - RNA, 17 nt, Mycobacterium avium subsp. paratuberculosis
ggcuggcaggucgcgcc

SEQ ID NO: 2962001 - RNA, 23 nt, Mycobacterium avium subsp. paratuberculosis
ggcuggcaucgucggcgccggcg

SEQ ID NO: 2962002 - RNA, 20 nt, Mycobacterium avium subsp. paratuberculosis
ggcuggcaugccggaacacc

SEQ ID NO: 2962003 - RNA, 15 nt, Mycobacterium avium subsp. paratuberculosis
ggcuggccaggcugg

SEQ ID NO: 2962004 - RNA, 17 nt, Mycobacterium avium subsp. paratuberculosis
gggaacgacggugcgcc

SEQ ID NO: 2962005 - RNA, 19 nt, Mycobacterium avium subsp. paratuberculosis
gggaacgccgaucaccgcg

SEQ ID NO: 2962006 - RNA, 20 nt, Mycobacterium avium subsp. paratuberculosis
gggaacgccgaucaccggca

SEQ ID NO: 2962007 - RNA, 13 nt, Mycobacterium avium subsp. paratuberculosis
gggaacgcggcga

SEQ ID NO: 2962008 - RNA, 13 nt, Mycobacterium avium subsp. paratuberculosis
gggaacggucagc

SEQ ID NO: 2962009 - RNA, 17 nt, Mycobacterium avium subsp. paratuberculosis
gggaacggucagccgcg

SEQ ID NO: 2962010 - RNA, 19 nt, Mycobacterium avium subsp. paratuberculosis
gggaacgucauggccagcu

SEQ ID NO: 2962011 - RNA, 15 nt, Mycobacterium avium subsp. paratuberculosis
gggaacucgaugcgg

SEQ ID NO: 2962012 - RNA, 15 nt, Mycobacterium avium subsp. paratuberculosis
gggaacucggccagc

SEQ ID NO: 2962013 - RNA, 17 nt, Mycobacterium avium subsp. paratuberculosis
gggaacucggugaugcc

SEQ ID NO: 2962014 - RNA, 20 nt, Mycobacterium avium subsp. paratuberculosis
gggaagacgugcacgugcag

SEQ ID NO: 2962015 - RNA, 18 nt, Mycobacterium avium subsp. paratuberculosis
gggaagaucgucgucccg

SEQ ID NO: 2962016 - RNA, 14 nt, Mycobacterium avium subsp. paratuberculosis
gggaagcccaccgc

SEQ ID NO: 2962017 - RNA, 13 nt, Mycobacterium avium subsp. paratuberculosis
gggaagcccagca

SEQ ID NO: 2962018 - RNA, 20 nt, Mycobacterium avium subsp. paratuberculosis
gggaagcccagcacccgcuc

SEQ ID NO: 2962019 - RNA, 14 nt, Mycobacterium avium subsp. paratuberculosis
gggaagccgcagca

SEQ ID NO: 2962020 - RNA, 17 nt, Mycobacterium avium subsp. paratuberculosis
gggaagccgcagcaggu

SEQ ID NO: 2962021 - RNA, 12 nt, Mycobacterium avium subsp. paratuberculosis
gggaagcuggug

SEQ ID NO: 2962022 - RNA, 23 nt, Mycobacterium avium subsp. paratuberculosis
gggaaggacucaaucggucaggg

SEQ ID NO: 2962023 - RNA, 14 nt, Mycobacterium avium subsp. paratuberculosis
gggaagggcccggg

SEQ ID NO: 2962024 - RNA, 15 nt, Mycobacterium avium subsp. paratuberculosis
gggaagggcuccccg

SEQ ID NO: 2962025 - RNA, 16 nt, Mycobacterium avium subsp. paratuberculosis
gggaagggcuccccgg

SEQ ID NO: 2962026 - RNA, 12 nt, Mycobacterium avium subsp. paratuberculosis
gggaaguccggg

SEQ ID NO: 2962027 - RNA, 19 nt, Mycobacterium avium subsp. paratuberculosis
gggaagucgaccggggcgc

SEQ ID NO: 2962028 - RNA, 15 nt, Mycobacterium avium subsp. paratuberculosis
gggaaucccacccgc

SEQ ID NO: 2962029 - RNA, 16 nt, Mycobacterium avium subsp. paratuberculosis
gggaaucccacccgca

SEQ ID NO: 2962030 - RNA, 17 nt, Mycobacterium avium subsp. paratuberculosis
gggaaucuuccuucuug

SEQ ID NO: 2962031 - RNA, 16 nt, Mycobacterium avium subsp. paratuberculosis
gggaaugcggcugggu

SEQ ID NO: 2962032 - RNA, 16 nt, Mycobacterium avium subsp. paratuberculosis
gggaauuccggcgcga

SEQ ID NO: 2962033 - RNA, 23 nt, Mycobacterium avium subsp. paratuberculosis
gggaauuggcaccggaccgccga

SEQ ID NO: 2962034 - RNA, 14 nt, Mycobacterium avium subsp. paratuberculosis
gggacacggcggcg

SEQ ID NO: 2962035 - RNA, 15 nt, Mycobacterium avium subsp. paratuberculosis
gggacacggcggcgc

SEQ ID NO: 2962036 - RNA, 19 nt, Mycobacterium avium subsp. paratuberculosis
gggacagcaccaccagguc

SEQ ID NO: 2962037 - RNA, 12 nt, Mycobacterium avium subsp. paratuberculosis
gggacagccgcg

SEQ ID NO: 2962038 - RNA, 16 nt, Mycobacterium avium subsp. paratuberculosis
gggacagccggucgac

SEQ ID NO: 2962039 - RNA, 19 nt, Mycobacterium avium subsp. paratuberculosis
gggacagccggucgacgaa

SEQ ID NO: 2962040 - RNA, 13 nt, Mycobacterium avium subsp. paratuberculosis
gggacaucgucgc

SEQ ID NO: 2962041 - RNA, 15 nt, Mycobacterium avium subsp. paratuberculosis
gggacaucgucgcgc

SEQ ID NO: 2962042 - RNA, 20 nt, Mycobacterium avium subsp. paratuberculosis
gggacaucgucgcgcccagg

SEQ ID NO: 2962043 - RNA, 21 nt, Mycobacterium avium subsp. paratuberculosis
gggacaugccgagcagcaccg

SEQ ID NO: 2962044 - RNA, 12 nt, Mycobacterium avium subsp. paratuberculosis
gggaccacccgc

SEQ ID NO: 2962045 - RNA, 16 nt, Mycobacterium avium subsp. paratuberculosis
gggaccacccgcagcg

SEQ ID NO: 2962046 - RNA, 23 nt, Mycobacterium avium subsp. paratuberculosis
gggaccacccgcagcgcggcgga

SEQ ID NO: 2962047 - RNA, 18 nt, Mycobacterium avium subsp. paratuberculosis
gggaccagcgcaaccgcg

SEQ ID NO: 2962048 - RNA, 19 nt, Mycobacterium avium subsp. paratuberculosis
gggacccccucgucgaucg

SEQ ID NO: 2962049 - RNA, 15 nt, Mycobacterium avium subsp. paratuberculosis
gggacccgcaccgga

SEQ ID NO: 2962050 - RNA, 16 nt, Mycobacterium avium subsp. paratuberculosis
gggacccggaacccgc

SEQ ID NO: 2962051 - RNA, 24 nt, Mycobacterium avium subsp. paratuberculosis
gggaccgaggugccgcgggucgau

SEQ ID NO: 2962052 - RNA, 21 nt, Mycobacterium avium subsp. paratuberculosis
gggaccgcacgccggguuggg

SEQ ID NO: 2962053 - RNA, 13 nt, Mycobacterium avium subsp. paratuberculosis
gggaccgcgggcg

SEQ ID NO: 2962054 - RNA, 16 nt, Mycobacterium avium subsp. paratuberculosis
gggaccgggcccggcg

SEQ ID NO: 2962055 - RNA, 18 nt, Mycobacterium avium subsp. paratuberculosis
gggaccgucaccguggcg

SEQ ID NO: 2962056 - RNA, 19 nt, Mycobacterium avium subsp. paratuberculosis
gggaccgucgcgcagcccg

SEQ ID NO: 2962057 - RNA, 21 nt, Mycobacterium avium subsp. paratuberculosis
gggaccgucgggaauggggcc

SEQ ID NO: 2962058 - RNA, 21 nt, Mycobacterium avium subsp. paratuberculosis
gggaccugggucugcggccgg

SEQ ID NO: 2962059 - RNA, 13 nt, Mycobacterium avium subsp. paratuberculosis
gggacgaagaccg

SEQ ID NO: 2962060 - RNA, 18 nt, Mycobacterium avium subsp. paratuberculosis
gggacgaagaccgggucg

SEQ ID NO: 2962061 - RNA, 16 nt, Mycobacterium avium subsp. paratuberculosis
gggacgacgccgaacu

SEQ ID NO: 2962062 - RNA, 14 nt, Mycobacterium avium subsp. paratuberculosis
gggacgccacggcg

SEQ ID NO: 2962063 - RNA, 18 nt, Mycobacterium avium subsp. paratuberculosis
gggacgccacggcgaaca

SEQ ID NO: 2962064 - RNA, 24 nt, Mycobacterium avium subsp. paratuberculosis
gggacgccguugacaccgggugcg

SEQ ID NO: 2962065 - RNA, 13 nt, Mycobacterium avium subsp. paratuberculosis
gggacgcggcagg

SEQ ID NO: 2962066 - RNA, 20 nt, Mycobacterium avium subsp. paratuberculosis
gggacgcgguccagcuuguc

SEQ ID NO: 2962067 - RNA, 14 nt, Mycobacterium avium subsp. paratuberculosis
gggacgcugaucua

SEQ ID NO: 2962068 - RNA, 20 nt, Mycobacterium avium subsp. paratuberculosis
gggacggaaaucgccugucc

SEQ ID NO: 2962069 - RNA, 12 nt, Mycobacterium avium subsp. paratuberculosis
gggacggccagc

SEQ ID NO: 2962070 - RNA, 14 nt, Mycobacterium avium subsp. paratuberculosis
gggacggccagcag

SEQ ID NO: 2962071 - RNA, 16 nt, Mycobacterium avium subsp. paratuberculosis
gggacggccagcaggg

SEQ ID NO: 2962072 - RNA, 15 nt, Mycobacterium avium subsp. paratuberculosis
gggacggcggcgagu

SEQ ID NO: 2962073 - RNA, 16 nt, Mycobacterium avium subsp. paratuberculosis
gggacgggggugccga

SEQ ID NO: 2962074 - RNA, 16 nt, Mycobacterium avium subsp. paratuberculosis
gggacgggucggcggc

SEQ ID NO: 2962075 - RNA, 17 nt, Mycobacterium avium subsp. paratuberculosis
gggacgggucggcggcg

SEQ ID NO: 2962076 - RNA, 14 nt, Mycobacterium avium subsp. paratuberculosis
gggacgggucggug

SEQ ID NO: 2962077 - RNA, 23 nt, Mycobacterium avium subsp. paratuberculosis
gggacggguugcaggccacgccc

SEQ ID NO: 2962078 - RNA, 23 nt, Mycobacterium avium subsp. paratuberculosis
gggacggugcagccgggggcggu

SEQ ID NO: 2962079 - RNA, 16 nt, Mycobacterium avium subsp. paratuberculosis
gggacgucggcgcgcu

SEQ ID NO: 2962080 - RNA, 19 nt, Mycobacterium avium subsp. paratuberculosis
gggacgucggcgcgcucgg

SEQ ID NO: 2962081 - RNA, 17 nt, Mycobacterium avium subsp. paratuberculosis
gggacgucgucguccca

SEQ ID NO: 2962082 - RNA, 13 nt, Mycobacterium avium subsp. paratuberculosis
gggacuccgggga

SEQ ID NO: 2962083 - RNA, 15 nt, Mycobacterium avium subsp. paratuberculosis
gggacuccggggacg

SEQ ID NO: 2962084 - RNA, 18 nt, Mycobacterium avium subsp. paratuberculosis
gggacuccggggacgggu

SEQ ID NO: 2962085 - RNA, 12 nt, Mycobacterium avium subsp. paratuberculosis
gggacugcagcg

SEQ ID NO: 2962086 - RNA, 16 nt, Mycobacterium avium subsp. paratuberculosis
gggacugcagcgcggu

SEQ ID NO: 2962087 - RNA, 17 nt, Mycobacterium avium subsp. paratuberculosis
gggacugcgccggggcc

SEQ ID NO: 2962088 - RNA, 14 nt, Mycobacterium avium subsp. paratuberculosis
gggagacugcgacc

SEQ ID NO: 2962089 - RNA, 18 nt, Mycobacterium avium subsp. paratuberculosis
gggaugucuagccgccga

SEQ ID NO: 2962090 - RNA, 15 nt, Mycobacterium avium subsp. paratuberculosis
gggaugugcugcagg

SEQ ID NO: 2962091 - RNA, 16 nt, Mycobacterium avium subsp. paratuberculosis
gggauuggcggccaac

SEQ ID NO: 2962092 - RNA, 20 nt, Mycobacterium avium subsp. paratuberculosis
gggauuucacgucugcucgg

SEQ ID NO: 2962093 - RNA, 15 nt, Mycobacterium avium subsp. paratuberculosis
gggauuucccgggcg

SEQ ID NO: 2962094 - RNA, 22 nt, Mycobacterium avium subsp. paratuberculosis
gggauuuggcuagcgggcgcgc

SEQ ID NO: 2962095 - RNA, 20 nt, Mycobacterium avium subsp. paratuberculosis
gggauuuuuuggggcggggc

SEQ ID NO: 2962096 - RNA, 15 nt, Mycobacterium avium subsp. paratuberculosis
gggcaaagacgacgg

SEQ ID NO: 2962097 - RNA, 13 nt, Mycobacterium avium subsp. paratuberculosis
gggcaacagcgcg

SEQ ID NO: 2962098 - RNA, 15 nt, Mycobacterium avium subsp. paratuberculosis
gggcaacagcgcgcc

SEQ ID NO: 2962099 - RNA, 16 nt, Mycobacterium avium subsp. paratuberculosis
gggcaacagcgcgccg

SEQ ID NO: 2962100 - RNA, 21 nt, Mycobacterium avium subsp. paratuberculosis
gggcaacagcgcgccggccgg

SEQ ID NO: 2962101 - RNA, 22 nt, Mycobacterium avium subsp. paratuberculosis
gggcaaccacagcggcgcauga

SEQ ID NO: 2962102 - RNA, 17 nt, Mycobacterium avium subsp. paratuberculosis
gggcaacgaacgcggcg

SEQ ID NO: 2962103 - RNA, 18 nt, Mycobacterium avium subsp. paratuberculosis
gggcaacgcgccggcggu

SEQ ID NO: 2962104 - RNA, 16 nt, Mycobacterium avium subsp. paratuberculosis
gggcaauaccggcagc

SEQ ID NO: 2962105 - RNA, 19 nt, Mycobacterium avium subsp. paratuberculosis
gggcaaucgcugcgcccgc

SEQ ID NO: 2962106 - RNA, 21 nt, Mycobacterium avium subsp. paratuberculosis
gggcaaucgcugcgcccgccg

SEQ ID NO: 2962107 - RNA, 19 nt, Mycobacterium avium subsp. paratuberculosis
gggcaaugaugucggcggg

SEQ ID NO: 2962108 - RNA, 20 nt, Mycobacterium avium subsp. paratuberculosis
gggcaauggccgcgacucug

SEQ ID NO: 2962109 - RNA, 23 nt, Mycobacterium avium subsp. paratuberculosis
gggcacaccggugcucuccugcu

SEQ ID NO: 2962110 - RNA, 21 nt, Mycobacterium avium subsp. paratuberculosis
gggcacaccgucguccacgcc

SEQ ID NO: 2962111 - RNA, 13 nt, Mycobacterium avium subsp. paratuberculosis
gggcacacgcggu

SEQ ID NO: 2962112 - RNA, 16 nt, Mycobacterium avium subsp. paratuberculosis
gggcacagccagcgcc

SEQ ID NO: 2962113 - RNA, 20 nt, Mycobacterium avium subsp. paratuberculosis
gggcacagccagcgcccggc

SEQ ID NO: 2962114 - RNA, 16 nt, Mycobacterium avium subsp. paratuberculosis
gggcacauagcucagg

SEQ ID NO: 2962115 - RNA, 17 nt, Mycobacterium avium subsp. paratuberculosis
gggcacauagcucaggu

SEQ ID NO: 2962116 - RNA, 13 nt, Mycobacterium avium subsp. paratuberculosis
gggcaccaccacc

SEQ ID NO: 2962117 - RNA, 11 nt, Mycobacterium avium subsp. paratuberculosis
gggcaccacgc

SEQ ID NO: 2962118 - RNA, 17 nt, Mycobacterium avium subsp. paratuberculosis
gggcaccacggcggcau

SEQ ID NO: 2962119 - RNA, 18 nt, Mycobacterium avium subsp. paratuberculosis
gggcaccacggcggcaug

SEQ ID NO: 2962120 - RNA, 11 nt, Mycobacterium avium subsp. paratuberculosis
gggcaccacgu

SEQ ID NO: 2962121 - RNA, 11 nt, Mycobacterium avium subsp. paratuberculosis
gggcaccagca

SEQ ID NO: 2962122 - RNA, 12 nt, Mycobacterium avium subsp. paratuberculosis
gggcaccagcac

SEQ ID NO: 2962123 - RNA, 21 nt, Mycobacterium avium subsp. paratuberculosis
gggcaccagcagcgcgacgcc

SEQ ID NO: 2962124 - RNA, 12 nt, Mycobacterium avium subsp. paratuberculosis
gggcaccagcga

SEQ ID NO: 2962125 - RNA, 17 nt, Mycobacterium avium subsp. paratuberculosis
gggcaccagcgacagca

SEQ ID NO: 2962126 - RNA, 18 nt, Mycobacterium avium subsp. paratuberculosis
gggcaccagcgcgacggu

SEQ ID NO: 2962127 - RNA, 19 nt, Mycobacterium avium subsp. paratuberculosis
gggcaccccaucggccagg

SEQ ID NO: 2962128 - RNA, 22 nt, Mycobacterium avium subsp. paratuberculosis
gggcaccccaucggccaggaac

SEQ ID NO: 2962129 - RNA, 20 nt, Mycobacterium avium subsp. paratuberculosis
gggcaccccugccgccaccg

SEQ ID NO: 2962130 - RNA, 23 nt, Mycobacterium avium subsp. paratuberculosis
gggcaccccugccgccaccgcga

SEQ ID NO: 2962131 - RNA, 18 nt, Mycobacterium avium subsp. paratuberculosis
gggcacccgacgucgacg

SEQ ID NO: 2962132 - RNA, 22 nt, Mycobacterium avium subsp. paratuberculosis
gggcacccgcgcgucgcgcagc

SEQ ID NO: 2962133 - RNA, 17 nt, Mycobacterium avium subsp. paratuberculosis
gggcacccggcgcggcc

SEQ ID NO: 2962134 - RNA, 19 nt, Mycobacterium avium subsp. paratuberculosis
gggcacccggcgcggccgc

SEQ ID NO: 2962135 - RNA, 23 nt, Mycobacterium avium subsp. paratuberculosis
gggcacccggcgcggccgcccag

SEQ ID NO: 2962136 - RNA, 20 nt, Mycobacterium avium subsp. paratuberculosis
gggcacccggguggacaccg

SEQ ID NO: 2962137 - RNA, 23 nt, Mycobacterium avium subsp. paratuberculosis
gggcacccggguggacaccgcga

SEQ ID NO: 2962138 - RNA, 22 nt, Mycobacterium avium subsp. paratuberculosis
gggcaccgacggccgcacccca

SEQ ID NO: 2962139 - RNA, 13 nt, Mycobacterium avium subsp. paratuberculosis
gggcaccgccagg

SEQ ID NO: 2962140 - RNA, 14 nt, Mycobacterium avium subsp. paratuberculosis
gggcaccgcgaacg

SEQ ID NO: 2962141 - RNA, 12 nt, Mycobacterium avium subsp. paratuberculosis
gggcaccgcgcc

SEQ ID NO: 2962142 - RNA, 16 nt, Mycobacterium avium subsp. paratuberculosis
gggcaccgcgcccgcc

SEQ ID NO: 2962143 - RNA, 17 nt, Mycobacterium avium subsp. paratuberculosis
gggcaccgcgcccgccc

SEQ ID NO: 2962144 - RNA, 22 nt, Mycobacterium avium subsp. paratuberculosis
gggcaccgucgucgcaccggca

SEQ ID NO: 2962145 - RNA, 16 nt, Mycobacterium avium subsp. paratuberculosis
gggcaccucggccagg

SEQ ID NO: 2962146 - RNA, 13 nt, Mycobacterium avium subsp. paratuberculosis
gggcaccucggcg

SEQ ID NO: 2962147 - RNA, 19 nt, Mycobacterium avium subsp. paratuberculosis
gggcacgaauucgguggcg

SEQ ID NO: 2962148 - RNA, 20 nt, Mycobacterium avium subsp. paratuberculosis
gggcacgacggucagcacgc

SEQ ID NO: 2962149 - RNA, 15 nt, Mycobacterium avium subsp. paratuberculosis
gggcacgcagcggcg

SEQ ID NO: 2962150 - RNA, 16 nt, Mycobacterium avium subsp. paratuberculosis
gggcacgcagcggcgu

SEQ ID NO: 2962151 - RNA, 20 nt, Mycobacterium avium subsp. paratuberculosis
gggcacgcagcggcgucacg

SEQ ID NO: 2962152 - RNA, 18 nt, Mycobacterium avium subsp. paratuberculosis
gggcacgcgcgcccggca

SEQ ID NO: 2962153 - RNA, 13 nt, Mycobacterium avium subsp. paratuberculosis
gggcacggucagg

SEQ ID NO: 2962154 - RNA, 16 nt, Mycobacterium avium subsp. paratuberculosis
gggcacggugggacgg

SEQ ID NO: 2962155 - RNA, 20 nt, Mycobacterium avium subsp. paratuberculosis
gggcacgguguagcugcggg

SEQ ID NO: 2962156 - RNA, 13 nt, Mycobacterium avium subsp. paratuberculosis
gggcacguccagc

SEQ ID NO: 2962157 - RNA, 18 nt, Mycobacterium avium subsp. paratuberculosis
gggcacguccagcccgcg

SEQ ID NO: 2962158 - RNA, 20 nt, Mycobacterium avium subsp. paratuberculosis
gggcacguccccgugcagcc

SEQ ID NO: 2962159 - RNA, 13 nt, Mycobacterium avium subsp. paratuberculosis
gggcacgucgacg

SEQ ID NO: 2962160 - RNA, 14 nt, Mycobacterium avium subsp. paratuberculosis
gggcacgucggcca

SEQ ID NO: 2962161 - RNA, 15 nt, Mycobacterium avium subsp. paratuberculosis
gggcacgucggccag

SEQ ID NO: 2962162 - RNA, 17 nt, Mycobacterium avium subsp. paratuberculosis
gggcagauaggcggcga

SEQ ID NO: 2962163 - RNA, 20 nt, Mycobacterium avium subsp. paratuberculosis
gggcagauaggcggcgacgg

SEQ ID NO: 2962164 - RNA, 19 nt, Mycobacterium avium subsp. paratuberculosis
gggcagaucgucggcacug

SEQ ID NO: 2962165 - RNA, 15 nt, Mycobacterium avium subsp. paratuberculosis
gggcagaugcccgcu

SEQ ID NO: 2962166 - RNA, 15 nt, Mycobacterium avium subsp. paratuberculosis
gggcagcaccagcgg

SEQ ID NO: 2962167 - RNA, 20 nt, Mycobacterium avium subsp. paratuberculosis
gggcagcaccagcggcacca

SEQ ID NO: 2962168 - RNA, 22 nt, Mycobacterium avium subsp. paratuberculosis
gggcagcaccagcggcaccagg

SEQ ID NO: 2962169 - RNA, 14 nt, Mycobacterium avium subsp. paratuberculosis
gggcagcacccgca

SEQ ID NO: 2962170 - RNA, 20 nt, Mycobacterium avium subsp. paratuberculosis
gggcagcaccucgcgcgcga

SEQ ID NO: 2962171 - RNA, 23 nt, Mycobacterium avium subsp. paratuberculosis
gggcagcaccucgcgcgcgagcc

SEQ ID NO: 2962172 - RNA, 19 nt, Mycobacterium avium subsp. paratuberculosis
gggcagcagcaccagcgcc

SEQ ID NO: 2962173 - RNA, 20 nt, Mycobacterium avium subsp. paratuberculosis
gggcagcagcagaucggcgu

SEQ ID NO: 2962174 - RNA, 20 nt, Mycobacterium avium subsp. paratuberculosis
gggccaacuccggcggcagc

SEQ ID NO: 2962175 - RNA, 23 nt, Mycobacterium avium subsp. paratuberculosis
gggccaacuccggcggcagccag

SEQ ID NO: 2962176 - RNA, 15 nt, Mycobacterium avium subsp. paratuberculosis
gggccaacugggugg

SEQ ID NO: 2962177 - RNA, 14 nt, Mycobacterium avium subsp. paratuberculosis
gggccaagcaccgg

SEQ ID NO: 2962178 - RNA, 16 nt, Mycobacterium avium subsp. paratuberculosis
gggccaagcaccggga

SEQ ID NO: 2962179 - RNA, 18 nt, Mycobacterium avium subsp. paratuberculosis
gggccacacacugcugcg

SEQ ID NO: 2962180 - RNA, 18 nt, Mycobacterium avium subsp. paratuberculosis
gggccacacccgucgacu

SEQ ID NO: 2962181 - RNA, 14 nt, Mycobacterium avium subsp. paratuberculosis
gggccacagcggcg

SEQ ID NO: 2962182 - RNA, 13 nt, Mycobacterium avium subsp. paratuberculosis
gggccaccaccac

SEQ ID NO: 2962183 - RNA, 15 nt, Mycobacterium avium subsp. paratuberculosis
gggccaccaccacgg

SEQ ID NO: 2962184 - RNA, 16 nt, Mycobacterium avium subsp. paratuberculosis
gggccaccaccacggc

SEQ ID NO: 2962185 - RNA, 20 nt, Mycobacterium avium subsp. paratuberculosis
gggccaccaccacggccgcc

SEQ ID NO: 2962186 - RNA, 15 nt, Mycobacterium avium subsp. paratuberculosis
gggccaccacgccag

SEQ ID NO: 2962187 - RNA, 12 nt, Mycobacterium avium subsp. paratuberculosis
gggccaccagcg

SEQ ID NO: 2962188 - RNA, 13 nt, Mycobacterium avium subsp. paratuberculosis
gggccaccagcgc

SEQ ID NO: 2962189 - RNA, 15 nt, Mycobacterium avium subsp. paratuberculosis
gggccaccagcgcag

SEQ ID NO: 2962190 - RNA, 14 nt, Mycobacterium avium subsp. paratuberculosis
gggccaccaggccg

SEQ ID NO: 2962191 - RNA, 17 nt, Mycobacterium avium subsp. paratuberculosis
gggccaccaggcgccgu

SEQ ID NO: 2962192 - RNA, 13 nt, Mycobacterium avium subsp. paratuberculosis
gggccaccgcggc

SEQ ID NO: 2962193 - RNA, 19 nt, Mycobacterium avium subsp. paratuberculosis
gggccaccgcgucgcugcc

SEQ ID NO: 2962194 - RNA, 13 nt, Mycobacterium avium subsp. paratuberculosis
gggccaccggcgc

SEQ ID NO: 2962195 - RNA, 13 nt, Mycobacterium avium subsp. paratuberculosis
gggccaccgggcc

SEQ ID NO: 2962196 - RNA, 15 nt, Mycobacterium avium subsp. paratuberculosis
gggccaccgggccga

SEQ ID NO: 2962197 - RNA, 10 nt, Mycobacterium avium subsp. paratuberculosis
gggccaccgu

SEQ ID NO: 2962198 - RNA, 19 nt, Mycobacterium avium subsp. paratuberculosis
gggccacgauccgcgcggc

SEQ ID NO: 2962199 - RNA, 20 nt, Mycobacterium avium subsp. paratuberculosis
gggccacgauccgcgcggcc

SEQ ID NO: 2962200 - RNA, 22 nt, Mycobacterium avium subsp. paratuberculosis
gggccacgcagucgucgaugaa

SEQ ID NO: 2962201 - RNA, 21 nt, Mycobacterium avium subsp. paratuberculosis
gggccacgccgacuagcgcgg

SEQ ID NO: 2962202 - RNA, 23 nt, Mycobacterium avium subsp. paratuberculosis
gggccacgccgacuagcgcggcg

SEQ ID NO: 2962203 - RNA, 14 nt, Mycobacterium avium subsp. paratuberculosis
gggccacggcgcga

SEQ ID NO: 2962204 - RNA, 20 nt, Mycobacterium avium subsp. paratuberculosis
gggccagacugcgcaccgcc

SEQ ID NO: 2962205 - RNA, 22 nt, Mycobacterium avium subsp. paratuberculosis
gggccagacugcgcaccgccag

SEQ ID NO: 2962206 - RNA, 20 nt, Mycobacterium avium subsp. paratuberculosis
gggccagaucgacccccacc

SEQ ID NO: 2962207 - RNA, 17 nt, Mycobacterium avium subsp. paratuberculosis
gggccagcaacaccagc

SEQ ID NO: 2962208 - RNA, 18 nt, Mycobacterium avium subsp. paratuberculosis
gggccagcaacaccagcu

SEQ ID NO: 2962209 - RNA, 15 nt, Mycobacterium avium subsp. paratuberculosis
gggccagcaacagca

SEQ ID NO: 2962210 - RNA, 23 nt, Mycobacterium avium subsp. paratuberculosis
gggccagcaacagcagcggcaug

SEQ ID NO: 2962211 - RNA, 13 nt, Mycobacterium avium subsp. paratuberculosis
gggccagcaccau

SEQ ID NO: 2962212 - RNA, 21 nt, Mycobacterium avium subsp. paratuberculosis
gggccagcacgaccccgccca

SEQ ID NO: 2962213 - RNA, 22 nt, Mycobacterium avium subsp. paratuberculosis
gggccagcacgaccccgcccac

SEQ ID NO: 2962214 - RNA, 23 nt, Mycobacterium avium subsp. paratuberculosis
gggccagcacgaccccgcccacg

SEQ ID NO: 2962215 - RNA, 18 nt, Mycobacterium avium subsp. paratuberculosis
gggccagcacgcccccgc

SEQ ID NO: 2962216 - RNA, 17 nt, Mycobacterium avium subsp. paratuberculosis
gggccagcagcagcagg

SEQ ID NO: 2962217 - RNA, 19 nt, Mycobacterium avium subsp. paratuberculosis
gggccagcagcagcagguc

SEQ ID NO: 2962218 - RNA, 14 nt, Mycobacterium avium subsp. paratuberculosis
gggccagcagccag

SEQ ID NO: 2962219 - RNA, 15 nt, Mycobacterium avium subsp. paratuberculosis
gggccagcagccagc

SEQ ID NO: 2962220 - RNA, 14 nt, Mycobacterium avium subsp. paratuberculosis
gggccagcagcccg

SEQ ID NO: 2962221 - RNA, 17 nt, Mycobacterium avium subsp. paratuberculosis
gggccagcagccgcgcg

SEQ ID NO: 2962222 - RNA, 15 nt, Mycobacterium avium subsp. paratuberculosis
gggccagcagccggg

SEQ ID NO: 2962223 - RNA, 18 nt, Mycobacterium avium subsp. paratuberculosis
gggccagcagcgucguca

SEQ ID NO: 2962224 - RNA, 16 nt, Mycobacterium avium subsp. paratuberculosis
gggccagcagucguga

SEQ ID NO: 2962225 - RNA, 22 nt, Mycobacterium avium subsp. paratuberculosis
gggccagcaguucguccacgcu

SEQ ID NO: 2962226 - RNA, 13 nt, Mycobacterium avium subsp. paratuberculosis
gggccagccaggu

SEQ ID NO: 2962227 - RNA, 14 nt, Mycobacterium avium subsp. paratuberculosis
gggccagccgaugc

SEQ ID NO: 2962228 - RNA, 17 nt, Mycobacterium avium subsp. paratuberculosis
gggccagccggcccucc

SEQ ID NO: 2962229 - RNA, 21 nt, Mycobacterium avium subsp. paratuberculosis
gggccagccggcccuccagga

SEQ ID NO: 2962230 - RNA, 14 nt, Mycobacterium avium subsp. paratuberculosis
gggccagccguugu

SEQ ID NO: 2962231 - RNA, 20 nt, Mycobacterium avium subsp. paratuberculosis
gggccagcgccaugccgccg

SEQ ID NO: 2962232 - RNA, 13 nt, Mycobacterium avium subsp. paratuberculosis
gggccagcgccga

SEQ ID NO: 2962233 - RNA, 17 nt, Mycobacterium avium subsp. paratuberculosis
gggccagcgccgagccg

SEQ ID NO: 2962234 - RNA, 17 nt, Mycobacterium avium subsp. paratuberculosis
gggccagcgccucggcg

SEQ ID NO: 2962235 - RNA, 18 nt, Mycobacterium avium subsp. paratuberculosis
gggccagcgccucggcgu

SEQ ID NO: 2962236 - RNA, 21 nt, Mycobacterium avium subsp. paratuberculosis
gggccagcgccuucggcgcca

SEQ ID NO: 2962237 - RNA, 22 nt, Mycobacterium avium subsp. paratuberculosis
gggccagcgccuucggcgccag

SEQ ID NO: 2962238 - RNA, 12 nt, Mycobacterium avium subsp. paratuberculosis
gggccagcgcgg

SEQ ID NO: 2962239 - RNA, 13 nt, Mycobacterium avium subsp. paratuberculosis
gggccagcgcggu

SEQ ID NO: 2962240 - RNA, 15 nt, Mycobacterium avium subsp. paratuberculosis
gggccagcgcgguga

SEQ ID NO: 2962241 - RNA, 18 nt, Mycobacterium avium subsp. paratuberculosis
gggccagcgcgguggcca

SEQ ID NO: 2962242 - RNA, 20 nt, Mycobacterium avium subsp. paratuberculosis
gggccagcgcgguggccagc

SEQ ID NO: 2962243 - RNA, 21 nt, Mycobacterium avium subsp. paratuberculosis
gggccagcgcgguggccagca

SEQ ID NO: 2962244 - RNA, 20 nt, Mycobacterium avium subsp. paratuberculosis
gggccagcggcaacugggcg

SEQ ID NO: 2962245 - RNA, 23 nt, Mycobacterium avium subsp. paratuberculosis
gggccagcggcaacugggcggcc

SEQ ID NO: 2962246 - RNA, 16 nt, Mycobacterium avium subsp. paratuberculosis
gggccagcggcgccgg

SEQ ID NO: 2962247 - RNA, 20 nt, Mycobacterium avium subsp. paratuberculosis
gggccagcguuuccagcgcc

SEQ ID NO: 2962248 - RNA, 18 nt, Mycobacterium avium subsp. paratuberculosis
gggccagcucgaaccugg

SEQ ID NO: 2962249 - RNA, 19 nt, Mycobacterium avium subsp. paratuberculosis
gggccagcucgaaccugga

SEQ ID NO: 2962250 - RNA, 21 nt, Mycobacterium avium subsp. paratuberculosis
gggccagcucgaaccuggagg

SEQ ID NO: 2962251 - RNA, 20 nt, Mycobacterium avium subsp. paratuberculosis
gggccagcucgucgagccgg

SEQ ID NO: 2962252 - RNA, 15 nt, Mycobacterium avium subsp. paratuberculosis
gggccaggaccggau

SEQ ID NO: 2962253 - RNA, 20 nt, Mycobacterium avium subsp. paratuberculosis
gggccaggaugaccgcccag

SEQ ID NO: 2962254 - RNA, 18 nt, Mycobacterium avium subsp. paratuberculosis
gggccaggaugccgaacg

SEQ ID NO: 2962255 - RNA, 14 nt, Mycobacterium avium subsp. paratuberculosis
gggccaggcacggc

SEQ ID NO: 2962256 - RNA, 14 nt, Mycobacterium avium subsp. paratuberculosis
gggccaggcccacc

SEQ ID NO: 2962257 - RNA, 14 nt, Mycobacterium avium subsp. paratuberculosis
gggccaggccguga

SEQ ID NO: 2962258 - RNA, 16 nt, Mycobacterium avium subsp. paratuberculosis
gggccaggccgugauc

SEQ ID NO: 2962259 - RNA, 15 nt, Mycobacterium avium subsp. paratuberculosis
gggccgaaggcggcg

SEQ ID NO: 2962260 - RNA, 16 nt, Mycobacterium avium subsp. paratuberculosis
gggccgaaggcggcgc

SEQ ID NO: 2962261 - RNA, 18 nt, Mycobacterium avium subsp. paratuberculosis
gggccgaaggcggcgccg

SEQ ID NO: 2962262 - RNA, 21 nt, Mycobacterium avium subsp. paratuberculosis
gggccgaaggcggcgccggcc

SEQ ID NO: 2962263 - RNA, 21 nt, Mycobacterium avium subsp. paratuberculosis
gggccgacagcacgccgggca

SEQ ID NO: 2962264 - RNA, 15 nt, Mycobacterium avium subsp. paratuberculosis
gggccgaccggccgg

SEQ ID NO: 2962265 - RNA, 15 nt, Mycobacterium avium subsp. paratuberculosis
gggccgaccgucagc

SEQ ID NO: 2962266 - RNA, 22 nt, Mycobacterium avium subsp. paratuberculosis
gggccgaccugcacgcugaagc

SEQ ID NO: 2962267 - RNA, 18 nt, Mycobacterium avium subsp. paratuberculosis
gggccgaccuggcggccg

SEQ ID NO: 2962268 - RNA, 20 nt, Mycobacterium avium subsp. paratuberculosis
gggccgaccuggcggccgga

SEQ ID NO: 2962269 - RNA, 20 nt, Mycobacterium avium subsp. paratuberculosis
gggccgagcgcgccgccgcc

SEQ ID NO: 2962270 - RNA, 21 nt, Mycobacterium avium subsp. paratuberculosis
gggccgagcguucggcgcgga

SEQ ID NO: 2962271 - RNA, 12 nt, Mycobacterium avium subsp. paratuberculosis
gggccgaggaag

SEQ ID NO: 2962272 - RNA, 20 nt, Mycobacterium avium subsp. paratuberculosis
gggccgaucagugccgcgcc

SEQ ID NO: 2962273 - RNA, 17 nt, Mycobacterium avium subsp. paratuberculosis
gggccgaugaccgcggc

SEQ ID NO: 2962274 - RNA, 21 nt, Mycobacterium avium subsp. paratuberculosis
gggccgaugaccgcggcgggc

SEQ ID NO: 2962275 - RNA, 22 nt, Mycobacterium avium subsp. paratuberculosis
gggccgaugaccgcggcgggca

SEQ ID NO: 2962276 - RNA, 22 nt, Mycobacterium avium subsp. paratuberculosis
gggccgcaauacggugcccgcc

SEQ ID NO: 2962277 - RNA, 21 nt, Mycobacterium avium subsp. paratuberculosis
gggccgcaccugaucgaugcc

SEQ ID NO: 2962278 - RNA, 22 nt, Mycobacterium avium subsp. paratuberculosis
gggccgcaccugaucgaugccg

SEQ ID NO: 2962279 - RNA, 12 nt, Mycobacterium avium subsp. paratuberculosis
gggccgcagccg

SEQ ID NO: 2962280 - RNA, 17 nt, Mycobacterium avium subsp. paratuberculosis
gggccgcagccgcgcgg

SEQ ID NO: 2962281 - RNA, 22 nt, Mycobacterium avium subsp. paratuberculosis
gggccgcagccgcgcggccggc

SEQ ID NO: 2962282 - RNA, 14 nt, Mycobacterium avium subsp. paratuberculosis
gggccgcagcgcgg

SEQ ID NO: 2962283 - RNA, 19 nt, Mycobacterium avium subsp. paratuberculosis
gggccgcagcucgcccagc

SEQ ID NO: 2962284 - RNA, 17 nt, Mycobacterium avium subsp. paratuberculosis
gggccgcauccagcgcc

SEQ ID NO: 2962285 - RNA, 19 nt, Mycobacterium avium subsp. paratuberculosis
gggccgcauccgcgagccg

SEQ ID NO: 2962286 - RNA, 22 nt, Mycobacterium avium subsp. paratuberculosis
gggccgcauccgcgagccgagc

SEQ ID NO: 2962287 - RNA, 12 nt, Mycobacterium avium subsp. paratuberculosis
gggccgccaacg

SEQ ID NO: 2962288 - RNA, 14 nt, Mycobacterium avium subsp. paratuberculosis
gggccgccacggcg

SEQ ID NO: 2962289 - RNA, 17 nt, Mycobacterium avium subsp. paratuberculosis
gggccgccacggcgcca

SEQ ID NO: 2962290 - RNA, 12 nt, Mycobacterium avium subsp. paratuberculosis
gggccgccagcc

SEQ ID NO: 2962291 - RNA, 13 nt, Mycobacterium avium subsp. paratuberculosis
gggccgccagccg

SEQ ID NO: 2962292 - RNA, 17 nt, Mycobacterium avium subsp. paratuberculosis
gggccgccagccgguac

SEQ ID NO: 2962293 - RNA, 20 nt, Mycobacterium avium subsp. paratuberculosis
gggccgccagguuggcggcg

SEQ ID NO: 2962294 - RNA, 22 nt, Mycobacterium avium subsp. paratuberculosis
gggccgccagguuggcggcggc

SEQ ID NO: 2962295 - RNA, 13 nt, Mycobacterium avium subsp. paratuberculosis
gggccgcccgcgc

SEQ ID NO: 2962296 - RNA, 20 nt, Mycobacterium avium subsp. paratuberculosis
gggccgcccgcgcguggucc

SEQ ID NO: 2962297 - RNA, 13 nt, Mycobacterium avium subsp. paratuberculosis
gggccgcccgcug

SEQ ID NO: 2962298 - RNA, 18 nt, Mycobacterium avium subsp. paratuberculosis
gggccgccgaugcgcccg

SEQ ID NO: 2962299 - RNA, 19 nt, Mycobacterium avium subsp. paratuberculosis
gggccgccgaugcgcccgc

SEQ ID NO: 2962300 - RNA, 14 nt, Mycobacterium avium subsp. paratuberculosis
gggccgccgcgaua

SEQ ID NO: 2962301 - RNA, 12 nt, Mycobacterium avium subsp. paratuberculosis
gggccgccgcgg

SEQ ID NO: 2962302 - RNA, 16 nt, Mycobacterium avium subsp. paratuberculosis
gggccgccgcggccac

SEQ ID NO: 2962303 - RNA, 17 nt, Mycobacterium avium subsp. paratuberculosis
gggccgccgcggccaca

SEQ ID NO: 2962304 - RNA, 15 nt, Mycobacterium avium subsp. paratuberculosis
gggccgccgcggcgg

SEQ ID NO: 2962305 - RNA, 17 nt, Mycobacterium avium subsp. paratuberculosis
gggccgccgcggcggca

SEQ ID NO: 2962306 - RNA, 16 nt, Mycobacterium avium subsp. paratuberculosis
gggccgccggccgcgg

SEQ ID NO: 2962307 - RNA, 15 nt, Mycobacterium avium subsp. paratuberculosis
gggccgccggccgcu

SEQ ID NO: 2962308 - RNA, 15 nt, Mycobacterium avium subsp. paratuberculosis
gggccgccggguggc

SEQ ID NO: 2962309 - RNA, 20 nt, Mycobacterium avium subsp. paratuberculosis
gggccgccggguggcggggc

SEQ ID NO: 2962310 - RNA, 18 nt, Mycobacterium avium subsp. paratuberculosis
gggccgccgucgccacca

SEQ ID NO: 2962311 - RNA, 15 nt, Mycobacterium avium subsp. paratuberculosis
gggccgccucacgca

SEQ ID NO: 2962312 - RNA, 13 nt, Mycobacterium avium subsp. paratuberculosis
gggccgcgagcgc

SEQ ID NO: 2962313 - RNA, 21 nt, Mycobacterium avium subsp. paratuberculosis
gggccgcgaugaggcucaggc

SEQ ID NO: 2962314 - RNA, 14 nt, Mycobacterium avium subsp. paratuberculosis
gggccgcgcccagu

SEQ ID NO: 2962315 - RNA, 12 nt, Mycobacterium avium subsp. paratuberculosis
gggccgcgcggg

SEQ ID NO: 2962316 - RNA, 12 nt, Mycobacterium avium subsp. paratuberculosis
gggccgcggcca

SEQ ID NO: 2962317 - RNA, 14 nt, Mycobacterium avium subsp. paratuberculosis
gggccgcggccagc

SEQ ID NO: 2962318 - RNA, 14 nt, Mycobacterium avium subsp. paratuberculosis
gggccgcggccgcc

SEQ ID NO: 2962319 - RNA, 15 nt, Mycobacterium avium subsp. paratuberculosis
gggccgcggccggca

SEQ ID NO: 2962320 - RNA, 15 nt, Mycobacterium avium subsp. paratuberculosis
gggccgcggcgccgu

SEQ ID NO: 2962321 - RNA, 15 nt, Mycobacterium avium subsp. paratuberculosis
gggccgcggcgucgg

SEQ ID NO: 2962322 - RNA, 19 nt, Mycobacterium avium subsp. paratuberculosis
gggccgcggcgucgggaug

SEQ ID NO: 2962323 - RNA, 14 nt, Mycobacterium avium subsp. paratuberculosis
gggccgcgggccca

SEQ ID NO: 2962324 - RNA, 18 nt, Mycobacterium avium subsp. paratuberculosis
gggccgcgucggccaacg

SEQ ID NO: 2962325 - RNA, 14 nt, Mycobacterium avium subsp. paratuberculosis
gggccgcuacgccg

SEQ ID NO: 2962326 - RNA, 19 nt, Mycobacterium avium subsp. paratuberculosis
gggccgcuggccgccccga

SEQ ID NO: 2962327 - RNA, 13 nt, Mycobacterium avium subsp. paratuberculosis
gggccggacagcg

SEQ ID NO: 2962328 - RNA, 18 nt, Mycobacterium avium subsp. paratuberculosis
gggccggacggugacgcc

SEQ ID NO: 2962329 - RNA, 22 nt, Mycobacterium avium subsp. paratuberculosis
gggccggaggugcgggucucga

SEQ ID NO: 2962330 - RNA, 17 nt, Mycobacterium avium subsp. paratuberculosis
gggccggaucgcgcagu

SEQ ID NO: 2962331 - RNA, 12 nt, Mycobacterium avium subsp. paratuberculosis
gggccggcagcc

SEQ ID NO: 2962332 - RNA, 12 nt, Mycobacterium avium subsp. paratuberculosis
gggccggccaga

SEQ ID NO: 2962333 - RNA, 12 nt, Mycobacterium avium subsp. paratuberculosis
gggccggccgcc

SEQ ID NO: 2962334 - RNA, 13 nt, Mycobacterium avium subsp. paratuberculosis
gggccggccgccc

SEQ ID NO: 2962335 - RNA, 15 nt, Mycobacterium avium subsp. paratuberculosis
gggccggccgcccgc

SEQ ID NO: 2962336 - RNA, 12 nt, Mycobacterium avium subsp. paratuberculosis
gggccggccgga

SEQ ID NO: 2962337 - RNA, 16 nt, Mycobacterium avium subsp. paratuberculosis
gggccggccggacagg

SEQ ID NO: 2962338 - RNA, 12 nt, Mycobacterium avium subsp. paratuberculosis
gggccggcgaag

SEQ ID NO: 2962339 - RNA, 20 nt, Mycobacterium avium subsp. paratuberculosis
gggccggcgaaggacagccg

SEQ ID NO: 2962340 - RNA, 19 nt, Mycobacterium avium subsp. paratuberculosis
gggccggcgaugcccguga

SEQ ID NO: 2962341 - RNA, 16 nt, Mycobacterium avium subsp. paratuberculosis
gggccggcgccgaagc

SEQ ID NO: 2962342 - RNA, 15 nt, Mycobacterium avium subsp. paratuberculosis
gggccggcgccgacg

SEQ ID NO: 2962343 - RNA, 17 nt, Mycobacterium avium subsp. paratuberculosis
gggccggcgccgacgac

SEQ ID NO: 2962344 - RNA, 20 nt, Mycobacterium avium subsp. paratuberculosis
gggcgaaguagccggcgauc

SEQ ID NO: 2962345 - RNA, 19 nt, Mycobacterium avium subsp. paratuberculosis
gggcgaagucgccggccag

SEQ ID NO: 2962346 - RNA, 18 nt, Mycobacterium avium subsp. paratuberculosis
gggcgacaugcccgcggu

SEQ ID NO: 2962347 - RNA, 19 nt, Mycobacterium avium subsp. paratuberculosis
gggcgaccaccacggccgc

SEQ ID NO: 2962348 - RNA, 20 nt, Mycobacterium avium subsp. paratuberculosis
gggcgaccaccacggccgca

SEQ ID NO: 2962349 - RNA, 21 nt, Mycobacterium avium subsp. paratuberculosis
gggcgaccaccacggccgcag

SEQ ID NO: 2962350 - RNA, 13 nt, Mycobacterium avium subsp. paratuberculosis
gggcgaccacguc

SEQ ID NO: 2962351 - RNA, 20 nt, Mycobacterium avium subsp. paratuberculosis
gggcgaccagauaggccagc

SEQ ID NO: 2962352 - RNA, 16 nt, Mycobacterium avium subsp. paratuberculosis
gggcgaccaugccgcg

SEQ ID NO: 2962353 - RNA, 16 nt, Mycobacterium avium subsp. paratuberculosis
gggcgaccccggccag

SEQ ID NO: 2962354 - RNA, 19 nt, Mycobacterium avium subsp. paratuberculosis
gggcgaccccggccaggau

SEQ ID NO: 2962355 - RNA, 20 nt, Mycobacterium avium subsp. paratuberculosis
gggcgaccccggccaggauc

SEQ ID NO: 2962356 - RNA, 13 nt, Mycobacterium avium subsp. paratuberculosis
gggcgaccgccgc

SEQ ID NO: 2962357 - RNA, 18 nt, Mycobacterium avium subsp. paratuberculosis
gggcgaccuggacgccgc

SEQ ID NO: 2962358 - RNA, 12 nt, Mycobacterium avium subsp. paratuberculosis
gggcgaccuggu

SEQ ID NO: 2962359 - RNA, 17 nt, Mycobacterium avium subsp. paratuberculosis
gggcgaccuggugcucg

SEQ ID NO: 2962360 - RNA, 18 nt, Mycobacterium avium subsp. paratuberculosis
gggcgaccuggugcucga

SEQ ID NO: 2962361 - RNA, 17 nt, Mycobacterium avium subsp. paratuberculosis
gggcgaccuugcgcagc

SEQ ID NO: 2962362 - RNA, 22 nt, Mycobacterium avium subsp. paratuberculosis
gggcgaccuugcgcagccggca

SEQ ID NO: 2962363 - RNA, 19 nt, Mycobacterium avium subsp. paratuberculosis
gggcgacgaugccggccgg

SEQ ID NO: 2962364 - RNA, 21 nt, Mycobacterium avium subsp. paratuberculosis
gggcgacgaugccggccggga

SEQ ID NO: 2962365 - RNA, 12 nt, Mycobacterium avium subsp. paratuberculosis
gggcgacgccgc

SEQ ID NO: 2962366 - RNA, 18 nt, Mycobacterium avium subsp. paratuberculosis
gggcgacgccgcggaagc

SEQ ID NO: 2962367 - RNA, 22 nt, Mycobacterium avium subsp. paratuberculosis
gggcgacggcggcgacgugauc

SEQ ID NO: 2962368 - RNA, 18 nt, Mycobacterium avium subsp. paratuberculosis
gggcgacgggccgaucac

SEQ ID NO: 2962369 - RNA, 19 nt, Mycobacterium avium subsp. paratuberculosis
gggcgacgucgucgcccac

SEQ ID NO: 2962370 - RNA, 14 nt, Mycobacterium avium subsp. paratuberculosis
gggcgacuccggcg

SEQ ID NO: 2962371 - RNA, 17 nt, Mycobacterium avium subsp. paratuberculosis
gggcgacuccggcgccg

SEQ ID NO: 2962372 - RNA, 19 nt, Mycobacterium avium subsp. paratuberculosis
gggcgacuccggcgccggu

SEQ ID NO: 2962373 - RNA, 18 nt, Mycobacterium avium subsp. paratuberculosis
gggcgacuucuucgccgg

SEQ ID NO: 2962374 - RNA, 20 nt, Mycobacterium avium subsp. paratuberculosis
gggcgagaccgucggugcgg

SEQ ID NO: 2962375 - RNA, 16 nt, Mycobacterium avium subsp. paratuberculosis
gggcgagcgucgccgc

SEQ ID NO: 2962376 - RNA, 16 nt, Mycobacterium avium subsp. paratuberculosis
gggcgagcuggccgcc

SEQ ID NO: 2962377 - RNA, 21 nt, Mycobacterium avium subsp. paratuberculosis
gggcgaggaacccgaccgcga

SEQ ID NO: 2962378 - RNA, 22 nt, Mycobacterium avium subsp. paratuberculosis
gggcgaggacggcuugggugug

SEQ ID NO: 2962379 - RNA, 14 nt, Mycobacterium avium subsp. paratuberculosis
gggcgagggcaacg

SEQ ID NO: 2962380 - RNA, 16 nt, Mycobacterium avium subsp. paratuberculosis
gggcgaguacaccucg

SEQ ID NO: 2962381 - RNA, 19 nt, Mycobacterium avium subsp. paratuberculosis
gggcgauaaccucggcggc

SEQ ID NO: 2962382 - RNA, 20 nt, Mycobacterium avium subsp. paratuberculosis
gggcgauaaccucggcggcg

SEQ ID NO: 2962383 - RNA, 14 nt, Mycobacterium avium subsp. paratuberculosis
gggcgaucaccgcg

SEQ ID NO: 2962384 - RNA, 16 nt, Mycobacterium avium subsp. paratuberculosis
gggcgaucaccgcggc

SEQ ID NO: 2962385 - RNA, 18 nt, Mycobacterium avium subsp. paratuberculosis
gggcgaucaccgcggcca

SEQ ID NO: 2962386 - RNA, 19 nt, Mycobacterium avium subsp. paratuberculosis
gggcgaucaccgcggccac

SEQ ID NO: 2962387 - RNA, 20 nt, Mycobacterium avium subsp. paratuberculosis
gggcgaucaccgcggccacc

SEQ ID NO: 2962388 - RNA, 19 nt, Mycobacterium avium subsp. paratuberculosis
gggcgaucagcccgcccac

SEQ ID NO: 2962389 - RNA, 21 nt, Mycobacterium avium subsp. paratuberculosis
gggcgaucagcccgcccacca

SEQ ID NO: 2962390 - RNA, 15 nt, Mycobacterium avium subsp. paratuberculosis
gggcgaucauccagg

SEQ ID NO: 2962391 - RNA, 18 nt, Mycobacterium avium subsp. paratuberculosis
gggcgauccugugcaccg

SEQ ID NO: 2962392 - RNA, 21 nt, Mycobacterium avium subsp. paratuberculosis
gggcgaucgacaccagcgugu

SEQ ID NO: 2962393 - RNA, 17 nt, Mycobacterium avium subsp. paratuberculosis
gggcgaucuccagcggc

SEQ ID NO: 2962394 - RNA, 20 nt, Mycobacterium avium subsp. paratuberculosis
gggcgaucuccagcggccgg

SEQ ID NO: 2962395 - RNA, 13 nt, Mycobacterium avium subsp. paratuberculosis
gggcgaucucgau

SEQ ID NO: 2962396 - RNA, 21 nt, Mycobacterium avium subsp. paratuberculosis
gggcgaucucgauggccacgc

SEQ ID NO: 2962397 - RNA, 19 nt, Mycobacterium avium subsp. paratuberculosis
gggcgaucucuucgaugcc

SEQ ID NO: 2962398 - RNA, 19 nt, Mycobacterium avium subsp. paratuberculosis
gggcgaugccgacacccca

SEQ ID NO: 2962399 - RNA, 16 nt, Mycobacterium avium subsp. paratuberculosis
gggcgaugcggcccgg

SEQ ID NO: 2962400 - RNA, 23 nt, Mycobacterium avium subsp. paratuberculosis
gggcgauggccauggccaggaac

SEQ ID NO: 2962401 - RNA, 17 nt, Mycobacterium avium subsp. paratuberculosis
gggcgauggugccgccg

SEQ ID NO: 2962402 - RNA, 18 nt, Mycobacterium avium subsp. paratuberculosis
gggcgauggugccgccgg

SEQ ID NO: 2962403 - RNA, 20 nt, Mycobacterium avium subsp. paratuberculosis
gggcgauucccggaugcugc

SEQ ID NO: 2962404 - RNA, 17 nt, Mycobacterium avium subsp. paratuberculosis
gggcgcaccgcgcgcca

SEQ ID NO: 2962405 - RNA, 19 nt, Mycobacterium avium subsp. paratuberculosis
gggcgcacgaucgggcgca

SEQ ID NO: 2962406 - RNA, 15 nt, Mycobacterium avium subsp. paratuberculosis
gggcgcagcccggcg

SEQ ID NO: 2962407 - RNA, 16 nt, Mycobacterium avium subsp. paratuberculosis
gggcgcagcccggcgg

SEQ ID NO: 2962408 - RNA, 15 nt, Mycobacterium avium subsp. paratuberculosis
gggcgcagccgaucg

SEQ ID NO: 2962409 - RNA, 14 nt, Mycobacterium avium subsp. paratuberculosis
gggcgcagcgccgu

SEQ ID NO: 2962410 - RNA, 17 nt, Mycobacterium avium subsp. paratuberculosis
gggcgcaggugggcggu

SEQ ID NO: 2962411 - RNA, 17 nt, Mycobacterium avium subsp. paratuberculosis
gggcgcauaccagcgcu

SEQ ID NO: 2962412 - RNA, 22 nt, Mycobacterium avium subsp. paratuberculosis
gggcgccacuucuccacgccga

SEQ ID NO: 2962413 - RNA, 13 nt, Mycobacterium avium subsp. paratuberculosis
gggcgccagcagc

SEQ ID NO: 2962414 - RNA, 14 nt, Mycobacterium avium subsp. paratuberculosis
gggcgccagcccgc

SEQ ID NO: 2962415 - RNA, 17 nt, Mycobacterium avium subsp. paratuberculosis
gggcgccagcccgccca

SEQ ID NO: 2962416 - RNA, 19 nt, Mycobacterium avium subsp. paratuberculosis
gggcgccagcccgcccagc

SEQ ID NO: 2962417 - RNA, 23 nt, Mycobacterium avium subsp. paratuberculosis
gggcgccagcccgcccagcgcca

SEQ ID NO: 2962418 - RNA, 19 nt, Mycobacterium avium subsp. paratuberculosis
gggcgccauccgcagcccg

SEQ ID NO: 2962419 - RNA, 17 nt, Mycobacterium avium subsp. paratuberculosis
gggcgcccacccguugg

SEQ ID NO: 2962420 - RNA, 21 nt, Mycobacterium avium subsp. paratuberculosis
gggcgcccagcaaacccagca

SEQ ID NO: 2962421 - RNA, 22 nt, Mycobacterium avium subsp. paratuberculosis
gggcgccccgacaucgccauca

SEQ ID NO: 2962422 - RNA, 13 nt, Mycobacterium avium subsp. paratuberculosis
gggcgccccgcug

SEQ ID NO: 2962423 - RNA, 16 nt, Mycobacterium avium subsp. paratuberculosis
gggcgcccgcggcgcg

SEQ ID NO: 2962424 - RNA, 17 nt, Mycobacterium avium subsp. paratuberculosis
gggcgcccgcggcgcgc

SEQ ID NO: 2962425 - RNA, 23 nt, Mycobacterium avium subsp. paratuberculosis
gggcgccgacgaucccggcgagc

SEQ ID NO: 2962426 - RNA, 15 nt, Mycobacterium avium subsp. paratuberculosis
gggcgccgccgaaca

SEQ ID NO: 2962427 - RNA, 16 nt, Mycobacterium avium subsp. paratuberculosis
gggcgccgcggcgccg

SEQ ID NO: 2962428 - RNA, 22 nt, Mycobacterium avium subsp. paratuberculosis
gggcggcaucgcgcgcggcggc

SEQ ID NO: 2962429 - RNA, 23 nt, Mycobacterium avium subsp. paratuberculosis
gggcggcaucgcgcgcggcggcc

SEQ ID NO: 2962430 - RNA, 18 nt, Mycobacterium avium subsp. paratuberculosis
gggcggccccgggcgcug

SEQ ID NO: 2962431 - RNA, 19 nt, Mycobacterium avium subsp. paratuberculosis
gggcggcccgcacggccgc

SEQ ID NO: 2962432 - RNA, 20 nt, Mycobacterium avium subsp. paratuberculosis
gggcggcccggguggacgcc

SEQ ID NO: 2962433 - RNA, 13 nt, Mycobacterium avium subsp. paratuberculosis
gggcggccgaucc

SEQ ID NO: 2962434 - RNA, 13 nt, Mycobacterium avium subsp. paratuberculosis
gggcggccgccgg

SEQ ID NO: 2962435 - RNA, 13 nt, Mycobacterium avium subsp. paratuberculosis
gggcggccgcgga

SEQ ID NO: 2962436 - RNA, 12 nt, Mycobacterium avium subsp. paratuberculosis
gggcggccggcu

SEQ ID NO: 2962437 - RNA, 19 nt, Mycobacterium avium subsp. paratuberculosis
gggcggccgggccgcggcg

SEQ ID NO: 2962438 - RNA, 23 nt, Mycobacterium avium subsp. paratuberculosis
gggcggccucggcguccgcggcg

SEQ ID NO: 2962439 - RNA, 19 nt, Mycobacterium avium subsp. paratuberculosis
gggcggccugccggccgcc

SEQ ID NO: 2962440 - RNA, 17 nt, Mycobacterium avium subsp. paratuberculosis
gggcggcgacaucgccg

SEQ ID NO: 2962441 - RNA, 21 nt, Mycobacterium avium subsp. paratuberculosis
gggcggcgacaucgccgagac

SEQ ID NO: 2962442 - RNA, 23 nt, Mycobacterium avium subsp. paratuberculosis
gggcggcgaccuguuuggccagc

SEQ ID NO: 2962443 - RNA, 14 nt, Mycobacterium avium subsp. paratuberculosis
gggcggcgacgucg

SEQ ID NO: 2962444 - RNA, 13 nt, Mycobacterium avium subsp. paratuberculosis
gggcggcgaugcg

SEQ ID NO: 2962445 - RNA, 13 nt, Mycobacterium avium subsp. paratuberculosis
gggcggcgcaguc

SEQ ID NO: 2962446 - RNA, 20 nt, Mycobacterium avium subsp. paratuberculosis
gggcggcgcagucggccgga

SEQ ID NO: 2962447 - RNA, 14 nt, Mycobacterium avium subsp. paratuberculosis
gggcggcgccgcgg

SEQ ID NO: 2962448 - RNA, 12 nt, Mycobacterium avium subsp. paratuberculosis
gggcggcgccgg

SEQ ID NO: 2962449 - RNA, 17 nt, Mycobacterium avium subsp. paratuberculosis
gggcggcgccggcacug

SEQ ID NO: 2962450 - RNA, 12 nt, Mycobacterium avium subsp. paratuberculosis
gggcggcgcgcg

SEQ ID NO: 2962451 - RNA, 17 nt, Mycobacterium avium subsp. paratuberculosis
gggcggcgcgcgccagc

SEQ ID NO: 2962452 - RNA, 12 nt, Mycobacterium avium subsp. paratuberculosis
gggcggcgcgcu

SEQ ID NO: 2962453 - RNA, 13 nt, Mycobacterium avium subsp. paratuberculosis
gggcggcgcggcg

SEQ ID NO: 2962454 - RNA, 15 nt, Mycobacterium avium subsp. paratuberculosis
gggcggcgcggcggu

SEQ ID NO: 2962455 - RNA, 14 nt, Mycobacterium avium subsp. paratuberculosis
gggcggcggccacc

SEQ ID NO: 2962456 - RNA, 22 nt, Mycobacterium avium subsp. paratuberculosis
gggcggcggccaccucgccgca

SEQ ID NO: 2962457 - RNA, 14 nt, Mycobacterium avium subsp. paratuberculosis
gggcggcggccucc

SEQ ID NO: 2962458 - RNA, 19 nt, Mycobacterium avium subsp. paratuberculosis
gggcggcggccuccggaug

SEQ ID NO: 2962459 - RNA, 13 nt, Mycobacterium avium subsp. paratuberculosis
gggcggcggcgcc

SEQ ID NO: 2962460 - RNA, 12 nt, Mycobacterium avium subsp. paratuberculosis
gggcggcggcgg

SEQ ID NO: 2962461 - RNA, 13 nt, Mycobacterium avium subsp. paratuberculosis
gggcggcggcggg

SEQ ID NO: 2962462 - RNA, 16 nt, Mycobacterium avium subsp. paratuberculosis
gggcggcggcgggaag

SEQ ID NO: 2962463 - RNA, 13 nt, Mycobacterium avium subsp. paratuberculosis
gggcggcggcugg

SEQ ID NO: 2962464 - RNA, 22 nt, Mycobacterium avium subsp. paratuberculosis
gggcggcggcugggccgcggcg

SEQ ID NO: 2962465 - RNA, 22 nt, Mycobacterium avium subsp. paratuberculosis
gggcgggaaucacgccccaggc

SEQ ID NO: 2962466 - RNA, 16 nt, Mycobacterium avium subsp. paratuberculosis
gggcgggaucgcggcg

SEQ ID NO: 2962467 - RNA, 19 nt, Mycobacterium avium subsp. paratuberculosis
gggcgggcaccucgaugcc

SEQ ID NO: 2962468 - RNA, 13 nt, Mycobacterium avium subsp. paratuberculosis
gggcgggcagccg

SEQ ID NO: 2962469 - RNA, 15 nt, Mycobacterium avium subsp. paratuberculosis
gggcgggcagccgcu

SEQ ID NO: 2962470 - RNA, 15 nt, Mycobacterium avium subsp. paratuberculosis
gggcgggcaggcccg

SEQ ID NO: 2962471 - RNA, 17 nt, Mycobacterium avium subsp. paratuberculosis
gggcgggccagcucgaa

SEQ ID NO: 2962472 - RNA, 21 nt, Mycobacterium avium subsp. paratuberculosis
gggcgggccccacgccaguca

SEQ ID NO: 2962473 - RNA, 14 nt, Mycobacterium avium subsp. paratuberculosis
gggcgggccgccag

SEQ ID NO: 2962474 - RNA, 16 nt, Mycobacterium avium subsp. paratuberculosis
gggcgggguggccacc

SEQ ID NO: 2962475 - RNA, 15 nt, Mycobacterium avium subsp. paratuberculosis
gggcgguccgcucca

SEQ ID NO: 2962476 - RNA, 18 nt, Mycobacterium avium subsp. paratuberculosis
gggcgguccgcuccacca

SEQ ID NO: 2962477 - RNA, 22 nt, Mycobacterium avium subsp. paratuberculosis
gggcggucgcgucgucggcggg

SEQ ID NO: 2962478 - RNA, 20 nt, Mycobacterium avium subsp. paratuberculosis
gggcggugcggugcgccgca

SEQ ID NO: 2962479 - RNA, 15 nt, Mycobacterium avium subsp. paratuberculosis
gggcgguggcgccgg

SEQ ID NO: 2962480 - RNA, 14 nt, Mycobacterium avium subsp. paratuberculosis
gggcgguggcggcg

SEQ ID NO: 2962481 - RNA, 15 nt, Mycobacterium avium subsp. paratuberculosis
gggcgguggcggcga

SEQ ID NO: 2962482 - RNA, 18 nt, Mycobacterium avium subsp. paratuberculosis
gggcgguggcggcgaacg

SEQ ID NO: 2962483 - RNA, 15 nt, Mycobacterium avium subsp. paratuberculosis
gggcguacagcggcg

SEQ ID NO: 2962484 - RNA, 18 nt, Mycobacterium avium subsp. paratuberculosis
gggcguacagcggcgcca

SEQ ID NO: 2962485 - RNA, 21 nt, Mycobacterium avium subsp. paratuberculosis
gggcguacagcggcgccaggu

SEQ ID NO: 2962486 - RNA, 17 nt, Mycobacterium avium subsp. paratuberculosis
gggcguacugcucggcg

SEQ ID NO: 2962487 - RNA, 21 nt, Mycobacterium avium subsp. paratuberculosis
gggcguagucgauggccucgu

SEQ ID NO: 2962488 - RNA, 23 nt, Mycobacterium avium subsp. paratuberculosis
gggcguagucgauggccucgucg

SEQ ID NO: 2962489 - RNA, 12 nt, Mycobacterium avium subsp. paratuberculosis
gggcgucacgag

SEQ ID NO: 2962490 - RNA, 19 nt, Mycobacterium avium subsp. paratuberculosis
gggcgucacgcaucagggc

SEQ ID NO: 2962491 - RNA, 23 nt, Mycobacterium avium subsp. paratuberculosis
gggcgucacgcaucagggccagc

SEQ ID NO: 2962492 - RNA, 12 nt, Mycobacterium avium subsp. paratuberculosis
gggcgucacgcc

SEQ ID NO: 2962493 - RNA, 15 nt, Mycobacterium avium subsp. paratuberculosis
gggcgucacgccagc

SEQ ID NO: 2962494 - RNA, 13 nt, Mycobacterium avium subsp. paratuberculosis
gggcgucacucug

SEQ ID NO: 2962495 - RNA, 13 nt, Mycobacterium avium subsp. paratuberculosis
gggcgucaggcgc

SEQ ID NO: 2962496 - RNA, 16 nt, Mycobacterium avium subsp. paratuberculosis
gggcguccagcgaggg

SEQ ID NO: 2962497 - RNA, 13 nt, Mycobacterium avium subsp. paratuberculosis
gggcguccgagaa

SEQ ID NO: 2962498 - RNA, 17 nt, Mycobacterium avium subsp. paratuberculosis
gggcguccuugaccagc

SEQ ID NO: 2962499 - RNA, 18 nt, Mycobacterium avium subsp. paratuberculosis
gggcguccuugaccagcu

SEQ ID NO: 2962500 - RNA, 11 nt, Mycobacterium avium subsp. paratuberculosis
gggcgucgacg

SEQ ID NO: 2962501 - RNA, 12 nt, Mycobacterium avium subsp. paratuberculosis
gggcgucgacga

SEQ ID NO: 2962502 - RNA, 15 nt, Mycobacterium avium subsp. paratuberculosis
gggcgucgacgaugg

SEQ ID NO: 2962503 - RNA, 18 nt, Mycobacterium avium subsp. paratuberculosis
gggcgucgcccgccgacg

SEQ ID NO: 2962504 - RNA, 12 nt, Mycobacterium avium subsp. paratuberculosis
gggcgucgccgc

SEQ ID NO: 2962505 - RNA, 16 nt, Mycobacterium avium subsp. paratuberculosis
gggcgucgccgccccc

SEQ ID NO: 2962506 - RNA, 13 nt, Mycobacterium avium subsp. paratuberculosis
gggcgucggcggc

SEQ ID NO: 2962507 - RNA, 15 nt, Mycobacterium avium subsp. paratuberculosis
gggcgucggcggccu

SEQ ID NO: 2962508 - RNA, 16 nt, Mycobacterium avium subsp. paratuberculosis
gggcgucgucggccgg

SEQ ID NO: 2962509 - RNA, 19 nt, Mycobacterium avium subsp. paratuberculosis
gggcgucguggucgacgcc

SEQ ID NO: 2962510 - RNA, 14 nt, Mycobacterium avium subsp. paratuberculosis
gggcgucucgaacc

SEQ ID NO: 2962511 - RNA, 19 nt, Mycobacterium avium subsp. paratuberculosis
gggcgucucgaugagcgag

SEQ ID NO: 2962512 - RNA, 14 nt, Mycobacterium avium subsp. paratuberculosis
gggcgugacagggu

SEQ ID NO: 2962513 - RNA, 15 nt, Mycobacterium avium subsp. paratuberculosis
gggcgugacgccgcu

SEQ ID NO: 2962514 - RNA, 16 nt, Mycobacterium avium subsp. paratuberculosis
gggcugcagggccggg

SEQ ID NO: 2962515 - RNA, 17 nt, Mycobacterium avium subsp. paratuberculosis
gggcugcccaccaccag

SEQ ID NO: 2962516 - RNA, 17 nt, Mycobacterium avium subsp. paratuberculosis
gggcugcgcgucgagca

SEQ ID NO: 2962517 - RNA, 17 nt, Mycobacterium avium subsp. paratuberculosis
gggcugcgcuugcggcg

SEQ ID NO: 2962518 - RNA, 18 nt, Mycobacterium avium subsp. paratuberculosis
gggcugcgcuugcggcgc

SEQ ID NO: 2962519 - RNA, 21 nt, Mycobacterium avium subsp. paratuberculosis
gggcugcgcuugcggcgcagc

SEQ ID NO: 2962520 - RNA, 22 nt, Mycobacterium avium subsp. paratuberculosis
gggcugcggcgagucccggcgc

SEQ ID NO: 2962521 - RNA, 16 nt, Mycobacterium avium subsp. paratuberculosis
gggcugcgggccaggc

SEQ ID NO: 2962522 - RNA, 20 nt, Mycobacterium avium subsp. paratuberculosis
gggcuggccgcacggugcag

SEQ ID NO: 2962523 - RNA, 14 nt, Mycobacterium avium subsp. paratuberculosis
gggcuggccguccg

SEQ ID NO: 2962524 - RNA, 13 nt, Mycobacterium avium subsp. paratuberculosis
gggcuggccgucg

SEQ ID NO: 2962525 - RNA, 15 nt, Mycobacterium avium subsp. paratuberculosis
gggcuggccgucggc

SEQ ID NO: 2962526 - RNA, 14 nt, Mycobacterium avium subsp. paratuberculosis
gggcugggcggggu

SEQ ID NO: 2962527 - RNA, 17 nt, Mycobacterium avium subsp. paratuberculosis
gggcugggucaccacgg

SEQ ID NO: 2962528 - RNA, 18 nt, Mycobacterium avium subsp. paratuberculosis
gggcuggugcgcagccgu

SEQ ID NO: 2962529 - RNA, 20 nt, Mycobacterium avium subsp. paratuberculosis
gggcugucccggccgcgaca

SEQ ID NO: 2962530 - RNA, 20 nt, Mycobacterium avium subsp. paratuberculosis
gggcuguccgcguggccgag

SEQ ID NO: 2962531 - RNA, 14 nt, Mycobacterium avium subsp. paratuberculosis
gggcuguccuccca

SEQ ID NO: 2962532 - RNA, 14 nt, Mycobacterium avium subsp. paratuberculosis
gggcugucggcgcc

SEQ ID NO: 2962533 - RNA, 21 nt, Mycobacterium avium subsp. paratuberculosis
gggcugucgggcaggccggug

SEQ ID NO: 2962534 - RNA, 13 nt, Mycobacterium avium subsp. paratuberculosis
gggcugugccggc

SEQ ID NO: 2962535 - RNA, 14 nt, Mycobacterium avium subsp. paratuberculosis
gggcugugccggcg

SEQ ID NO: 2962536 - RNA, 16 nt, Mycobacterium avium subsp. paratuberculosis
gggcugugccggcggg

SEQ ID NO: 2962537 - RNA, 19 nt, Mycobacterium avium subsp. paratuberculosis
gggcugugccggcggguca

SEQ ID NO: 2962538 - RNA, 18 nt, Mycobacterium avium subsp. paratuberculosis
gggcugugggcgcagggc

SEQ ID NO: 2962539 - RNA, 18 nt, Mycobacterium avium subsp. paratuberculosis
gggcuucgaacgcccgca

SEQ ID NO: 2962540 - RNA, 21 nt, Mycobacterium avium subsp. paratuberculosis
gggcuucgaacgcccgcacca

SEQ ID NO: 2962541 - RNA, 22 nt, Mycobacterium avium subsp. paratuberculosis
gggcuucgaacgcccgcaccac

SEQ ID NO: 2962542 - RNA, 19 nt, Mycobacterium avium subsp. paratuberculosis
gggcuuuugcgucugcucg

SEQ ID NO: 2962543 - RNA, 19 nt, Mycobacterium avium subsp. paratuberculosis
ggggaagcccagcacccgc

SEQ ID NO: 2962544 - RNA, 16 nt, Mycobacterium avium subsp. paratuberculosis
ggggaagccggccagu

SEQ ID NO: 2962545 - RNA, 23 nt, Mycobacterium avium subsp. paratuberculosis
ggggaaggacucaaucggucagg

SEQ ID NO: 2962546 - RNA, 18 nt, Mycobacterium avium subsp. paratuberculosis
ggggaagggcuccccgga

SEQ ID NO: 2962547 - RNA, 20 nt, Mycobacterium avium subsp. paratuberculosis
ggggaaggugcgggcggggc

SEQ ID NO: 2962548 - RNA, 16 nt, Mycobacterium avium subsp. paratuberculosis
ggggaagucgaccggg

SEQ ID NO: 2962549 - RNA, 20 nt, Mycobacterium avium subsp. paratuberculosis
ggggaauggcggucagcggg

SEQ ID NO: 2962550 - RNA, 23 nt, Mycobacterium avium subsp. paratuberculosis
ggggacacccucgggguagccgg

SEQ ID NO: 2962551 - RNA, 16 nt, Mycobacterium avium subsp. paratuberculosis
ggggaccagcgcaacc

SEQ ID NO: 2962552 - RNA, 22 nt, Mycobacterium avium subsp. paratuberculosis
ggggaccagcgcaaccgcggcg

SEQ ID NO: 2962553 - RNA, 14 nt, Mycobacterium avium subsp. paratuberculosis
ggggacccgcaccg

SEQ ID NO: 2962554 - RNA, 15 nt, Mycobacterium avium subsp. paratuberculosis
ggggacggguugcgg

SEQ ID NO: 2962555 - RNA, 17 nt, Mycobacterium avium subsp. paratuberculosis
ggggacggugcagccgg

SEQ ID NO: 2962556 - RNA, 22 nt, Mycobacterium avium subsp. paratuberculosis
ggggacggugcagccgggggcg

SEQ ID NO: 2962557 - RNA, 23 nt, Mycobacterium avium subsp. paratuberculosis
ggggacgucgacgugggcggcca

SEQ ID NO: 2962558 - RNA, 16 nt, Mycobacterium avium subsp. paratuberculosis
ggggagaggcgcggcg

SEQ ID NO: 2962559 - RNA, 19 nt, Mycobacterium avium subsp. paratuberculosis
ggggagaggcgcggcgcga

SEQ ID NO: 2962560 - RNA, 18 nt, Mycobacterium avium subsp. paratuberculosis
ggggagccgugcagcgcc

SEQ ID NO: 2962561 - RNA, 13 nt, Mycobacterium avium subsp. paratuberculosis
ggggaggcccagc

SEQ ID NO: 2962562 - RNA, 20 nt, Mycobacterium avium subsp. paratuberculosis
ggggaggcccagcccgccgc

SEQ ID NO: 2962563 - RNA, 18 nt, Mycobacterium avium subsp. paratuberculosis
ggggaggcguugcguccc

SEQ ID NO: 2962564 - RNA, 17 nt, Mycobacterium avium subsp. paratuberculosis
ggggagggucgguggcc

SEQ ID NO: 2962565 - RNA, 22 nt, Mycobacterium avium subsp. paratuberculosis
ggggagggucgguggcccagcc

SEQ ID NO: 2962566 - RNA, 13 nt, Mycobacterium avium subsp. paratuberculosis
ggggaguucgcgg

SEQ ID NO: 2962567 - RNA, 16 nt, Mycobacterium avium subsp. paratuberculosis
ggggaguucgcgguug

SEQ ID NO: 2962568 - RNA, 21 nt, Mycobacterium avium subsp. paratuberculosis
ggggaucaccucaucgcccag

SEQ ID NO: 2962569 - RNA, 14 nt, Mycobacterium avium subsp. paratuberculosis
ggggaucaccucgc

SEQ ID NO: 2962570 - RNA, 20 nt, Mycobacterium avium subsp. paratuberculosis
ggggaucaggaugacgccgc

SEQ ID NO: 2962571 - RNA, 22 nt, Mycobacterium avium subsp. paratuberculosis
ggggaucaggaugacgccgcgg

SEQ ID NO: 2962572 - RNA, 19 nt, Mycobacterium avium subsp. paratuberculosis
ggggauccagcggcggccu

SEQ ID NO: 2962573 - RNA, 12 nt, Mycobacterium avium subsp. paratuberculosis
ggggaucccgaa

SEQ ID NO: 2962574 - RNA, 18 nt, Mycobacterium avium subsp. paratuberculosis
ggggauccgaucugcucg

SEQ ID NO: 2962575 - RNA, 14 nt, Mycobacterium avium subsp. paratuberculosis
ggggaucggcggga

SEQ ID NO: 2962576 - RNA, 14 nt, Mycobacterium avium subsp. paratuberculosis
ggggaucgugucga

SEQ ID NO: 2962577 - RNA, 14 nt, Mycobacterium avium subsp. paratuberculosis
ggggaugcgcaucc

SEQ ID NO: 2962578 - RNA, 17 nt, Mycobacterium avium subsp. paratuberculosis
ggggauggugcgccggg

SEQ ID NO: 2962579 - RNA, 18 nt, Mycobacterium avium subsp. paratuberculosis
ggggauggugcgccgggu

SEQ ID NO: 2962580 - RNA, 20 nt, Mycobacterium avium subsp. paratuberculosis
ggggauggugcgccgggucg

SEQ ID NO: 2962581 - RNA, 17 nt, Mycobacterium avium subsp. paratuberculosis
ggggauguagccgccgg

SEQ ID NO: 2962582 - RNA, 17 nt, Mycobacterium avium subsp. paratuberculosis
ggggauguaugcggucc

SEQ ID NO: 2962583 - RNA, 19 nt, Mycobacterium avium subsp. paratuberculosis
ggggaugucgaaccccacg

SEQ ID NO: 2962584 - RNA, 17 nt, Mycobacterium avium subsp. paratuberculosis
ggggaugucgucgggcg

SEQ ID NO: 2962585 - RNA, 23 nt, Mycobacterium avium subsp. paratuberculosis
ggggauuucacgucugcucggcg

SEQ ID NO: 2962586 - RNA, 16 nt, Mycobacterium avium subsp. paratuberculosis
ggggcaagcagcggca

SEQ ID NO: 2962587 - RNA, 20 nt, Mycobacterium avium subsp. paratuberculosis
ggggcaagcagcggcagcca

SEQ ID NO: 2962588 - RNA, 20 nt, Mycobacterium avium subsp. paratuberculosis
ggggcaccacguccaccagc

SEQ ID NO: 2962589 - RNA, 11 nt, Mycobacterium avium subsp. paratuberculosis
ggggcaccaga

SEQ ID NO: 2962590 - RNA, 19 nt, Mycobacterium avium subsp. paratuberculosis
ggggcacgcgcgcccggca

SEQ ID NO: 2962591 - RNA, 22 nt, Mycobacterium avium subsp. paratuberculosis
ggggcacgcgcgcccggcaccg

SEQ ID NO: 2962592 - RNA, 13 nt, Mycobacterium avium subsp. paratuberculosis
ggggcacgucccc

SEQ ID NO: 2962593 - RNA, 23 nt, Mycobacterium avium subsp. paratuberculosis
ggggcacguccccgugcagccgg

SEQ ID NO: 2962594 - RNA, 15 nt, Mycobacterium avium subsp. paratuberculosis
ggggcagaucgucgg

SEQ ID NO: 2962595 - RNA, 22 nt, Mycobacterium avium subsp. paratuberculosis
ggggcagaucgucggcacugcc

SEQ ID NO: 2962596 - RNA, 21 nt, Mycobacterium avium subsp. paratuberculosis
ggggcagcacccgcaccgugu

SEQ ID NO: 2962597 - RNA, 14 nt, Mycobacterium avium subsp. paratuberculosis
ggggcagcagcaga

SEQ ID NO: 2962598 - RNA, 13 nt, Mycobacterium avium subsp. paratuberculosis
ggggcgggcccca

SEQ ID NO: 2962599 - RNA, 11 nt, Mycobacterium avium subsp. paratuberculosis
ggggcggggcg

SEQ ID NO: 2962600 - RNA, 16 nt, Mycobacterium avium subsp. paratuberculosis
ggggcggugcagccgg

SEQ ID NO: 2962601 - RNA, 20 nt, Mycobacterium avium subsp. paratuberculosis
ggggcggugcagccgggugc

SEQ ID NO: 2962602 - RNA, 13 nt, Mycobacterium avium subsp. paratuberculosis
ggggcguacgcgc

SEQ ID NO: 2962603 - RNA, 19 nt, Mycobacterium avium subsp. paratuberculosis
ggggcgucggcggccuuga

SEQ ID NO: 2962604 - RNA, 13 nt, Mycobacterium avium subsp. paratuberculosis
ggggcguggcgga

SEQ ID NO: 2962605 - RNA, 16 nt, Mycobacterium avium subsp. paratuberculosis
ggggcguugcccgucg

SEQ ID NO: 2962606 - RNA, 18 nt, Mycobacterium avium subsp. paratuberculosis
ggggcguugcccgucgcc

SEQ ID NO: 2962607 - RNA, 23 nt, Mycobacterium avium subsp. paratuberculosis
ggggcguugguugcggccccgcc

SEQ ID NO: 2962608 - RNA, 22 nt, Mycobacterium avium subsp. paratuberculosis
ggggcuacaaaaccaagaccgc

SEQ ID NO: 2962609 - RNA, 16 nt, Mycobacterium avium subsp. paratuberculosis
ggggcuauccgggguc

SEQ ID NO: 2962610 - RNA, 13 nt, Mycobacterium avium subsp. paratuberculosis
ggggcucagccga

SEQ ID NO: 2962611 - RNA, 19 nt, Mycobacterium avium subsp. paratuberculosis
ggggcucagccgaagccgg

SEQ ID NO: 2962612 - RNA, 18 nt, Mycobacterium avium subsp. paratuberculosis
ggggcucauacggcggcu

SEQ ID NO: 2962613 - RNA, 17 nt, Mycobacterium avium subsp. paratuberculosis
ggggcucgacaggcagc

SEQ ID NO: 2962614 - RNA, 20 nt, Mycobacterium avium subsp. paratuberculosis
ggggcucgacaggcagcccg

SEQ ID NO: 2962615 - RNA, 17 nt, Mycobacterium avium subsp. paratuberculosis
ggggcugcgcggcuugc

SEQ ID NO: 2962616 - RNA, 23 nt, Mycobacterium avium subsp. paratuberculosis
ggggcugcgcggcuugcugcggu

SEQ ID NO: 2962617 - RNA, 16 nt, Mycobacterium avium subsp. paratuberculosis
ggggcugcgggccagg

SEQ ID NO: 2962618 - RNA, 23 nt, Mycobacterium avium subsp. paratuberculosis
ggggcuggccgcacggugcagca

SEQ ID NO: 2962619 - RNA, 13 nt, Mycobacterium avium subsp. paratuberculosis
ggggcuggcggcg

SEQ ID NO: 2962620 - RNA, 16 nt, Mycobacterium avium subsp. paratuberculosis
ggggcuguccucccag

SEQ ID NO: 2962621 - RNA, 22 nt, Mycobacterium avium subsp. paratuberculosis
ggggcuugagcgcgucgucgcc

SEQ ID NO: 2962622 - RNA, 18 nt, Mycobacterium avium subsp. paratuberculosis
ggggcuuuugcgucugcu

SEQ ID NO: 2962623 - RNA, 19 nt, Mycobacterium avium subsp. paratuberculosis
ggggcuuuugcgucugcuc

SEQ ID NO: 2962624 - RNA, 17 nt, Mycobacterium avium subsp. paratuberculosis
gggggaacccccucgcg

SEQ ID NO: 2962625 - RNA, 18 nt, Mycobacterium avium subsp. paratuberculosis
gggggaacccccucgcgc

SEQ ID NO: 2962626 - RNA, 20 nt, Mycobacterium avium subsp. paratuberculosis
gggggaagucgaccggggcg

SEQ ID NO: 2962627 - RNA, 18 nt, Mycobacterium avium subsp. paratuberculosis
gggggaccagcgcaaccg

SEQ ID NO: 2962628 - RNA, 15 nt, Mycobacterium avium subsp. paratuberculosis
gggggacgaaccagu

SEQ ID NO: 2962629 - RNA, 22 nt, Mycobacterium avium subsp. paratuberculosis
gggggacuuucgcgucugcucg

SEQ ID NO: 2962630 - RNA, 16 nt, Mycobacterium avium subsp. paratuberculosis
gggggagggucggugg

SEQ ID NO: 2962631 - RNA, 20 nt, Mycobacterium avium subsp. paratuberculosis
gggggauuucacgucugcuc

SEQ ID NO: 2962632 - RNA, 12 nt, Mycobacterium avium subsp. paratuberculosis
gggggccaggcg

SEQ ID NO: 2962633 - RNA, 12 nt, Mycobacterium avium subsp. paratuberculosis
gggggcgcagcc

SEQ ID NO: 2962634 - RNA, 19 nt, Mycobacterium avium subsp. paratuberculosis
gggggcgcgggcggcaggu

SEQ ID NO: 2962635 - RNA, 11 nt, Mycobacterium avium subsp. paratuberculosis
gggggcggccg

SEQ ID NO: 2962636 - RNA, 13 nt, Mycobacterium avium subsp. paratuberculosis
gggggcggccggg

SEQ ID NO: 2962637 - RNA, 22 nt, Mycobacterium avium subsp. paratuberculosis
gggggcuguccaccugcaccug

SEQ ID NO: 2962638 - RNA, 19 nt, Mycobacterium avium subsp. paratuberculosis
gggggcuuuugcgucugcu

SEQ ID NO: 2962639 - RNA, 12 nt, Mycobacterium avium subsp. paratuberculosis
ggggggcggggu

SEQ ID NO: 2962640 - RNA, 20 nt, Mycobacterium avium subsp. paratuberculosis
ggggguaaaccgccagcagc

SEQ ID NO: 2962641 - RNA, 18 nt, Mycobacterium avium subsp. paratuberculosis
gggggucaucagugaccg

SEQ ID NO: 2962642 - RNA, 16 nt, Mycobacterium avium subsp. paratuberculosis
gggggucgacccgccg

SEQ ID NO: 2962643 - RNA, 24 nt, Mycobacterium avium subsp. paratuberculosis
gggggucgacccgccgcagcccgc

SEQ ID NO: 2962644 - RNA, 14 nt, Mycobacterium avium subsp. paratuberculosis
gggggugccgaccg

SEQ ID NO: 2962645 - RNA, 15 nt, Mycobacterium avium subsp. paratuberculosis
gggggugccgcagcg

SEQ ID NO: 2962646 - RNA, 20 nt, Mycobacterium avium subsp. paratuberculosis
gggggugccgcagcggcggc

SEQ ID NO: 2962647 - RNA, 20 nt, Mycobacterium avium subsp. paratuberculosis
gggggugucguagcggcugu

SEQ ID NO: 2962648 - RNA, 14 nt, Mycobacterium avium subsp. paratuberculosis
gggguacucggcgg

SEQ ID NO: 2962649 - RNA, 19 nt, Mycobacterium avium subsp. paratuberculosis
gggguagacggcaugccgg

SEQ ID NO: 2962650 - RNA, 16 nt, Mycobacterium avium subsp. paratuberculosis
gggguagaggccgcgg

SEQ ID NO: 2962651 - RNA, 17 nt, Mycobacterium avium subsp. paratuberculosis
gggguagaggccgcgga

SEQ ID NO: 2962652 - RNA, 14 nt, Mycobacterium avium subsp. paratuberculosis
gggguagccggccc

SEQ ID NO: 2962653 - RNA, 19 nt, Mycobacterium avium subsp. paratuberculosis
gggguaguucagcgcgcgg

SEQ ID NO: 2962654 - RNA, 15 nt, Mycobacterium avium subsp. paratuberculosis
gggguaguucugcuc

SEQ ID NO: 2962655 - RNA, 16 nt, Mycobacterium avium subsp. paratuberculosis
ggggucaagcggcaga

SEQ ID NO: 2962656 - RNA, 18 nt, Mycobacterium avium subsp. paratuberculosis
ggggucaccuuggccgga

SEQ ID NO: 2962657 - RNA, 16 nt, Mycobacterium avium subsp. paratuberculosis
ggggucagggcgcuca

SEQ ID NO: 2962658 - RNA, 23 nt, Mycobacterium avium subsp. paratuberculosis
ggggucccaauccucgccgagca

SEQ ID NO: 2962659 - RNA, 19 nt, Mycobacterium avium subsp. paratuberculosis
gggguccgcaacgccggcg

SEQ ID NO: 2962660 - RNA, 16 nt, Mycobacterium avium subsp. paratuberculosis
gggguccuccagcggc

SEQ ID NO: 2962661 - RNA, 19 nt, Mycobacterium avium subsp. paratuberculosis
gggguccuccagcggcagg

SEQ ID NO: 2962662 - RNA, 21 nt, Mycobacterium avium subsp. paratuberculosis
gggguccucgauggcggcggc

SEQ ID NO: 2962663 - RNA, 16 nt, Mycobacterium avium subsp. paratuberculosis
gggguccucucggcgc

SEQ ID NO: 2962664 - RNA, 13 nt, Mycobacterium avium subsp. paratuberculosis
ggggucgacccgc

SEQ ID NO: 2962665 - RNA, 14 nt, Mycobacterium avium subsp. paratuberculosis
ggggucgacccgcc

SEQ ID NO: 2962666 - RNA, 22 nt, Mycobacterium avium subsp. paratuberculosis
ggggucgacccgccgcagcccg

SEQ ID NO: 2962667 - RNA, 13 nt, Mycobacterium avium subsp. paratuberculosis
ggggucgcgccgg

SEQ ID NO: 2962668 - RNA, 15 nt, Mycobacterium avium subsp. paratuberculosis
ggggucgcggcccgc

SEQ ID NO: 2962669 - RNA, 12 nt, Mycobacterium avium subsp. paratuberculosis
ggggucggccga

SEQ ID NO: 2962670 - RNA, 15 nt, Mycobacterium avium subsp. paratuberculosis
ggggucggcgcccuc

SEQ ID NO: 2962671 - RNA, 13 nt, Mycobacterium avium subsp. paratuberculosis
ggggucggcgccg

SEQ ID NO: 2962672 - RNA, 14 nt, Mycobacterium avium subsp. paratuberculosis
ggggucggcgccgc

SEQ ID NO: 2962673 - RNA, 17 nt, Mycobacterium avium subsp. paratuberculosis
ggggucggcgccgcgcg

SEQ ID NO: 2962674 - RNA, 20 nt, Mycobacterium avium subsp. paratuberculosis
ggggucggcgucgggccggg

SEQ ID NO: 2962675 - RNA, 21 nt, Mycobacterium avium subsp. paratuberculosis
ggggucggcgucgggccgggg

SEQ ID NO: 2962676 - RNA, 15 nt, Mycobacterium avium subsp. paratuberculosis
ggggucgggccggac

SEQ ID NO: 2962677 - RNA, 17 nt, Mycobacterium avium subsp. paratuberculosis
ggggucggugaccagcc

SEQ ID NO: 2962678 - RNA, 20 nt, Mycobacterium avium subsp. paratuberculosis
ggggucguaccaccaccagu

SEQ ID NO: 2962679 - RNA, 22 nt, Mycobacterium avium subsp. paratuberculosis
ggggugaccgucacccccggcg

SEQ ID NO: 2962680 - RNA, 14 nt, Mycobacterium avium subsp. paratuberculosis
ggggugacgcccgu

SEQ ID NO: 2962681 - RNA, 19 nt, Mycobacterium avium subsp. paratuberculosis
ggggugacgcccgucccgc

SEQ ID NO: 2962682 - RNA, 23 nt, Mycobacterium avium subsp. paratuberculosis
ggggugaggcacccgcugcacca

SEQ ID NO: 2962683 - RNA, 13 nt, Mycobacterium avium subsp. paratuberculosis
ggguccgccgucg

SEQ ID NO: 2962684 - RNA, 16 nt, Mycobacterium avium subsp. paratuberculosis
ggguccgcgguccucc

SEQ ID NO: 2962685 - RNA, 17 nt, Mycobacterium avium subsp. paratuberculosis
ggguccggucagcaccg

SEQ ID NO: 2962686 - RNA, 19 nt, Mycobacterium avium subsp. paratuberculosis
ggguccggucagcaccgcg

SEQ ID NO: 2962687 - RNA, 14 nt, Mycobacterium avium subsp. paratuberculosis
ggguccuaucagga

SEQ ID NO: 2962688 - RNA, 20 nt, Mycobacterium avium subsp. paratuberculosis
ggguccuaucaggacuggac

SEQ ID NO: 2962689 - RNA, 19 nt, Mycobacterium avium subsp. paratuberculosis
ggguccucgauggcggcgg

SEQ ID NO: 2962690 - RNA, 23 nt, Mycobacterium avium subsp. paratuberculosis
ggguccucgauggcggcggcugc

SEQ ID NO: 2962691 - RNA, 18 nt, Mycobacterium avium subsp. paratuberculosis
ggguccucucggcgccgu

SEQ ID NO: 2962692 - RNA, 16 nt, Mycobacterium avium subsp. paratuberculosis
ggguccuggcccccgc

SEQ ID NO: 2962693 - RNA, 17 nt, Mycobacterium avium subsp. paratuberculosis
ggguccuggcccccgcc

SEQ ID NO: 2962694 - RNA, 18 nt, Mycobacterium avium subsp. paratuberculosis
ggguccuugccggcggcg

SEQ ID NO: 2962695 - RNA, 20 nt, Mycobacterium avium subsp. paratuberculosis
ggguccuugccggcggcggg

SEQ ID NO: 2962696 - RNA, 18 nt, Mycobacterium avium subsp. paratuberculosis
ggguccuugcgccccggc

SEQ ID NO: 2962697 - RNA, 19 nt, Mycobacterium avium subsp. paratuberculosis
ggguccuugcgccccggcg

SEQ ID NO: 2962698 - RNA, 17 nt, Mycobacterium avium subsp. paratuberculosis
gggucgaacaucacccg

SEQ ID NO: 2962699 - RNA, 22 nt, Mycobacterium avium subsp. paratuberculosis
gggucgaacaucacccggcggc

SEQ ID NO: 2962700 - RNA, 23 nt, Mycobacterium avium subsp. paratuberculosis
gggucgaacggcaaccugggcgg

SEQ ID NO: 2962701 - RNA, 22 nt, Mycobacterium avium subsp. paratuberculosis
gggucgaaguccugcgccgcgg

SEQ ID NO: 2962702 - RNA, 16 nt, Mycobacterium avium subsp. paratuberculosis
gggucgacccgccgca

SEQ ID NO: 2962703 - RNA, 13 nt, Mycobacterium avium subsp. paratuberculosis
gggucgaccgccg

SEQ ID NO: 2962704 - RNA, 11 nt, Mycobacterium avium subsp. paratuberculosis
gggucgacgcc

SEQ ID NO: 2962705 - RNA, 20 nt, Mycobacterium avium subsp. paratuberculosis
gggucgacugggccaggucg

SEQ ID NO: 2962706 - RNA, 20 nt, Mycobacterium avium subsp. paratuberculosis
gggucgagacaccgucgcgc

SEQ ID NO: 2962707 - RNA, 21 nt, Mycobacterium avium subsp. paratuberculosis
gggucgagacaccgucgcgca

SEQ ID NO: 2962708 - RNA, 16 nt, Mycobacterium avium subsp. paratuberculosis
gggucgagaucagcac

SEQ ID NO: 2962709 - RNA, 17 nt, Mycobacterium avium subsp. paratuberculosis
gggucgagaucagcacc

SEQ ID NO: 2962710 - RNA, 12 nt, Mycobacterium avium subsp. paratuberculosis
gggucgagcagc

SEQ ID NO: 2962711 - RNA, 19 nt, Mycobacterium avium subsp. paratuberculosis
gggucgauaugcugcaacg

SEQ ID NO: 2962712 - RNA, 16 nt, Mycobacterium avium subsp. paratuberculosis
gggucgaucucggcgc

SEQ ID NO: 2962713 - RNA, 17 nt, Mycobacterium avium subsp. paratuberculosis
gggucgaucucggcgca

SEQ ID NO: 2962714 - RNA, 15 nt, Mycobacterium avium subsp. paratuberculosis
gggucgauggcgacg

SEQ ID NO: 2962715 - RNA, 17 nt, Mycobacterium avium subsp. paratuberculosis
gggucgcacgccgguag

SEQ ID NO: 2962716 - RNA, 13 nt, Mycobacterium avium subsp. paratuberculosis
gggucgccaggcc

SEQ ID NO: 2962717 - RNA, 21 nt, Mycobacterium avium subsp. paratuberculosis
gggucgccaggccaccgcacg

SEQ ID NO: 2962718 - RNA, 16 nt, Mycobacterium avium subsp. paratuberculosis
gggucgccgggcaggu

SEQ ID NO: 2962719 - RNA, 12 nt, Mycobacterium avium subsp. paratuberculosis
gggucgccgggu

SEQ ID NO: 2962720 - RNA, 17 nt, Mycobacterium avium subsp. paratuberculosis
gggucgccguggccgaa

SEQ ID NO: 2962721 - RNA, 16 nt, Mycobacterium avium subsp. paratuberculosis
gggucgcgcgcgaaca

SEQ ID NO: 2962722 - RNA, 19 nt, Mycobacterium avium subsp. paratuberculosis
gggucgcgcggcuacagca

SEQ ID NO: 2962723 - RNA, 15 nt, Mycobacterium avium subsp. paratuberculosis
gggucgcggcccacc

SEQ ID NO: 2962724 - RNA, 13 nt, Mycobacterium avium subsp. paratuberculosis
gggucgcgguggg

SEQ ID NO: 2962725 - RNA, 22 nt, Mycobacterium avium subsp. paratuberculosis
gggucggagcaaauccggcagc

SEQ ID NO: 2962726 - RNA, 23 nt, Mycobacterium avium subsp. paratuberculosis
gggucggagcaaauccggcagcg

SEQ ID NO: 2962727 - RNA, 12 nt, Mycobacterium avium subsp. paratuberculosis
gggucggccagc

SEQ ID NO: 2962728 - RNA, 14 nt, Mycobacterium avium subsp. paratuberculosis
gggucggccagcga

SEQ ID NO: 2962729 - RNA, 17 nt, Mycobacterium avium subsp. paratuberculosis
gggucggcgagcagccg

SEQ ID NO: 2962730 - RNA, 20 nt, Mycobacterium avium subsp. paratuberculosis
gggucggcgcccucggcgau

SEQ ID NO: 2962731 - RNA, 13 nt, Mycobacterium avium subsp. paratuberculosis
gggucggcgccgg

SEQ ID NO: 2962732 - RNA, 18 nt, Mycobacterium avium subsp. paratuberculosis
gggucggcgccggccagc

SEQ ID NO: 2962733 - RNA, 21 nt, Mycobacterium avium subsp. paratuberculosis
gggucggcucggcucggccgg

SEQ ID NO: 2962734 - RNA, 15 nt, Mycobacterium avium subsp. paratuberculosis
gggucgggugcggcg

SEQ ID NO: 2962735 - RNA, 14 nt, Mycobacterium avium subsp. paratuberculosis
gggucggucgagcc

SEQ ID NO: 2962736 - RNA, 14 nt, Mycobacterium avium subsp. paratuberculosis
gggucgguggccca

SEQ ID NO: 2962737 - RNA, 16 nt, Mycobacterium avium subsp. paratuberculosis
gggucgguggcccagc

SEQ ID NO: 2962738 - RNA, 22 nt, Mycobacterium avium subsp. paratuberculosis
gggucgguggcccagccggccg

SEQ ID NO: 2962739 - RNA, 16 nt, Mycobacterium avium subsp. paratuberculosis
gggucguaccaccacc

SEQ ID NO: 2962740 - RNA, 14 nt, Mycobacterium avium subsp. paratuberculosis
gggucguagagcgc

SEQ ID NO: 2962741 - RNA, 16 nt, Mycobacterium avium subsp. paratuberculosis
gggucguagagcgcga

SEQ ID NO: 2962742 - RNA, 22 nt, Mycobacterium avium subsp. paratuberculosis
gggucguagagcgcgaagcccu

SEQ ID NO: 2962743 - RNA, 17 nt, Mycobacterium avium subsp. paratuberculosis
gggucguagccgaagcc

SEQ ID NO: 2962744 - RNA, 22 nt, Mycobacterium avium subsp. paratuberculosis
gggucguagccgaagccgccgu

SEQ ID NO: 2962745 - RNA, 15 nt, Mycobacterium avium subsp. paratuberculosis
gggucguagccgucg

SEQ ID NO: 2962746 - RNA, 17 nt, Mycobacterium avium subsp. paratuberculosis
gggucguccgcgacgcu

SEQ ID NO: 2962747 - RNA, 12 nt, Mycobacterium avium subsp. paratuberculosis
gggucgucgacg

SEQ ID NO: 2962748 - RNA, 12 nt, Mycobacterium avium subsp. paratuberculosis
gggucgucgcgg

SEQ ID NO: 2962749 - RNA, 20 nt, Mycobacterium avium subsp. paratuberculosis
gggucgucgcgguccacgcc

SEQ ID NO: 2962750 - RNA, 14 nt, Mycobacterium avium subsp. paratuberculosis
gggucgucggccug

SEQ ID NO: 2962751 - RNA, 15 nt, Mycobacterium avium subsp. paratuberculosis
gggucgucgggccgg

SEQ ID NO: 2962752 - RNA, 14 nt, Mycobacterium avium subsp. paratuberculosis
gggucgucgggcgg

SEQ ID NO: 2962753 - RNA, 18 nt, Mycobacterium avium subsp. paratuberculosis
gggucgugcggcggcggu

SEQ ID NO: 2962754 - RNA, 18 nt, Mycobacterium avium subsp. paratuberculosis
gggucguucagcugaacg

SEQ ID NO: 2962755 - RNA, 16 nt, Mycobacterium avium subsp. paratuberculosis
gggucguugcacacca

SEQ ID NO: 2962756 - RNA, 20 nt, Mycobacterium avium subsp. paratuberculosis
gggucguuggcggcgguggg

SEQ ID NO: 2962757 - RNA, 17 nt, Mycobacterium avium subsp. paratuberculosis
gggucucagcgcccgcc

SEQ ID NO: 2962758 - RNA, 17 nt, Mycobacterium avium subsp. paratuberculosis
gggucucaucccgccga

SEQ ID NO: 2962759 - RNA, 15 nt, Mycobacterium avium subsp. paratuberculosis
gggucucgcgcagca

SEQ ID NO: 2962760 - RNA, 18 nt, Mycobacterium avium subsp. paratuberculosis
gggucucgggcagcagca

SEQ ID NO: 2962761 - RNA, 14 nt, Mycobacterium avium subsp. paratuberculosis
gggucugccacgcc

SEQ ID NO: 2962762 - RNA, 19 nt, Mycobacterium avium subsp. paratuberculosis
gggucugccacgcccaccg

SEQ ID NO: 2962763 - RNA, 14 nt, Mycobacterium avium subsp. paratuberculosis
gggucugcggccgg

SEQ ID NO: 2962764 - RNA, 18 nt, Mycobacterium avium subsp. paratuberculosis
gggucugcucacgcaacg

SEQ ID NO: 2962765 - RNA, 18 nt, Mycobacterium avium subsp. paratuberculosis
gggucuggcucggcacca

SEQ ID NO: 2962766 - RNA, 15 nt, Mycobacterium avium subsp. paratuberculosis
gggucuggucgguuu

SEQ ID NO: 2962767 - RNA, 18 nt, Mycobacterium avium subsp. paratuberculosis
gggucugugaccacgguc

SEQ ID NO: 2962768 - RNA, 16 nt, Mycobacterium avium subsp. paratuberculosis
gggugcgauggcaacg

SEQ ID NO: 2962769 - RNA, 24 nt, Mycobacterium avium subsp. paratuberculosis
gggugcgcagcgcgucgucgguca

SEQ ID NO: 2962770 - RNA, 14 nt, Mycobacterium avium subsp. paratuberculosis
gggugcgccaggca

SEQ ID NO: 2962771 - RNA, 15 nt, Mycobacterium avium subsp. paratuberculosis
gggugcgcucaccgc

SEQ ID NO: 2962772 - RNA, 21 nt, Mycobacterium avium subsp. paratuberculosis
gggugcgcucaccgcaucgaa

SEQ ID NO: 2962773 - RNA, 13 nt, Mycobacterium avium subsp. paratuberculosis
gggugcggcacgg

SEQ ID NO: 2962774 - RNA, 18 nt, Mycobacterium avium subsp. paratuberculosis
gggugcggcacggcaugg

SEQ ID NO: 2962775 - RNA, 13 nt, Mycobacterium avium subsp. paratuberculosis
gggugcggccagc

SEQ ID NO: 2962776 - RNA, 17 nt, Mycobacterium avium subsp. paratuberculosis
gggugcggccagcgcag

SEQ ID NO: 2962777 - RNA, 13 nt, Mycobacterium avium subsp. paratuberculosis
gggugcggccggu

SEQ ID NO: 2962778 - RNA, 17 nt, Mycobacterium avium subsp. paratuberculosis
gggugcgggcgcugcaa

SEQ ID NO: 2962779 - RNA, 20 nt, Mycobacterium avium subsp. paratuberculosis
gggugcggugcagccgcggu

SEQ ID NO: 2962780 - RNA, 13 nt, Mycobacterium avium subsp. paratuberculosis
gggugcggugcgg

SEQ ID NO: 2962781 - RNA, 19 nt, Mycobacterium avium subsp. paratuberculosis
gggugcgguugagcaccag

SEQ ID NO: 2962782 - RNA, 23 nt, Mycobacterium avium subsp. paratuberculosis
gggugcgguugagcaccagcccg

SEQ ID NO: 2962783 - RNA, 21 nt, Mycobacterium avium subsp. paratuberculosis
gggugcguccagaccggccgg

SEQ ID NO: 2962784 - RNA, 20 nt, Mycobacterium avium subsp. paratuberculosis
gggugcucaccccggccagg

SEQ ID NO: 2962785 - RNA, 14 nt, Mycobacterium avium subsp. paratuberculosis
gggugcucagccgc

SEQ ID NO: 2962786 - RNA, 12 nt, Mycobacterium avium subsp. paratuberculosis
gggugcucccgc

SEQ ID NO: 2962787 - RNA, 15 nt, Mycobacterium avium subsp. paratuberculosis
gggugcucccgccaa

SEQ ID NO: 2962788 - RNA, 13 nt, Mycobacterium avium subsp. paratuberculosis
gggugcucgaucg

SEQ ID NO: 2962789 - RNA, 19 nt, Mycobacterium avium subsp. paratuberculosis
gggugcucgaucggcgcgc

SEQ ID NO: 2962790 - RNA, 17 nt, Mycobacterium avium subsp. paratuberculosis
gggugcugaacgccugc

SEQ ID NO: 2962791 - RNA, 23 nt, Mycobacterium avium subsp. paratuberculosis
gggugcugaacgccugccggcgc

SEQ ID NO: 2962792 - RNA, 14 nt, Mycobacterium avium subsp. paratuberculosis
gggugcuggucagc

SEQ ID NO: 2962793 - RNA, 20 nt, Mycobacterium avium subsp. paratuberculosis
gggugcuuuugugucugcuc

SEQ ID NO: 2962794 - RNA, 22 nt, Mycobacterium avium subsp. paratuberculosis
ggguggaacuggacgccgugga

SEQ ID NO: 2962795 - RNA, 21 nt, Mycobacterium avium subsp. paratuberculosis
ggguggaucuugacggcgacg

SEQ ID NO: 2962796 - RNA, 12 nt, Mycobacterium avium subsp. paratuberculosis
ggguggccagca

SEQ ID NO: 2962797 - RNA, 13 nt, Mycobacterium avium subsp. paratuberculosis
ggguggccagcac

SEQ ID NO: 2962798 - RNA, 16 nt, Mycobacterium avium subsp. paratuberculosis
ggguggccagcaccag

SEQ ID NO: 2962799 - RNA, 20 nt, Mycobacterium avium subsp. paratuberculosis
ggguggccagcacgcugcgg

SEQ ID NO: 2962800 - RNA, 22 nt, Mycobacterium avium subsp. paratuberculosis
ggguggccagcuucaccggucg

SEQ ID NO: 2962801 - RNA, 16 nt, Mycobacterium avium subsp. paratuberculosis
ggguggccccagcccg

SEQ ID NO: 2962802 - RNA, 13 nt, Mycobacterium avium subsp. paratuberculosis
ggguggcccgccc

SEQ ID NO: 2962803 - RNA, 15 nt, Mycobacterium avium subsp. paratuberculosis
ggguggcccgcccgg

SEQ ID NO: 2962804 - RNA, 12 nt, Mycobacterium avium subsp. paratuberculosis
ggguggccggcc

SEQ ID NO: 2962805 - RNA, 16 nt, Mycobacterium avium subsp. paratuberculosis
ggguggccggccagca

SEQ ID NO: 2962806 - RNA, 14 nt, Mycobacterium avium subsp. paratuberculosis
ggguggccggggcc

SEQ ID NO: 2962807 - RNA, 12 nt, Mycobacterium avium subsp. paratuberculosis
ggguggccgggu

SEQ ID NO: 2962808 - RNA, 14 nt, Mycobacterium avium subsp. paratuberculosis
ggguggccgggucg

SEQ ID NO: 2962809 - RNA, 17 nt, Mycobacterium avium subsp. paratuberculosis
ggguggcgaucaccgcg

SEQ ID NO: 2962810 - RNA, 18 nt, Mycobacterium avium subsp. paratuberculosis
ggguggcgaucaccgcgg

SEQ ID NO: 2962811 - RNA, 23 nt, Mycobacterium avium subsp. paratuberculosis
ggguggcgccacagccggggauc

SEQ ID NO: 2962812 - RNA, 22 nt, Mycobacterium avium subsp. paratuberculosis
ggguggcgccggccagcaccac

SEQ ID NO: 2962813 - RNA, 13 nt, Mycobacterium avium subsp. paratuberculosis
ggguggcggggcg

SEQ ID NO: 2962814 - RNA, 12 nt, Mycobacterium avium subsp. paratuberculosis
gggugggcacgu

SEQ ID NO: 2962815 - RNA, 21 nt, Mycobacterium avium subsp. paratuberculosis
gggugggcacgucggccagga

SEQ ID NO: 2962816 - RNA, 14 nt, Mycobacterium avium subsp. paratuberculosis
gggugggcagcccc

SEQ ID NO: 2962817 - RNA, 12 nt, Mycobacterium avium subsp. paratuberculosis
gggugggcagcg

SEQ ID NO: 2962818 - RNA, 13 nt, Mycobacterium avium subsp. paratuberculosis
gggugggcagcgc

SEQ ID NO: 2962819 - RNA, 15 nt, Mycobacterium avium subsp. paratuberculosis
gggugggcagcgcga

SEQ ID NO: 2962820 - RNA, 13 nt, Mycobacterium avium subsp. paratuberculosis
gggugggcgaacg

SEQ ID NO: 2962821 - RNA, 19 nt, Mycobacterium avium subsp. paratuberculosis
ggguggggacgacgccgaa

SEQ ID NO: 2962822 - RNA, 18 nt, Mycobacterium avium subsp. paratuberculosis
ggguggggaucacgucgg

SEQ ID NO: 2962823 - RNA, 13 nt, Mycobacterium avium subsp. paratuberculosis
gggugggggucug

SEQ ID NO: 2962824 - RNA, 11 nt, Mycobacterium avium subsp. paratuberculosis
gggugggugcu

SEQ ID NO: 2962825 - RNA, 18 nt, Mycobacterium avium subsp. paratuberculosis
ggguggucacaccgcuga

SEQ ID NO: 2962826 - RNA, 15 nt, Mycobacterium avium subsp. paratuberculosis
ggguggucaccagcg

SEQ ID NO: 2962827 - RNA, 16 nt, Mycobacterium avium subsp. paratuberculosis
ggguggucaccagcgc

SEQ ID NO: 2962828 - RNA, 18 nt, Mycobacterium avium subsp. paratuberculosis
ggguggucaccagcgcgg

SEQ ID NO: 2962829 - RNA, 19 nt, Mycobacterium avium subsp. paratuberculosis
ggguggucaccagcgcggu

SEQ ID NO: 2962830 - RNA, 12 nt, Mycobacterium avium subsp. paratuberculosis
ggguggucagcg

SEQ ID NO: 2962831 - RNA, 15 nt, Mycobacterium avium subsp. paratuberculosis
ggguggucagcgcgg

SEQ ID NO: 2962832 - RNA, 16 nt, Mycobacterium avium subsp. paratuberculosis
ggguggucagcgucuc

SEQ ID NO: 2962833 - RNA, 13 nt, Mycobacterium avium subsp. paratuberculosis
gggugguccaggc

SEQ ID NO: 2962834 - RNA, 14 nt, Mycobacterium avium subsp. paratuberculosis
ggguggucugcugg

SEQ ID NO: 2962835 - RNA, 11 nt, Mycobacterium avium subsp. paratuberculosis
gggugguggug

SEQ ID NO: 2962836 - RNA, 16 nt, Mycobacterium avium subsp. paratuberculosis
ggguggugugcaaggc

SEQ ID NO: 2962837 - RNA, 20 nt, Mycobacterium avium subsp. paratuberculosis
gggugguuuugcgucugcuc

SEQ ID NO: 2962838 - RNA, 20 nt, Mycobacterium avium subsp. paratuberculosis
ggguguaacgcgucgacggc

SEQ ID NO: 2962839 - RNA, 15 nt, Mycobacterium avium subsp. paratuberculosis
ggguguagcggaugg

SEQ ID NO: 2962840 - RNA, 20 nt, Mycobacterium avium subsp. paratuberculosis
ggguguaggcccgaucaggg

SEQ ID NO: 2962841 - RNA, 15 nt, Mycobacterium avium subsp. paratuberculosis
ggguguaggccgcgu

SEQ ID NO: 2962842 - RNA, 16 nt, Mycobacterium avium subsp. paratuberculosis
ggguguauucgcccac

SEQ ID NO: 2962843 - RNA, 23 nt, Mycobacterium avium subsp. paratuberculosis
ggguguauucgcccaccccggcg

SEQ ID NO: 2962844 - RNA, 16 nt, Mycobacterium avium subsp. paratuberculosis
gggugucaggucggcg

SEQ ID NO: 2962845 - RNA, 19 nt, Mycobacterium avium subsp. paratuberculosis
gggugucccagcgccacug

SEQ ID NO: 2962846 - RNA, 19 nt, Mycobacterium avium subsp. paratuberculosis
ggguguccgagcgggccgu

SEQ ID NO: 2962847 - RNA, 15 nt, Mycobacterium avium subsp. paratuberculosis
gggugucgaaaccgc

SEQ ID NO: 2962848 - RNA, 16 nt, Mycobacterium avium subsp. paratuberculosis
gggugucgaacagcag

SEQ ID NO: 2962849 - RNA, 23 nt, Mycobacterium avium subsp. paratuberculosis
gggugucgaacagcaggcccagg

SEQ ID NO: 2962850 - RNA, 13 nt, Mycobacterium avium subsp. paratuberculosis
gggugucgaccca

SEQ ID NO: 2962851 - RNA, 15 nt, Mycobacterium avium subsp. paratuberculosis
gggugucgacgaugc

SEQ ID NO: 2962852 - RNA, 12 nt, Mycobacterium avium subsp. paratuberculosis
gggugucgacgc

SEQ ID NO: 2962853 - RNA, 13 nt, Mycobacterium avium subsp. paratuberculosis
gggugucgcccuc

SEQ ID NO: 2962854 - RNA, 14 nt, Mycobacterium avium subsp. paratuberculosis
gguacggcggccgc

SEQ ID NO: 2962855 - RNA, 15 nt, Mycobacterium avium subsp. paratuberculosis
gguacggcggccgcg

SEQ ID NO: 2962856 - RNA, 21 nt, Mycobacterium avium subsp. paratuberculosis
gguacggcucaacggccggcg

SEQ ID NO: 2962857 - RNA, 16 nt, Mycobacterium avium subsp. paratuberculosis
gguacgugcgccggcg

SEQ ID NO: 2962858 - RNA, 17 nt, Mycobacterium avium subsp. paratuberculosis
gguacgugcgccggcgg

SEQ ID NO: 2962859 - RNA, 18 nt, Mycobacterium avium subsp. paratuberculosis
gguacgugcgccggcggu

SEQ ID NO: 2962860 - RNA, 19 nt, Mycobacterium avium subsp. paratuberculosis
gguacgugcgccggcggug

SEQ ID NO: 2962861 - RNA, 21 nt, Mycobacterium avium subsp. paratuberculosis
gguacgugcgccggcggugcg

SEQ ID NO: 2962862 - RNA, 19 nt, Mycobacterium avium subsp. paratuberculosis
gguacucgagcgugcccgc

SEQ ID NO: 2962863 - RNA, 20 nt, Mycobacterium avium subsp. paratuberculosis
gguacucgagcgugcccgcg

SEQ ID NO: 2962864 - RNA, 22 nt, Mycobacterium avium subsp. paratuberculosis
gguacucgagcgugcccgcgcc

SEQ ID NO: 2962865 - RNA, 14 nt, Mycobacterium avium subsp. paratuberculosis
gguacucggcggcg

SEQ ID NO: 2962866 - RNA, 21 nt, Mycobacterium avium subsp. paratuberculosis
gguacugcuugccgccgggcc

SEQ ID NO: 2962867 - RNA, 18 nt, Mycobacterium avium subsp. paratuberculosis
gguacugggcguggucgc

SEQ ID NO: 2962868 - RNA, 20 nt, Mycobacterium avium subsp. paratuberculosis
gguagaaccaacgcggcgcc

SEQ ID NO: 2962869 - RNA, 24 nt, Mycobacterium avium subsp. paratuberculosis
gguagaaccagcccggcccgucga

SEQ ID NO: 2962870 - RNA, 14 nt, Mycobacterium avium subsp. paratuberculosis
gguagaagccgcga

SEQ ID NO: 2962871 - RNA, 13 nt, Mycobacterium avium subsp. paratuberculosis
gguagacaccgcc

SEQ ID NO: 2962872 - RNA, 15 nt, Mycobacterium avium subsp. paratuberculosis
gguagaccgccgagu

SEQ ID NO: 2962873 - RNA, 18 nt, Mycobacterium avium subsp. paratuberculosis
gguagacgaucaccggcu

SEQ ID NO: 2962874 - RNA, 18 nt, Mycobacterium avium subsp. paratuberculosis
gguagacgaugcccagcc

SEQ ID NO: 2962875 - RNA, 16 nt, Mycobacterium avium subsp. paratuberculosis
gguagacggcaugccg

SEQ ID NO: 2962876 - RNA, 18 nt, Mycobacterium avium subsp. paratuberculosis
gguagacggcaugccggg

SEQ ID NO: 2962877 - RNA, 20 nt, Mycobacterium avium subsp. paratuberculosis
gguagacggcaugccgggcc

SEQ ID NO: 2962878 - RNA, 21 nt, Mycobacterium avium subsp. paratuberculosis
gguagacggcaugccgggcca

SEQ ID NO: 2962879 - RNA, 20 nt, Mycobacterium avium subsp. paratuberculosis
gguagacgucgggcugggcg

SEQ ID NO: 2962880 - RNA, 21 nt, Mycobacterium avium subsp. paratuberculosis
gguagacguucuccccgccgg

SEQ ID NO: 2962881 - RNA, 22 nt, Mycobacterium avium subsp. paratuberculosis
gguagacguucuccccgccgga

SEQ ID NO: 2962882 - RNA, 13 nt, Mycobacterium avium subsp. paratuberculosis
gguagagcggcac

SEQ ID NO: 2962883 - RNA, 14 nt, Mycobacterium avium subsp. paratuberculosis
gguagaggcggcga

SEQ ID NO: 2962884 - RNA, 15 nt, Mycobacterium avium subsp. paratuberculosis
gguagaggcugucca

SEQ ID NO: 2962885 - RNA, 14 nt, Mycobacterium avium subsp. paratuberculosis
gguagaucgccgga

SEQ ID NO: 2962886 - RNA, 23 nt, Mycobacterium avium subsp. paratuberculosis
gguagaugccgaagccguugacg

SEQ ID NO: 2962887 - RNA, 14 nt, Mycobacterium avium subsp. paratuberculosis
gguagaugguggcc

SEQ ID NO: 2962888 - RNA, 14 nt, Mycobacterium avium subsp. paratuberculosis
gguagaugucgcga

SEQ ID NO: 2962889 - RNA, 14 nt, Mycobacterium avium subsp. paratuberculosis
gguagcaggcgcgc

SEQ ID NO: 2962890 - RNA, 15 nt, Mycobacterium avium subsp. paratuberculosis
gguagcaggcgcgca

SEQ ID NO: 2962891 - RNA, 18 nt, Mycobacterium avium subsp. paratuberculosis
gguagcaggcgcgcagca

SEQ ID NO: 2962892 - RNA, 12 nt, Mycobacterium avium subsp. paratuberculosis
gguagccagcac

SEQ ID NO: 2962893 - RNA, 20 nt, Mycobacterium avium subsp. paratuberculosis
gguagccagcaccgccccgg

SEQ ID NO: 2962894 - RNA, 21 nt, Mycobacterium avium subsp. paratuberculosis
gguagccagcaccgccccggu

SEQ ID NO: 2962895 - RNA, 21 nt, Mycobacterium avium subsp. paratuberculosis
gguagccaugggucucggcga

SEQ ID NO: 2962896 - RNA, 22 nt, Mycobacterium avium subsp. paratuberculosis
gguagcccaggauucccgaccc

SEQ ID NO: 2962897 - RNA, 13 nt, Mycobacterium avium subsp. paratuberculosis
gguagcccgucga

SEQ ID NO: 2962898 - RNA, 15 nt, Mycobacterium avium subsp. paratuberculosis
gguagcccgucgacg

SEQ ID NO: 2962899 - RNA, 16 nt, Mycobacterium avium subsp. paratuberculosis
gguagcccgucgacgg

SEQ ID NO: 2962900 - RNA, 20 nt, Mycobacterium avium subsp. paratuberculosis
gguagcccgucgacgggcca

SEQ ID NO: 2962901 - RNA, 21 nt, Mycobacterium avium subsp. paratuberculosis
gguagcccgucgacgggccac

SEQ ID NO: 2962902 - RNA, 21 nt, Mycobacterium avium subsp. paratuberculosis
gguagccgccguagccggcgg

SEQ ID NO: 2962903 - RNA, 16 nt, Mycobacterium avium subsp. paratuberculosis
gguagccgcucgccca

SEQ ID NO: 2962904 - RNA, 18 nt, Mycobacterium avium subsp. paratuberculosis
gguagccgcucgcccagc

SEQ ID NO: 2962905 - RNA, 22 nt, Mycobacterium avium subsp. paratuberculosis
gguagccgcucgcccagcgcgg

SEQ ID NO: 2962906 - RNA, 17 nt, Mycobacterium avium subsp. paratuberculosis
gguagccggcccgcagc

SEQ ID NO: 2962907 - RNA, 21 nt, Mycobacterium avium subsp. paratuberculosis
gguagccggcccgcagccagc

SEQ ID NO: 2962908 - RNA, 15 nt, Mycobacterium avium subsp. paratuberculosis
gguagcgcagcacca

SEQ ID NO: 2962909 - RNA, 15 nt, Mycobacterium avium subsp. paratuberculosis
gguagcgcaucagcu

SEQ ID NO: 2962910 - RNA, 22 nt, Mycobacterium avium subsp. paratuberculosis
gguagcgccgccggggcgggca

SEQ ID NO: 2962911 - RNA, 14 nt, Mycobacterium avium subsp. paratuberculosis
gguagcggaccugc

SEQ ID NO: 2962912 - RNA, 17 nt, Mycobacterium avium subsp. paratuberculosis
gguagcggugcucgaug

SEQ ID NO: 2962913 - RNA, 17 nt, Mycobacterium avium subsp. paratuberculosis
gguagcgugcgcccgac

SEQ ID NO: 2962914 - RNA, 22 nt, Mycobacterium avium subsp. paratuberculosis
gguaggccggccgcagcugcug

SEQ ID NO: 2962915 - RNA, 15 nt, Mycobacterium avium subsp. paratuberculosis
gguaggcgaccaugc

SEQ ID NO: 2962916 - RNA, 24 nt, Mycobacterium avium subsp. paratuberculosis
gguaggcgagaucaacaccgcgca

SEQ ID NO: 2962917 - RNA, 16 nt, Mycobacterium avium subsp. paratuberculosis
gguaggcgcaccgccg

SEQ ID NO: 2962918 - RNA, 20 nt, Mycobacterium avium subsp. paratuberculosis
gguaggcgcaccgccgggca

SEQ ID NO: 2962919 - RNA, 20 nt, Mycobacterium avium subsp. paratuberculosis
gguaggcgccgaugcccgcc

SEQ ID NO: 2962920 - RNA, 15 nt, Mycobacterium avium subsp. paratuberculosis
gguaggcgccgcucg

SEQ ID NO: 2962921 - RNA, 15 nt, Mycobacterium avium subsp. paratuberculosis
gguaggcgcggguga

SEQ ID NO: 2962922 - RNA, 14 nt, Mycobacterium avium subsp. paratuberculosis
gguaggcggccagc

SEQ ID NO: 2962923 - RNA, 13 nt, Mycobacterium avium subsp. paratuberculosis
gguaggcggccgg

SEQ ID NO: 2962924 - RNA, 17 nt, Mycobacterium avium subsp. paratuberculosis
gguaggcggcgccgucg

SEQ ID NO: 2962925 - RNA, 22 nt, Mycobacterium avium subsp. paratuberculosis
gguaggcggcgccgucgaccag

SEQ ID NO: 2962926 - RNA, 15 nt, Mycobacterium avium subsp. paratuberculosis
gguaggcgguggcgc

SEQ ID NO: 2962927 - RNA, 14 nt, Mycobacterium avium subsp. paratuberculosis
gguaggcgucgcgc

SEQ ID NO: 2962928 - RNA, 21 nt, Mycobacterium avium subsp. paratuberculosis
gguaggcguuguugggcuugg

SEQ ID NO: 2962929 - RNA, 21 nt, Mycobacterium avium subsp. paratuberculosis
gguagggccggucaccggucg

SEQ ID NO: 2962930 - RNA, 23 nt, Mycobacterium avium subsp. paratuberculosis
gguagggcgccgucggcggggga

SEQ ID NO: 2962931 - RNA, 13 nt, Mycobacterium avium subsp. paratuberculosis
gguagggcggcgg

SEQ ID NO: 2962932 - RNA, 17 nt, Mycobacterium avium subsp. paratuberculosis
gguagggcuccgcgcug

SEQ ID NO: 2962933 - RNA, 15 nt, Mycobacterium avium subsp. paratuberculosis
gguagggucgggugc

SEQ ID NO: 2962934 - RNA, 22 nt, Mycobacterium avium subsp. paratuberculosis
gguaggugaucgccucgaccag

SEQ ID NO: 2962935 - RNA, 15 nt, Mycobacterium avium subsp. paratuberculosis
gguaggugcccgggu

SEQ ID NO: 2962936 - RNA, 22 nt, Mycobacterium avium subsp. paratuberculosis
gguaggugcccgggucgugcgg

SEQ ID NO: 2962937 - RNA, 15 nt, Mycobacterium avium subsp. paratuberculosis
gguaggugccggccg

SEQ ID NO: 2962938 - RNA, 19 nt, Mycobacterium avium subsp. paratuberculosis
ggucacguagugcuucuug

SEQ ID NO: 2962939 - RNA, 22 nt, Mycobacterium avium subsp. paratuberculosis
ggucacguagugcuucuugaag

SEQ ID NO: 2962940 - RNA, 21 nt, Mycobacterium avium subsp. paratuberculosis
ggucagaccccguaccagcgc

SEQ ID NO: 2962941 - RNA, 17 nt, Mycobacterium avium subsp. paratuberculosis
ggucagaccgcggcggu

SEQ ID NO: 2962942 - RNA, 18 nt, Mycobacterium avium subsp. paratuberculosis
ggucagaccgcggcgguc

SEQ ID NO: 2962943 - RNA, 15 nt, Mycobacterium avium subsp. paratuberculosis
ggucagagcccgaac

SEQ ID NO: 2962944 - RNA, 12 nt, Mycobacterium avium subsp. paratuberculosis
ggucagcaacag

SEQ ID NO: 2962945 - RNA, 14 nt, Mycobacterium avium subsp. paratuberculosis
ggucagcaccacca

SEQ ID NO: 2962946 - RNA, 17 nt, Mycobacterium avium subsp. paratuberculosis
ggucagcacccgcagcc

SEQ ID NO: 2962947 - RNA, 23 nt, Mycobacterium avium subsp. paratuberculosis
ggucagcacccgcagccgcgagu

SEQ ID NO: 2962948 - RNA, 13 nt, Mycobacterium avium subsp. paratuberculosis
ggucagcaccgcg

SEQ ID NO: 2962949 - RNA, 17 nt, Mycobacterium avium subsp. paratuberculosis
ggucagcaccgcgcggc

SEQ ID NO: 2962950 - RNA, 20 nt, Mycobacterium avium subsp. paratuberculosis
ggucagcaccgcgcggcggu

SEQ ID NO: 2962951 - RNA, 21 nt, Mycobacterium avium subsp. paratuberculosis
ggucagcaccgcgcggcggug

SEQ ID NO: 2962952 - RNA, 22 nt, Mycobacterium avium subsp. paratuberculosis
ggucagcaccgcgcggcggugc

SEQ ID NO: 2962953 - RNA, 19 nt, Mycobacterium avium subsp. paratuberculosis
ggucagcaccgucaccgcc

SEQ ID NO: 2962954 - RNA, 19 nt, Mycobacterium avium subsp. paratuberculosis
ggucagcacgucggucagc

SEQ ID NO: 2962955 - RNA, 17 nt, Mycobacterium avium subsp. paratuberculosis
ggucagcagcacccggu

SEQ ID NO: 2962956 - RNA, 16 nt, Mycobacterium avium subsp. paratuberculosis
ggucagcagcagcgcc

SEQ ID NO: 2962957 - RNA, 17 nt, Mycobacterium avium subsp. paratuberculosis
ggucagcagcagcgccu

SEQ ID NO: 2962958 - RNA, 22 nt, Mycobacterium avium subsp. paratuberculosis
ggucagcagcgucugcgccagc

SEQ ID NO: 2962959 - RNA, 23 nt, Mycobacterium avium subsp. paratuberculosis
ggucagcagcgucugcgccagcu

SEQ ID NO: 2962960 - RNA, 14 nt, Mycobacterium avium subsp. paratuberculosis
ggucagcaggcgcc

SEQ ID NO: 2962961 - RNA, 17 nt, Mycobacterium avium subsp. paratuberculosis
ggucagcaggcgccgca

SEQ ID NO: 2962962 - RNA, 14 nt, Mycobacterium avium subsp. paratuberculosis
ggucagcaggguga

SEQ ID NO: 2962963 - RNA, 16 nt, Mycobacterium avium subsp. paratuberculosis
ggucagcagggugacg

SEQ ID NO: 2962964 - RNA, 21 nt, Mycobacterium avium subsp. paratuberculosis
ggucagccagguuggccaggu

SEQ ID NO: 2962965 - RNA, 17 nt, Mycobacterium avium subsp. paratuberculosis
ggucagcccccaccgcg

SEQ ID NO: 2962966 - RNA, 21 nt, Mycobacterium avium subsp. paratuberculosis
ggucagcccgcccuuggccgc

SEQ ID NO: 2962967 - RNA, 22 nt, Mycobacterium avium subsp. paratuberculosis
ggucagcccgcccuuggccgcg

SEQ ID NO: 2962968 - RNA, 13 nt, Mycobacterium avium subsp. paratuberculosis
ggucagcccgcgc

SEQ ID NO: 2962969 - RNA, 14 nt, Mycobacterium avium subsp. paratuberculosis
ggucagccgcacca

SEQ ID NO: 2962970 - RNA, 16 nt, Mycobacterium avium subsp. paratuberculosis
ggucagccgcaccagg

SEQ ID NO: 2962971 - RNA, 18 nt, Mycobacterium avium subsp. paratuberculosis
ggucagccgcaccagguu

SEQ ID NO: 2962972 - RNA, 20 nt, Mycobacterium avium subsp. paratuberculosis
ggucagccgcggcggcagca

SEQ ID NO: 2962973 - RNA, 20 nt, Mycobacterium avium subsp. paratuberculosis
ggucagccgcggcucgaugg

SEQ ID NO: 2962974 - RNA, 13 nt, Mycobacterium avium subsp. paratuberculosis
ggucagccgggcg

SEQ ID NO: 2962975 - RNA, 22 nt, Mycobacterium avium subsp. paratuberculosis
ggucagcgagcgguuggcgacg

SEQ ID NO: 2962976 - RNA, 13 nt, Mycobacterium avium subsp. paratuberculosis
ggucagcgaggcg

SEQ ID NO: 2962977 - RNA, 13 nt, Mycobacterium avium subsp. paratuberculosis
ggucagcgccagc

SEQ ID NO: 2962978 - RNA, 14 nt, Mycobacterium avium subsp. paratuberculosis
ggucagcgccagca

SEQ ID NO: 2962979 - RNA, 13 nt, Mycobacterium avium subsp. paratuberculosis
ggucagcgcgaca

SEQ ID NO: 2962980 - RNA, 21 nt, Mycobacterium avium subsp. paratuberculosis
ggucagcgcgacaucgccggc

SEQ ID NO: 2962981 - RNA, 12 nt, Mycobacterium avium subsp. paratuberculosis
ggucagcgcgcc

SEQ ID NO: 2962982 - RNA, 17 nt, Mycobacterium avium subsp. paratuberculosis
ggucagcgcggcccgcg

SEQ ID NO: 2962983 - RNA, 18 nt, Mycobacterium avium subsp. paratuberculosis
ggucagcgcggcccgcgg

SEQ ID NO: 2962984 - RNA, 17 nt, Mycobacterium avium subsp. paratuberculosis
ggucagcgcguccaggu

SEQ ID NO: 2962985 - RNA, 22 nt, Mycobacterium avium subsp. paratuberculosis
ggucagcgcguccaggugcgcc

SEQ ID NO: 2962986 - RNA, 19 nt, Mycobacterium avium subsp. paratuberculosis
ggucagcgcgucggcgacc

SEQ ID NO: 2962987 - RNA, 23 nt, Mycobacterium avium subsp. paratuberculosis
ggucagcgcgucggcgaccgcgc

SEQ ID NO: 2962988 - RNA, 16 nt, Mycobacterium avium subsp. paratuberculosis
ggucagcgcuacugcc

SEQ ID NO: 2962989 - RNA, 19 nt, Mycobacterium avium subsp. paratuberculosis
ggucagcgcuccuggccgg

SEQ ID NO: 2962990 - RNA, 18 nt, Mycobacterium avium subsp. paratuberculosis
ggucagcgcuuccagcgc

SEQ ID NO: 2962991 - RNA, 16 nt, Mycobacterium avium subsp. paratuberculosis
ggucagcggcaacacg

SEQ ID NO: 2962992 - RNA, 23 nt, Mycobacterium avium subsp. paratuberculosis
ggucagcggcaggucccaggcca

SEQ ID NO: 2962993 - RNA, 18 nt, Mycobacterium avium subsp. paratuberculosis
ggucagcggcccgaucac

SEQ ID NO: 2962994 - RNA, 14 nt, Mycobacterium avium subsp. paratuberculosis
ggucagcggcgcca

SEQ ID NO: 2962995 - RNA, 15 nt, Mycobacterium avium subsp. paratuberculosis
ggucagcggcgccac

SEQ ID NO: 2962996 - RNA, 16 nt, Mycobacterium avium subsp. paratuberculosis
ggucagcggcgccacc

SEQ ID NO: 2962997 - RNA, 19 nt, Mycobacterium avium subsp. paratuberculosis
ggucagcggcgccaccggg

SEQ ID NO: 2962998 - RNA, 13 nt, Mycobacterium avium subsp. paratuberculosis
ggucagcggcgug

SEQ ID NO: 2962999 - RNA, 14 nt, Mycobacterium avium subsp. paratuberculosis
ggucagcggcgugc

SEQ ID NO: 2963000 - RNA, 16 nt, Mycobacterium avium subsp. paratuberculosis
ggucagcggcgugcug

SEQ ID NO: 2963001 - RNA, 14 nt, Mycobacterium avium subsp. paratuberculosis
ggucagcgucgcca

SEQ ID NO: 2963002 - RNA, 14 nt, Mycobacterium avium subsp. paratuberculosis
ggucagcgucgccg

SEQ ID NO: 2963003 - RNA, 15 nt, Mycobacterium avium subsp. paratuberculosis
ggucagcgucgccgc

SEQ ID NO: 2963004 - RNA, 20 nt, Mycobacterium avium subsp. paratuberculosis
ggucagcgucgccgccccga

SEQ ID NO: 2963005 - RNA, 23 nt, Mycobacterium avium subsp. paratuberculosis
ggucagcgucucgccggggaaca

SEQ ID NO: 2963006 - RNA, 20 nt, Mycobacterium avium subsp. paratuberculosis
ggucagcgucucggcgauca

SEQ ID NO: 2963007 - RNA, 17 nt, Mycobacterium avium subsp. paratuberculosis
ggucagcgucuggcggg

SEQ ID NO: 2963008 - RNA, 22 nt, Mycobacterium avium subsp. paratuberculosis
ggucagcguggcgucggcgcgc

SEQ ID NO: 2963009 - RNA, 17 nt, Mycobacterium avium subsp. paratuberculosis
ggucagcuccaccugcg

SEQ ID NO: 2963010 - RNA, 21 nt, Mycobacterium avium subsp. paratuberculosis
ggucagcucccccgucgggcc

SEQ ID NO: 2963011 - RNA, 21 nt, Mycobacterium avium subsp. paratuberculosis
ggucagcucgaaggugcccgc

SEQ ID NO: 2963012 - RNA, 16 nt, Mycobacterium avium subsp. paratuberculosis
ggucagcucgaucgcc

SEQ ID NO: 2963013 - RNA, 20 nt, Mycobacterium avium subsp. paratuberculosis
ggucagcucgaucgccgcgc

SEQ ID NO: 2963014 - RNA, 21 nt, Mycobacterium avium subsp. paratuberculosis
ggucagcucgaucgccgcgcc

SEQ ID NO: 2963015 - RNA, 23 nt, Mycobacterium avium subsp. paratuberculosis
ggucagcucgaucgccgcgccca

SEQ ID NO: 2963016 - RNA, 18 nt, Mycobacterium avium subsp. paratuberculosis
ggucagcucgcgcccggc

SEQ ID NO: 2963017 - RNA, 22 nt, Mycobacterium avium subsp. paratuberculosis
ggucagcucgcgcccggccagg

SEQ ID NO: 2963018 - RNA, 23 nt, Mycobacterium avium subsp. paratuberculosis
ggucaggaacaccgagccggcgg

SEQ ID NO: 2963019 - RNA, 19 nt, Mycobacterium avium subsp. paratuberculosis
ggucaggcauuccaccgcg

SEQ ID NO: 2963020 - RNA, 13 nt, Mycobacterium avium subsp. paratuberculosis
ggucaggcccagg

SEQ ID NO: 2963021 - RNA, 14 nt, Mycobacterium avium subsp. paratuberculosis
ggucaggccggcgc

SEQ ID NO: 2963022 - RNA, 22 nt, Mycobacterium avium subsp. paratuberculosis
gguccagggcgggucgucgaug

SEQ ID NO: 2963023 - RNA, 18 nt, Mycobacterium avium subsp. paratuberculosis
gguccaggugggguggug

SEQ ID NO: 2963024 - RNA, 20 nt, Mycobacterium avium subsp. paratuberculosis
gguccaggugggguggugga

SEQ ID NO: 2963025 - RNA, 17 nt, Mycobacterium avium subsp. paratuberculosis
gguccagugccggcgag

SEQ ID NO: 2963026 - RNA, 16 nt, Mycobacterium avium subsp. paratuberculosis
gguccaguugugccgc

SEQ ID NO: 2963027 - RNA, 21 nt, Mycobacterium avium subsp. paratuberculosis
gguccaucccguugcgcauga

SEQ ID NO: 2963028 - RNA, 20 nt, Mycobacterium avium subsp. paratuberculosis
gguccaucgccucgaccagc

SEQ ID NO: 2963029 - RNA, 23 nt, Mycobacterium avium subsp. paratuberculosis
gguccaucgccucgaccagcacc

SEQ ID NO: 2963030 - RNA, 15 nt, Mycobacterium avium subsp. paratuberculosis
gguccaucuccagcu

SEQ ID NO: 2963031 - RNA, 16 nt, Mycobacterium avium subsp. paratuberculosis
gguccaucuccagcuc

SEQ ID NO: 2963032 - RNA, 17 nt, Mycobacterium avium subsp. paratuberculosis
gguccaucuccagcucc

SEQ ID NO: 2963033 - RNA, 22 nt, Mycobacterium avium subsp. paratuberculosis
gguccauggccuugacgucggg

SEQ ID NO: 2963034 - RNA, 18 nt, Mycobacterium avium subsp. paratuberculosis
gguccaugugccgcaucu

SEQ ID NO: 2963035 - RNA, 18 nt, Mycobacterium avium subsp. paratuberculosis
ggucccaauccucgccga

SEQ ID NO: 2963036 - RNA, 16 nt, Mycobacterium avium subsp. paratuberculosis
ggucccacucgggaaa

SEQ ID NO: 2963037 - RNA, 21 nt, Mycobacterium avium subsp. paratuberculosis
ggucccagaugcgcgacggcc

SEQ ID NO: 2963038 - RNA, 20 nt, Mycobacterium avium subsp. paratuberculosis
ggucccaggcguggucggcg

SEQ ID NO: 2963039 - RNA, 17 nt, Mycobacterium avium subsp. paratuberculosis
ggucccaggugggcgcg

SEQ ID NO: 2963040 - RNA, 21 nt, Mycobacterium avium subsp. paratuberculosis
ggucccaggugggcgcgcagc

SEQ ID NO: 2963041 - RNA, 13 nt, Mycobacterium avium subsp. paratuberculosis
ggucccagucccc

SEQ ID NO: 2963042 - RNA, 15 nt, Mycobacterium avium subsp. paratuberculosis
ggucccccgccgacc

SEQ ID NO: 2963043 - RNA, 12 nt, Mycobacterium avium subsp. paratuberculosis
ggucccccugag

SEQ ID NO: 2963044 - RNA, 18 nt, Mycobacterium avium subsp. paratuberculosis
gguccccgccgccgugca

SEQ ID NO: 2963045 - RNA, 12 nt, Mycobacterium avium subsp. paratuberculosis
gguccccgcgcc

SEQ ID NO: 2963046 - RNA, 13 nt, Mycobacterium avium subsp. paratuberculosis
ggucccgacgcgg

SEQ ID NO: 2963047 - RNA, 16 nt, Mycobacterium avium subsp. paratuberculosis
ggucccgacgcggcgc

SEQ ID NO: 2963048 - RNA, 17 nt, Mycobacterium avium subsp. paratuberculosis
ggucccgacgcggcgcg

SEQ ID NO: 2963049 - RNA, 12 nt, Mycobacterium avium subsp. paratuberculosis
ggucccgacgcu

SEQ ID NO: 2963050 - RNA, 16 nt, Mycobacterium avium subsp. paratuberculosis
ggucccgccggugauc

SEQ ID NO: 2963051 - RNA, 16 nt, Mycobacterium avium subsp. paratuberculosis
ggucccgcggcggcgc

SEQ ID NO: 2963052 - RNA, 17 nt, Mycobacterium avium subsp. paratuberculosis
ggucccggccgacgggc

SEQ ID NO: 2963053 - RNA, 14 nt, Mycobacterium avium subsp. paratuberculosis
ggucccggcggacc

SEQ ID NO: 2963054 - RNA, 19 nt, Mycobacterium avium subsp. paratuberculosis
ggucccggcgggggcggcg

SEQ ID NO: 2963055 - RNA, 17 nt, Mycobacterium avium subsp. paratuberculosis
ggucccggucagcgucc

SEQ ID NO: 2963056 - RNA, 14 nt, Mycobacterium avium subsp. paratuberculosis
ggucccggucaggu

SEQ ID NO: 2963057 - RNA, 16 nt, Mycobacterium avium subsp. paratuberculosis
ggucccguccaucgcc

SEQ ID NO: 2963058 - RNA, 12 nt, Mycobacterium avium subsp. paratuberculosis
ggucccgugcgc

SEQ ID NO: 2963059 - RNA, 13 nt, Mycobacterium avium subsp. paratuberculosis
gguccgaccagcg

SEQ ID NO: 2963060 - RNA, 12 nt, Mycobacterium avium subsp. paratuberculosis
gguccgaccgcc

SEQ ID NO: 2963061 - RNA, 14 nt, Mycobacterium avium subsp. paratuberculosis
gguccgacggcugc

SEQ ID NO: 2963062 - RNA, 16 nt, Mycobacterium avium subsp. paratuberculosis
gguccgaggugaucgc

SEQ ID NO: 2963063 - RNA, 21 nt, Mycobacterium avium subsp. paratuberculosis
gguccgaggugaucgcgaacg

SEQ ID NO: 2963064 - RNA, 19 nt, Mycobacterium avium subsp. paratuberculosis
gguccgaucguccggcgcc

SEQ ID NO: 2963065 - RNA, 17 nt, Mycobacterium avium subsp. paratuberculosis
gguccgauugcccgacu

SEQ ID NO: 2963066 - RNA, 17 nt, Mycobacterium avium subsp. paratuberculosis
gguccgauuucccgacu

SEQ ID NO: 2963067 - RNA, 19 nt, Mycobacterium avium subsp. paratuberculosis
gguccgauuucccgacucc

SEQ ID NO: 2963068 - RNA, 18 nt, Mycobacterium avium subsp. paratuberculosis
gguccgcaacgcggcggu

SEQ ID NO: 2963069 - RNA, 23 nt, Mycobacterium avium subsp. paratuberculosis
gguccgcaacgcggcggugacga

SEQ ID NO: 2963070 - RNA, 15 nt, Mycobacterium avium subsp. paratuberculosis
gguccgcccggacca

SEQ ID NO: 2963071 - RNA, 14 nt, Mycobacterium avium subsp. paratuberculosis
gguccgccgcagcg

SEQ ID NO: 2963072 - RNA, 15 nt, Mycobacterium avium subsp. paratuberculosis
gguccgccgcagcgg

SEQ ID NO: 2963073 - RNA, 18 nt, Mycobacterium avium subsp. paratuberculosis
gguccgccgcagcggcgc

SEQ ID NO: 2963074 - RNA, 16 nt, Mycobacterium avium subsp. paratuberculosis
gguccgccgccggcgg

SEQ ID NO: 2963075 - RNA, 15 nt, Mycobacterium avium subsp. paratuberculosis
gguccgccgggcgcg

SEQ ID NO: 2963076 - RNA, 19 nt, Mycobacterium avium subsp. paratuberculosis
gguccgccggugccagcaa

SEQ ID NO: 2963077 - RNA, 23 nt, Mycobacterium avium subsp. paratuberculosis
gguccgccggugccagcaacaca

SEQ ID NO: 2963078 - RNA, 16 nt, Mycobacterium avium subsp. paratuberculosis
gguccgccgucggggu

SEQ ID NO: 2963079 - RNA, 18 nt, Mycobacterium avium subsp. paratuberculosis
gguccgcgaacucgucga

SEQ ID NO: 2963080 - RNA, 19 nt, Mycobacterium avium subsp. paratuberculosis
gguccgcggugaugccgag

SEQ ID NO: 2963081 - RNA, 19 nt, Mycobacterium avium subsp. paratuberculosis
gguccgcgguuuggucagc

SEQ ID NO: 2963082 - RNA, 21 nt, Mycobacterium avium subsp. paratuberculosis
gguccgcucaacuugaucagc

SEQ ID NO: 2963083 - RNA, 16 nt, Mycobacterium avium subsp. paratuberculosis
gguccggaaccgcgcc

SEQ ID NO: 2963084 - RNA, 20 nt, Mycobacterium avium subsp. paratuberculosis
gguccggcagcgcgcccagg

SEQ ID NO: 2963085 - RNA, 13 nt, Mycobacterium avium subsp. paratuberculosis
gguccggcccggg

SEQ ID NO: 2963086 - RNA, 14 nt, Mycobacterium avium subsp. paratuberculosis
gguccggcccgggg

SEQ ID NO: 2963087 - RNA, 12 nt, Mycobacterium avium subsp. paratuberculosis
gguccggccggc

SEQ ID NO: 2963088 - RNA, 15 nt, Mycobacterium avium subsp. paratuberculosis
gguccggccgugccg

SEQ ID NO: 2963089 - RNA, 23 nt, Mycobacterium avium subsp. paratuberculosis
gguccggcgcccgaucggcaccc

SEQ ID NO: 2963090 - RNA, 15 nt, Mycobacterium avium subsp. paratuberculosis
gguccggcgcgacca

SEQ ID NO: 2963091 - RNA, 15 nt, Mycobacterium avium subsp. paratuberculosis
gguccggcggcacca

SEQ ID NO: 2963092 - RNA, 17 nt, Mycobacterium avium subsp. paratuberculosis
gguccggcggcaccacc

SEQ ID NO: 2963093 - RNA, 22 nt, Mycobacterium avium subsp. paratuberculosis
gguccggcggcaccacccgcgg

SEQ ID NO: 2963094 - RNA, 19 nt, Mycobacterium avium subsp. paratuberculosis
gguccggcugaacgccagc

SEQ ID NO: 2963095 - RNA, 23 nt, Mycobacterium avium subsp. paratuberculosis
gguccggcugaacgccagcagcc

SEQ ID NO: 2963096 - RNA, 21 nt, Mycobacterium avium subsp. paratuberculosis
gguccggcuucaccgucaggg

SEQ ID NO: 2963097 - RNA, 19 nt, Mycobacterium avium subsp. paratuberculosis
gguccgggaacagcgacuc

SEQ ID NO: 2963098 - RNA, 19 nt, Mycobacterium avium subsp. paratuberculosis
gguccggucacgcccgggg

SEQ ID NO: 2963099 - RNA, 12 nt, Mycobacterium avium subsp. paratuberculosis
gguccggucagc

SEQ ID NO: 2963100 - RNA, 19 nt, Mycobacterium avium subsp. paratuberculosis
gguccgguucgaccggcgu

SEQ ID NO: 2963101 - RNA, 18 nt, Mycobacterium avium subsp. paratuberculosis
gguccgugccacggccgc

SEQ ID NO: 2963102 - RNA, 20 nt, Mycobacterium avium subsp. paratuberculosis
gguccgugccacggccgcgg

SEQ ID NO: 2963103 - RNA, 15 nt, Mycobacterium avium subsp. paratuberculosis
gguccguucggcggu

SEQ ID NO: 2963104 - RNA, 18 nt, Mycobacterium avium subsp. paratuberculosis
gguccguuggaggugauc

SEQ ID NO: 2963105 - RNA, 23 nt, Mycobacterium avium subsp. paratuberculosis
gguccguuggaggugaucgccag

SEQ ID NO: 2963106 - RNA, 18 nt, Mycobacterium avium subsp. paratuberculosis
gguccuccaacggcacca

SEQ ID NO: 2963107 - RNA, 18 nt, Mycobacterium avium subsp. paratuberculosis
ggucgaggccggccagcg

SEQ ID NO: 2963108 - RNA, 19 nt, Mycobacterium avium subsp. paratuberculosis
ggucgagggcguucgcggu

SEQ ID NO: 2963109 - RNA, 17 nt, Mycobacterium avium subsp. paratuberculosis
ggucgagggucgccagg

SEQ ID NO: 2963110 - RNA, 18 nt, Mycobacterium avium subsp. paratuberculosis
ggucgagggucgccaggc

SEQ ID NO: 2963111 - RNA, 21 nt, Mycobacterium avium subsp. paratuberculosis
ggucgagggugacccgggcga

SEQ ID NO: 2963112 - RNA, 15 nt, Mycobacterium avium subsp. paratuberculosis
ggucgagguccucgg

SEQ ID NO: 2963113 - RNA, 18 nt, Mycobacterium avium subsp. paratuberculosis
ggucgagguccucggcga

SEQ ID NO: 2963114 - RNA, 18 nt, Mycobacterium avium subsp. paratuberculosis
ggucgaggucgccgacag

SEQ ID NO: 2963115 - RNA, 16 nt, Mycobacterium avium subsp. paratuberculosis
ggucgaggucggccag

SEQ ID NO: 2963116 - RNA, 17 nt, Mycobacterium avium subsp. paratuberculosis
ggucgaggucggccagc

SEQ ID NO: 2963117 - RNA, 14 nt, Mycobacterium avium subsp. paratuberculosis
ggucgagucguaga

SEQ ID NO: 2963118 - RNA, 15 nt, Mycobacterium avium subsp. paratuberculosis
ggucgauaugcugca

SEQ ID NO: 2963119 - RNA, 22 nt, Mycobacterium avium subsp. paratuberculosis
ggucgauaugcugcaacggcug

SEQ ID NO: 2963120 - RNA, 18 nt, Mycobacterium avium subsp. paratuberculosis
ggucgaucaacaccaacg

SEQ ID NO: 2963121 - RNA, 15 nt, Mycobacterium avium subsp. paratuberculosis
ggucgaucaccucgu

SEQ ID NO: 2963122 - RNA, 18 nt, Mycobacterium avium subsp. paratuberculosis
ggucgaucccgccggcga

SEQ ID NO: 2963123 - RNA, 17 nt, Mycobacterium avium subsp. paratuberculosis
ggucgaucucggccagc

SEQ ID NO: 2963124 - RNA, 14 nt, Mycobacterium avium subsp. paratuberculosis
ggucgaucucggcg

SEQ ID NO: 2963125 - RNA, 12 nt, Mycobacterium avium subsp. paratuberculosis
ggucgaucugcg

SEQ ID NO: 2963126 - RNA, 17 nt, Mycobacterium avium subsp. paratuberculosis
ggucgaucugcggcacg

SEQ ID NO: 2963127 - RNA, 18 nt, Mycobacterium avium subsp. paratuberculosis
ggucgaugaacucgcggg

SEQ ID NO: 2963128 - RNA, 21 nt, Mycobacterium avium subsp. paratuberculosis
ggucgaugaacucgcgggcga

SEQ ID NO: 2963129 - RNA, 16 nt, Mycobacterium avium subsp. paratuberculosis
ggucgaugacgccgcg

SEQ ID NO: 2963130 - RNA, 14 nt, Mycobacterium avium subsp. paratuberculosis
ggucgaugagcugg

SEQ ID NO: 2963131 - RNA, 16 nt, Mycobacterium avium subsp. paratuberculosis
ggucgaugagcuggug

SEQ ID NO: 2963132 - RNA, 23 nt, Mycobacterium avium subsp. paratuberculosis
ggucgaugaucuggcggucccgc

SEQ ID NO: 2963133 - RNA, 14 nt, Mycobacterium avium subsp. paratuberculosis
ggucgaugcccgcg

SEQ ID NO: 2963134 - RNA, 18 nt, Mycobacterium avium subsp. paratuberculosis
ggucgaugcccgcgccga

SEQ ID NO: 2963135 - RNA, 24 nt, Mycobacterium avium subsp. paratuberculosis
ggucgaugcccgcgccgaccagcg

SEQ ID NO: 2963136 - RNA, 18 nt, Mycobacterium avium subsp. paratuberculosis
ggucgauggucugcccgc

SEQ ID NO: 2963137 - RNA, 18 nt, Mycobacterium avium subsp. paratuberculosis
ggucgaugucggcgaacc

SEQ ID NO: 2963138 - RNA, 18 nt, Mycobacterium avium subsp. paratuberculosis
ggucgaugucggugcggc

SEQ ID NO: 2963139 - RNA, 21 nt, Mycobacterium avium subsp. paratuberculosis
ggucgaugucggugcggccgc

SEQ ID NO: 2963140 - RNA, 22 nt, Mycobacterium avium subsp. paratuberculosis
ggucgcaccaaagugccguuga

SEQ ID NO: 2963141 - RNA, 14 nt, Mycobacterium avium subsp. paratuberculosis
ggucgcacgccggu

SEQ ID NO: 2963142 - RNA, 22 nt, Mycobacterium avium subsp. paratuberculosis
ggucgcacgccgguagccgcuc

SEQ ID NO: 2963143 - RNA, 15 nt, Mycobacterium avium subsp. paratuberculosis
ggucgcagcggcacg

SEQ ID NO: 2963144 - RNA, 18 nt, Mycobacterium avium subsp. paratuberculosis
ggucgcaggccgcccggc

SEQ ID NO: 2963145 - RNA, 15 nt, Mycobacterium avium subsp. paratuberculosis
ggucgcaggcgagcc

SEQ ID NO: 2963146 - RNA, 14 nt, Mycobacterium avium subsp. paratuberculosis
ggucgcaggugauc

SEQ ID NO: 2963147 - RNA, 17 nt, Mycobacterium avium subsp. paratuberculosis
ggucgccaaacugcgca

SEQ ID NO: 2963148 - RNA, 14 nt, Mycobacterium avium subsp. paratuberculosis
ggucgccaccacca

SEQ ID NO: 2963149 - RNA, 15 nt, Mycobacterium avium subsp. paratuberculosis
ggucgccaccaccag

SEQ ID NO: 2963150 - RNA, 17 nt, Mycobacterium avium subsp. paratuberculosis
ggucgccaccaccagcg

SEQ ID NO: 2963151 - RNA, 13 nt, Mycobacterium avium subsp. paratuberculosis
ggucgccacggcc

SEQ ID NO: 2963152 - RNA, 16 nt, Mycobacterium avium subsp. paratuberculosis
ggucgccacggccggc

SEQ ID NO: 2963153 - RNA, 17 nt, Mycobacterium avium subsp. paratuberculosis
ggucgccacggccggca

SEQ ID NO: 2963154 - RNA, 18 nt, Mycobacterium avium subsp. paratuberculosis
ggucgccacggccggcag

SEQ ID NO: 2963155 - RNA, 19 nt, Mycobacterium avium subsp. paratuberculosis
ggucgccacggccggcagc

SEQ ID NO: 2963156 - RNA, 20 nt, Mycobacterium avium subsp. paratuberculosis
ggucgccacggccggcagca

SEQ ID NO: 2963157 - RNA, 20 nt, Mycobacterium avium subsp. paratuberculosis
ggucgccacucgggcggccg

SEQ ID NO: 2963158 - RNA, 14 nt, Mycobacterium avium subsp. paratuberculosis
ggucgccagcgcca

SEQ ID NO: 2963159 - RNA, 17 nt, Mycobacterium avium subsp. paratuberculosis
ggucgccagcgccacgc

SEQ ID NO: 2963160 - RNA, 16 nt, Mycobacterium avium subsp. paratuberculosis
ggucgccaggccaccg

SEQ ID NO: 2963161 - RNA, 15 nt, Mycobacterium avium subsp. paratuberculosis
ggucgcccaccacga

SEQ ID NO: 2963162 - RNA, 21 nt, Mycobacterium avium subsp. paratuberculosis
ggucgcccaccacgacgacgu

SEQ ID NO: 2963163 - RNA, 20 nt, Mycobacterium avium subsp. paratuberculosis
ggucgcccagauagaucgca

SEQ ID NO: 2963164 - RNA, 14 nt, Mycobacterium avium subsp. paratuberculosis
ggucgcccccucgg

SEQ ID NO: 2963165 - RNA, 21 nt, Mycobacterium avium subsp. paratuberculosis
ggucgcccccucggccggucc

SEQ ID NO: 2963166 - RNA, 22 nt, Mycobacterium avium subsp. paratuberculosis
ggucgcccccucggccgguccg

SEQ ID NO: 2963167 - RNA, 11 nt, Mycobacterium avium subsp. paratuberculosis
ggucgcccggc

SEQ ID NO: 2963168 - RNA, 18 nt, Mycobacterium avium subsp. paratuberculosis
ggucgcccggcucgccgg

SEQ ID NO: 2963169 - RNA, 21 nt, Mycobacterium avium subsp. paratuberculosis
ggucgcccggcucgccgggcu

SEQ ID NO: 2963170 - RNA, 10 nt, Mycobacterium avium subsp. paratuberculosis
ggucgccgaa

SEQ ID NO: 2963171 - RNA, 14 nt, Mycobacterium avium subsp. paratuberculosis
ggucgccgaacgug

SEQ ID NO: 2963172 - RNA, 21 nt, Mycobacterium avium subsp. paratuberculosis
ggucgccgaacgugcgcggcg

SEQ ID NO: 2963173 - RNA, 21 nt, Mycobacterium avium subsp. paratuberculosis
ggucgccgacagcgucgucca

SEQ ID NO: 2963174 - RNA, 15 nt, Mycobacterium avium subsp. paratuberculosis
ggucgccgacgccgu

SEQ ID NO: 2963175 - RNA, 15 nt, Mycobacterium avium subsp. paratuberculosis
ggucgccgcccacgc

SEQ ID NO: 2963176 - RNA, 21 nt, Mycobacterium avium subsp. paratuberculosis
ggucgccgcccacgccgugca

SEQ ID NO: 2963177 - RNA, 14 nt, Mycobacterium avium subsp. paratuberculosis
ggucgccgcgcagc

SEQ ID NO: 2963178 - RNA, 17 nt, Mycobacterium avium subsp. paratuberculosis
ggucgccgcgcagcacc

SEQ ID NO: 2963179 - RNA, 18 nt, Mycobacterium avium subsp. paratuberculosis
ggucgccgcgccgccggu

SEQ ID NO: 2963180 - RNA, 19 nt, Mycobacterium avium subsp. paratuberculosis
ggucgccgcgccgccggug

SEQ ID NO: 2963181 - RNA, 13 nt, Mycobacterium avium subsp. paratuberculosis
ggucgccggcggc

SEQ ID NO: 2963182 - RNA, 15 nt, Mycobacterium avium subsp. paratuberculosis
ggucgccggcggccg

SEQ ID NO: 2963183 - RNA, 17 nt, Mycobacterium avium subsp. paratuberculosis
ggucgccgggcaggugg

SEQ ID NO: 2963184 - RNA, 22 nt, Mycobacterium avium subsp. paratuberculosis
ggucgccgggcagguggucggc

SEQ ID NO: 2963185 - RNA, 19 nt, Mycobacterium avium subsp. paratuberculosis
ggucgccggugugaucgag

SEQ ID NO: 2963186 - RNA, 14 nt, Mycobacterium avium subsp. paratuberculosis
ggucgccggugugc

SEQ ID NO: 2963187 - RNA, 17 nt, Mycobacterium avium subsp. paratuberculosis
ggucgccggugugcagc

SEQ ID NO: 2963188 - RNA, 18 nt, Mycobacterium avium subsp. paratuberculosis
ggucgccggugugcagcc

SEQ ID NO: 2963189 - RNA, 17 nt, Mycobacterium avium subsp. paratuberculosis
ggucgccgucgugcucg

SEQ ID NO: 2963190 - RNA, 19 nt, Mycobacterium avium subsp. paratuberculosis
ggucgcgaagacgcuggcc

SEQ ID NO: 2963191 - RNA, 20 nt, Mycobacterium avium subsp. paratuberculosis
ggucgcgaagacgcuggcca

SEQ ID NO: 2963192 - RNA, 14 nt, Mycobacterium avium subsp. paratuberculosis
ggucggcgccggcc

SEQ ID NO: 2963193 - RNA, 15 nt, Mycobacterium avium subsp. paratuberculosis
ggucggcgccggcca

SEQ ID NO: 2963194 - RNA, 19 nt, Mycobacterium avium subsp. paratuberculosis
ggucggcgcggcgacguga

SEQ ID NO: 2963195 - RNA, 15 nt, Mycobacterium avium subsp. paratuberculosis
ggucggcgcggucca

SEQ ID NO: 2963196 - RNA, 19 nt, Mycobacterium avium subsp. paratuberculosis
ggucggcgggagccggcgg

SEQ ID NO: 2963197 - RNA, 20 nt, Mycobacterium avium subsp. paratuberculosis
ggucggcgggagccggcggc

SEQ ID NO: 2963198 - RNA, 12 nt, Mycobacterium avium subsp. paratuberculosis
ggucggcgggca

SEQ ID NO: 2963199 - RNA, 21 nt, Mycobacterium avium subsp. paratuberculosis
ggucggcgucaccccaccgag

SEQ ID NO: 2963200 - RNA, 17 nt, Mycobacterium avium subsp. paratuberculosis
ggucggcguccagcgcg

SEQ ID NO: 2963201 - RNA, 20 nt, Mycobacterium avium subsp. paratuberculosis
ggucggcguccagcgcggug

SEQ ID NO: 2963202 - RNA, 22 nt, Mycobacterium avium subsp. paratuberculosis
ggucggcguccagcgcggugag

SEQ ID NO: 2963203 - RNA, 23 nt, Mycobacterium avium subsp. paratuberculosis
ggucggcguccagcgcggugagc

SEQ ID NO: 2963204 - RNA, 22 nt, Mycobacterium avium subsp. paratuberculosis
ggucggcgucgggccgggggcg

SEQ ID NO: 2963205 - RNA, 22 nt, Mycobacterium avium subsp. paratuberculosis
ggucggcgucguacagcagccc

SEQ ID NO: 2963206 - RNA, 19 nt, Mycobacterium avium subsp. paratuberculosis
ggucggcucggcucggccg

SEQ ID NO: 2963207 - RNA, 21 nt, Mycobacterium avium subsp. paratuberculosis
ggucggcucggcucggccggc

SEQ ID NO: 2963208 - RNA, 17 nt, Mycobacterium avium subsp. paratuberculosis
ggucggcuuccagaugc

SEQ ID NO: 2963209 - RNA, 18 nt, Mycobacterium avium subsp. paratuberculosis
ggucgggauacucguccu

SEQ ID NO: 2963210 - RNA, 14 nt, Mycobacterium avium subsp. paratuberculosis
ggucgggaucgauc

SEQ ID NO: 2963211 - RNA, 16 nt, Mycobacterium avium subsp. paratuberculosis
ggucgggaucgauccc

SEQ ID NO: 2963212 - RNA, 20 nt, Mycobacterium avium subsp. paratuberculosis
ggucgggaucugcggugagc

SEQ ID NO: 2963213 - RNA, 17 nt, Mycobacterium avium subsp. paratuberculosis
ggucgggcaugccggcc

SEQ ID NO: 2963214 - RNA, 19 nt, Mycobacterium avium subsp. paratuberculosis
ggucgggcaugccggccgg

SEQ ID NO: 2963215 - RNA, 21 nt, Mycobacterium avium subsp. paratuberculosis
ggucgggcaugccggccggca

SEQ ID NO: 2963216 - RNA, 16 nt, Mycobacterium avium subsp. paratuberculosis
ggucgggcccagguag

SEQ ID NO: 2963217 - RNA, 13 nt, Mycobacterium avium subsp. paratuberculosis
ggucgggccggcc

SEQ ID NO: 2963218 - RNA, 15 nt, Mycobacterium avium subsp. paratuberculosis
ggucgggccggccga

SEQ ID NO: 2963219 - RNA, 14 nt, Mycobacterium avium subsp. paratuberculosis
ggucgggcgcacca

SEQ ID NO: 2963220 - RNA, 23 nt, Mycobacterium avium subsp. paratuberculosis
ggucgggcgcaccacgaccuccg

SEQ ID NO: 2963221 - RNA, 16 nt, Mycobacterium avium subsp. paratuberculosis
ggucggggaauuccgg

SEQ ID NO: 2963222 - RNA, 13 nt, Mycobacterium avium subsp. paratuberculosis
ggucggggcggcg

SEQ ID NO: 2963223 - RNA, 16 nt, Mycobacterium avium subsp. paratuberculosis
ggucggggcggcgggc

SEQ ID NO: 2963224 - RNA, 18 nt, Mycobacterium avium subsp. paratuberculosis
ggucggggcggcgggcga

SEQ ID NO: 2963225 - RNA, 22 nt, Mycobacterium avium subsp. paratuberculosis
ggucgggguccaggccgcgccg

SEQ ID NO: 2963226 - RNA, 18 nt, Mycobacterium avium subsp. paratuberculosis
ggucgggucccggcaaca

SEQ ID NO: 2963227 - RNA, 20 nt, Mycobacterium avium subsp. paratuberculosis
ggucgggugcgcucaccgca

SEQ ID NO: 2963228 - RNA, 13 nt, Mycobacterium avium subsp. paratuberculosis
ggucgggugcggc

SEQ ID NO: 2963229 - RNA, 18 nt, Mycobacterium avium subsp. paratuberculosis
ggucgggugcggcggugu

SEQ ID NO: 2963230 - RNA, 13 nt, Mycobacterium avium subsp. paratuberculosis
ggucgguacgcgc

SEQ ID NO: 2963231 - RNA, 12 nt, Mycobacterium avium subsp. paratuberculosis
ggucggucagcu

SEQ ID NO: 2963232 - RNA, 16 nt, Mycobacterium avium subsp. paratuberculosis
ggucggucagcucgaa

SEQ ID NO: 2963233 - RNA, 17 nt, Mycobacterium avium subsp. paratuberculosis
ggucggucagucgcgcc

SEQ ID NO: 2963234 - RNA, 22 nt, Mycobacterium avium subsp. paratuberculosis
ggucggucagucgcgccgccag

SEQ ID NO: 2963235 - RNA, 15 nt, Mycobacterium avium subsp. paratuberculosis
ggucggucggcccgc

SEQ ID NO: 2963236 - RNA, 14 nt, Mycobacterium avium subsp. paratuberculosis
ggucggucggccgc

SEQ ID NO: 2963237 - RNA, 15 nt, Mycobacterium avium subsp. paratuberculosis
ggucggucggccgca

SEQ ID NO: 2963238 - RNA, 20 nt, Mycobacterium avium subsp. paratuberculosis
ggucggugaagugccggcug

SEQ ID NO: 2963239 - RNA, 20 nt, Mycobacterium avium subsp. paratuberculosis
ggucggugacaaagaucaca

SEQ ID NO: 2963240 - RNA, 14 nt, Mycobacterium avium subsp. paratuberculosis
ggucggugagcugg

SEQ ID NO: 2963241 - RNA, 21 nt, Mycobacterium avium subsp. paratuberculosis
ggucggugagcuggccgcgca

SEQ ID NO: 2963242 - RNA, 22 nt, Mycobacterium avium subsp. paratuberculosis
ggucggugagcuggccgcgcag

SEQ ID NO: 2963243 - RNA, 15 nt, Mycobacterium avium subsp. paratuberculosis
ggucggugaggcugg

SEQ ID NO: 2963244 - RNA, 15 nt, Mycobacterium avium subsp. paratuberculosis
ggucggugcccagca

SEQ ID NO: 2963245 - RNA, 21 nt, Mycobacterium avium subsp. paratuberculosis
ggucggugcccagcaccgccg

SEQ ID NO: 2963246 - RNA, 14 nt, Mycobacterium avium subsp. paratuberculosis
ggucggugcgcagc

SEQ ID NO: 2963247 - RNA, 13 nt, Mycobacterium avium subsp. paratuberculosis
ggucggugcgcgg

SEQ ID NO: 2963248 - RNA, 15 nt, Mycobacterium avium subsp. paratuberculosis
ggucgguggccacca

SEQ ID NO: 2963249 - RNA, 20 nt, Mycobacterium avium subsp. paratuberculosis
ggucgguggcccagccggcc

SEQ ID NO: 2963250 - RNA, 11 nt, Mycobacterium avium subsp. paratuberculosis
ggucgguggcg

SEQ ID NO: 2963251 - RNA, 15 nt, Mycobacterium avium subsp. paratuberculosis
ggucgguggcgauga

SEQ ID NO: 2963252 - RNA, 15 nt, Mycobacterium avium subsp. paratuberculosis
ggucgguggcggugc

SEQ ID NO: 2963253 - RNA, 14 nt, Mycobacterium avium subsp. paratuberculosis
ggucgguggugauc

SEQ ID NO: 2963254 - RNA, 15 nt, Mycobacterium avium subsp. paratuberculosis
ggucggugguucgcg

SEQ ID NO: 2963255 - RNA, 16 nt, Mycobacterium avium subsp. paratuberculosis
ggucggugguucgcgc

SEQ ID NO: 2963256 - RNA, 17 nt, Mycobacterium avium subsp. paratuberculosis
ggucggugguucgcgcg

SEQ ID NO: 2963257 - RNA, 22 nt, Mycobacterium avium subsp. paratuberculosis
ggucgguucauccacucggcca

SEQ ID NO: 2963258 - RNA, 15 nt, Mycobacterium avium subsp. paratuberculosis
ggucguaccaccacc

SEQ ID NO: 2963259 - RNA, 22 nt, Mycobacterium avium subsp. paratuberculosis
ggucguaccaccaccagucggc

SEQ ID NO: 2963260 - RNA, 17 nt, Mycobacterium avium subsp. paratuberculosis
ggucguagaugguccgc

SEQ ID NO: 2963261 - RNA, 18 nt, Mycobacterium avium subsp. paratuberculosis
ggucguagaugguccgca

SEQ ID NO: 2963262 - RNA, 16 nt, Mycobacterium avium subsp. paratuberculosis
ggucguagcgucgggg

SEQ ID NO: 2963263 - RNA, 15 nt, Mycobacterium avium subsp. paratuberculosis
ggucguagucggccc

SEQ ID NO: 2963264 - RNA, 17 nt, Mycobacterium avium subsp. paratuberculosis
ggucguagucggcccgc

SEQ ID NO: 2963265 - RNA, 16 nt, Mycobacterium avium subsp. paratuberculosis
ggucgucaacgacccg

SEQ ID NO: 2963266 - RNA, 17 nt, Mycobacterium avium subsp. paratuberculosis
ggucgucaacgacccgg

SEQ ID NO: 2963267 - RNA, 18 nt, Mycobacterium avium subsp. paratuberculosis
ggucgucgacgagcccgc

SEQ ID NO: 2963268 - RNA, 14 nt, Mycobacterium avium subsp. paratuberculosis
ggucgucgacgucc

SEQ ID NO: 2963269 - RNA, 22 nt, Mycobacterium avium subsp. paratuberculosis
ggucgucgacguccucgaugcc

SEQ ID NO: 2963270 - RNA, 21 nt, Mycobacterium avium subsp. paratuberculosis
ggucgucgacgucggacgcgg

SEQ ID NO: 2963271 - RNA, 19 nt, Mycobacterium avium subsp. paratuberculosis
ggucgucgcccaccgacgc

SEQ ID NO: 2963272 - RNA, 19 nt, Mycobacterium avium subsp. paratuberculosis
ggucgucgcggccaacgcc

SEQ ID NO: 2963273 - RNA, 18 nt, Mycobacterium avium subsp. paratuberculosis
ggucgucgcgguccacgc

SEQ ID NO: 2963274 - RNA, 19 nt, Mycobacterium avium subsp. paratuberculosis
ggucgucgcgguccacgcc

SEQ ID NO: 2963275 - RNA, 13 nt, Mycobacterium avium subsp. paratuberculosis
ggucgucggccag

SEQ ID NO: 2963276 - RNA, 16 nt, Mycobacterium avium subsp. paratuberculosis
ggucgucggcgucgga

SEQ ID NO: 2963277 - RNA, 18 nt, Mycobacterium avium subsp. paratuberculosis
ggugaacgaggccgcgcc

SEQ ID NO: 2963278 - RNA, 18 nt, Mycobacterium avium subsp. paratuberculosis
ggugaacgccggugaggu

SEQ ID NO: 2963279 - RNA, 16 nt, Mycobacterium avium subsp. paratuberculosis
ggugaacgcgucgguc

SEQ ID NO: 2963280 - RNA, 15 nt, Mycobacterium avium subsp. paratuberculosis
ggugaacgggccgca

SEQ ID NO: 2963281 - RNA, 16 nt, Mycobacterium avium subsp. paratuberculosis
ggugaacugguugacg

SEQ ID NO: 2963282 - RNA, 20 nt, Mycobacterium avium subsp. paratuberculosis
ggugaagccgcggacggcga

SEQ ID NO: 2963283 - RNA, 17 nt, Mycobacterium avium subsp. paratuberculosis
ggugaagccgugcacgc

SEQ ID NO: 2963284 - RNA, 19 nt, Mycobacterium avium subsp. paratuberculosis
ggugaagccgugcacgccg

SEQ ID NO: 2963285 - RNA, 21 nt, Mycobacterium avium subsp. paratuberculosis
ggugaagcugccgaccaggaa

SEQ ID NO: 2963286 - RNA, 17 nt, Mycobacterium avium subsp. paratuberculosis
ggugaaggccuggaugc

SEQ ID NO: 2963287 - RNA, 20 nt, Mycobacterium avium subsp. paratuberculosis
ggugaaggcggccaccgcgg

SEQ ID NO: 2963288 - RNA, 19 nt, Mycobacterium avium subsp. paratuberculosis
ggugaaggugccccacgcc

SEQ ID NO: 2963289 - RNA, 20 nt, Mycobacterium avium subsp. paratuberculosis
ggugaagucggugcccagcg

SEQ ID NO: 2963290 - RNA, 12 nt, Mycobacterium avium subsp. paratuberculosis
ggugaagucguu

SEQ ID NO: 2963291 - RNA, 20 nt, Mycobacterium avium subsp. paratuberculosis
ggugaaguugccggucaggc

SEQ ID NO: 2963292 - RNA, 18 nt, Mycobacterium avium subsp. paratuberculosis
ggugaaguuggcggcggu

SEQ ID NO: 2963293 - RNA, 20 nt, Mycobacterium avium subsp. paratuberculosis
ggugaaguuggcggcgguga

SEQ ID NO: 2963294 - RNA, 21 nt, Mycobacterium avium subsp. paratuberculosis
ggugaauaccacugcgcgccc

SEQ ID NO: 2963295 - RNA, 18 nt, Mycobacterium avium subsp. paratuberculosis
ggugaauucaucgucccc

SEQ ID NO: 2963296 - RNA, 15 nt, Mycobacterium avium subsp. paratuberculosis
ggugaauugggcgag

SEQ ID NO: 2963297 - RNA, 15 nt, Mycobacterium avium subsp. paratuberculosis
ggugacaacgguggu

SEQ ID NO: 2963298 - RNA, 13 nt, Mycobacterium avium subsp. paratuberculosis
ggugacaugaugg

SEQ ID NO: 2963299 - RNA, 23 nt, Mycobacterium avium subsp. paratuberculosis
ggugaccaccugcaccugcggca

SEQ ID NO: 2963300 - RNA, 17 nt, Mycobacterium avium subsp. paratuberculosis
ggugaccacggucggcg

SEQ ID NO: 2963301 - RNA, 20 nt, Mycobacterium avium subsp. paratuberculosis
ggugaccagcgcccccgaca

SEQ ID NO: 2963302 - RNA, 19 nt, Mycobacterium avium subsp. paratuberculosis
ggugacccaauccggcuga

SEQ ID NO: 2963303 - RNA, 18 nt, Mycobacterium avium subsp. paratuberculosis
ggugaccccgucgaacga

SEQ ID NO: 2963304 - RNA, 20 nt, Mycobacterium avium subsp. paratuberculosis
ggugaccgacgacgugacga

SEQ ID NO: 2963305 - RNA, 18 nt, Mycobacterium avium subsp. paratuberculosis
ggugaccgagucgucgcg

SEQ ID NO: 2963306 - RNA, 22 nt, Mycobacterium avium subsp. paratuberculosis
ggugaccgagucgucgcgcacc

SEQ ID NO: 2963307 - RNA, 14 nt, Mycobacterium avium subsp. paratuberculosis
ggugaccgcgacgc

SEQ ID NO: 2963308 - RNA, 16 nt, Mycobacterium avium subsp. paratuberculosis
ggugaccgcgccgcgg

SEQ ID NO: 2963309 - RNA, 17 nt, Mycobacterium avium subsp. paratuberculosis
ggugaccgcgccgcggg

SEQ ID NO: 2963310 - RNA, 23 nt, Mycobacterium avium subsp. paratuberculosis
ggugaccggccugagacgacgcc

SEQ ID NO: 2963311 - RNA, 15 nt, Mycobacterium avium subsp. paratuberculosis
ggugaccggcgaggu

SEQ ID NO: 2963312 - RNA, 20 nt, Mycobacterium avium subsp. paratuberculosis
ggugaccggcgaggugcgcc

SEQ ID NO: 2963313 - RNA, 18 nt, Mycobacterium avium subsp. paratuberculosis
ggugaccggcgcgcagca

SEQ ID NO: 2963314 - RNA, 18 nt, Mycobacterium avium subsp. paratuberculosis
ggugaccggcgcgcccga

SEQ ID NO: 2963315 - RNA, 19 nt, Mycobacterium avium subsp. paratuberculosis
ggugaccggcgcgcccgag

SEQ ID NO: 2963316 - RNA, 16 nt, Mycobacterium avium subsp. paratuberculosis
ggugaccggcggccag

SEQ ID NO: 2963317 - RNA, 21 nt, Mycobacterium avium subsp. paratuberculosis
ggugaccguacucgugggcca

SEQ ID NO: 2963318 - RNA, 16 nt, Mycobacterium avium subsp. paratuberculosis
ggugaccgucgccgac

SEQ ID NO: 2963319 - RNA, 11 nt, Mycobacterium avium subsp. paratuberculosis
ggugaccucga

SEQ ID NO: 2963320 - RNA, 12 nt, Mycobacterium avium subsp. paratuberculosis
ggugaccucgaa

SEQ ID NO: 2963321 - RNA, 19 nt, Mycobacterium avium subsp. paratuberculosis
ggugaccucgagcaccggc

SEQ ID NO: 2963322 - RNA, 22 nt, Mycobacterium avium subsp. paratuberculosis
ggugaccucgagcagcgcgcgc

SEQ ID NO: 2963323 - RNA, 13 nt, Mycobacterium avium subsp. paratuberculosis
ggugaccucgguc

SEQ ID NO: 2963324 - RNA, 19 nt, Mycobacterium avium subsp. paratuberculosis
ggugaccucgucgggcgcc

SEQ ID NO: 2963325 - RNA, 20 nt, Mycobacterium avium subsp. paratuberculosis
ggugaccucgucgggcgcca

SEQ ID NO: 2963326 - RNA, 23 nt, Mycobacterium avium subsp. paratuberculosis
ggugaccucgucgggcgccagcc

SEQ ID NO: 2963327 - RNA, 14 nt, Mycobacterium avium subsp. paratuberculosis
ggugaccugcacgc

SEQ ID NO: 2963328 - RNA, 23 nt, Mycobacterium avium subsp. paratuberculosis
ggugaccugcggaucgcgggcga

SEQ ID NO: 2963329 - RNA, 23 nt, Mycobacterium avium subsp. paratuberculosis
ggugaccuugcgggcggucagca

SEQ ID NO: 2963330 - RNA, 18 nt, Mycobacterium avium subsp. paratuberculosis
ggugacgaacucaagggc

SEQ ID NO: 2963331 - RNA, 22 nt, Mycobacterium avium subsp. paratuberculosis
ggugacgaacucaagggcguca

SEQ ID NO: 2963332 - RNA, 19 nt, Mycobacterium avium subsp. paratuberculosis
ggugacgaccggcagccgc

SEQ ID NO: 2963333 - RNA, 22 nt, Mycobacterium avium subsp. paratuberculosis
ggugacgaccggcagccgcgcc

SEQ ID NO: 2963334 - RNA, 18 nt, Mycobacterium avium subsp. paratuberculosis
ggugacgaggaggguguc

SEQ ID NO: 2963335 - RNA, 20 nt, Mycobacterium avium subsp. paratuberculosis
ggugacgaggagggugucgg

SEQ ID NO: 2963336 - RNA, 22 nt, Mycobacterium avium subsp. paratuberculosis
ggugacgauccacagcgcgaau

SEQ ID NO: 2963337 - RNA, 23 nt, Mycobacterium avium subsp. paratuberculosis
ggugacgaugucgaugacggcgg

SEQ ID NO: 2963338 - RNA, 12 nt, Mycobacterium avium subsp. paratuberculosis
ggugacgcccgu

SEQ ID NO: 2963339 - RNA, 15 nt, Mycobacterium avium subsp. paratuberculosis
ggugacgccgcacga

SEQ ID NO: 2963340 - RNA, 15 nt, Mycobacterium avium subsp. paratuberculosis
ggugacgcgccggcc

SEQ ID NO: 2963341 - RNA, 14 nt, Mycobacterium avium subsp. paratuberculosis
ggugacgcucaccc

SEQ ID NO: 2963342 - RNA, 19 nt, Mycobacterium avium subsp. paratuberculosis
ggugacgcucacccggccc

SEQ ID NO: 2963343 - RNA, 11 nt, Mycobacterium avium subsp. paratuberculosis
ggugacgcuga

SEQ ID NO: 2963344 - RNA, 20 nt, Mycobacterium avium subsp. paratuberculosis
ggugacggauguggucggcc

SEQ ID NO: 2963345 - RNA, 17 nt, Mycobacterium avium subsp. paratuberculosis
ggugacggccgugaugc

SEQ ID NO: 2963346 - RNA, 16 nt, Mycobacterium avium subsp. paratuberculosis
ggugacggcgucggcg

SEQ ID NO: 2963347 - RNA, 14 nt, Mycobacterium avium subsp. paratuberculosis
ggugacggucaggg

SEQ ID NO: 2963348 - RNA, 20 nt, Mycobacterium avium subsp. paratuberculosis
ggugacggucaugccgagcc

SEQ ID NO: 2963349 - RNA, 23 nt, Mycobacterium avium subsp. paratuberculosis
ggugacgguuuuggucugcgccg

SEQ ID NO: 2963350 - RNA, 14 nt, Mycobacterium avium subsp. paratuberculosis
ggugacgucgccga

SEQ ID NO: 2963351 - RNA, 13 nt, Mycobacterium avium subsp. paratuberculosis
ggugacgucgcgc

SEQ ID NO: 2963352 - RNA, 17 nt, Mycobacterium avium subsp. paratuberculosis
ggugacguggcggccgu

SEQ ID NO: 2963353 - RNA, 18 nt, Mycobacterium avium subsp. paratuberculosis
ggugacguggcggccguc

SEQ ID NO: 2963354 - RNA, 18 nt, Mycobacterium avium subsp. paratuberculosis
ggugacguuccagccgug

SEQ ID NO: 2963355 - RNA, 23 nt, Mycobacterium avium subsp. paratuberculosis
ggugacuccuccucggccagccc

SEQ ID NO: 2963356 - RNA, 18 nt, Mycobacterium avium subsp. paratuberculosis
ggugacuucgagccgggc

SEQ ID NO: 2963357 - RNA, 21 nt, Mycobacterium avium subsp. paratuberculosis
ggugacuucgagccgggcgcg

SEQ ID NO: 2963358 - RNA, 14 nt, Mycobacterium avium subsp. paratuberculosis
ggugacuucgaugu

SEQ ID NO: 2963359 - RNA, 19 nt, Mycobacterium avium subsp. paratuberculosis
ggugagaaaagcgaccagc

SEQ ID NO: 2963360 - RNA, 18 nt, Mycobacterium avium subsp. paratuberculosis
ggugagaaagucgaucug

SEQ ID NO: 2963361 - RNA, 20 nt, Mycobacterium avium subsp. paratuberculosis
ggugaugucacccucgaggc

SEQ ID NO: 2963362 - RNA, 22 nt, Mycobacterium avium subsp. paratuberculosis
ggugaugucacccucgaggccg

SEQ ID NO: 2963363 - RNA, 22 nt, Mycobacterium avium subsp. paratuberculosis
ggugaugucgacgucgucgacc

SEQ ID NO: 2963364 - RNA, 14 nt, Mycobacterium avium subsp. paratuberculosis
ggugaugucgccga

SEQ ID NO: 2963365 - RNA, 21 nt, Mycobacterium avium subsp. paratuberculosis
ggugaugucgcugccgccgcc

SEQ ID NO: 2963366 - RNA, 19 nt, Mycobacterium avium subsp. paratuberculosis
ggugaugucggugagcgcc

SEQ ID NO: 2963367 - RNA, 14 nt, Mycobacterium avium subsp. paratuberculosis
ggugaugugcagga

SEQ ID NO: 2963368 - RNA, 21 nt, Mycobacterium avium subsp. paratuberculosis
ggugaugugcggcgcggcggu

SEQ ID NO: 2963369 - RNA, 22 nt, Mycobacterium avium subsp. paratuberculosis
ggugaugugcggcgcggcggug

SEQ ID NO: 2963370 - RNA, 21 nt, Mycobacterium avium subsp. paratuberculosis
ggugauguuggccgcgacgcc

SEQ ID NO: 2963371 - RNA, 20 nt, Mycobacterium avium subsp. paratuberculosis
ggugauuccggcacccgcca

SEQ ID NO: 2963372 - RNA, 19 nt, Mycobacterium avium subsp. paratuberculosis
ggugauucgcgcggcgccc

SEQ ID NO: 2963373 - RNA, 22 nt, Mycobacterium avium subsp. paratuberculosis
ggugcaacacucgagcgcgcuc

SEQ ID NO: 2963374 - RNA, 16 nt, Mycobacterium avium subsp. paratuberculosis
ggugcaacgccgccga

SEQ ID NO: 2963375 - RNA, 23 nt, Mycobacterium avium subsp. paratuberculosis
ggugcaacgccgccgacagcacc

SEQ ID NO: 2963376 - RNA, 16 nt, Mycobacterium avium subsp. paratuberculosis
ggugcacagcccgugc

SEQ ID NO: 2963377 - RNA, 14 nt, Mycobacterium avium subsp. paratuberculosis
ggugcaccacccag

SEQ ID NO: 2963378 - RNA, 15 nt, Mycobacterium avium subsp. paratuberculosis
ggugcaccacccagg

SEQ ID NO: 2963379 - RNA, 21 nt, Mycobacterium avium subsp. paratuberculosis
ggugcaccacccaggccaccc

SEQ ID NO: 2963380 - RNA, 15 nt, Mycobacterium avium subsp. paratuberculosis
ggugcaccgccagcg

SEQ ID NO: 2963381 - RNA, 12 nt, Mycobacterium avium subsp. paratuberculosis
ggugcaccgcgc

SEQ ID NO: 2963382 - RNA, 21 nt, Mycobacterium avium subsp. paratuberculosis
ggugcaccgcgcgcaccacgu

SEQ ID NO: 2963383 - RNA, 23 nt, Mycobacterium avium subsp. paratuberculosis
ggugcacgaacggcacguugccc

SEQ ID NO: 2963384 - RNA, 15 nt, Mycobacterium avium subsp. paratuberculosis
ggugcacgagcgucg

SEQ ID NO: 2963385 - RNA, 18 nt, Mycobacterium avium subsp. paratuberculosis
ggugcacgccgagcagca

SEQ ID NO: 2963386 - RNA, 22 nt, Mycobacterium avium subsp. paratuberculosis
ggugcacgccgagcagcaccgg

SEQ ID NO: 2963387 - RNA, 14 nt, Mycobacterium avium subsp. paratuberculosis
ggugcacggcgcca

SEQ ID NO: 2963388 - RNA, 16 nt, Mycobacterium avium subsp. paratuberculosis
ggugcacggucagcuc

SEQ ID NO: 2963389 - RNA, 22 nt, Mycobacterium avium subsp. paratuberculosis
ggugcacggucagcucgcgccc

SEQ ID NO: 2963390 - RNA, 22 nt, Mycobacterium avium subsp. paratuberculosis
ggugcagaccccggcguccagu

SEQ ID NO: 2963391 - RNA, 15 nt, Mycobacterium avium subsp. paratuberculosis
ggugcagacgugacg

SEQ ID NO: 2963392 - RNA, 22 nt, Mycobacterium avium subsp. paratuberculosis
ggugcagauagguggucuccca

SEQ ID NO: 2963393 - RNA, 21 nt, Mycobacterium avium subsp. paratuberculosis
ggugcagcaccacgaacgcug

SEQ ID NO: 2963394 - RNA, 18 nt, Mycobacterium avium subsp. paratuberculosis
ggugcagcagcagccacg

SEQ ID NO: 2963395 - RNA, 15 nt, Mycobacterium avium subsp. paratuberculosis
ggugcagcagcugga

SEQ ID NO: 2963396 - RNA, 23 nt, Mycobacterium avium subsp. paratuberculosis
ggugcagccccgcacugaacggg

SEQ ID NO: 2963397 - RNA, 13 nt, Mycobacterium avium subsp. paratuberculosis
ggugcagccgcgg

SEQ ID NO: 2963398 - RNA, 14 nt, Mycobacterium avium subsp. paratuberculosis
ggugcagccggggg

SEQ ID NO: 2963399 - RNA, 19 nt, Mycobacterium avium subsp. paratuberculosis
ggugcagccgggggcggug

SEQ ID NO: 2963400 - RNA, 21 nt, Mycobacterium avium subsp. paratuberculosis
ggugcagccgggggcggugca

SEQ ID NO: 2963401 - RNA, 14 nt, Mycobacterium avium subsp. paratuberculosis
ggugcagccgggug

SEQ ID NO: 2963402 - RNA, 13 nt, Mycobacterium avium subsp. paratuberculosis
ggugcagcgacuc

SEQ ID NO: 2963403 - RNA, 21 nt, Mycobacterium avium subsp. paratuberculosis
ggugcagcgacucguuggccg

SEQ ID NO: 2963404 - RNA, 17 nt, Mycobacterium avium subsp. paratuberculosis
ggugcagcgggcuggcg

SEQ ID NO: 2963405 - RNA, 14 nt, Mycobacterium avium subsp. paratuberculosis
ggugcagcuccuug

SEQ ID NO: 2963406 - RNA, 22 nt, Mycobacterium avium subsp. paratuberculosis
ggugcagcuccuugagccgccg

SEQ ID NO: 2963407 - RNA, 19 nt, Mycobacterium avium subsp. paratuberculosis
ggugcaggcccagcugcug

SEQ ID NO: 2963408 - RNA, 17 nt, Mycobacterium avium subsp. paratuberculosis
ggugcaggcccgggcgg

SEQ ID NO: 2963409 - RNA, 19 nt, Mycobacterium avium subsp. paratuberculosis
ggugcaggcccgggcggcg

SEQ ID NO: 2963410 - RNA, 13 nt, Mycobacterium avium subsp. paratuberculosis
ggugcaggccgcg

SEQ ID NO: 2963411 - RNA, 22 nt, Mycobacterium avium subsp. paratuberculosis
ggugcaggugcccgucggccuc

SEQ ID NO: 2963412 - RNA, 21 nt, Mycobacterium avium subsp. paratuberculosis
ggugcaguacgcaucggcgcc

SEQ ID NO: 2963413 - RNA, 22 nt, Mycobacterium avium subsp. paratuberculosis
ggugcaguacgcaucggcgccg

SEQ ID NO: 2963414 - RNA, 21 nt, Mycobacterium avium subsp. paratuberculosis
ggugcauccagucggcgccga

SEQ ID NO: 2963415 - RNA, 21 nt, Mycobacterium avium subsp. paratuberculosis
ggugcaucgaccggcggaagu

SEQ ID NO: 2963416 - RNA, 18 nt, Mycobacterium avium subsp. paratuberculosis
ggugcaucgccaccgucg

SEQ ID NO: 2963417 - RNA, 17 nt, Mycobacterium avium subsp. paratuberculosis
ggugccaaggucgccgg

SEQ ID NO: 2963418 - RNA, 13 nt, Mycobacterium avium subsp. paratuberculosis
ggugccacgauga

SEQ ID NO: 2963419 - RNA, 16 nt, Mycobacterium avium subsp. paratuberculosis
ggugccacggucaggc

SEQ ID NO: 2963420 - RNA, 12 nt, Mycobacterium avium subsp. paratuberculosis
ggugccagcaac

SEQ ID NO: 2963421 - RNA, 18 nt, Mycobacterium avium subsp. paratuberculosis
ggugccagccgugcggcg

SEQ ID NO: 2963422 - RNA, 14 nt, Mycobacterium avium subsp. paratuberculosis
ggugcccaccagca

SEQ ID NO: 2963423 - RNA, 17 nt, Mycobacterium avium subsp. paratuberculosis
ggugcccaccgggcagc

SEQ ID NO: 2963424 - RNA, 18 nt, Mycobacterium avium subsp. paratuberculosis
ggugcccaccgggcagcc

SEQ ID NO: 2963425 - RNA, 14 nt, Mycobacterium avium subsp. paratuberculosis
ggugcccagccagg

SEQ ID NO: 2963426 - RNA, 21 nt, Mycobacterium avium subsp. paratuberculosis
ggugcccagccaggccgccgg

SEQ ID NO: 2963427 - RNA, 19 nt, Mycobacterium avium subsp. paratuberculosis
ggugcccaggucgcccaga

SEQ ID NO: 2963428 - RNA, 15 nt, Mycobacterium avium subsp. paratuberculosis
ggugccccacgccau

SEQ ID NO: 2963429 - RNA, 16 nt, Mycobacterium avium subsp. paratuberculosis
ggugcccccgcccggc

SEQ ID NO: 2963430 - RNA, 17 nt, Mycobacterium avium subsp. paratuberculosis
ggugcccccgcccggcc

SEQ ID NO: 2963431 - RNA, 19 nt, Mycobacterium avium subsp. paratuberculosis
ggugcccccgcccggccgg

SEQ ID NO: 2963432 - RNA, 15 nt, Mycobacterium avium subsp. paratuberculosis
ggugccccgcaccgc

SEQ ID NO: 2963433 - RNA, 23 nt, Mycobacterium avium subsp. paratuberculosis
ggugccccgccguuucagcagcg

SEQ ID NO: 2963434 - RNA, 14 nt, Mycobacterium avium subsp. paratuberculosis
ggugccccgcgacc

SEQ ID NO: 2963435 - RNA, 17 nt, Mycobacterium avium subsp. paratuberculosis
ggugccccgcgaccgca

SEQ ID NO: 2963436 - RNA, 20 nt, Mycobacterium avium subsp. paratuberculosis
ggugcccgagcugaucgcgg

SEQ ID NO: 2963437 - RNA, 24 nt, Mycobacterium avium subsp. paratuberculosis
ggugcccgagcugaucgcggccgg

SEQ ID NO: 2963438 - RNA, 16 nt, Mycobacterium avium subsp. paratuberculosis
ggugcccgcagcauca

SEQ ID NO: 2963439 - RNA, 18 nt, Mycobacterium avium subsp. paratuberculosis
ggugcccgcaucgccgaa

SEQ ID NO: 2963440 - RNA, 18 nt, Mycobacterium avium subsp. paratuberculosis
ggugcccgccgcgaccgc

SEQ ID NO: 2963441 - RNA, 18 nt, Mycobacterium avium subsp. paratuberculosis
ggugcccgcguacagcgg

SEQ ID NO: 2963442 - RNA, 19 nt, Mycobacterium avium subsp. paratuberculosis
ggugcccgcguacagcggg

SEQ ID NO: 2963443 - RNA, 19 nt, Mycobacterium avium subsp. paratuberculosis
ggugcccggcugggcgcgc

SEQ ID NO: 2963444 - RNA, 12 nt, Mycobacterium avium subsp. paratuberculosis
ggugcccuccuc

SEQ ID NO: 2963445 - RNA, 20 nt, Mycobacterium avium subsp. paratuberculosis
ggugcgccgcucgucggcca

SEQ ID NO: 2963446 - RNA, 12 nt, Mycobacterium avium subsp. paratuberculosis
ggugcgccggca

SEQ ID NO: 2963447 - RNA, 15 nt, Mycobacterium avium subsp. paratuberculosis
ggugcgccggcagcg

SEQ ID NO: 2963448 - RNA, 14 nt, Mycobacterium avium subsp. paratuberculosis
ggugcgccgggucg

SEQ ID NO: 2963449 - RNA, 18 nt, Mycobacterium avium subsp. paratuberculosis
ggugcgcgagauggcgau

SEQ ID NO: 2963450 - RNA, 14 nt, Mycobacterium avium subsp. paratuberculosis
ggugcgcgccggcg

SEQ ID NO: 2963451 - RNA, 12 nt, Mycobacterium avium subsp. paratuberculosis
ggugcgcggcga

SEQ ID NO: 2963452 - RNA, 15 nt, Mycobacterium avium subsp. paratuberculosis
ggugcgcggcgaagg

SEQ ID NO: 2963453 - RNA, 15 nt, Mycobacterium avium subsp. paratuberculosis
ggugcgcggcgagcg

SEQ ID NO: 2963454 - RNA, 14 nt, Mycobacterium avium subsp. paratuberculosis
ggugcgcggcgccg

SEQ ID NO: 2963455 - RNA, 14 nt, Mycobacterium avium subsp. paratuberculosis
ggugcgcggggugg

SEQ ID NO: 2963456 - RNA, 15 nt, Mycobacterium avium subsp. paratuberculosis
ggugcgcggucagcg

SEQ ID NO: 2963457 - RNA, 17 nt, Mycobacterium avium subsp. paratuberculosis
ggugcgcgucagccguc

SEQ ID NO: 2963458 - RNA, 15 nt, Mycobacterium avium subsp. paratuberculosis
ggugcgcucaccgca

SEQ ID NO: 2963459 - RNA, 19 nt, Mycobacterium avium subsp. paratuberculosis
ggugcgcucaccgcaucga

SEQ ID NO: 2963460 - RNA, 14 nt, Mycobacterium avium subsp. paratuberculosis
ggugcgcucgacgg

SEQ ID NO: 2963461 - RNA, 21 nt, Mycobacterium avium subsp. paratuberculosis
ggugcgcucgacggccugcac

SEQ ID NO: 2963462 - RNA, 22 nt, Mycobacterium avium subsp. paratuberculosis
ggugcgcucgugaccggcggug

SEQ ID NO: 2963463 - RNA, 16 nt, Mycobacterium avium subsp. paratuberculosis
ggugcgcuggccgacc

SEQ ID NO: 2963464 - RNA, 13 nt, Mycobacterium avium subsp. paratuberculosis
ggugcggaacacc

SEQ ID NO: 2963465 - RNA, 13 nt, Mycobacterium avium subsp. paratuberculosis
ggugcggacccgu

SEQ ID NO: 2963466 - RNA, 17 nt, Mycobacterium avium subsp. paratuberculosis
ggugcggacggucgccg

SEQ ID NO: 2963467 - RNA, 18 nt, Mycobacterium avium subsp. paratuberculosis
ggugcggacggucgccga

SEQ ID NO: 2963468 - RNA, 20 nt, Mycobacterium avium subsp. paratuberculosis
ggugcggacggucgccgacg

SEQ ID NO: 2963469 - RNA, 22 nt, Mycobacterium avium subsp. paratuberculosis
ggugcggaugaagugcgccagc

SEQ ID NO: 2963470 - RNA, 21 nt, Mycobacterium avium subsp. paratuberculosis
ggugcggcaacccgaucgccg

SEQ ID NO: 2963471 - RNA, 12 nt, Mycobacterium avium subsp. paratuberculosis
ggugcggcaccu

SEQ ID NO: 2963472 - RNA, 13 nt, Mycobacterium avium subsp. paratuberculosis
ggugcggcaccuc

SEQ ID NO: 2963473 - RNA, 14 nt, Mycobacterium avium subsp. paratuberculosis
ggugcggcccgcgg

SEQ ID NO: 2963474 - RNA, 16 nt, Mycobacterium avium subsp. paratuberculosis
ggugcggcccgcggca

SEQ ID NO: 2963475 - RNA, 13 nt, Mycobacterium avium subsp. paratuberculosis
ggugcggccgcgc

SEQ ID NO: 2963476 - RNA, 20 nt, Mycobacterium avium subsp. paratuberculosis
ggugcggccgcgcagcucga

SEQ ID NO: 2963477 - RNA, 14 nt, Mycobacterium avium subsp. paratuberculosis
ggugcggcgcucgg

SEQ ID NO: 2963478 - RNA, 18 nt, Mycobacterium avium subsp. paratuberculosis
ggugcggcgcucggugug

SEQ ID NO: 2963479 - RNA, 15 nt, Mycobacterium avium subsp. paratuberculosis
ggugcggcgugcggu

SEQ ID NO: 2963480 - RNA, 14 nt, Mycobacterium avium subsp. paratuberculosis
ggugcgggccagca

SEQ ID NO: 2963481 - RNA, 19 nt, Mycobacterium avium subsp. paratuberculosis
ggugcgggcggggcccggg

SEQ ID NO: 2963482 - RNA, 16 nt, Mycobacterium avium subsp. paratuberculosis
ggugcgggcugcacca

SEQ ID NO: 2963483 - RNA, 20 nt, Mycobacterium avium subsp. paratuberculosis
ggugcggggacagugcgggc

SEQ ID NO: 2963484 - RNA, 22 nt, Mycobacterium avium subsp. paratuberculosis
ggugcggggccgcggccggcac

SEQ ID NO: 2963485 - RNA, 20 nt, Mycobacterium avium subsp. paratuberculosis
ggugcgggucacacccucgg

SEQ ID NO: 2963486 - RNA, 16 nt, Mycobacterium avium subsp. paratuberculosis
ggugcgggugcggccg

SEQ ID NO: 2963487 - RNA, 17 nt, Mycobacterium avium subsp. paratuberculosis
ggugcgggugcggccgg

SEQ ID NO: 2963488 - RNA, 21 nt, Mycobacterium avium subsp. paratuberculosis
ggugcgggugguguggcgucg

SEQ ID NO: 2963489 - RNA, 15 nt, Mycobacterium avium subsp. paratuberculosis
ggugcggguguccga

SEQ ID NO: 2963490 - RNA, 18 nt, Mycobacterium avium subsp. paratuberculosis
ggugcgguaggugccggc

SEQ ID NO: 2963491 - RNA, 22 nt, Mycobacterium avium subsp. paratuberculosis
ggugcgguaggugccggccgcg

SEQ ID NO: 2963492 - RNA, 15 nt, Mycobacterium avium subsp. paratuberculosis
ggugcggucgaugac

SEQ ID NO: 2963493 - RNA, 18 nt, Mycobacterium avium subsp. paratuberculosis
ggugcggucgcgcagccg

SEQ ID NO: 2963494 - RNA, 17 nt, Mycobacterium avium subsp. paratuberculosis
ggugcggugcaccgcgg

SEQ ID NO: 2963495 - RNA, 23 nt, Mycobacterium avium subsp. paratuberculosis
ggugcggugcaccgcggcgcgca

SEQ ID NO: 2963496 - RNA, 13 nt, Mycobacterium avium subsp. paratuberculosis
ggugcggugcagc

SEQ ID NO: 2963497 - RNA, 12 nt, Mycobacterium avium subsp. paratuberculosis
ggugcgguguca

SEQ ID NO: 2963498 - RNA, 16 nt, Mycobacterium avium subsp. paratuberculosis
ggugcgguugagcacc

SEQ ID NO: 2963499 - RNA, 16 nt, Mycobacterium avium subsp. paratuberculosis
ggugcguccagaccgg

SEQ ID NO: 2963500 - RNA, 22 nt, Mycobacterium avium subsp. paratuberculosis
ggugcguccagaccggccgggg

SEQ ID NO: 2963501 - RNA, 16 nt, Mycobacterium avium subsp. paratuberculosis
ggugcguccgccggcg

SEQ ID NO: 2963502 - RNA, 17 nt, Mycobacterium avium subsp. paratuberculosis
ggugcguccgccggcgg

SEQ ID NO: 2963503 - RNA, 13 nt, Mycobacterium avium subsp. paratuberculosis
ggugcgucgggcg

SEQ ID NO: 2963504 - RNA, 16 nt, Mycobacterium avium subsp. paratuberculosis
ggugcgucgggcgccg

SEQ ID NO: 2963505 - RNA, 17 nt, Mycobacterium avium subsp. paratuberculosis
ggugcgucgggcgccgg

SEQ ID NO: 2963506 - RNA, 19 nt, Mycobacterium avium subsp. paratuberculosis
ggugcgugaugaccagggc

SEQ ID NO: 2963507 - RNA, 22 nt, Mycobacterium avium subsp. paratuberculosis
ggugcguucgcguucgggcagc

SEQ ID NO: 2963508 - RNA, 15 nt, Mycobacterium avium subsp. paratuberculosis
ggugcucaccccggc

SEQ ID NO: 2963509 - RNA, 17 nt, Mycobacterium avium subsp. paratuberculosis
ggugcucaccccggcca

SEQ ID NO: 2963510 - RNA, 19 nt, Mycobacterium avium subsp. paratuberculosis
ggugcucaccccggccagg

SEQ ID NO: 2963511 - RNA, 20 nt, Mycobacterium avium subsp. paratuberculosis
ggugcucacgcuuccgugcu

SEQ ID NO: 2963512 - RNA, 23 nt, Mycobacterium avium subsp. paratuberculosis
ggugcucaucagcgacaccacgg

SEQ ID NO: 2963513 - RNA, 18 nt, Mycobacterium avium subsp. paratuberculosis
ggugcucgaucagcgacu

SEQ ID NO: 2963514 - RNA, 18 nt, Mycobacterium avium subsp. paratuberculosis
ggugcucgaucggcgcgc

SEQ ID NO: 2963515 - RNA, 10 nt, Mycobacterium avium subsp. paratuberculosis
ggugcucgcc

SEQ ID NO: 2963516 - RNA, 15 nt, Mycobacterium avium subsp. paratuberculosis
ggugcucgccggcgc

SEQ ID NO: 2963517 - RNA, 14 nt, Mycobacterium avium subsp. paratuberculosis
ggugcucgcgcagg

SEQ ID NO: 2963518 - RNA, 21 nt, Mycobacterium avium subsp. paratuberculosis
ggugcucgcgccgggcggccu

SEQ ID NO: 2963519 - RNA, 22 nt, Mycobacterium avium subsp. paratuberculosis
ggugcucgucgagcauccggcg

SEQ ID NO: 2963520 - RNA, 17 nt, Mycobacterium avium subsp. paratuberculosis
ggugcugaacgccugcc

SEQ ID NO: 2963521 - RNA, 22 nt, Mycobacterium avium subsp. paratuberculosis
ggugcugaacgccugccggcgc

SEQ ID NO: 2963522 - RNA, 20 nt, Mycobacterium avium subsp. paratuberculosis
ggugcugaaugaacgaccug

SEQ ID NO: 2963523 - RNA, 21 nt, Mycobacterium avium subsp. paratuberculosis
ggugcugacccggucgcggcc

SEQ ID NO: 2963524 - RNA, 12 nt, Mycobacterium avium subsp. paratuberculosis
ggugcugcagcg

SEQ ID NO: 2963525 - RNA, 15 nt, Mycobacterium avium subsp. paratuberculosis
ggugcugcagcgcga

SEQ ID NO: 2963526 - RNA, 15 nt, Mycobacterium avium subsp. paratuberculosis
ggugcugcccggcgc

SEQ ID NO: 2963527 - RNA, 16 nt, Mycobacterium avium subsp. paratuberculosis
ggugcugcccggcgcg

SEQ ID NO: 2963528 - RNA, 16 nt, Mycobacterium avium subsp. paratuberculosis
ggugcugccgugccga

SEQ ID NO: 2963529 - RNA, 16 nt, Mycobacterium avium subsp. paratuberculosis
ggugcugcugccccuc

SEQ ID NO: 2963530 - RNA, 14 nt, Mycobacterium avium subsp. paratuberculosis
gguggccgccacca

SEQ ID NO: 2963531 - RNA, 18 nt, Mycobacterium avium subsp. paratuberculosis
gguggccgccaccaacau

SEQ ID NO: 2963532 - RNA, 19 nt, Mycobacterium avium subsp. paratuberculosis
gguggccgccaccaacauc

SEQ ID NO: 2963533 - RNA, 16 nt, Mycobacterium avium subsp. paratuberculosis
gguggccgcggccgcc

SEQ ID NO: 2963534 - RNA, 23 nt, Mycobacterium avium subsp. paratuberculosis
gguggccgcuuuccaccccggcg

SEQ ID NO: 2963535 - RNA, 14 nt, Mycobacterium avium subsp. paratuberculosis
gguggccggccagc

SEQ ID NO: 2963536 - RNA, 12 nt, Mycobacterium avium subsp. paratuberculosis
gguggccggggc

SEQ ID NO: 2963537 - RNA, 14 nt, Mycobacterium avium subsp. paratuberculosis
gguggccggggcca

SEQ ID NO: 2963538 - RNA, 15 nt, Mycobacterium avium subsp. paratuberculosis
gguggccgggucgcc

SEQ ID NO: 2963539 - RNA, 20 nt, Mycobacterium avium subsp. paratuberculosis
gguggccgggucgccgucga

SEQ ID NO: 2963540 - RNA, 15 nt, Mycobacterium avium subsp. paratuberculosis
gguggccggugggcg

SEQ ID NO: 2963541 - RNA, 18 nt, Mycobacterium avium subsp. paratuberculosis
gguggccggugggcggcg

SEQ ID NO: 2963542 - RNA, 18 nt, Mycobacterium avium subsp. paratuberculosis
gguggccucggcgcugcc

SEQ ID NO: 2963543 - RNA, 23 nt, Mycobacterium avium subsp. paratuberculosis
gguggccucggcgcugcccgccg

SEQ ID NO: 2963544 - RNA, 18 nt, Mycobacterium avium subsp. paratuberculosis
gguggccucgucggcgcc

SEQ ID NO: 2963545 - RNA, 22 nt, Mycobacterium avium subsp. paratuberculosis
gguggccucgucggcgccgucg

SEQ ID NO: 2963546 - RNA, 16 nt, Mycobacterium avium subsp. paratuberculosis
gguggccugcccggcg

SEQ ID NO: 2963547 - RNA, 20 nt, Mycobacterium avium subsp. paratuberculosis
gguggccugcccggcggugc

SEQ ID NO: 2963548 - RNA, 21 nt, Mycobacterium avium subsp. paratuberculosis
gguggccugcccggcggugcc

SEQ ID NO: 2963549 - RNA, 22 nt, Mycobacterium avium subsp. paratuberculosis
gguggccugcccggcggugccg

SEQ ID NO: 2963550 - RNA, 23 nt, Mycobacterium avium subsp. paratuberculosis
gguggccugcccggcggugccga

SEQ ID NO: 2963551 - RNA, 16 nt, Mycobacterium avium subsp. paratuberculosis
gguggccuggucggcg

SEQ ID NO: 2963552 - RNA, 18 nt, Mycobacterium avium subsp. paratuberculosis
gguggccuucaucaccgc

SEQ ID NO: 2963553 - RNA, 20 nt, Mycobacterium avium subsp. paratuberculosis
gguggccuugacgacggcca

SEQ ID NO: 2963554 - RNA, 16 nt, Mycobacterium avium subsp. paratuberculosis
gguggccuuggccacc

SEQ ID NO: 2963555 - RNA, 19 nt, Mycobacterium avium subsp. paratuberculosis
gguggcgaacagcggguuc

SEQ ID NO: 2963556 - RNA, 16 nt, Mycobacterium avium subsp. paratuberculosis
gguggcgaacugcacc

SEQ ID NO: 2963557 - RNA, 17 nt, Mycobacterium avium subsp. paratuberculosis
gguggcgaacugcacca

SEQ ID NO: 2963558 - RNA, 22 nt, Mycobacterium avium subsp. paratuberculosis
gguggcgaacugcaccagcacg

SEQ ID NO: 2963559 - RNA, 17 nt, Mycobacterium avium subsp. paratuberculosis
gguggcgaccaccgacc

SEQ ID NO: 2963560 - RNA, 21 nt, Mycobacterium avium subsp. paratuberculosis
gguggcgacgaaccuggcugc

SEQ ID NO: 2963561 - RNA, 16 nt, Mycobacterium avium subsp. paratuberculosis
gguggcgaucaccgcg

SEQ ID NO: 2963562 - RNA, 13 nt, Mycobacterium avium subsp. paratuberculosis
gguggcgauggug

SEQ ID NO: 2963563 - RNA, 14 nt, Mycobacterium avium subsp. paratuberculosis
gguggcgcccgcgg

SEQ ID NO: 2963564 - RNA, 15 nt, Mycobacterium avium subsp. paratuberculosis
gguggcgcccgcggu

SEQ ID NO: 2963565 - RNA, 13 nt, Mycobacterium avium subsp. paratuberculosis
gguggcgcccgga

SEQ ID NO: 2963566 - RNA, 14 nt, Mycobacterium avium subsp. paratuberculosis
gguggcgcccggag

SEQ ID NO: 2963567 - RNA, 13 nt, Mycobacterium avium subsp. paratuberculosis
gguggcgccgcgc

SEQ ID NO: 2963568 - RNA, 15 nt, Mycobacterium avium subsp. paratuberculosis
gguggcgccgcgggc

SEQ ID NO: 2963569 - RNA, 14 nt, Mycobacterium avium subsp. paratuberculosis
gguggcgccggcca

SEQ ID NO: 2963570 - RNA, 16 nt, Mycobacterium avium subsp. paratuberculosis
gguggcgccggccagc

SEQ ID NO: 2963571 - RNA, 13 nt, Mycobacterium avium subsp. paratuberculosis
gguggcgcgcauc

SEQ ID NO: 2963572 - RNA, 17 nt, Mycobacterium avium subsp. paratuberculosis
gguggcgcugccgagca

SEQ ID NO: 2963573 - RNA, 11 nt, Mycobacterium avium subsp. paratuberculosis
gguggcggcca

SEQ ID NO: 2963574 - RNA, 11 nt, Mycobacterium avium subsp. paratuberculosis
gguggcggcga

SEQ ID NO: 2963575 - RNA, 13 nt, Mycobacterium avium subsp. paratuberculosis
gguggcggcgccg

SEQ ID NO: 2963576 - RNA, 15 nt, Mycobacterium avium subsp. paratuberculosis
gguggcggcgccgga

SEQ ID NO: 2963577 - RNA, 12 nt, Mycobacterium avium subsp. paratuberculosis
gguggcgggccg

SEQ ID NO: 2963578 - RNA, 18 nt, Mycobacterium avium subsp. paratuberculosis
gguggcgggccgccgggu

SEQ ID NO: 2963579 - RNA, 19 nt, Mycobacterium avium subsp. paratuberculosis
gguggcgggccgccgggug

SEQ ID NO: 2963580 - RNA, 21 nt, Mycobacterium avium subsp. paratuberculosis
gguggcgggccgccggguggc

SEQ ID NO: 2963581 - RNA, 16 nt, Mycobacterium avium subsp. paratuberculosis
gguggcggucccggcg

SEQ ID NO: 2963582 - RNA, 17 nt, Mycobacterium avium subsp. paratuberculosis
gguggcggucccggcgg

SEQ ID NO: 2963583 - RNA, 17 nt, Mycobacterium avium subsp. paratuberculosis
gguggcggugccgcggc

SEQ ID NO: 2963584 - RNA, 20 nt, Mycobacterium avium subsp. paratuberculosis
gguggcggugccgcggcggc

SEQ ID NO: 2963585 - RNA, 22 nt, Mycobacterium avium subsp. paratuberculosis
gguggcggugcggucgcgcagc

SEQ ID NO: 2963586 - RNA, 14 nt, Mycobacterium avium subsp. paratuberculosis
gguggcgguggcca

SEQ ID NO: 2963587 - RNA, 16 nt, Mycobacterium avium subsp. paratuberculosis
gguggcgguggggccg

SEQ ID NO: 2963588 - RNA, 21 nt, Mycobacterium avium subsp. paratuberculosis
gguggcgguggggccgaagcc

SEQ ID NO: 2963589 - RNA, 13 nt, Mycobacterium avium subsp. paratuberculosis
gguggcgguguuc

SEQ ID NO: 2963590 - RNA, 17 nt, Mycobacterium avium subsp. paratuberculosis
gguggcguccagcgggu

SEQ ID NO: 2963591 - RNA, 17 nt, Mycobacterium avium subsp. paratuberculosis
gguggcguccucgacgg

SEQ ID NO: 2963592 - RNA, 13 nt, Mycobacterium avium subsp. paratuberculosis
gguggcgucgccg

SEQ ID NO: 2963593 - RNA, 20 nt, Mycobacterium avium subsp. paratuberculosis
gguggcgucgccgccggugc

SEQ ID NO: 2963594 - RNA, 14 nt, Mycobacterium avium subsp. paratuberculosis
gguggcgucggcgg

SEQ ID NO: 2963595 - RNA, 17 nt, Mycobacterium avium subsp. paratuberculosis
gguggcgucggcggccu

SEQ ID NO: 2963596 - RNA, 16 nt, Mycobacterium avium subsp. paratuberculosis
gguggcgucggcgucg

SEQ ID NO: 2963597 - RNA, 22 nt, Mycobacterium avium subsp. paratuberculosis
gguggcgucggugaugccggac

SEQ ID NO: 2963598 - RNA, 23 nt, Mycobacterium avium subsp. paratuberculosis
gguggcuaccgccgggcgggccg

SEQ ID NO: 2963599 - RNA, 21 nt, Mycobacterium avium subsp. paratuberculosis
ggugggaauccacagcgguuc

SEQ ID NO: 2963600 - RNA, 15 nt, Mycobacterium avium subsp. paratuberculosis
ggugggacggcgggu

SEQ ID NO: 2963601 - RNA, 21 nt, Mycobacterium avium subsp. paratuberculosis
ggugggauccauucggucucg

SEQ ID NO: 2963602 - RNA, 16 nt, Mycobacterium avium subsp. paratuberculosis
ggugggcaccagcagc

SEQ ID NO: 2963603 - RNA, 21 nt, Mycobacterium avium subsp. paratuberculosis
ggugggcaccuggccgucggu

SEQ ID NO: 2963604 - RNA, 18 nt, Mycobacterium avium subsp. paratuberculosis
ggugggcagaugcccgcu

SEQ ID NO: 2963605 - RNA, 19 nt, Mycobacterium avium subsp. paratuberculosis
ggugggcagaugcccgcug

SEQ ID NO: 2963606 - RNA, 23 nt, Mycobacterium avium subsp. paratuberculosis
ggugggcagcgcggccagcacgg

SEQ ID NO: 2963607 - RNA, 17 nt, Mycobacterium avium subsp. paratuberculosis
ggugggcagcucggugg

SEQ ID NO: 2963608 - RNA, 15 nt, Mycobacterium avium subsp. paratuberculosis
ggugggccagucgaa

SEQ ID NO: 2963609 - RNA, 13 nt, Mycobacterium avium subsp. paratuberculosis
ggugggcccgccg

SEQ ID NO: 2963610 - RNA, 14 nt, Mycobacterium avium subsp. paratuberculosis
ggugggcccgccgu

SEQ ID NO: 2963611 - RNA, 22 nt, Mycobacterium avium subsp. paratuberculosis
ggugggcccgccgucgaccacg

SEQ ID NO: 2963612 - RNA, 16 nt, Mycobacterium avium subsp. paratuberculosis
ggugggccgccgcggc

SEQ ID NO: 2963613 - RNA, 12 nt, Mycobacterium avium subsp. paratuberculosis
ggugggcgaaca

SEQ ID NO: 2963614 - RNA, 17 nt, Mycobacterium avium subsp. paratuberculosis
ggugggcgaacagcagc

SEQ ID NO: 2963615 - RNA, 22 nt, Mycobacterium avium subsp. paratuberculosis
gguguagcggcggcugaagcgc

SEQ ID NO: 2963616 - RNA, 16 nt, Mycobacterium avium subsp. paratuberculosis
gguguagcugcggguc

SEQ ID NO: 2963617 - RNA, 13 nt, Mycobacterium avium subsp. paratuberculosis
gguguaggccgcg

SEQ ID NO: 2963618 - RNA, 22 nt, Mycobacterium avium subsp. paratuberculosis
gguguaggcgaucgggaacagc

SEQ ID NO: 2963619 - RNA, 15 nt, Mycobacterium avium subsp. paratuberculosis
gguguaguccugcuu

SEQ ID NO: 2963620 - RNA, 16 nt, Mycobacterium avium subsp. paratuberculosis
gguguaguccugcuuc

SEQ ID NO: 2963621 - RNA, 15 nt, Mycobacterium avium subsp. paratuberculosis
gguguagucgcugac

SEQ ID NO: 2963622 - RNA, 16 nt, Mycobacterium avium subsp. paratuberculosis
ggugucaccgacgcca

SEQ ID NO: 2963623 - RNA, 20 nt, Mycobacterium avium subsp. paratuberculosis
ggugucaccgacgccagcgg

SEQ ID NO: 2963624 - RNA, 20 nt, Mycobacterium avium subsp. paratuberculosis
ggugucacgcuggcgugacg

SEQ ID NO: 2963625 - RNA, 17 nt, Mycobacterium avium subsp. paratuberculosis
ggugucacguccacgcc

SEQ ID NO: 2963626 - RNA, 19 nt, Mycobacterium avium subsp. paratuberculosis
ggugucacguccacgccgc

SEQ ID NO: 2963627 - RNA, 13 nt, Mycobacterium avium subsp. paratuberculosis
ggugucagcgcga

SEQ ID NO: 2963628 - RNA, 16 nt, Mycobacterium avium subsp. paratuberculosis
ggugucaggaucgccg

SEQ ID NO: 2963629 - RNA, 13 nt, Mycobacterium avium subsp. paratuberculosis
gguguccacccgc

SEQ ID NO: 2963630 - RNA, 16 nt, Mycobacterium avium subsp. paratuberculosis
gguguccacccgcgcc

SEQ ID NO: 2963631 - RNA, 14 nt, Mycobacterium avium subsp. paratuberculosis
gguguccacgaugc

SEQ ID NO: 2963632 - RNA, 18 nt, Mycobacterium avium subsp. paratuberculosis
gguguccacgaugcggug

SEQ ID NO: 2963633 - RNA, 17 nt, Mycobacterium avium subsp. paratuberculosis
gguguccacgucgccca

SEQ ID NO: 2963634 - RNA, 19 nt, Mycobacterium avium subsp. paratuberculosis
gguguccacgucgcccagc

SEQ ID NO: 2963635 - RNA, 22 nt, Mycobacterium avium subsp. paratuberculosis
gguguccagcccuacccgucca

SEQ ID NO: 2963636 - RNA, 14 nt, Mycobacterium avium subsp. paratuberculosis
ggugucccagcgcc

SEQ ID NO: 2963637 - RNA, 21 nt, Mycobacterium avium subsp. paratuberculosis
ggugucccaguucccggcggg

SEQ ID NO: 2963638 - RNA, 13 nt, Mycobacterium avium subsp. paratuberculosis
ggugucccgcgcc

SEQ ID NO: 2963639 - RNA, 17 nt, Mycobacterium avium subsp. paratuberculosis
gguguccgagcgggccg

SEQ ID NO: 2963640 - RNA, 22 nt, Mycobacterium avium subsp. paratuberculosis
gguguccgagcgggccguggca

SEQ ID NO: 2963641 - RNA, 14 nt, Mycobacterium avium subsp. paratuberculosis
gguguccgcgggca

SEQ ID NO: 2963642 - RNA, 17 nt, Mycobacterium avium subsp. paratuberculosis
gguguccuugcgcacca

SEQ ID NO: 2963643 - RNA, 20 nt, Mycobacterium avium subsp. paratuberculosis
gguguccuugcgcaccacgu

SEQ ID NO: 2963644 - RNA, 19 nt, Mycobacterium avium subsp. paratuberculosis
ggugucgaaaccgcccagu

SEQ ID NO: 2963645 - RNA, 18 nt, Mycobacterium avium subsp. paratuberculosis
ggugucgaaggccggggu

SEQ ID NO: 2963646 - RNA, 13 nt, Mycobacterium avium subsp. paratuberculosis
ggugucgacgccg

SEQ ID NO: 2963647 - RNA, 14 nt, Mycobacterium avium subsp. paratuberculosis
ggugucgagccggu

SEQ ID NO: 2963648 - RNA, 18 nt, Mycobacterium avium subsp. paratuberculosis
ggugucgagccggugccg

SEQ ID NO: 2963649 - RNA, 14 nt, Mycobacterium avium subsp. paratuberculosis
ggugucgagggcca

SEQ ID NO: 2963650 - RNA, 20 nt, Mycobacterium avium subsp. paratuberculosis
ggugucgaggucgucggcca

SEQ ID NO: 2963651 - RNA, 23 nt, Mycobacterium avium subsp. paratuberculosis
ggugucgauagugaacgccucgg

SEQ ID NO: 2963652 - RNA, 14 nt, Mycobacterium avium subsp. paratuberculosis
ggugucgcccucgc

SEQ ID NO: 2963653 - RNA, 14 nt, Mycobacterium avium subsp. paratuberculosis
ggugucgccgagcc

SEQ ID NO: 2963654 - RNA, 18 nt, Mycobacterium avium subsp. paratuberculosis
ggugucgccgagccgcac

SEQ ID NO: 2963655 - RNA, 19 nt, Mycobacterium avium subsp. paratuberculosis
ggugucgccgagccgcacc

SEQ ID NO: 2963656 - RNA, 23 nt, Mycobacterium avium subsp. paratuberculosis
ggugucgccgauuucggugucga

SEQ ID NO: 2963657 - RNA, 15 nt, Mycobacterium avium subsp. paratuberculosis
ggugucgccgucgcc

SEQ ID NO: 2963658 - RNA, 23 nt, Mycobacterium avium subsp. paratuberculosis
ggugucggacuugucgccguugu

SEQ ID NO: 2963659 - RNA, 12 nt, Mycobacterium avium subsp. paratuberculosis
ggugucggcgau

SEQ ID NO: 2963660 - RNA, 16 nt, Mycobacterium avium subsp. paratuberculosis
ggugucggcgccccgg

SEQ ID NO: 2963661 - RNA, 21 nt, Mycobacterium avium subsp. paratuberculosis
ggugucggcgccccggcgcug

SEQ ID NO: 2963662 - RNA, 12 nt, Mycobacterium avium subsp. paratuberculosis
ggugucggcggg

SEQ ID NO: 2963663 - RNA, 12 nt, Mycobacterium avium subsp. paratuberculosis
ggugucggcggu

SEQ ID NO: 2963664 - RNA, 14 nt, Mycobacterium avium subsp. paratuberculosis
ggugucggcgguga

SEQ ID NO: 2963665 - RNA, 14 nt, Mycobacterium avium subsp. paratuberculosis
ggugucggcgucga

SEQ ID NO: 2963666 - RNA, 17 nt, Mycobacterium avium subsp. paratuberculosis
ggugucggggucgucga

SEQ ID NO: 2963667 - RNA, 23 nt, Mycobacterium avium subsp. paratuberculosis
ggugucggugccgagcacgcggc

SEQ ID NO: 2963668 - RNA, 19 nt, Mycobacterium avium subsp. paratuberculosis
ggugucguagacgacgucg

SEQ ID NO: 2963669 - RNA, 16 nt, Mycobacterium avium subsp. paratuberculosis
ggugucguagcggcug

SEQ ID NO: 2963670 - RNA, 18 nt, Mycobacterium avium subsp. paratuberculosis
ggugucguaguugcgcgc

SEQ ID NO: 2963671 - RNA, 20 nt, Mycobacterium avium subsp. paratuberculosis
ggugucgucgcgcacccagc

SEQ ID NO: 2963672 - RNA, 20 nt, Mycobacterium avium subsp. paratuberculosis
ggugucgucgggccgcagca

SEQ ID NO: 2963673 - RNA, 23 nt, Mycobacterium avium subsp. paratuberculosis
ggugucgucgggccgcagcacgg

SEQ ID NO: 2963674 - RNA, 16 nt, Mycobacterium avium subsp. paratuberculosis
ggugugacauccccgg

SEQ ID NO: 2963675 - RNA, 15 nt, Mycobacterium avium subsp. paratuberculosis
ggugugacggauccg

SEQ ID NO: 2963676 - RNA, 19 nt, Mycobacterium avium subsp. paratuberculosis
ggugugaucgagcaccagc

SEQ ID NO: 2963677 - RNA, 13 nt, Mycobacterium avium subsp. paratuberculosis
ggugugcaccagc

SEQ ID NO: 2963678 - RNA, 15 nt, Mycobacterium avium subsp. paratuberculosis
ggugugcaccagcga

SEQ ID NO: 2963679 - RNA, 15 nt, Mycobacterium avium subsp. paratuberculosis
ggugugcagcagcuc

SEQ ID NO: 2963680 - RNA, 15 nt, Mycobacterium avium subsp. paratuberculosis
ggugugcccgcccuu

SEQ ID NO: 2963681 - RNA, 13 nt, Mycobacterium avium subsp. paratuberculosis
ggugugcccgcgg

SEQ ID NO: 2963682 - RNA, 14 nt, Mycobacterium avium subsp. paratuberculosis
ggugugccgaaggg

SEQ ID NO: 2963683 - RNA, 20 nt, Mycobacterium avium subsp. paratuberculosis
ggugugccgcugguaggcgg

SEQ ID NO: 2963684 - RNA, 16 nt, Mycobacterium avium subsp. paratuberculosis
ggugugcggcacggcg

SEQ ID NO: 2963685 - RNA, 15 nt, Mycobacterium avium subsp. paratuberculosis
ggugugcucggcggc

SEQ ID NO: 2963686 - RNA, 18 nt, Mycobacterium avium subsp. paratuberculosis
ggugugcucggugaucca

SEQ ID NO: 2963687 - RNA, 20 nt, Mycobacterium avium subsp. paratuberculosis
gguguggaucuccagcagcu

SEQ ID NO: 2963688 - RNA, 14 nt, Mycobacterium avium subsp. paratuberculosis
gguguggcaggugg

SEQ ID NO: 2963689 - RNA, 15 nt, Mycobacterium avium subsp. paratuberculosis
gguguggcagguggc

SEQ ID NO: 2963690 - RNA, 12 nt, Mycobacterium avium subsp. paratuberculosis
gguguggccgcg

SEQ ID NO: 2963691 - RNA, 15 nt, Mycobacterium avium subsp. paratuberculosis
gguguggcgucggcc

SEQ ID NO: 2963692 - RNA, 22 nt, Mycobacterium avium subsp. paratuberculosis
gguguggcgucggccgggggcg

SEQ ID NO: 2963693 - RNA, 13 nt, Mycobacterium avium subsp. paratuberculosis
ggugugggcagcc

SEQ ID NO: 2963694 - RNA, 16 nt, Mycobacterium avium subsp. paratuberculosis
ggugugggcgccguca

SEQ ID NO: 2963695 - RNA, 15 nt, Mycobacterium avium subsp. paratuberculosis
gguguuccaccagcg

SEQ ID NO: 2963696 - RNA, 17 nt, Mycobacterium avium subsp. paratuberculosis
gguguuccaccagcggc

SEQ ID NO: 2963697 - RNA, 19 nt, Mycobacterium avium subsp. paratuberculosis
gguguuccaccagcggccg

SEQ ID NO: 2963698 - RNA, 14 nt, Mycobacterium avium subsp. paratuberculosis
gguguuccccgggc

SEQ ID NO: 2963699 - RNA, 22 nt, Mycobacterium avium subsp. paratuberculosis
gguguuccccgggcgagcgucg

SEQ ID NO: 2963700 - RNA, 20 nt, Mycobacterium avium subsp. paratuberculosis
gguugauccggaucgggcgg

SEQ ID NO: 2963701 - RNA, 22 nt, Mycobacterium avium subsp. paratuberculosis
gguugcagaugucgguggccuu

SEQ ID NO: 2963702 - RNA, 15 nt, Mycobacterium avium subsp. paratuberculosis
gguugcaggcgccca

SEQ ID NO: 2963703 - RNA, 23 nt, Mycobacterium avium subsp. paratuberculosis
gguugccacgcggauagcccagc

SEQ ID NO: 2963704 - RNA, 23 nt, Mycobacterium avium subsp. paratuberculosis
gguugcccggaagccgcauggug

SEQ ID NO: 2963705 - RNA, 19 nt, Mycobacterium avium subsp. paratuberculosis
gguugccgcacgaccaugu

SEQ ID NO: 2963706 - RNA, 14 nt, Mycobacterium avium subsp. paratuberculosis
gguugccggcggcc

SEQ ID NO: 2963707 - RNA, 16 nt, Mycobacterium avium subsp. paratuberculosis
gguugccgucgacgaa

SEQ ID NO: 2963708 - RNA, 19 nt, Mycobacterium avium subsp. paratuberculosis
gguugccucggccagcacc

SEQ ID NO: 2963709 - RNA, 16 nt, Mycobacterium avium subsp. paratuberculosis
gguugcggaucaugcg

SEQ ID NO: 2963710 - RNA, 13 nt, Mycobacterium avium subsp. paratuberculosis
gguugcggcaccg

SEQ ID NO: 2963711 - RNA, 16 nt, Mycobacterium avium subsp. paratuberculosis
gguugcggcaccggcg

SEQ ID NO: 2963712 - RNA, 15 nt, Mycobacterium avium subsp. paratuberculosis
gguugcggcagcaca

SEQ ID NO: 2963713 - RNA, 21 nt, Mycobacterium avium subsp. paratuberculosis
gguugcggccccgccagcaga

SEQ ID NO: 2963714 - RNA, 21 nt, Mycobacterium avium subsp. paratuberculosis
gguugcgggccgaacugccga

SEQ ID NO: 2963715 - RNA, 17 nt, Mycobacterium avium subsp. paratuberculosis
gguugcggugcuugcug

SEQ ID NO: 2963716 - RNA, 15 nt, Mycobacterium avium subsp. paratuberculosis
gguugcgguggccga

SEQ ID NO: 2963717 - RNA, 14 nt, Mycobacterium avium subsp. paratuberculosis
gguugcgguguugc

SEQ ID NO: 2963718 - RNA, 19 nt, Mycobacterium avium subsp. paratuberculosis
gguugcgguguugcgcagc

SEQ ID NO: 2963719 - RNA, 20 nt, Mycobacterium avium subsp. paratuberculosis
gguugcgguguugcgcagcg

SEQ ID NO: 2963720 - RNA, 21 nt, Mycobacterium avium subsp. paratuberculosis
gguugcgguugucggucaggc

SEQ ID NO: 2963721 - RNA, 17 nt, Mycobacterium avium subsp. paratuberculosis
gguugcguucgccggcg

SEQ ID NO: 2963722 - RNA, 15 nt, Mycobacterium avium subsp. paratuberculosis
gguugcugagccgcc

SEQ ID NO: 2963723 - RNA, 19 nt, Mycobacterium avium subsp. paratuberculosis
gguuggacaccuccuuggg

SEQ ID NO: 2963724 - RNA, 17 nt, Mycobacterium avium subsp. paratuberculosis
gguuggacaugaagccc

SEQ ID NO: 2963725 - RNA, 15 nt, Mycobacterium avium subsp. paratuberculosis
gguuggcccgcacca

SEQ ID NO: 2963726 - RNA, 20 nt, Mycobacterium avium subsp. paratuberculosis
gguuggcccgcaccacccag

SEQ ID NO: 2963727 - RNA, 17 nt, Mycobacterium avium subsp. paratuberculosis
gguuggccggccgggcg

SEQ ID NO: 2963728 - RNA, 15 nt, Mycobacterium avium subsp. paratuberculosis
gguuggccggcgggu

SEQ ID NO: 2963729 - RNA, 15 nt, Mycobacterium avium subsp. paratuberculosis
gguuggcgccgguga

SEQ ID NO: 2963730 - RNA, 11 nt, Mycobacterium avium subsp. paratuberculosis
gguuggcggcc

SEQ ID NO: 2963731 - RNA, 12 nt, Mycobacterium avium subsp. paratuberculosis
gguuggcggccg

SEQ ID NO: 2963732 - RNA, 13 nt, Mycobacterium avium subsp. paratuberculosis
gguuggcggcggc

SEQ ID NO: 2963733 - RNA, 16 nt, Mycobacterium avium subsp. paratuberculosis
gguugggcgccagcag

SEQ ID NO: 2963734 - RNA, 19 nt, Mycobacterium avium subsp. paratuberculosis
gguugggcgccugcgguga

SEQ ID NO: 2963735 - RNA, 15 nt, Mycobacterium avium subsp. paratuberculosis
gguugggcggcggcc

SEQ ID NO: 2963736 - RNA, 16 nt, Mycobacterium avium subsp. paratuberculosis
gguugggcggcggcca

SEQ ID NO: 2963737 - RNA, 14 nt, Mycobacterium avium subsp. paratuberculosis
gguugggcggggcg

SEQ ID NO: 2963738 - RNA, 23 nt, Mycobacterium avium subsp. paratuberculosis
gguuggggacggcgaggaucgcg

SEQ ID NO: 2963739 - RNA, 17 nt, Mycobacterium avium subsp. paratuberculosis
gguuggucaauccgggc

SEQ ID NO: 2963740 - RNA, 18 nt, Mycobacterium avium subsp. paratuberculosis
gguuggucaauccgggca

SEQ ID NO: 2963741 - RNA, 15 nt, Mycobacterium avium subsp. paratuberculosis
gguuggucggagccg

SEQ ID NO: 2963742 - RNA, 15 nt, Mycobacterium avium subsp. paratuberculosis
gguuggucggcgcgg

SEQ ID NO: 2963743 - RNA, 20 nt, Mycobacterium avium subsp. paratuberculosis
gguuggucggcgcggcgacg

SEQ ID NO: 2963744 - RNA, 17 nt, Mycobacterium avium subsp. paratuberculosis
gguuguagcaggcggug

SEQ ID NO: 2963745 - RNA, 18 nt, Mycobacterium avium subsp. paratuberculosis
gguuguccagccggugca

SEQ ID NO: 2963746 - RNA, 12 nt, Mycobacterium avium subsp. paratuberculosis
gguugucgccgc

SEQ ID NO: 2963747 - RNA, 22 nt, Mycobacterium avium subsp. paratuberculosis
gguugucgcucagaggcgggca

SEQ ID NO: 2963748 - RNA, 14 nt, Mycobacterium avium subsp. paratuberculosis
gguugucggucagg

SEQ ID NO: 2963749 - RNA, 15 nt, Mycobacterium avium subsp. paratuberculosis
gguugucggucaggc

SEQ ID NO: 2963750 - RNA, 12 nt, Mycobacterium avium subsp. paratuberculosis
gguugucgucgg

SEQ ID NO: 2963751 - RNA, 19 nt, Mycobacterium avium subsp. paratuberculosis
gguugucgucgggcaccac

SEQ ID NO: 2963752 - RNA, 23 nt, Mycobacterium avium subsp. paratuberculosis
gguugucgucgggcaccacggcg

SEQ ID NO: 2963753 - RNA, 17 nt, Mycobacterium avium subsp. paratuberculosis
gguugucgucgucggcg

SEQ ID NO: 2963754 - RNA, 20 nt, Mycobacterium avium subsp. paratuberculosis
gguuguugaagucgaucaug

SEQ ID NO: 2963755 - RNA, 21 nt, Mycobacterium avium subsp. paratuberculosis
gguuucaccgccgucccgucc

SEQ ID NO: 2963756 - RNA, 18 nt, Mycobacterium avium subsp. paratuberculosis
gguuucauucaccgcggu

SEQ ID NO: 2963757 - RNA, 21 nt, Mycobacterium avium subsp. paratuberculosis
gguuucauucaccgcgguugc

SEQ ID NO: 2963758 - RNA, 20 nt, Mycobacterium avium subsp. paratuberculosis
gguuuccacgugcacggcgc

SEQ ID NO: 2963759 - RNA, 17 nt, Mycobacterium avium subsp. paratuberculosis
gguuuccgcugaugcgg

SEQ ID NO: 2963760 - RNA, 20 nt, Mycobacterium avium subsp. paratuberculosis
gguuucgccguacagcuggu

SEQ ID NO: 2963761 - RNA, 18 nt, Mycobacterium avium subsp. paratuberculosis
gguuucggggucgccguc

SEQ ID NO: 2963762 - RNA, 21 nt, Mycobacterium avium subsp. paratuberculosis
gguuucgggucgagagccgca

SEQ ID NO: 2963763 - RNA, 16 nt, Mycobacterium avium subsp. paratuberculosis
gguuucgugugcucag

SEQ ID NO: 2963764 - RNA, 13 nt, Mycobacterium avium subsp. paratuberculosis
gguuucguugucc

SEQ ID NO: 2963765 - RNA, 15 nt, Mycobacterium avium subsp. paratuberculosis
gguuugaccacggcg

SEQ ID NO: 2963766 - RNA, 21 nt, Mycobacterium avium subsp. paratuberculosis
gguuugcgccggcuccaccgc

SEQ ID NO: 2963767 - RNA, 22 nt, Mycobacterium avium subsp. paratuberculosis
gguuugcgccggcuccaccgcg

SEQ ID NO: 2963768 - RNA, 20 nt, Mycobacterium avium subsp. paratuberculosis
gguuuggccagcaccgcggc

SEQ ID NO: 2963769 - RNA, 14 nt, Mycobacterium avium subsp. paratuberculosis
gguuuggccgcggg

SEQ ID NO: 2963770 - RNA, 19 nt, Mycobacterium avium subsp. paratuberculosis
gguuuggccgcgggcgggc

SEQ ID NO: 2963771 - RNA, 15 nt, Mycobacterium avium subsp. paratuberculosis
gguuuguccggccag

SEQ ID NO: 2963772 - RNA, 19 nt, Mycobacterium avium subsp. paratuberculosis
gguuuguccggccaggucc

SEQ ID NO: 2963773 - RNA, 19 nt, Mycobacterium avium subsp. paratuberculosis
gguuuguccggcucugccu

SEQ ID NO: 2963774 - RNA, 23 nt, Mycobacterium avium subsp. paratuberculosis
gguuuucgccucggucugggcga

SEQ ID NO: 2963775 - RNA, 22 nt, Mycobacterium avium subsp. paratuberculosis
gguuuugcgucugcucggcggc

SEQ ID NO: 2963776 - RNA, 20 nt, Mycobacterium avium subsp. paratuberculosis
gguuuuugauugcgcggcgc

SEQ ID NO: 2963777 - RNA, 17 nt, Mycobacterium avium subsp. paratuberculosis
guaaaccagcagcgcca

SEQ ID NO: 2963778 - RNA, 23 nt, Mycobacterium avium subsp. paratuberculosis
guaaaccgccagcagcgcaagcu

SEQ ID NO: 2963779 - RNA, 15 nt, Mycobacterium avium subsp. paratuberculosis
guaacacccugcgcc

SEQ ID NO: 2963780 - RNA, 22 nt, Mycobacterium avium subsp. paratuberculosis
guaacacgaucucggucgccag

SEQ ID NO: 2963781 - RNA, 22 nt, Mycobacterium avium subsp. paratuberculosis
guaacagagcgggaucccgcag

SEQ ID NO: 2963782 - RNA, 13 nt, Mycobacterium avium subsp. paratuberculosis
guaacccgggacc

SEQ ID NO: 2963783 - RNA, 14 nt, Mycobacterium avium subsp. paratuberculosis
guaacccuccggcg

SEQ ID NO: 2963784 - RNA, 12 nt, Mycobacterium avium subsp. paratuberculosis
guacccgccgca

SEQ ID NO: 2963785 - RNA, 12 nt, Mycobacterium avium subsp. paratuberculosis
guacccgcgcgg

SEQ ID NO: 2963786 - RNA, 14 nt, Mycobacterium avium subsp. paratuberculosis
guacccgcgcggcg

SEQ ID NO: 2963787 - RNA, 16 nt, Mycobacterium avium subsp. paratuberculosis
guacccgcgcggcguc

SEQ ID NO: 2963788 - RNA, 20 nt, Mycobacterium avium subsp. paratuberculosis
guacccgcgcggcgucggcc

SEQ ID NO: 2963789 - RNA, 22 nt, Mycobacterium avium subsp. paratuberculosis
guacccggucugaucgcccagc

SEQ ID NO: 2963790 - RNA, 16 nt, Mycobacterium avium subsp. paratuberculosis
guaccgaacgacgagc

SEQ ID NO: 2963791 - RNA, 17 nt, Mycobacterium avium subsp. paratuberculosis
guaccgaacgacgagcc

SEQ ID NO: 2963792 - RNA, 22 nt, Mycobacterium avium subsp. paratuberculosis
guaccgaacgacgagccgucga

SEQ ID NO: 2963793 - RNA, 17 nt, Mycobacterium avium subsp. paratuberculosis
guaccgauccgcgggcc

SEQ ID NO: 2963794 - RNA, 23 nt, Mycobacterium avium subsp. paratuberculosis
guaccgauccgcgggccggcacu

SEQ ID NO: 2963795 - RNA, 23 nt, Mycobacterium avium subsp. paratuberculosis
guaccgaugaccaccgcugugga

SEQ ID NO: 2963796 - RNA, 16 nt, Mycobacterium avium subsp. paratuberculosis
guaccgcaacaccgaa

SEQ ID NO: 2963797 - RNA, 15 nt, Mycobacterium avium subsp. paratuberculosis
guaccgcuuggccca

SEQ ID NO: 2963798 - RNA, 15 nt, Mycobacterium avium subsp. paratuberculosis
guaccggcgccaggc

SEQ ID NO: 2963799 - RNA, 19 nt, Mycobacterium avium subsp. paratuberculosis
guaccggcgccaggccggc

SEQ ID NO: 2963800 - RNA, 21 nt, Mycobacterium avium subsp. paratuberculosis
guaccggcgccaggccggcga

SEQ ID NO: 2963801 - RNA, 17 nt, Mycobacterium avium subsp. paratuberculosis
guaccggguggccguga

SEQ ID NO: 2963802 - RNA, 15 nt, Mycobacterium avium subsp. paratuberculosis
guaccgguuccgggc

SEQ ID NO: 2963803 - RNA, 18 nt, Mycobacterium avium subsp. paratuberculosis
guaccgguuccgggcgac

SEQ ID NO: 2963804 - RNA, 17 nt, Mycobacterium avium subsp. paratuberculosis
guaccuagggcccacgc

SEQ ID NO: 2963805 - RNA, 19 nt, Mycobacterium avium subsp. paratuberculosis
guacgacaucucgacggug

SEQ ID NO: 2963806 - RNA, 23 nt, Mycobacterium avium subsp. paratuberculosis
guacgacaucucgacggugaccg

SEQ ID NO: 2963807 - RNA, 14 nt, Mycobacterium avium subsp. paratuberculosis
guacgaccgcgacg

SEQ ID NO: 2963808 - RNA, 20 nt, Mycobacterium avium subsp. paratuberculosis
guacgaccguagccggucgg

SEQ ID NO: 2963809 - RNA, 14 nt, Mycobacterium avium subsp. paratuberculosis
guacgcaucggcgc

SEQ ID NO: 2963810 - RNA, 23 nt, Mycobacterium avium subsp. paratuberculosis
guacgccgccuugacgccgggca

SEQ ID NO: 2963811 - RNA, 18 nt, Mycobacterium avium subsp. paratuberculosis
guacgcgagaagcgcgca

SEQ ID NO: 2963812 - RNA, 13 nt, Mycobacterium avium subsp. paratuberculosis
guacgcgauggcg

SEQ ID NO: 2963813 - RNA, 17 nt, Mycobacterium avium subsp. paratuberculosis
guacgcgauggcggcgc

SEQ ID NO: 2963814 - RNA, 20 nt, Mycobacterium avium subsp. paratuberculosis
guacgcgauggcggcgcgcu

SEQ ID NO: 2963815 - RNA, 22 nt, Mycobacterium avium subsp. paratuberculosis
guacgcgauggcggcgcgcucg

SEQ ID NO: 2963816 - RNA, 18 nt, Mycobacterium avium subsp. paratuberculosis
guacgcgcaauccugccc

SEQ ID NO: 2963817 - RNA, 13 nt, Mycobacterium avium subsp. paratuberculosis
guacgcgccggcc

SEQ ID NO: 2963818 - RNA, 15 nt, Mycobacterium avium subsp. paratuberculosis
guacgcgccggccag

SEQ ID NO: 2963819 - RNA, 19 nt, Mycobacterium avium subsp. paratuberculosis
guacgcgccggccagccgg

SEQ ID NO: 2963820 - RNA, 20 nt, Mycobacterium avium subsp. paratuberculosis
guacgcgccgucgucgucgc

SEQ ID NO: 2963821 - RNA, 15 nt, Mycobacterium avium subsp. paratuberculosis
guacgcgcugccgac

SEQ ID NO: 2963822 - RNA, 20 nt, Mycobacterium avium subsp. paratuberculosis
guacggauugcggacgccuc

SEQ ID NO: 2963823 - RNA, 21 nt, Mycobacterium avium subsp. paratuberculosis
guacggcccgggaagccgcag

SEQ ID NO: 2963824 - RNA, 15 nt, Mycobacterium avium subsp. paratuberculosis
guacggccgacgccc

SEQ ID NO: 2963825 - RNA, 18 nt, Mycobacterium avium subsp. paratuberculosis
guacggccgacgcccagc

SEQ ID NO: 2963826 - RNA, 15 nt, Mycobacterium avium subsp. paratuberculosis
guacggcggccgcgg

SEQ ID NO: 2963827 - RNA, 20 nt, Mycobacterium avium subsp. paratuberculosis
guacggcggccgcggacccg

SEQ ID NO: 2963828 - RNA, 20 nt, Mycobacterium avium subsp. paratuberculosis
guacggcucaacggccggcg

SEQ ID NO: 2963829 - RNA, 17 nt, Mycobacterium avium subsp. paratuberculosis
guacgggcgcagcgccg

SEQ ID NO: 2963830 - RNA, 15 nt, Mycobacterium avium subsp. paratuberculosis
guacggucggccgua

SEQ ID NO: 2963831 - RNA, 18 nt, Mycobacterium avium subsp. paratuberculosis
guacgucuugcgcaccug

SEQ ID NO: 2963832 - RNA, 13 nt, Mycobacterium avium subsp. paratuberculosis
guacgugcgccgg

SEQ ID NO: 2963833 - RNA, 18 nt, Mycobacterium avium subsp. paratuberculosis
guacuagccuggcacggc

SEQ ID NO: 2963834 - RNA, 21 nt, Mycobacterium avium subsp. paratuberculosis
guacucaaaccgggccugcgc

SEQ ID NO: 2963835 - RNA, 19 nt, Mycobacterium avium subsp. paratuberculosis
guacuccaccgcgccgucg

SEQ ID NO: 2963836 - RNA, 22 nt, Mycobacterium avium subsp. paratuberculosis
guacucccaggauuccgucggc

SEQ ID NO: 2963837 - RNA, 14 nt, Mycobacterium avium subsp. paratuberculosis
guacuccucggugu

SEQ ID NO: 2963838 - RNA, 15 nt, Mycobacterium avium subsp. paratuberculosis
guacucgaccgcgac

SEQ ID NO: 2963839 - RNA, 18 nt, Mycobacterium avium subsp. paratuberculosis
guacucgagcgugcccgc

SEQ ID NO: 2963840 - RNA, 20 nt, Mycobacterium avium subsp. paratuberculosis
guacucgaguggcgaacggg

SEQ ID NO: 2963841 - RNA, 16 nt, Mycobacterium avium subsp. paratuberculosis
guacucgcacagccgg

SEQ ID NO: 2963842 - RNA, 17 nt, Mycobacterium avium subsp. paratuberculosis
guacucgcacagccggc

SEQ ID NO: 2963843 - RNA, 13 nt, Mycobacterium avium subsp. paratuberculosis
guacucggcggcg

SEQ ID NO: 2963844 - RNA, 14 nt, Mycobacterium avium subsp. paratuberculosis
guacucggcggcgg

SEQ ID NO: 2963845 - RNA, 16 nt, Mycobacterium avium subsp. paratuberculosis
guacucggcggcgggc

SEQ ID NO: 2963846 - RNA, 18 nt, Mycobacterium avium subsp. paratuberculosis
guacucggcggcgggcag

SEQ ID NO: 2963847 - RNA, 22 nt, Mycobacterium avium subsp. paratuberculosis
guacucggcggcgggcaggcuc

SEQ ID NO: 2963848 - RNA, 16 nt, Mycobacterium avium subsp. paratuberculosis
guacucggcgucgccg

SEQ ID NO: 2963849 - RNA, 17 nt, Mycobacterium avium subsp. paratuberculosis
guacucggcgucgccga

SEQ ID NO: 2963850 - RNA, 18 nt, Mycobacterium avium subsp. paratuberculosis
guacucgugggccaccac

SEQ ID NO: 2963851 - RNA, 15 nt, Mycobacterium avium subsp. paratuberculosis
guacugaucaccgcg

SEQ ID NO: 2963852 - RNA, 14 nt, Mycobacterium avium subsp. paratuberculosis
guacugcucggcgc

SEQ ID NO: 2963853 - RNA, 21 nt, Mycobacterium avium subsp. paratuberculosis
guacugcuugccgccgggcca

SEQ ID NO: 2963854 - RNA, 20 nt, Mycobacterium avium subsp. paratuberculosis
guacuggggugucagcgcga

SEQ ID NO: 2963855 - RNA, 23 nt, Mycobacterium avium subsp. paratuberculosis
guagaaccaacgcggcgccggug

SEQ ID NO: 2963856 - RNA, 16 nt, Mycobacterium avium subsp. paratuberculosis
guagaaccagcccggc

SEQ ID NO: 2963857 - RNA, 20 nt, Mycobacterium avium subsp. paratuberculosis
guagaaccagugcgccuugu

SEQ ID NO: 2963858 - RNA, 20 nt, Mycobacterium avium subsp. paratuberculosis
guagaaccggcccagcagcg

SEQ ID NO: 2963859 - RNA, 14 nt, Mycobacterium avium subsp. paratuberculosis
guagaacucgggau

SEQ ID NO: 2963860 - RNA, 14 nt, Mycobacterium avium subsp. paratuberculosis
guagaagaccaccu

SEQ ID NO: 2963861 - RNA, 19 nt, Mycobacterium avium subsp. paratuberculosis
guagaagaucagcgccagc

SEQ ID NO: 2963862 - RNA, 16 nt, Mycobacterium avium subsp. paratuberculosis
guagaagaugcgccgg

SEQ ID NO: 2963863 - RNA, 17 nt, Mycobacterium avium subsp. paratuberculosis
guagaaguggccgaccg

SEQ ID NO: 2963864 - RNA, 23 nt, Mycobacterium avium subsp. paratuberculosis
guagacagcguggucgcgcagca

SEQ ID NO: 2963865 - RNA, 16 nt, Mycobacterium avium subsp. paratuberculosis
guagacccacagcugc

SEQ ID NO: 2963866 - RNA, 23 nt, Mycobacterium avium subsp. paratuberculosis
guagacccggggguccagggugc

SEQ ID NO: 2963867 - RNA, 14 nt, Mycobacterium avium subsp. paratuberculosis
guagaccgccgagu

SEQ ID NO: 2963868 - RNA, 22 nt, Mycobacterium avium subsp. paratuberculosis
guagcgcugcauagucggcccg

SEQ ID NO: 2963869 - RNA, 20 nt, Mycobacterium avium subsp. paratuberculosis
guagcggaagcugccguugc

SEQ ID NO: 2963870 - RNA, 21 nt, Mycobacterium avium subsp. paratuberculosis
guagcggaaguacaccgguug

SEQ ID NO: 2963871 - RNA, 15 nt, Mycobacterium avium subsp. paratuberculosis
guagcggacgacggc

SEQ ID NO: 2963872 - RNA, 16 nt, Mycobacterium avium subsp. paratuberculosis
guagcggacgacggcc

SEQ ID NO: 2963873 - RNA, 19 nt, Mycobacterium avium subsp. paratuberculosis
guagcggacgggccgcauc

SEQ ID NO: 2963874 - RNA, 19 nt, Mycobacterium avium subsp. paratuberculosis
guagcggauggcgacggcg

SEQ ID NO: 2963875 - RNA, 13 nt, Mycobacterium avium subsp. paratuberculosis
guagcggccgcac

SEQ ID NO: 2963876 - RNA, 21 nt, Mycobacterium avium subsp. paratuberculosis
guagcggcgccaccggcuggc

SEQ ID NO: 2963877 - RNA, 11 nt, Mycobacterium avium subsp. paratuberculosis
guagcggcgga

SEQ ID NO: 2963878 - RNA, 16 nt, Mycobacterium avium subsp. paratuberculosis
guagcggcggucggcg

SEQ ID NO: 2963879 - RNA, 14 nt, Mycobacterium avium subsp. paratuberculosis
guagcggcucgcca

SEQ ID NO: 2963880 - RNA, 22 nt, Mycobacterium avium subsp. paratuberculosis
guagcgggucagcuccaccugc

SEQ ID NO: 2963881 - RNA, 14 nt, Mycobacterium avium subsp. paratuberculosis
guagcgguccucga

SEQ ID NO: 2963882 - RNA, 13 nt, Mycobacterium avium subsp. paratuberculosis
guagcggucgggg

SEQ ID NO: 2963883 - RNA, 14 nt, Mycobacterium avium subsp. paratuberculosis
guagcggucguaga

SEQ ID NO: 2963884 - RNA, 16 nt, Mycobacterium avium subsp. paratuberculosis
guagcggucgugcggg

SEQ ID NO: 2963885 - RNA, 19 nt, Mycobacterium avium subsp. paratuberculosis
guagcggugaaacgccugc

SEQ ID NO: 2963886 - RNA, 14 nt, Mycobacterium avium subsp. paratuberculosis
guagcggugggcgc

SEQ ID NO: 2963887 - RNA, 15 nt, Mycobacterium avium subsp. paratuberculosis
guagcgugcgcccga

SEQ ID NO: 2963888 - RNA, 23 nt, Mycobacterium avium subsp. paratuberculosis
guagcgugcgcccgacgccggac

SEQ ID NO: 2963889 - RNA, 17 nt, Mycobacterium avium subsp. paratuberculosis
guagcucacggugucgg

SEQ ID NO: 2963890 - RNA, 13 nt, Mycobacterium avium subsp. paratuberculosis
guagcucagccac

SEQ ID NO: 2963891 - RNA, 20 nt, Mycobacterium avium subsp. paratuberculosis
guagcucagccacgccggca

SEQ ID NO: 2963892 - RNA, 22 nt, Mycobacterium avium subsp. paratuberculosis
guagcucagccacgccggcaca

SEQ ID NO: 2963893 - RNA, 22 nt, Mycobacterium avium subsp. paratuberculosis
guagcucagcggaaccgacacc

SEQ ID NO: 2963894 - RNA, 14 nt, Mycobacterium avium subsp. paratuberculosis
guagcucgccgcgg

SEQ ID NO: 2963895 - RNA, 14 nt, Mycobacterium avium subsp. paratuberculosis
guagcucgcgccga

SEQ ID NO: 2963896 - RNA, 16 nt, Mycobacterium avium subsp. paratuberculosis
guagcucgcgccgacc

SEQ ID NO: 2963897 - RNA, 16 nt, Mycobacterium avium subsp. paratuberculosis
guagcugagcagcagg

SEQ ID NO: 2963898 - RNA, 16 nt, Mycobacterium avium subsp. paratuberculosis
guagcuggugcgcagc

SEQ ID NO: 2963899 - RNA, 19 nt, Mycobacterium avium subsp. paratuberculosis
guagcuggugcgcagcccg

SEQ ID NO: 2963900 - RNA, 19 nt, Mycobacterium avium subsp. paratuberculosis
guaggacaccacgguggcg

SEQ ID NO: 2963901 - RNA, 13 nt, Mycobacterium avium subsp. paratuberculosis
guaggacagcagc

SEQ ID NO: 2963902 - RNA, 15 nt, Mycobacterium avium subsp. paratuberculosis
guaggacgccgugca

SEQ ID NO: 2963903 - RNA, 20 nt, Mycobacterium avium subsp. paratuberculosis
guaggagcugacggccauga

SEQ ID NO: 2963904 - RNA, 20 nt, Mycobacterium avium subsp. paratuberculosis
guaggccagcaucucggcga

SEQ ID NO: 2963905 - RNA, 19 nt, Mycobacterium avium subsp. paratuberculosis
guaggccagcccggcgugc

SEQ ID NO: 2963906 - RNA, 23 nt, Mycobacterium avium subsp. paratuberculosis
guaggccagcccggcgugcagga

SEQ ID NO: 2963907 - RNA, 22 nt, Mycobacterium avium subsp. paratuberculosis
guaggcccaguccugcagcucg

SEQ ID NO: 2963908 - RNA, 16 nt, Mycobacterium avium subsp. paratuberculosis
guaggccgccgcgacc

SEQ ID NO: 2963909 - RNA, 23 nt, Mycobacterium avium subsp. paratuberculosis
guaggccgccugcccgggcgccg

SEQ ID NO: 2963910 - RNA, 15 nt, Mycobacterium avium subsp. paratuberculosis
guaggccgcgccgau

SEQ ID NO: 2963911 - RNA, 17 nt, Mycobacterium avium subsp. paratuberculosis
guaggccgcgccgauca

SEQ ID NO: 2963912 - RNA, 21 nt, Mycobacterium avium subsp. paratuberculosis
guaggccgcgccgaucacgaa

SEQ ID NO: 2963913 - RNA, 16 nt, Mycobacterium avium subsp. paratuberculosis
guaggccgcgcggugc

SEQ ID NO: 2963914 - RNA, 13 nt, Mycobacterium avium subsp. paratuberculosis
guaggccggaucc

SEQ ID NO: 2963915 - RNA, 21 nt, Mycobacterium avium subsp. paratuberculosis
guaggccuugcugagccggcc

SEQ ID NO: 2963916 - RNA, 20 nt, Mycobacterium avium subsp. paratuberculosis
guaggcgaaauaacccaccc

SEQ ID NO: 2963917 - RNA, 22 nt, Mycobacterium avium subsp. paratuberculosis
guaggcgaagagcggcacgauc

SEQ ID NO: 2963918 - RNA, 23 nt, Mycobacterium avium subsp. paratuberculosis
guaggcgaccacaccgccggcca

SEQ ID NO: 2963919 - RNA, 19 nt, Mycobacterium avium subsp. paratuberculosis
guaggcgaccaugcccagc

SEQ ID NO: 2963920 - RNA, 19 nt, Mycobacterium avium subsp. paratuberculosis
guaggcgccgaacgccgga

SEQ ID NO: 2963921 - RNA, 20 nt, Mycobacterium avium subsp. paratuberculosis
guaggcgccgaacgccggau

SEQ ID NO: 2963922 - RNA, 14 nt, Mycobacterium avium subsp. paratuberculosis
guaggcgccgaugc

SEQ ID NO: 2963923 - RNA, 17 nt, Mycobacterium avium subsp. paratuberculosis
guaggcgccgccgcgca

SEQ ID NO: 2963924 - RNA, 12 nt, Mycobacterium avium subsp. paratuberculosis
guaggcgccgcu

SEQ ID NO: 2963925 - RNA, 14 nt, Mycobacterium avium subsp. paratuberculosis
guaggcgccgcucg

SEQ ID NO: 2963926 - RNA, 23 nt, Mycobacterium avium subsp. paratuberculosis
guaggcgccgcucgaccccucgg

SEQ ID NO: 2963927 - RNA, 14 nt, Mycobacterium avium subsp. paratuberculosis
guaggcgcggguga

SEQ ID NO: 2963928 - RNA, 19 nt, Mycobacterium avium subsp. paratuberculosis
guaggcggccagcagcacc

SEQ ID NO: 2963929 - RNA, 13 nt, Mycobacterium avium subsp. paratuberculosis
guaggcggccggg

SEQ ID NO: 2963930 - RNA, 15 nt, Mycobacterium avium subsp. paratuberculosis
guaggcggccgggau

SEQ ID NO: 2963931 - RNA, 20 nt, Mycobacterium avium subsp. paratuberculosis
guaggcggcgugccagggca

SEQ ID NO: 2963932 - RNA, 13 nt, Mycobacterium avium subsp. paratuberculosis
guaggcgguggcg

SEQ ID NO: 2963933 - RNA, 23 nt, Mycobacterium avium subsp. paratuberculosis
guaggcgucgaacgggccgggca

SEQ ID NO: 2963934 - RNA, 16 nt, Mycobacterium avium subsp. paratuberculosis
guaggcgucgcgcagc

SEQ ID NO: 2963935 - RNA, 15 nt, Mycobacterium avium subsp. paratuberculosis
guaggcgucggcgga

SEQ ID NO: 2963936 - RNA, 20 nt, Mycobacterium avium subsp. paratuberculosis
guaggcguggcaggccauca

SEQ ID NO: 2963937 - RNA, 22 nt, Mycobacterium avium subsp. paratuberculosis
guagggcacaccggugcucucc

SEQ ID NO: 2963938 - RNA, 14 nt, Mycobacterium avium subsp. paratuberculosis
guagggcagcccga

SEQ ID NO: 2963939 - RNA, 17 nt, Mycobacterium avium subsp. paratuberculosis
guagggcagcccgagca

SEQ ID NO: 2963940 - RNA, 21 nt, Mycobacterium avium subsp. paratuberculosis
guagggcagcccgagcaacug

SEQ ID NO: 2963941 - RNA, 14 nt, Mycobacterium avium subsp. paratuberculosis
guagggccaccacg

SEQ ID NO: 2963942 - RNA, 13 nt, Mycobacterium avium subsp. paratuberculosis
guagggccgcagc

SEQ ID NO: 2963943 - RNA, 15 nt, Mycobacterium avium subsp. paratuberculosis
guagggccggucacc

SEQ ID NO: 2963944 - RNA, 17 nt, Mycobacterium avium subsp. paratuberculosis
guagggccggucaccgg

SEQ ID NO: 2963945 - RNA, 19 nt, Mycobacterium avium subsp. paratuberculosis
guagggcgccgucggcggg

SEQ ID NO: 2963946 - RNA, 23 nt, Mycobacterium avium subsp. paratuberculosis
guagggcuccgcgcugaccagcg

SEQ ID NO: 2963947 - RNA, 14 nt, Mycobacterium avium subsp. paratuberculosis
guagggcucggcgu

SEQ ID NO: 2963948 - RNA, 13 nt, Mycobacterium avium subsp. paratuberculosis
guagggguccucc

SEQ ID NO: 2963949 - RNA, 19 nt, Mycobacterium avium subsp. paratuberculosis
guagggguccuccagcggc

SEQ ID NO: 2963950 - RNA, 24 nt, Mycobacterium avium subsp. paratuberculosis
guaggucaacccgcucaggucggc

SEQ ID NO: 2963951 - RNA, 18 nt, Mycobacterium avium subsp. paratuberculosis
guaggucaucagcgacgu

SEQ ID NO: 2963952 - RNA, 19 nt, Mycobacterium avium subsp. paratuberculosis
guaggugagcaacgccagc

SEQ ID NO: 2963953 - RNA, 15 nt, Mycobacterium avium subsp. paratuberculosis
gucaacgugucgagc

SEQ ID NO: 2963954 - RNA, 16 nt, Mycobacterium avium subsp. paratuberculosis
gucaacucgacccgca

SEQ ID NO: 2963955 - RNA, 18 nt, Mycobacterium avium subsp. paratuberculosis
gucaacucgacccgcacc

SEQ ID NO: 2963956 - RNA, 23 nt, Mycobacterium avium subsp. paratuberculosis
gucaacucgacccgcaccucgaa

SEQ ID NO: 2963957 - RNA, 19 nt, Mycobacterium avium subsp. paratuberculosis
gucaagaacgaaucgucgc

SEQ ID NO: 2963958 - RNA, 21 nt, Mycobacterium avium subsp. paratuberculosis
gucaagaacgcaaucgcccag

SEQ ID NO: 2963959 - RNA, 22 nt, Mycobacterium avium subsp. paratuberculosis
gucaagauaccggccggcgcgg

SEQ ID NO: 2963960 - RNA, 14 nt, Mycobacterium avium subsp. paratuberculosis
gucaagccggccag

SEQ ID NO: 2963961 - RNA, 16 nt, Mycobacterium avium subsp. paratuberculosis
gucaagccggccagca

SEQ ID NO: 2963962 - RNA, 20 nt, Mycobacterium avium subsp. paratuberculosis
gucaagccggccagcagcgg

SEQ ID NO: 2963963 - RNA, 15 nt, Mycobacterium avium subsp. paratuberculosis
gucaauccccgcggu

SEQ ID NO: 2963964 - RNA, 23 nt, Mycobacterium avium subsp. paratuberculosis
gucaauccccgcgguucgaggug

SEQ ID NO: 2963965 - RNA, 21 nt, Mycobacterium avium subsp. paratuberculosis
gucaaugauggucagccgcac

SEQ ID NO: 2963966 - RNA, 15 nt, Mycobacterium avium subsp. paratuberculosis
gucaaugccgcagcc

SEQ ID NO: 2963967 - RNA, 16 nt, Mycobacterium avium subsp. paratuberculosis
gucaauugccacagcc

SEQ ID NO: 2963968 - RNA, 13 nt, Mycobacterium avium subsp. paratuberculosis
gucacacccucgg

SEQ ID NO: 2963969 - RNA, 18 nt, Mycobacterium avium subsp. paratuberculosis
gucacacccucggcccgc

SEQ ID NO: 2963970 - RNA, 20 nt, Mycobacterium avium subsp. paratuberculosis
gucacacccucggcccgcca

SEQ ID NO: 2963971 - RNA, 14 nt, Mycobacterium avium subsp. paratuberculosis
gucacaccgcggcc

SEQ ID NO: 2963972 - RNA, 17 nt, Mycobacterium avium subsp. paratuberculosis
gucacaccgcggccagc

SEQ ID NO: 2963973 - RNA, 18 nt, Mycobacterium avium subsp. paratuberculosis
gucacaccgcggccagcg

SEQ ID NO: 2963974 - RNA, 13 nt, Mycobacterium avium subsp. paratuberculosis
gucacagccgcga

SEQ ID NO: 2963975 - RNA, 17 nt, Mycobacterium avium subsp. paratuberculosis
gucacauacgccucacc

SEQ ID NO: 2963976 - RNA, 20 nt, Mycobacterium avium subsp. paratuberculosis
gucacauccgucacgcccgu

SEQ ID NO: 2963977 - RNA, 21 nt, Mycobacterium avium subsp. paratuberculosis
gucacaucgcguuagcaaggg

SEQ ID NO: 2963978 - RNA, 17 nt, Mycobacterium avium subsp. paratuberculosis
gucaccaacgcgaaggu

SEQ ID NO: 2963979 - RNA, 15 nt, Mycobacterium avium subsp. paratuberculosis
gucaccaaggcgauu

SEQ ID NO: 2963980 - RNA, 18 nt, Mycobacterium avium subsp. paratuberculosis
gucaccaaugcgccggcg

SEQ ID NO: 2963981 - RNA, 21 nt, Mycobacterium avium subsp. paratuberculosis
gucaccaaugcgccggcggcc

SEQ ID NO: 2963982 - RNA, 17 nt, Mycobacterium avium subsp. paratuberculosis
gucaccaccaacgccac

SEQ ID NO: 2963983 - RNA, 13 nt, Mycobacterium avium subsp. paratuberculosis
gucaccaccgagc

SEQ ID NO: 2963984 - RNA, 17 nt, Mycobacterium avium subsp. paratuberculosis
gucaccaccgagccggu

SEQ ID NO: 2963985 - RNA, 16 nt, Mycobacterium avium subsp. paratuberculosis
gucaccacggucaccc

SEQ ID NO: 2963986 - RNA, 13 nt, Mycobacterium avium subsp. paratuberculosis
gucaccagcgcgg

SEQ ID NO: 2963987 - RNA, 14 nt, Mycobacterium avium subsp. paratuberculosis
gucaccagcgcggu

SEQ ID NO: 2963988 - RNA, 19 nt, Mycobacterium avium subsp. paratuberculosis
gucaccagcggcccgcugu

SEQ ID NO: 2963989 - RNA, 16 nt, Mycobacterium avium subsp. paratuberculosis
gucaccagcucgccga

SEQ ID NO: 2963990 - RNA, 22 nt, Mycobacterium avium subsp. paratuberculosis
gucaccaggcugcucggcgggc

SEQ ID NO: 2963991 - RNA, 23 nt, Mycobacterium avium subsp. paratuberculosis
gucaccaggucgcgguagaucga

SEQ ID NO: 2963992 - RNA, 13 nt, Mycobacterium avium subsp. paratuberculosis
gucaccaucagcg

SEQ ID NO: 2963993 - RNA, 14 nt, Mycobacterium avium subsp. paratuberculosis
gucaccaucagcgg

SEQ ID NO: 2963994 - RNA, 16 nt, Mycobacterium avium subsp. paratuberculosis
gucaccaucagcggcu

SEQ ID NO: 2963995 - RNA, 20 nt, Mycobacterium avium subsp. paratuberculosis
gucacccacuggcggccggc

SEQ ID NO: 2963996 - RNA, 19 nt, Mycobacterium avium subsp. paratuberculosis
gucaccccaccgagcagcu

SEQ ID NO: 2963997 - RNA, 13 nt, Mycobacterium avium subsp. paratuberculosis
gucaccccgaguu

SEQ ID NO: 2963998 - RNA, 21 nt, Mycobacterium avium subsp. paratuberculosis
gucaccccggagauccggccg

SEQ ID NO: 2963999 - RNA, 22 nt, Mycobacterium avium subsp. paratuberculosis
gucaccccggagauccggccgc

SEQ ID NO: 2964000 - RNA, 13 nt, Mycobacterium avium subsp. paratuberculosis
gucaccccggcca

SEQ ID NO: 2964001 - RNA, 16 nt, Mycobacterium avium subsp. paratuberculosis
gucaccccggccauca

SEQ ID NO: 2964002 - RNA, 20 nt, Mycobacterium avium subsp. paratuberculosis
gucaccccggccaucaugcc

SEQ ID NO: 2964003 - RNA, 15 nt, Mycobacterium avium subsp. paratuberculosis
gucacccgcagcccg

SEQ ID NO: 2964004 - RNA, 19 nt, Mycobacterium avium subsp. paratuberculosis
gucacccggcuggccgcac

SEQ ID NO: 2964005 - RNA, 20 nt, Mycobacterium avium subsp. paratuberculosis
gucacccggcuggccgcaca

SEQ ID NO: 2964006 - RNA, 17 nt, Mycobacterium avium subsp. paratuberculosis
gucacccgugggccgac

SEQ ID NO: 2964007 - RNA, 18 nt, Mycobacterium avium subsp. paratuberculosis
gucacccgugggccgacc

SEQ ID NO: 2964008 - RNA, 22 nt, Mycobacterium avium subsp. paratuberculosis
gucacccgugggccgaccggcc

SEQ ID NO: 2964009 - RNA, 14 nt, Mycobacterium avium subsp. paratuberculosis
gucacccuccucgc

SEQ ID NO: 2964010 - RNA, 18 nt, Mycobacterium avium subsp. paratuberculosis
gucacccuccucgcggcg

SEQ ID NO: 2964011 - RNA, 17 nt, Mycobacterium avium subsp. paratuberculosis
gucacccucgaggccga

SEQ ID NO: 2964012 - RNA, 21 nt, Mycobacterium avium subsp. paratuberculosis
gucaccgaccccucggcggcc

SEQ ID NO: 2964013 - RNA, 22 nt, Mycobacterium avium subsp. paratuberculosis
gucaccgaccccucggcggccg

SEQ ID NO: 2964014 - RNA, 18 nt, Mycobacterium avium subsp. paratuberculosis
gucaccgacgccagcggg

SEQ ID NO: 2964015 - RNA, 18 nt, Mycobacterium avium subsp. paratuberculosis
gucaccgagcggccgucc

SEQ ID NO: 2964016 - RNA, 20 nt, Mycobacterium avium subsp. paratuberculosis
gucaccgagguagggccggg

SEQ ID NO: 2964017 - RNA, 21 nt, Mycobacterium avium subsp. paratuberculosis
gucaccgccaggaccacccac

SEQ ID NO: 2964018 - RNA, 16 nt, Mycobacterium avium subsp. paratuberculosis
gucaccgccgcaccgu

SEQ ID NO: 2964019 - RNA, 15 nt, Mycobacterium avium subsp. paratuberculosis
gucaccgcgaccaug

SEQ ID NO: 2964020 - RNA, 22 nt, Mycobacterium avium subsp. paratuberculosis
gucaccgcgaccaugcccggcg

SEQ ID NO: 2964021 - RNA, 22 nt, Mycobacterium avium subsp. paratuberculosis
gucaccgcgggaauggccgcgc

SEQ ID NO: 2964022 - RNA, 22 nt, Mycobacterium avium subsp. paratuberculosis
gucaccgcgggugaucugcgcc

SEQ ID NO: 2964023 - RNA, 17 nt, Mycobacterium avium subsp. paratuberculosis
gucaccgcugaugccgc

SEQ ID NO: 2964024 - RNA, 23 nt, Mycobacterium avium subsp. paratuberculosis
gucaccggaauugaagcccugcu

SEQ ID NO: 2964025 - RNA, 19 nt, Mycobacterium avium subsp. paratuberculosis
gucaccggaugcaccggca

SEQ ID NO: 2964026 - RNA, 23 nt, Mycobacterium avium subsp. paratuberculosis
gucaccggaugcaccggcagcca

SEQ ID NO: 2964027 - RNA, 19 nt, Mycobacterium avium subsp. paratuberculosis
gucaccggaugcacgugca

SEQ ID NO: 2964028 - RNA, 18 nt, Mycobacterium avium subsp. paratuberculosis
gucaccggcaaggugccg

SEQ ID NO: 2964029 - RNA, 16 nt, Mycobacterium avium subsp. paratuberculosis
gucaccggcaggcggu

SEQ ID NO: 2964030 - RNA, 23 nt, Mycobacterium avium subsp. paratuberculosis
gucaccggccauccgcugcgcgu

SEQ ID NO: 2964031 - RNA, 14 nt, Mycobacterium avium subsp. paratuberculosis
gucaccggccgagc

SEQ ID NO: 2964032 - RNA, 15 nt, Mycobacterium avium subsp. paratuberculosis
gucaccggcucggga

SEQ ID NO: 2964033 - RNA, 14 nt, Mycobacterium avium subsp. paratuberculosis
gucaccggcugccc

SEQ ID NO: 2964034 - RNA, 18 nt, Mycobacterium avium subsp. paratuberculosis
gucaccggcugcccgacc

SEQ ID NO: 2964035 - RNA, 18 nt, Mycobacterium avium subsp. paratuberculosis
gucaccggggugccgccc

SEQ ID NO: 2964036 - RNA, 19 nt, Mycobacterium avium subsp. paratuberculosis
gucaccggggugccgccca

SEQ ID NO: 2964037 - RNA, 15 nt, Mycobacterium avium subsp. paratuberculosis
gucacuacccgcgau

SEQ ID NO: 2964038 - RNA, 15 nt, Mycobacterium avium subsp. paratuberculosis
gucacucuggcguga

SEQ ID NO: 2964039 - RNA, 20 nt, Mycobacterium avium subsp. paratuberculosis
gucacucuggcgugacgcuc

SEQ ID NO: 2964040 - RNA, 22 nt, Mycobacterium avium subsp. paratuberculosis
gucacucuggcgugacgcucgg

SEQ ID NO: 2964041 - RNA, 20 nt, Mycobacterium avium subsp. paratuberculosis
gucacucuggcgugacguuc

SEQ ID NO: 2964042 - RNA, 15 nt, Mycobacterium avium subsp. paratuberculosis
gucacugucggcgcg

SEQ ID NO: 2964043 - RNA, 16 nt, Mycobacterium avium subsp. paratuberculosis
gucacuucgccgggcu

SEQ ID NO: 2964044 - RNA, 21 nt, Mycobacterium avium subsp. paratuberculosis
gucagaaccggggccagcacg

SEQ ID NO: 2964045 - RNA, 23 nt, Mycobacterium avium subsp. paratuberculosis
gucagaaccggggccagcacgcc

SEQ ID NO: 2964046 - RNA, 18 nt, Mycobacterium avium subsp. paratuberculosis
gucagaccacaacacggg

SEQ ID NO: 2964047 - RNA, 13 nt, Mycobacterium avium subsp. paratuberculosis
gucagaccccgua

SEQ ID NO: 2964048 - RNA, 14 nt, Mycobacterium avium subsp. paratuberculosis
gucagaccgcggcg

SEQ ID NO: 2964049 - RNA, 16 nt, Mycobacterium avium subsp. paratuberculosis
gucagaccgcggcggu

SEQ ID NO: 2964050 - RNA, 19 nt, Mycobacterium avium subsp. paratuberculosis
gucagaccgcggcggucgc

SEQ ID NO: 2964051 - RNA, 19 nt, Mycobacterium avium subsp. paratuberculosis
gucagacgaugggccgccc

SEQ ID NO: 2964052 - RNA, 19 nt, Mycobacterium avium subsp. paratuberculosis
gucagagcccgaacacggg

SEQ ID NO: 2964053 - RNA, 20 nt, Mycobacterium avium subsp. paratuberculosis
gucagcaccaccaacagcag

SEQ ID NO: 2964054 - RNA, 22 nt, Mycobacterium avium subsp. paratuberculosis
gucagcaccaccaacagcagcg

SEQ ID NO: 2964055 - RNA, 13 nt, Mycobacterium avium subsp. paratuberculosis
gucagcaccgcgc

SEQ ID NO: 2964056 - RNA, 17 nt, Mycobacterium avium subsp. paratuberculosis
gucagcaccgcgcggcg

SEQ ID NO: 2964057 - RNA, 15 nt, Mycobacterium avium subsp. paratuberculosis
gucagcaccggcgug

SEQ ID NO: 2964058 - RNA, 15 nt, Mycobacterium avium subsp. paratuberculosis
gucagcaccggggcc

SEQ ID NO: 2964059 - RNA, 13 nt, Mycobacterium avium subsp. paratuberculosis
gucagcaccguca

SEQ ID NO: 2964060 - RNA, 17 nt, Mycobacterium avium subsp. paratuberculosis
gucagcaccgucaccgc

SEQ ID NO: 2964061 - RNA, 19 nt, Mycobacterium avium subsp. paratuberculosis
gucagcaccgucaccgccu

SEQ ID NO: 2964062 - RNA, 22 nt, Mycobacterium avium subsp. paratuberculosis
gucagcaccgugggcccgugcg

SEQ ID NO: 2964063 - RNA, 22 nt, Mycobacterium avium subsp. paratuberculosis
gucagcacgucggucagcgagc

SEQ ID NO: 2964064 - RNA, 23 nt, Mycobacterium avium subsp. paratuberculosis
gucagcacgucggucagcgagcg

SEQ ID NO: 2964065 - RNA, 15 nt, Mycobacterium avium subsp. paratuberculosis
gucagcagcacccgg

SEQ ID NO: 2964066 - RNA, 12 nt, Mycobacterium avium subsp. paratuberculosis
gucagcagcgcg

SEQ ID NO: 2964067 - RNA, 17 nt, Mycobacterium avium subsp. paratuberculosis
gucagcagcgucugcgc

SEQ ID NO: 2964068 - RNA, 12 nt, Mycobacterium avium subsp. paratuberculosis
gucagcaggcgc

SEQ ID NO: 2964069 - RNA, 16 nt, Mycobacterium avium subsp. paratuberculosis
gucagcaggcgccgca

SEQ ID NO: 2964070 - RNA, 17 nt, Mycobacterium avium subsp. paratuberculosis
gucagcaggcgccgcag

SEQ ID NO: 2964071 - RNA, 14 nt, Mycobacterium avium subsp. paratuberculosis
gucagcagggccuc

SEQ ID NO: 2964072 - RNA, 15 nt, Mycobacterium avium subsp. paratuberculosis
gucagcagggccucg

SEQ ID NO: 2964073 - RNA, 22 nt, Mycobacterium avium subsp. paratuberculosis
gucagcagggugacgucguuga

SEQ ID NO: 2964074 - RNA, 20 nt, Mycobacterium avium subsp. paratuberculosis
gucagcauggcgaugacguc

SEQ ID NO: 2964075 - RNA, 16 nt, Mycobacterium avium subsp. paratuberculosis
gucagcccccaccgcg

SEQ ID NO: 2964076 - RNA, 17 nt, Mycobacterium avium subsp. paratuberculosis
gucagcccccaccgcgc

SEQ ID NO: 2964077 - RNA, 22 nt, Mycobacterium avium subsp. paratuberculosis
gucagcccccaccgcgccguga

SEQ ID NO: 2964078 - RNA, 21 nt, Mycobacterium avium subsp. paratuberculosis
gucagccccgaguccacgacg

SEQ ID NO: 2964079 - RNA, 17 nt, Mycobacterium avium subsp. paratuberculosis
gucagcccgcgucgcgc

SEQ ID NO: 2964080 - RNA, 20 nt, Mycobacterium avium subsp. paratuberculosis
gucagcccgcgucgcgcagc

SEQ ID NO: 2964081 - RNA, 21 nt, Mycobacterium avium subsp. paratuberculosis
gucagcccgcgucgcgcagca

SEQ ID NO: 2964082 - RNA, 13 nt, Mycobacterium avium subsp. paratuberculosis
gucagccgcacca

SEQ ID NO: 2964083 - RNA, 15 nt, Mycobacterium avium subsp. paratuberculosis
gucagccgcggcggc

SEQ ID NO: 2964084 - RNA, 17 nt, Mycobacterium avium subsp. paratuberculosis
gucagccgcggcggcag

SEQ ID NO: 2964085 - RNA, 15 nt, Mycobacterium avium subsp. paratuberculosis
gucagccgcggcucg

SEQ ID NO: 2964086 - RNA, 13 nt, Mycobacterium avium subsp. paratuberculosis
gucagccgggcgg

SEQ ID NO: 2964087 - RNA, 14 nt, Mycobacterium avium subsp. paratuberculosis
gucagccgggcggc

SEQ ID NO: 2964088 - RNA, 16 nt, Mycobacterium avium subsp. paratuberculosis
gucagccgggcggccu

SEQ ID NO: 2964089 - RNA, 18 nt, Mycobacterium avium subsp. paratuberculosis
gucagccgggcggccucg

SEQ ID NO: 2964090 - RNA, 14 nt, Mycobacterium avium subsp. paratuberculosis
gucagccgucgucg

SEQ ID NO: 2964091 - RNA, 16 nt, Mycobacterium avium subsp. paratuberculosis
gucagcgacaacggcc

SEQ ID NO: 2964092 - RNA, 23 nt, Mycobacterium avium subsp. paratuberculosis
gucagcgaggcguagcugcaggc

SEQ ID NO: 2964093 - RNA, 23 nt, Mycobacterium avium subsp. paratuberculosis
gucagcgagugguaccggguggc

SEQ ID NO: 2964094 - RNA, 12 nt, Mycobacterium avium subsp. paratuberculosis
gucagcgccccc

SEQ ID NO: 2964095 - RNA, 20 nt, Mycobacterium avium subsp. paratuberculosis
gucagcgccgcccgcaguuc

SEQ ID NO: 2964096 - RNA, 16 nt, Mycobacterium avium subsp. paratuberculosis
gucagcgcgaccucgg

SEQ ID NO: 2964097 - RNA, 13 nt, Mycobacterium avium subsp. paratuberculosis
gucagcgcggccc

SEQ ID NO: 2964098 - RNA, 15 nt, Mycobacterium avium subsp. paratuberculosis
gucagcgcggcccgc

SEQ ID NO: 2964099 - RNA, 19 nt, Mycobacterium avium subsp. paratuberculosis
gucagcgcggcccgcggcg

SEQ ID NO: 2964100 - RNA, 19 nt, Mycobacterium avium subsp. paratuberculosis
gucagcgcgucggcgaccg

SEQ ID NO: 2964101 - RNA, 22 nt, Mycobacterium avium subsp. paratuberculosis
gucagcgcgucggcgaccgcgc

SEQ ID NO: 2964102 - RNA, 15 nt, Mycobacterium avium subsp. paratuberculosis
gucagcgcgugaccc

SEQ ID NO: 2964103 - RNA, 20 nt, Mycobacterium avium subsp. paratuberculosis
gucagcgcgugaccccggcg

SEQ ID NO: 2964104 - RNA, 23 nt, Mycobacterium avium subsp. paratuberculosis
gucagcgcgugaccccggcgacc

SEQ ID NO: 2964105 - RNA, 17 nt, Mycobacterium avium subsp. paratuberculosis
gucagcgcuccuggccg

SEQ ID NO: 2964106 - RNA, 16 nt, Mycobacterium avium subsp. paratuberculosis
gucagcgcuuccagcg

SEQ ID NO: 2964107 - RNA, 18 nt, Mycobacterium avium subsp. paratuberculosis
gucagcgcuuccagcgcg

SEQ ID NO: 2964108 - RNA, 21 nt, Mycobacterium avium subsp. paratuberculosis
gucagcgcuuccagcgcggcg

SEQ ID NO: 2964109 - RNA, 23 nt, Mycobacterium avium subsp. paratuberculosis
gucagcgcuuccagcgcggcgau

SEQ ID NO: 2964110 - RNA, 17 nt, Mycobacterium avium subsp. paratuberculosis
gucagcggcagguccca

SEQ ID NO: 2964111 - RNA, 20 nt, Mycobacterium avium subsp. paratuberculosis
gucagcggcaggucccaggc

SEQ ID NO: 2964112 - RNA, 15 nt, Mycobacterium avium subsp. paratuberculosis
gucagcggccagccc

SEQ ID NO: 2964113 - RNA, 16 nt, Mycobacterium avium subsp. paratuberculosis
gucagcggccagccca

SEQ ID NO: 2964114 - RNA, 16 nt, Mycobacterium avium subsp. paratuberculosis
gucagcggcccgauca

SEQ ID NO: 2964115 - RNA, 14 nt, Mycobacterium avium subsp. paratuberculosis
gucagcggccucgg

SEQ ID NO: 2964116 - RNA, 17 nt, Mycobacterium avium subsp. paratuberculosis
gucagcggcgccaccgg

SEQ ID NO: 2964117 - RNA, 18 nt, Mycobacterium avium subsp. paratuberculosis
gucagcggcgccaccggg

SEQ ID NO: 2964118 - RNA, 13 nt, Mycobacterium avium subsp. paratuberculosis
gucagcggcgggc

SEQ ID NO: 2964119 - RNA, 20 nt, Mycobacterium avium subsp. paratuberculosis
gucagcggcgucaggauggu

SEQ ID NO: 2964120 - RNA, 12 nt, Mycobacterium avium subsp. paratuberculosis
gucagcggcgug

SEQ ID NO: 2964121 - RNA, 20 nt, Mycobacterium avium subsp. paratuberculosis
gucagcggcgugcugcgcag

SEQ ID NO: 2964122 - RNA, 21 nt, Mycobacterium avium subsp. paratuberculosis
gucagcguccaguccggcgug

SEQ ID NO: 2964123 - RNA, 15 nt, Mycobacterium avium subsp. paratuberculosis
gucagcgucgccgcc

SEQ ID NO: 2964124 - RNA, 16 nt, Mycobacterium avium subsp. paratuberculosis
gucagcgucgccgccc

SEQ ID NO: 2964125 - RNA, 16 nt, Mycobacterium avium subsp. paratuberculosis
gucagcgucucggcga

SEQ ID NO: 2964126 - RNA, 23 nt, Mycobacterium avium subsp. paratuberculosis
gucagcgucucggcgaucagcug

SEQ ID NO: 2964127 - RNA, 15 nt, Mycobacterium avium subsp. paratuberculosis
gucagcguggcgucg

SEQ ID NO: 2964128 - RNA, 17 nt, Mycobacterium avium subsp. paratuberculosis
gucagcguggcgucggc

SEQ ID NO: 2964129 - RNA, 19 nt, Mycobacterium avium subsp. paratuberculosis
gucagcguggcgucggcgc

SEQ ID NO: 2964130 - RNA, 23 nt, Mycobacterium avium subsp. paratuberculosis
gucagcuaggaagccagccgucc

SEQ ID NO: 2964131 - RNA, 21 nt, Mycobacterium avium subsp. paratuberculosis
gucagcucaggaacggccgga

SEQ ID NO: 2964132 - RNA, 16 nt, Mycobacterium avium subsp. paratuberculosis
gucagcuccaccugcg

SEQ ID NO: 2964133 - RNA, 20 nt, Mycobacterium avium subsp. paratuberculosis
gucagcuccaccugcggcac

SEQ ID NO: 2964134 - RNA, 21 nt, Mycobacterium avium subsp. paratuberculosis
gucagcuccaccugcggcacc

SEQ ID NO: 2964135 - RNA, 16 nt, Mycobacterium avium subsp. paratuberculosis
gucagcucccccgaca

SEQ ID NO: 2964136 - RNA, 21 nt, Mycobacterium avium subsp. paratuberculosis
gucagcucccccgacaccgcc

SEQ ID NO: 2964137 - RNA, 22 nt, Mycobacterium avium subsp. paratuberculosis
gucagcucccccgacaccgcca

SEQ ID NO: 2964138 - RNA, 15 nt, Mycobacterium avium subsp. paratuberculosis
gucagcucccccguc

SEQ ID NO: 2964139 - RNA, 19 nt, Mycobacterium avium subsp. paratuberculosis
gucagcucccccgucgggc

SEQ ID NO: 2964140 - RNA, 21 nt, Mycobacterium avium subsp. paratuberculosis
gucagcucgaaggugcccgca

SEQ ID NO: 2964141 - RNA, 20 nt, Mycobacterium avium subsp. paratuberculosis
gucagcucgaucgccgcgcc

SEQ ID NO: 2964142 - RNA, 18 nt, Mycobacterium avium subsp. paratuberculosis
gucagcucgccguccggg

SEQ ID NO: 2964143 - RNA, 14 nt, Mycobacterium avium subsp. paratuberculosis
gucagcucgcgccc

SEQ ID NO: 2964144 - RNA, 17 nt, Mycobacterium avium subsp. paratuberculosis
gucagcucgcgcccggc

SEQ ID NO: 2964145 - RNA, 18 nt, Mycobacterium avium subsp. paratuberculosis
gucagcucgcgcccggcc

SEQ ID NO: 2964146 - RNA, 15 nt, Mycobacterium avium subsp. paratuberculosis
gucagcugccgcacc

SEQ ID NO: 2964147 - RNA, 16 nt, Mycobacterium avium subsp. paratuberculosis
gucagcugguagaugg

SEQ ID NO: 2964148 - RNA, 22 nt, Mycobacterium avium subsp. paratuberculosis
gucagcugguagaugguggccg

SEQ ID NO: 2964149 - RNA, 19 nt, Mycobacterium avium subsp. paratuberculosis
gucagcuuggagccgagca

SEQ ID NO: 2964150 - RNA, 23 nt, Mycobacterium avium subsp. paratuberculosis
gucaggaacaccgagccggcggc

SEQ ID NO: 2964151 - RNA, 14 nt, Mycobacterium avium subsp. paratuberculosis
gucaggaacccggc

SEQ ID NO: 2964152 - RNA, 17 nt, Mycobacterium avium subsp. paratuberculosis
gucaggaacccggcccg

SEQ ID NO: 2964153 - RNA, 14 nt, Mycobacterium avium subsp. paratuberculosis
gucaggaacgcgga

SEQ ID NO: 2964154 - RNA, 21 nt, Mycobacterium avium subsp. paratuberculosis
gucaggaaugcgacgacgucg

SEQ ID NO: 2964155 - RNA, 21 nt, Mycobacterium avium subsp. paratuberculosis
gucaggcauuccaccgcgcgg

SEQ ID NO: 2964156 - RNA, 15 nt, Mycobacterium avium subsp. paratuberculosis
gucaggccggcgccg

SEQ ID NO: 2964157 - RNA, 17 nt, Mycobacterium avium subsp. paratuberculosis
gucaggccggcgccggg

SEQ ID NO: 2964158 - RNA, 23 nt, Mycobacterium avium subsp. paratuberculosis
gucaggccgggaaugucgcgcag

SEQ ID NO: 2964159 - RNA, 14 nt, Mycobacterium avium subsp. paratuberculosis
gucaggccggucag

SEQ ID NO: 2964160 - RNA, 19 nt, Mycobacterium avium subsp. paratuberculosis
gucaggccggucagcgacg

SEQ ID NO: 2964161 - RNA, 20 nt, Mycobacterium avium subsp. paratuberculosis
gucaggccggucagcgacga

SEQ ID NO: 2964162 - RNA, 14 nt, Mycobacterium avium subsp. paratuberculosis
gucaggccguagcg

SEQ ID NO: 2964163 - RNA, 17 nt, Mycobacterium avium subsp. paratuberculosis
gucaggccgucucgagc

SEQ ID NO: 2964164 - RNA, 24 nt, Mycobacterium avium subsp. paratuberculosis
gucaggccgucucgagccggcgca

SEQ ID NO: 2964165 - RNA, 22 nt, Mycobacterium avium subsp. paratuberculosis
gucaggccgugaucggccagcc

SEQ ID NO: 2964166 - RNA, 23 nt, Mycobacterium avium subsp. paratuberculosis
gucaggccgugcacgaacagggu

SEQ ID NO: 2964167 - RNA, 17 nt, Mycobacterium avium subsp. paratuberculosis
gucaggcgcagccagcg

SEQ ID NO: 2964168 - RNA, 14 nt, Mycobacterium avium subsp. paratuberculosis
gucaggcgcugggu

SEQ ID NO: 2964169 - RNA, 23 nt, Mycobacterium avium subsp. paratuberculosis
gucagggcagcggugucaccgac

SEQ ID NO: 2964170 - RNA, 14 nt, Mycobacterium avium subsp. paratuberculosis
gucagggccagcaa

SEQ ID NO: 2964171 - RNA, 21 nt, Mycobacterium avium subsp. paratuberculosis
gucagggcgacuccggcgccg

SEQ ID NO: 2964172 - RNA, 17 nt, Mycobacterium avium subsp. paratuberculosis
gucaggggugccggagg

SEQ ID NO: 2964173 - RNA, 21 nt, Mycobacterium avium subsp. paratuberculosis
gucaggggugccggaggcggc

SEQ ID NO: 2964174 - RNA, 20 nt, Mycobacterium avium subsp. paratuberculosis
gucagggugacguggcggcc

SEQ ID NO: 2964175 - RNA, 23 nt, Mycobacterium avium subsp. paratuberculosis
gucagggugacguggcggccguc

SEQ ID NO: 2964176 - RNA, 13 nt, Mycobacterium avium subsp. paratuberculosis
gucaggguggccu

SEQ ID NO: 2964177 - RNA, 18 nt, Mycobacterium avium subsp. paratuberculosis
gucaggguggccucgucg

SEQ ID NO: 2964178 - RNA, 19 nt, Mycobacterium avium subsp. paratuberculosis
gucaggguggccucgucgg

SEQ ID NO: 2964179 - RNA, 21 nt, Mycobacterium avium subsp. paratuberculosis
gucagguagccgaggucgccg

SEQ ID NO: 2964180 - RNA, 15 nt, Mycobacterium avium subsp. paratuberculosis
gucagguaggcgucg

SEQ ID NO: 2964181 - RNA, 18 nt, Mycobacterium avium subsp. paratuberculosis
gucagguaggcgucgaac

SEQ ID NO: 2964182 - RNA, 17 nt, Mycobacterium avium subsp. paratuberculosis
gucaggucaaccaggcc

SEQ ID NO: 2964183 - RNA, 14 nt, Mycobacterium avium subsp. paratuberculosis
gucaggucgaccgg

SEQ ID NO: 2964184 - RNA, 15 nt, Mycobacterium avium subsp. paratuberculosis
gucaggucgaccggc

SEQ ID NO: 2964185 - RNA, 21 nt, Mycobacterium avium subsp. paratuberculosis
gucaggucuucggucgcgacc

SEQ ID NO: 2964186 - RNA, 22 nt, Mycobacterium avium subsp. paratuberculosis
gucaggucuucggucgcgaccc

SEQ ID NO: 2964187 - RNA, 20 nt, Mycobacterium avium subsp. paratuberculosis
gucagguggauggucaccgg

SEQ ID NO: 2964188 - RNA, 20 nt, Mycobacterium avium subsp. paratuberculosis
gucagguucuucugcgcgau

SEQ ID NO: 2964189 - RNA, 22 nt, Mycobacterium avium subsp. paratuberculosis
gucagguucuucugcgcgaugu

SEQ ID NO: 2964190 - RNA, 19 nt, Mycobacterium avium subsp. paratuberculosis
gucagguugacgccgauga

SEQ ID NO: 2964191 - RNA, 15 nt, Mycobacterium avium subsp. paratuberculosis
gucagguuggggccg

SEQ ID NO: 2964192 - RNA, 21 nt, Mycobacterium avium subsp. paratuberculosis
gucaguacagcuaggccagca

SEQ ID NO: 2964193 - RNA, 16 nt, Mycobacterium avium subsp. paratuberculosis
gucagucgcgccgcca

SEQ ID NO: 2964194 - RNA, 22 nt, Mycobacterium avium subsp. paratuberculosis
gucagucgcgccgccagcaacc

SEQ ID NO: 2964195 - RNA, 15 nt, Mycobacterium avium subsp. paratuberculosis
gucaguucgcggcgc

SEQ ID NO: 2964196 - RNA, 22 nt, Mycobacterium avium subsp. paratuberculosis
gucaguuggucgaugucggugc

SEQ ID NO: 2964197 - RNA, 16 nt, Mycobacterium avium subsp. paratuberculosis
gucauaggccgcgcag

SEQ ID NO: 2964198 - RNA, 14 nt, Mycobacterium avium subsp. paratuberculosis
gucauaucgacggc

SEQ ID NO: 2964199 - RNA, 19 nt, Mycobacterium avium subsp. paratuberculosis
gucaucaccgccgagggcc

SEQ ID NO: 2964200 - RNA, 14 nt, Mycobacterium avium subsp. paratuberculosis
gucaucaccgggga

SEQ ID NO: 2964201 - RNA, 12 nt, Mycobacterium avium subsp. paratuberculosis
gucaucaccuug

SEQ ID NO: 2964202 - RNA, 18 nt, Mycobacterium avium subsp. paratuberculosis
gucaucagugaccgcacg

SEQ ID NO: 2964203 - RNA, 14 nt, Mycobacterium avium subsp. paratuberculosis
gucaucaucaccgg

SEQ ID NO: 2964204 - RNA, 12 nt, Mycobacterium avium subsp. paratuberculosis
gucauccccauc

SEQ ID NO: 2964205 - RNA, 23 nt, Mycobacterium avium subsp. paratuberculosis
gucauccccaucucgagcaggaa

SEQ ID NO: 2964206 - RNA, 13 nt, Mycobacterium avium subsp. paratuberculosis
guccaccggcgga

SEQ ID NO: 2964207 - RNA, 16 nt, Mycobacterium avium subsp. paratuberculosis
guccaccggucgacga

SEQ ID NO: 2964208 - RNA, 20 nt, Mycobacterium avium subsp. paratuberculosis
guccaccguugucucggcgc

SEQ ID NO: 2964209 - RNA, 11 nt, Mycobacterium avium subsp. paratuberculosis
guccaccugca

SEQ ID NO: 2964210 - RNA, 14 nt, Mycobacterium avium subsp. paratuberculosis
guccacgaccccgg

SEQ ID NO: 2964211 - RNA, 19 nt, Mycobacterium avium subsp. paratuberculosis
guccacgaccccggcggca

SEQ ID NO: 2964212 - RNA, 22 nt, Mycobacterium avium subsp. paratuberculosis
guccacgaccccggcggcaccg

SEQ ID NO: 2964213 - RNA, 14 nt, Mycobacterium avium subsp. paratuberculosis
guccacgacguccu

SEQ ID NO: 2964214 - RNA, 17 nt, Mycobacterium avium subsp. paratuberculosis
guccacgaugcggugcc

SEQ ID NO: 2964215 - RNA, 19 nt, Mycobacterium avium subsp. paratuberculosis
guccacgaugcggugccgg

SEQ ID NO: 2964216 - RNA, 17 nt, Mycobacterium avium subsp. paratuberculosis
guccacgaugcguuggu

SEQ ID NO: 2964217 - RNA, 13 nt, Mycobacterium avium subsp. paratuberculosis
guccacgcccagc

SEQ ID NO: 2964218 - RNA, 19 nt, Mycobacterium avium subsp. paratuberculosis
guccacgcccagcgccccg

SEQ ID NO: 2964219 - RNA, 13 nt, Mycobacterium avium subsp. paratuberculosis
guccacgccgagg

SEQ ID NO: 2964220 - RNA, 21 nt, Mycobacterium avium subsp. paratuberculosis
guccacgccgagggcggcggc

SEQ ID NO: 2964221 - RNA, 12 nt, Mycobacterium avium subsp. paratuberculosis
guccacgccgug

SEQ ID NO: 2964222 - RNA, 23 nt, Mycobacterium avium subsp. paratuberculosis
guccacgcuggcggugucgaaga

SEQ ID NO: 2964223 - RNA, 12 nt, Mycobacterium avium subsp. paratuberculosis
guccacgggucg

SEQ ID NO: 2964224 - RNA, 15 nt, Mycobacterium avium subsp. paratuberculosis
guccacggucagcgc

SEQ ID NO: 2964225 - RNA, 19 nt, Mycobacterium avium subsp. paratuberculosis
guccacggucagcgcgucg

SEQ ID NO: 2964226 - RNA, 14 nt, Mycobacterium avium subsp. paratuberculosis
guccacgguggcgc

SEQ ID NO: 2964227 - RNA, 18 nt, Mycobacterium avium subsp. paratuberculosis
guccacgguggcgccgaa

SEQ ID NO: 2964228 - RNA, 14 nt, Mycobacterium avium subsp. paratuberculosis
guccacguccugcc

SEQ ID NO: 2964229 - RNA, 15 nt, Mycobacterium avium subsp. paratuberculosis
guccacguugaugcc

SEQ ID NO: 2964230 - RNA, 18 nt, Mycobacterium avium subsp. paratuberculosis
guccacguugaugccgcc

SEQ ID NO: 2964231 - RNA, 24 nt, Mycobacterium avium subsp. paratuberculosis
guccacguugaugccgcccagcag

SEQ ID NO: 2964232 - RNA, 23 nt, Mycobacterium avium subsp. paratuberculosis
guccacuccaauacggcccggcg

SEQ ID NO: 2964233 - RNA, 15 nt, Mycobacterium avium subsp. paratuberculosis
guccacucgaugucc

SEQ ID NO: 2964234 - RNA, 17 nt, Mycobacterium avium subsp. paratuberculosis
guccagaacucggcggc

SEQ ID NO: 2964235 - RNA, 18 nt, Mycobacterium avium subsp. paratuberculosis
guccagaacucggcggcg

SEQ ID NO: 2964236 - RNA, 21 nt, Mycobacterium avium subsp. paratuberculosis
guccagaacucggcggcgguu

SEQ ID NO: 2964237 - RNA, 14 nt, Mycobacterium avium subsp. paratuberculosis
guccagaccggccg

SEQ ID NO: 2964238 - RNA, 16 nt, Mycobacterium avium subsp. paratuberculosis
guccagaucggccagc

SEQ ID NO: 2964239 - RNA, 18 nt, Mycobacterium avium subsp. paratuberculosis
guccagaucggccagcgc

SEQ ID NO: 2964240 - RNA, 19 nt, Mycobacterium avium subsp. paratuberculosis
guccagaucggccagcgcg

SEQ ID NO: 2964241 - RNA, 16 nt, Mycobacterium avium subsp. paratuberculosis
guccagaucggcgcgc

SEQ ID NO: 2964242 - RNA, 16 nt, Mycobacterium avium subsp. paratuberculosis
guccagcaacgccgac

SEQ ID NO: 2964243 - RNA, 13 nt, Mycobacterium avium subsp. paratuberculosis
guccagcaccgcc

SEQ ID NO: 2964244 - RNA, 14 nt, Mycobacterium avium subsp. paratuberculosis
guccagcaccgcca

SEQ ID NO: 2964245 - RNA, 15 nt, Mycobacterium avium subsp. paratuberculosis
guccagcaccgccac

SEQ ID NO: 2964246 - RNA, 16 nt, Mycobacterium avium subsp. paratuberculosis
guccagcaccgccacg

SEQ ID NO: 2964247 - RNA, 14 nt, Mycobacterium avium subsp. paratuberculosis
guccagcaccggcg

SEQ ID NO: 2964248 - RNA, 19 nt, Mycobacterium avium subsp. paratuberculosis
guccagcaccggcgccccg

SEQ ID NO: 2964249 - RNA, 23 nt, Mycobacterium avium subsp. paratuberculosis
guccagcaccugaccgucggcca

SEQ ID NO: 2964250 - RNA, 17 nt, Mycobacterium avium subsp. paratuberculosis
guccagcaccugcucga

SEQ ID NO: 2964251 - RNA, 16 nt, Mycobacterium avium subsp. paratuberculosis
guccagcacgcccaga

SEQ ID NO: 2964252 - RNA, 14 nt, Mycobacterium avium subsp. paratuberculosis
guccagcacggcga

SEQ ID NO: 2964253 - RNA, 18 nt, Mycobacterium avium subsp. paratuberculosis
guccagcacgugcccagc

SEQ ID NO: 2964254 - RNA, 14 nt, Mycobacterium avium subsp. paratuberculosis
guccagcagcagcg

SEQ ID NO: 2964255 - RNA, 15 nt, Mycobacterium avium subsp. paratuberculosis
guccagcagcagcgc

SEQ ID NO: 2964256 - RNA, 17 nt, Mycobacterium avium subsp. paratuberculosis
guccagcagcagcgcgc

SEQ ID NO: 2964257 - RNA, 22 nt, Mycobacterium avium subsp. paratuberculosis
guccagcagcaugucguaguag

SEQ ID NO: 2964258 - RNA, 22 nt, Mycobacterium avium subsp. paratuberculosis
guccagcaugcccacgccgucg

SEQ ID NO: 2964259 - RNA, 15 nt, Mycobacterium avium subsp. paratuberculosis
guccagccagccgcg

SEQ ID NO: 2964260 - RNA, 16 nt, Mycobacterium avium subsp. paratuberculosis
guccagccagccgcgc

SEQ ID NO: 2964261 - RNA, 18 nt, Mycobacterium avium subsp. paratuberculosis
guccagccagccgcgccg

SEQ ID NO: 2964262 - RNA, 20 nt, Mycobacterium avium subsp. paratuberculosis
guccagccagccgcgccgcg

SEQ ID NO: 2964263 - RNA, 13 nt, Mycobacterium avium subsp. paratuberculosis
guccagcccagcg

SEQ ID NO: 2964264 - RNA, 22 nt, Mycobacterium avium subsp. paratuberculosis
guccagcccgauguuggccuca

SEQ ID NO: 2964265 - RNA, 13 nt, Mycobacterium avium subsp. paratuberculosis
guccagcccgcgc

SEQ ID NO: 2964266 - RNA, 21 nt, Mycobacterium avium subsp. paratuberculosis
guccagcccgcgccagcucgg

SEQ ID NO: 2964267 - RNA, 14 nt, Mycobacterium avium subsp. paratuberculosis
guccagcccgguca

SEQ ID NO: 2964268 - RNA, 22 nt, Mycobacterium avium subsp. paratuberculosis
guccagcccuacccguccagcg

SEQ ID NO: 2964269 - RNA, 13 nt, Mycobacterium avium subsp. paratuberculosis
guccagccgccgc

SEQ ID NO: 2964270 - RNA, 15 nt, Mycobacterium avium subsp. paratuberculosis
guccagccgccgcgu

SEQ ID NO: 2964271 - RNA, 16 nt, Mycobacterium avium subsp. paratuberculosis
guccagccgccggcgg

SEQ ID NO: 2964272 - RNA, 11 nt, Mycobacterium avium subsp. paratuberculosis
guccagccggu

SEQ ID NO: 2964273 - RNA, 18 nt, Mycobacterium avium subsp. paratuberculosis
guccagccggucgcaggu

SEQ ID NO: 2964274 - RNA, 19 nt, Mycobacterium avium subsp. paratuberculosis
guccagccggucgcaggug

SEQ ID NO: 2964275 - RNA, 13 nt, Mycobacterium avium subsp. paratuberculosis
guccagccgugcg

SEQ ID NO: 2964276 - RNA, 19 nt, Mycobacterium avium subsp. paratuberculosis
guccagccguucgcgcacg

SEQ ID NO: 2964277 - RNA, 21 nt, Mycobacterium avium subsp. paratuberculosis
guccagcgaaucgaccggguu

SEQ ID NO: 2964278 - RNA, 13 nt, Mycobacterium avium subsp. paratuberculosis
guccagcgcggug

SEQ ID NO: 2964279 - RNA, 14 nt, Mycobacterium avium subsp. paratuberculosis
guccagcgcgguga

SEQ ID NO: 2964280 - RNA, 11 nt, Mycobacterium avium subsp. paratuberculosis
guccagcggcc

SEQ ID NO: 2964281 - RNA, 18 nt, Mycobacterium avium subsp. paratuberculosis
guccagcggguugccgcu

SEQ ID NO: 2964282 - RNA, 20 nt, Mycobacterium avium subsp. paratuberculosis
guccagcggguugucgucgu

SEQ ID NO: 2964283 - RNA, 22 nt, Mycobacterium avium subsp. paratuberculosis
guccagcggguugucgucgucg

SEQ ID NO: 2964284 - RNA, 23 nt, Mycobacterium avium subsp. paratuberculosis
guccagcgucgacugcaccgacu

SEQ ID NO: 2964285 - RNA, 13 nt, Mycobacterium avium subsp. paratuberculosis
guccagcgucgcg

SEQ ID NO: 2964286 - RNA, 16 nt, Mycobacterium avium subsp. paratuberculosis
guccagcgucgcggcc

SEQ ID NO: 2964287 - RNA, 15 nt, Mycobacterium avium subsp. paratuberculosis
guccagcgugccgcg

SEQ ID NO: 2964288 - RNA, 17 nt, Mycobacterium avium subsp. paratuberculosis
guccagcgugccgcgca

SEQ ID NO: 2964289 - RNA, 18 nt, Mycobacterium avium subsp. paratuberculosis
guccagcgugccgcgcac

SEQ ID NO: 2964290 - RNA, 19 nt, Mycobacterium avium subsp. paratuberculosis
guccagcgugccgcgcacc

SEQ ID NO: 2964291 - RNA, 17 nt, Mycobacterium avium subsp. paratuberculosis
guccaucgggaccgcgg

SEQ ID NO: 2964292 - RNA, 16 nt, Mycobacterium avium subsp. paratuberculosis
guccaucguccucgcg

SEQ ID NO: 2964293 - RNA, 17 nt, Mycobacterium avium subsp. paratuberculosis
guccaucuccagcuccg

SEQ ID NO: 2964294 - RNA, 22 nt, Mycobacterium avium subsp. paratuberculosis
guccaugcucuugcgggcggca

SEQ ID NO: 2964295 - RNA, 20 nt, Mycobacterium avium subsp. paratuberculosis
guccaugcuggugccgccga

SEQ ID NO: 2964296 - RNA, 14 nt, Mycobacterium avium subsp. paratuberculosis
guccauggccuuga

SEQ ID NO: 2964297 - RNA, 18 nt, Mycobacterium avium subsp. paratuberculosis
guccauggucgagccgca

SEQ ID NO: 2964298 - RNA, 16 nt, Mycobacterium avium subsp. paratuberculosis
guccauguaguucagc

SEQ ID NO: 2964299 - RNA, 16 nt, Mycobacterium avium subsp. paratuberculosis
gucccaauccucgccg

SEQ ID NO: 2964300 - RNA, 19 nt, Mycobacterium avium subsp. paratuberculosis
gucccacaccaccaccgag

SEQ ID NO: 2964301 - RNA, 20 nt, Mycobacterium avium subsp. paratuberculosis
gucccacaccaccaccgagc

SEQ ID NO: 2964302 - RNA, 21 nt, Mycobacterium avium subsp. paratuberculosis
gucccacaccaccaccgagcc

SEQ ID NO: 2964303 - RNA, 17 nt, Mycobacterium avium subsp. paratuberculosis
gucccacaucuccuugg

SEQ ID NO: 2964304 - RNA, 24 nt, Mycobacterium avium subsp. paratuberculosis
gucccacguggugaucagcauccg

SEQ ID NO: 2964305 - RNA, 13 nt, Mycobacterium avium subsp. paratuberculosis
gucccacucggga

SEQ ID NO: 2964306 - RNA, 23 nt, Mycobacterium avium subsp. paratuberculosis
gucccagaucguagggcucggcg

SEQ ID NO: 2964307 - RNA, 21 nt, Mycobacterium avium subsp. paratuberculosis
gucccagcacaacgccuccga

SEQ ID NO: 2964308 - RNA, 18 nt, Mycobacterium avium subsp. paratuberculosis
gucccagcacagccgucg

SEQ ID NO: 2964309 - RNA, 19 nt, Mycobacterium avium subsp. paratuberculosis
gucccagcacagccgucgc

SEQ ID NO: 2964310 - RNA, 14 nt, Mycobacterium avium subsp. paratuberculosis
gucccagccggaca

SEQ ID NO: 2964311 - RNA, 20 nt, Mycobacterium avium subsp. paratuberculosis
gucccagcgcaacggcgucg

SEQ ID NO: 2964312 - RNA, 13 nt, Mycobacterium avium subsp. paratuberculosis
gucccagcgccac

SEQ ID NO: 2964313 - RNA, 16 nt, Mycobacterium avium subsp. paratuberculosis
gucccagcgccacugg

SEQ ID NO: 2964314 - RNA, 20 nt, Mycobacterium avium subsp. paratuberculosis
gucccaggguuggucggagc

SEQ ID NO: 2964315 - RNA, 13 nt, Mycobacterium avium subsp. paratuberculosis
gucccaggugcug

SEQ ID NO: 2964316 - RNA, 20 nt, Mycobacterium avium subsp. paratuberculosis
gucccaggugggcgcgcagc

SEQ ID NO: 2964317 - RNA, 20 nt, Mycobacterium avium subsp. paratuberculosis
gucccaguccagccguucgc

SEQ ID NO: 2964318 - RNA, 16 nt, Mycobacterium avium subsp. paratuberculosis
gucccagugcucgacc

SEQ ID NO: 2964319 - RNA, 20 nt, Mycobacterium avium subsp. paratuberculosis
gucccagugcucgaccagau

SEQ ID NO: 2964320 - RNA, 20 nt, Mycobacterium avium subsp. paratuberculosis
gucccagugcuugggcacgu

SEQ ID NO: 2964321 - RNA, 17 nt, Mycobacterium avium subsp. paratuberculosis
gucccaguucccggcgg

SEQ ID NO: 2964322 - RNA, 19 nt, Mycobacterium avium subsp. paratuberculosis
gucccaguucccggcgggc

SEQ ID NO: 2964323 - RNA, 23 nt, Mycobacterium avium subsp. paratuberculosis
gucccaguucccggcgggcaggu

SEQ ID NO: 2964324 - RNA, 22 nt, Mycobacterium avium subsp. paratuberculosis
gucccaguuguuuccccagccc

SEQ ID NO: 2964325 - RNA, 14 nt, Mycobacterium avium subsp. paratuberculosis
guccccaccaccga

SEQ ID NO: 2964326 - RNA, 18 nt, Mycobacterium avium subsp. paratuberculosis
guccccaccaccgacagc

SEQ ID NO: 2964327 - RNA, 15 nt, Mycobacterium avium subsp. paratuberculosis
guccccaccgaucag

SEQ ID NO: 2964328 - RNA, 23 nt, Mycobacterium avium subsp. paratuberculosis
guccccaccgaucaggaucggcg

SEQ ID NO: 2964329 - RNA, 16 nt, Mycobacterium avium subsp. paratuberculosis
gucccccgagcgggcc

SEQ ID NO: 2964330 - RNA, 24 nt, Mycobacterium avium subsp. paratuberculosis
gucccccgagcgggccuucacgcu

SEQ ID NO: 2964331 - RNA, 14 nt, Mycobacterium avium subsp. paratuberculosis
gucccccugagcug

SEQ ID NO: 2964332 - RNA, 19 nt, Mycobacterium avium subsp. paratuberculosis
guccccgauuucgcggccg

SEQ ID NO: 2964333 - RNA, 13 nt, Mycobacterium avium subsp. paratuberculosis
guccccgccgccg

SEQ ID NO: 2964334 - RNA, 14 nt, Mycobacterium avium subsp. paratuberculosis
guccccgccgccgu

SEQ ID NO: 2964335 - RNA, 15 nt, Mycobacterium avium subsp. paratuberculosis
guccccgccgccgug

SEQ ID NO: 2964336 - RNA, 17 nt, Mycobacterium avium subsp. paratuberculosis
guccccgccgccgugca

SEQ ID NO: 2964337 - RNA, 15 nt, Mycobacterium avium subsp. paratuberculosis
guccccgccgguggc

SEQ ID NO: 2964338 - RNA, 19 nt, Mycobacterium avium subsp. paratuberculosis
guccccgccgguggcggcg

SEQ ID NO: 2964339 - RNA, 14 nt, Mycobacterium avium subsp. paratuberculosis
guccccgcgcccgc

SEQ ID NO: 2964340 - RNA, 18 nt, Mycobacterium avium subsp. paratuberculosis
guccccgcgcccgccgcg

SEQ ID NO: 2964341 - RNA, 14 nt, Mycobacterium avium subsp. paratuberculosis
guccccgcgccggg

SEQ ID NO: 2964342 - RNA, 17 nt, Mycobacterium avium subsp. paratuberculosis
guccccgcgccgggcaa

SEQ ID NO: 2964343 - RNA, 18 nt, Mycobacterium avium subsp. paratuberculosis
guccccgcgccgggcaau

SEQ ID NO: 2964344 - RNA, 13 nt, Mycobacterium avium subsp. paratuberculosis
guccccgcgcggc

SEQ ID NO: 2964345 - RNA, 16 nt, Mycobacterium avium subsp. paratuberculosis
guccccgcgcggcucg

SEQ ID NO: 2964346 - RNA, 14 nt, Mycobacterium avium subsp. paratuberculosis
guccccgcggguga

SEQ ID NO: 2964347 - RNA, 14 nt, Mycobacterium avium subsp. paratuberculosis
guccccggccggcc

SEQ ID NO: 2964348 - RNA, 23 nt, Mycobacterium avium subsp. paratuberculosis
guccccgggcaccccggucaccg

SEQ ID NO: 2964349 - RNA, 15 nt, Mycobacterium avium subsp. paratuberculosis
guccccgggcccagc

SEQ ID NO: 2964350 - RNA, 20 nt, Mycobacterium avium subsp. paratuberculosis
guccccgggcccagcaccac

SEQ ID NO: 2964351 - RNA, 15 nt, Mycobacterium avium subsp. paratuberculosis
guccccgggcgugcc

SEQ ID NO: 2964352 - RNA, 17 nt, Mycobacterium avium subsp. paratuberculosis
guccccgugcagccggg

SEQ ID NO: 2964353 - RNA, 15 nt, Mycobacterium avium subsp. paratuberculosis
gucccgacagggagc

SEQ ID NO: 2964354 - RNA, 21 nt, Mycobacterium avium subsp. paratuberculosis
gucccgacagggagccgacga

SEQ ID NO: 2964355 - RNA, 15 nt, Mycobacterium avium subsp. paratuberculosis
gucccgacgcggcgc

SEQ ID NO: 2964356 - RNA, 22 nt, Mycobacterium avium subsp. paratuberculosis
gucccgacgcggcgcgacaccg

SEQ ID NO: 2964357 - RNA, 23 nt, Mycobacterium avium subsp. paratuberculosis
gucccgacgcggcgcgacaccgc

SEQ ID NO: 2964358 - RNA, 15 nt, Mycobacterium avium subsp. paratuberculosis
gucccgaucaccuug

SEQ ID NO: 2964359 - RNA, 12 nt, Mycobacterium avium subsp. paratuberculosis
gucccgcccggc

SEQ ID NO: 2964360 - RNA, 15 nt, Mycobacterium avium subsp. paratuberculosis
gucccgcccggcgcc

SEQ ID NO: 2964361 - RNA, 21 nt, Mycobacterium avium subsp. paratuberculosis
gucccgcccggcgccggccga

SEQ ID NO: 2964362 - RNA, 11 nt, Mycobacterium avium subsp. paratuberculosis
gucccgccguc

SEQ ID NO: 2964363 - RNA, 18 nt, Mycobacterium avium subsp. paratuberculosis
gucccgccgucucgacca

SEQ ID NO: 2964364 - RNA, 13 nt, Mycobacterium avium subsp. paratuberculosis
gucccgcgcccgc

SEQ ID NO: 2964365 - RNA, 16 nt, Mycobacterium avium subsp. paratuberculosis
gucccgcgccuggcgc

SEQ ID NO: 2964366 - RNA, 17 nt, Mycobacterium avium subsp. paratuberculosis
gucccgcgccuggcgca

SEQ ID NO: 2964367 - RNA, 12 nt, Mycobacterium avium subsp. paratuberculosis
gucccgcgcggc

SEQ ID NO: 2964368 - RNA, 13 nt, Mycobacterium avium subsp. paratuberculosis
gucccgcgcggcg

SEQ ID NO: 2964369 - RNA, 15 nt, Mycobacterium avium subsp. paratuberculosis
gucccgcgcggcgca

SEQ ID NO: 2964370 - RNA, 17 nt, Mycobacterium avium subsp. paratuberculosis
gucccgcgcggcgcagg

SEQ ID NO: 2964371 - RNA, 21 nt, Mycobacterium avium subsp. paratuberculosis
gucccgcgcggcgcagggcgg

SEQ ID NO: 2964372 - RNA, 19 nt, Mycobacterium avium subsp. paratuberculosis
gucccgcgcgggggccgcc

SEQ ID NO: 2964373 - RNA, 20 nt, Mycobacterium avium subsp. paratuberculosis
gucccgcgcgggggccgccg

SEQ ID NO: 2964374 - RNA, 14 nt, Mycobacterium avium subsp. paratuberculosis
gucccgcguggccg

SEQ ID NO: 2964375 - RNA, 19 nt, Mycobacterium avium subsp. paratuberculosis
gucccgcguugugcaccaa

SEQ ID NO: 2964376 - RNA, 22 nt, Mycobacterium avium subsp. paratuberculosis
guccgcaaccgccggcagcggc

SEQ ID NO: 2964377 - RNA, 15 nt, Mycobacterium avium subsp. paratuberculosis
guccgcaacgccggc

SEQ ID NO: 2964378 - RNA, 18 nt, Mycobacterium avium subsp. paratuberculosis
guccgcaacgccggcgug

SEQ ID NO: 2964379 - RNA, 13 nt, Mycobacterium avium subsp. paratuberculosis
guccgcaacgcgg

SEQ ID NO: 2964380 - RNA, 21 nt, Mycobacterium avium subsp. paratuberculosis
guccgcaagcaccucgcgcuc

SEQ ID NO: 2964381 - RNA, 12 nt, Mycobacterium avium subsp. paratuberculosis
guccgcaccgcg

SEQ ID NO: 2964382 - RNA, 14 nt, Mycobacterium avium subsp. paratuberculosis
guccgcaccgcgac

SEQ ID NO: 2964383 - RNA, 20 nt, Mycobacterium avium subsp. paratuberculosis
guccgcaccgcgacgagauc

SEQ ID NO: 2964384 - RNA, 19 nt, Mycobacterium avium subsp. paratuberculosis
guccgcagauagaucgacg

SEQ ID NO: 2964385 - RNA, 22 nt, Mycobacterium avium subsp. paratuberculosis
guccgcagauagaucgacgcga

SEQ ID NO: 2964386 - RNA, 13 nt, Mycobacterium avium subsp. paratuberculosis
guccgcaggcgaa

SEQ ID NO: 2964387 - RNA, 21 nt, Mycobacterium avium subsp. paratuberculosis
guccgccagggugccgcugcc

SEQ ID NO: 2964388 - RNA, 24 nt, Mycobacterium avium subsp. paratuberculosis
guccgccagggugccgcugcccgc

SEQ ID NO: 2964389 - RNA, 21 nt, Mycobacterium avium subsp. paratuberculosis
guccgcccacuucgacgguga

SEQ ID NO: 2964390 - RNA, 16 nt, Mycobacterium avium subsp. paratuberculosis
guccgcccagacgcgg

SEQ ID NO: 2964391 - RNA, 15 nt, Mycobacterium avium subsp. paratuberculosis
guccgccccgagauc

SEQ ID NO: 2964392 - RNA, 19 nt, Mycobacterium avium subsp. paratuberculosis
guccgccccgcugccggac

SEQ ID NO: 2964393 - RNA, 20 nt, Mycobacterium avium subsp. paratuberculosis
guccgccccgcugccggacc

SEQ ID NO: 2964394 - RNA, 15 nt, Mycobacterium avium subsp. paratuberculosis
guccgccgacagcgg

SEQ ID NO: 2964395 - RNA, 16 nt, Mycobacterium avium subsp. paratuberculosis
guccgccgacagcggg

SEQ ID NO: 2964396 - RNA, 15 nt, Mycobacterium avium subsp. paratuberculosis
guccgccgcagcggc

SEQ ID NO: 2964397 - RNA, 16 nt, Mycobacterium avium subsp. paratuberculosis
guccgccgcagcggcg

SEQ ID NO: 2964398 - RNA, 16 nt, Mycobacterium avium subsp. paratuberculosis
guccgccgccggcgga

SEQ ID NO: 2964399 - RNA, 15 nt, Mycobacterium avium subsp. paratuberculosis
guccgccgccgggcc

SEQ ID NO: 2964400 - RNA, 21 nt, Mycobacterium avium subsp. paratuberculosis
guccgccgccgggccugucca

SEQ ID NO: 2964401 - RNA, 14 nt, Mycobacterium avium subsp. paratuberculosis
guccgccgccgucc

SEQ ID NO: 2964402 - RNA, 19 nt, Mycobacterium avium subsp. paratuberculosis
guccgccgccgucccaccg

SEQ ID NO: 2964403 - RNA, 22 nt, Mycobacterium avium subsp. paratuberculosis
guccgccgccgucccaccggcg

SEQ ID NO: 2964404 - RNA, 19 nt, Mycobacterium avium subsp. paratuberculosis
guccgccggagaccagcag

SEQ ID NO: 2964405 - RNA, 14 nt, Mycobacterium avium subsp. paratuberculosis
guccgccggccggu

SEQ ID NO: 2964406 - RNA, 22 nt, Mycobacterium avium subsp. paratuberculosis
guccgccggccgguccucugcg

SEQ ID NO: 2964407 - RNA, 11 nt, Mycobacterium avium subsp. paratuberculosis
guccgccggcg

SEQ ID NO: 2964408 - RNA, 18 nt, Mycobacterium avium subsp. paratuberculosis
guccgccggcggugcggg

SEQ ID NO: 2964409 - RNA, 14 nt, Mycobacterium avium subsp. paratuberculosis
guccgccggcuggc

SEQ ID NO: 2964410 - RNA, 15 nt, Mycobacterium avium subsp. paratuberculosis
guccgccgggcgcga

SEQ ID NO: 2964411 - RNA, 17 nt, Mycobacterium avium subsp. paratuberculosis
guccgccgucaucggcg

SEQ ID NO: 2964412 - RNA, 18 nt, Mycobacterium avium subsp. paratuberculosis
guccgccgucaucggcgg

SEQ ID NO: 2964413 - RNA, 14 nt, Mycobacterium avium subsp. paratuberculosis
guccgccgucgagu

SEQ ID NO: 2964414 - RNA, 20 nt, Mycobacterium avium subsp. paratuberculosis
guccgccgucggggugcggu

SEQ ID NO: 2964415 - RNA, 18 nt, Mycobacterium avium subsp. paratuberculosis
guccgccuccgaccagcc

SEQ ID NO: 2964416 - RNA, 19 nt, Mycobacterium avium subsp. paratuberculosis
guccgccuccgaccagccg

SEQ ID NO: 2964417 - RNA, 15 nt, Mycobacterium avium subsp. paratuberculosis
guccgcgaacgggug

SEQ ID NO: 2964418 - RNA, 17 nt, Mycobacterium avium subsp. paratuberculosis
guccgcgaacucgucga

SEQ ID NO: 2964419 - RNA, 18 nt, Mycobacterium avium subsp. paratuberculosis
guccgcgaacucgucgac

SEQ ID NO: 2964420 - RNA, 20 nt, Mycobacterium avium subsp. paratuberculosis
guccgcgaacucgucgacgc

SEQ ID NO: 2964421 - RNA, 23 nt, Mycobacterium avium subsp. paratuberculosis
guccgcgaacucgucgacgccca

SEQ ID NO: 2964422 - RNA, 14 nt, Mycobacterium avium subsp. paratuberculosis
guccgcgacgcuga

SEQ ID NO: 2964423 - RNA, 19 nt, Mycobacterium avium subsp. paratuberculosis
guccgcgacgcugagcgcc

SEQ ID NO: 2964424 - RNA, 23 nt, Mycobacterium avium subsp. paratuberculosis
guccgcgacgcugagcgccaggc

SEQ ID NO: 2964425 - RNA, 12 nt, Mycobacterium avium subsp. paratuberculosis
guccgcgcccac

SEQ ID NO: 2964426 - RNA, 13 nt, Mycobacterium avium subsp. paratuberculosis
guccgcgcccacc

SEQ ID NO: 2964427 - RNA, 15 nt, Mycobacterium avium subsp. paratuberculosis
guccgcgcccacccg

SEQ ID NO: 2964428 - RNA, 18 nt, Mycobacterium avium subsp. paratuberculosis
guccgcgcccacccgaug

SEQ ID NO: 2964429 - RNA, 13 nt, Mycobacterium avium subsp. paratuberculosis
guccgcgccggcg

SEQ ID NO: 2964430 - RNA, 14 nt, Mycobacterium avium subsp. paratuberculosis
guccgcgccggcgc

SEQ ID NO: 2964431 - RNA, 15 nt, Mycobacterium avium subsp. paratuberculosis
guccgcgccggcgca

SEQ ID NO: 2964432 - RNA, 14 nt, Mycobacterium avium subsp. paratuberculosis
guccgcgccggucc

SEQ ID NO: 2964433 - RNA, 16 nt, Mycobacterium avium subsp. paratuberculosis
guccgcgcgaccauca

SEQ ID NO: 2964434 - RNA, 21 nt, Mycobacterium avium subsp. paratuberculosis
guccgcgcgaccaucagcccg

SEQ ID NO: 2964435 - RNA, 22 nt, Mycobacterium avium subsp. paratuberculosis
guccgcgcgagaguaucgccac

SEQ ID NO: 2964436 - RNA, 21 nt, Mycobacterium avium subsp. paratuberculosis
guccgcgcguagugcucgcgc

SEQ ID NO: 2964437 - RNA, 23 nt, Mycobacterium avium subsp. paratuberculosis
guccgcgcguagugcucgcgcag

SEQ ID NO: 2964438 - RNA, 19 nt, Mycobacterium avium subsp. paratuberculosis
guccgcggaggcgagcagc

SEQ ID NO: 2964439 - RNA, 22 nt, Mycobacterium avium subsp. paratuberculosis
guccgcggaggcgagcagccgg

SEQ ID NO: 2964440 - RNA, 23 nt, Mycobacterium avium subsp. paratuberculosis
guccgcggaggcgagcagccggg

SEQ ID NO: 2964441 - RNA, 13 nt, Mycobacterium avium subsp. paratuberculosis
guccgcggccgcg

SEQ ID NO: 2964442 - RNA, 20 nt, Mycobacterium avium subsp. paratuberculosis
guccgcggccgcggcgcgca

SEQ ID NO: 2964443 - RNA, 15 nt, Mycobacterium avium subsp. paratuberculosis
guccgcggcggaggg

SEQ ID NO: 2964444 - RNA, 13 nt, Mycobacterium avium subsp. paratuberculosis
guccgcggcggcg

SEQ ID NO: 2964445 - RNA, 15 nt, Mycobacterium avium subsp. paratuberculosis
guccgcggcggcgug

SEQ ID NO: 2964446 - RNA, 17 nt, Mycobacterium avium subsp. paratuberculosis
guccgcggcggcgugcc

SEQ ID NO: 2964447 - RNA, 21 nt, Mycobacterium avium subsp. paratuberculosis
guccgcggcggcgugccgccc

SEQ ID NO: 2964448 - RNA, 13 nt, Mycobacterium avium subsp. paratuberculosis
guccgcggcgucg

SEQ ID NO: 2964449 - RNA, 23 nt, Mycobacterium avium subsp. paratuberculosis
guccgcggcgucggguagggcgc

SEQ ID NO: 2964450 - RNA, 20 nt, Mycobacterium avium subsp. paratuberculosis
guccgcgggaauuggcaccg

SEQ ID NO: 2964451 - RNA, 22 nt, Mycobacterium avium subsp. paratuberculosis
guccgcgggaauuggcaccgga

SEQ ID NO: 2964452 - RNA, 19 nt, Mycobacterium avium subsp. paratuberculosis
guccgcggugagcaccgga

SEQ ID NO: 2964453 - RNA, 21 nt, Mycobacterium avium subsp. paratuberculosis
guccgcggugagcaccggauc

SEQ ID NO: 2964454 - RNA, 14 nt, Mycobacterium avium subsp. paratuberculosis
guccgcggugaugc

SEQ ID NO: 2964455 - RNA, 12 nt, Mycobacterium avium subsp. paratuberculosis
guccgcgguggu

SEQ ID NO: 2964456 - RNA, 14 nt, Mycobacterium avium subsp. paratuberculosis
guccgcgguggugg

SEQ ID NO: 2964457 - RNA, 23 nt, Mycobacterium avium subsp. paratuberculosis
guccgcgguuucaccgugcgcgc

SEQ ID NO: 2964458 - RNA, 14 nt, Mycobacterium avium subsp. paratuberculosis
guccgcgucggcgc

SEQ ID NO: 2964459 - RNA, 24 nt, Mycobacterium avium subsp. paratuberculosis
guccgcgugacaagccggcgucga

SEQ ID NO: 2964460 - RNA, 12 nt, Mycobacterium avium subsp. paratuberculosis
guccgcguggcc

SEQ ID NO: 2964461 - RNA, 16 nt, Mycobacterium avium subsp. paratuberculosis
guccugcucggcgacg

SEQ ID NO: 2964462 - RNA, 21 nt, Mycobacterium avium subsp. paratuberculosis
guccugcuucagcucgcugau

SEQ ID NO: 2964463 - RNA, 17 nt, Mycobacterium avium subsp. paratuberculosis
guccuggacgucgucgc

SEQ ID NO: 2964464 - RNA, 15 nt, Mycobacterium avium subsp. paratuberculosis
guccuggaucgcgca

SEQ ID NO: 2964465 - RNA, 16 nt, Mycobacterium avium subsp. paratuberculosis
guccuggaucgcgcag

SEQ ID NO: 2964466 - RNA, 18 nt, Mycobacterium avium subsp. paratuberculosis
guccuggaucgcgcaggu

SEQ ID NO: 2964467 - RNA, 19 nt, Mycobacterium avium subsp. paratuberculosis
guccuggaucgcgcaggug

SEQ ID NO: 2964468 - RNA, 17 nt, Mycobacterium avium subsp. paratuberculosis
guccuggaugaacagca

SEQ ID NO: 2964469 - RNA, 23 nt, Mycobacterium avium subsp. paratuberculosis
guccuggcccccgccccagcccg

SEQ ID NO: 2964470 - RNA, 18 nt, Mycobacterium avium subsp. paratuberculosis
guccuggcccuugaccgc

SEQ ID NO: 2964471 - RNA, 19 nt, Mycobacterium avium subsp. paratuberculosis
guccuggcgcuggugcagc

SEQ ID NO: 2964472 - RNA, 14 nt, Mycobacterium avium subsp. paratuberculosis
guccugggccggga

SEQ ID NO: 2964473 - RNA, 16 nt, Mycobacterium avium subsp. paratuberculosis
guccugggccuggcgc

SEQ ID NO: 2964474 - RNA, 23 nt, Mycobacterium avium subsp. paratuberculosis
guccugguaccccagcaaaaccc

SEQ ID NO: 2964475 - RNA, 20 nt, Mycobacterium avium subsp. paratuberculosis
guccuggucgcuuucgguga

SEQ ID NO: 2964476 - RNA, 19 nt, Mycobacterium avium subsp. paratuberculosis
guccugguugaggaucugc

SEQ ID NO: 2964477 - RNA, 21 nt, Mycobacterium avium subsp. paratuberculosis
guccuguccggucucggucgc

SEQ ID NO: 2964478 - RNA, 22 nt, Mycobacterium avium subsp. paratuberculosis
guccuucaacuugcgcgacgcc

SEQ ID NO: 2964479 - RNA, 18 nt, Mycobacterium avium subsp. paratuberculosis
guccuucuccgccgggcu

SEQ ID NO: 2964480 - RNA, 17 nt, Mycobacterium avium subsp. paratuberculosis
guccuucucgaaccggg

SEQ ID NO: 2964481 - RNA, 17 nt, Mycobacterium avium subsp. paratuberculosis
guccuugaccagcugcg

SEQ ID NO: 2964482 - RNA, 19 nt, Mycobacterium avium subsp. paratuberculosis
guccuugacccggccgcac

SEQ ID NO: 2964483 - RNA, 13 nt, Mycobacterium avium subsp. paratuberculosis
guccuugaccuug

SEQ ID NO: 2964484 - RNA, 19 nt, Mycobacterium avium subsp. paratuberculosis
guccuugagcccccaccug

SEQ ID NO: 2964485 - RNA, 17 nt, Mycobacterium avium subsp. paratuberculosis
guccuugauccgggcgc

SEQ ID NO: 2964486 - RNA, 18 nt, Mycobacterium avium subsp. paratuberculosis
guccuugauccgggcgcc

SEQ ID NO: 2964487 - RNA, 21 nt, Mycobacterium avium subsp. paratuberculosis
guccuugaucgggaacgggua

SEQ ID NO: 2964488 - RNA, 14 nt, Mycobacterium avium subsp. paratuberculosis
guccuugcccagca

SEQ ID NO: 2964489 - RNA, 17 nt, Mycobacterium avium subsp. paratuberculosis
guccuugcccagcaguu

SEQ ID NO: 2964490 - RNA, 14 nt, Mycobacterium avium subsp. paratuberculosis
guccuugcgcacca

SEQ ID NO: 2964491 - RNA, 17 nt, Mycobacterium avium subsp. paratuberculosis
guccuugcgcaccacgu

SEQ ID NO: 2964492 - RNA, 14 nt, Mycobacterium avium subsp. paratuberculosis
guccuugcgccccg

SEQ ID NO: 2964493 - RNA, 18 nt, Mycobacterium avium subsp. paratuberculosis
guccuugcgccccggcgg

SEQ ID NO: 2964494 - RNA, 17 nt, Mycobacterium avium subsp. paratuberculosis
guccuugcugcccaggg

SEQ ID NO: 2964495 - RNA, 13 nt, Mycobacterium avium subsp. paratuberculosis
guccuuggccgcc

SEQ ID NO: 2964496 - RNA, 18 nt, Mycobacterium avium subsp. paratuberculosis
guccuuggccgccagcac

SEQ ID NO: 2964497 - RNA, 21 nt, Mycobacterium avium subsp. paratuberculosis
guccuuggugauuucgcgcac

SEQ ID NO: 2964498 - RNA, 14 nt, Mycobacterium avium subsp. paratuberculosis
guccuuguggucga

SEQ ID NO: 2964499 - RNA, 15 nt, Mycobacterium avium subsp. paratuberculosis
gucgaaaaacccggu

SEQ ID NO: 2964500 - RNA, 19 nt, Mycobacterium avium subsp. paratuberculosis
gucgaaaaacccggugccg

SEQ ID NO: 2964501 - RNA, 22 nt, Mycobacterium avium subsp. paratuberculosis
gucgaaaaacccggugccggcc

SEQ ID NO: 2964502 - RNA, 18 nt, Mycobacterium avium subsp. paratuberculosis
gucgaaaccgucuccggc

SEQ ID NO: 2964503 - RNA, 21 nt, Mycobacterium avium subsp. paratuberculosis
gucgaaauagcggcgcaccug

SEQ ID NO: 2964504 - RNA, 12 nt, Mycobacterium avium subsp. paratuberculosis
gucgaaaucgca

SEQ ID NO: 2964505 - RNA, 15 nt, Mycobacterium avium subsp. paratuberculosis
gucgaacaacgcggu

SEQ ID NO: 2964506 - RNA, 20 nt, Mycobacterium avium subsp. paratuberculosis
gucgaacaacgcggugaccg

SEQ ID NO: 2964507 - RNA, 14 nt, Mycobacterium avium subsp. paratuberculosis
gucgaacaccgugc

SEQ ID NO: 2964508 - RNA, 15 nt, Mycobacterium avium subsp. paratuberculosis
gucgaacaccgugcc

SEQ ID NO: 2964509 - RNA, 13 nt, Mycobacterium avium subsp. paratuberculosis
gucgaacacggcg

SEQ ID NO: 2964510 - RNA, 18 nt, Mycobacterium avium subsp. paratuberculosis
gucgaacagcacgccggc

SEQ ID NO: 2964511 - RNA, 21 nt, Mycobacterium avium subsp. paratuberculosis
gucgaacagcacgccggccgg

SEQ ID NO: 2964512 - RNA, 12 nt, Mycobacterium avium subsp. paratuberculosis
gucgaacagcag

SEQ ID NO: 2964513 - RNA, 17 nt, Mycobacterium avium subsp. paratuberculosis
gucgaacagcaggccca

SEQ ID NO: 2964514 - RNA, 20 nt, Mycobacterium avium subsp. paratuberculosis
gucgaacagcaggcccaggc

SEQ ID NO: 2964515 - RNA, 18 nt, Mycobacterium avium subsp. paratuberculosis
gucgaacagccgggccgc

SEQ ID NO: 2964516 - RNA, 20 nt, Mycobacterium avium subsp. paratuberculosis
gucgaacagccgggccgccc

SEQ ID NO: 2964517 - RNA, 14 nt, Mycobacterium avium subsp. paratuberculosis
gucgaacagcgcgc

SEQ ID NO: 2964518 - RNA, 16 nt, Mycobacterium avium subsp. paratuberculosis
gucgaacagcgcgccc

SEQ ID NO: 2964519 - RNA, 17 nt, Mycobacterium avium subsp. paratuberculosis
gucgaacagcgcgcccg

SEQ ID NO: 2964520 - RNA, 18 nt, Mycobacterium avium subsp. paratuberculosis
gucgaacagcgcgcccga

SEQ ID NO: 2964521 - RNA, 19 nt, Mycobacterium avium subsp. paratuberculosis
gucgaacagcgcgcccgac

SEQ ID NO: 2964522 - RNA, 17 nt, Mycobacterium avium subsp. paratuberculosis
gucgaacaggaugcagc

SEQ ID NO: 2964523 - RNA, 23 nt, Mycobacterium avium subsp. paratuberculosis
gucgaacaggaugcagccggcca

SEQ ID NO: 2964524 - RNA, 17 nt, Mycobacterium avium subsp. paratuberculosis
gucgaacaucacccggc

SEQ ID NO: 2964525 - RNA, 20 nt, Mycobacterium avium subsp. paratuberculosis
gucgaacaucacccggcggc

SEQ ID NO: 2964526 - RNA, 21 nt, Mycobacterium avium subsp. paratuberculosis
gucgaacaucacccggcggca

SEQ ID NO: 2964527 - RNA, 23 nt, Mycobacterium avium subsp. paratuberculosis
gucgaaccacgcggcggcggugc

SEQ ID NO: 2964528 - RNA, 21 nt, Mycobacterium avium subsp. paratuberculosis
gucgaacccgaaaagcaccag

SEQ ID NO: 2964529 - RNA, 23 nt, Mycobacterium avium subsp. paratuberculosis
gucgaacccgaaaagcaccaggc

SEQ ID NO: 2964530 - RNA, 17 nt, Mycobacterium avium subsp. paratuberculosis
gucgaacccgaccccgg

SEQ ID NO: 2964531 - RNA, 22 nt, Mycobacterium avium subsp. paratuberculosis
gucgaaccgcgagcgcgcggug

SEQ ID NO: 2964532 - RNA, 23 nt, Mycobacterium avium subsp. paratuberculosis
gucgaacgccaccuucaccgcgc

SEQ ID NO: 2964533 - RNA, 19 nt, Mycobacterium avium subsp. paratuberculosis
gucgaacgccagcgccgca

SEQ ID NO: 2964534 - RNA, 20 nt, Mycobacterium avium subsp. paratuberculosis
gucgaacgccagcgccgcaa

SEQ ID NO: 2964535 - RNA, 17 nt, Mycobacterium avium subsp. paratuberculosis
gucgaacgcggcgccga

SEQ ID NO: 2964536 - RNA, 21 nt, Mycobacterium avium subsp. paratuberculosis
gucgaacgcggcgccgacguc

SEQ ID NO: 2964537 - RNA, 23 nt, Mycobacterium avium subsp. paratuberculosis
gucgaacgcggcgccgacguccu

SEQ ID NO: 2964538 - RNA, 16 nt, Mycobacterium avium subsp. paratuberculosis
gucgaacgcguacacg

SEQ ID NO: 2964539 - RNA, 12 nt, Mycobacterium avium subsp. paratuberculosis
gucgaacggcaa

SEQ ID NO: 2964540 - RNA, 19 nt, Mycobacterium avium subsp. paratuberculosis
gucgaacgggccgggcacc

SEQ ID NO: 2964541 - RNA, 22 nt, Mycobacterium avium subsp. paratuberculosis
gucgaacuccauccgccgucga

SEQ ID NO: 2964542 - RNA, 23 nt, Mycobacterium avium subsp. paratuberculosis
gucgaacucgaugggggugccgc

SEQ ID NO: 2964543 - RNA, 17 nt, Mycobacterium avium subsp. paratuberculosis
gucgaacucgggcccga

SEQ ID NO: 2964544 - RNA, 18 nt, Mycobacterium avium subsp. paratuberculosis
gucgaacucgggcccgag

SEQ ID NO: 2964545 - RNA, 17 nt, Mycobacterium avium subsp. paratuberculosis
gucgaccuccucgaccc

SEQ ID NO: 2964546 - RNA, 19 nt, Mycobacterium avium subsp. paratuberculosis
gucgaccuccucgaccccg

SEQ ID NO: 2964547 - RNA, 14 nt, Mycobacterium avium subsp. paratuberculosis
gucgaccucggcca

SEQ ID NO: 2964548 - RNA, 15 nt, Mycobacterium avium subsp. paratuberculosis
gucgaccucggccac

SEQ ID NO: 2964549 - RNA, 16 nt, Mycobacterium avium subsp. paratuberculosis
gucgaccucggccacc

SEQ ID NO: 2964550 - RNA, 17 nt, Mycobacterium avium subsp. paratuberculosis
gucgaccucggccacca

SEQ ID NO: 2964551 - RNA, 14 nt, Mycobacterium avium subsp. paratuberculosis
gucgaccugcucgu

SEQ ID NO: 2964552 - RNA, 19 nt, Mycobacterium avium subsp. paratuberculosis
gucgaccugcucgucggug

SEQ ID NO: 2964553 - RNA, 20 nt, Mycobacterium avium subsp. paratuberculosis
gucgaccugcucgucgguga

SEQ ID NO: 2964554 - RNA, 20 nt, Mycobacterium avium subsp. paratuberculosis
gucgaccuuggggucaccgu

SEQ ID NO: 2964555 - RNA, 21 nt, Mycobacterium avium subsp. paratuberculosis
gucgaccuuggggucaccguc

SEQ ID NO: 2964556 - RNA, 18 nt, Mycobacterium avium subsp. paratuberculosis
gucgacgaacuuggacgg

SEQ ID NO: 2964557 - RNA, 17 nt, Mycobacterium avium subsp. paratuberculosis
gucgacgaccaccacca

SEQ ID NO: 2964558 - RNA, 13 nt, Mycobacterium avium subsp. paratuberculosis
gucgacgacccgu

SEQ ID NO: 2964559 - RNA, 20 nt, Mycobacterium avium subsp. paratuberculosis
gucgacgacgaaucccgccu

SEQ ID NO: 2964560 - RNA, 21 nt, Mycobacterium avium subsp. paratuberculosis
gucgacgacgaaucccgccuc

SEQ ID NO: 2964561 - RNA, 15 nt, Mycobacterium avium subsp. paratuberculosis
gucgacgacggcgcc

SEQ ID NO: 2964562 - RNA, 18 nt, Mycobacterium avium subsp. paratuberculosis
gucgacgacggcgccgcg

SEQ ID NO: 2964563 - RNA, 19 nt, Mycobacterium avium subsp. paratuberculosis
gucgacgacggcgccgcgu

SEQ ID NO: 2964564 - RNA, 18 nt, Mycobacterium avium subsp. paratuberculosis
gucgacgacguugcgggc

SEQ ID NO: 2964565 - RNA, 20 nt, Mycobacterium avium subsp. paratuberculosis
gucgacgacguugcgggcca

SEQ ID NO: 2964566 - RNA, 15 nt, Mycobacterium avium subsp. paratuberculosis
gucgacgagcaggcu

SEQ ID NO: 2964567 - RNA, 14 nt, Mycobacterium avium subsp. paratuberculosis
gucgacgagcccgc

SEQ ID NO: 2964568 - RNA, 16 nt, Mycobacterium avium subsp. paratuberculosis
gucgacgagcccgccg

SEQ ID NO: 2964569 - RNA, 17 nt, Mycobacterium avium subsp. paratuberculosis
gucgacgagcccgccgg

SEQ ID NO: 2964570 - RNA, 18 nt, Mycobacterium avium subsp. paratuberculosis
gucgacgagcccgccggc

SEQ ID NO: 2964571 - RNA, 21 nt, Mycobacterium avium subsp. paratuberculosis
gucgacgagcccgccggcggg

SEQ ID NO: 2964572 - RNA, 16 nt, Mycobacterium avium subsp. paratuberculosis
gucgacgagcccgcgc

SEQ ID NO: 2964573 - RNA, 17 nt, Mycobacterium avium subsp. paratuberculosis
gucgacgagcccgcgcc

SEQ ID NO: 2964574 - RNA, 14 nt, Mycobacterium avium subsp. paratuberculosis
gucgacgaugcguu

SEQ ID NO: 2964575 - RNA, 20 nt, Mycobacterium avium subsp. paratuberculosis
gucgacgauggcccggaccg

SEQ ID NO: 2964576 - RNA, 21 nt, Mycobacterium avium subsp. paratuberculosis
gucgacgauggcccggaccgc

SEQ ID NO: 2964577 - RNA, 17 nt, Mycobacterium avium subsp. paratuberculosis
gucgacgauggcccggg

SEQ ID NO: 2964578 - RNA, 23 nt, Mycobacterium avium subsp. paratuberculosis
gucgacgauggcccgggccacac

SEQ ID NO: 2964579 - RNA, 20 nt, Mycobacterium avium subsp. paratuberculosis
gucgacgcaccacgagcagc

SEQ ID NO: 2964580 - RNA, 23 nt, Mycobacterium avium subsp. paratuberculosis
gucgacgcaccacgagcagccga

SEQ ID NO: 2964581 - RNA, 13 nt, Mycobacterium avium subsp. paratuberculosis
gucgacgcccacc

SEQ ID NO: 2964582 - RNA, 15 nt, Mycobacterium avium subsp. paratuberculosis
gucgacgccccgcgc

SEQ ID NO: 2964583 - RNA, 20 nt, Mycobacterium avium subsp. paratuberculosis
gucgacgcccuuggcgccca

SEQ ID NO: 2964584 - RNA, 22 nt, Mycobacterium avium subsp. paratuberculosis
gucgacgcccuuggcgcccagc

SEQ ID NO: 2964585 - RNA, 19 nt, Mycobacterium avium subsp. paratuberculosis
gucgacgccgauggugacc

SEQ ID NO: 2964586 - RNA, 14 nt, Mycobacterium avium subsp. paratuberculosis
gucgacgccgugcu

SEQ ID NO: 2964587 - RNA, 15 nt, Mycobacterium avium subsp. paratuberculosis
gucgacgccgugcug

SEQ ID NO: 2964588 - RNA, 22 nt, Mycobacterium avium subsp. paratuberculosis
gucgacgccgugguccagccgg

SEQ ID NO: 2964589 - RNA, 15 nt, Mycobacterium avium subsp. paratuberculosis
gucgacgcgccgcac

SEQ ID NO: 2964590 - RNA, 13 nt, Mycobacterium avium subsp. paratuberculosis
gucgacgcgggcg

SEQ ID NO: 2964591 - RNA, 14 nt, Mycobacterium avium subsp. paratuberculosis
gucgacgcgggcga

SEQ ID NO: 2964592 - RNA, 19 nt, Mycobacterium avium subsp. paratuberculosis
gucgacgcgggcgacguca

SEQ ID NO: 2964593 - RNA, 23 nt, Mycobacterium avium subsp. paratuberculosis
gucgacgcggucgaacaacgcgg

SEQ ID NO: 2964594 - RNA, 22 nt, Mycobacterium avium subsp. paratuberculosis
gucgacgcguuguugcucggcg

SEQ ID NO: 2964595 - RNA, 19 nt, Mycobacterium avium subsp. paratuberculosis
gucgacgcugagcacccgc

SEQ ID NO: 2964596 - RNA, 20 nt, Mycobacterium avium subsp. paratuberculosis
gucgacgcugagcacccgcc

SEQ ID NO: 2964597 - RNA, 21 nt, Mycobacterium avium subsp. paratuberculosis
gucgacgcugagcacccgccc

SEQ ID NO: 2964598 - RNA, 22 nt, Mycobacterium avium subsp. paratuberculosis
gucgacgcugagcacccgcccg

SEQ ID NO: 2964599 - RNA, 16 nt, Mycobacterium avium subsp. paratuberculosis
gucgacgcugagccgc

SEQ ID NO: 2964600 - RNA, 17 nt, Mycobacterium avium subsp. paratuberculosis
gucgacgcugagccgcu

SEQ ID NO: 2964601 - RNA, 20 nt, Mycobacterium avium subsp. paratuberculosis
gucgacgcugagccgcucgu

SEQ ID NO: 2964602 - RNA, 23 nt, Mycobacterium avium subsp. paratuberculosis
gucgacgcugagccgcucgucga

SEQ ID NO: 2964603 - RNA, 15 nt, Mycobacterium avium subsp. paratuberculosis
gucgacgcugcccaa

SEQ ID NO: 2964604 - RNA, 15 nt, Mycobacterium avium subsp. paratuberculosis
gucgacgcugugcgc

SEQ ID NO: 2964605 - RNA, 19 nt, Mycobacterium avium subsp. paratuberculosis
gucgacggagucgucggcg

SEQ ID NO: 2964606 - RNA, 20 nt, Mycobacterium avium subsp. paratuberculosis
gucgacggagucgucggcgc

SEQ ID NO: 2964607 - RNA, 16 nt, Mycobacterium avium subsp. paratuberculosis
gucgacggcaagcagu

SEQ ID NO: 2964608 - RNA, 15 nt, Mycobacterium avium subsp. paratuberculosis
gucgacggccgcgcc

SEQ ID NO: 2964609 - RNA, 17 nt, Mycobacterium avium subsp. paratuberculosis
gucgacggccgcgccga

SEQ ID NO: 2964610 - RNA, 12 nt, Mycobacterium avium subsp. paratuberculosis
gucgacggcgcc

SEQ ID NO: 2964611 - RNA, 20 nt, Mycobacterium avium subsp. paratuberculosis
gucgacggcgccggacaccu

SEQ ID NO: 2964612 - RNA, 14 nt, Mycobacterium avium subsp. paratuberculosis
gucgacggcgguga

SEQ ID NO: 2964613 - RNA, 17 nt, Mycobacterium avium subsp. paratuberculosis
gucgacggcguggaaca

SEQ ID NO: 2964614 - RNA, 18 nt, Mycobacterium avium subsp. paratuberculosis
gucgacggcguggaacac

SEQ ID NO: 2964615 - RNA, 19 nt, Mycobacterium avium subsp. paratuberculosis
gucgacggcguggaacacg

SEQ ID NO: 2964616 - RNA, 22 nt, Mycobacterium avium subsp. paratuberculosis
gucgacggcguggaacacgccc

SEQ ID NO: 2964617 - RNA, 13 nt, Mycobacterium avium subsp. paratuberculosis
gucgacgggaaga

SEQ ID NO: 2964618 - RNA, 17 nt, Mycobacterium avium subsp. paratuberculosis
gucgacgggccaccagc

SEQ ID NO: 2964619 - RNA, 23 nt, Mycobacterium avium subsp. paratuberculosis
gucgacgggccaccagcgcaggu

SEQ ID NO: 2964620 - RNA, 14 nt, Mycobacterium avium subsp. paratuberculosis
gucgacggugauca

SEQ ID NO: 2964621 - RNA, 23 nt, Mycobacterium avium subsp. paratuberculosis
gucgacgguugccucggccagca

SEQ ID NO: 2964622 - RNA, 18 nt, Mycobacterium avium subsp. paratuberculosis
gucgacgguuugcccggc

SEQ ID NO: 2964623 - RNA, 20 nt, Mycobacterium avium subsp. paratuberculosis
gucgacgguuugcccggcga

SEQ ID NO: 2964624 - RNA, 15 nt, Mycobacterium avium subsp. paratuberculosis
gucgacgucaacacc

SEQ ID NO: 2964625 - RNA, 16 nt, Mycobacterium avium subsp. paratuberculosis
gucgacgucauccggc

SEQ ID NO: 2964626 - RNA, 19 nt, Mycobacterium avium subsp. paratuberculosis
gucgacgucauccggcugc

SEQ ID NO: 2964627 - RNA, 20 nt, Mycobacterium avium subsp. paratuberculosis
gucgacguccacguugaugc

SEQ ID NO: 2964628 - RNA, 17 nt, Mycobacterium avium subsp. paratuberculosis
gucgacguccucgaugc

SEQ ID NO: 2964629 - RNA, 20 nt, Mycobacterium avium subsp. paratuberculosis
gucgagcgucacgcuggcgu

SEQ ID NO: 2964630 - RNA, 14 nt, Mycobacterium avium subsp. paratuberculosis
gucgagcuccucgg

SEQ ID NO: 2964631 - RNA, 17 nt, Mycobacterium avium subsp. paratuberculosis
gucgagcuccucggcca

SEQ ID NO: 2964632 - RNA, 20 nt, Mycobacterium avium subsp. paratuberculosis
gucgagcuccucggccagcg

SEQ ID NO: 2964633 - RNA, 20 nt, Mycobacterium avium subsp. paratuberculosis
gucgagcucgaagcccaggg

SEQ ID NO: 2964634 - RNA, 20 nt, Mycobacterium avium subsp. paratuberculosis
gucgaggacugggucaccgu

SEQ ID NO: 2964635 - RNA, 20 nt, Mycobacterium avium subsp. paratuberculosis
gucgaggccgaaccgcagcc

SEQ ID NO: 2964636 - RNA, 22 nt, Mycobacterium avium subsp. paratuberculosis
gucgaggccgaaccgcagccgg

SEQ ID NO: 2964637 - RNA, 23 nt, Mycobacterium avium subsp. paratuberculosis
gucgaggccgaaccgcagccgga

SEQ ID NO: 2964638 - RNA, 13 nt, Mycobacterium avium subsp. paratuberculosis
gucgaggccggcc

SEQ ID NO: 2964639 - RNA, 23 nt, Mycobacterium avium subsp. paratuberculosis
gucgaggccguaucccaccacga

SEQ ID NO: 2964640 - RNA, 16 nt, Mycobacterium avium subsp. paratuberculosis
gucgaggcgcugcagc

SEQ ID NO: 2964641 - RNA, 13 nt, Mycobacterium avium subsp. paratuberculosis
gucgagggccacc

SEQ ID NO: 2964642 - RNA, 14 nt, Mycobacterium avium subsp. paratuberculosis
gucgagggccaccg

SEQ ID NO: 2964643 - RNA, 20 nt, Mycobacterium avium subsp. paratuberculosis
gucgagggccaccggcuccu

SEQ ID NO: 2964644 - RNA, 19 nt, Mycobacterium avium subsp. paratuberculosis
gucgagggcguucgcggug

SEQ ID NO: 2964645 - RNA, 22 nt, Mycobacterium avium subsp. paratuberculosis
gucgagggcuaaccaccgguga

SEQ ID NO: 2964646 - RNA, 18 nt, Mycobacterium avium subsp. paratuberculosis
gucgaggggcuugagcgc

SEQ ID NO: 2964647 - RNA, 22 nt, Mycobacterium avium subsp. paratuberculosis
gucgaggggcuugagcgcgucg

SEQ ID NO: 2964648 - RNA, 19 nt, Mycobacterium avium subsp. paratuberculosis
gucgagguagugcgcgaug

SEQ ID NO: 2964649 - RNA, 17 nt, Mycobacterium avium subsp. paratuberculosis
gucgagguccucggcga

SEQ ID NO: 2964650 - RNA, 19 nt, Mycobacterium avium subsp. paratuberculosis
gucgagguccucggcgaug

SEQ ID NO: 2964651 - RNA, 19 nt, Mycobacterium avium subsp. paratuberculosis
gucgaggucgccgacagcg

SEQ ID NO: 2964652 - RNA, 14 nt, Mycobacterium avium subsp. paratuberculosis
gucgaggucgcgca

SEQ ID NO: 2964653 - RNA, 16 nt, Mycobacterium avium subsp. paratuberculosis
gucgaggucgucggcc

SEQ ID NO: 2964654 - RNA, 20 nt, Mycobacterium avium subsp. paratuberculosis
gucgaggucgucggccaguu

SEQ ID NO: 2964655 - RNA, 19 nt, Mycobacterium avium subsp. paratuberculosis
gucgagguguugucgugcc

SEQ ID NO: 2964656 - RNA, 22 nt, Mycobacterium avium subsp. paratuberculosis
gucgagguguugucgugccggg

SEQ ID NO: 2964657 - RNA, 21 nt, Mycobacterium avium subsp. paratuberculosis
gucgagguugaugccgacguc

SEQ ID NO: 2964658 - RNA, 18 nt, Mycobacterium avium subsp. paratuberculosis
gucgagucggccaccgcg

SEQ ID NO: 2964659 - RNA, 23 nt, Mycobacterium avium subsp. paratuberculosis
gucgagucggccaccgcggucga

SEQ ID NO: 2964660 - RNA, 22 nt, Mycobacterium avium subsp. paratuberculosis
gucgagugcucgauggccagcg

SEQ ID NO: 2964661 - RNA, 19 nt, Mycobacterium avium subsp. paratuberculosis
gucgaguuccuccacgacu

SEQ ID NO: 2964662 - RNA, 19 nt, Mycobacterium avium subsp. paratuberculosis
gucgaguucgcggcgcagc

SEQ ID NO: 2964663 - RNA, 21 nt, Mycobacterium avium subsp. paratuberculosis
gucgaguucgcggcgcagcac

SEQ ID NO: 2964664 - RNA, 23 nt, Mycobacterium avium subsp. paratuberculosis
gucgaguucgcggcgcagcacgg

SEQ ID NO: 2964665 - RNA, 18 nt, Mycobacterium avium subsp. paratuberculosis
gucgaucaacaccaacga

SEQ ID NO: 2964666 - RNA, 17 nt, Mycobacterium avium subsp. paratuberculosis
gucgaucaccucgucga

SEQ ID NO: 2964667 - RNA, 17 nt, Mycobacterium avium subsp. paratuberculosis
gucgaucacgccgccgg

SEQ ID NO: 2964668 - RNA, 21 nt, Mycobacterium avium subsp. paratuberculosis
gucgaucagcgacggcccgcc

SEQ ID NO: 2964669 - RNA, 14 nt, Mycobacterium avium subsp. paratuberculosis
gucgaucagcgcgc

SEQ ID NO: 2964670 - RNA, 17 nt, Mycobacterium avium subsp. paratuberculosis
gucgaucagcgcgccgc

SEQ ID NO: 2964671 - RNA, 20 nt, Mycobacterium avium subsp. paratuberculosis
gucgaucagcgcgccgccca

SEQ ID NO: 2964672 - RNA, 21 nt, Mycobacterium avium subsp. paratuberculosis
gucgaucauguagcgcuggua

SEQ ID NO: 2964673 - RNA, 18 nt, Mycobacterium avium subsp. paratuberculosis
gucgauccacccaccggc

SEQ ID NO: 2964674 - RNA, 18 nt, Mycobacterium avium subsp. paratuberculosis
gucgauccacucccgcgc

SEQ ID NO: 2964675 - RNA, 19 nt, Mycobacterium avium subsp. paratuberculosis
gucgauccacucccgcgcg

SEQ ID NO: 2964676 - RNA, 20 nt, Mycobacterium avium subsp. paratuberculosis
gucgauccacucccgcgcgc

SEQ ID NO: 2964677 - RNA, 16 nt, Mycobacterium avium subsp. paratuberculosis
gucgauccccgcagcu

SEQ ID NO: 2964678 - RNA, 17 nt, Mycobacterium avium subsp. paratuberculosis
gucgauccccgcagcuc

SEQ ID NO: 2964679 - RNA, 19 nt, Mycobacterium avium subsp. paratuberculosis
gucgauccccgcagcuccc

SEQ ID NO: 2964680 - RNA, 15 nt, Mycobacterium avium subsp. paratuberculosis
gucgaucccgccggc

SEQ ID NO: 2964681 - RNA, 22 nt, Mycobacterium avium subsp. paratuberculosis
gucgaucccgccggcgaucgac

SEQ ID NO: 2964682 - RNA, 23 nt, Mycobacterium avium subsp. paratuberculosis
gucgaucccgccggcgaucgacg

SEQ ID NO: 2964683 - RNA, 22 nt, Mycobacterium avium subsp. paratuberculosis
gucgaucgaauacaccugccgc

SEQ ID NO: 2964684 - RNA, 13 nt, Mycobacterium avium subsp. paratuberculosis
gucgaucgacgcc

SEQ ID NO: 2964685 - RNA, 13 nt, Mycobacterium avium subsp. paratuberculosis
gucgaucgccguc

SEQ ID NO: 2964686 - RNA, 14 nt, Mycobacterium avium subsp. paratuberculosis
gucgaucgccguca

SEQ ID NO: 2964687 - RNA, 12 nt, Mycobacterium avium subsp. paratuberculosis
gucgaucgcguc

SEQ ID NO: 2964688 - RNA, 12 nt, Mycobacterium avium subsp. paratuberculosis
gucgaucggcuc

SEQ ID NO: 2964689 - RNA, 15 nt, Mycobacterium avium subsp. paratuberculosis
gucgaucggcucggc

SEQ ID NO: 2964690 - RNA, 19 nt, Mycobacterium avium subsp. paratuberculosis
gucgaucggcucggcgccc

SEQ ID NO: 2964691 - RNA, 22 nt, Mycobacterium avium subsp. paratuberculosis
gucgaucggcucggcgccccac

SEQ ID NO: 2964692 - RNA, 19 nt, Mycobacterium avium subsp. paratuberculosis
gucgaucuccucgcgcggc

SEQ ID NO: 2964693 - RNA, 16 nt, Mycobacterium avium subsp. paratuberculosis
gucgaucucggccagc

SEQ ID NO: 2964694 - RNA, 15 nt, Mycobacterium avium subsp. paratuberculosis
gucgaucucggcgca

SEQ ID NO: 2964695 - RNA, 19 nt, Mycobacterium avium subsp. paratuberculosis
gucgaucucggcgcaggug

SEQ ID NO: 2964696 - RNA, 16 nt, Mycobacterium avium subsp. paratuberculosis
gucgaucucggugagc

SEQ ID NO: 2964697 - RNA, 18 nt, Mycobacterium avium subsp. paratuberculosis
gucgaucucggugagccg

SEQ ID NO: 2964698 - RNA, 17 nt, Mycobacterium avium subsp. paratuberculosis
gucgaucucgucgcaca

SEQ ID NO: 2964699 - RNA, 14 nt, Mycobacterium avium subsp. paratuberculosis
gucgaucuggcgga

SEQ ID NO: 2964700 - RNA, 18 nt, Mycobacterium avium subsp. paratuberculosis
gucgaucuucgcggcgua

SEQ ID NO: 2964701 - RNA, 17 nt, Mycobacterium avium subsp. paratuberculosis
gucgaucuugucgucca

SEQ ID NO: 2964702 - RNA, 23 nt, Mycobacterium avium subsp. paratuberculosis
gucgaugaacucgcgggcgagca

SEQ ID NO: 2964703 - RNA, 21 nt, Mycobacterium avium subsp. paratuberculosis
gucgaugaaguugaagacgcg

SEQ ID NO: 2964704 - RNA, 23 nt, Mycobacterium avium subsp. paratuberculosis
gucgaugaccucgcgcccggcgc

SEQ ID NO: 2964705 - RNA, 14 nt, Mycobacterium avium subsp. paratuberculosis
gucgaugacgccgc

SEQ ID NO: 2964706 - RNA, 15 nt, Mycobacterium avium subsp. paratuberculosis
gucgaugacgccgcg

SEQ ID NO: 2964707 - RNA, 17 nt, Mycobacterium avium subsp. paratuberculosis
gucgaugacgccgcgcc

SEQ ID NO: 2964708 - RNA, 16 nt, Mycobacterium avium subsp. paratuberculosis
gucgaugacggcggcg

SEQ ID NO: 2964709 - RNA, 17 nt, Mycobacterium avium subsp. paratuberculosis
gucgaugacggcggcgc

SEQ ID NO: 2964710 - RNA, 23 nt, Mycobacterium avium subsp. paratuberculosis
gucgaugaucuggcggucccgca

SEQ ID NO: 2964711 - RNA, 18 nt, Mycobacterium avium subsp. paratuberculosis
gucgaugaugccggcgga

SEQ ID NO: 2964712 - RNA, 15 nt, Mycobacterium avium subsp. paratuberculosis
gucgaugcccgcgcc

SEQ ID NO: 2964713 - RNA, 22 nt, Mycobacterium avium subsp. paratuberculosis
gucgccagcaccgugcugaucc

SEQ ID NO: 2964714 - RNA, 14 nt, Mycobacterium avium subsp. paratuberculosis
gucgccagccgccg

SEQ ID NO: 2964715 - RNA, 15 nt, Mycobacterium avium subsp. paratuberculosis
gucgccagccgccgg

SEQ ID NO: 2964716 - RNA, 17 nt, Mycobacterium avium subsp. paratuberculosis
gucgccagccgccggcu

SEQ ID NO: 2964717 - RNA, 19 nt, Mycobacterium avium subsp. paratuberculosis
gucgccaggccaccgcacg

SEQ ID NO: 2964718 - RNA, 20 nt, Mycobacterium avium subsp. paratuberculosis
gucgccaggccaccgcacgu

SEQ ID NO: 2964719 - RNA, 21 nt, Mycobacterium avium subsp. paratuberculosis
gucgccaggccaccgcacguc

SEQ ID NO: 2964720 - RNA, 14 nt, Mycobacterium avium subsp. paratuberculosis
gucgccaugccguc

SEQ ID NO: 2964721 - RNA, 16 nt, Mycobacterium avium subsp. paratuberculosis
gucgcccacaccggau

SEQ ID NO: 2964722 - RNA, 13 nt, Mycobacterium avium subsp. paratuberculosis
gucgcccaccacg

SEQ ID NO: 2964723 - RNA, 20 nt, Mycobacterium avium subsp. paratuberculosis
gucgcccaccacgacgacgu

SEQ ID NO: 2964724 - RNA, 23 nt, Mycobacterium avium subsp. paratuberculosis
gucgcccacccgccagcccgcgu

SEQ ID NO: 2964725 - RNA, 17 nt, Mycobacterium avium subsp. paratuberculosis
gucgcccacccggggcc

SEQ ID NO: 2964726 - RNA, 18 nt, Mycobacterium avium subsp. paratuberculosis
gucgcccacccggggccg

SEQ ID NO: 2964727 - RNA, 17 nt, Mycobacterium avium subsp. paratuberculosis
gucgcccaccguguuga

SEQ ID NO: 2964728 - RNA, 16 nt, Mycobacterium avium subsp. paratuberculosis
gucgcccagcagcccg

SEQ ID NO: 2964729 - RNA, 23 nt, Mycobacterium avium subsp. paratuberculosis
gucgcccagcagcccggccagcc

SEQ ID NO: 2964730 - RNA, 19 nt, Mycobacterium avium subsp. paratuberculosis
gucgcccagcgugucggcg

SEQ ID NO: 2964731 - RNA, 14 nt, Mycobacterium avium subsp. paratuberculosis
gucgcccagcuggg

SEQ ID NO: 2964732 - RNA, 15 nt, Mycobacterium avium subsp. paratuberculosis
gucgcccagcugggc

SEQ ID NO: 2964733 - RNA, 17 nt, Mycobacterium avium subsp. paratuberculosis
gucgcccagcugggcca

SEQ ID NO: 2964734 - RNA, 15 nt, Mycobacterium avium subsp. paratuberculosis
gucgcccaucaccag

SEQ ID NO: 2964735 - RNA, 17 nt, Mycobacterium avium subsp. paratuberculosis
gucgcccaucaccagca

SEQ ID NO: 2964736 - RNA, 22 nt, Mycobacterium avium subsp. paratuberculosis
gucgcccaucaccagcagaccc

SEQ ID NO: 2964737 - RNA, 15 nt, Mycobacterium avium subsp. paratuberculosis
gucgcccccucggcc

SEQ ID NO: 2964738 - RNA, 12 nt, Mycobacterium avium subsp. paratuberculosis
gucgccccgcac

SEQ ID NO: 2964739 - RNA, 15 nt, Mycobacterium avium subsp. paratuberculosis
gucgccccgcaccga

SEQ ID NO: 2964740 - RNA, 14 nt, Mycobacterium avium subsp. paratuberculosis
gucgccccggccgc

SEQ ID NO: 2964741 - RNA, 18 nt, Mycobacterium avium subsp. paratuberculosis
gucgccccggccgcggug

SEQ ID NO: 2964742 - RNA, 13 nt, Mycobacterium avium subsp. paratuberculosis
gucgcccgcccag

SEQ ID NO: 2964743 - RNA, 15 nt, Mycobacterium avium subsp. paratuberculosis
gucgcccgcccaggc

SEQ ID NO: 2964744 - RNA, 17 nt, Mycobacterium avium subsp. paratuberculosis
gucgcccgcccaggccg

SEQ ID NO: 2964745 - RNA, 18 nt, Mycobacterium avium subsp. paratuberculosis
gucgcccgcccaggccgc

SEQ ID NO: 2964746 - RNA, 13 nt, Mycobacterium avium subsp. paratuberculosis
gucgcccgccgac

SEQ ID NO: 2964747 - RNA, 14 nt, Mycobacterium avium subsp. paratuberculosis
gucgcccgccgacg

SEQ ID NO: 2964748 - RNA, 23 nt, Mycobacterium avium subsp. paratuberculosis
gucgcccgcguugcggcgcagcg

SEQ ID NO: 2964749 - RNA, 19 nt, Mycobacterium avium subsp. paratuberculosis
gucgcccggcgcggcaucg

SEQ ID NO: 2964750 - RNA, 12 nt, Mycobacterium avium subsp. paratuberculosis
gucgcccggcgg

SEQ ID NO: 2964751 - RNA, 14 nt, Mycobacterium avium subsp. paratuberculosis
gucgcccggcggca

SEQ ID NO: 2964752 - RNA, 16 nt, Mycobacterium avium subsp. paratuberculosis
gucgcccggcggcacc

SEQ ID NO: 2964753 - RNA, 17 nt, Mycobacterium avium subsp. paratuberculosis
gucgcccggcggcaccg

SEQ ID NO: 2964754 - RNA, 19 nt, Mycobacterium avium subsp. paratuberculosis
gucgcccggcggcaccgag

SEQ ID NO: 2964755 - RNA, 13 nt, Mycobacterium avium subsp. paratuberculosis
gucgcccggcguc

SEQ ID NO: 2964756 - RNA, 14 nt, Mycobacterium avium subsp. paratuberculosis
gucgcccggcgucc

SEQ ID NO: 2964757 - RNA, 15 nt, Mycobacterium avium subsp. paratuberculosis
gucgcccggcgucca

SEQ ID NO: 2964758 - RNA, 23 nt, Mycobacterium avium subsp. paratuberculosis
gucgcccggcucgccgggcugca

SEQ ID NO: 2964759 - RNA, 13 nt, Mycobacterium avium subsp. paratuberculosis
gucgcccggguag

SEQ ID NO: 2964760 - RNA, 19 nt, Mycobacterium avium subsp. paratuberculosis
gucgcccggguagggcagc

SEQ ID NO: 2964761 - RNA, 20 nt, Mycobacterium avium subsp. paratuberculosis
gucgcccggguugcacaggu

SEQ ID NO: 2964762 - RNA, 15 nt, Mycobacterium avium subsp. paratuberculosis
gucgcccgucucggc

SEQ ID NO: 2964763 - RNA, 15 nt, Mycobacterium avium subsp. paratuberculosis
gucgcccguggccca

SEQ ID NO: 2964764 - RNA, 23 nt, Mycobacterium avium subsp. paratuberculosis
gucgcccucgaaguagagccgcu

SEQ ID NO: 2964765 - RNA, 14 nt, Mycobacterium avium subsp. paratuberculosis
gucgcccucgaucg

SEQ ID NO: 2964766 - RNA, 18 nt, Mycobacterium avium subsp. paratuberculosis
gucgcccucgaucgcgac

SEQ ID NO: 2964767 - RNA, 20 nt, Mycobacterium avium subsp. paratuberculosis
gucgcccucgcgcagggcca

SEQ ID NO: 2964768 - RNA, 23 nt, Mycobacterium avium subsp. paratuberculosis
gucgcccucgggguacucggcgg

SEQ ID NO: 2964769 - RNA, 17 nt, Mycobacterium avium subsp. paratuberculosis
gucgcccugacacagca

SEQ ID NO: 2964770 - RNA, 23 nt, Mycobacterium avium subsp. paratuberculosis
gucgcccugacacagcaccggcg

SEQ ID NO: 2964771 - RNA, 15 nt, Mycobacterium avium subsp. paratuberculosis
gucgccgaacgccac

SEQ ID NO: 2964772 - RNA, 20 nt, Mycobacterium avium subsp. paratuberculosis
gucgccgaacgugcgcggcg

SEQ ID NO: 2964773 - RNA, 19 nt, Mycobacterium avium subsp. paratuberculosis
gucgccgaaguuccagccg

SEQ ID NO: 2964774 - RNA, 20 nt, Mycobacterium avium subsp. paratuberculosis
gucgccgaaguuccagccga

SEQ ID NO: 2964775 - RNA, 18 nt, Mycobacterium avium subsp. paratuberculosis
gucgccgaauccggcggg

SEQ ID NO: 2964776 - RNA, 13 nt, Mycobacterium avium subsp. paratuberculosis
gucgccgacagcg

SEQ ID NO: 2964777 - RNA, 20 nt, Mycobacterium avium subsp. paratuberculosis
gucgccgaccagcaggacgc

SEQ ID NO: 2964778 - RNA, 15 nt, Mycobacterium avium subsp. paratuberculosis
gucgccgaccagccg

SEQ ID NO: 2964779 - RNA, 13 nt, Mycobacterium avium subsp. paratuberculosis
gucgccgaccagg

SEQ ID NO: 2964780 - RNA, 18 nt, Mycobacterium avium subsp. paratuberculosis
gucgccgaccagguagcg

SEQ ID NO: 2964781 - RNA, 13 nt, Mycobacterium avium subsp. paratuberculosis
gucgccgacgccg

SEQ ID NO: 2964782 - RNA, 14 nt, Mycobacterium avium subsp. paratuberculosis
gucgccgacgccga

SEQ ID NO: 2964783 - RNA, 20 nt, Mycobacterium avium subsp. paratuberculosis
gucgccgacgccgucgauga

SEQ ID NO: 2964784 - RNA, 16 nt, Mycobacterium avium subsp. paratuberculosis
gucgccgacgggccca

SEQ ID NO: 2964785 - RNA, 16 nt, Mycobacterium avium subsp. paratuberculosis
gucgccgacgguggcg

SEQ ID NO: 2964786 - RNA, 21 nt, Mycobacterium avium subsp. paratuberculosis
gucgccgacguagacgagccg

SEQ ID NO: 2964787 - RNA, 22 nt, Mycobacterium avium subsp. paratuberculosis
gucgccgacguagacgagccgg

SEQ ID NO: 2964788 - RNA, 23 nt, Mycobacterium avium subsp. paratuberculosis
gucgccgacguagacgagccggu

SEQ ID NO: 2964789 - RNA, 22 nt, Mycobacterium avium subsp. paratuberculosis
gucgccgacguuguugucgaug

SEQ ID NO: 2964790 - RNA, 17 nt, Mycobacterium avium subsp. paratuberculosis
gucgccgagccgcaccg

SEQ ID NO: 2964791 - RNA, 15 nt, Mycobacterium avium subsp. paratuberculosis
gucgccgagccgcgc

SEQ ID NO: 2964792 - RNA, 17 nt, Mycobacterium avium subsp. paratuberculosis
gucgccgagguccucga

SEQ ID NO: 2964793 - RNA, 19 nt, Mycobacterium avium subsp. paratuberculosis
gucgccgagguccucgacc

SEQ ID NO: 2964794 - RNA, 20 nt, Mycobacterium avium subsp. paratuberculosis
gucgccgagguccucgaccu

SEQ ID NO: 2964795 - RNA, 14 nt, Mycobacterium avium subsp. paratuberculosis
gucgccgaucagca

SEQ ID NO: 2964796 - RNA, 20 nt, Mycobacterium avium subsp. paratuberculosis
gucgccgaucagcaccaggu

SEQ ID NO: 2964797 - RNA, 16 nt, Mycobacterium avium subsp. paratuberculosis
gucgccgauccagccg

SEQ ID NO: 2964798 - RNA, 17 nt, Mycobacterium avium subsp. paratuberculosis
gucgccuuccugcgcgu

SEQ ID NO: 2964799 - RNA, 17 nt, Mycobacterium avium subsp. paratuberculosis
gucgccuucuggcuggg

SEQ ID NO: 2964800 - RNA, 18 nt, Mycobacterium avium subsp. paratuberculosis
gucgccuucuggcugggg

SEQ ID NO: 2964801 - RNA, 19 nt, Mycobacterium avium subsp. paratuberculosis
gucgccuucuggcuggggu

SEQ ID NO: 2964802 - RNA, 16 nt, Mycobacterium avium subsp. paratuberculosis
gucgccuuguuggccc

SEQ ID NO: 2964803 - RNA, 19 nt, Mycobacterium avium subsp. paratuberculosis
gucgcgaaaaucgguggug

SEQ ID NO: 2964804 - RNA, 18 nt, Mycobacterium avium subsp. paratuberculosis
gucgcgaagacgcuggcc

SEQ ID NO: 2964805 - RNA, 22 nt, Mycobacterium avium subsp. paratuberculosis
gucgcgaagacgcuggccacga

SEQ ID NO: 2964806 - RNA, 12 nt, Mycobacterium avium subsp. paratuberculosis
gucgcgacccgg

SEQ ID NO: 2964807 - RNA, 14 nt, Mycobacterium avium subsp. paratuberculosis
gucgcgaccgccgg

SEQ ID NO: 2964808 - RNA, 17 nt, Mycobacterium avium subsp. paratuberculosis
gucgcgacgagcgggcc

SEQ ID NO: 2964809 - RNA, 18 nt, Mycobacterium avium subsp. paratuberculosis
gucgcgacgagcgggccg

SEQ ID NO: 2964810 - RNA, 23 nt, Mycobacterium avium subsp. paratuberculosis
gucgcgacgagcgggccgaucag

SEQ ID NO: 2964811 - RNA, 15 nt, Mycobacterium avium subsp. paratuberculosis
gucgcgaucacacca

SEQ ID NO: 2964812 - RNA, 17 nt, Mycobacterium avium subsp. paratuberculosis
gucgcgaucacaccacc

SEQ ID NO: 2964813 - RNA, 21 nt, Mycobacterium avium subsp. paratuberculosis
gucgcgaucacaccaccacgc

SEQ ID NO: 2964814 - RNA, 12 nt, Mycobacterium avium subsp. paratuberculosis
gucgcgaucgcg

SEQ ID NO: 2964815 - RNA, 21 nt, Mycobacterium avium subsp. paratuberculosis
gucgcgaugcccaagccggcc

SEQ ID NO: 2964816 - RNA, 18 nt, Mycobacterium avium subsp. paratuberculosis
gucgcgaugugcucgauc

SEQ ID NO: 2964817 - RNA, 21 nt, Mycobacterium avium subsp. paratuberculosis
gucgcgcaaacugacaggcgg

SEQ ID NO: 2964818 - RNA, 14 nt, Mycobacterium avium subsp. paratuberculosis
gucgcgcaaugcca

SEQ ID NO: 2964819 - RNA, 13 nt, Mycobacterium avium subsp. paratuberculosis
gucgcgcaccacc

SEQ ID NO: 2964820 - RNA, 17 nt, Mycobacterium avium subsp. paratuberculosis
gucgcgcaccaccucga

SEQ ID NO: 2964821 - RNA, 16 nt, Mycobacterium avium subsp. paratuberculosis
gucgcgcaccagcucg

SEQ ID NO: 2964822 - RNA, 17 nt, Mycobacterium avium subsp. paratuberculosis
gucgcgcaccagcucga

SEQ ID NO: 2964823 - RNA, 19 nt, Mycobacterium avium subsp. paratuberculosis
gucgcgcaccagcucgagg

SEQ ID NO: 2964824 - RNA, 19 nt, Mycobacterium avium subsp. paratuberculosis
gucgcgcaccauccgcgac

SEQ ID NO: 2964825 - RNA, 14 nt, Mycobacterium avium subsp. paratuberculosis
gucgcgcacccaga

SEQ ID NO: 2964826 - RNA, 17 nt, Mycobacterium avium subsp. paratuberculosis
gucgcgcacccagccgc

SEQ ID NO: 2964827 - RNA, 18 nt, Mycobacterium avium subsp. paratuberculosis
gucgcgcacccagccgca

SEQ ID NO: 2964828 - RNA, 14 nt, Mycobacterium avium subsp. paratuberculosis
gucgcgcacccgca

SEQ ID NO: 2964829 - RNA, 15 nt, Mycobacterium avium subsp. paratuberculosis
gucgcgcacccgcac

SEQ ID NO: 2964830 - RNA, 16 nt, Mycobacterium avium subsp. paratuberculosis
gucgcgcacccgcacg

SEQ ID NO: 2964831 - RNA, 15 nt, Mycobacterium avium subsp. paratuberculosis
gucgcgcaccgcggc

SEQ ID NO: 2964832 - RNA, 16 nt, Mycobacterium avium subsp. paratuberculosis
gucgcgcaccgcggcg

SEQ ID NO: 2964833 - RNA, 17 nt, Mycobacterium avium subsp. paratuberculosis
gucgcgcaccgcggcgg

SEQ ID NO: 2964834 - RNA, 18 nt, Mycobacterium avium subsp. paratuberculosis
gucgcgcaccgcggcggg

SEQ ID NO: 2964835 - RNA, 22 nt, Mycobacterium avium subsp. paratuberculosis
gucgcgcaccgcggcggggucc

SEQ ID NO: 2964836 - RNA, 13 nt, Mycobacterium avium subsp. paratuberculosis
gucgcgcagcacc

SEQ ID NO: 2964837 - RNA, 15 nt, Mycobacterium avium subsp. paratuberculosis
gucgcgcagcaccuc

SEQ ID NO: 2964838 - RNA, 23 nt, Mycobacterium avium subsp. paratuberculosis
gucgcgcagcaccuccuggguga

SEQ ID NO: 2964839 - RNA, 15 nt, Mycobacterium avium subsp. paratuberculosis
gucgcgcagcagcgg

SEQ ID NO: 2964840 - RNA, 17 nt, Mycobacterium avium subsp. paratuberculosis
gucgcgcagcauccgca

SEQ ID NO: 2964841 - RNA, 16 nt, Mycobacterium avium subsp. paratuberculosis
gucgcgcagcauggcc

SEQ ID NO: 2964842 - RNA, 13 nt, Mycobacterium avium subsp. paratuberculosis
gucgcgcagcccg

SEQ ID NO: 2964843 - RNA, 14 nt, Mycobacterium avium subsp. paratuberculosis
gucgcgcagcccga

SEQ ID NO: 2964844 - RNA, 14 nt, Mycobacterium avium subsp. paratuberculosis
gucgcgcagccgcc

SEQ ID NO: 2964845 - RNA, 15 nt, Mycobacterium avium subsp. paratuberculosis
gucgcgcagccgccg

SEQ ID NO: 2964846 - RNA, 16 nt, Mycobacterium avium subsp. paratuberculosis
gucgcgcagccgccgg

SEQ ID NO: 2964847 - RNA, 13 nt, Mycobacterium avium subsp. paratuberculosis
gucgcgcagccgg

SEQ ID NO: 2964848 - RNA, 20 nt, Mycobacterium avium subsp. paratuberculosis
gucgcgcaggaugcccagca

SEQ ID NO: 2964849 - RNA, 23 nt, Mycobacterium avium subsp. paratuberculosis
gucgcgcaggaugcccagcacca

SEQ ID NO: 2964850 - RNA, 16 nt, Mycobacterium avium subsp. paratuberculosis
gucgcgcaggucgggc

SEQ ID NO: 2964851 - RNA, 20 nt, Mycobacterium avium subsp. paratuberculosis
gucgcgcaggucgggccggc

SEQ ID NO: 2964852 - RNA, 19 nt, Mycobacterium avium subsp. paratuberculosis
gucgcgcaucgccucggcg

SEQ ID NO: 2964853 - RNA, 22 nt, Mycobacterium avium subsp. paratuberculosis
gucgcgcaucgccucggcggcc

SEQ ID NO: 2964854 - RNA, 23 nt, Mycobacterium avium subsp. paratuberculosis
gucgcgcaucgccucggcggccg

SEQ ID NO: 2964855 - RNA, 23 nt, Mycobacterium avium subsp. paratuberculosis
gucgcgccagacguccagcgccg

SEQ ID NO: 2964856 - RNA, 19 nt, Mycobacterium avium subsp. paratuberculosis
gucgcgcccaggaacgcgc

SEQ ID NO: 2964857 - RNA, 22 nt, Mycobacterium avium subsp. paratuberculosis
gucgcgcccaggaacgcgccgg

SEQ ID NO: 2964858 - RNA, 13 nt, Mycobacterium avium subsp. paratuberculosis
gucgcgcccggcg

SEQ ID NO: 2964859 - RNA, 17 nt, Mycobacterium avium subsp. paratuberculosis
gucgcgcccggcgucgg

SEQ ID NO: 2964860 - RNA, 19 nt, Mycobacterium avium subsp. paratuberculosis
gucgcgccgaccuggucgc

SEQ ID NO: 2964861 - RNA, 15 nt, Mycobacterium avium subsp. paratuberculosis
gucgcgccgaggugg

SEQ ID NO: 2964862 - RNA, 20 nt, Mycobacterium avium subsp. paratuberculosis
gucgcgccgagguggccgcc

SEQ ID NO: 2964863 - RNA, 13 nt, Mycobacterium avium subsp. paratuberculosis
gucgcgccgccac

SEQ ID NO: 2964864 - RNA, 14 nt, Mycobacterium avium subsp. paratuberculosis
gucgcgccgccacc

SEQ ID NO: 2964865 - RNA, 18 nt, Mycobacterium avium subsp. paratuberculosis
gucgcgccgccaccccag

SEQ ID NO: 2964866 - RNA, 15 nt, Mycobacterium avium subsp. paratuberculosis
gucgcgccgccagca

SEQ ID NO: 2964867 - RNA, 21 nt, Mycobacterium avium subsp. paratuberculosis
gucgcgccgccgcgucgugcc

SEQ ID NO: 2964868 - RNA, 17 nt, Mycobacterium avium subsp. paratuberculosis
gucgcgccgcgucgcgc

SEQ ID NO: 2964869 - RNA, 21 nt, Mycobacterium avium subsp. paratuberculosis
gucgcgccgcgucgcgccgcc

SEQ ID NO: 2964870 - RNA, 15 nt, Mycobacterium avium subsp. paratuberculosis
gucgcgccggagccg

SEQ ID NO: 2964871 - RNA, 12 nt, Mycobacterium avium subsp. paratuberculosis
gucgcgcgaaca

SEQ ID NO: 2964872 - RNA, 17 nt, Mycobacterium avium subsp. paratuberculosis
gucgcgcgacugggcgc

SEQ ID NO: 2964873 - RNA, 19 nt, Mycobacterium avium subsp. paratuberculosis
gucgcgcgacugggcgccc

SEQ ID NO: 2964874 - RNA, 21 nt, Mycobacterium avium subsp. paratuberculosis
gucgcgcgacugggcgcccac

SEQ ID NO: 2964875 - RNA, 13 nt, Mycobacterium avium subsp. paratuberculosis
gucgcgcgccggc

SEQ ID NO: 2964876 - RNA, 14 nt, Mycobacterium avium subsp. paratuberculosis
gucgcgcgccggcg

SEQ ID NO: 2964877 - RNA, 16 nt, Mycobacterium avium subsp. paratuberculosis
gucgcgcgccggcgca

SEQ ID NO: 2964878 - RNA, 15 nt, Mycobacterium avium subsp. paratuberculosis
gucgcgcggcugcuc

SEQ ID NO: 2964879 - RNA, 18 nt, Mycobacterium avium subsp. paratuberculosis
gucgcgcggcugcucgaa

SEQ ID NO: 2964880 - RNA, 12 nt, Mycobacterium avium subsp. paratuberculosis
gucgcgcggggu

SEQ ID NO: 2964881 - RNA, 13 nt, Mycobacterium avium subsp. paratuberculosis
gucgcgcgggguc

SEQ ID NO: 2964882 - RNA, 21 nt, Mycobacterium avium subsp. paratuberculosis
gucgcgcggggugacgcccgu

SEQ ID NO: 2964883 - RNA, 17 nt, Mycobacterium avium subsp. paratuberculosis
gucgcgucgucggcggg

SEQ ID NO: 2964884 - RNA, 21 nt, Mycobacterium avium subsp. paratuberculosis
gucgcgucgucggcgggcugc

SEQ ID NO: 2964885 - RNA, 13 nt, Mycobacterium avium subsp. paratuberculosis
gucgcgucgugcg

SEQ ID NO: 2964886 - RNA, 15 nt, Mycobacterium avium subsp. paratuberculosis
gucgcgucgugcggc

SEQ ID NO: 2964887 - RNA, 19 nt, Mycobacterium avium subsp. paratuberculosis
gucgcgucgugcggccggc

SEQ ID NO: 2964888 - RNA, 21 nt, Mycobacterium avium subsp. paratuberculosis
gucgcgucgugcggccggcgc

SEQ ID NO: 2964889 - RNA, 15 nt, Mycobacterium avium subsp. paratuberculosis
gucgcgugaccggcg

SEQ ID NO: 2964890 - RNA, 16 nt, Mycobacterium avium subsp. paratuberculosis
gucgcguucccgggcc

SEQ ID NO: 2964891 - RNA, 22 nt, Mycobacterium avium subsp. paratuberculosis
gucgcguucgacccacaccucg

SEQ ID NO: 2964892 - RNA, 18 nt, Mycobacterium avium subsp. paratuberculosis
gucgcguugaaagccgcg

SEQ ID NO: 2964893 - RNA, 19 nt, Mycobacterium avium subsp. paratuberculosis
gucgcguugaaagccgcga

SEQ ID NO: 2964894 - RNA, 20 nt, Mycobacterium avium subsp. paratuberculosis
gucgcguugaaagccgcgaa

SEQ ID NO: 2964895 - RNA, 16 nt, Mycobacterium avium subsp. paratuberculosis
gucgcuaccucaccac

SEQ ID NO: 2964896 - RNA, 17 nt, Mycobacterium avium subsp. paratuberculosis
gucgcuaccucaccacg

SEQ ID NO: 2964897 - RNA, 18 nt, Mycobacterium avium subsp. paratuberculosis
gucgcuaccucaccacgu

SEQ ID NO: 2964898 - RNA, 21 nt, Mycobacterium avium subsp. paratuberculosis
gucgcuaccucaccacgugcc

SEQ ID NO: 2964899 - RNA, 23 nt, Mycobacterium avium subsp. paratuberculosis
gucgcuaccucaccacgugccac

SEQ ID NO: 2964900 - RNA, 18 nt, Mycobacterium avium subsp. paratuberculosis
gucgcucaaaggcgggca

SEQ ID NO: 2964901 - RNA, 17 nt, Mycobacterium avium subsp. paratuberculosis
gucgcucaacggcucca

SEQ ID NO: 2964902 - RNA, 20 nt, Mycobacterium avium subsp. paratuberculosis
gucgcucagaggcgggcacu

SEQ ID NO: 2964903 - RNA, 22 nt, Mycobacterium avium subsp. paratuberculosis
gucgcucaucccgaugucggcg

SEQ ID NO: 2964904 - RNA, 13 nt, Mycobacterium avium subsp. paratuberculosis
gucgcucggcggc

SEQ ID NO: 2964905 - RNA, 14 nt, Mycobacterium avium subsp. paratuberculosis
gucgcucggcggcg

SEQ ID NO: 2964906 - RNA, 15 nt, Mycobacterium avium subsp. paratuberculosis
gucgcucggcggcga

SEQ ID NO: 2964907 - RNA, 17 nt, Mycobacterium avium subsp. paratuberculosis
gucgcucggcggcgacg

SEQ ID NO: 2964908 - RNA, 14 nt, Mycobacterium avium subsp. paratuberculosis
gucgcugaacgcgu

SEQ ID NO: 2964909 - RNA, 12 nt, Mycobacterium avium subsp. paratuberculosis
gucgcugaccac

SEQ ID NO: 2964910 - RNA, 13 nt, Mycobacterium avium subsp. paratuberculosis
gucgcugaccacc

SEQ ID NO: 2964911 - RNA, 18 nt, Mycobacterium avium subsp. paratuberculosis
gucgcugaccccgcucgg

SEQ ID NO: 2964912 - RNA, 20 nt, Mycobacterium avium subsp. paratuberculosis
gucgcugaccccgcucggcg

SEQ ID NO: 2964913 - RNA, 23 nt, Mycobacterium avium subsp. paratuberculosis
gucgcugaccccgcucggcgugg

SEQ ID NO: 2964914 - RNA, 16 nt, Mycobacterium avium subsp. paratuberculosis
gucgcugacccgccgc

SEQ ID NO: 2964915 - RNA, 17 nt, Mycobacterium avium subsp. paratuberculosis
gucgcugacccgccgca

SEQ ID NO: 2964916 - RNA, 18 nt, Mycobacterium avium subsp. paratuberculosis
gucgcugacccgccgcaa

SEQ ID NO: 2964917 - RNA, 23 nt, Mycobacterium avium subsp. paratuberculosis
gucgcugacccgccgcaacagcc

SEQ ID NO: 2964918 - RNA, 15 nt, Mycobacterium avium subsp. paratuberculosis
gucgcugacccgggc

SEQ ID NO: 2964919 - RNA, 17 nt, Mycobacterium avium subsp. paratuberculosis
gucgcugacccgggcgg

SEQ ID NO: 2964920 - RNA, 18 nt, Mycobacterium avium subsp. paratuberculosis
gucgcugacccgggcggc

SEQ ID NO: 2964921 - RNA, 22 nt, Mycobacterium avium subsp. paratuberculosis
gucgcugacccgggcggccugc

SEQ ID NO: 2964922 - RNA, 13 nt, Mycobacterium avium subsp. paratuberculosis
gucgcugaccuuc

SEQ ID NO: 2964923 - RNA, 23 nt, Mycobacterium avium subsp. paratuberculosis
gucgcugacgaugauccuggccu

SEQ ID NO: 2964924 - RNA, 16 nt, Mycobacterium avium subsp. paratuberculosis
gucgcugacgccgagc

SEQ ID NO: 2964925 - RNA, 20 nt, Mycobacterium avium subsp. paratuberculosis
gucgcugagcaauucgguga

SEQ ID NO: 2964926 - RNA, 22 nt, Mycobacterium avium subsp. paratuberculosis
gucgcugagcgggaagcugcug

SEQ ID NO: 2964927 - RNA, 20 nt, Mycobacterium avium subsp. paratuberculosis
gucgcugaggcugcgggugg

SEQ ID NO: 2964928 - RNA, 18 nt, Mycobacterium avium subsp. paratuberculosis
gucgcugaguaugcagau

SEQ ID NO: 2964929 - RNA, 22 nt, Mycobacterium avium subsp. paratuberculosis
gucgcugaguaugcagaugaug

SEQ ID NO: 2964930 - RNA, 15 nt, Mycobacterium avium subsp. paratuberculosis
gucgcugcagcggcg

SEQ ID NO: 2964931 - RNA, 16 nt, Mycobacterium avium subsp. paratuberculosis
gucgcugcagcggcgg

SEQ ID NO: 2964932 - RNA, 21 nt, Mycobacterium avium subsp. paratuberculosis
gucgcugcccagauacgccgc

SEQ ID NO: 2964933 - RNA, 24 nt, Mycobacterium avium subsp. paratuberculosis
gucgcugcccagauacgccgcgac

SEQ ID NO: 2964934 - RNA, 13 nt, Mycobacterium avium subsp. paratuberculosis
gucgcugcccggc

SEQ ID NO: 2964935 - RNA, 16 nt, Mycobacterium avium subsp. paratuberculosis
gucgcugccgccgccg

SEQ ID NO: 2964936 - RNA, 18 nt, Mycobacterium avium subsp. paratuberculosis
gucgcugccgccgccggc

SEQ ID NO: 2964937 - RNA, 18 nt, Mycobacterium avium subsp. paratuberculosis
gucgcugccguagcgcug

SEQ ID NO: 2964938 - RNA, 12 nt, Mycobacterium avium subsp. paratuberculosis
gucgcugcgagg

SEQ ID NO: 2964939 - RNA, 18 nt, Mycobacterium avium subsp. paratuberculosis
gucgcugcgaggcgggca

SEQ ID NO: 2964940 - RNA, 20 nt, Mycobacterium avium subsp. paratuberculosis
gucgcugcgaggcgggcaca

SEQ ID NO: 2964941 - RNA, 23 nt, Mycobacterium avium subsp. paratuberculosis
gucgcugcgaugauggucaccgu

SEQ ID NO: 2964942 - RNA, 12 nt, Mycobacterium avium subsp. paratuberculosis
gucgcugcgcuc

SEQ ID NO: 2964943 - RNA, 21 nt, Mycobacterium avium subsp. paratuberculosis
gucgcugcgcucgccgucggc

SEQ ID NO: 2964944 - RNA, 22 nt, Mycobacterium avium subsp. paratuberculosis
gucgcugcgcucgccgucggcc

SEQ ID NO: 2964945 - RNA, 23 nt, Mycobacterium avium subsp. paratuberculosis
gucgcugcgcucgccgucggcca

SEQ ID NO: 2964946 - RNA, 22 nt, Mycobacterium avium subsp. paratuberculosis
gucgcugcucaugagcccucca

SEQ ID NO: 2964947 - RNA, 14 nt, Mycobacterium avium subsp. paratuberculosis
gucgcuggccaggu

SEQ ID NO: 2964948 - RNA, 23 nt, Mycobacterium avium subsp. paratuberculosis
gucgcuggccagguacaccacca

SEQ ID NO: 2964949 - RNA, 13 nt, Mycobacterium avium subsp. paratuberculosis
gucgcuggccgcg

SEQ ID NO: 2964950 - RNA, 15 nt, Mycobacterium avium subsp. paratuberculosis
gucgcuggccgcgac

SEQ ID NO: 2964951 - RNA, 13 nt, Mycobacterium avium subsp. paratuberculosis
gucgcuggcgcgc

SEQ ID NO: 2964952 - RNA, 14 nt, Mycobacterium avium subsp. paratuberculosis
gucgcuggcgcgcu

SEQ ID NO: 2964953 - RNA, 18 nt, Mycobacterium avium subsp. paratuberculosis
gucgcuggcguacgccau

SEQ ID NO: 2964954 - RNA, 12 nt, Mycobacterium avium subsp. paratuberculosis
gucgcugggugu

SEQ ID NO: 2964955 - RNA, 13 nt, Mycobacterium avium subsp. paratuberculosis
gucgcugggugua

SEQ ID NO: 2964956 - RNA, 15 nt, Mycobacterium avium subsp. paratuberculosis
gucgcuggucgaacc

SEQ ID NO: 2964957 - RNA, 17 nt, Mycobacterium avium subsp. paratuberculosis
gucgcuguaggccagcc

SEQ ID NO: 2964958 - RNA, 19 nt, Mycobacterium avium subsp. paratuberculosis
gucgcuguaggccagcccg

SEQ ID NO: 2964959 - RNA, 14 nt, Mycobacterium avium subsp. paratuberculosis
gucgcugucggcga

SEQ ID NO: 2964960 - RNA, 19 nt, Mycobacterium avium subsp. paratuberculosis
gucgcuguuagccucgcca

SEQ ID NO: 2964961 - RNA, 20 nt, Mycobacterium avium subsp. paratuberculosis
gucgcuguuagccucgccag

SEQ ID NO: 2964962 - RNA, 21 nt, Mycobacterium avium subsp. paratuberculosis
gucgcuguuagccucgccagc

SEQ ID NO: 2964963 - RNA, 19 nt, Mycobacterium avium subsp. paratuberculosis
gucgcuguuggcgacggug

SEQ ID NO: 2964964 - RNA, 21 nt, Mycobacterium avium subsp. paratuberculosis
gucgcuuugcggcgaaccggg

SEQ ID NO: 2964965 - RNA, 15 nt, Mycobacterium avium subsp. paratuberculosis
gucggaauacagcag

SEQ ID NO: 2964966 - RNA, 14 nt, Mycobacterium avium subsp. paratuberculosis
gucggaaucggcgc

SEQ ID NO: 2964967 - RNA, 20 nt, Mycobacterium avium subsp. paratuberculosis
gucggccgcccguccgggcc

SEQ ID NO: 2964968 - RNA, 17 nt, Mycobacterium avium subsp. paratuberculosis
gucggccgcggccggcg

SEQ ID NO: 2964969 - RNA, 19 nt, Mycobacterium avium subsp. paratuberculosis
gucggccgcgugcaccugu

SEQ ID NO: 2964970 - RNA, 22 nt, Mycobacterium avium subsp. paratuberculosis
gucggccggauucucgcccggc

SEQ ID NO: 2964971 - RNA, 17 nt, Mycobacterium avium subsp. paratuberculosis
gucggccggcaggccgc

SEQ ID NO: 2964972 - RNA, 19 nt, Mycobacterium avium subsp. paratuberculosis
gucggccggcaggccgccc

SEQ ID NO: 2964973 - RNA, 22 nt, Mycobacterium avium subsp. paratuberculosis
gucggccggcaggccgcccgac

SEQ ID NO: 2964974 - RNA, 23 nt, Mycobacterium avium subsp. paratuberculosis
gucggccggcaguugcggccgcu

SEQ ID NO: 2964975 - RNA, 22 nt, Mycobacterium avium subsp. paratuberculosis
gucggccggcggggcgggggcg

SEQ ID NO: 2964976 - RNA, 16 nt, Mycobacterium avium subsp. paratuberculosis
gucggccggcucgacc

SEQ ID NO: 2964977 - RNA, 17 nt, Mycobacterium avium subsp. paratuberculosis
gucggccggcugcagcc

SEQ ID NO: 2964978 - RNA, 16 nt, Mycobacterium avium subsp. paratuberculosis
gucggccgggccggcg

SEQ ID NO: 2964979 - RNA, 18 nt, Mycobacterium avium subsp. paratuberculosis
gucggccgggccggcggu

SEQ ID NO: 2964980 - RNA, 17 nt, Mycobacterium avium subsp. paratuberculosis
gucggccgggcugccca

SEQ ID NO: 2964981 - RNA, 22 nt, Mycobacterium avium subsp. paratuberculosis
gucggccgggcugcccaccacc

SEQ ID NO: 2964982 - RNA, 23 nt, Mycobacterium avium subsp. paratuberculosis
gucggccgggggcgcgggcggca

SEQ ID NO: 2964983 - RNA, 19 nt, Mycobacterium avium subsp. paratuberculosis
gucggccguacacaaggaa

SEQ ID NO: 2964984 - RNA, 19 nt, Mycobacterium avium subsp. paratuberculosis
gucggccgucggcgccgcc

SEQ ID NO: 2964985 - RNA, 19 nt, Mycobacterium avium subsp. paratuberculosis
gucggccuccagccggcgg

SEQ ID NO: 2964986 - RNA, 14 nt, Mycobacterium avium subsp. paratuberculosis
gucggccuccuccu

SEQ ID NO: 2964987 - RNA, 16 nt, Mycobacterium avium subsp. paratuberculosis
gucggccucggcggug

SEQ ID NO: 2964988 - RNA, 23 nt, Mycobacterium avium subsp. paratuberculosis
gucggccugcacgucggcgcgca

SEQ ID NO: 2964989 - RNA, 20 nt, Mycobacterium avium subsp. paratuberculosis
gucggccugcccgcgggugg

SEQ ID NO: 2964990 - RNA, 19 nt, Mycobacterium avium subsp. paratuberculosis
gucggccugcgcugcggcc

SEQ ID NO: 2964991 - RNA, 20 nt, Mycobacterium avium subsp. paratuberculosis
gucggccugcgcugcggcca

SEQ ID NO: 2964992 - RNA, 15 nt, Mycobacterium avium subsp. paratuberculosis
gucggccuguccggu

SEQ ID NO: 2964993 - RNA, 16 nt, Mycobacterium avium subsp. paratuberculosis
gucggccuugaccagg

SEQ ID NO: 2964994 - RNA, 21 nt, Mycobacterium avium subsp. paratuberculosis
gucggcgaacaccugcuuguu

SEQ ID NO: 2964995 - RNA, 23 nt, Mycobacterium avium subsp. paratuberculosis
gucggcgaaccagggcagccagc

SEQ ID NO: 2964996 - RNA, 24 nt, Mycobacterium avium subsp. paratuberculosis
gucggcgaaccagggcagccagcc

SEQ ID NO: 2964997 - RNA, 19 nt, Mycobacterium avium subsp. paratuberculosis
gucggcgaaccguucgucg

SEQ ID NO: 2964998 - RNA, 22 nt, Mycobacterium avium subsp. paratuberculosis
gucggcgaacgcccggucgaug

SEQ ID NO: 2964999 - RNA, 17 nt, Mycobacterium avium subsp. paratuberculosis
gucggcgaacggccagu

SEQ ID NO: 2965000 - RNA, 16 nt, Mycobacterium avium subsp. paratuberculosis
gucggcgaaggcgcgc

SEQ ID NO: 2965001 - RNA, 18 nt, Mycobacterium avium subsp. paratuberculosis
gucggcgaaggcgcgcag

SEQ ID NO: 2965002 - RNA, 19 nt, Mycobacterium avium subsp. paratuberculosis
gucggcgaaggugccccgc

SEQ ID NO: 2965003 - RNA, 15 nt, Mycobacterium avium subsp. paratuberculosis
gucggcgaagguguc

SEQ ID NO: 2965004 - RNA, 17 nt, Mycobacterium avium subsp. paratuberculosis
gucggcgacccgcuugg

SEQ ID NO: 2965005 - RNA, 20 nt, Mycobacterium avium subsp. paratuberculosis
gucggcgacccgcuugguga

SEQ ID NO: 2965006 - RNA, 16 nt, Mycobacterium avium subsp. paratuberculosis
gucggcgacgccgucg

SEQ ID NO: 2965007 - RNA, 20 nt, Mycobacterium avium subsp. paratuberculosis
gucggcgacgccgucggggu

SEQ ID NO: 2965008 - RNA, 13 nt, Mycobacterium avium subsp. paratuberculosis
gucggcgacggcg

SEQ ID NO: 2965009 - RNA, 14 nt, Mycobacterium avium subsp. paratuberculosis
gucggcgacggcgc

SEQ ID NO: 2965010 - RNA, 15 nt, Mycobacterium avium subsp. paratuberculosis
gucggcgacggcgcu

SEQ ID NO: 2965011 - RNA, 17 nt, Mycobacterium avium subsp. paratuberculosis
gucggcgacggcgcuca

SEQ ID NO: 2965012 - RNA, 15 nt, Mycobacterium avium subsp. paratuberculosis
gucggcgagcagcug

SEQ ID NO: 2965013 - RNA, 15 nt, Mycobacterium avium subsp. paratuberculosis
gucggcgagcuugcc

SEQ ID NO: 2965014 - RNA, 13 nt, Mycobacterium avium subsp. paratuberculosis
gucggcgaucagc

SEQ ID NO: 2965015 - RNA, 20 nt, Mycobacterium avium subsp. paratuberculosis
gucggcgauccacgccuccg

SEQ ID NO: 2965016 - RNA, 15 nt, Mycobacterium avium subsp. paratuberculosis
gucggcgaucgccag

SEQ ID NO: 2965017 - RNA, 16 nt, Mycobacterium avium subsp. paratuberculosis
gucggcgaucgccagc

SEQ ID NO: 2965018 - RNA, 17 nt, Mycobacterium avium subsp. paratuberculosis
gucggcgaucgccagca

SEQ ID NO: 2965019 - RNA, 18 nt, Mycobacterium avium subsp. paratuberculosis
gucggcgaucgccagcac

SEQ ID NO: 2965020 - RNA, 20 nt, Mycobacterium avium subsp. paratuberculosis
gucggcgaucgccagcacgg

SEQ ID NO: 2965021 - RNA, 22 nt, Mycobacterium avium subsp. paratuberculosis
gucggcgaucgccagcacggug

SEQ ID NO: 2965022 - RNA, 15 nt, Mycobacterium avium subsp. paratuberculosis
gucggcgaucgcgcg

SEQ ID NO: 2965023 - RNA, 17 nt, Mycobacterium avium subsp. paratuberculosis
gucggcgaucgcgcgca

SEQ ID NO: 2965024 - RNA, 18 nt, Mycobacterium avium subsp. paratuberculosis
gucggcgaucucggucac

SEQ ID NO: 2965025 - RNA, 23 nt, Mycobacterium avium subsp. paratuberculosis
gucggcgaucucggucaccgagc

SEQ ID NO: 2965026 - RNA, 19 nt, Mycobacterium avium subsp. paratuberculosis
gucggcgaugcgguggucg

SEQ ID NO: 2965027 - RNA, 17 nt, Mycobacterium avium subsp. paratuberculosis
gucggcgauggcggcgu

SEQ ID NO: 2965028 - RNA, 20 nt, Mycobacterium avium subsp. paratuberculosis
gucggcgauggcggcgugca

SEQ ID NO: 2965029 - RNA, 20 nt, Mycobacterium avium subsp. paratuberculosis
gucggcgcagcgcacgucgc

SEQ ID NO: 2965030 - RNA, 24 nt, Mycobacterium avium subsp. paratuberculosis
gucggcgcagcgcacgucgccgcc

SEQ ID NO: 2965031 - RNA, 13 nt, Mycobacterium avium subsp. paratuberculosis
gucggcgcccaga

SEQ ID NO: 2965032 - RNA, 19 nt, Mycobacterium avium subsp. paratuberculosis
gucggcgcccagaucggcc

SEQ ID NO: 2965033 - RNA, 22 nt, Mycobacterium avium subsp. paratuberculosis
gucggcgcccagaucggccagc

SEQ ID NO: 2965034 - RNA, 23 nt, Mycobacterium avium subsp. paratuberculosis
gucggcgcccagaucggccagcc

SEQ ID NO: 2965035 - RNA, 17 nt, Mycobacterium avium subsp. paratuberculosis
gucggcgcccaggauuc

SEQ ID NO: 2965036 - RNA, 14 nt, Mycobacterium avium subsp. paratuberculosis
gucggcgccccgcc

SEQ ID NO: 2965037 - RNA, 15 nt, Mycobacterium avium subsp. paratuberculosis
gucggcgccccgccc

SEQ ID NO: 2965038 - RNA, 17 nt, Mycobacterium avium subsp. paratuberculosis
gucggcgccccgcccgc

SEQ ID NO: 2965039 - RNA, 14 nt, Mycobacterium avium subsp. paratuberculosis
gucggcgccccggc

SEQ ID NO: 2965040 - RNA, 16 nt, Mycobacterium avium subsp. paratuberculosis
gucggcgccccggcgc

SEQ ID NO: 2965041 - RNA, 13 nt, Mycobacterium avium subsp. paratuberculosis
gucggcgcccggc

SEQ ID NO: 2965042 - RNA, 20 nt, Mycobacterium avium subsp. paratuberculosis
gucggcgcccggcaccggga

SEQ ID NO: 2965043 - RNA, 15 nt, Mycobacterium avium subsp. paratuberculosis
gucggcgcccggccc

SEQ ID NO: 2965044 - RNA, 20 nt, Mycobacterium avium subsp. paratuberculosis
gucggcgcccucggcgaucu

SEQ ID NO: 2965045 - RNA, 14 nt, Mycobacterium avium subsp. paratuberculosis
gucggcgccgacgg

SEQ ID NO: 2965046 - RNA, 15 nt, Mycobacterium avium subsp. paratuberculosis
gucggcgccgacggc

SEQ ID NO: 2965047 - RNA, 19 nt, Mycobacterium avium subsp. paratuberculosis
gucggcgccgacggccagc

SEQ ID NO: 2965048 - RNA, 20 nt, Mycobacterium avium subsp. paratuberculosis
gucggcgccgacggccagca

SEQ ID NO: 2965049 - RNA, 12 nt, Mycobacterium avium subsp. paratuberculosis
gucggcgccgau

SEQ ID NO: 2965050 - RNA, 21 nt, Mycobacterium avium subsp. paratuberculosis
gucggcgccgaucacgccggu

SEQ ID NO: 2965051 - RNA, 20 nt, Mycobacterium avium subsp. paratuberculosis
gucggcguccagcgcgguga

SEQ ID NO: 2965052 - RNA, 20 nt, Mycobacterium avium subsp. paratuberculosis
gucggcguccgugccguccg

SEQ ID NO: 2965053 - RNA, 14 nt, Mycobacterium avium subsp. paratuberculosis
gucggcgucgaacg

SEQ ID NO: 2965054 - RNA, 22 nt, Mycobacterium avium subsp. paratuberculosis
gucggcgucgaacggcgucugg

SEQ ID NO: 2965055 - RNA, 14 nt, Mycobacterium avium subsp. paratuberculosis
gucggcgucgaagg

SEQ ID NO: 2965056 - RNA, 14 nt, Mycobacterium avium subsp. paratuberculosis
gucggcgucgaucg

SEQ ID NO: 2965057 - RNA, 21 nt, Mycobacterium avium subsp. paratuberculosis
gucggcgucgaucgccgucac

SEQ ID NO: 2965058 - RNA, 14 nt, Mycobacterium avium subsp. paratuberculosis
gucggcgucgaugu

SEQ ID NO: 2965059 - RNA, 15 nt, Mycobacterium avium subsp. paratuberculosis
gucggcgucgccgag

SEQ ID NO: 2965060 - RNA, 16 nt, Mycobacterium avium subsp. paratuberculosis
gucggcgucgccgagc

SEQ ID NO: 2965061 - RNA, 17 nt, Mycobacterium avium subsp. paratuberculosis
gucggcgucgccgagcc

SEQ ID NO: 2965062 - RNA, 21 nt, Mycobacterium avium subsp. paratuberculosis
gucggcgucgccgagccgcgc

SEQ ID NO: 2965063 - RNA, 16 nt, Mycobacterium avium subsp. paratuberculosis
gucggcgucgcggcgc

SEQ ID NO: 2965064 - RNA, 13 nt, Mycobacterium avium subsp. paratuberculosis
gucggcgucggcc

SEQ ID NO: 2965065 - RNA, 14 nt, Mycobacterium avium subsp. paratuberculosis
gucggcgucggcca

SEQ ID NO: 2965066 - RNA, 15 nt, Mycobacterium avium subsp. paratuberculosis
gucggcgucggccac

SEQ ID NO: 2965067 - RNA, 19 nt, Mycobacterium avium subsp. paratuberculosis
gucggcgucggccaccgcg

SEQ ID NO: 2965068 - RNA, 14 nt, Mycobacterium avium subsp. paratuberculosis
gucggcgucgggcc

SEQ ID NO: 2965069 - RNA, 17 nt, Mycobacterium avium subsp. paratuberculosis
gucggcgucgggccggg

SEQ ID NO: 2965070 - RNA, 14 nt, Mycobacterium avium subsp. paratuberculosis
gucggcgucguaca

SEQ ID NO: 2965071 - RNA, 24 nt, Mycobacterium avium subsp. paratuberculosis
gucggcgucuucggggauguagcc

SEQ ID NO: 2965072 - RNA, 14 nt, Mycobacterium avium subsp. paratuberculosis
gucggcgugcccgc

SEQ ID NO: 2965073 - RNA, 20 nt, Mycobacterium avium subsp. paratuberculosis
gucggcgugcccgccgacca

SEQ ID NO: 2965074 - RNA, 23 nt, Mycobacterium avium subsp. paratuberculosis
gucggcgugcccgccgaccagga

SEQ ID NO: 2965075 - RNA, 13 nt, Mycobacterium avium subsp. paratuberculosis
gucggcguggccg

SEQ ID NO: 2965076 - RNA, 14 nt, Mycobacterium avium subsp. paratuberculosis
gucggcucgcccgc

SEQ ID NO: 2965077 - RNA, 16 nt, Mycobacterium avium subsp. paratuberculosis
gucggcucgcccgcga

SEQ ID NO: 2965078 - RNA, 12 nt, Mycobacterium avium subsp. paratuberculosis
gucggcucgccg

SEQ ID NO: 2965079 - RNA, 14 nt, Mycobacterium avium subsp. paratuberculosis
gucggcucgccgau

SEQ ID NO: 2965080 - RNA, 17 nt, Mycobacterium avium subsp. paratuberculosis
gucggcucgccugcgag

SEQ ID NO: 2965081 - RNA, 18 nt, Mycobacterium avium subsp. paratuberculosis
gucggcucggcucggccg

SEQ ID NO: 2965082 - RNA, 21 nt, Mycobacterium avium subsp. paratuberculosis
gucggcucggcucggccggcc

SEQ ID NO: 2965083 - RNA, 24 nt, Mycobacterium avium subsp. paratuberculosis
gucggcucggcucggccggccggc

SEQ ID NO: 2965084 - RNA, 23 nt, Mycobacterium avium subsp. paratuberculosis
gucggcucguguccgaugacgag

SEQ ID NO: 2965085 - RNA, 17 nt, Mycobacterium avium subsp. paratuberculosis
gucggcuggcgugcggc

SEQ ID NO: 2965086 - RNA, 19 nt, Mycobacterium avium subsp. paratuberculosis
gucggcuggcgugcggcgc

SEQ ID NO: 2965087 - RNA, 17 nt, Mycobacterium avium subsp. paratuberculosis
gucggcuuccuccucgg

SEQ ID NO: 2965088 - RNA, 19 nt, Mycobacterium avium subsp. paratuberculosis
gucggcuuccuccucggcg

SEQ ID NO: 2965089 - RNA, 16 nt, Mycobacterium avium subsp. paratuberculosis
gucggcuucguacggc

SEQ ID NO: 2965090 - RNA, 18 nt, Mycobacterium avium subsp. paratuberculosis
gucggcuucguacggccc

SEQ ID NO: 2965091 - RNA, 19 nt, Mycobacterium avium subsp. paratuberculosis
gucggcuucguacggcccg

SEQ ID NO: 2965092 - RNA, 21 nt, Mycobacterium avium subsp. paratuberculosis
gucggcuucguacggcccggg

SEQ ID NO: 2965093 - RNA, 17 nt, Mycobacterium avium subsp. paratuberculosis
gucgggaaaucggaccc

SEQ ID NO: 2965094 - RNA, 23 nt, Mycobacterium avium subsp. paratuberculosis
gucgggaaaucggacccagcccg

SEQ ID NO: 2965095 - RNA, 17 nt, Mycobacterium avium subsp. paratuberculosis
gucgggaacgccgauca

SEQ ID NO: 2965096 - RNA, 21 nt, Mycobacterium avium subsp. paratuberculosis
gucgggaacgccgaucaccgc

SEQ ID NO: 2965097 - RNA, 21 nt, Mycobacterium avium subsp. paratuberculosis
gucgggaccgaugccgcugau

SEQ ID NO: 2965098 - RNA, 20 nt, Mycobacterium avium subsp. paratuberculosis
gucgggaccgucgcgcagcc

SEQ ID NO: 2965099 - RNA, 22 nt, Mycobacterium avium subsp. paratuberculosis
gucgggaccgucgcgcagcccg

SEQ ID NO: 2965100 - RNA, 18 nt, Mycobacterium avium subsp. paratuberculosis
gucgggacgcggcaggcg

SEQ ID NO: 2965101 - RNA, 16 nt, Mycobacterium avium subsp. paratuberculosis
gucgggacggccagca

SEQ ID NO: 2965102 - RNA, 18 nt, Mycobacterium avium subsp. paratuberculosis
gucgggacggccagcagg

SEQ ID NO: 2965103 - RNA, 16 nt, Mycobacterium avium subsp. paratuberculosis
gucgggacguccgcgc

SEQ ID NO: 2965104 - RNA, 13 nt, Mycobacterium avium subsp. paratuberculosis
gucgggacgucgg

SEQ ID NO: 2965105 - RNA, 15 nt, Mycobacterium avium subsp. paratuberculosis
gucgggacgucggcg

SEQ ID NO: 2965106 - RNA, 16 nt, Mycobacterium avium subsp. paratuberculosis
gucgggauacucgucc

SEQ ID NO: 2965107 - RNA, 20 nt, Mycobacterium avium subsp. paratuberculosis
gucgggauagggcgcgucga

SEQ ID NO: 2965108 - RNA, 22 nt, Mycobacterium avium subsp. paratuberculosis
gucgggauagggcgcgucgauc

SEQ ID NO: 2965109 - RNA, 15 nt, Mycobacterium avium subsp. paratuberculosis
gucgggaucaacacg

SEQ ID NO: 2965110 - RNA, 21 nt, Mycobacterium avium subsp. paratuberculosis
gucgggaucgaucccgucggc

SEQ ID NO: 2965111 - RNA, 15 nt, Mycobacterium avium subsp. paratuberculosis
gucgggauggcggcg

SEQ ID NO: 2965112 - RNA, 17 nt, Mycobacterium avium subsp. paratuberculosis
gucgggcaaucggaccc

SEQ ID NO: 2965113 - RNA, 23 nt, Mycobacterium avium subsp. paratuberculosis
gucgggcaaucggacccagcccg

SEQ ID NO: 2965114 - RNA, 15 nt, Mycobacterium avium subsp. paratuberculosis
gucgggcacagccag

SEQ ID NO: 2965115 - RNA, 17 nt, Mycobacterium avium subsp. paratuberculosis
gucgggcacagccagcg

SEQ ID NO: 2965116 - RNA, 23 nt, Mycobacterium avium subsp. paratuberculosis
gucgggcacagccagcgcccggc

SEQ ID NO: 2965117 - RNA, 15 nt, Mycobacterium avium subsp. paratuberculosis
gucgggcacaucccg

SEQ ID NO: 2965118 - RNA, 17 nt, Mycobacterium avium subsp. paratuberculosis
gucgggcaccacggcgg

SEQ ID NO: 2965119 - RNA, 14 nt, Mycobacterium avium subsp. paratuberculosis
gucgggcaccgcca

SEQ ID NO: 2965120 - RNA, 15 nt, Mycobacterium avium subsp. paratuberculosis
gucgggcaccgccag

SEQ ID NO: 2965121 - RNA, 14 nt, Mycobacterium avium subsp. paratuberculosis
gucgggcaccugcu

SEQ ID NO: 2965122 - RNA, 13 nt, Mycobacterium avium subsp. paratuberculosis
gucgggcagcagc

SEQ ID NO: 2965123 - RNA, 23 nt, Mycobacterium avium subsp. paratuberculosis
gucgggcagcagcuccaucgacg

SEQ ID NO: 2965124 - RNA, 16 nt, Mycobacterium avium subsp. paratuberculosis
gucgggcaugccggcc

SEQ ID NO: 2965125 - RNA, 17 nt, Mycobacterium avium subsp. paratuberculosis
gucgggcaugccggccg

SEQ ID NO: 2965126 - RNA, 18 nt, Mycobacterium avium subsp. paratuberculosis
gucgggcaugccggccgg

SEQ ID NO: 2965127 - RNA, 20 nt, Mycobacterium avium subsp. paratuberculosis
gucgggcaugccggccggca

SEQ ID NO: 2965128 - RNA, 17 nt, Mycobacterium avium subsp. paratuberculosis
gucgggccaacugggug

SEQ ID NO: 2965129 - RNA, 18 nt, Mycobacterium avium subsp. paratuberculosis
gucgggccgcagcacggc

SEQ ID NO: 2965130 - RNA, 14 nt, Mycobacterium avium subsp. paratuberculosis
gucgggccgcgggc

SEQ ID NO: 2965131 - RNA, 13 nt, Mycobacterium avium subsp. paratuberculosis
gucgggccggaca

SEQ ID NO: 2965132 - RNA, 17 nt, Mycobacterium avium subsp. paratuberculosis
gucgggccggccgauga

SEQ ID NO: 2965133 - RNA, 20 nt, Mycobacterium avium subsp. paratuberculosis
gucgggccgggggcggcggc

SEQ ID NO: 2965134 - RNA, 17 nt, Mycobacterium avium subsp. paratuberculosis
gucgggccguccgccgg

SEQ ID NO: 2965135 - RNA, 18 nt, Mycobacterium avium subsp. paratuberculosis
gucgggccguccgccggc

SEQ ID NO: 2965136 - RNA, 14 nt, Mycobacterium avium subsp. paratuberculosis
gucggucccgacgc

SEQ ID NO: 2965137 - RNA, 21 nt, Mycobacterium avium subsp. paratuberculosis
gucggucccgacgcggcgcga

SEQ ID NO: 2965138 - RNA, 21 nt, Mycobacterium avium subsp. paratuberculosis
gucggucgagccuggcgcgca

SEQ ID NO: 2965139 - RNA, 21 nt, Mycobacterium avium subsp. paratuberculosis
gucggucgcgccgaccugguc

SEQ ID NO: 2965140 - RNA, 14 nt, Mycobacterium avium subsp. paratuberculosis
gucggucggcagga

SEQ ID NO: 2965141 - RNA, 14 nt, Mycobacterium avium subsp. paratuberculosis
gucggucggcccgc

SEQ ID NO: 2965142 - RNA, 18 nt, Mycobacterium avium subsp. paratuberculosis
gucggucggcccgcugcg

SEQ ID NO: 2965143 - RNA, 14 nt, Mycobacterium avium subsp. paratuberculosis
gucggucggccgca

SEQ ID NO: 2965144 - RNA, 15 nt, Mycobacterium avium subsp. paratuberculosis
gucggucggccgcac

SEQ ID NO: 2965145 - RNA, 14 nt, Mycobacterium avium subsp. paratuberculosis
gucggucucgacgu

SEQ ID NO: 2965146 - RNA, 14 nt, Mycobacterium avium subsp. paratuberculosis
gucggucugcaggu

SEQ ID NO: 2965147 - RNA, 16 nt, Mycobacterium avium subsp. paratuberculosis
gucggugaacucgucc

SEQ ID NO: 2965148 - RNA, 15 nt, Mycobacterium avium subsp. paratuberculosis
gucggugaaguccga

SEQ ID NO: 2965149 - RNA, 18 nt, Mycobacterium avium subsp. paratuberculosis
gucggugaagugccggcu

SEQ ID NO: 2965150 - RNA, 19 nt, Mycobacterium avium subsp. paratuberculosis
gucggugaaguuggcggcg

SEQ ID NO: 2965151 - RNA, 15 nt, Mycobacterium avium subsp. paratuberculosis
gucggugaccacggu

SEQ ID NO: 2965152 - RNA, 20 nt, Mycobacterium avium subsp. paratuberculosis
gucggugaccacggucggcg

SEQ ID NO: 2965153 - RNA, 23 nt, Mycobacterium avium subsp. paratuberculosis
gucggugaccacggucggcgggu

SEQ ID NO: 2965154 - RNA, 23 nt, Mycobacterium avium subsp. paratuberculosis
gucggugacgcccuuguccucga

SEQ ID NO: 2965155 - RNA, 20 nt, Mycobacterium avium subsp. paratuberculosis
gucggugagcgccaccccga

SEQ ID NO: 2965156 - RNA, 20 nt, Mycobacterium avium subsp. paratuberculosis
gucggugagcuggccgcgca

SEQ ID NO: 2965157 - RNA, 12 nt, Mycobacterium avium subsp. paratuberculosis
gucggugcagug

SEQ ID NO: 2965158 - RNA, 23 nt, Mycobacterium avium subsp. paratuberculosis
gucggugcccagcaccgccggcg

SEQ ID NO: 2965159 - RNA, 17 nt, Mycobacterium avium subsp. paratuberculosis
gucggugcccagcgcga

SEQ ID NO: 2965160 - RNA, 22 nt, Mycobacterium avium subsp. paratuberculosis
gucggugcccagcgcgaggucg

SEQ ID NO: 2965161 - RNA, 13 nt, Mycobacterium avium subsp. paratuberculosis
gucggugcccagg

SEQ ID NO: 2965162 - RNA, 15 nt, Mycobacterium avium subsp. paratuberculosis
gucggugcccagguc

SEQ ID NO: 2965163 - RNA, 20 nt, Mycobacterium avium subsp. paratuberculosis
gucggugcccaggucgccca

SEQ ID NO: 2965164 - RNA, 22 nt, Mycobacterium avium subsp. paratuberculosis
gucggugcccaggucgcccaga

SEQ ID NO: 2965165 - RNA, 15 nt, Mycobacterium avium subsp. paratuberculosis
gucggugccgcggcg

SEQ ID NO: 2965166 - RNA, 17 nt, Mycobacterium avium subsp. paratuberculosis
gucggugccgcggcgca

SEQ ID NO: 2965167 - RNA, 18 nt, Mycobacterium avium subsp. paratuberculosis
gucggugccgcggcgcac

SEQ ID NO: 2965168 - RNA, 19 nt, Mycobacterium avium subsp. paratuberculosis
gucggugccgcggcgcacc

SEQ ID NO: 2965169 - RNA, 20 nt, Mycobacterium avium subsp. paratuberculosis
gucggugccgcggcgcaccc

SEQ ID NO: 2965170 - RNA, 23 nt, Mycobacterium avium subsp. paratuberculosis
gucggugccgcggcgcaccccga

SEQ ID NO: 2965171 - RNA, 13 nt, Mycobacterium avium subsp. paratuberculosis
gucggugccgcgu

SEQ ID NO: 2965172 - RNA, 16 nt, Mycobacterium avium subsp. paratuberculosis
gucggugccgcguucg

SEQ ID NO: 2965173 - RNA, 12 nt, Mycobacterium avium subsp. paratuberculosis
gucggugcgcgc

SEQ ID NO: 2965174 - RNA, 15 nt, Mycobacterium avium subsp. paratuberculosis
gucggugcggccgca

SEQ ID NO: 2965175 - RNA, 14 nt, Mycobacterium avium subsp. paratuberculosis
gucggugcggcggg

SEQ ID NO: 2965176 - RNA, 17 nt, Mycobacterium avium subsp. paratuberculosis
gucgguggacagcgcga

SEQ ID NO: 2965177 - RNA, 19 nt, Mycobacterium avium subsp. paratuberculosis
gucgguggacagcgcgacg

SEQ ID NO: 2965178 - RNA, 16 nt, Mycobacterium avium subsp. paratuberculosis
gucgguggccaccacc

SEQ ID NO: 2965179 - RNA, 17 nt, Mycobacterium avium subsp. paratuberculosis
gucgguggccaccaccg

SEQ ID NO: 2965180 - RNA, 21 nt, Mycobacterium avium subsp. paratuberculosis
gucgguggcccagccggccga

SEQ ID NO: 2965181 - RNA, 11 nt, Mycobacterium avium subsp. paratuberculosis
gucgguggccg

SEQ ID NO: 2965182 - RNA, 13 nt, Mycobacterium avium subsp. paratuberculosis
gucgguggcggcg

SEQ ID NO: 2965183 - RNA, 16 nt, Mycobacterium avium subsp. paratuberculosis
gucgguggcggcggcg

SEQ ID NO: 2965184 - RNA, 16 nt, Mycobacterium avium subsp. paratuberculosis
gucgguggcggugccg

SEQ ID NO: 2965185 - RNA, 18 nt, Mycobacterium avium subsp. paratuberculosis
gucgguggcggugccgcg

SEQ ID NO: 2965186 - RNA, 19 nt, Mycobacterium avium subsp. paratuberculosis
gucgguggcgguggggccg

SEQ ID NO: 2965187 - RNA, 20 nt, Mycobacterium avium subsp. paratuberculosis
gucggugggcagcucgucgg

SEQ ID NO: 2965188 - RNA, 21 nt, Mycobacterium avium subsp. paratuberculosis
gucggugggcagcucgucggc

SEQ ID NO: 2965189 - RNA, 15 nt, Mycobacterium avium subsp. paratuberculosis
gucggugggccgccg

SEQ ID NO: 2965190 - RNA, 16 nt, Mycobacterium avium subsp. paratuberculosis
gucggugggccgccgc

SEQ ID NO: 2965191 - RNA, 18 nt, Mycobacterium avium subsp. paratuberculosis
gucggugggggccaggcg

SEQ ID NO: 2965192 - RNA, 19 nt, Mycobacterium avium subsp. paratuberculosis
gucggugggggccaggcgg

SEQ ID NO: 2965193 - RNA, 21 nt, Mycobacterium avium subsp. paratuberculosis
gucggugggggccaggcgggu

SEQ ID NO: 2965194 - RNA, 18 nt, Mycobacterium avium subsp. paratuberculosis
gucggugguggggccggc

SEQ ID NO: 2965195 - RNA, 15 nt, Mycobacterium avium subsp. paratuberculosis
gucggugucccgcgc

SEQ ID NO: 2965196 - RNA, 11 nt, Mycobacterium avium subsp. paratuberculosis
gucggugucga

SEQ ID NO: 2965197 - RNA, 19 nt, Mycobacterium avium subsp. paratuberculosis
gucggugucgaagacgguc

SEQ ID NO: 2965198 - RNA, 15 nt, Mycobacterium avium subsp. paratuberculosis
gucggugugagcggu

SEQ ID NO: 2965199 - RNA, 16 nt, Mycobacterium avium subsp. paratuberculosis
gucggugugcagcagc

SEQ ID NO: 2965200 - RNA, 22 nt, Mycobacterium avium subsp. paratuberculosis
gucggugugcagcagcucggcg

SEQ ID NO: 2965201 - RNA, 23 nt, Mycobacterium avium subsp. paratuberculosis
gucggugugcagcagcucggcga

SEQ ID NO: 2965202 - RNA, 21 nt, Mycobacterium avium subsp. paratuberculosis
gucgguucauccacucggcca

SEQ ID NO: 2965203 - RNA, 24 nt, Mycobacterium avium subsp. paratuberculosis
gucgguucauccacucggccacca

SEQ ID NO: 2965204 - RNA, 16 nt, Mycobacterium avium subsp. paratuberculosis
gucgguuucggucgcg

SEQ ID NO: 2965205 - RNA, 13 nt, Mycobacterium avium subsp. paratuberculosis
gucguacaccucg

SEQ ID NO: 2965206 - RNA, 14 nt, Mycobacterium avium subsp. paratuberculosis
gucguacagcagcc

SEQ ID NO: 2965207 - RNA, 16 nt, Mycobacterium avium subsp. paratuberculosis
gucguacagcagcccc

SEQ ID NO: 2965208 - RNA, 19 nt, Mycobacterium avium subsp. paratuberculosis
gucguacgggcgcagcgcc

SEQ ID NO: 2965209 - RNA, 17 nt, Mycobacterium avium subsp. paratuberculosis
gucguacucgaccgcga

SEQ ID NO: 2965210 - RNA, 14 nt, Mycobacterium avium subsp. paratuberculosis
gucguacucgggug

SEQ ID NO: 2965211 - RNA, 17 nt, Mycobacterium avium subsp. paratuberculosis
gucguagagcgcgaagc

SEQ ID NO: 2965212 - RNA, 14 nt, Mycobacterium avium subsp. paratuberculosis
gucguagccgcggg

SEQ ID NO: 2965213 - RNA, 15 nt, Mycobacterium avium subsp. paratuberculosis
gucguagccgcgggu

SEQ ID NO: 2965214 - RNA, 13 nt, Mycobacterium avium subsp. paratuberculosis
gucguagccgucg

SEQ ID NO: 2965215 - RNA, 16 nt, Mycobacterium avium subsp. paratuberculosis
gucguagcggcgccac

SEQ ID NO: 2965216 - RNA, 18 nt, Mycobacterium avium subsp. paratuberculosis
gucguagcggcgccaccg

SEQ ID NO: 2965217 - RNA, 16 nt, Mycobacterium avium subsp. paratuberculosis
gucguagucgaggccg

SEQ ID NO: 2965218 - RNA, 16 nt, Mycobacterium avium subsp. paratuberculosis
gucguagucgcucggc

SEQ ID NO: 2965219 - RNA, 20 nt, Mycobacterium avium subsp. paratuberculosis
gucguagucgcucggcggcg

SEQ ID NO: 2965220 - RNA, 18 nt, Mycobacterium avium subsp. paratuberculosis
gucguagucggcccgccg

SEQ ID NO: 2965221 - RNA, 23 nt, Mycobacterium avium subsp. paratuberculosis
gucgucggccugcacgucggcgc

SEQ ID NO: 2965222 - RNA, 16 nt, Mycobacterium avium subsp. paratuberculosis
gucgucggcgaacggc

SEQ ID NO: 2965223 - RNA, 16 nt, Mycobacterium avium subsp. paratuberculosis
gucgucggcgacgacc

SEQ ID NO: 2965224 - RNA, 17 nt, Mycobacterium avium subsp. paratuberculosis
gucgucggcgacgaccu

SEQ ID NO: 2965225 - RNA, 14 nt, Mycobacterium avium subsp. paratuberculosis
gucgucggcgccgc

SEQ ID NO: 2965226 - RNA, 17 nt, Mycobacterium avium subsp. paratuberculosis
gucgucggcgccgcgcc

SEQ ID NO: 2965227 - RNA, 18 nt, Mycobacterium avium subsp. paratuberculosis
gucgucggcgcgguuguc

SEQ ID NO: 2965228 - RNA, 15 nt, Mycobacterium avium subsp. paratuberculosis
gucgucggcggacug

SEQ ID NO: 2965229 - RNA, 13 nt, Mycobacterium avium subsp. paratuberculosis
gucgucggcggcg

SEQ ID NO: 2965230 - RNA, 20 nt, Mycobacterium avium subsp. paratuberculosis
gucgucggcggcgacgugcc

SEQ ID NO: 2965231 - RNA, 12 nt, Mycobacterium avium subsp. paratuberculosis
gucgucggcggg

SEQ ID NO: 2965232 - RNA, 13 nt, Mycobacterium avium subsp. paratuberculosis
gucgucgggcacc

SEQ ID NO: 2965233 - RNA, 17 nt, Mycobacterium avium subsp. paratuberculosis
gucgucgggcaccacgg

SEQ ID NO: 2965234 - RNA, 21 nt, Mycobacterium avium subsp. paratuberculosis
gucgucgggcaccacggcggc

SEQ ID NO: 2965235 - RNA, 14 nt, Mycobacterium avium subsp. paratuberculosis
gucgucgggcagga

SEQ ID NO: 2965236 - RNA, 17 nt, Mycobacterium avium subsp. paratuberculosis
gucgucgggccgcagca

SEQ ID NO: 2965237 - RNA, 16 nt, Mycobacterium avium subsp. paratuberculosis
gucgucgggcgcggug

SEQ ID NO: 2965238 - RNA, 23 nt, Mycobacterium avium subsp. paratuberculosis
gucgucggggcaucgcagcgcgc

SEQ ID NO: 2965239 - RNA, 16 nt, Mycobacterium avium subsp. paratuberculosis
gucgucggucagcucg

SEQ ID NO: 2965240 - RNA, 14 nt, Mycobacterium avium subsp. paratuberculosis
gucgucggucaggc

SEQ ID NO: 2965241 - RNA, 20 nt, Mycobacterium avium subsp. paratuberculosis
gucgucggugaacgccggug

SEQ ID NO: 2965242 - RNA, 22 nt, Mycobacterium avium subsp. paratuberculosis
gucgucggugaacgccggugag

SEQ ID NO: 2965243 - RNA, 19 nt, Mycobacterium avium subsp. paratuberculosis
gucgucggugauggugacc

SEQ ID NO: 2965244 - RNA, 18 nt, Mycobacterium avium subsp. paratuberculosis
gucgucggugggccgccg

SEQ ID NO: 2965245 - RNA, 19 nt, Mycobacterium avium subsp. paratuberculosis
gucgucggugggccgccgc

SEQ ID NO: 2965246 - RNA, 21 nt, Mycobacterium avium subsp. paratuberculosis
gucgucguccgcaaccgccgg

SEQ ID NO: 2965247 - RNA, 12 nt, Mycobacterium avium subsp. paratuberculosis
gucgucguccuc

SEQ ID NO: 2965248 - RNA, 14 nt, Mycobacterium avium subsp. paratuberculosis
gucgucgucgaagg

SEQ ID NO: 2965249 - RNA, 15 nt, Mycobacterium avium subsp. paratuberculosis
gucgucgucgacgcu

SEQ ID NO: 2965250 - RNA, 14 nt, Mycobacterium avium subsp. paratuberculosis
gucgucgucgagcc

SEQ ID NO: 2965251 - RNA, 15 nt, Mycobacterium avium subsp. paratuberculosis
gucgucgucgccgcc

SEQ ID NO: 2965252 - RNA, 17 nt, Mycobacterium avium subsp. paratuberculosis
gucgucgucgccgccgg

SEQ ID NO: 2965253 - RNA, 15 nt, Mycobacterium avium subsp. paratuberculosis
gucgucgucgcucca

SEQ ID NO: 2965254 - RNA, 14 nt, Mycobacterium avium subsp. paratuberculosis
gucgucgucggccg

SEQ ID NO: 2965255 - RNA, 14 nt, Mycobacterium avium subsp. paratuberculosis
gucgucgucggcga

SEQ ID NO: 2965256 - RNA, 16 nt, Mycobacterium avium subsp. paratuberculosis
gucgucgucggcgacg

SEQ ID NO: 2965257 - RNA, 17 nt, Mycobacterium avium subsp. paratuberculosis
gucgucgucggcgacga

SEQ ID NO: 2965258 - RNA, 20 nt, Mycobacterium avium subsp. paratuberculosis
gucgucgugcgcgggcgaaa

SEQ ID NO: 2965259 - RNA, 20 nt, Mycobacterium avium subsp. paratuberculosis
gucgucgugguagcggucgg

SEQ ID NO: 2965260 - RNA, 20 nt, Mycobacterium avium subsp. paratuberculosis
gucgucguugagcaucacca

SEQ ID NO: 2965261 - RNA, 20 nt, Mycobacterium avium subsp. paratuberculosis
gucgucguuggcccgccgcg

SEQ ID NO: 2965262 - RNA, 19 nt, Mycobacterium avium subsp. paratuberculosis
gucgucguugugggccagc

SEQ ID NO: 2965263 - RNA, 20 nt, Mycobacterium avium subsp. paratuberculosis
gucgucguugugggccagcg

SEQ ID NO: 2965264 - RNA, 23 nt, Mycobacterium avium subsp. paratuberculosis
gucgucguugugggccagcgcgg

SEQ ID NO: 2965265 - RNA, 18 nt, Mycobacterium avium subsp. paratuberculosis
gucgucuucuuggccgcg

SEQ ID NO: 2965266 - RNA, 20 nt, Mycobacterium avium subsp. paratuberculosis
gucgugaaacauggcgcccg

SEQ ID NO: 2965267 - RNA, 22 nt, Mycobacterium avium subsp. paratuberculosis
gucgugauggcgaaccagcgcc

SEQ ID NO: 2965268 - RNA, 16 nt, Mycobacterium avium subsp. paratuberculosis
gucgugcaacucccgc

SEQ ID NO: 2965269 - RNA, 17 nt, Mycobacterium avium subsp. paratuberculosis
gucgugcaacucccgcg

SEQ ID NO: 2965270 - RNA, 18 nt, Mycobacterium avium subsp. paratuberculosis
gucgugcaacucccgcgc

SEQ ID NO: 2965271 - RNA, 20 nt, Mycobacterium avium subsp. paratuberculosis
gucgugcaacucccgcgccg

SEQ ID NO: 2965272 - RNA, 23 nt, Mycobacterium avium subsp. paratuberculosis
gucgugcaacucccgcgccgcgg

SEQ ID NO: 2965273 - RNA, 12 nt, Mycobacterium avium subsp. paratuberculosis
gucgugcaccac

SEQ ID NO: 2965274 - RNA, 19 nt, Mycobacterium avium subsp. paratuberculosis
gucgugcaccacgacgucg

SEQ ID NO: 2965275 - RNA, 14 nt, Mycobacterium avium subsp. paratuberculosis
gucgugcacgccgu

SEQ ID NO: 2965276 - RNA, 13 nt, Mycobacterium avium subsp. paratuberculosis
gucgugcagcacc

SEQ ID NO: 2965277 - RNA, 14 nt, Mycobacterium avium subsp. paratuberculosis
gucgugcagcaccg

SEQ ID NO: 2965278 - RNA, 20 nt, Mycobacterium avium subsp. paratuberculosis
gucgugcagcaccgccagca

SEQ ID NO: 2965279 - RNA, 21 nt, Mycobacterium avium subsp. paratuberculosis
gucgugcauucaggucaccgc

SEQ ID NO: 2965280 - RNA, 22 nt, Mycobacterium avium subsp. paratuberculosis
gucgugcauucaggucaccgcg

SEQ ID NO: 2965281 - RNA, 23 nt, Mycobacterium avium subsp. paratuberculosis
gucgugcauucaggucaccgcgc

SEQ ID NO: 2965282 - RNA, 19 nt, Mycobacterium avium subsp. paratuberculosis
gucgugccgggugaugcag

SEQ ID NO: 2965283 - RNA, 21 nt, Mycobacterium avium subsp. paratuberculosis
gucgugcggccggcgccggcg

SEQ ID NO: 2965284 - RNA, 22 nt, Mycobacterium avium subsp. paratuberculosis
gucgugcgggaugccgagcagc

SEQ ID NO: 2965285 - RNA, 16 nt, Mycobacterium avium subsp. paratuberculosis
gucgugcggucgcacc

SEQ ID NO: 2965286 - RNA, 17 nt, Mycobacterium avium subsp. paratuberculosis
gucgugcggucgcacca

SEQ ID NO: 2965287 - RNA, 21 nt, Mycobacterium avium subsp. paratuberculosis
gucgugcucggcgagcaccgu

SEQ ID NO: 2965288 - RNA, 22 nt, Mycobacterium avium subsp. paratuberculosis
gucgugcucgucggcgggcacc

SEQ ID NO: 2965289 - RNA, 17 nt, Mycobacterium avium subsp. paratuberculosis
gucguggcccugcucgu

SEQ ID NO: 2965290 - RNA, 16 nt, Mycobacterium avium subsp. paratuberculosis
gucguggccgacggga

SEQ ID NO: 2965291 - RNA, 19 nt, Mycobacterium avium subsp. paratuberculosis
gucguggcgacaucgccgc

SEQ ID NO: 2965292 - RNA, 21 nt, Mycobacterium avium subsp. paratuberculosis
gucguggcgacaucgccgcgg

SEQ ID NO: 2965293 - RNA, 22 nt, Mycobacterium avium subsp. paratuberculosis
gucguggcgacaucgccgcggc

SEQ ID NO: 2965294 - RNA, 15 nt, Mycobacterium avium subsp. paratuberculosis
gucguggcgccgagg

SEQ ID NO: 2965295 - RNA, 21 nt, Mycobacterium avium subsp. paratuberculosis
gucguggcgugccgggcggua

SEQ ID NO: 2965296 - RNA, 18 nt, Mycobacterium avium subsp. paratuberculosis
gucguggguauccgccgc

SEQ ID NO: 2965297 - RNA, 19 nt, Mycobacterium avium subsp. paratuberculosis
gucguggguauccgccgcc

SEQ ID NO: 2965298 - RNA, 21 nt, Mycobacterium avium subsp. paratuberculosis
gucguggguauccgccgccag

SEQ ID NO: 2965299 - RNA, 16 nt, Mycobacterium avium subsp. paratuberculosis
gucgugggugacccgg

SEQ ID NO: 2965300 - RNA, 15 nt, Mycobacterium avium subsp. paratuberculosis
gucguggucgacgcc

SEQ ID NO: 2965301 - RNA, 16 nt, Mycobacterium avium subsp. paratuberculosis
gucgugguggccgcga

SEQ ID NO: 2965302 - RNA, 14 nt, Mycobacterium avium subsp. paratuberculosis
gucguguccgggcc

SEQ ID NO: 2965303 - RNA, 15 nt, Mycobacterium avium subsp. paratuberculosis
gucguguccgggccc

SEQ ID NO: 2965304 - RNA, 17 nt, Mycobacterium avium subsp. paratuberculosis
gucguguccgggcccga

SEQ ID NO: 2965305 - RNA, 21 nt, Mycobacterium avium subsp. paratuberculosis
gucucgcgggaguggccggcg

SEQ ID NO: 2965306 - RNA, 14 nt, Mycobacterium avium subsp. paratuberculosis
gucucggccgcggu

SEQ ID NO: 2965307 - RNA, 13 nt, Mycobacterium avium subsp. paratuberculosis
gucucggcgaggc

SEQ ID NO: 2965308 - RNA, 17 nt, Mycobacterium avium subsp. paratuberculosis
gucucggcgaggcgcuc

SEQ ID NO: 2965309 - RNA, 17 nt, Mycobacterium avium subsp. paratuberculosis
gucucggcgccgucgcc

SEQ ID NO: 2965310 - RNA, 23 nt, Mycobacterium avium subsp. paratuberculosis
gucucggcggccgagcgcaccgc

SEQ ID NO: 2965311 - RNA, 15 nt, Mycobacterium avium subsp. paratuberculosis
gucucggcgucucgg

SEQ ID NO: 2965312 - RNA, 20 nt, Mycobacterium avium subsp. paratuberculosis
gucucggcgucucggcccga

SEQ ID NO: 2965313 - RNA, 18 nt, Mycobacterium avium subsp. paratuberculosis
gucucggcgucucggcgu

SEQ ID NO: 2965314 - RNA, 22 nt, Mycobacterium avium subsp. paratuberculosis
gucucggcgugcucggccacga

SEQ ID NO: 2965315 - RNA, 15 nt, Mycobacterium avium subsp. paratuberculosis
gucucgggaucgccg

SEQ ID NO: 2965316 - RNA, 18 nt, Mycobacterium avium subsp. paratuberculosis
gucucgggcaccacgccg

SEQ ID NO: 2965317 - RNA, 21 nt, Mycobacterium avium subsp. paratuberculosis
gucucgggcaccacgccgacg

SEQ ID NO: 2965318 - RNA, 16 nt, Mycobacterium avium subsp. paratuberculosis
gucucgggcagcagca

SEQ ID NO: 2965319 - RNA, 17 nt, Mycobacterium avium subsp. paratuberculosis
gucucggguuugccgac

SEQ ID NO: 2965320 - RNA, 22 nt, Mycobacterium avium subsp. paratuberculosis
gucucggugucggacuugucgc

SEQ ID NO: 2965321 - RNA, 16 nt, Mycobacterium avium subsp. paratuberculosis
gucucgucggccgcga

SEQ ID NO: 2965322 - RNA, 17 nt, Mycobacterium avium subsp. paratuberculosis
gucucgucggccgcgac

SEQ ID NO: 2965323 - RNA, 16 nt, Mycobacterium avium subsp. paratuberculosis
gucucguugugcaccg

SEQ ID NO: 2965324 - RNA, 18 nt, Mycobacterium avium subsp. paratuberculosis
gucucguugugcaccggc

SEQ ID NO: 2965325 - RNA, 17 nt, Mycobacterium avium subsp. paratuberculosis
gucucugucgucgacca

SEQ ID NO: 2965326 - RNA, 18 nt, Mycobacterium avium subsp. paratuberculosis
gucucuucgacccgguag

SEQ ID NO: 2965327 - RNA, 17 nt, Mycobacterium avium subsp. paratuberculosis
gucugaaaugccgggcc

SEQ ID NO: 2965328 - RNA, 21 nt, Mycobacterium avium subsp. paratuberculosis
gucugagcccgggcaggcggc

SEQ ID NO: 2965329 - RNA, 14 nt, Mycobacterium avium subsp. paratuberculosis
gucugaucgcccag

SEQ ID NO: 2965330 - RNA, 15 nt, Mycobacterium avium subsp. paratuberculosis
gucugcaccgggaug

SEQ ID NO: 2965331 - RNA, 16 nt, Mycobacterium avium subsp. paratuberculosis
gucugcagcagccgcu

SEQ ID NO: 2965332 - RNA, 22 nt, Mycobacterium avium subsp. paratuberculosis
gucugcagcagccgcugcuggg

SEQ ID NO: 2965333 - RNA, 13 nt, Mycobacterium avium subsp. paratuberculosis
gucugcagcgacg

SEQ ID NO: 2965334 - RNA, 22 nt, Mycobacterium avium subsp. paratuberculosis
gucugcaggucguaguaggcgc

SEQ ID NO: 2965335 - RNA, 21 nt, Mycobacterium avium subsp. paratuberculosis
gucugcauccggaaccgggca

SEQ ID NO: 2965336 - RNA, 17 nt, Mycobacterium avium subsp. paratuberculosis
gucugccacgcccaccg

SEQ ID NO: 2965337 - RNA, 19 nt, Mycobacterium avium subsp. paratuberculosis
gucugccacgcccaccggu

SEQ ID NO: 2965338 - RNA, 22 nt, Mycobacterium avium subsp. paratuberculosis
gucugccacgcccaccgguggc

SEQ ID NO: 2965339 - RNA, 16 nt, Mycobacterium avium subsp. paratuberculosis
gucugccagaacggcg

SEQ ID NO: 2965340 - RNA, 19 nt, Mycobacterium avium subsp. paratuberculosis
gucugccagaacggcggca

SEQ ID NO: 2965341 - RNA, 22 nt, Mycobacterium avium subsp. paratuberculosis
gucugccagaacggcggcagcg

SEQ ID NO: 2965342 - RNA, 13 nt, Mycobacterium avium subsp. paratuberculosis
gucugccgggaca

SEQ ID NO: 2965343 - RNA, 23 nt, Mycobacterium avium subsp. paratuberculosis
gucugccgggacagguagcgcag

SEQ ID NO: 2965344 - RNA, 23 nt, Mycobacterium avium subsp. paratuberculosis
gucugccuugcugacgccgcggu

SEQ ID NO: 2965345 - RNA, 15 nt, Mycobacterium avium subsp. paratuberculosis
gucugcgccccggcg

SEQ ID NO: 2965346 - RNA, 17 nt, Mycobacterium avium subsp. paratuberculosis
gucugcgccccggcguc

SEQ ID NO: 2965347 - RNA, 19 nt, Mycobacterium avium subsp. paratuberculosis
gucugcgccccggcgucga

SEQ ID NO: 2965348 - RNA, 12 nt, Mycobacterium avium subsp. paratuberculosis
gucugcgcccga

SEQ ID NO: 2965349 - RNA, 17 nt, Mycobacterium avium subsp. paratuberculosis
gucugcgcccgaucggc

SEQ ID NO: 2965350 - RNA, 21 nt, Mycobacterium avium subsp. paratuberculosis
gucugcgccggcggugucgag

SEQ ID NO: 2965351 - RNA, 13 nt, Mycobacterium avium subsp. paratuberculosis
gucugcgccucga

SEQ ID NO: 2965352 - RNA, 13 nt, Mycobacterium avium subsp. paratuberculosis
gucugcggccgcg

SEQ ID NO: 2965353 - RNA, 16 nt, Mycobacterium avium subsp. paratuberculosis
gucugcggccgcgacu

SEQ ID NO: 2965354 - RNA, 22 nt, Mycobacterium avium subsp. paratuberculosis
gucugcggccgcgacugcaccc

SEQ ID NO: 2965355 - RNA, 13 nt, Mycobacterium avium subsp. paratuberculosis
gucugcggccggg

SEQ ID NO: 2965356 - RNA, 15 nt, Mycobacterium avium subsp. paratuberculosis
gucugcggcucggcg

SEQ ID NO: 2965357 - RNA, 16 nt, Mycobacterium avium subsp. paratuberculosis
gucugcggcucggcgc

SEQ ID NO: 2965358 - RNA, 18 nt, Mycobacterium avium subsp. paratuberculosis
gucugcgggaagcccacc

SEQ ID NO: 2965359 - RNA, 22 nt, Mycobacterium avium subsp. paratuberculosis
gucugcgggaagcccaccgcgg

SEQ ID NO: 2965360 - RNA, 14 nt, Mycobacterium avium subsp. paratuberculosis
gucugcggugcgcc

SEQ ID NO: 2965361 - RNA, 16 nt, Mycobacterium avium subsp. paratuberculosis
gucugcggugugggca

SEQ ID NO: 2965362 - RNA, 13 nt, Mycobacterium avium subsp. paratuberculosis
gucugcucgccgg

SEQ ID NO: 2965363 - RNA, 16 nt, Mycobacterium avium subsp. paratuberculosis
gucugcucgccgucac

SEQ ID NO: 2965364 - RNA, 12 nt, Mycobacterium avium subsp. paratuberculosis
gucugcucgccu

SEQ ID NO: 2965365 - RNA, 13 nt, Mycobacterium avium subsp. paratuberculosis
gucugcucggcgg

SEQ ID NO: 2965366 - RNA, 14 nt, Mycobacterium avium subsp. paratuberculosis
gucugcucggcggg

SEQ ID NO: 2965367 - RNA, 15 nt, Mycobacterium avium subsp. paratuberculosis
gucugcugcgccauc

SEQ ID NO: 2965368 - RNA, 15 nt, Mycobacterium avium subsp. paratuberculosis
gucugcuggcccggu

SEQ ID NO: 2965369 - RNA, 21 nt, Mycobacterium avium subsp. paratuberculosis
gucugcugggcguugccgguc

SEQ ID NO: 2965370 - RNA, 22 nt, Mycobacterium avium subsp. paratuberculosis
gucugcuugugaaugggcugcg

SEQ ID NO: 2965371 - RNA, 18 nt, Mycobacterium avium subsp. paratuberculosis
gucuggaugaucgucucg

SEQ ID NO: 2965372 - RNA, 22 nt, Mycobacterium avium subsp. paratuberculosis
gucuggaugaucgucucggccg

SEQ ID NO: 2965373 - RNA, 15 nt, Mycobacterium avium subsp. paratuberculosis
gucuggcagccggcc

SEQ ID NO: 2965374 - RNA, 16 nt, Mycobacterium avium subsp. paratuberculosis
gucuggcagccggccg

SEQ ID NO: 2965375 - RNA, 18 nt, Mycobacterium avium subsp. paratuberculosis
gucuggcagccggccggc

SEQ ID NO: 2965376 - RNA, 19 nt, Mycobacterium avium subsp. paratuberculosis
gucuggcagccggccggca

SEQ ID NO: 2965377 - RNA, 15 nt, Mycobacterium avium subsp. paratuberculosis
gucuggccaccgaag

SEQ ID NO: 2965378 - RNA, 14 nt, Mycobacterium avium subsp. paratuberculosis
gucuggcccggugc

SEQ ID NO: 2965379 - RNA, 19 nt, Mycobacterium avium subsp. paratuberculosis
gucugggcgaccaugccgc

SEQ ID NO: 2965380 - RNA, 20 nt, Mycobacterium avium subsp. paratuberculosis
gucugggcgaccaugccgcg

SEQ ID NO: 2965381 - RNA, 16 nt, Mycobacterium avium subsp. paratuberculosis
gucugguccaccgggc

SEQ ID NO: 2965382 - RNA, 15 nt, Mycobacterium avium subsp. paratuberculosis
gucugugaccacggu

SEQ ID NO: 2965383 - RNA, 19 nt, Mycobacterium avium subsp. paratuberculosis
gucuguggaucgugucugg

SEQ ID NO: 2965384 - RNA, 23 nt, Mycobacterium avium subsp. paratuberculosis
gucuguucacuacuuuuccgguu

SEQ ID NO: 2965385 - RNA, 19 nt, Mycobacterium avium subsp. paratuberculosis
gucuuacggauaucccgcg

SEQ ID NO: 2965386 - RNA, 15 nt, Mycobacterium avium subsp. paratuberculosis
gucuucccgccgccg

SEQ ID NO: 2965387 - RNA, 17 nt, Mycobacterium avium subsp. paratuberculosis
gucuucccgccgccguc

SEQ ID NO: 2965388 - RNA, 15 nt, Mycobacterium avium subsp. paratuberculosis
gucuuccgggccacc

SEQ ID NO: 2965389 - RNA, 14 nt, Mycobacterium avium subsp. paratuberculosis
gucuucggccaucg

SEQ ID NO: 2965390 - RNA, 17 nt, Mycobacterium avium subsp. paratuberculosis
gugaaguuggcggcggu

SEQ ID NO: 2965391 - RNA, 18 nt, Mycobacterium avium subsp. paratuberculosis
gugaaguuggcggcggug

SEQ ID NO: 2965392 - RNA, 19 nt, Mycobacterium avium subsp. paratuberculosis
gugaaguuggcggcgguga

SEQ ID NO: 2965393 - RNA, 14 nt, Mycobacterium avium subsp. paratuberculosis
gugaaucgacaccg

SEQ ID NO: 2965394 - RNA, 19 nt, Mycobacterium avium subsp. paratuberculosis
gugaaucgacaccgcacgg

SEQ ID NO: 2965395 - RNA, 16 nt, Mycobacterium avium subsp. paratuberculosis
gugaaucuuggccagc

SEQ ID NO: 2965396 - RNA, 19 nt, Mycobacterium avium subsp. paratuberculosis
gugaaucuuggccagcagc

SEQ ID NO: 2965397 - RNA, 14 nt, Mycobacterium avium subsp. paratuberculosis
gugaaugcccagcg

SEQ ID NO: 2965398 - RNA, 16 nt, Mycobacterium avium subsp. paratuberculosis
gugaaugcccagcggg

SEQ ID NO: 2965399 - RNA, 16 nt, Mycobacterium avium subsp. paratuberculosis
gugaaugcucagcggg

SEQ ID NO: 2965400 - RNA, 14 nt, Mycobacterium avium subsp. paratuberculosis
gugaaugggcugcg

SEQ ID NO: 2965401 - RNA, 15 nt, Mycobacterium avium subsp. paratuberculosis
gugaaugggcugcgc

SEQ ID NO: 2965402 - RNA, 13 nt, Mycobacterium avium subsp. paratuberculosis
gugaauucggccg

SEQ ID NO: 2965403 - RNA, 21 nt, Mycobacterium avium subsp. paratuberculosis
gugacaaagaucacagcgccc

SEQ ID NO: 2965404 - RNA, 17 nt, Mycobacterium avium subsp. paratuberculosis
gugacaacggugguggc

SEQ ID NO: 2965405 - RNA, 13 nt, Mycobacterium avium subsp. paratuberculosis
gugacacagccaa

SEQ ID NO: 2965406 - RNA, 16 nt, Mycobacterium avium subsp. paratuberculosis
gugacacagccaaagc

SEQ ID NO: 2965407 - RNA, 17 nt, Mycobacterium avium subsp. paratuberculosis
gugacaggggcagcagc

SEQ ID NO: 2965408 - RNA, 14 nt, Mycobacterium avium subsp. paratuberculosis
gugacagucgaccu

SEQ ID NO: 2965409 - RNA, 21 nt, Mycobacterium avium subsp. paratuberculosis
gugacagucgaccucgcgcgu

SEQ ID NO: 2965410 - RNA, 23 nt, Mycobacterium avium subsp. paratuberculosis
gugacagucgagggcuaaccacc

SEQ ID NO: 2965411 - RNA, 13 nt, Mycobacterium avium subsp. paratuberculosis
gugacaucgccac

SEQ ID NO: 2965412 - RNA, 13 nt, Mycobacterium avium subsp. paratuberculosis
gugaccaccugca

SEQ ID NO: 2965413 - RNA, 19 nt, Mycobacterium avium subsp. paratuberculosis
gugaccaccugcaccugcg

SEQ ID NO: 2965414 - RNA, 21 nt, Mycobacterium avium subsp. paratuberculosis
gugaccaccugcaccugcggc

SEQ ID NO: 2965415 - RNA, 19 nt, Mycobacterium avium subsp. paratuberculosis
gugaccacgccgugcccgg

SEQ ID NO: 2965416 - RNA, 22 nt, Mycobacterium avium subsp. paratuberculosis
gugaccacgccgugcccggcgc

SEQ ID NO: 2965417 - RNA, 18 nt, Mycobacterium avium subsp. paratuberculosis
gugaccacggucacagcc

SEQ ID NO: 2965418 - RNA, 21 nt, Mycobacterium avium subsp. paratuberculosis
gugaccacggucacagccgcg

SEQ ID NO: 2965419 - RNA, 20 nt, Mycobacterium avium subsp. paratuberculosis
gugaccagccacauguucuc

SEQ ID NO: 2965420 - RNA, 15 nt, Mycobacterium avium subsp. paratuberculosis
gugaccagcgccccc

SEQ ID NO: 2965421 - RNA, 22 nt, Mycobacterium avium subsp. paratuberculosis
gugaccaggcuugccccguacg

SEQ ID NO: 2965422 - RNA, 22 nt, Mycobacterium avium subsp. paratuberculosis
gugaccagugcagagcgauggg

SEQ ID NO: 2965423 - RNA, 15 nt, Mycobacterium avium subsp. paratuberculosis
gugaccaucgggucg

SEQ ID NO: 2965424 - RNA, 20 nt, Mycobacterium avium subsp. paratuberculosis
gugaccccguugcacaggca

SEQ ID NO: 2965425 - RNA, 22 nt, Mycobacterium avium subsp. paratuberculosis
gugacccgauccagggcccgcu

SEQ ID NO: 2965426 - RNA, 17 nt, Mycobacterium avium subsp. paratuberculosis
gugacccgccgugaccg

SEQ ID NO: 2965427 - RNA, 20 nt, Mycobacterium avium subsp. paratuberculosis
gugacccgccgugaccggcg

SEQ ID NO: 2965428 - RNA, 13 nt, Mycobacterium avium subsp. paratuberculosis
gugacccgcucgg

SEQ ID NO: 2965429 - RNA, 18 nt, Mycobacterium avium subsp. paratuberculosis
gugacccgcucgggcgcc

SEQ ID NO: 2965430 - RNA, 21 nt, Mycobacterium avium subsp. paratuberculosis
gugacccgcucgggcgccucg

SEQ ID NO: 2965431 - RNA, 14 nt, Mycobacterium avium subsp. paratuberculosis
gugacccgggcgau

SEQ ID NO: 2965432 - RNA, 17 nt, Mycobacterium avium subsp. paratuberculosis
gugacccgggcgauggu

SEQ ID NO: 2965433 - RNA, 21 nt, Mycobacterium avium subsp. paratuberculosis
gugacccugccgucaccggcc

SEQ ID NO: 2965434 - RNA, 23 nt, Mycobacterium avium subsp. paratuberculosis
gugacccugccgucaccggccau

SEQ ID NO: 2965435 - RNA, 19 nt, Mycobacterium avium subsp. paratuberculosis
gugaccgaggccgcccgcu

SEQ ID NO: 2965436 - RNA, 18 nt, Mycobacterium avium subsp. paratuberculosis
gugaccgagucgucgcgc

SEQ ID NO: 2965437 - RNA, 14 nt, Mycobacterium avium subsp. paratuberculosis
gugaccgccagcac

SEQ ID NO: 2965438 - RNA, 18 nt, Mycobacterium avium subsp. paratuberculosis
gugaccgccagcaccgcg

SEQ ID NO: 2965439 - RNA, 20 nt, Mycobacterium avium subsp. paratuberculosis
gugaccgccagcaccgcggg

SEQ ID NO: 2965440 - RNA, 13 nt, Mycobacterium avium subsp. paratuberculosis
gugaccgcccgcu

SEQ ID NO: 2965441 - RNA, 21 nt, Mycobacterium avium subsp. paratuberculosis
gugaccgcccgcucgacggcc

SEQ ID NO: 2965442 - RNA, 16 nt, Mycobacterium avium subsp. paratuberculosis
gugaccgccucgucga

SEQ ID NO: 2965443 - RNA, 20 nt, Mycobacterium avium subsp. paratuberculosis
gugaccgccuuggcgcgcuc

SEQ ID NO: 2965444 - RNA, 14 nt, Mycobacterium avium subsp. paratuberculosis
gugaccgcgacgcu

SEQ ID NO: 2965445 - RNA, 15 nt, Mycobacterium avium subsp. paratuberculosis
gugaccgcgacgcug

SEQ ID NO: 2965446 - RNA, 20 nt, Mycobacterium avium subsp. paratuberculosis
gugaccgcgacgcugccggu

SEQ ID NO: 2965447 - RNA, 11 nt, Mycobacterium avium subsp. paratuberculosis
gugaccgcgcc

SEQ ID NO: 2965448 - RNA, 14 nt, Mycobacterium avium subsp. paratuberculosis
gugaccgcgccgcg

SEQ ID NO: 2965449 - RNA, 23 nt, Mycobacterium avium subsp. paratuberculosis
gugaccgcgccgguguucggcgc

SEQ ID NO: 2965450 - RNA, 12 nt, Mycobacterium avium subsp. paratuberculosis
gugaccgcggcc

SEQ ID NO: 2965451 - RNA, 15 nt, Mycobacterium avium subsp. paratuberculosis
gugaccgcggccucg

SEQ ID NO: 2965452 - RNA, 18 nt, Mycobacterium avium subsp. paratuberculosis
gugaccggaucggccagc

SEQ ID NO: 2965453 - RNA, 23 nt, Mycobacterium avium subsp. paratuberculosis
gugaccggccugagacgacgcca

SEQ ID NO: 2965454 - RNA, 12 nt, Mycobacterium avium subsp. paratuberculosis
gugaccggcgag

SEQ ID NO: 2965455 - RNA, 14 nt, Mycobacterium avium subsp. paratuberculosis
gugaccggcgaggu

SEQ ID NO: 2965456 - RNA, 23 nt, Mycobacterium avium subsp. paratuberculosis
gugaccggcgccgggucgcggua

SEQ ID NO: 2965457 - RNA, 15 nt, Mycobacterium avium subsp. paratuberculosis
gugaccggcgcgcag

SEQ ID NO: 2965458 - RNA, 15 nt, Mycobacterium avium subsp. paratuberculosis
gugaccggcgcgccc

SEQ ID NO: 2965459 - RNA, 19 nt, Mycobacterium avium subsp. paratuberculosis
gugaccggcgcgcccgagu

SEQ ID NO: 2965460 - RNA, 20 nt, Mycobacterium avium subsp. paratuberculosis
gugaccggcggccagcgagg

SEQ ID NO: 2965461 - RNA, 16 nt, Mycobacterium avium subsp. paratuberculosis
gugaccggcggugucg

SEQ ID NO: 2965462 - RNA, 20 nt, Mycobacterium avium subsp. paratuberculosis
gugaccggcggugucggugc

SEQ ID NO: 2965463 - RNA, 13 nt, Mycobacterium avium subsp. paratuberculosis
gugaccggcucga

SEQ ID NO: 2965464 - RNA, 16 nt, Mycobacterium avium subsp. paratuberculosis
gugaccggcugcucgc

SEQ ID NO: 2965465 - RNA, 18 nt, Mycobacterium avium subsp. paratuberculosis
gugaccggcugcucgcgc

SEQ ID NO: 2965466 - RNA, 14 nt, Mycobacterium avium subsp. paratuberculosis
gugaccgggaagua

SEQ ID NO: 2965467 - RNA, 17 nt, Mycobacterium avium subsp. paratuberculosis
gugaccggggucggcgc

SEQ ID NO: 2965468 - RNA, 18 nt, Mycobacterium avium subsp. paratuberculosis
gugaccggggucggcgcc

SEQ ID NO: 2965469 - RNA, 19 nt, Mycobacterium avium subsp. paratuberculosis
gugaccggggucggcgccc

SEQ ID NO: 2965470 - RNA, 20 nt, Mycobacterium avium subsp. paratuberculosis
gugaccggggucggcgcccu

SEQ ID NO: 2965471 - RNA, 22 nt, Mycobacterium avium subsp. paratuberculosis
gugaccggggucggcgcccucg

SEQ ID NO: 2965472 - RNA, 19 nt, Mycobacterium avium subsp. paratuberculosis
gugaccucgaagauggucg

SEQ ID NO: 2965473 - RNA, 15 nt, Mycobacterium avium subsp. paratuberculosis
gugaccucgacggug

SEQ ID NO: 2965474 - RNA, 16 nt, Mycobacterium avium subsp. paratuberculosis
gugaccucgagcaccg

SEQ ID NO: 2965475 - RNA, 23 nt, Mycobacterium avium subsp. paratuberculosis
gugacggugugcgggucgguggu

SEQ ID NO: 2965476 - RNA, 18 nt, Mycobacterium avium subsp. paratuberculosis
gugacgucgccgauggcg

SEQ ID NO: 2965477 - RNA, 17 nt, Mycobacterium avium subsp. paratuberculosis
gugacgucgcgccgcuc

SEQ ID NO: 2965478 - RNA, 13 nt, Mycobacterium avium subsp. paratuberculosis
gugacgucguuga

SEQ ID NO: 2965479 - RNA, 18 nt, Mycobacterium avium subsp. paratuberculosis
gugacguggcggccgucg

SEQ ID NO: 2965480 - RNA, 17 nt, Mycobacterium avium subsp. paratuberculosis
gugacguugagcacccg

SEQ ID NO: 2965481 - RNA, 20 nt, Mycobacterium avium subsp. paratuberculosis
gugacguuguaggagaacgu

SEQ ID NO: 2965482 - RNA, 17 nt, Mycobacterium avium subsp. paratuberculosis
gugacuugucgggccgc

SEQ ID NO: 2965483 - RNA, 20 nt, Mycobacterium avium subsp. paratuberculosis
gugagaaaagcgaccagcgc

SEQ ID NO: 2965484 - RNA, 15 nt, Mycobacterium avium subsp. paratuberculosis
gugagauccagcagc

SEQ ID NO: 2965485 - RNA, 19 nt, Mycobacterium avium subsp. paratuberculosis
gugagcaacaccggcacga

SEQ ID NO: 2965486 - RNA, 21 nt, Mycobacterium avium subsp. paratuberculosis
gugagcaacaccggcacgauc

SEQ ID NO: 2965487 - RNA, 18 nt, Mycobacterium avium subsp. paratuberculosis
gugagcaacgccagcgcg

SEQ ID NO: 2965488 - RNA, 19 nt, Mycobacterium avium subsp. paratuberculosis
gugagcaccggaucgacca

SEQ ID NO: 2965489 - RNA, 14 nt, Mycobacterium avium subsp. paratuberculosis
gugagcaccgggaa

SEQ ID NO: 2965490 - RNA, 18 nt, Mycobacterium avium subsp. paratuberculosis
gugagcagggccagcggc

SEQ ID NO: 2965491 - RNA, 13 nt, Mycobacterium avium subsp. paratuberculosis
gugagccgccaca

SEQ ID NO: 2965492 - RNA, 17 nt, Mycobacterium avium subsp. paratuberculosis
gugagccgggugcccgc

SEQ ID NO: 2965493 - RNA, 19 nt, Mycobacterium avium subsp. paratuberculosis
gugagccgggugcccgcgu

SEQ ID NO: 2965494 - RNA, 16 nt, Mycobacterium avium subsp. paratuberculosis
gugagccucagggcgc

SEQ ID NO: 2965495 - RNA, 20 nt, Mycobacterium avium subsp. paratuberculosis
gugagccucagggcgcgcug

SEQ ID NO: 2965496 - RNA, 15 nt, Mycobacterium avium subsp. paratuberculosis
gugagcgccaccccg

SEQ ID NO: 2965497 - RNA, 16 nt, Mycobacterium avium subsp. paratuberculosis
gugagcgcgccggccc

SEQ ID NO: 2965498 - RNA, 18 nt, Mycobacterium avium subsp. paratuberculosis
gugagcgcgccggcccga

SEQ ID NO: 2965499 - RNA, 15 nt, Mycobacterium avium subsp. paratuberculosis
gugagcgcgucgagc

SEQ ID NO: 2965500 - RNA, 15 nt, Mycobacterium avium subsp. paratuberculosis
gugagcggccgcagc

SEQ ID NO: 2965501 - RNA, 12 nt, Mycobacterium avium subsp. paratuberculosis
gugagcggcgcg

SEQ ID NO: 2965502 - RNA, 15 nt, Mycobacterium avium subsp. paratuberculosis
gugagcggcgcgucc

SEQ ID NO: 2965503 - RNA, 12 nt, Mycobacterium avium subsp. paratuberculosis
gugagcgguggc

SEQ ID NO: 2965504 - RNA, 16 nt, Mycobacterium avium subsp. paratuberculosis
gugagcgugccgaucg

SEQ ID NO: 2965505 - RNA, 17 nt, Mycobacterium avium subsp. paratuberculosis
gugagcuaucagcucgc

SEQ ID NO: 2965506 - RNA, 17 nt, Mycobacterium avium subsp. paratuberculosis
gugagcugaucgcgucg

SEQ ID NO: 2965507 - RNA, 16 nt, Mycobacterium avium subsp. paratuberculosis
gugagcuggccgcgca

SEQ ID NO: 2965508 - RNA, 18 nt, Mycobacterium avium subsp. paratuberculosis
gugagcuggccgcgcagc

SEQ ID NO: 2965509 - RNA, 16 nt, Mycobacterium avium subsp. paratuberculosis
gugagcuuccugccaa

SEQ ID NO: 2965510 - RNA, 21 nt, Mycobacterium avium subsp. paratuberculosis
gugaggacaccacgaucagcg

SEQ ID NO: 2965511 - RNA, 19 nt, Mycobacterium avium subsp. paratuberculosis
gugaggacgcccggcgagu

SEQ ID NO: 2965512 - RNA, 14 nt, Mycobacterium avium subsp. paratuberculosis
gugaggcacccgcu

SEQ ID NO: 2965513 - RNA, 22 nt, Mycobacterium avium subsp. paratuberculosis
gugaggcacccgcugcaccagc

SEQ ID NO: 2965514 - RNA, 20 nt, Mycobacterium avium subsp. paratuberculosis
gugaggcaccgaacgccagc

SEQ ID NO: 2965515 - RNA, 22 nt, Mycobacterium avium subsp. paratuberculosis
gugaggcaccgaacgccagcag

SEQ ID NO: 2965516 - RNA, 11 nt, Mycobacterium avium subsp. paratuberculosis
gugaggccagc

SEQ ID NO: 2965517 - RNA, 21 nt, Mycobacterium avium subsp. paratuberculosis
gugaggccgaggcgagugagg

SEQ ID NO: 2965518 - RNA, 14 nt, Mycobacterium avium subsp. paratuberculosis
gugaggcgcgccgg

SEQ ID NO: 2965519 - RNA, 20 nt, Mycobacterium avium subsp. paratuberculosis
gugaggcguuggcccgcacc

SEQ ID NO: 2965520 - RNA, 22 nt, Mycobacterium avium subsp. paratuberculosis
gugagggaacgccgaucaccgg

SEQ ID NO: 2965521 - RNA, 17 nt, Mycobacterium avium subsp. paratuberculosis
gugaggggauccagcgg

SEQ ID NO: 2965522 - RNA, 20 nt, Mycobacterium avium subsp. paratuberculosis
gugaggggauccagcggcgg

SEQ ID NO: 2965523 - RNA, 17 nt, Mycobacterium avium subsp. paratuberculosis
gugaggguuuccacgug

SEQ ID NO: 2965524 - RNA, 14 nt, Mycobacterium avium subsp. paratuberculosis
gugaggucgcgcag

SEQ ID NO: 2965525 - RNA, 18 nt, Mycobacterium avium subsp. paratuberculosis
gugaguucaucgacgucg

SEQ ID NO: 2965526 - RNA, 17 nt, Mycobacterium avium subsp. paratuberculosis
gugauaccggcccagcg

SEQ ID NO: 2965527 - RNA, 16 nt, Mycobacterium avium subsp. paratuberculosis
gugauacgccgacgca

SEQ ID NO: 2965528 - RNA, 20 nt, Mycobacterium avium subsp. paratuberculosis
gugauagaucaucccggcca

SEQ ID NO: 2965529 - RNA, 16 nt, Mycobacterium avium subsp. paratuberculosis
gugauagcccaggccu

SEQ ID NO: 2965530 - RNA, 13 nt, Mycobacterium avium subsp. paratuberculosis
gugauagcggccg

SEQ ID NO: 2965531 - RNA, 14 nt, Mycobacterium avium subsp. paratuberculosis
gugauagcggccgc

SEQ ID NO: 2965532 - RNA, 15 nt, Mycobacterium avium subsp. paratuberculosis
gugauagcggccgcg

SEQ ID NO: 2965533 - RNA, 23 nt, Mycobacterium avium subsp. paratuberculosis
gugauagcggcguaccgcggcgg

SEQ ID NO: 2965534 - RNA, 19 nt, Mycobacterium avium subsp. paratuberculosis
gugauaguggucgucgucg

SEQ ID NO: 2965535 - RNA, 16 nt, Mycobacterium avium subsp. paratuberculosis
gugaucaaagccggug

SEQ ID NO: 2965536 - RNA, 21 nt, Mycobacterium avium subsp. paratuberculosis
gugaucaaagccgguggcagc

SEQ ID NO: 2965537 - RNA, 13 nt, Mycobacterium avium subsp. paratuberculosis
gugaucacccagc

SEQ ID NO: 2965538 - RNA, 17 nt, Mycobacterium avium subsp. paratuberculosis
gugaucacccgccgggu

SEQ ID NO: 2965539 - RNA, 23 nt, Mycobacterium avium subsp. paratuberculosis
gugaucacgauguugggccaugc

SEQ ID NO: 2965540 - RNA, 15 nt, Mycobacterium avium subsp. paratuberculosis
gugaucagcagcagg

SEQ ID NO: 2965541 - RNA, 13 nt, Mycobacterium avium subsp. paratuberculosis
gugaucagcaucc

SEQ ID NO: 2965542 - RNA, 15 nt, Mycobacterium avium subsp. paratuberculosis
gugauccacgcggug

SEQ ID NO: 2965543 - RNA, 18 nt, Mycobacterium avium subsp. paratuberculosis
gugauccacuccagcacc

SEQ ID NO: 2965544 - RNA, 19 nt, Mycobacterium avium subsp. paratuberculosis
gugauccagagcaucaggg

SEQ ID NO: 2965545 - RNA, 24 nt, Mycobacterium avium subsp. paratuberculosis
gugauccagcccugcucggccagc

SEQ ID NO: 2965546 - RNA, 20 nt, Mycobacterium avium subsp. paratuberculosis
gugaucccgaugccgcgcag

SEQ ID NO: 2965547 - RNA, 22 nt, Mycobacterium avium subsp. paratuberculosis
gugauccggaaugcggugcugc

SEQ ID NO: 2965548 - RNA, 17 nt, Mycobacterium avium subsp. paratuberculosis
gugauccggugccacgc

SEQ ID NO: 2965549 - RNA, 21 nt, Mycobacterium avium subsp. paratuberculosis
gugauccggugccacgcggcu

SEQ ID NO: 2965550 - RNA, 20 nt, Mycobacterium avium subsp. paratuberculosis
gugauccucgucuccggcgg

SEQ ID NO: 2965551 - RNA, 23 nt, Mycobacterium avium subsp. paratuberculosis
gugauccucgucuccggcggcag

SEQ ID NO: 2965552 - RNA, 19 nt, Mycobacterium avium subsp. paratuberculosis
gugaucgaaacgccgcgcu

SEQ ID NO: 2965553 - RNA, 14 nt, Mycobacterium avium subsp. paratuberculosis
gugaucgagcacca

SEQ ID NO: 2965554 - RNA, 15 nt, Mycobacterium avium subsp. paratuberculosis
gugaucgagcaccag

SEQ ID NO: 2965555 - RNA, 17 nt, Mycobacterium avium subsp. paratuberculosis
gugaucgagcaccagcg

SEQ ID NO: 2965556 - RNA, 21 nt, Mycobacterium avium subsp. paratuberculosis
gugaucgagcaccagcgucga

SEQ ID NO: 2965557 - RNA, 19 nt, Mycobacterium avium subsp. paratuberculosis
gugaucgccaccaccagcg

SEQ ID NO: 2965558 - RNA, 16 nt, Mycobacterium avium subsp. paratuberculosis
gugaucgccagcccgg

SEQ ID NO: 2965559 - RNA, 13 nt, Mycobacterium avium subsp. paratuberculosis
gugaucgccgccc

SEQ ID NO: 2965560 - RNA, 15 nt, Mycobacterium avium subsp. paratuberculosis
gugcaagcucgccag

SEQ ID NO: 2965561 - RNA, 22 nt, Mycobacterium avium subsp. paratuberculosis
gugcaagggcgacauguccggg

SEQ ID NO: 2965562 - RNA, 16 nt, Mycobacterium avium subsp. paratuberculosis
gugcacacccgcagcg

SEQ ID NO: 2965563 - RNA, 20 nt, Mycobacterium avium subsp. paratuberculosis
gugcacacccgcagcgaccg

SEQ ID NO: 2965564 - RNA, 15 nt, Mycobacterium avium subsp. paratuberculosis
gugcacaccggccuu

SEQ ID NO: 2965565 - RNA, 13 nt, Mycobacterium avium subsp. paratuberculosis
gugcacaggccgc

SEQ ID NO: 2965566 - RNA, 14 nt, Mycobacterium avium subsp. paratuberculosis
gugcacaggccgcc

SEQ ID NO: 2965567 - RNA, 17 nt, Mycobacterium avium subsp. paratuberculosis
gugcacaggccgccgca

SEQ ID NO: 2965568 - RNA, 14 nt, Mycobacterium avium subsp. paratuberculosis
gugcaccacccagg

SEQ ID NO: 2965569 - RNA, 20 nt, Mycobacterium avium subsp. paratuberculosis
gugcaccacccaggccaccc

SEQ ID NO: 2965570 - RNA, 21 nt, Mycobacterium avium subsp. paratuberculosis
gugcaccacccaggccacccg

SEQ ID NO: 2965571 - RNA, 12 nt, Mycobacterium avium subsp. paratuberculosis
gugcaccagcga

SEQ ID NO: 2965572 - RNA, 14 nt, Mycobacterium avium subsp. paratuberculosis
gugcaccagcgauc

SEQ ID NO: 2965573 - RNA, 18 nt, Mycobacterium avium subsp. paratuberculosis
gugcaccagcgauccggc

SEQ ID NO: 2965574 - RNA, 20 nt, Mycobacterium avium subsp. paratuberculosis
gugcaccagcgauccggcgc

SEQ ID NO: 2965575 - RNA, 19 nt, Mycobacterium avium subsp. paratuberculosis
gugcaccaggacgcgaccg

SEQ ID NO: 2965576 - RNA, 15 nt, Mycobacterium avium subsp. paratuberculosis
gugcaccagguagau

SEQ ID NO: 2965577 - RNA, 14 nt, Mycobacterium avium subsp. paratuberculosis
gugcacccacgcca

SEQ ID NO: 2965578 - RNA, 22 nt, Mycobacterium avium subsp. paratuberculosis
gugcacccgaugcucccggucg

SEQ ID NO: 2965579 - RNA, 13 nt, Mycobacterium avium subsp. paratuberculosis
gugcaccgccagc

SEQ ID NO: 2965580 - RNA, 15 nt, Mycobacterium avium subsp. paratuberculosis
gugcaccgccagcgc

SEQ ID NO: 2965581 - RNA, 16 nt, Mycobacterium avium subsp. paratuberculosis
gugcaccgccagcgcg

SEQ ID NO: 2965582 - RNA, 17 nt, Mycobacterium avium subsp. paratuberculosis
gugcaccgccagcgcgg

SEQ ID NO: 2965583 - RNA, 19 nt, Mycobacterium avium subsp. paratuberculosis
gugcaccgccagcgcggcg

SEQ ID NO: 2965584 - RNA, 18 nt, Mycobacterium avium subsp. paratuberculosis
gugcaccgcccgcgcgau

SEQ ID NO: 2965585 - RNA, 19 nt, Mycobacterium avium subsp. paratuberculosis
gugcaccgcgcgcaccacg

SEQ ID NO: 2965586 - RNA, 17 nt, Mycobacterium avium subsp. paratuberculosis
gugcaccgcggccaacc

SEQ ID NO: 2965587 - RNA, 19 nt, Mycobacterium avium subsp. paratuberculosis
gugcaccgcggccaacccg

SEQ ID NO: 2965588 - RNA, 13 nt, Mycobacterium avium subsp. paratuberculosis
gugcaccgcggcg

SEQ ID NO: 2965589 - RNA, 14 nt, Mycobacterium avium subsp. paratuberculosis
gugcaccgcggcgc

SEQ ID NO: 2965590 - RNA, 15 nt, Mycobacterium avium subsp. paratuberculosis
gugcaccgcggcgcg

SEQ ID NO: 2965591 - RNA, 16 nt, Mycobacterium avium subsp. paratuberculosis
gugcaccggcacgucg

SEQ ID NO: 2965592 - RNA, 15 nt, Mycobacterium avium subsp. paratuberculosis
gugcaccguggugac

SEQ ID NO: 2965593 - RNA, 16 nt, Mycobacterium avium subsp. paratuberculosis
gugcaccugcagccgg

SEQ ID NO: 2965594 - RNA, 19 nt, Mycobacterium avium subsp. paratuberculosis
gugcaccugugaggcaccg

SEQ ID NO: 2965595 - RNA, 16 nt, Mycobacterium avium subsp. paratuberculosis
gugcacgaacagggug

SEQ ID NO: 2965596 - RNA, 15 nt, Mycobacterium avium subsp. paratuberculosis
gugcacgaacgcggc

SEQ ID NO: 2965597 - RNA, 22 nt, Mycobacterium avium subsp. paratuberculosis
gugcacgaacgcggccagcggg

SEQ ID NO: 2965598 - RNA, 23 nt, Mycobacterium avium subsp. paratuberculosis
gugcacgaacgcggccagcgggc

SEQ ID NO: 2965599 - RNA, 20 nt, Mycobacterium avium subsp. paratuberculosis
gugcacgagcgucgugcggg

SEQ ID NO: 2965600 - RNA, 17 nt, Mycobacterium avium subsp. paratuberculosis
gugcacgaucgcgguga

SEQ ID NO: 2965601 - RNA, 18 nt, Mycobacterium avium subsp. paratuberculosis
gugcacgaucgcggugac

SEQ ID NO: 2965602 - RNA, 22 nt, Mycobacterium avium subsp. paratuberculosis
gugcacgaucgcggugacgcgc

SEQ ID NO: 2965603 - RNA, 21 nt, Mycobacterium avium subsp. paratuberculosis
gugcacgauggacagguagcg

SEQ ID NO: 2965604 - RNA, 15 nt, Mycobacterium avium subsp. paratuberculosis
gugcacgccgagcag

SEQ ID NO: 2965605 - RNA, 20 nt, Mycobacterium avium subsp. paratuberculosis
gugcacgccgagcagcaccg

SEQ ID NO: 2965606 - RNA, 22 nt, Mycobacterium avium subsp. paratuberculosis
gugcacgccgagcagcaccggc

SEQ ID NO: 2965607 - RNA, 23 nt, Mycobacterium avium subsp. paratuberculosis
gugcacgccgagcagcaccggca

SEQ ID NO: 2965608 - RNA, 21 nt, Mycobacterium avium subsp. paratuberculosis
gugcacgccgaggcgugccgc

SEQ ID NO: 2965609 - RNA, 13 nt, Mycobacterium avium subsp. paratuberculosis
gugcacgccgucg

SEQ ID NO: 2965610 - RNA, 18 nt, Mycobacterium avium subsp. paratuberculosis
gugcacgccgucgugcuc

SEQ ID NO: 2965611 - RNA, 23 nt, Mycobacterium avium subsp. paratuberculosis
gugcacgccgucgugcucggcga

SEQ ID NO: 2965612 - RNA, 19 nt, Mycobacterium avium subsp. paratuberculosis
gugcacgccguggcggcgg

SEQ ID NO: 2965613 - RNA, 15 nt, Mycobacterium avium subsp. paratuberculosis
gugcacgcguucgga

SEQ ID NO: 2965614 - RNA, 23 nt, Mycobacterium avium subsp. paratuberculosis
gugcacgcguucggacaccucgg

SEQ ID NO: 2965615 - RNA, 14 nt, Mycobacterium avium subsp. paratuberculosis
gugcacgcucggcg

SEQ ID NO: 2965616 - RNA, 15 nt, Mycobacterium avium subsp. paratuberculosis
gugcacgcucggcgc

SEQ ID NO: 2965617 - RNA, 16 nt, Mycobacterium avium subsp. paratuberculosis
gugcacgcucggcgcg

SEQ ID NO: 2965618 - RNA, 16 nt, Mycobacterium avium subsp. paratuberculosis
gugcacggacagcuca

SEQ ID NO: 2965619 - RNA, 19 nt, Mycobacterium avium subsp. paratuberculosis
gugcacggacagcucaccg

SEQ ID NO: 2965620 - RNA, 13 nt, Mycobacterium avium subsp. paratuberculosis
gugcacggcgccg

SEQ ID NO: 2965621 - RNA, 14 nt, Mycobacterium avium subsp. paratuberculosis
gugcacggcgccgu

SEQ ID NO: 2965622 - RNA, 19 nt, Mycobacterium avium subsp. paratuberculosis
gugcacggcgccgugccgc

SEQ ID NO: 2965623 - RNA, 23 nt, Mycobacterium avium subsp. paratuberculosis
gugcacggcgccgugccgcgcgg

SEQ ID NO: 2965624 - RNA, 19 nt, Mycobacterium avium subsp. paratuberculosis
gugcacucggcgaugcgcc

SEQ ID NO: 2965625 - RNA, 15 nt, Mycobacterium avium subsp. paratuberculosis
gugcagaacagcacg

SEQ ID NO: 2965626 - RNA, 16 nt, Mycobacterium avium subsp. paratuberculosis
gugcagaacagcacga

SEQ ID NO: 2965627 - RNA, 20 nt, Mycobacterium avium subsp. paratuberculosis
gugcagacaaccggugugcc

SEQ ID NO: 2965628 - RNA, 15 nt, Mycobacterium avium subsp. paratuberculosis
gugcagaccccggcg

SEQ ID NO: 2965629 - RNA, 18 nt, Mycobacterium avium subsp. paratuberculosis
gugcagaccccggcgucc

SEQ ID NO: 2965630 - RNA, 12 nt, Mycobacterium avium subsp. paratuberculosis
gugcagaccgga

SEQ ID NO: 2965631 - RNA, 16 nt, Mycobacterium avium subsp. paratuberculosis
gugcagaccggacagc

SEQ ID NO: 2965632 - RNA, 15 nt, Mycobacterium avium subsp. paratuberculosis
gugcagacgugacgu

SEQ ID NO: 2965633 - RNA, 17 nt, Mycobacterium avium subsp. paratuberculosis
gugcagaucguccaucg

SEQ ID NO: 2965634 - RNA, 21 nt, Mycobacterium avium subsp. paratuberculosis
gugcagcaccacgaacgcugc

SEQ ID NO: 2965635 - RNA, 14 nt, Mycobacterium avium subsp. paratuberculosis
gugcagcaccgcca

SEQ ID NO: 2965636 - RNA, 16 nt, Mycobacterium avium subsp. paratuberculosis
gugcagcaccucgaag

SEQ ID NO: 2965637 - RNA, 15 nt, Mycobacterium avium subsp. paratuberculosis
gugcagcacgccgcg

SEQ ID NO: 2965638 - RNA, 17 nt, Mycobacterium avium subsp. paratuberculosis
gugcagcacgccgcgga

SEQ ID NO: 2965639 - RNA, 14 nt, Mycobacterium avium subsp. paratuberculosis
gugcagcacgggga

SEQ ID NO: 2965640 - RNA, 14 nt, Mycobacterium avium subsp. paratuberculosis
gugcagcagcagcc

SEQ ID NO: 2965641 - RNA, 14 nt, Mycobacterium avium subsp. paratuberculosis
gugcagcagcgccg

SEQ ID NO: 2965642 - RNA, 15 nt, Mycobacterium avium subsp. paratuberculosis
gugcagcagcgccgc

SEQ ID NO: 2965643 - RNA, 16 nt, Mycobacterium avium subsp. paratuberculosis
gugcagcagcgccgcg

SEQ ID NO: 2965644 - RNA, 14 nt, Mycobacterium avium subsp. paratuberculosis
gugcagcagcucgg

SEQ ID NO: 2965645 - RNA, 12 nt, Mycobacterium avium subsp. paratuberculosis
gugcccagcccg

SEQ ID NO: 2965646 - RNA, 13 nt, Mycobacterium avium subsp. paratuberculosis
gugcccagcgcga

SEQ ID NO: 2965647 - RNA, 14 nt, Mycobacterium avium subsp. paratuberculosis
gugccccacaagcg

SEQ ID NO: 2965648 - RNA, 18 nt, Mycobacterium avium subsp. paratuberculosis
gugccccacgccaugugc

SEQ ID NO: 2965649 - RNA, 23 nt, Mycobacterium avium subsp. paratuberculosis
gugccccgcaccgccaggcuggc

SEQ ID NO: 2965650 - RNA, 13 nt, Mycobacterium avium subsp. paratuberculosis
gugccccgcgacc

SEQ ID NO: 2965651 - RNA, 21 nt, Mycobacterium avium subsp. paratuberculosis
gugccccgcuggaucccggug

SEQ ID NO: 2965652 - RNA, 16 nt, Mycobacterium avium subsp. paratuberculosis
gugccccguccggcgc

SEQ ID NO: 2965653 - RNA, 23 nt, Mycobacterium avium subsp. paratuberculosis
gugccccguccggcgccagcccg

SEQ ID NO: 2965654 - RNA, 15 nt, Mycobacterium avium subsp. paratuberculosis
gugccccucgacccg

SEQ ID NO: 2965655 - RNA, 18 nt, Mycobacterium avium subsp. paratuberculosis
gugcccgaacgcgcgucg

SEQ ID NO: 2965656 - RNA, 13 nt, Mycobacterium avium subsp. paratuberculosis
gugcccgacggcg

SEQ ID NO: 2965657 - RNA, 15 nt, Mycobacterium avium subsp. paratuberculosis
gugcccgacggcgcg

SEQ ID NO: 2965658 - RNA, 16 nt, Mycobacterium avium subsp. paratuberculosis
gugcccgacggcgcgc

SEQ ID NO: 2965659 - RNA, 18 nt, Mycobacterium avium subsp. paratuberculosis
gugcccgacggcgcgccc

SEQ ID NO: 2965660 - RNA, 20 nt, Mycobacterium avium subsp. paratuberculosis
gugcccgacggcgcgcccga

SEQ ID NO: 2965661 - RNA, 22 nt, Mycobacterium avium subsp. paratuberculosis
gugcccgacggcgcgcccgacg

SEQ ID NO: 2965662 - RNA, 12 nt, Mycobacterium avium subsp. paratuberculosis
gugcccgagcac

SEQ ID NO: 2965663 - RNA, 12 nt, Mycobacterium avium subsp. paratuberculosis
gugcccgagccg

SEQ ID NO: 2965664 - RNA, 18 nt, Mycobacterium avium subsp. paratuberculosis
gugcccgagcugaucgcg

SEQ ID NO: 2965665 - RNA, 21 nt, Mycobacterium avium subsp. paratuberculosis
gugcccgagcugaucgcggcc

SEQ ID NO: 2965666 - RNA, 23 nt, Mycobacterium avium subsp. paratuberculosis
gugcccgagcugaucgcggccgg

SEQ ID NO: 2965667 - RNA, 24 nt, Mycobacterium avium subsp. paratuberculosis
gugcccgcccagcugcacccaccg

SEQ ID NO: 2965668 - RNA, 15 nt, Mycobacterium avium subsp. paratuberculosis
gugcccgccgcgacc

SEQ ID NO: 2965669 - RNA, 16 nt, Mycobacterium avium subsp. paratuberculosis
gugcccgccgcgaccg

SEQ ID NO: 2965670 - RNA, 18 nt, Mycobacterium avium subsp. paratuberculosis
gugcccgccgugcgcccc

SEQ ID NO: 2965671 - RNA, 14 nt, Mycobacterium avium subsp. paratuberculosis
gugcccgcgcccac

SEQ ID NO: 2965672 - RNA, 14 nt, Mycobacterium avium subsp. paratuberculosis
gugcccgcgggaca

SEQ ID NO: 2965673 - RNA, 14 nt, Mycobacterium avium subsp. paratuberculosis
gugcccgcgggcca

SEQ ID NO: 2965674 - RNA, 20 nt, Mycobacterium avium subsp. paratuberculosis
gugcccgcggucaugcgcgg

SEQ ID NO: 2965675 - RNA, 18 nt, Mycobacterium avium subsp. paratuberculosis
gugcccgcguacagcggg

SEQ ID NO: 2965676 - RNA, 21 nt, Mycobacterium avium subsp. paratuberculosis
gugcccgcguacagcgggucg

SEQ ID NO: 2965677 - RNA, 12 nt, Mycobacterium avium subsp. paratuberculosis
gugcccggccaa

SEQ ID NO: 2965678 - RNA, 16 nt, Mycobacterium avium subsp. paratuberculosis
gugcccggcccaggca

SEQ ID NO: 2965679 - RNA, 11 nt, Mycobacterium avium subsp. paratuberculosis
gugcccggcga

SEQ ID NO: 2965680 - RNA, 12 nt, Mycobacterium avium subsp. paratuberculosis
gugcccggcgag

SEQ ID NO: 2965681 - RNA, 19 nt, Mycobacterium avium subsp. paratuberculosis
gugcccggcgccggacggc

SEQ ID NO: 2965682 - RNA, 13 nt, Mycobacterium avium subsp. paratuberculosis
gugcccggcguug

SEQ ID NO: 2965683 - RNA, 17 nt, Mycobacterium avium subsp. paratuberculosis
gugcccggcugggcgcg

SEQ ID NO: 2965684 - RNA, 22 nt, Mycobacterium avium subsp. paratuberculosis
gugcccgggguccaccggccga

SEQ ID NO: 2965685 - RNA, 13 nt, Mycobacterium avium subsp. paratuberculosis
gugcccgucggcc

SEQ ID NO: 2965686 - RNA, 18 nt, Mycobacterium avium subsp. paratuberculosis
gugcccguugcccgauca

SEQ ID NO: 2965687 - RNA, 22 nt, Mycobacterium avium subsp. paratuberculosis
gugcccguugcccgaucagccg

SEQ ID NO: 2965688 - RNA, 16 nt, Mycobacterium avium subsp. paratuberculosis
gugcccucaauagcgg

SEQ ID NO: 2965689 - RNA, 15 nt, Mycobacterium avium subsp. paratuberculosis
gugcccuccucgccg

SEQ ID NO: 2965690 - RNA, 14 nt, Mycobacterium avium subsp. paratuberculosis
gugcccucguggug

SEQ ID NO: 2965691 - RNA, 18 nt, Mycobacterium avium subsp. paratuberculosis
gugcccuuccccggcggc

SEQ ID NO: 2965692 - RNA, 22 nt, Mycobacterium avium subsp. paratuberculosis
gugcccuuccccggcggccggc

SEQ ID NO: 2965693 - RNA, 15 nt, Mycobacterium avium subsp. paratuberculosis
gugcccuucgaguug

SEQ ID NO: 2965694 - RNA, 21 nt, Mycobacterium avium subsp. paratuberculosis
gugcccuucgaguugccguug

SEQ ID NO: 2965695 - RNA, 22 nt, Mycobacterium avium subsp. paratuberculosis
gugccgaacacguacagcggcg

SEQ ID NO: 2965696 - RNA, 23 nt, Mycobacterium avium subsp. paratuberculosis
gugccgaacacguacagcggcgg

SEQ ID NO: 2965697 - RNA, 20 nt, Mycobacterium avium subsp. paratuberculosis
gugccgaacagcgacgucug

SEQ ID NO: 2965698 - RNA, 21 nt, Mycobacterium avium subsp. paratuberculosis
gugccgaaccggaucuggccc

SEQ ID NO: 2965699 - RNA, 13 nt, Mycobacterium avium subsp. paratuberculosis
gugccgaacggcg

SEQ ID NO: 2965700 - RNA, 14 nt, Mycobacterium avium subsp. paratuberculosis
gugccgaacggcgc

SEQ ID NO: 2965701 - RNA, 12 nt, Mycobacterium avium subsp. paratuberculosis
gugccgaacgug

SEQ ID NO: 2965702 - RNA, 13 nt, Mycobacterium avium subsp. paratuberculosis
gugccgaagcgcc

SEQ ID NO: 2965703 - RNA, 19 nt, Mycobacterium avium subsp. paratuberculosis
gugccgaagcgccacgggg

SEQ ID NO: 2965704 - RNA, 15 nt, Mycobacterium avium subsp. paratuberculosis
gugccgaagcgccgc

SEQ ID NO: 2965705 - RNA, 16 nt, Mycobacterium avium subsp. paratuberculosis
gugccgaagcgccgca

SEQ ID NO: 2965706 - RNA, 21 nt, Mycobacterium avium subsp. paratuberculosis
gugccgaagcgccgcaugccc

SEQ ID NO: 2965707 - RNA, 15 nt, Mycobacterium avium subsp. paratuberculosis
gugccgaagggcaac

SEQ ID NO: 2965708 - RNA, 21 nt, Mycobacterium avium subsp. paratuberculosis
gugccgaagggcaaccgcagc

SEQ ID NO: 2965709 - RNA, 15 nt, Mycobacterium avium subsp. paratuberculosis
gugccgaccagccga

SEQ ID NO: 2965710 - RNA, 21 nt, Mycobacterium avium subsp. paratuberculosis
gugccgaccgcgugucggcac

SEQ ID NO: 2965711 - RNA, 17 nt, Mycobacterium avium subsp. paratuberculosis
gugccgaccugggcggc

SEQ ID NO: 2965712 - RNA, 13 nt, Mycobacterium avium subsp. paratuberculosis
gugccgacgaccu

SEQ ID NO: 2965713 - RNA, 19 nt, Mycobacterium avium subsp. paratuberculosis
gugccgacgaccucgucgu

SEQ ID NO: 2965714 - RNA, 16 nt, Mycobacterium avium subsp. paratuberculosis
gugccgacgagcucgc

SEQ ID NO: 2965715 - RNA, 18 nt, Mycobacterium avium subsp. paratuberculosis
gugccgacgagcucgccg

SEQ ID NO: 2965716 - RNA, 20 nt, Mycobacterium avium subsp. paratuberculosis
gugccgacgagcucgccgcu

SEQ ID NO: 2965717 - RNA, 18 nt, Mycobacterium avium subsp. paratuberculosis
gugccgacggugcgugcc

SEQ ID NO: 2965718 - RNA, 21 nt, Mycobacterium avium subsp. paratuberculosis
gugccgacggugcgugccagc

SEQ ID NO: 2965719 - RNA, 12 nt, Mycobacterium avium subsp. paratuberculosis
gugccgagcacg

SEQ ID NO: 2965720 - RNA, 14 nt, Mycobacterium avium subsp. paratuberculosis
gugccgagcacgcg

SEQ ID NO: 2965721 - RNA, 20 nt, Mycobacterium avium subsp. paratuberculosis
gugccgagcacgcggccgcg

SEQ ID NO: 2965722 - RNA, 21 nt, Mycobacterium avium subsp. paratuberculosis
gugccgagcacgcggccgcgc

SEQ ID NO: 2965723 - RNA, 22 nt, Mycobacterium avium subsp. paratuberculosis
gugccgagcacgcggccgcgcc

SEQ ID NO: 2965724 - RNA, 15 nt, Mycobacterium avium subsp. paratuberculosis
gugccgagcccgccg

SEQ ID NO: 2965725 - RNA, 16 nt, Mycobacterium avium subsp. paratuberculosis
gugccgagcccgccgg

SEQ ID NO: 2965726 - RNA, 21 nt, Mycobacterium avium subsp. paratuberculosis
gugccgagcccgccggcggcg

SEQ ID NO: 2965727 - RNA, 20 nt, Mycobacterium avium subsp. paratuberculosis
gugccgaguucgaccucggu

SEQ ID NO: 2965728 - RNA, 18 nt, Mycobacterium avium subsp. paratuberculosis
gugccgaucaccucgccg

SEQ ID NO: 2965729 - RNA, 20 nt, Mycobacterium avium subsp. paratuberculosis
gugccgaucaccucgccggc

SEQ ID NO: 2965730 - RNA, 19 nt, Mycobacterium avium subsp. paratuberculosis
gugccgggccagcugcucg

SEQ ID NO: 2965731 - RNA, 18 nt, Mycobacterium avium subsp. paratuberculosis
gugccgggucgcagcggc

SEQ ID NO: 2965732 - RNA, 15 nt, Mycobacterium avium subsp. paratuberculosis
gugccgguccagccg

SEQ ID NO: 2965733 - RNA, 21 nt, Mycobacterium avium subsp. paratuberculosis
gugccggugaugaacgcgccg

SEQ ID NO: 2965734 - RNA, 18 nt, Mycobacterium avium subsp. paratuberculosis
gugccggugcagcaccuc

SEQ ID NO: 2965735 - RNA, 23 nt, Mycobacterium avium subsp. paratuberculosis
gugccggugcagcaccucgaucu

SEQ ID NO: 2965736 - RNA, 20 nt, Mycobacterium avium subsp. paratuberculosis
gugccgguguugccgacggc

SEQ ID NO: 2965737 - RNA, 22 nt, Mycobacterium avium subsp. paratuberculosis
gugccgguguugccgacggcgc

SEQ ID NO: 2965738 - RNA, 19 nt, Mycobacterium avium subsp. paratuberculosis
gugccguccagcuccgccg

SEQ ID NO: 2965739 - RNA, 22 nt, Mycobacterium avium subsp. paratuberculosis
gugccguccagcuccgccgaca

SEQ ID NO: 2965740 - RNA, 15 nt, Mycobacterium avium subsp. paratuberculosis
gugccguccgggucg

SEQ ID NO: 2965741 - RNA, 22 nt, Mycobacterium avium subsp. paratuberculosis
gugccguccucggccgccaccg

SEQ ID NO: 2965742 - RNA, 19 nt, Mycobacterium avium subsp. paratuberculosis
gugccgucgaucgcccgcu

SEQ ID NO: 2965743 - RNA, 14 nt, Mycobacterium avium subsp. paratuberculosis
gugccgucgcgcuc

SEQ ID NO: 2965744 - RNA, 20 nt, Mycobacterium avium subsp. paratuberculosis
gugccgucgcgcucgacgau

SEQ ID NO: 2965745 - RNA, 18 nt, Mycobacterium avium subsp. paratuberculosis
gugccgucgcgggcgucg

SEQ ID NO: 2965746 - RNA, 20 nt, Mycobacterium avium subsp. paratuberculosis
gugccgucgcgggcgucggg

SEQ ID NO: 2965747 - RNA, 13 nt, Mycobacterium avium subsp. paratuberculosis
gugccgucggcgu

SEQ ID NO: 2965748 - RNA, 16 nt, Mycobacterium avium subsp. paratuberculosis
gugccguggucggugc

SEQ ID NO: 2965749 - RNA, 17 nt, Mycobacterium avium subsp. paratuberculosis
gugccguggucggugcc

SEQ ID NO: 2965750 - RNA, 16 nt, Mycobacterium avium subsp. paratuberculosis
gugccguugagcgugg

SEQ ID NO: 2965751 - RNA, 16 nt, Mycobacterium avium subsp. paratuberculosis
gugccguugaucaggg

SEQ ID NO: 2965752 - RNA, 19 nt, Mycobacterium avium subsp. paratuberculosis
gugccguugaucagggcgg

SEQ ID NO: 2965753 - RNA, 12 nt, Mycobacterium avium subsp. paratuberculosis
gugccucgccac

SEQ ID NO: 2965754 - RNA, 17 nt, Mycobacterium avium subsp. paratuberculosis
gugccucuucgucggcc

SEQ ID NO: 2965755 - RNA, 20 nt, Mycobacterium avium subsp. paratuberculosis
gugccucuucgucggccggc

SEQ ID NO: 2965756 - RNA, 23 nt, Mycobacterium avium subsp. paratuberculosis
gugccucuucgucggccggcagu

SEQ ID NO: 2965757 - RNA, 12 nt, Mycobacterium avium subsp. paratuberculosis
gugccugcgggc

SEQ ID NO: 2965758 - RNA, 17 nt, Mycobacterium avium subsp. paratuberculosis
gugccugcgggcccagc

SEQ ID NO: 2965759 - RNA, 20 nt, Mycobacterium avium subsp. paratuberculosis
gugccugcgggcccagcucg

SEQ ID NO: 2965760 - RNA, 21 nt, Mycobacterium avium subsp. paratuberculosis
gugccugcgggcccagcucgg

SEQ ID NO: 2965761 - RNA, 17 nt, Mycobacterium avium subsp. paratuberculosis
gugccuggcuccccggc

SEQ ID NO: 2965762 - RNA, 16 nt, Mycobacterium avium subsp. paratuberculosis
gugccuugcacccagc

SEQ ID NO: 2965763 - RNA, 20 nt, Mycobacterium avium subsp. paratuberculosis
gugccuugcacccagcggaa

SEQ ID NO: 2965764 - RNA, 22 nt, Mycobacterium avium subsp. paratuberculosis
gugcgaaaauggcugcccggca

SEQ ID NO: 2965765 - RNA, 19 nt, Mycobacterium avium subsp. paratuberculosis
gugcgaaucaucguggcgc

SEQ ID NO: 2965766 - RNA, 14 nt, Mycobacterium avium subsp. paratuberculosis
gugcgacaccggcg

SEQ ID NO: 2965767 - RNA, 16 nt, Mycobacterium avium subsp. paratuberculosis
gugcgacaccggcgug

SEQ ID NO: 2965768 - RNA, 17 nt, Mycobacterium avium subsp. paratuberculosis
gugcgacgccgcgcagc

SEQ ID NO: 2965769 - RNA, 20 nt, Mycobacterium avium subsp. paratuberculosis
gugcgacgccgcgcagcggg

SEQ ID NO: 2965770 - RNA, 21 nt, Mycobacterium avium subsp. paratuberculosis
gugcgacggcaauccggcccc

SEQ ID NO: 2965771 - RNA, 20 nt, Mycobacterium avium subsp. paratuberculosis
gugcgacuugguggccagca

SEQ ID NO: 2965772 - RNA, 22 nt, Mycobacterium avium subsp. paratuberculosis
gugcgacuugguggccagcacc

SEQ ID NO: 2965773 - RNA, 23 nt, Mycobacterium avium subsp. paratuberculosis
gugcgacuugguggccagcacca

SEQ ID NO: 2965774 - RNA, 18 nt, Mycobacterium avium subsp. paratuberculosis
gugcgagccaccucgauc

SEQ ID NO: 2965775 - RNA, 15 nt, Mycobacterium avium subsp. paratuberculosis
gugcgagccgagcac

SEQ ID NO: 2965776 - RNA, 21 nt, Mycobacterium avium subsp. paratuberculosis
gugcgagccgagcacgcagcc

SEQ ID NO: 2965777 - RNA, 14 nt, Mycobacterium avium subsp. paratuberculosis
gugcgagccgcuga

SEQ ID NO: 2965778 - RNA, 21 nt, Mycobacterium avium subsp. paratuberculosis
gugcgaugguggucgccgucg

SEQ ID NO: 2965779 - RNA, 22 nt, Mycobacterium avium subsp. paratuberculosis
gugcgaugguggucgccgucgu

SEQ ID NO: 2965780 - RNA, 15 nt, Mycobacterium avium subsp. paratuberculosis
gugcgaugucggugc

SEQ ID NO: 2965781 - RNA, 17 nt, Mycobacterium avium subsp. paratuberculosis
gugcgcaaguagcgcuc

SEQ ID NO: 2965782 - RNA, 17 nt, Mycobacterium avium subsp. paratuberculosis
gugcgcaauggcgaaca

SEQ ID NO: 2965783 - RNA, 13 nt, Mycobacterium avium subsp. paratuberculosis
gugcgcaccccgu

SEQ ID NO: 2965784 - RNA, 23 nt, Mycobacterium avium subsp. paratuberculosis
gugcgcaccccguugccgccggc

SEQ ID NO: 2965785 - RNA, 16 nt, Mycobacterium avium subsp. paratuberculosis
gugcgcacgaacggcg

SEQ ID NO: 2965786 - RNA, 18 nt, Mycobacterium avium subsp. paratuberculosis
gugcgcacgaacggcgcg

SEQ ID NO: 2965787 - RNA, 12 nt, Mycobacterium avium subsp. paratuberculosis
gugcgcacgauc

SEQ ID NO: 2965788 - RNA, 22 nt, Mycobacterium avium subsp. paratuberculosis
gugcgcacgaucugcaggccga

SEQ ID NO: 2965789 - RNA, 12 nt, Mycobacterium avium subsp. paratuberculosis
gugcgcagcacg

SEQ ID NO: 2965790 - RNA, 13 nt, Mycobacterium avium subsp. paratuberculosis
gugcgcagcccgc

SEQ ID NO: 2965791 - RNA, 16 nt, Mycobacterium avium subsp. paratuberculosis
gugcgcagcccgccgg

SEQ ID NO: 2965792 - RNA, 16 nt, Mycobacterium avium subsp. paratuberculosis
gugcgcagccgcugca

SEQ ID NO: 2965793 - RNA, 19 nt, Mycobacterium avium subsp. paratuberculosis
gugcgcagccgcugcagcg

SEQ ID NO: 2965794 - RNA, 15 nt, Mycobacterium avium subsp. paratuberculosis
gugcgcagcgcgucg

SEQ ID NO: 2965795 - RNA, 20 nt, Mycobacterium avium subsp. paratuberculosis
gugcgcagcgcgucgucggu

SEQ ID NO: 2965796 - RNA, 12 nt, Mycobacterium avium subsp. paratuberculosis
gugcgcaggcgg

SEQ ID NO: 2965797 - RNA, 16 nt, Mycobacterium avium subsp. paratuberculosis
gugcgcaggcggcgcg

SEQ ID NO: 2965798 - RNA, 17 nt, Mycobacterium avium subsp. paratuberculosis
gugcgcaggcggcgcgc

SEQ ID NO: 2965799 - RNA, 21 nt, Mycobacterium avium subsp. paratuberculosis
gugcgcaggcggcgcgcagcc

SEQ ID NO: 2965800 - RNA, 17 nt, Mycobacterium avium subsp. paratuberculosis
gugcgcaguucgggauc

SEQ ID NO: 2965801 - RNA, 13 nt, Mycobacterium avium subsp. paratuberculosis
gugcgcaucggcg

SEQ ID NO: 2965802 - RNA, 20 nt, Mycobacterium avium subsp. paratuberculosis
gugcgcaucggcgacgccgc

SEQ ID NO: 2965803 - RNA, 13 nt, Mycobacterium avium subsp. paratuberculosis
gugcgcauggcgu

SEQ ID NO: 2965804 - RNA, 17 nt, Mycobacterium avium subsp. paratuberculosis
gugcgcauucggcgacg

SEQ ID NO: 2965805 - RNA, 19 nt, Mycobacterium avium subsp. paratuberculosis
gugcgcauucggcgacgcu

SEQ ID NO: 2965806 - RNA, 21 nt, Mycobacterium avium subsp. paratuberculosis
gugcgccacgcccgcagcgca

SEQ ID NO: 2965807 - RNA, 15 nt, Mycobacterium avium subsp. paratuberculosis
gugcgccacugcggg

SEQ ID NO: 2965808 - RNA, 19 nt, Mycobacterium avium subsp. paratuberculosis
gugcgccagaucagcgugg

SEQ ID NO: 2965809 - RNA, 15 nt, Mycobacterium avium subsp. paratuberculosis
gugcgccagcgacgg

SEQ ID NO: 2965810 - RNA, 13 nt, Mycobacterium avium subsp. paratuberculosis
gugcgccagcgcc

SEQ ID NO: 2965811 - RNA, 17 nt, Mycobacterium avium subsp. paratuberculosis
gugcgccagcgugaaca

SEQ ID NO: 2965812 - RNA, 12 nt, Mycobacterium avium subsp. paratuberculosis
gugcgccaggca

SEQ ID NO: 2965813 - RNA, 14 nt, Mycobacterium avium subsp. paratuberculosis
gugcgccaggcagg

SEQ ID NO: 2965814 - RNA, 13 nt, Mycobacterium avium subsp. paratuberculosis
gugcggccgcgau

SEQ ID NO: 2965815 - RNA, 15 nt, Mycobacterium avium subsp. paratuberculosis
gugcggccgcgcagc

SEQ ID NO: 2965816 - RNA, 19 nt, Mycobacterium avium subsp. paratuberculosis
gugcggccgcgcagcucga

SEQ ID NO: 2965817 - RNA, 19 nt, Mycobacterium avium subsp. paratuberculosis
gugcggccggcgccggcgg

SEQ ID NO: 2965818 - RNA, 21 nt, Mycobacterium avium subsp. paratuberculosis
gugcggccucggcaccgugcc

SEQ ID NO: 2965819 - RNA, 12 nt, Mycobacterium avium subsp. paratuberculosis
gugcggcgcccu

SEQ ID NO: 2965820 - RNA, 13 nt, Mycobacterium avium subsp. paratuberculosis
gugcggcgccgcc

SEQ ID NO: 2965821 - RNA, 16 nt, Mycobacterium avium subsp. paratuberculosis
gugcggcgcggucgca

SEQ ID NO: 2965822 - RNA, 16 nt, Mycobacterium avium subsp. paratuberculosis
gugcggcgcugccggc

SEQ ID NO: 2965823 - RNA, 19 nt, Mycobacterium avium subsp. paratuberculosis
gugcggcggcggugccugg

SEQ ID NO: 2965824 - RNA, 17 nt, Mycobacterium avium subsp. paratuberculosis
gugcggcggcucguuga

SEQ ID NO: 2965825 - RNA, 16 nt, Mycobacterium avium subsp. paratuberculosis
gugcggcggugacgau

SEQ ID NO: 2965826 - RNA, 14 nt, Mycobacterium avium subsp. paratuberculosis
gugcggcgugcggu

SEQ ID NO: 2965827 - RNA, 14 nt, Mycobacterium avium subsp. paratuberculosis
gugcggcucgggcg

SEQ ID NO: 2965828 - RNA, 21 nt, Mycobacterium avium subsp. paratuberculosis
gugcggcucgggcgguggcgc

SEQ ID NO: 2965829 - RNA, 13 nt, Mycobacterium avium subsp. paratuberculosis
gugcgggccagca

SEQ ID NO: 2965830 - RNA, 14 nt, Mycobacterium avium subsp. paratuberculosis
gugcgggccagcag

SEQ ID NO: 2965831 - RNA, 16 nt, Mycobacterium avium subsp. paratuberculosis
gugcgggccagcagcc

SEQ ID NO: 2965832 - RNA, 16 nt, Mycobacterium avium subsp. paratuberculosis
gugcgggcguccuuga

SEQ ID NO: 2965833 - RNA, 20 nt, Mycobacterium avium subsp. paratuberculosis
gugcgggcuccgcacgaccu

SEQ ID NO: 2965834 - RNA, 17 nt, Mycobacterium avium subsp. paratuberculosis
gugcgggcugacgucga

SEQ ID NO: 2965835 - RNA, 19 nt, Mycobacterium avium subsp. paratuberculosis
gugcggggccgcggccggc

SEQ ID NO: 2965836 - RNA, 20 nt, Mycobacterium avium subsp. paratuberculosis
gugcggggccucgucgccgc

SEQ ID NO: 2965837 - RNA, 22 nt, Mycobacterium avium subsp. paratuberculosis
gugcggggccucgucgccgcgg

SEQ ID NO: 2965838 - RNA, 20 nt, Mycobacterium avium subsp. paratuberculosis
gugcggggugugcaggccga

SEQ ID NO: 2965839 - RNA, 13 nt, Mycobacterium avium subsp. paratuberculosis
gugcgggucgcgc

SEQ ID NO: 2965840 - RNA, 13 nt, Mycobacterium avium subsp. paratuberculosis
gugcgggucucga

SEQ ID NO: 2965841 - RNA, 17 nt, Mycobacterium avium subsp. paratuberculosis
gugcgggugccgaacac

SEQ ID NO: 2965842 - RNA, 13 nt, Mycobacterium avium subsp. paratuberculosis
gugcggguggccg

SEQ ID NO: 2965843 - RNA, 18 nt, Mycobacterium avium subsp. paratuberculosis
gugcggguggccgggucg

SEQ ID NO: 2965844 - RNA, 20 nt, Mycobacterium avium subsp. paratuberculosis
gugcgggugguguggcgucg

SEQ ID NO: 2965845 - RNA, 17 nt, Mycobacterium avium subsp. paratuberculosis
gugcggguguccgagcg

SEQ ID NO: 2965846 - RNA, 19 nt, Mycobacterium avium subsp. paratuberculosis
gugcggguguccgagcggg

SEQ ID NO: 2965847 - RNA, 20 nt, Mycobacterium avium subsp. paratuberculosis
gugcggguguccgagcgggc

SEQ ID NO: 2965848 - RNA, 14 nt, Mycobacterium avium subsp. paratuberculosis
gugcggguuggcgc

SEQ ID NO: 2965849 - RNA, 21 nt, Mycobacterium avium subsp. paratuberculosis
gugcgguaggugccggccgcg

SEQ ID NO: 2965850 - RNA, 13 nt, Mycobacterium avium subsp. paratuberculosis
gugcggucgauga

SEQ ID NO: 2965851 - RNA, 14 nt, Mycobacterium avium subsp. paratuberculosis
gugcggucgcgcag

SEQ ID NO: 2965852 - RNA, 16 nt, Mycobacterium avium subsp. paratuberculosis
gugcggucgcgcagcc

SEQ ID NO: 2965853 - RNA, 17 nt, Mycobacterium avium subsp. paratuberculosis
gugcggucgcgcagccg

SEQ ID NO: 2965854 - RNA, 13 nt, Mycobacterium avium subsp. paratuberculosis
gugcggucggcga

SEQ ID NO: 2965855 - RNA, 15 nt, Mycobacterium avium subsp. paratuberculosis
gugcggucggcgucg

SEQ ID NO: 2965856 - RNA, 16 nt, Mycobacterium avium subsp. paratuberculosis
gugcggugcaccgcgg

SEQ ID NO: 2965857 - RNA, 19 nt, Mycobacterium avium subsp. paratuberculosis
gugcggugcaccgcggcgc

SEQ ID NO: 2965858 - RNA, 21 nt, Mycobacterium avium subsp. paratuberculosis
gugcggugcaccgcggcgcgc

SEQ ID NO: 2965859 - RNA, 14 nt, Mycobacterium avium subsp. paratuberculosis
gugcggugcagccg

SEQ ID NO: 2965860 - RNA, 17 nt, Mycobacterium avium subsp. paratuberculosis
gugcggugcagccgcgg

SEQ ID NO: 2965861 - RNA, 18 nt, Mycobacterium avium subsp. paratuberculosis
gugcggugcagccgcggu

SEQ ID NO: 2965862 - RNA, 16 nt, Mycobacterium avium subsp. paratuberculosis
gugcggugcgccgcau

SEQ ID NO: 2965863 - RNA, 13 nt, Mycobacterium avium subsp. paratuberculosis
gugcggugcggcc

SEQ ID NO: 2965864 - RNA, 14 nt, Mycobacterium avium subsp. paratuberculosis
gugcggugcggccg

SEQ ID NO: 2965865 - RNA, 18 nt, Mycobacterium avium subsp. paratuberculosis
gugcgguggucggcguca

SEQ ID NO: 2965866 - RNA, 22 nt, Mycobacterium avium subsp. paratuberculosis
gugcgguugagcaccagcccgg

SEQ ID NO: 2965867 - RNA, 17 nt, Mycobacterium avium subsp. paratuberculosis
gugcgguuggcccgcgg

SEQ ID NO: 2965868 - RNA, 19 nt, Mycobacterium avium subsp. paratuberculosis
gugcgguuggcccgcggcg

SEQ ID NO: 2965869 - RNA, 17 nt, Mycobacterium avium subsp. paratuberculosis
gugcguacuucgcguuc

SEQ ID NO: 2965870 - RNA, 22 nt, Mycobacterium avium subsp. paratuberculosis
gugcguacuucgcguuccgcca

SEQ ID NO: 2965871 - RNA, 13 nt, Mycobacterium avium subsp. paratuberculosis
gugcguagcggcc

SEQ ID NO: 2965872 - RNA, 16 nt, Mycobacterium avium subsp. paratuberculosis
gugcguagcggcccga

SEQ ID NO: 2965873 - RNA, 17 nt, Mycobacterium avium subsp. paratuberculosis
gugcgucacgcugguga

SEQ ID NO: 2965874 - RNA, 22 nt, Mycobacterium avium subsp. paratuberculosis
gugcgucagaaccggggccagc

SEQ ID NO: 2965875 - RNA, 20 nt, Mycobacterium avium subsp. paratuberculosis
gugcgucaucgcgcuggggu

SEQ ID NO: 2965876 - RNA, 21 nt, Mycobacterium avium subsp. paratuberculosis
gugcguccagaccggccgggg

SEQ ID NO: 2965877 - RNA, 13 nt, Mycobacterium avium subsp. paratuberculosis
gugcgucgggcgc

SEQ ID NO: 2965878 - RNA, 17 nt, Mycobacterium avium subsp. paratuberculosis
gugcgucgggcgccggc

SEQ ID NO: 2965879 - RNA, 20 nt, Mycobacterium avium subsp. paratuberculosis
gugcgucgggcgccggcgcg

SEQ ID NO: 2965880 - RNA, 23 nt, Mycobacterium avium subsp. paratuberculosis
gugcgucuuuucccacacgcucg

SEQ ID NO: 2965881 - RNA, 20 nt, Mycobacterium avium subsp. paratuberculosis
gugcgugacguaagugucgu

SEQ ID NO: 2965882 - RNA, 22 nt, Mycobacterium avium subsp. paratuberculosis
gugcgugaugaccagggccucg

SEQ ID NO: 2965883 - RNA, 18 nt, Mycobacterium avium subsp. paratuberculosis
gugcgugccagcagcucg

SEQ ID NO: 2965884 - RNA, 14 nt, Mycobacterium avium subsp. paratuberculosis
gugcgugcgcucga

SEQ ID NO: 2965885 - RNA, 17 nt, Mycobacterium avium subsp. paratuberculosis
gugcguucgcguucggg

SEQ ID NO: 2965886 - RNA, 16 nt, Mycobacterium avium subsp. paratuberculosis
gugcguuugaugacgc

SEQ ID NO: 2965887 - RNA, 14 nt, Mycobacterium avium subsp. paratuberculosis
gugcuacugccgac

SEQ ID NO: 2965888 - RNA, 16 nt, Mycobacterium avium subsp. paratuberculosis
gugcuagcgagcgggc

SEQ ID NO: 2965889 - RNA, 20 nt, Mycobacterium avium subsp. paratuberculosis
gugcuagcgagcgggcacgc

SEQ ID NO: 2965890 - RNA, 13 nt, Mycobacterium avium subsp. paratuberculosis
gugcucagccgca

SEQ ID NO: 2965891 - RNA, 18 nt, Mycobacterium avium subsp. paratuberculosis
gugcucagccgcacggau

SEQ ID NO: 2965892 - RNA, 22 nt, Mycobacterium avium subsp. paratuberculosis
gugcucagguugcgcagcagcc

SEQ ID NO: 2965893 - RNA, 13 nt, Mycobacterium avium subsp. paratuberculosis
gugcucaucagcg

SEQ ID NO: 2965894 - RNA, 19 nt, Mycobacterium avium subsp. paratuberculosis
gugcucaucagcgacacca

SEQ ID NO: 2965895 - RNA, 19 nt, Mycobacterium avium subsp. paratuberculosis
gugcucaucuacgucgucg

SEQ ID NO: 2965896 - RNA, 20 nt, Mycobacterium avium subsp. paratuberculosis
gugcuccagcaggcgcgccg

SEQ ID NO: 2965897 - RNA, 13 nt, Mycobacterium avium subsp. paratuberculosis
gugcucccagcuc

SEQ ID NO: 2965898 - RNA, 13 nt, Mycobacterium avium subsp. paratuberculosis
gugcucccgccga

SEQ ID NO: 2965899 - RNA, 20 nt, Mycobacterium avium subsp. paratuberculosis
guggaaaucgagcgcgcugu

SEQ ID NO: 2965900 - RNA, 17 nt, Mycobacterium avium subsp. paratuberculosis
guggaacaccgcgcuga

SEQ ID NO: 2965901 - RNA, 18 nt, Mycobacterium avium subsp. paratuberculosis
guggaacacgucggcgau

SEQ ID NO: 2965902 - RNA, 19 nt, Mycobacterium avium subsp. paratuberculosis
guggaacaguucggugcgg

SEQ ID NO: 2965903 - RNA, 15 nt, Mycobacterium avium subsp. paratuberculosis
guggaacccagcacc

SEQ ID NO: 2965904 - RNA, 23 nt, Mycobacterium avium subsp. paratuberculosis
guggaacgacgccagaaccggca

SEQ ID NO: 2965905 - RNA, 16 nt, Mycobacterium avium subsp. paratuberculosis
guggaacgcgucgcgc

SEQ ID NO: 2965906 - RNA, 23 nt, Mycobacterium avium subsp. paratuberculosis
guggaagauguugccgccacuca

SEQ ID NO: 2965907 - RNA, 13 nt, Mycobacterium avium subsp. paratuberculosis
guggaagccgcga

SEQ ID NO: 2965908 - RNA, 14 nt, Mycobacterium avium subsp. paratuberculosis
guggaagccgcgau

SEQ ID NO: 2965909 - RNA, 16 nt, Mycobacterium avium subsp. paratuberculosis
guggaagguguuggug

SEQ ID NO: 2965910 - RNA, 19 nt, Mycobacterium avium subsp. paratuberculosis
guggaagguguuggugcgg

SEQ ID NO: 2965911 - RNA, 15 nt, Mycobacterium avium subsp. paratuberculosis
guggaagucagcgcg

SEQ ID NO: 2965912 - RNA, 13 nt, Mycobacterium avium subsp. paratuberculosis
guggacaccgcac

SEQ ID NO: 2965913 - RNA, 21 nt, Mycobacterium avium subsp. paratuberculosis
guggacaccgcgaucaccacc

SEQ ID NO: 2965914 - RNA, 18 nt, Mycobacterium avium subsp. paratuberculosis
guggacaccuuggcggcc

SEQ ID NO: 2965915 - RNA, 22 nt, Mycobacterium avium subsp. paratuberculosis
guggacagcgcgacgggcaccc

SEQ ID NO: 2965916 - RNA, 15 nt, Mycobacterium avium subsp. paratuberculosis
guggacaggaggaca

SEQ ID NO: 2965917 - RNA, 19 nt, Mycobacterium avium subsp. paratuberculosis
guggacagguagcggugcu

SEQ ID NO: 2965918 - RNA, 16 nt, Mycobacterium avium subsp. paratuberculosis
guggacaggucgauga

SEQ ID NO: 2965919 - RNA, 22 nt, Mycobacterium avium subsp. paratuberculosis
guggacaggucgaugauguugc

SEQ ID NO: 2965920 - RNA, 19 nt, Mycobacterium avium subsp. paratuberculosis
guggacaugcagccgccgc

SEQ ID NO: 2965921 - RNA, 21 nt, Mycobacterium avium subsp. paratuberculosis
guggacaugcagccgccgcgg

SEQ ID NO: 2965922 - RNA, 22 nt, Mycobacterium avium subsp. paratuberculosis
guggacaugcagccgccgcgga

SEQ ID NO: 2965923 - RNA, 14 nt, Mycobacterium avium subsp. paratuberculosis
guggaccgcgcagu

SEQ ID NO: 2965924 - RNA, 20 nt, Mycobacterium avium subsp. paratuberculosis
guggaccgcgcagucggcgu

SEQ ID NO: 2965925 - RNA, 21 nt, Mycobacterium avium subsp. paratuberculosis
guggaccgcgugugcccgccu

SEQ ID NO: 2965926 - RNA, 14 nt, Mycobacterium avium subsp. paratuberculosis
guggacgaacgcgg

SEQ ID NO: 2965927 - RNA, 17 nt, Mycobacterium avium subsp. paratuberculosis
guggacgaacgcggcga

SEQ ID NO: 2965928 - RNA, 14 nt, Mycobacterium avium subsp. paratuberculosis
guggacgagcagcc

SEQ ID NO: 2965929 - RNA, 16 nt, Mycobacterium avium subsp. paratuberculosis
guggacgagcagccgc

SEQ ID NO: 2965930 - RNA, 19 nt, Mycobacterium avium subsp. paratuberculosis
guggacgaugcggggccgg

SEQ ID NO: 2965931 - RNA, 14 nt, Mycobacterium avium subsp. paratuberculosis
guggacgcccgcga

SEQ ID NO: 2965932 - RNA, 18 nt, Mycobacterium avium subsp. paratuberculosis
guggacgccgcgcacgac

SEQ ID NO: 2965933 - RNA, 19 nt, Mycobacterium avium subsp. paratuberculosis
guggacgccgcgcacgacg

SEQ ID NO: 2965934 - RNA, 15 nt, Mycobacterium avium subsp. paratuberculosis
guggacgcgaccagg

SEQ ID NO: 2965935 - RNA, 16 nt, Mycobacterium avium subsp. paratuberculosis
guggacgcgaccaggc

SEQ ID NO: 2965936 - RNA, 14 nt, Mycobacterium avium subsp. paratuberculosis
guggacgcgcgcgg

SEQ ID NO: 2965937 - RNA, 19 nt, Mycobacterium avium subsp. paratuberculosis
guggacgcggucgccgccc

SEQ ID NO: 2965938 - RNA, 18 nt, Mycobacterium avium subsp. paratuberculosis
guggacggucagcgcgcc

SEQ ID NO: 2965939 - RNA, 16 nt, Mycobacterium avium subsp. paratuberculosis
guggacgucaggccgu

SEQ ID NO: 2965940 - RNA, 24 nt, Mycobacterium avium subsp. paratuberculosis
guggacgucguuuuccagccggcg

SEQ ID NO: 2965941 - RNA, 15 nt, Mycobacterium avium subsp. paratuberculosis
guggacuccagcacc

SEQ ID NO: 2965942 - RNA, 21 nt, Mycobacterium avium subsp. paratuberculosis
guggacuccagcaccagcacg

SEQ ID NO: 2965943 - RNA, 16 nt, Mycobacterium avium subsp. paratuberculosis
guggagacguaccagc

SEQ ID NO: 2965944 - RNA, 20 nt, Mycobacterium avium subsp. paratuberculosis
guggagacguaccagcugcc

SEQ ID NO: 2965945 - RNA, 14 nt, Mycobacterium avium subsp. paratuberculosis
guggagauggccag

SEQ ID NO: 2965946 - RNA, 16 nt, Mycobacterium avium subsp. paratuberculosis
guggagauggccagca

SEQ ID NO: 2965947 - RNA, 17 nt, Mycobacterium avium subsp. paratuberculosis
guggagauggccagcac

SEQ ID NO: 2965948 - RNA, 18 nt, Mycobacterium avium subsp. paratuberculosis
guggagcacagcacggca

SEQ ID NO: 2965949 - RNA, 19 nt, Mycobacterium avium subsp. paratuberculosis
guggagcggcccagcucgg

SEQ ID NO: 2965950 - RNA, 20 nt, Mycobacterium avium subsp. paratuberculosis
guggaggcguagugcgccca

SEQ ID NO: 2965951 - RNA, 20 nt, Mycobacterium avium subsp. paratuberculosis
guggauauuucgcggccgaa

SEQ ID NO: 2965952 - RNA, 19 nt, Mycobacterium avium subsp. paratuberculosis
guggauccggugaccgcga

SEQ ID NO: 2965953 - RNA, 19 nt, Mycobacterium avium subsp. paratuberculosis
guggaucgcuucggccagc

SEQ ID NO: 2965954 - RNA, 22 nt, Mycobacterium avium subsp. paratuberculosis
guggaucgcuucggccagcgcg

SEQ ID NO: 2965955 - RNA, 16 nt, Mycobacterium avium subsp. paratuberculosis
guggaucuccagcagc

SEQ ID NO: 2965956 - RNA, 20 nt, Mycobacterium avium subsp. paratuberculosis
guggaucuccagcagcuuca

SEQ ID NO: 2965957 - RNA, 17 nt, Mycobacterium avium subsp. paratuberculosis
guggaugacgcagccga

SEQ ID NO: 2965958 - RNA, 16 nt, Mycobacterium avium subsp. paratuberculosis
guggauggccggccgg

SEQ ID NO: 2965959 - RNA, 22 nt, Mycobacterium avium subsp. paratuberculosis
guggauggccggccgggucacg

SEQ ID NO: 2965960 - RNA, 22 nt, Mycobacterium avium subsp. paratuberculosis
guggauugucggccgcccgucc

SEQ ID NO: 2965961 - RNA, 20 nt, Mycobacterium avium subsp. paratuberculosis
guggcaacgugccacaggcc

SEQ ID NO: 2965962 - RNA, 17 nt, Mycobacterium avium subsp. paratuberculosis
guggcaccccgcgccgg

SEQ ID NO: 2965963 - RNA, 21 nt, Mycobacterium avium subsp. paratuberculosis
guggcacccgggugcccggcu

SEQ ID NO: 2965964 - RNA, 13 nt, Mycobacterium avium subsp. paratuberculosis
guggcagcccggc

SEQ ID NO: 2965965 - RNA, 14 nt, Mycobacterium avium subsp. paratuberculosis
guggcagcccggcu

SEQ ID NO: 2965966 - RNA, 23 nt, Mycobacterium avium subsp. paratuberculosis
guggcagcgcuccugcagcgcgg

SEQ ID NO: 2965967 - RNA, 21 nt, Mycobacterium avium subsp. paratuberculosis
guggcagcggacccggucggc

SEQ ID NO: 2965968 - RNA, 18 nt, Mycobacterium avium subsp. paratuberculosis
guggcagcggucggcggc

SEQ ID NO: 2965969 - RNA, 21 nt, Mycobacterium avium subsp. paratuberculosis
guggcagcggucggcggcuga

SEQ ID NO: 2965970 - RNA, 19 nt, Mycobacterium avium subsp. paratuberculosis
guggcaggccaucagcccg

SEQ ID NO: 2965971 - RNA, 22 nt, Mycobacterium avium subsp. paratuberculosis
guggcaggccaucagcccggcg

SEQ ID NO: 2965972 - RNA, 22 nt, Mycobacterium avium subsp. paratuberculosis
guggcaggcgauggcgucggcc

SEQ ID NO: 2965973 - RNA, 16 nt, Mycobacterium avium subsp. paratuberculosis
guggcaggcgauggug

SEQ ID NO: 2965974 - RNA, 15 nt, Mycobacterium avium subsp. paratuberculosis
guggcagggccagca

SEQ ID NO: 2965975 - RNA, 17 nt, Mycobacterium avium subsp. paratuberculosis
guggcagggccagcagc

SEQ ID NO: 2965976 - RNA, 18 nt, Mycobacterium avium subsp. paratuberculosis
guggcagggccagcagcc

SEQ ID NO: 2965977 - RNA, 14 nt, Mycobacterium avium subsp. paratuberculosis
guggcaucaccgcc

SEQ ID NO: 2965978 - RNA, 18 nt, Mycobacterium avium subsp. paratuberculosis
guggccaaaaagugccgg

SEQ ID NO: 2965979 - RNA, 13 nt, Mycobacterium avium subsp. paratuberculosis
guggccaccacau

SEQ ID NO: 2965980 - RNA, 17 nt, Mycobacterium avium subsp. paratuberculosis
guggccacccucgccgc

SEQ ID NO: 2965981 - RNA, 18 nt, Mycobacterium avium subsp. paratuberculosis
guggccacccucgccgcc

SEQ ID NO: 2965982 - RNA, 19 nt, Mycobacterium avium subsp. paratuberculosis
guggccacccucgccgccg

SEQ ID NO: 2965983 - RNA, 13 nt, Mycobacterium avium subsp. paratuberculosis
guggccuggucga

SEQ ID NO: 2965984 - RNA, 22 nt, Mycobacterium avium subsp. paratuberculosis
guggccuggucgaacagcacgc

SEQ ID NO: 2965985 - RNA, 16 nt, Mycobacterium avium subsp. paratuberculosis
guggccuggucggcga

SEQ ID NO: 2965986 - RNA, 14 nt, Mycobacterium avium subsp. paratuberculosis
guggccuucaucac

SEQ ID NO: 2965987 - RNA, 15 nt, Mycobacterium avium subsp. paratuberculosis
guggccuucaucacc

SEQ ID NO: 2965988 - RNA, 20 nt, Mycobacterium avium subsp. paratuberculosis
guggccuucaucaccgcccc

SEQ ID NO: 2965989 - RNA, 21 nt, Mycobacterium avium subsp. paratuberculosis
guggccuugacgacggccacc

SEQ ID NO: 2965990 - RNA, 16 nt, Mycobacterium avium subsp. paratuberculosis
guggccuugcugaucc

SEQ ID NO: 2965991 - RNA, 20 nt, Mycobacterium avium subsp. paratuberculosis
guggccuugcugauccccag

SEQ ID NO: 2965992 - RNA, 18 nt, Mycobacterium avium subsp. paratuberculosis
guggccuuggccaccacg

SEQ ID NO: 2965993 - RNA, 17 nt, Mycobacterium avium subsp. paratuberculosis
guggcgaaaccaacacc

SEQ ID NO: 2965994 - RNA, 16 nt, Mycobacterium avium subsp. paratuberculosis
guggcgaacagcgggu

SEQ ID NO: 2965995 - RNA, 18 nt, Mycobacterium avium subsp. paratuberculosis
guggcgaacugcaccagc

SEQ ID NO: 2965996 - RNA, 19 nt, Mycobacterium avium subsp. paratuberculosis
guggcgaacugcaccagca

SEQ ID NO: 2965997 - RNA, 20 nt, Mycobacterium avium subsp. paratuberculosis
guggcgaacugcaccagcac

SEQ ID NO: 2965998 - RNA, 16 nt, Mycobacterium avium subsp. paratuberculosis
guggcgacaacaggcg

SEQ ID NO: 2965999 - RNA, 17 nt, Mycobacterium avium subsp. paratuberculosis
guggcgacaacaggcga

SEQ ID NO: 2966000 - RNA, 16 nt, Mycobacterium avium subsp. paratuberculosis
guggcgacaucgccgc

SEQ ID NO: 2966001 - RNA, 18 nt, Mycobacterium avium subsp. paratuberculosis
guggcgacaucgccgcgg

SEQ ID NO: 2966002 - RNA, 19 nt, Mycobacterium avium subsp. paratuberculosis
guggcgacaucgccgcggc

SEQ ID NO: 2966003 - RNA, 22 nt, Mycobacterium avium subsp. paratuberculosis
guggcgacaucgccgcggccgg

SEQ ID NO: 2966004 - RNA, 16 nt, Mycobacterium avium subsp. paratuberculosis
guggcgacgacgccga

SEQ ID NO: 2966005 - RNA, 17 nt, Mycobacterium avium subsp. paratuberculosis
guggcgaucaccgcggc

SEQ ID NO: 2966006 - RNA, 23 nt, Mycobacterium avium subsp. paratuberculosis
guggcgaugacgaauuccgcacc

SEQ ID NO: 2966007 - RNA, 18 nt, Mycobacterium avium subsp. paratuberculosis
guggcgaugaucaccucg

SEQ ID NO: 2966008 - RNA, 22 nt, Mycobacterium avium subsp. paratuberculosis
guggcgcacaacccggacagcg

SEQ ID NO: 2966009 - RNA, 22 nt, Mycobacterium avium subsp. paratuberculosis
guggcgcacagaucgucucggc

SEQ ID NO: 2966010 - RNA, 13 nt, Mycobacterium avium subsp. paratuberculosis
guggcgcacgcug

SEQ ID NO: 2966011 - RNA, 16 nt, Mycobacterium avium subsp. paratuberculosis
guggcgcccgcggugg

SEQ ID NO: 2966012 - RNA, 13 nt, Mycobacterium avium subsp. paratuberculosis
guggcgccgcgca

SEQ ID NO: 2966013 - RNA, 16 nt, Mycobacterium avium subsp. paratuberculosis
guggcgccgcgcagcc

SEQ ID NO: 2966014 - RNA, 15 nt, Mycobacterium avium subsp. paratuberculosis
guggcgccgcgggcg

SEQ ID NO: 2966015 - RNA, 14 nt, Mycobacterium avium subsp. paratuberculosis
guggcgccggcauc

SEQ ID NO: 2966016 - RNA, 18 nt, Mycobacterium avium subsp. paratuberculosis
guggcgccggcaucgacc

SEQ ID NO: 2966017 - RNA, 15 nt, Mycobacterium avium subsp. paratuberculosis
guggcgccggccagc

SEQ ID NO: 2966018 - RNA, 16 nt, Mycobacterium avium subsp. paratuberculosis
guggcgccggccagca

SEQ ID NO: 2966019 - RNA, 17 nt, Mycobacterium avium subsp. paratuberculosis
guggcgccggccagcac

SEQ ID NO: 2966020 - RNA, 21 nt, Mycobacterium avium subsp. paratuberculosis
guggcgccggccagcaccacg

SEQ ID NO: 2966021 - RNA, 17 nt, Mycobacterium avium subsp. paratuberculosis
guggcgccggcgcgcga

SEQ ID NO: 2966022 - RNA, 13 nt, Mycobacterium avium subsp. paratuberculosis
guggcgccggggc

SEQ ID NO: 2966023 - RNA, 18 nt, Mycobacterium avium subsp. paratuberculosis
guggcgccgguaggcgcg

SEQ ID NO: 2966024 - RNA, 13 nt, Mycobacterium avium subsp. paratuberculosis
guggcgccgguuu

SEQ ID NO: 2966025 - RNA, 14 nt, Mycobacterium avium subsp. paratuberculosis
guggcgccgugcag

SEQ ID NO: 2966026 - RNA, 19 nt, Mycobacterium avium subsp. paratuberculosis
guggcgccuccgcccgggu

SEQ ID NO: 2966027 - RNA, 17 nt, Mycobacterium avium subsp. paratuberculosis
guggcgcgaaucccggc

SEQ ID NO: 2966028 - RNA, 21 nt, Mycobacterium avium subsp. paratuberculosis
guggcgcgaaucccggccucg

SEQ ID NO: 2966029 - RNA, 13 nt, Mycobacterium avium subsp. paratuberculosis
guggcgcgccccg

SEQ ID NO: 2966030 - RNA, 14 nt, Mycobacterium avium subsp. paratuberculosis
guggcgcgccccgg

SEQ ID NO: 2966031 - RNA, 17 nt, Mycobacterium avium subsp. paratuberculosis
guggcgcgccccggccc

SEQ ID NO: 2966032 - RNA, 14 nt, Mycobacterium avium subsp. paratuberculosis
guggcgcugccgag

SEQ ID NO: 2966033 - RNA, 13 nt, Mycobacterium avium subsp. paratuberculosis
guggcggccacca

SEQ ID NO: 2966034 - RNA, 14 nt, Mycobacterium avium subsp. paratuberculosis
guggcggccacgau

SEQ ID NO: 2966035 - RNA, 16 nt, Mycobacterium avium subsp. paratuberculosis
guggcggccagcgaga

SEQ ID NO: 2966036 - RNA, 12 nt, Mycobacterium avium subsp. paratuberculosis
guggcggccggg

SEQ ID NO: 2966037 - RNA, 18 nt, Mycobacterium avium subsp. paratuberculosis
guggcggccgucgcgcac

SEQ ID NO: 2966038 - RNA, 19 nt, Mycobacterium avium subsp. paratuberculosis
guggcggcgaacgcgcggu

SEQ ID NO: 2966039 - RNA, 24 nt, Mycobacterium avium subsp. paratuberculosis
guggcggcgaacgcgcggucgucg

SEQ ID NO: 2966040 - RNA, 19 nt, Mycobacterium avium subsp. paratuberculosis
guggcggcgacaucgaugc

SEQ ID NO: 2966041 - RNA, 13 nt, Mycobacterium avium subsp. paratuberculosis
guggcggcgccgg

SEQ ID NO: 2966042 - RNA, 14 nt, Mycobacterium avium subsp. paratuberculosis
guggcggcgccgga

SEQ ID NO: 2966043 - RNA, 13 nt, Mycobacterium avium subsp. paratuberculosis
guggcggcggcga

SEQ ID NO: 2966044 - RNA, 14 nt, Mycobacterium avium subsp. paratuberculosis
guggcggcgggcca

SEQ ID NO: 2966045 - RNA, 19 nt, Mycobacterium avium subsp. paratuberculosis
guggcggcgggccagcucg

SEQ ID NO: 2966046 - RNA, 20 nt, Mycobacterium avium subsp. paratuberculosis
guggcggcgggccagcucgu

SEQ ID NO: 2966047 - RNA, 15 nt, Mycobacterium avium subsp. paratuberculosis
guggcggcggugucg

SEQ ID NO: 2966048 - RNA, 16 nt, Mycobacterium avium subsp. paratuberculosis
guggcggcggugucgc

SEQ ID NO: 2966049 - RNA, 15 nt, Mycobacterium avium subsp. paratuberculosis
guggcgggccaggcg

SEQ ID NO: 2966050 - RNA, 14 nt, Mycobacterium avium subsp. paratuberculosis
guggcgggcccggg

SEQ ID NO: 2966051 - RNA, 15 nt, Mycobacterium avium subsp. paratuberculosis
guggcgggccgccgg

SEQ ID NO: 2966052 - RNA, 19 nt, Mycobacterium avium subsp. paratuberculosis
guggcgggcguccugcggg

SEQ ID NO: 2966053 - RNA, 22 nt, Mycobacterium avium subsp. paratuberculosis
guggcggggcguugcccgucgc

SEQ ID NO: 2966054 - RNA, 16 nt, Mycobacterium avium subsp. paratuberculosis
guggcggucccggcgg

SEQ ID NO: 2966055 - RNA, 17 nt, Mycobacterium avium subsp. paratuberculosis
guggcggucccggcgga

SEQ ID NO: 2966056 - RNA, 19 nt, Mycobacterium avium subsp. paratuberculosis
guggcggucccggcggacc

SEQ ID NO: 2966057 - RNA, 14 nt, Mycobacterium avium subsp. paratuberculosis
guggcggucggugc

SEQ ID NO: 2966058 - RNA, 19 nt, Mycobacterium avium subsp. paratuberculosis
guggcggucggugcgcagc

SEQ ID NO: 2966059 - RNA, 14 nt, Mycobacterium avium subsp. paratuberculosis
guggcggugccgcg

SEQ ID NO: 2966060 - RNA, 16 nt, Mycobacterium avium subsp. paratuberculosis
guggcggugccgcggc

SEQ ID NO: 2966061 - RNA, 17 nt, Mycobacterium avium subsp. paratuberculosis
guggcggugccgcggcg

SEQ ID NO: 2966062 - RNA, 15 nt, Mycobacterium avium subsp. paratuberculosis
guggcgguggccacg

SEQ ID NO: 2966063 - RNA, 16 nt, Mycobacterium avium subsp. paratuberculosis
guggcgguggccacgg

SEQ ID NO: 2966064 - RNA, 21 nt, Mycobacterium avium subsp. paratuberculosis
guggcgguggggccgaagccg

SEQ ID NO: 2966065 - RNA, 20 nt, Mycobacterium avium subsp. paratuberculosis
guggcgguguucgagggcgc

SEQ ID NO: 2966066 - RNA, 13 nt, Mycobacterium avium subsp. paratuberculosis
guggcguagcggu

SEQ ID NO: 2966067 - RNA, 16 nt, Mycobacterium avium subsp. paratuberculosis
guggcguagucgucga

SEQ ID NO: 2966068 - RNA, 19 nt, Mycobacterium avium subsp. paratuberculosis
gugggcguacgggcgggca

SEQ ID NO: 2966069 - RNA, 14 nt, Mycobacterium avium subsp. paratuberculosis
gugggcgucguggu

SEQ ID NO: 2966070 - RNA, 13 nt, Mycobacterium avium subsp. paratuberculosis
gugggcgugccgg

SEQ ID NO: 2966071 - RNA, 16 nt, Mycobacterium avium subsp. paratuberculosis
gugggcucggccaucc

SEQ ID NO: 2966072 - RNA, 21 nt, Mycobacterium avium subsp. paratuberculosis
gugggcuuagcggggugagcu

SEQ ID NO: 2966073 - RNA, 15 nt, Mycobacterium avium subsp. paratuberculosis
guggggacgacgccg

SEQ ID NO: 2966074 - RNA, 17 nt, Mycobacterium avium subsp. paratuberculosis
guggggacgacgccgaa

SEQ ID NO: 2966075 - RNA, 18 nt, Mycobacterium avium subsp. paratuberculosis
guggggccgaagccgaca

SEQ ID NO: 2966076 - RNA, 19 nt, Mycobacterium avium subsp. paratuberculosis
gugggggucgacccgccgc

SEQ ID NO: 2966077 - RNA, 17 nt, Mycobacterium avium subsp. paratuberculosis
gugggguugaagcuggc

SEQ ID NO: 2966078 - RNA, 14 nt, Mycobacterium avium subsp. paratuberculosis
gugggucagcgagg

SEQ ID NO: 2966079 - RNA, 14 nt, Mycobacterium avium subsp. paratuberculosis
gugggucagcuuca

SEQ ID NO: 2966080 - RNA, 14 nt, Mycobacterium avium subsp. paratuberculosis
gugggucggcggcu

SEQ ID NO: 2966081 - RNA, 23 nt, Mycobacterium avium subsp. paratuberculosis
gugggugccgacgagcucgccgc

SEQ ID NO: 2966082 - RNA, 13 nt, Mycobacterium avium subsp. paratuberculosis
guggguggucagc

SEQ ID NO: 2966083 - RNA, 15 nt, Mycobacterium avium subsp. paratuberculosis
guggguggucugcug

SEQ ID NO: 2966084 - RNA, 15 nt, Mycobacterium avium subsp. paratuberculosis
gugguaccggcgcca

SEQ ID NO: 2966085 - RNA, 15 nt, Mycobacterium avium subsp. paratuberculosis
gugguaccggguggc

SEQ ID NO: 2966086 - RNA, 20 nt, Mycobacterium avium subsp. paratuberculosis
gugguagacagcguggucgc

SEQ ID NO: 2966087 - RNA, 16 nt, Mycobacterium avium subsp. paratuberculosis
gugguagaugucgcga

SEQ ID NO: 2966088 - RNA, 17 nt, Mycobacterium avium subsp. paratuberculosis
guggucaacggcaccga

SEQ ID NO: 2966089 - RNA, 18 nt, Mycobacterium avium subsp. paratuberculosis
guggucaacggcaccgac

SEQ ID NO: 2966090 - RNA, 19 nt, Mycobacterium avium subsp. paratuberculosis
guggucaacggcaccgaca

SEQ ID NO: 2966091 - RNA, 15 nt, Mycobacterium avium subsp. paratuberculosis
guggucaccagcgcg

SEQ ID NO: 2966092 - RNA, 16 nt, Mycobacterium avium subsp. paratuberculosis
guggucaccagcgcgg

SEQ ID NO: 2966093 - RNA, 17 nt, Mycobacterium avium subsp. paratuberculosis
guggucaccagcgcggu

SEQ ID NO: 2966094 - RNA, 12 nt, Mycobacterium avium subsp. paratuberculosis
guggucacccgc

SEQ ID NO: 2966095 - RNA, 16 nt, Mycobacterium avium subsp. paratuberculosis
guggucacccgcagcc

SEQ ID NO: 2966096 - RNA, 21 nt, Mycobacterium avium subsp. paratuberculosis
guggucaccguguuggugacg

SEQ ID NO: 2966097 - RNA, 12 nt, Mycobacterium avium subsp. paratuberculosis
guggucagcacc

SEQ ID NO: 2966098 - RNA, 13 nt, Mycobacterium avium subsp. paratuberculosis
guggucagcgcgg

SEQ ID NO: 2966099 - RNA, 22 nt, Mycobacterium avium subsp. paratuberculosis
guggucagcggcgccaccggga

SEQ ID NO: 2966100 - RNA, 17 nt, Mycobacterium avium subsp. paratuberculosis
guggucagcgucucgcc

SEQ ID NO: 2966101 - RNA, 16 nt, Mycobacterium avium subsp. paratuberculosis
guggucagcgucucgg

SEQ ID NO: 2966102 - RNA, 18 nt, Mycobacterium avium subsp. paratuberculosis
guggucagcgucucggcg

SEQ ID NO: 2966103 - RNA, 23 nt, Mycobacterium avium subsp. paratuberculosis
guggucaggcccaggcgaccucg

SEQ ID NO: 2966104 - RNA, 15 nt, Mycobacterium avium subsp. paratuberculosis
gugguccaccgccgc

SEQ ID NO: 2966105 - RNA, 19 nt, Mycobacterium avium subsp. paratuberculosis
gugguccaccgccgcgccg

SEQ ID NO: 2966106 - RNA, 19 nt, Mycobacterium avium subsp. paratuberculosis
gugguccagcacgugccca

SEQ ID NO: 2966107 - RNA, 16 nt, Mycobacterium avium subsp. paratuberculosis
gugguccagccggucg

SEQ ID NO: 2966108 - RNA, 18 nt, Mycobacterium avium subsp. paratuberculosis
gugguccagccggucgca

SEQ ID NO: 2966109 - RNA, 22 nt, Mycobacterium avium subsp. paratuberculosis
gugguccagccggucgcaggug

SEQ ID NO: 2966110 - RNA, 22 nt, Mycobacterium avium subsp. paratuberculosis
gugguccgcgcgaccaucagcc

SEQ ID NO: 2966111 - RNA, 19 nt, Mycobacterium avium subsp. paratuberculosis
guggucgacgagcccgcgc

SEQ ID NO: 2966112 - RNA, 14 nt, Mycobacterium avium subsp. paratuberculosis
guggucgacgccgu

SEQ ID NO: 2966113 - RNA, 16 nt, Mycobacterium avium subsp. paratuberculosis
guggucgacgcgccgc

SEQ ID NO: 2966114 - RNA, 17 nt, Mycobacterium avium subsp. paratuberculosis
guggucgacgcgccgca

SEQ ID NO: 2966115 - RNA, 18 nt, Mycobacterium avium subsp. paratuberculosis
guggucgacgcgccgcac

SEQ ID NO: 2966116 - RNA, 20 nt, Mycobacterium avium subsp. paratuberculosis
guggucgagcaugcggguga

SEQ ID NO: 2966117 - RNA, 23 nt, Mycobacterium avium subsp. paratuberculosis
guggucgaucccgccggcgaucg

SEQ ID NO: 2966118 - RNA, 12 nt, Mycobacterium avium subsp. paratuberculosis
guggucgaugcc

SEQ ID NO: 2966119 - RNA, 13 nt, Mycobacterium avium subsp. paratuberculosis
guggucgaugccc

SEQ ID NO: 2966120 - RNA, 15 nt, Mycobacterium avium subsp. paratuberculosis
guggucgccgucgua

SEQ ID NO: 2966121 - RNA, 14 nt, Mycobacterium avium subsp. paratuberculosis
guggucgccguugg

SEQ ID NO: 2966122 - RNA, 20 nt, Mycobacterium avium subsp. paratuberculosis
guggucgccguuggcgugga

SEQ ID NO: 2966123 - RNA, 14 nt, Mycobacterium avium subsp. paratuberculosis
guggucgcgcagca

SEQ ID NO: 2966124 - RNA, 17 nt, Mycobacterium avium subsp. paratuberculosis
guggucggcagcaccgg

SEQ ID NO: 2966125 - RNA, 16 nt, Mycobacterium avium subsp. paratuberculosis
guggucggccacgacg

SEQ ID NO: 2966126 - RNA, 14 nt, Mycobacterium avium subsp. paratuberculosis
guggucggccgccc

SEQ ID NO: 2966127 - RNA, 14 nt, Mycobacterium avium subsp. paratuberculosis
guggucggcgcggu

SEQ ID NO: 2966128 - RNA, 14 nt, Mycobacterium avium subsp. paratuberculosis
guggucgggcaugc

SEQ ID NO: 2966129 - RNA, 17 nt, Mycobacterium avium subsp. paratuberculosis
guggucgggcaugccgg

SEQ ID NO: 2966130 - RNA, 20 nt, Mycobacterium avium subsp. paratuberculosis
guggucgguagggucgggug

SEQ ID NO: 2966131 - RNA, 14 nt, Mycobacterium avium subsp. paratuberculosis
guggucgucgacga

SEQ ID NO: 2966132 - RNA, 14 nt, Mycobacterium avium subsp. paratuberculosis
guggucgucgucga

SEQ ID NO: 2966133 - RNA, 19 nt, Mycobacterium avium subsp. paratuberculosis
guggucucccagacgucga

SEQ ID NO: 2966134 - RNA, 22 nt, Mycobacterium avium subsp. paratuberculosis
guggucucccagacgucgaccu

SEQ ID NO: 2966135 - RNA, 18 nt, Mycobacterium avium subsp. paratuberculosis
guggucuccuggccgccg

SEQ ID NO: 2966136 - RNA, 14 nt, Mycobacterium avium subsp. paratuberculosis
guggucucgaugca

SEQ ID NO: 2966137 - RNA, 16 nt, Mycobacterium avium subsp. paratuberculosis
guggucucguugugca

SEQ ID NO: 2966138 - RNA, 15 nt, Mycobacterium avium subsp. paratuberculosis
guggucugccagaac

SEQ ID NO: 2966139 - RNA, 23 nt, Mycobacterium avium subsp. paratuberculosis
guggugaacucuucgcagcgcuc

SEQ ID NO: 2966140 - RNA, 23 nt, Mycobacterium avium subsp. paratuberculosis
guggugacggccccagacgaagu

SEQ ID NO: 2966141 - RNA, 14 nt, Mycobacterium avium subsp. paratuberculosis
guggugacgggcgu

SEQ ID NO: 2966142 - RNA, 20 nt, Mycobacterium avium subsp. paratuberculosis
guggugacgggcgucggcgg

SEQ ID NO: 2966143 - RNA, 22 nt, Mycobacterium avium subsp. paratuberculosis
guggugacgggcgucggcgggc

SEQ ID NO: 2966144 - RNA, 15 nt, Mycobacterium avium subsp. paratuberculosis
guggugaucagcauc

SEQ ID NO: 2966145 - RNA, 14 nt, Mycobacterium avium subsp. paratuberculosis
guggugaucgccgc

SEQ ID NO: 2966146 - RNA, 16 nt, Mycobacterium avium subsp. paratuberculosis
guggugaucgcggcgg

SEQ ID NO: 2966147 - RNA, 19 nt, Mycobacterium avium subsp. paratuberculosis
guggugaucgcggcggcgu

SEQ ID NO: 2966148 - RNA, 15 nt, Mycobacterium avium subsp. paratuberculosis
guggugaucggccag

SEQ ID NO: 2966149 - RNA, 22 nt, Mycobacterium avium subsp. paratuberculosis
guggugaucggccaggcgccca

SEQ ID NO: 2966150 - RNA, 13 nt, Mycobacterium avium subsp. paratuberculosis
guggugcacgaac

SEQ ID NO: 2966151 - RNA, 19 nt, Mycobacterium avium subsp. paratuberculosis
guggugcacgaacggcacg

SEQ ID NO: 2966152 - RNA, 13 nt, Mycobacterium avium subsp. paratuberculosis
guggugcaggugc

SEQ ID NO: 2966153 - RNA, 19 nt, Mycobacterium avium subsp. paratuberculosis
gugucgcacagcauguccu

SEQ ID NO: 2966154 - RNA, 15 nt, Mycobacterium avium subsp. paratuberculosis
gugucgccgagccgc

SEQ ID NO: 2966155 - RNA, 17 nt, Mycobacterium avium subsp. paratuberculosis
gugucgccgagccgcac

SEQ ID NO: 2966156 - RNA, 13 nt, Mycobacterium avium subsp. paratuberculosis
gugucgccggggc

SEQ ID NO: 2966157 - RNA, 21 nt, Mycobacterium avium subsp. paratuberculosis
gugucgccggggcggaucccc

SEQ ID NO: 2966158 - RNA, 16 nt, Mycobacterium avium subsp. paratuberculosis
gugucgccgguggugc

SEQ ID NO: 2966159 - RNA, 15 nt, Mycobacterium avium subsp. paratuberculosis
gugucgccgucgccg

SEQ ID NO: 2966160 - RNA, 11 nt, Mycobacterium avium subsp. paratuberculosis
gugucgcggcc

SEQ ID NO: 2966161 - RNA, 13 nt, Mycobacterium avium subsp. paratuberculosis
gugucgcggcugc

SEQ ID NO: 2966162 - RNA, 13 nt, Mycobacterium avium subsp. paratuberculosis
gugucgcucaucc

SEQ ID NO: 2966163 - RNA, 16 nt, Mycobacterium avium subsp. paratuberculosis
gugucgcucaucccga

SEQ ID NO: 2966164 - RNA, 21 nt, Mycobacterium avium subsp. paratuberculosis
gugucgcuguaggccagcccg

SEQ ID NO: 2966165 - RNA, 22 nt, Mycobacterium avium subsp. paratuberculosis
gugucgcuguaggccagcccgg

SEQ ID NO: 2966166 - RNA, 21 nt, Mycobacterium avium subsp. paratuberculosis
gugucggagaucggcgagugc

SEQ ID NO: 2966167 - RNA, 11 nt, Mycobacterium avium subsp. paratuberculosis
gugucggcgac

SEQ ID NO: 2966168 - RNA, 14 nt, Mycobacterium avium subsp. paratuberculosis
gugucggcgggcgg

SEQ ID NO: 2966169 - RNA, 16 nt, Mycobacterium avium subsp. paratuberculosis
gugucggcggggccgg

SEQ ID NO: 2966170 - RNA, 22 nt, Mycobacterium avium subsp. paratuberculosis
gugucggcgucgaugucgucgu

SEQ ID NO: 2966171 - RNA, 14 nt, Mycobacterium avium subsp. paratuberculosis
gugucggggucggc

SEQ ID NO: 2966172 - RNA, 19 nt, Mycobacterium avium subsp. paratuberculosis
gugucggggucggcgccgc

SEQ ID NO: 2966173 - RNA, 16 nt, Mycobacterium avium subsp. paratuberculosis
gugucggggucgucga

SEQ ID NO: 2966174 - RNA, 20 nt, Mycobacterium avium subsp. paratuberculosis
gugucguagacgacgucgac

SEQ ID NO: 2966175 - RNA, 21 nt, Mycobacterium avium subsp. paratuberculosis
gugucguagacgacgucgacc

SEQ ID NO: 2966176 - RNA, 16 nt, Mycobacterium avium subsp. paratuberculosis
gugucguagcggcugu

SEQ ID NO: 2966177 - RNA, 18 nt, Mycobacterium avium subsp. paratuberculosis
gugucguagcggcugucg

SEQ ID NO: 2966178 - RNA, 18 nt, Mycobacterium avium subsp. paratuberculosis
gugucgucgucgccgccg

SEQ ID NO: 2966179 - RNA, 19 nt, Mycobacterium avium subsp. paratuberculosis
gugucgucgucgccgccgg

SEQ ID NO: 2966180 - RNA, 13 nt, Mycobacterium avium subsp. paratuberculosis
gugucgucgucgg

SEQ ID NO: 2966181 - RNA, 22 nt, Mycobacterium avium subsp. paratuberculosis
gugucguggcgacaucgccgcg

SEQ ID NO: 2966182 - RNA, 15 nt, Mycobacterium avium subsp. paratuberculosis
gugucgugugcguga

SEQ ID NO: 2966183 - RNA, 17 nt, Mycobacterium avium subsp. paratuberculosis
gugucgugugcgugacg

SEQ ID NO: 2966184 - RNA, 16 nt, Mycobacterium avium subsp. paratuberculosis
gugucuuucucgauga

SEQ ID NO: 2966185 - RNA, 18 nt, Mycobacterium avium subsp. paratuberculosis
gugugaucgagcaccagc

SEQ ID NO: 2966186 - RNA, 13 nt, Mycobacterium avium subsp. paratuberculosis
gugugcaccagcg

SEQ ID NO: 2966187 - RNA, 15 nt, Mycobacterium avium subsp. paratuberculosis
gugugcagccacccg

SEQ ID NO: 2966188 - RNA, 19 nt, Mycobacterium avium subsp. paratuberculosis
gugugcauccugggcgucg

SEQ ID NO: 2966189 - RNA, 13 nt, Mycobacterium avium subsp. paratuberculosis
gugugccagcccg

SEQ ID NO: 2966190 - RNA, 17 nt, Mycobacterium avium subsp. paratuberculosis
gugugcccagcacgacg

SEQ ID NO: 2966191 - RNA, 24 nt, Mycobacterium avium subsp. paratuberculosis
gugugcccagcacgacgccgcugg

SEQ ID NO: 2966192 - RNA, 16 nt, Mycobacterium avium subsp. paratuberculosis
gugugcccgcgggcca

SEQ ID NO: 2966193 - RNA, 17 nt, Mycobacterium avium subsp. paratuberculosis
gugugcccgcgggccag

SEQ ID NO: 2966194 - RNA, 15 nt, Mycobacterium avium subsp. paratuberculosis
gugugcgcaucggcg

SEQ ID NO: 2966195 - RNA, 11 nt, Mycobacterium avium subsp. paratuberculosis
gugugcggcac

SEQ ID NO: 2966196 - RNA, 16 nt, Mycobacterium avium subsp. paratuberculosis
gugugcggcagcucgg

SEQ ID NO: 2966197 - RNA, 15 nt, Mycobacterium avium subsp. paratuberculosis
gugugcucagcuccc

SEQ ID NO: 2966198 - RNA, 20 nt, Mycobacterium avium subsp. paratuberculosis
gugugcucagcucccgagca

SEQ ID NO: 2966199 - RNA, 14 nt, Mycobacterium avium subsp. paratuberculosis
gugugcugacccag

SEQ ID NO: 2966200 - RNA, 21 nt, Mycobacterium avium subsp. paratuberculosis
guguggaucgcuucggccagc

SEQ ID NO: 2966201 - RNA, 23 nt, Mycobacterium avium subsp. paratuberculosis
guguggaucgcuucggccagcgc

SEQ ID NO: 2966202 - RNA, 14 nt, Mycobacterium avium subsp. paratuberculosis
guguggcagguggc

SEQ ID NO: 2966203 - RNA, 12 nt, Mycobacterium avium subsp. paratuberculosis
guguggccgcgg

SEQ ID NO: 2966204 - RNA, 16 nt, Mycobacterium avium subsp. paratuberculosis
guguggccgcgguggu

SEQ ID NO: 2966205 - RNA, 17 nt, Mycobacterium avium subsp. paratuberculosis
guguggcgccgugcagg

SEQ ID NO: 2966206 - RNA, 17 nt, Mycobacterium avium subsp. paratuberculosis
gugugggcucgcccggg

SEQ ID NO: 2966207 - RNA, 16 nt, Mycobacterium avium subsp. paratuberculosis
gugugguacagcgcca

SEQ ID NO: 2966208 - RNA, 19 nt, Mycobacterium avium subsp. paratuberculosis
guguguacacagggcggcg

SEQ ID NO: 2966209 - RNA, 15 nt, Mycobacterium avium subsp. paratuberculosis
guguucaacgcgccg

SEQ ID NO: 2966210 - RNA, 20 nt, Mycobacterium avium subsp. paratuberculosis
guguucaacgcgccgaugcc

SEQ ID NO: 2966211 - RNA, 17 nt, Mycobacterium avium subsp. paratuberculosis
guguucaagccggcgug

SEQ ID NO: 2966212 - RNA, 14 nt, Mycobacterium avium subsp. paratuberculosis
guguucaccgcgcc

SEQ ID NO: 2966213 - RNA, 12 nt, Mycobacterium avium subsp. paratuberculosis
guguuccaggua

SEQ ID NO: 2966214 - RNA, 14 nt, Mycobacterium avium subsp. paratuberculosis
guguuccuugcggc

SEQ ID NO: 2966215 - RNA, 12 nt, Mycobacterium avium subsp. paratuberculosis
guguucgccgag

SEQ ID NO: 2966216 - RNA, 22 nt, Mycobacterium avium subsp. paratuberculosis
guguucgccgaggaaccggcag

SEQ ID NO: 2966217 - RNA, 16 nt, Mycobacterium avium subsp. paratuberculosis
guguucggcgccagcc

SEQ ID NO: 2966218 - RNA, 23 nt, Mycobacterium avium subsp. paratuberculosis
guguucgggaucggcgcccaccg

SEQ ID NO: 2966219 - RNA, 23 nt, Mycobacterium avium subsp. paratuberculosis
guguucgggcaguugccggccau

SEQ ID NO: 2966220 - RNA, 12 nt, Mycobacterium avium subsp. paratuberculosis
guguucucacgg

SEQ ID NO: 2966221 - RNA, 13 nt, Mycobacterium avium subsp. paratuberculosis
guguucucacggc

SEQ ID NO: 2966222 - RNA, 17 nt, Mycobacterium avium subsp. paratuberculosis
guguucucacggcgaau

SEQ ID NO: 2966223 - RNA, 19 nt, Mycobacterium avium subsp. paratuberculosis
guguugacguaacacccug

SEQ ID NO: 2966224 - RNA, 16 nt, Mycobacterium avium subsp. paratuberculosis
guguugaucauccggc

SEQ ID NO: 2966225 - RNA, 16 nt, Mycobacterium avium subsp. paratuberculosis
guguugaucucgucga

SEQ ID NO: 2966226 - RNA, 18 nt, Mycobacterium avium subsp. paratuberculosis
guguugccgacggcgccg

SEQ ID NO: 2966227 - RNA, 23 nt, Mycobacterium avium subsp. paratuberculosis
guguugccgacggcgccggugcc

SEQ ID NO: 2966228 - RNA, 12 nt, Mycobacterium avium subsp. paratuberculosis
guguugcucugg

SEQ ID NO: 2966229 - RNA, 15 nt, Mycobacterium avium subsp. paratuberculosis
guguuggcggcgucg

SEQ ID NO: 2966230 - RNA, 19 nt, Mycobacterium avium subsp. paratuberculosis
guguuguuugagaacucaa

SEQ ID NO: 2966231 - RNA, 13 nt, Mycobacterium avium subsp. paratuberculosis
guguuucggucgg

SEQ ID NO: 2966232 - RNA, 17 nt, Mycobacterium avium subsp. paratuberculosis
guuaagacuucggcgaa

SEQ ID NO: 2966233 - RNA, 14 nt, Mycobacterium avium subsp. paratuberculosis
guuaagugcccgcc

SEQ ID NO: 2966234 - RNA, 13 nt, Mycobacterium avium subsp. paratuberculosis
guuaccagcucac

SEQ ID NO: 2966235 - RNA, 20 nt, Mycobacterium avium subsp. paratuberculosis
guuacccgaacccagcgccu

SEQ ID NO: 2966236 - RNA, 20 nt, Mycobacterium avium subsp. paratuberculosis
guuagggcgucaggcgcugg

SEQ ID NO: 2966237 - RNA, 18 nt, Mycobacterium avium subsp. paratuberculosis
guuagguacgcggcuggc

SEQ ID NO: 2966238 - RNA, 18 nt, Mycobacterium avium subsp. paratuberculosis
guuccgacaucagugcgg

SEQ ID NO: 2966239 - RNA, 15 nt, Mycobacterium avium subsp. paratuberculosis
guuccgccacggcgg

SEQ ID NO: 2966240 - RNA, 21 nt, Mycobacterium avium subsp. paratuberculosis
guuccgcgacaucggugaccg

SEQ ID NO: 2966241 - RNA, 14 nt, Mycobacterium avium subsp. paratuberculosis
guuccgcgucggcc

SEQ ID NO: 2966242 - RNA, 18 nt, Mycobacterium avium subsp. paratuberculosis
guuccgcgucggccccca

SEQ ID NO: 2966243 - RNA, 13 nt, Mycobacterium avium subsp. paratuberculosis
guuccggcgagau

SEQ ID NO: 2966244 - RNA, 20 nt, Mycobacterium avium subsp. paratuberculosis
guuccggcgagaucuucucc

SEQ ID NO: 2966245 - RNA, 15 nt, Mycobacterium avium subsp. paratuberculosis
guuccggcggccggc

SEQ ID NO: 2966246 - RNA, 18 nt, Mycobacterium avium subsp. paratuberculosis
guuccggcggccggcggc

SEQ ID NO: 2966247 - RNA, 14 nt, Mycobacterium avium subsp. paratuberculosis
guuccggcgguccu

SEQ ID NO: 2966248 - RNA, 16 nt, Mycobacterium avium subsp. paratuberculosis
guuccggcgguccugc

SEQ ID NO: 2966249 - RNA, 14 nt, Mycobacterium avium subsp. paratuberculosis
guuccggcgugcag

SEQ ID NO: 2966250 - RNA, 23 nt, Mycobacterium avium subsp. paratuberculosis
guuccgggcgaccccggccagga

SEQ ID NO: 2966251 - RNA, 19 nt, Mycobacterium avium subsp. paratuberculosis
guuccgguggacuccagca

SEQ ID NO: 2966252 - RNA, 13 nt, Mycobacterium avium subsp. paratuberculosis
guuccgguggcgc

SEQ ID NO: 2966253 - RNA, 14 nt, Mycobacterium avium subsp. paratuberculosis
guuccggugucgag

SEQ ID NO: 2966254 - RNA, 17 nt, Mycobacterium avium subsp. paratuberculosis
guuccggugucgagccg

SEQ ID NO: 2966255 - RNA, 19 nt, Mycobacterium avium subsp. paratuberculosis
guuccggugucgagccggu

SEQ ID NO: 2966256 - RNA, 17 nt, Mycobacterium avium subsp. paratuberculosis
guuccgguuggccaggu

SEQ ID NO: 2966257 - RNA, 21 nt, Mycobacterium avium subsp. paratuberculosis
guuccucgaacaggcuggcca

SEQ ID NO: 2966258 - RNA, 15 nt, Mycobacterium avium subsp. paratuberculosis
guuccucgacggcga

SEQ ID NO: 2966259 - RNA, 22 nt, Mycobacterium avium subsp. paratuberculosis
guuccucgacguaggccagauc

SEQ ID NO: 2966260 - RNA, 12 nt, Mycobacterium avium subsp. paratuberculosis
guuccucggcgu

SEQ ID NO: 2966261 - RNA, 14 nt, Mycobacterium avium subsp. paratuberculosis
guuccugcaugccg

SEQ ID NO: 2966262 - RNA, 17 nt, Mycobacterium avium subsp. paratuberculosis
guuccugcaugccgggc

SEQ ID NO: 2966263 - RNA, 16 nt, Mycobacterium avium subsp. paratuberculosis
guuccuuacgccgacg

SEQ ID NO: 2966264 - RNA, 17 nt, Mycobacterium avium subsp. paratuberculosis
guuccuugauccggccg

SEQ ID NO: 2966265 - RNA, 14 nt, Mycobacterium avium subsp. paratuberculosis
guuccuugcgcagc

SEQ ID NO: 2966266 - RNA, 15 nt, Mycobacterium avium subsp. paratuberculosis
guuccuugcgcagca

SEQ ID NO: 2966267 - RNA, 18 nt, Mycobacterium avium subsp. paratuberculosis
guuccuugcggccgccga

SEQ ID NO: 2966268 - RNA, 13 nt, Mycobacterium avium subsp. paratuberculosis
guucgaagcgcag

SEQ ID NO: 2966269 - RNA, 15 nt, Mycobacterium avium subsp. paratuberculosis
guucgaagcgcagcg

SEQ ID NO: 2966270 - RNA, 13 nt, Mycobacterium avium subsp. paratuberculosis
guucgaccggcac

SEQ ID NO: 2966271 - RNA, 17 nt, Mycobacterium avium subsp. paratuberculosis
guucgaccggcaccagc

SEQ ID NO: 2966272 - RNA, 21 nt, Mycobacterium avium subsp. paratuberculosis
guucgaccggcaccagcagcc

SEQ ID NO: 2966273 - RNA, 14 nt, Mycobacterium avium subsp. paratuberculosis
guucgaccggcguc

SEQ ID NO: 2966274 - RNA, 17 nt, Mycobacterium avium subsp. paratuberculosis
guucgaccuccacccgc

SEQ ID NO: 2966275 - RNA, 19 nt, Mycobacterium avium subsp. paratuberculosis
guucgacguagcccgccga

SEQ ID NO: 2966276 - RNA, 18 nt, Mycobacterium avium subsp. paratuberculosis
guucgacgucacgacggu

SEQ ID NO: 2966277 - RNA, 14 nt, Mycobacterium avium subsp. paratuberculosis
guucgagcgccgcg

SEQ ID NO: 2966278 - RNA, 17 nt, Mycobacterium avium subsp. paratuberculosis
guucgagcgccgcggcc

SEQ ID NO: 2966279 - RNA, 14 nt, Mycobacterium avium subsp. paratuberculosis
guucgagggcgcgg

SEQ ID NO: 2966280 - RNA, 18 nt, Mycobacterium avium subsp. paratuberculosis
guucgagggcgcggcgua

SEQ ID NO: 2966281 - RNA, 19 nt, Mycobacterium avium subsp. paratuberculosis
guucgagggcgcggcguag

SEQ ID NO: 2966282 - RNA, 24 nt, Mycobacterium avium subsp. paratuberculosis
guucgagggcgcggcguagccgcc

SEQ ID NO: 2966283 - RNA, 17 nt, Mycobacterium avium subsp. paratuberculosis
guucgaggugcucgcgc

SEQ ID NO: 2966284 - RNA, 19 nt, Mycobacterium avium subsp. paratuberculosis
guucgaguaggcgaccaca

SEQ ID NO: 2966285 - RNA, 21 nt, Mycobacterium avium subsp. paratuberculosis
guucgaguucgucgaccagcg

SEQ ID NO: 2966286 - RNA, 19 nt, Mycobacterium avium subsp. paratuberculosis
guucgauaccguccgcgcc

SEQ ID NO: 2966287 - RNA, 22 nt, Mycobacterium avium subsp. paratuberculosis
guucgauaccguccgcgcccac

SEQ ID NO: 2966288 - RNA, 13 nt, Mycobacterium avium subsp. paratuberculosis
guucgauaucgcc

SEQ ID NO: 2966289 - RNA, 17 nt, Mycobacterium avium subsp. paratuberculosis
guucgauaucgcccagg

SEQ ID NO: 2966290 - RNA, 13 nt, Mycobacterium avium subsp. paratuberculosis
guucgaucaccga

SEQ ID NO: 2966291 - RNA, 21 nt, Mycobacterium avium subsp. paratuberculosis
guucgaucagcagcucggugg

SEQ ID NO: 2966292 - RNA, 22 nt, Mycobacterium avium subsp. paratuberculosis
guucgaucagcagcucgguggc

SEQ ID NO: 2966293 - RNA, 19 nt, Mycobacterium avium subsp. paratuberculosis
guucgauccgccggugccg

SEQ ID NO: 2966294 - RNA, 19 nt, Mycobacterium avium subsp. paratuberculosis
guucgaucuccucggcgua

SEQ ID NO: 2966295 - RNA, 15 nt, Mycobacterium avium subsp. paratuberculosis
guucgaucucgucgg

SEQ ID NO: 2966296 - RNA, 15 nt, Mycobacterium avium subsp. paratuberculosis
guucgaugcccugcc

SEQ ID NO: 2966297 - RNA, 13 nt, Mycobacterium avium subsp. paratuberculosis
guucgaugcgcuc

SEQ ID NO: 2966298 - RNA, 20 nt, Mycobacterium avium subsp. paratuberculosis
guucgaugucggccagcgcg

SEQ ID NO: 2966299 - RNA, 14 nt, Mycobacterium avium subsp. paratuberculosis
guucgcccuccccg

SEQ ID NO: 2966300 - RNA, 17 nt, Mycobacterium avium subsp. paratuberculosis
guucgcccuccccggcc

SEQ ID NO: 2966301 - RNA, 20 nt, Mycobacterium avium subsp. paratuberculosis
guucgcccuccccggccagc

SEQ ID NO: 2966302 - RNA, 15 nt, Mycobacterium avium subsp. paratuberculosis
guucgcccuggccgc

SEQ ID NO: 2966303 - RNA, 16 nt, Mycobacterium avium subsp. paratuberculosis
guucgccgacaccgca

SEQ ID NO: 2966304 - RNA, 14 nt, Mycobacterium avium subsp. paratuberculosis
guucgccgacagca

SEQ ID NO: 2966305 - RNA, 19 nt, Mycobacterium avium subsp. paratuberculosis
guucgccgacagcagcuca

SEQ ID NO: 2966306 - RNA, 19 nt, Mycobacterium avium subsp. paratuberculosis
guucgccgaggaaccggca

SEQ ID NO: 2966307 - RNA, 12 nt, Mycobacterium avium subsp. paratuberculosis
guucgccgaugu

SEQ ID NO: 2966308 - RNA, 23 nt, Mycobacterium avium subsp. paratuberculosis
guucgccgauguccccgcgggug

SEQ ID NO: 2966309 - RNA, 22 nt, Mycobacterium avium subsp. paratuberculosis
guucgccggaauggcaaggcca

SEQ ID NO: 2966310 - RNA, 15 nt, Mycobacterium avium subsp. paratuberculosis
guucgccggccagca

SEQ ID NO: 2966311 - RNA, 17 nt, Mycobacterium avium subsp. paratuberculosis
guucgccggccagcacg

SEQ ID NO: 2966312 - RNA, 12 nt, Mycobacterium avium subsp. paratuberculosis
guucgccggcga

SEQ ID NO: 2966313 - RNA, 17 nt, Mycobacterium avium subsp. paratuberculosis
guucgccggcgacggcc

SEQ ID NO: 2966314 - RNA, 20 nt, Mycobacterium avium subsp. paratuberculosis
guucgccggcgacggccagc

SEQ ID NO: 2966315 - RNA, 23 nt, Mycobacterium avium subsp. paratuberculosis
guucgccggcgacggccagcgcg

SEQ ID NO: 2966316 - RNA, 13 nt, Mycobacterium avium subsp. paratuberculosis
guucgccggcgua

SEQ ID NO: 2966317 - RNA, 16 nt, Mycobacterium avium subsp. paratuberculosis
guucgccgguaccgcc

SEQ ID NO: 2966318 - RNA, 19 nt, Mycobacterium avium subsp. paratuberculosis
guucgccgguaccgccggc

SEQ ID NO: 2966319 - RNA, 20 nt, Mycobacterium avium subsp. paratuberculosis
guucgccgguaccgccggcc

SEQ ID NO: 2966320 - RNA, 17 nt, Mycobacterium avium subsp. paratuberculosis
guucgccggugaccgcg

SEQ ID NO: 2966321 - RNA, 19 nt, Mycobacterium avium subsp. paratuberculosis
guucgccggugaccgcgcc

SEQ ID NO: 2966322 - RNA, 20 nt, Mycobacterium avium subsp. paratuberculosis
guucgccggugaccgcgccg

SEQ ID NO: 2966323 - RNA, 20 nt, Mycobacterium avium subsp. paratuberculosis
guucugcgugcggguggccg

SEQ ID NO: 2966324 - RNA, 13 nt, Mycobacterium avium subsp. paratuberculosis
guucugcucgaag

SEQ ID NO: 2966325 - RNA, 16 nt, Mycobacterium avium subsp. paratuberculosis
guucugcuuggcaggc

SEQ ID NO: 2966326 - RNA, 17 nt, Mycobacterium avium subsp. paratuberculosis
guucuggaugcccaggg

SEQ ID NO: 2966327 - RNA, 15 nt, Mycobacterium avium subsp. paratuberculosis
guucuggccgugguc

SEQ ID NO: 2966328 - RNA, 17 nt, Mycobacterium avium subsp. paratuberculosis
guucuggccguggucgg

SEQ ID NO: 2966329 - RNA, 17 nt, Mycobacterium avium subsp. paratuberculosis
guucuucgaugacggcc

SEQ ID NO: 2966330 - RNA, 22 nt, Mycobacterium avium subsp. paratuberculosis
guucuucgcgaagaacgacgcc

SEQ ID NO: 2966331 - RNA, 23 nt, Mycobacterium avium subsp. paratuberculosis
guucuucucacaggugacgacgc

SEQ ID NO: 2966332 - RNA, 13 nt, Mycobacterium avium subsp. paratuberculosis
guucuugcccgaa

SEQ ID NO: 2966333 - RNA, 16 nt, Mycobacterium avium subsp. paratuberculosis
guucuuggcggccugc

SEQ ID NO: 2966334 - RNA, 18 nt, Mycobacterium avium subsp. paratuberculosis
guucuuggcggccugcuc

SEQ ID NO: 2966335 - RNA, 16 nt, Mycobacterium avium subsp. paratuberculosis
guugaaaaacgcggug

SEQ ID NO: 2966336 - RNA, 15 nt, Mycobacterium avium subsp. paratuberculosis
guugaaaguccuugc

SEQ ID NO: 2966337 - RNA, 19 nt, Mycobacterium avium subsp. paratuberculosis
guugaaccgguacaggccc

SEQ ID NO: 2966338 - RNA, 16 nt, Mycobacterium avium subsp. paratuberculosis
guugaacgcgcgggug

SEQ ID NO: 2966339 - RNA, 14 nt, Mycobacterium avium subsp. paratuberculosis
guugaacggcaccc

SEQ ID NO: 2966340 - RNA, 17 nt, Mycobacterium avium subsp. paratuberculosis
guugaacggcaccccgc

SEQ ID NO: 2966341 - RNA, 15 nt, Mycobacterium avium subsp. paratuberculosis
guugaagcuggccac

SEQ ID NO: 2966342 - RNA, 16 nt, Mycobacterium avium subsp. paratuberculosis
guugaagcuggccacc

SEQ ID NO: 2966343 - RNA, 14 nt, Mycobacterium avium subsp. paratuberculosis
guugaagucgauca

SEQ ID NO: 2966344 - RNA, 14 nt, Mycobacterium avium subsp. paratuberculosis
guugaaguuggcca

SEQ ID NO: 2966345 - RNA, 15 nt, Mycobacterium avium subsp. paratuberculosis
guugacaccaccgag

SEQ ID NO: 2966346 - RNA, 22 nt, Mycobacterium avium subsp. paratuberculosis
guugacaccgggugcguccaga

SEQ ID NO: 2966347 - RNA, 17 nt, Mycobacterium avium subsp. paratuberculosis
guugaccaacgccgccu

SEQ ID NO: 2966348 - RNA, 15 nt, Mycobacterium avium subsp. paratuberculosis
guugaccaccaggua

SEQ ID NO: 2966349 - RNA, 17 nt, Mycobacterium avium subsp. paratuberculosis
guugaccacccgcagcg

SEQ ID NO: 2966350 - RNA, 21 nt, Mycobacterium avium subsp. paratuberculosis
guugaccacccgcagcgaggc

SEQ ID NO: 2966351 - RNA, 22 nt, Mycobacterium avium subsp. paratuberculosis
guugaccaggugggcggccacc

SEQ ID NO: 2966352 - RNA, 17 nt, Mycobacterium avium subsp. paratuberculosis
guugaccccgacggcgc

SEQ ID NO: 2966353 - RNA, 17 nt, Mycobacterium avium subsp. paratuberculosis
guugaccccggccccgg

SEQ ID NO: 2966354 - RNA, 18 nt, Mycobacterium avium subsp. paratuberculosis
guugaccccggccccggc

SEQ ID NO: 2966355 - RNA, 17 nt, Mycobacterium avium subsp. paratuberculosis
guugacccggccggucg

SEQ ID NO: 2966356 - RNA, 16 nt, Mycobacterium avium subsp. paratuberculosis
guugacccucagcagg

SEQ ID NO: 2966357 - RNA, 19 nt, Mycobacterium avium subsp. paratuberculosis
guugacccucagcagggcg

SEQ ID NO: 2966358 - RNA, 14 nt, Mycobacterium avium subsp. paratuberculosis
guugaccgacgccu

SEQ ID NO: 2966359 - RNA, 22 nt, Mycobacterium avium subsp. paratuberculosis
guugaccgaggcgaucgcggcc

SEQ ID NO: 2966360 - RNA, 23 nt, Mycobacterium avium subsp. paratuberculosis
guugaccgaggcgaucgcggcca

SEQ ID NO: 2966361 - RNA, 14 nt, Mycobacterium avium subsp. paratuberculosis
guugaccgccgaca

SEQ ID NO: 2966362 - RNA, 14 nt, Mycobacterium avium subsp. paratuberculosis
guugaccgcggcga

SEQ ID NO: 2966363 - RNA, 14 nt, Mycobacterium avium subsp. paratuberculosis
guugaccggccggu

SEQ ID NO: 2966364 - RNA, 16 nt, Mycobacterium avium subsp. paratuberculosis
guugaccgggucgccg

SEQ ID NO: 2966365 - RNA, 18 nt, Mycobacterium avium subsp. paratuberculosis
guugaccgggucgccgau

SEQ ID NO: 2966366 - RNA, 14 nt, Mycobacterium avium subsp. paratuberculosis
guugaccggugcgc

SEQ ID NO: 2966367 - RNA, 18 nt, Mycobacterium avium subsp. paratuberculosis
guugaccguugcgcccca

SEQ ID NO: 2966368 - RNA, 20 nt, Mycobacterium avium subsp. paratuberculosis
guugaccuucucgaccaggc

SEQ ID NO: 2966369 - RNA, 14 nt, Mycobacterium avium subsp. paratuberculosis
guugaccuugacca

SEQ ID NO: 2966370 - RNA, 23 nt, Mycobacterium avium subsp. paratuberculosis
guugacgcauucaaugucgcccu

SEQ ID NO: 2966371 - RNA, 16 nt, Mycobacterium avium subsp. paratuberculosis
guugacgcccccggug

SEQ ID NO: 2966372 - RNA, 19 nt, Mycobacterium avium subsp. paratuberculosis
guugacgcccccggugacg

SEQ ID NO: 2966373 - RNA, 20 nt, Mycobacterium avium subsp. paratuberculosis
guugacgcccccggugacga

SEQ ID NO: 2966374 - RNA, 14 nt, Mycobacterium avium subsp. paratuberculosis
guugacgccgaugc

SEQ ID NO: 2966375 - RNA, 15 nt, Mycobacterium avium subsp. paratuberculosis
guugacgggccgcgg

SEQ ID NO: 2966376 - RNA, 18 nt, Mycobacterium avium subsp. paratuberculosis
guugacggugaccggcgc

SEQ ID NO: 2966377 - RNA, 19 nt, Mycobacterium avium subsp. paratuberculosis
guugacguagacgacgggc

SEQ ID NO: 2966378 - RNA, 15 nt, Mycobacterium avium subsp. paratuberculosis
guugacgucggugua

SEQ ID NO: 2966379 - RNA, 17 nt, Mycobacterium avium subsp. paratuberculosis
guugacgugcaccggcg

SEQ ID NO: 2966380 - RNA, 23 nt, Mycobacterium avium subsp. paratuberculosis
guugacguugaucgcgccgaucu

SEQ ID NO: 2966381 - RNA, 16 nt, Mycobacterium avium subsp. paratuberculosis
guugacuccucugcca

SEQ ID NO: 2966382 - RNA, 16 nt, Mycobacterium avium subsp. paratuberculosis
guugagcacacacagg

SEQ ID NO: 2966383 - RNA, 21 nt, Mycobacterium avium subsp. paratuberculosis
guugagcacacacaggucgcc

SEQ ID NO: 2966384 - RNA, 14 nt, Mycobacterium avium subsp. paratuberculosis
guugagcaccacga

SEQ ID NO: 2966385 - RNA, 23 nt, Mycobacterium avium subsp. paratuberculosis
guugagcacccggaugucguaga

SEQ ID NO: 2966386 - RNA, 13 nt, Mycobacterium avium subsp. paratuberculosis
guugagcaccgcg

SEQ ID NO: 2966387 - RNA, 16 nt, Mycobacterium avium subsp. paratuberculosis
guugagcacgcccgcg

SEQ ID NO: 2966388 - RNA, 20 nt, Mycobacterium avium subsp. paratuberculosis
guugagcagauccugcagcu

SEQ ID NO: 2966389 - RNA, 22 nt, Mycobacterium avium subsp. paratuberculosis
guugagccacaacaugucccgg

SEQ ID NO: 2966390 - RNA, 15 nt, Mycobacterium avium subsp. paratuberculosis
guugagcccggaccg

SEQ ID NO: 2966391 - RNA, 17 nt, Mycobacterium avium subsp. paratuberculosis
guugagcccggaccggc

SEQ ID NO: 2966392 - RNA, 20 nt, Mycobacterium avium subsp. paratuberculosis
guugagcccggaccggccgu

SEQ ID NO: 2966393 - RNA, 17 nt, Mycobacterium avium subsp. paratuberculosis
guugagccggcgcaccg

SEQ ID NO: 2966394 - RNA, 19 nt, Mycobacterium avium subsp. paratuberculosis
guugagccggcgcaccgcg

SEQ ID NO: 2966395 - RNA, 16 nt, Mycobacterium avium subsp. paratuberculosis
guugagcgucgccacc

SEQ ID NO: 2966396 - RNA, 19 nt, Mycobacterium avium subsp. paratuberculosis
guugagcguggacaccgca

SEQ ID NO: 2966397 - RNA, 21 nt, Mycobacterium avium subsp. paratuberculosis
guugagcguggcagcggucgg

SEQ ID NO: 2966398 - RNA, 14 nt, Mycobacterium avium subsp. paratuberculosis
guugagcuucucgg

SEQ ID NO: 2966399 - RNA, 17 nt, Mycobacterium avium subsp. paratuberculosis
guugagcuucucgguga

SEQ ID NO: 2966400 - RNA, 16 nt, Mycobacterium avium subsp. paratuberculosis
guugaggaucugcacg

SEQ ID NO: 2966401 - RNA, 16 nt, Mycobacterium avium subsp. paratuberculosis
guugaggaugucgacg

SEQ ID NO: 2966402 - RNA, 22 nt, Mycobacterium avium subsp. paratuberculosis
guugaggcggcggcgggccagg

SEQ ID NO: 2966403 - RNA, 19 nt, Mycobacterium avium subsp. paratuberculosis
guugagggcggggcagcag

SEQ ID NO: 2966404 - RNA, 18 nt, Mycobacterium avium subsp. paratuberculosis
guugagucccucggcgag

SEQ ID NO: 2966405 - RNA, 15 nt, Mycobacterium avium subsp. paratuberculosis
guugagugcgccgug

SEQ ID NO: 2966406 - RNA, 18 nt, Mycobacterium avium subsp. paratuberculosis
guugauacucgggcaacg

SEQ ID NO: 2966407 - RNA, 16 nt, Mycobacterium avium subsp. paratuberculosis
guugaucacaccgucg

SEQ ID NO: 2966408 - RNA, 18 nt, Mycobacterium avium subsp. paratuberculosis
guugcgcggaccggcgau

SEQ ID NO: 2966409 - RNA, 15 nt, Mycobacterium avium subsp. paratuberculosis
guugcgcggccgcau

SEQ ID NO: 2966410 - RNA, 15 nt, Mycobacterium avium subsp. paratuberculosis
guugcgcggcggcca

SEQ ID NO: 2966411 - RNA, 18 nt, Mycobacterium avium subsp. paratuberculosis
guugcgcguucaagccgc

SEQ ID NO: 2966412 - RNA, 19 nt, Mycobacterium avium subsp. paratuberculosis
guugcgcuggaugaagguc

SEQ ID NO: 2966413 - RNA, 18 nt, Mycobacterium avium subsp. paratuberculosis
guugcggaucaugcgcgu

SEQ ID NO: 2966414 - RNA, 18 nt, Mycobacterium avium subsp. paratuberculosis
guugcggaucgaacggcg

SEQ ID NO: 2966415 - RNA, 21 nt, Mycobacterium avium subsp. paratuberculosis
guugcggaucgaacggcggaa

SEQ ID NO: 2966416 - RNA, 22 nt, Mycobacterium avium subsp. paratuberculosis
guugcggaucggugcaggccgc

SEQ ID NO: 2966417 - RNA, 22 nt, Mycobacterium avium subsp. paratuberculosis
guugcggcaccggcgaauccga

SEQ ID NO: 2966418 - RNA, 14 nt, Mycobacterium avium subsp. paratuberculosis
guugcggcagcaca

SEQ ID NO: 2966419 - RNA, 16 nt, Mycobacterium avium subsp. paratuberculosis
guugcggcagggccac

SEQ ID NO: 2966420 - RNA, 17 nt, Mycobacterium avium subsp. paratuberculosis
guugcggcccacgguga

SEQ ID NO: 2966421 - RNA, 18 nt, Mycobacterium avium subsp. paratuberculosis
guugcggccccgccagca

SEQ ID NO: 2966422 - RNA, 21 nt, Mycobacterium avium subsp. paratuberculosis
guugcggccgcuucccacccg

SEQ ID NO: 2966423 - RNA, 13 nt, Mycobacterium avium subsp. paratuberculosis
guugcggccggcc

SEQ ID NO: 2966424 - RNA, 17 nt, Mycobacterium avium subsp. paratuberculosis
guugcggccggccauga

SEQ ID NO: 2966425 - RNA, 14 nt, Mycobacterium avium subsp. paratuberculosis
guugcggccggcgg

SEQ ID NO: 2966426 - RNA, 20 nt, Mycobacterium avium subsp. paratuberculosis
guugcggccggcggugucgu

SEQ ID NO: 2966427 - RNA, 19 nt, Mycobacterium avium subsp. paratuberculosis
guugcggcgcagcgucucg

SEQ ID NO: 2966428 - RNA, 23 nt, Mycobacterium avium subsp. paratuberculosis
guugcggcggccggccagcagcc

SEQ ID NO: 2966429 - RNA, 12 nt, Mycobacterium avium subsp. paratuberculosis
guugcggcgggc

SEQ ID NO: 2966430 - RNA, 22 nt, Mycobacterium avium subsp. paratuberculosis
guugcggcgucagguccgcgaa

SEQ ID NO: 2966431 - RNA, 14 nt, Mycobacterium avium subsp. paratuberculosis
guugcgggccaggu

SEQ ID NO: 2966432 - RNA, 14 nt, Mycobacterium avium subsp. paratuberculosis
guugcgggcggcgc

SEQ ID NO: 2966433 - RNA, 17 nt, Mycobacterium avium subsp. paratuberculosis
guugcgguggccgauca

SEQ ID NO: 2966434 - RNA, 19 nt, Mycobacterium avium subsp. paratuberculosis
guugcgguguugcgcagcg

SEQ ID NO: 2966435 - RNA, 19 nt, Mycobacterium avium subsp. paratuberculosis
guugcgguugccccacccc

SEQ ID NO: 2966436 - RNA, 17 nt, Mycobacterium avium subsp. paratuberculosis
guugcgugacuugucgg

SEQ ID NO: 2966437 - RNA, 19 nt, Mycobacterium avium subsp. paratuberculosis
guugcgugacuugucgggc

SEQ ID NO: 2966438 - RNA, 16 nt, Mycobacterium avium subsp. paratuberculosis
guugcgugcagccgca

SEQ ID NO: 2966439 - RNA, 14 nt, Mycobacterium avium subsp. paratuberculosis
guugcuccggcguc

SEQ ID NO: 2966440 - RNA, 18 nt, Mycobacterium avium subsp. paratuberculosis
guugcucggggcucgcgg

SEQ ID NO: 2966441 - RNA, 19 nt, Mycobacterium avium subsp. paratuberculosis
guugcucggggcucgcggu

SEQ ID NO: 2966442 - RNA, 12 nt, Mycobacterium avium subsp. paratuberculosis
guugcucgucgg

SEQ ID NO: 2966443 - RNA, 15 nt, Mycobacterium avium subsp. paratuberculosis
guugcugagccgccg

SEQ ID NO: 2966444 - RNA, 14 nt, Mycobacterium avium subsp. paratuberculosis
guugcuggcgcgau

SEQ ID NO: 2966445 - RNA, 14 nt, Mycobacterium avium subsp. paratuberculosis
guugcuggcgucgu

SEQ ID NO: 2966446 - RNA, 16 nt, Mycobacterium avium subsp. paratuberculosis
guugcuguacuggggu

SEQ ID NO: 2966447 - RNA, 19 nt, Mycobacterium avium subsp. paratuberculosis
guugcuguacugggguguc

SEQ ID NO: 2966448 - RNA, 21 nt, Mycobacterium avium subsp. paratuberculosis
guugcuuggguugcuccucgg

SEQ ID NO: 2966449 - RNA, 14 nt, Mycobacterium avium subsp. paratuberculosis
guuggaaccggcca

SEQ ID NO: 2966450 - RNA, 16 nt, Mycobacterium avium subsp. paratuberculosis
guuggaaccggccacc

SEQ ID NO: 2966451 - RNA, 15 nt, Mycobacterium avium subsp. paratuberculosis
guuggacaggccggc

SEQ ID NO: 2966452 - RNA, 22 nt, Mycobacterium avium subsp. paratuberculosis
guuggacuccaccgccaccgcg

SEQ ID NO: 2966453 - RNA, 21 nt, Mycobacterium avium subsp. paratuberculosis
guuggcacccgaccgacgccc

SEQ ID NO: 2966454 - RNA, 11 nt, Mycobacterium avium subsp. paratuberculosis
guuggcaggcc

SEQ ID NO: 2966455 - RNA, 15 nt, Mycobacterium avium subsp. paratuberculosis
guuggcaucccgcgc

SEQ ID NO: 2966456 - RNA, 16 nt, Mycobacterium avium subsp. paratuberculosis
guuggcaucccgcgcc

SEQ ID NO: 2966457 - RNA, 23 nt, Mycobacterium avium subsp. paratuberculosis
guuggcaucccgcgccugccugg

SEQ ID NO: 2966458 - RNA, 16 nt, Mycobacterium avium subsp. paratuberculosis
guuggccagcaccgcg

SEQ ID NO: 2966459 - RNA, 14 nt, Mycobacterium avium subsp. paratuberculosis
guuggccagguggc

SEQ ID NO: 2966460 - RNA, 18 nt, Mycobacterium avium subsp. paratuberculosis
guuggcccacagcuugcc

SEQ ID NO: 2966461 - RNA, 16 nt, Mycobacterium avium subsp. paratuberculosis
guuggcccgcaccacc

SEQ ID NO: 2966462 - RNA, 17 nt, Mycobacterium avium subsp. paratuberculosis
guuggcccgcaccaccc

SEQ ID NO: 2966463 - RNA, 19 nt, Mycobacterium avium subsp. paratuberculosis
guuggcccgcacccgccgc

SEQ ID NO: 2966464 - RNA, 15 nt, Mycobacterium avium subsp. paratuberculosis
guuggcccgccgcgg

SEQ ID NO: 2966465 - RNA, 12 nt, Mycobacterium avium subsp. paratuberculosis
guuggcccgcgg

SEQ ID NO: 2966466 - RNA, 17 nt, Mycobacterium avium subsp. paratuberculosis
guuggcccgcggcgccc

SEQ ID NO: 2966467 - RNA, 14 nt, Mycobacterium avium subsp. paratuberculosis
guuggcccugcucu

SEQ ID NO: 2966468 - RNA, 16 nt, Mycobacterium avium subsp. paratuberculosis
guuggcccuucgaccu

SEQ ID NO: 2966469 - RNA, 13 nt, Mycobacterium avium subsp. paratuberculosis
guuggccgcgacg

SEQ ID NO: 2966470 - RNA, 17 nt, Mycobacterium avium subsp. paratuberculosis
guuggccgcgacgccgc

SEQ ID NO: 2966471 - RNA, 14 nt, Mycobacterium avium subsp. paratuberculosis
guuggccggcccgc

SEQ ID NO: 2966472 - RNA, 16 nt, Mycobacterium avium subsp. paratuberculosis
guuggccggcccgccc

SEQ ID NO: 2966473 - RNA, 15 nt, Mycobacterium avium subsp. paratuberculosis
guuggccggccgggc

SEQ ID NO: 2966474 - RNA, 13 nt, Mycobacterium avium subsp. paratuberculosis
guuggccgucgcg

SEQ ID NO: 2966475 - RNA, 20 nt, Mycobacterium avium subsp. paratuberculosis
guuggccucccacaggucga

SEQ ID NO: 2966476 - RNA, 17 nt, Mycobacterium avium subsp. paratuberculosis
guuggccuccucgguga

SEQ ID NO: 2966477 - RNA, 16 nt, Mycobacterium avium subsp. paratuberculosis
guuggcgacgacggcg

SEQ ID NO: 2966478 - RNA, 18 nt, Mycobacterium avium subsp. paratuberculosis
guuggcgaucagggcggc

SEQ ID NO: 2966479 - RNA, 20 nt, Mycobacterium avium subsp. paratuberculosis
guuggcgaucagggcggcgc

SEQ ID NO: 2966480 - RNA, 18 nt, Mycobacterium avium subsp. paratuberculosis
guuggcgccgggcccggu

SEQ ID NO: 2966481 - RNA, 16 nt, Mycobacterium avium subsp. paratuberculosis
guuggcgccggucgac

SEQ ID NO: 2966482 - RNA, 13 nt, Mycobacterium avium subsp. paratuberculosis
guuggcgccggug

SEQ ID NO: 2966483 - RNA, 14 nt, Mycobacterium avium subsp. paratuberculosis
guuggcgccgguga

SEQ ID NO: 2966484 - RNA, 23 nt, Mycobacterium avium subsp. paratuberculosis
guuggcgccguccgcggcggcca

SEQ ID NO: 2966485 - RNA, 16 nt, Mycobacterium avium subsp. paratuberculosis
guuggcgcgcaccagc

SEQ ID NO: 2966486 - RNA, 17 nt, Mycobacterium avium subsp. paratuberculosis
guuggcgcucaacguga

SEQ ID NO: 2966487 - RNA, 19 nt, Mycobacterium avium subsp. paratuberculosis
guuggcgcucaacgugaua

SEQ ID NO: 2966488 - RNA, 22 nt, Mycobacterium avium subsp. paratuberculosis
guuggcggacucguuggggcca

SEQ ID NO: 2966489 - RNA, 17 nt, Mycobacterium avium subsp. paratuberculosis
guuggcggccagcgcgc

SEQ ID NO: 2966490 - RNA, 18 nt, Mycobacterium avium subsp. paratuberculosis
guuggcggccagcgcgcc

SEQ ID NO: 2966491 - RNA, 22 nt, Mycobacterium avium subsp. paratuberculosis
guuggcggccagcgcgccgccg

SEQ ID NO: 2966492 - RNA, 17 nt, Mycobacterium avium subsp. paratuberculosis
guuggcggcgucgucgc

SEQ ID NO: 2966493 - RNA, 20 nt, Mycobacterium avium subsp. paratuberculosis
guuuccggcuucaaaaaccu

SEQ ID NO: 2966494 - RNA, 22 nt, Mycobacterium avium subsp. paratuberculosis
guuuccggugcucccccggacc

SEQ ID NO: 2966495 - RNA, 17 nt, Mycobacterium avium subsp. paratuberculosis
guuuccguccggcgaca

SEQ ID NO: 2966496 - RNA, 13 nt, Mycobacterium avium subsp. paratuberculosis
guuuccuggugca

SEQ ID NO: 2966497 - RNA, 20 nt, Mycobacterium avium subsp. paratuberculosis
guuuccuggugcaccaggua

SEQ ID NO: 2966498 - RNA, 14 nt, Mycobacterium avium subsp. paratuberculosis
guuucgaagacgcc

SEQ ID NO: 2966499 - RNA, 19 nt, Mycobacterium avium subsp. paratuberculosis
guuucgaccugcgggugca

SEQ ID NO: 2966500 - RNA, 17 nt, Mycobacterium avium subsp. paratuberculosis
guuucgaggaucugggc

SEQ ID NO: 2966501 - RNA, 16 nt, Mycobacterium avium subsp. paratuberculosis
guuucggcccuccagc

SEQ ID NO: 2966502 - RNA, 13 nt, Mycobacterium avium subsp. paratuberculosis
guuucggccggcc

SEQ ID NO: 2966503 - RNA, 16 nt, Mycobacterium avium subsp. paratuberculosis
guuucgggucgagagc

SEQ ID NO: 2966504 - RNA, 14 nt, Mycobacterium avium subsp. paratuberculosis
guuucggucggcgu

SEQ ID NO: 2966505 - RNA, 16 nt, Mycobacterium avium subsp. paratuberculosis
guuucggucggcgucg

SEQ ID NO: 2966506 - RNA, 17 nt, Mycobacterium avium subsp. paratuberculosis
guuucggucggcgucga

SEQ ID NO: 2966507 - RNA, 21 nt, Mycobacterium avium subsp. paratuberculosis
guuucgucucuuccucgggca

SEQ ID NO: 2966508 - RNA, 18 nt, Mycobacterium avium subsp. paratuberculosis
guuucgugaacgacgccg

SEQ ID NO: 2966509 - RNA, 20 nt, Mycobacterium avium subsp. paratuberculosis
guuucgugugcucagcuccc

SEQ ID NO: 2966510 - RNA, 23 nt, Mycobacterium avium subsp. paratuberculosis
guuucgugugguacagcgccagc

SEQ ID NO: 2966511 - RNA, 15 nt, Mycobacterium avium subsp. paratuberculosis
guuucugccggccgc

SEQ ID NO: 2966512 - RNA, 18 nt, Mycobacterium avium subsp. paratuberculosis
guuugagcgugccgccgg

SEQ ID NO: 2966513 - RNA, 17 nt, Mycobacterium avium subsp. paratuberculosis
guuugaucaccaccugg

SEQ ID NO: 2966514 - RNA, 20 nt, Mycobacterium avium subsp. paratuberculosis
guuugcaggcgaucucgccg

SEQ ID NO: 2966515 - RNA, 13 nt, Mycobacterium avium subsp. paratuberculosis
guuugcgccggcu

SEQ ID NO: 2966516 - RNA, 17 nt, Mycobacterium avium subsp. paratuberculosis
guuugcgggucgguggg

SEQ ID NO: 2966517 - RNA, 11 nt, Mycobacterium avium subsp. paratuberculosis
guuuggccagc

SEQ ID NO: 2966518 - RNA, 23 nt, Mycobacterium avium subsp. paratuberculosis
guuuggccugaaccagcucgugc

SEQ ID NO: 2966519 - RNA, 22 nt, Mycobacterium avium subsp. paratuberculosis
guuuggccugcggcaacagcac

SEQ ID NO: 2966520 - RNA, 14 nt, Mycobacterium avium subsp. paratuberculosis
guuugggcgugcgg

SEQ ID NO: 2966521 - RNA, 14 nt, Mycobacterium avium subsp. paratuberculosis
guuuggugguggcg

SEQ ID NO: 2966522 - RNA, 15 nt, Mycobacterium avium subsp. paratuberculosis
guuugguguucgggc

SEQ ID NO: 2966523 - RNA, 19 nt, Mycobacterium avium subsp. paratuberculosis
guuugucccuugggcggau

SEQ ID NO: 2966524 - RNA, 21 nt, Mycobacterium avium subsp. paratuberculosis
guuuguccugcucggcgacgc

SEQ ID NO: 2966525 - RNA, 17 nt, Mycobacterium avium subsp. paratuberculosis
guuuuccuucggugcgu

SEQ ID NO: 2966526 - RNA, 21 nt, Mycobacterium avium subsp. paratuberculosis
guuuucggcgcgcagcucgcg

SEQ ID NO: 2966527 - RNA, 17 nt, Mycobacterium avium subsp. paratuberculosis
guuuucggcgcgcgccg

SEQ ID NO: 2966528 - RNA, 21 nt, Mycobacterium avium subsp. paratuberculosis
guuuucgggccggucagcgcg

SEQ ID NO: 2966529 - RNA, 22 nt, Mycobacterium avium subsp. paratuberculosis
guuuucggugugccgcugcauc

SEQ ID NO: 2966530 - RNA, 17 nt, Mycobacterium avium subsp. paratuberculosis
guuuugaucagcccggg

SEQ ID NO: 2966531 - RNA, 16 nt, Mycobacterium avium subsp. paratuberculosis
guuuugaugccgccgg

SEQ ID NO: 2966532 - RNA, 17 nt, Mycobacterium avium subsp. paratuberculosis
guuuugcgucugcucgg

SEQ ID NO: 2966533 - RNA, 24 nt, Mycobacterium avium subsp. paratuberculosis
guuuugcgucugcucggcggcuca

SEQ ID NO: 2966534 - RNA, 14 nt, Mycobacterium avium subsp. paratuberculosis
uaaaccagcagcgc

SEQ ID NO: 2966535 - RNA, 14 nt, Mycobacterium avium subsp. paratuberculosis
uaaaccggccggcg

SEQ ID NO: 2966536 - RNA, 15 nt, Mycobacterium avium subsp. paratuberculosis
uaaagcauuggccca

SEQ ID NO: 2966537 - RNA, 15 nt, Mycobacterium avium subsp. paratuberculosis
uaaagccgaccgccc

SEQ ID NO: 2966538 - RNA, 15 nt, Mycobacterium avium subsp. paratuberculosis
uaaccaccggugacg

SEQ ID NO: 2966539 - RNA, 14 nt, Mycobacterium avium subsp. paratuberculosis
uaacccagcaccac

SEQ ID NO: 2966540 - RNA, 22 nt, Mycobacterium avium subsp. paratuberculosis
uaacccgggacccggaacccgc

SEQ ID NO: 2966541 - RNA, 15 nt, Mycobacterium avium subsp. paratuberculosis
uaaccgcgggcaucg

SEQ ID NO: 2966542 - RNA, 17 nt, Mycobacterium avium subsp. paratuberculosis
uaaccggcuuccgagac

SEQ ID NO: 2966543 - RNA, 19 nt, Mycobacterium avium subsp. paratuberculosis
uaaccguacggcccgaaca

SEQ ID NO: 2966544 - RNA, 14 nt, Mycobacterium avium subsp. paratuberculosis
uaaccguggcaggc

SEQ ID NO: 2966545 - RNA, 19 nt, Mycobacterium avium subsp. paratuberculosis
uaaccucggcggcggcgcg

SEQ ID NO: 2966546 - RNA, 20 nt, Mycobacterium avium subsp. paratuberculosis
uaacgccggccccggcgacg

SEQ ID NO: 2966547 - RNA, 19 nt, Mycobacterium avium subsp. paratuberculosis
uaacgcgucgacggcaagc

SEQ ID NO: 2966548 - RNA, 20 nt, Mycobacterium avium subsp. paratuberculosis
uaacugcguguggcgcacgc

SEQ ID NO: 2966549 - RNA, 16 nt, Mycobacterium avium subsp. paratuberculosis
uaagcggauugaccag

SEQ ID NO: 2966550 - RNA, 12 nt, Mycobacterium avium subsp. paratuberculosis
uaaggccgaggc

SEQ ID NO: 2966551 - RNA, 20 nt, Mycobacterium avium subsp. paratuberculosis
uaagugucguggggcucagc

SEQ ID NO: 2966552 - RNA, 22 nt, Mycobacterium avium subsp. paratuberculosis
uaauccccccgcgccgcccgga

SEQ ID NO: 2966553 - RNA, 20 nt, Mycobacterium avium subsp. paratuberculosis
uacacagggcggcgacacgc

SEQ ID NO: 2966554 - RNA, 23 nt, Mycobacterium avium subsp. paratuberculosis
uacacagggcggcgacacgccga

SEQ ID NO: 2966555 - RNA, 22 nt, Mycobacterium avium subsp. paratuberculosis
uacacauagcccaucagcacgc

SEQ ID NO: 2966556 - RNA, 13 nt, Mycobacterium avium subsp. paratuberculosis
uacaccggcucgc

SEQ ID NO: 2966557 - RNA, 19 nt, Mycobacterium avium subsp. paratuberculosis
uacaccgguugcgccgagg

SEQ ID NO: 2966558 - RNA, 20 nt, Mycobacterium avium subsp. paratuberculosis
uacaccgugcccgagccgau

SEQ ID NO: 2966559 - RNA, 21 nt, Mycobacterium avium subsp. paratuberculosis
uacacgaugcccuuggccagc

SEQ ID NO: 2966560 - RNA, 23 nt, Mycobacterium avium subsp. paratuberculosis
uacacgaugcccuuggccagcag

SEQ ID NO: 2966561 - RNA, 13 nt, Mycobacterium avium subsp. paratuberculosis
uacacggcccgcg

SEQ ID NO: 2966562 - RNA, 15 nt, Mycobacterium avium subsp. paratuberculosis
uacacggcccgcggc

SEQ ID NO: 2966563 - RNA, 14 nt, Mycobacterium avium subsp. paratuberculosis
uacacguggccgau

SEQ ID NO: 2966564 - RNA, 14 nt, Mycobacterium avium subsp. paratuberculosis
uacagcagccccug

SEQ ID NO: 2966565 - RNA, 15 nt, Mycobacterium avium subsp. paratuberculosis
uacagcggcgccagg

SEQ ID NO: 2966566 - RNA, 13 nt, Mycobacterium avium subsp. paratuberculosis
uacagcgucagca

SEQ ID NO: 2966567 - RNA, 16 nt, Mycobacterium avium subsp. paratuberculosis
uacagcgucugcugga

SEQ ID NO: 2966568 - RNA, 15 nt, Mycobacterium avium subsp. paratuberculosis
uacagcuaggccagc

SEQ ID NO: 2966569 - RNA, 19 nt, Mycobacterium avium subsp. paratuberculosis
uacagcuaggccagcagcg

SEQ ID NO: 2966570 - RNA, 18 nt, Mycobacterium avium subsp. paratuberculosis
uacagcugguccggccgg

SEQ ID NO: 2966571 - RNA, 15 nt, Mycobacterium avium subsp. paratuberculosis
uacaggagggccagg

SEQ ID NO: 2966572 - RNA, 16 nt, Mycobacterium avium subsp. paratuberculosis
uacaggagggccaggg

SEQ ID NO: 2966573 - RNA, 18 nt, Mycobacterium avium subsp. paratuberculosis
uacaggagggccagggcu

SEQ ID NO: 2966574 - RNA, 15 nt, Mycobacterium avium subsp. paratuberculosis
uacaggccgucgggg

SEQ ID NO: 2966575 - RNA, 20 nt, Mycobacterium avium subsp. paratuberculosis
uacaggccgucggggaugcc

SEQ ID NO: 2966576 - RNA, 19 nt, Mycobacterium avium subsp. paratuberculosis
uacaggugccggcggcgcg

SEQ ID NO: 2966577 - RNA, 20 nt, Mycobacterium avium subsp. paratuberculosis
uacaucgacgcgaccggccc

SEQ ID NO: 2966578 - RNA, 13 nt, Mycobacterium avium subsp. paratuberculosis
uacggcgccggua

SEQ ID NO: 2966579 - RNA, 12 nt, Mycobacterium avium subsp. paratuberculosis
uacggcggccgc

SEQ ID NO: 2966580 - RNA, 18 nt, Mycobacterium avium subsp. paratuberculosis
uacggcgggccggcgccg

SEQ ID NO: 2966581 - RNA, 18 nt, Mycobacterium avium subsp. paratuberculosis
uacggcucaacggccggc

SEQ ID NO: 2966582 - RNA, 16 nt, Mycobacterium avium subsp. paratuberculosis
uacgggcgcaccgcgc

SEQ ID NO: 2966583 - RNA, 19 nt, Mycobacterium avium subsp. paratuberculosis
uacggguugccgucgacga

SEQ ID NO: 2966584 - RNA, 17 nt, Mycobacterium avium subsp. paratuberculosis
uacgugucccugcggcu

SEQ ID NO: 2966585 - RNA, 22 nt, Mycobacterium avium subsp. paratuberculosis
uacucaaaccgggccugcgcgc

SEQ ID NO: 2966586 - RNA, 22 nt, Mycobacterium avium subsp. paratuberculosis
uacuccgacagauacuucgucg

SEQ ID NO: 2966587 - RNA, 20 nt, Mycobacterium avium subsp. paratuberculosis
uacuccgguaccacgccguc

SEQ ID NO: 2966588 - RNA, 14 nt, Mycobacterium avium subsp. paratuberculosis
uacuccucgcgguc

SEQ ID NO: 2966589 - RNA, 21 nt, Mycobacterium avium subsp. paratuberculosis
uacuccucggugugcugaccc

SEQ ID NO: 2966590 - RNA, 17 nt, Mycobacterium avium subsp. paratuberculosis
uacucgagcgugcccgc

SEQ ID NO: 2966591 - RNA, 22 nt, Mycobacterium avium subsp. paratuberculosis
uacucgggugaguaguccagca

SEQ ID NO: 2966592 - RNA, 19 nt, Mycobacterium avium subsp. paratuberculosis
uacucggucaccucgucga

SEQ ID NO: 2966593 - RNA, 16 nt, Mycobacterium avium subsp. paratuberculosis
uacucgguguagagca

SEQ ID NO: 2966594 - RNA, 21 nt, Mycobacterium avium subsp. paratuberculosis
uacugcugcgggugcggccag

SEQ ID NO: 2966595 - RNA, 20 nt, Mycobacterium avium subsp. paratuberculosis
uacuugaugacgcacgucgg

SEQ ID NO: 2966596 - RNA, 15 nt, Mycobacterium avium subsp. paratuberculosis
uacuugcggccgcga

SEQ ID NO: 2966597 - RNA, 16 nt, Mycobacterium avium subsp. paratuberculosis
uacuuggccagcugcg

SEQ ID NO: 2966598 - RNA, 19 nt, Mycobacterium avium subsp. paratuberculosis
uagaaccggcccagcagcg

SEQ ID NO: 2966599 - RNA, 13 nt, Mycobacterium avium subsp. paratuberculosis
uagaagaugcgcc

SEQ ID NO: 2966600 - RNA, 13 nt, Mycobacterium avium subsp. paratuberculosis
uagaagccgcgac

SEQ ID NO: 2966601 - RNA, 17 nt, Mycobacterium avium subsp. paratuberculosis
uagaccagcaucagcau

SEQ ID NO: 2966602 - RNA, 16 nt, Mycobacterium avium subsp. paratuberculosis
uagaccgauggcggcg

SEQ ID NO: 2966603 - RNA, 18 nt, Mycobacterium avium subsp. paratuberculosis
uagacgaugcccagcccc

SEQ ID NO: 2966604 - RNA, 14 nt, Mycobacterium avium subsp. paratuberculosis
uagacgccgccgug

SEQ ID NO: 2966605 - RNA, 24 nt, Mycobacterium avium subsp. paratuberculosis
uagacgcgcaccagggccgcgagc

SEQ ID NO: 2966606 - RNA, 15 nt, Mycobacterium avium subsp. paratuberculosis
uagacgcgggccggc

SEQ ID NO: 2966607 - RNA, 22 nt, Mycobacterium avium subsp. paratuberculosis
uagacgcgggccggcacccggg

SEQ ID NO: 2966608 - RNA, 17 nt, Mycobacterium avium subsp. paratuberculosis
uagacgcugccgcuggc

SEQ ID NO: 2966609 - RNA, 21 nt, Mycobacterium avium subsp. paratuberculosis
uagacggcaugccgggccagc

SEQ ID NO: 2966610 - RNA, 20 nt, Mycobacterium avium subsp. paratuberculosis
uagacguagugcagccgccc

SEQ ID NO: 2966611 - RNA, 20 nt, Mycobacterium avium subsp. paratuberculosis
uagagcaggaccgagccgcg

SEQ ID NO: 2966612 - RNA, 19 nt, Mycobacterium avium subsp. paratuberculosis
uagagccgcugcacgcguu

SEQ ID NO: 2966613 - RNA, 21 nt, Mycobacterium avium subsp. paratuberculosis
uagagcgggauccccaccgug

SEQ ID NO: 2966614 - RNA, 16 nt, Mycobacterium avium subsp. paratuberculosis
uagagcugacgggacc

SEQ ID NO: 2966615 - RNA, 13 nt, Mycobacterium avium subsp. paratuberculosis
uagaggccgcgga

SEQ ID NO: 2966616 - RNA, 20 nt, Mycobacterium avium subsp. paratuberculosis
uagaggggugauuaggcagu

SEQ ID NO: 2966617 - RNA, 13 nt, Mycobacterium avium subsp. paratuberculosis
uagaggugcagcg

SEQ ID NO: 2966618 - RNA, 19 nt, Mycobacterium avium subsp. paratuberculosis
uagaucagcaggcccucgg

SEQ ID NO: 2966619 - RNA, 13 nt, Mycobacterium avium subsp. paratuberculosis
uagaucagcgccu

SEQ ID NO: 2966620 - RNA, 17 nt, Mycobacterium avium subsp. paratuberculosis
uagaucucgcgccgcgc

SEQ ID NO: 2966621 - RNA, 17 nt, Mycobacterium avium subsp. paratuberculosis
uagaugcggcccagccc

SEQ ID NO: 2966622 - RNA, 20 nt, Mycobacterium avium subsp. paratuberculosis
uagaugcggcccagcccggc

SEQ ID NO: 2966623 - RNA, 18 nt, Mycobacterium avium subsp. paratuberculosis
uagaugguggccgucggc

SEQ ID NO: 2966624 - RNA, 13 nt, Mycobacterium avium subsp. paratuberculosis
uagauguugcggc

SEQ ID NO: 2966625 - RNA, 15 nt, Mycobacterium avium subsp. paratuberculosis
uagcacccggccggc

SEQ ID NO: 2966626 - RNA, 21 nt, Mycobacterium avium subsp. paratuberculosis
uagcagcagaccgcgaucagc

SEQ ID NO: 2966627 - RNA, 19 nt, Mycobacterium avium subsp. paratuberculosis
uagcagcgcggcuuggcca

SEQ ID NO: 2966628 - RNA, 21 nt, Mycobacterium avium subsp. paratuberculosis
uagcagcgcggcuuggccacc

SEQ ID NO: 2966629 - RNA, 23 nt, Mycobacterium avium subsp. paratuberculosis
uagcagcgcggcuuggccaccac

SEQ ID NO: 2966630 - RNA, 15 nt, Mycobacterium avium subsp. paratuberculosis
uagcaggcgcgcagc

SEQ ID NO: 2966631 - RNA, 15 nt, Mycobacterium avium subsp. paratuberculosis
uagcaggcgguggug

SEQ ID NO: 2966632 - RNA, 15 nt, Mycobacterium avium subsp. paratuberculosis
uagccagcaccgccc

SEQ ID NO: 2966633 - RNA, 17 nt, Mycobacterium avium subsp. paratuberculosis
uagcccaccucgagcac

SEQ ID NO: 2966634 - RNA, 13 nt, Mycobacterium avium subsp. paratuberculosis
uagcccaugucgc

SEQ ID NO: 2966635 - RNA, 18 nt, Mycobacterium avium subsp. paratuberculosis
uagcccgaaacgucgcag

SEQ ID NO: 2966636 - RNA, 21 nt, Mycobacterium avium subsp. paratuberculosis
uagcccgaaacgucgcagccc

SEQ ID NO: 2966637 - RNA, 23 nt, Mycobacterium avium subsp. paratuberculosis
uagcccgccgcggcgaccggggc

SEQ ID NO: 2966638 - RNA, 15 nt, Mycobacterium avium subsp. paratuberculosis
uagcccggccgcggc

SEQ ID NO: 2966639 - RNA, 20 nt, Mycobacterium avium subsp. paratuberculosis
uagcccucccggaacagcuu

SEQ ID NO: 2966640 - RNA, 17 nt, Mycobacterium avium subsp. paratuberculosis
uagccgaccaacgggcg

SEQ ID NO: 2966641 - RNA, 18 nt, Mycobacterium avium subsp. paratuberculosis
uagccgaccaacgggcgg

SEQ ID NO: 2966642 - RNA, 17 nt, Mycobacterium avium subsp. paratuberculosis
uagccgaccgacccggc

SEQ ID NO: 2966643 - RNA, 19 nt, Mycobacterium avium subsp. paratuberculosis
uagccgccgagcgucacgc

SEQ ID NO: 2966644 - RNA, 13 nt, Mycobacterium avium subsp. paratuberculosis
uagccgccgggcg

SEQ ID NO: 2966645 - RNA, 21 nt, Mycobacterium avium subsp. paratuberculosis
uagccgccgguggcgucggug

SEQ ID NO: 2966646 - RNA, 15 nt, Mycobacterium avium subsp. paratuberculosis
uagccgcgccgcggu

SEQ ID NO: 2966647 - RNA, 18 nt, Mycobacterium avium subsp. paratuberculosis
uagccgcucgcccagcgc

SEQ ID NO: 2966648 - RNA, 20 nt, Mycobacterium avium subsp. paratuberculosis
uagccgcucgcccagcgcgg

SEQ ID NO: 2966649 - RNA, 21 nt, Mycobacterium avium subsp. paratuberculosis
uagccgcucgcccagcgcggc

SEQ ID NO: 2966650 - RNA, 19 nt, Mycobacterium avium subsp. paratuberculosis
uagccggaccgcuugacgc

SEQ ID NO: 2966651 - RNA, 21 nt, Mycobacterium avium subsp. paratuberculosis
uagccggaccgcuugacgccg

SEQ ID NO: 2966652 - RNA, 16 nt, Mycobacterium avium subsp. paratuberculosis
uagccggccagcgucg

SEQ ID NO: 2966653 - RNA, 19 nt, Mycobacterium avium subsp. paratuberculosis
uagccggcccgcagccagc

SEQ ID NO: 2966654 - RNA, 21 nt, Mycobacterium avium subsp. paratuberculosis
uagccggcgaucgucgccguc

SEQ ID NO: 2966655 - RNA, 22 nt, Mycobacterium avium subsp. paratuberculosis
uagccggcgaucgucgccguca

SEQ ID NO: 2966656 - RNA, 20 nt, Mycobacterium avium subsp. paratuberculosis
uagccgggcucgagcaccga

SEQ ID NO: 2966657 - RNA, 18 nt, Mycobacterium avium subsp. paratuberculosis
uagccggggacggugcag

SEQ ID NO: 2966658 - RNA, 19 nt, Mycobacterium avium subsp. paratuberculosis
uagccggggacggugcagc

SEQ ID NO: 2966659 - RNA, 17 nt, Mycobacterium avium subsp. paratuberculosis
uagccguacacggcggc

SEQ ID NO: 2966660 - RNA, 18 nt, Mycobacterium avium subsp. paratuberculosis
uagccguacacggcggcg

SEQ ID NO: 2966661 - RNA, 21 nt, Mycobacterium avium subsp. paratuberculosis
uagccguacacggcggcgaag

SEQ ID NO: 2966662 - RNA, 16 nt, Mycobacterium avium subsp. paratuberculosis
uaggcgucgcgcagca

SEQ ID NO: 2966663 - RNA, 19 nt, Mycobacterium avium subsp. paratuberculosis
uaggcgucgcgcagcagcg

SEQ ID NO: 2966664 - RNA, 14 nt, Mycobacterium avium subsp. paratuberculosis
uaggcguggcaggc

SEQ ID NO: 2966665 - RNA, 13 nt, Mycobacterium avium subsp. paratuberculosis
uaggcucggcagc

SEQ ID NO: 2966666 - RNA, 16 nt, Mycobacterium avium subsp. paratuberculosis
uagggacugcgccggg

SEQ ID NO: 2966667 - RNA, 24 nt, Mycobacterium avium subsp. paratuberculosis
uagggcagauaggcggcgacggcg

SEQ ID NO: 2966668 - RNA, 21 nt, Mycobacterium avium subsp. paratuberculosis
uagggccaccacgccagccuc

SEQ ID NO: 2966669 - RNA, 16 nt, Mycobacterium avium subsp. paratuberculosis
uagggcuccgcgcuga

SEQ ID NO: 2966670 - RNA, 22 nt, Mycobacterium avium subsp. paratuberculosis
uagggcuccgcgcugaccagcg

SEQ ID NO: 2966671 - RNA, 13 nt, Mycobacterium avium subsp. paratuberculosis
uaggucacccggu

SEQ ID NO: 2966672 - RNA, 13 nt, Mycobacterium avium subsp. paratuberculosis
uaggucaucagcg

SEQ ID NO: 2966673 - RNA, 21 nt, Mycobacterium avium subsp. paratuberculosis
uagguccggcgcgaccagguu

SEQ ID NO: 2966674 - RNA, 16 nt, Mycobacterium avium subsp. paratuberculosis
uaggucgccuccaggu

SEQ ID NO: 2966675 - RNA, 20 nt, Mycobacterium avium subsp. paratuberculosis
uaggucgguggccaccaccg

SEQ ID NO: 2966676 - RNA, 22 nt, Mycobacterium avium subsp. paratuberculosis
uaggugcacagcccgugcagga

SEQ ID NO: 2966677 - RNA, 20 nt, Mycobacterium avium subsp. paratuberculosis
uagguggccagcacgaucgg

SEQ ID NO: 2966678 - RNA, 18 nt, Mycobacterium avium subsp. paratuberculosis
uagguggcgaccaccgac

SEQ ID NO: 2966679 - RNA, 14 nt, Mycobacterium avium subsp. paratuberculosis
uagguggucuccca

SEQ ID NO: 2966680 - RNA, 17 nt, Mycobacterium avium subsp. paratuberculosis
uaguacaccgggcuggu

SEQ ID NO: 2966681 - RNA, 17 nt, Mycobacterium avium subsp. paratuberculosis
uaguagccagcaucguu

SEQ ID NO: 2966682 - RNA, 21 nt, Mycobacterium avium subsp. paratuberculosis
uaguccagcaccugaccgucg

SEQ ID NO: 2966683 - RNA, 17 nt, Mycobacterium avium subsp. paratuberculosis
uaguccagcacggcgaa

SEQ ID NO: 2966684 - RNA, 13 nt, Mycobacterium avium subsp. paratuberculosis
uagucgaccaccc

SEQ ID NO: 2966685 - RNA, 15 nt, Mycobacterium avium subsp. paratuberculosis
uagucgaccacccgc

SEQ ID NO: 2966686 - RNA, 24 nt, Mycobacterium avium subsp. paratuberculosis
uagucgaggggcuugagcgcgucg

SEQ ID NO: 2966687 - RNA, 17 nt, Mycobacterium avium subsp. paratuberculosis
uagucgccgauggagac

SEQ ID NO: 2966688 - RNA, 20 nt, Mycobacterium avium subsp. paratuberculosis
uagucgccgauggagaccuc

SEQ ID NO: 2966689 - RNA, 13 nt, Mycobacterium avium subsp. paratuberculosis
uagucggcccgcc

SEQ ID NO: 2966690 - RNA, 16 nt, Mycobacterium avium subsp. paratuberculosis
uagucggcgaucggcg

SEQ ID NO: 2966691 - RNA, 21 nt, Mycobacterium avium subsp. paratuberculosis
uagucggcgccgacggccagc

SEQ ID NO: 2966692 - RNA, 15 nt, Mycobacterium avium subsp. paratuberculosis
uagugcagcugcagc

SEQ ID NO: 2966693 - RNA, 17 nt, Mycobacterium avium subsp. paratuberculosis
uaguggcgugcggccuc

SEQ ID NO: 2966694 - RNA, 16 nt, Mycobacterium avium subsp. paratuberculosis
uagugggucggcggcu

SEQ ID NO: 2966695 - RNA, 15 nt, Mycobacterium avium subsp. paratuberculosis
uagugguccaccgcc

SEQ ID NO: 2966696 - RNA, 16 nt, Mycobacterium avium subsp. paratuberculosis
uaguggugcaggugcc

SEQ ID NO: 2966697 - RNA, 13 nt, Mycobacterium avium subsp. paratuberculosis
uaguguguuuggu

SEQ ID NO: 2966698 - RNA, 13 nt, Mycobacterium avium subsp. paratuberculosis
uaguucagcagcc

SEQ ID NO: 2966699 - RNA, 15 nt, Mycobacterium avium subsp. paratuberculosis
uaguucuucgucagg

SEQ ID NO: 2966700 - RNA, 16 nt, Mycobacterium avium subsp. paratuberculosis
uaguucuugacgccga

SEQ ID NO: 2966701 - RNA, 17 nt, Mycobacterium avium subsp. paratuberculosis
uaguuggugcugggcac

SEQ ID NO: 2966702 - RNA, 11 nt, Mycobacterium avium subsp. paratuberculosis
uaucagcucgc

SEQ ID NO: 2966703 - RNA, 14 nt, Mycobacterium avium subsp. paratuberculosis
uaucaggacuggac

SEQ ID NO: 2966704 - RNA, 21 nt, Mycobacterium avium subsp. paratuberculosis
uaucccgauuuuuuccgcucu

SEQ ID NO: 2966705 - RNA, 20 nt, Mycobacterium avium subsp. paratuberculosis
uaucccgucaggucgcggua

SEQ ID NO: 2966706 - RNA, 16 nt, Mycobacterium avium subsp. paratuberculosis
uaucgccacgccgacc

SEQ ID NO: 2966707 - RNA, 19 nt, Mycobacterium avium subsp. paratuberculosis
uaucgcccggcgcccggcc

SEQ ID NO: 2966708 - RNA, 16 nt, Mycobacterium avium subsp. paratuberculosis
uaucggccccggccga

SEQ ID NO: 2966709 - RNA, 19 nt, Mycobacterium avium subsp. paratuberculosis
uaucggccgcggggccggc

SEQ ID NO: 2966710 - RNA, 15 nt, Mycobacterium avium subsp. paratuberculosis
uaucucugauuugaa

SEQ ID NO: 2966711 - RNA, 20 nt, Mycobacterium avium subsp. paratuberculosis
uaugccuuggcccgcgcggc

SEQ ID NO: 2966712 - RNA, 20 nt, Mycobacterium avium subsp. paratuberculosis
uaugcugcaacggcuggcgc

SEQ ID NO: 2966713 - RNA, 21 nt, Mycobacterium avium subsp. paratuberculosis
uauggcaucgccaaggcgcug

SEQ ID NO: 2966714 - RNA, 20 nt, Mycobacterium avium subsp. paratuberculosis
uauucaucgcggccgccggg

SEQ ID NO: 2966715 - RNA, 17 nt, Mycobacterium avium subsp. paratuberculosis
uauucgccgucguggug

SEQ ID NO: 2966716 - RNA, 18 nt, Mycobacterium avium subsp. paratuberculosis
uauucgcgggaggacagc

SEQ ID NO: 2966717 - RNA, 13 nt, Mycobacterium avium subsp. paratuberculosis
uauuggcuagcgc

SEQ ID NO: 2966718 - RNA, 18 nt, Mycobacterium avium subsp. paratuberculosis
ucaaaccguugaccacca

SEQ ID NO: 2966719 - RNA, 15 nt, Mycobacterium avium subsp. paratuberculosis
ucaaacuccgugucc

SEQ ID NO: 2966720 - RNA, 22 nt, Mycobacterium avium subsp. paratuberculosis
ucaacaccgggauccggcgcgc

SEQ ID NO: 2966721 - RNA, 16 nt, Mycobacterium avium subsp. paratuberculosis
ucaaccacaccagcau

SEQ ID NO: 2966722 - RNA, 21 nt, Mycobacterium avium subsp. paratuberculosis
ucaaccccgcgcgcgggccag

SEQ ID NO: 2966723 - RNA, 23 nt, Mycobacterium avium subsp. paratuberculosis
ucaaccccgcgcgcgggccagcg

SEQ ID NO: 2966724 - RNA, 18 nt, Mycobacterium avium subsp. paratuberculosis
ucaacccgagcaccgggc

SEQ ID NO: 2966725 - RNA, 21 nt, Mycobacterium avium subsp. paratuberculosis
ucaacccgaucgaggacaccg

SEQ ID NO: 2966726 - RNA, 18 nt, Mycobacterium avium subsp. paratuberculosis
ucaaccgauuucggccag

SEQ ID NO: 2966727 - RNA, 13 nt, Mycobacterium avium subsp. paratuberculosis
ucaaccgcccagc

SEQ ID NO: 2966728 - RNA, 15 nt, Mycobacterium avium subsp. paratuberculosis
ucaacgacccggauc

SEQ ID NO: 2966729 - RNA, 22 nt, Mycobacterium avium subsp. paratuberculosis
ucaacgagacacccucgcgcag

SEQ ID NO: 2966730 - RNA, 14 nt, Mycobacterium avium subsp. paratuberculosis
ucaacgccccgguc

SEQ ID NO: 2966731 - RNA, 21 nt, Mycobacterium avium subsp. paratuberculosis
ucaacgccgggucgacgccga

SEQ ID NO: 2966732 - RNA, 13 nt, Mycobacterium avium subsp. paratuberculosis
ucaacgcgccgaa

SEQ ID NO: 2966733 - RNA, 18 nt, Mycobacterium avium subsp. paratuberculosis
ucaacgcgccgaacaacg

SEQ ID NO: 2966734 - RNA, 14 nt, Mycobacterium avium subsp. paratuberculosis
ucaacgcggacacg

SEQ ID NO: 2966735 - RNA, 20 nt, Mycobacterium avium subsp. paratuberculosis
ucaacggcaccgacagggcc

SEQ ID NO: 2966736 - RNA, 16 nt, Mycobacterium avium subsp. paratuberculosis
ucaacggccaaccgcc

SEQ ID NO: 2966737 - RNA, 14 nt, Mycobacterium avium subsp. paratuberculosis
ucaacggccggcgc

SEQ ID NO: 2966738 - RNA, 17 nt, Mycobacterium avium subsp. paratuberculosis
ucaacggcuccagguag

SEQ ID NO: 2966739 - RNA, 22 nt, Mycobacterium avium subsp. paratuberculosis
ucaacggcuccagguagggcac

SEQ ID NO: 2966740 - RNA, 22 nt, Mycobacterium avium subsp. paratuberculosis
ucaacggcuugaugaugcuguc

SEQ ID NO: 2966741 - RNA, 20 nt, Mycobacterium avium subsp. paratuberculosis
ucaacgugaccaccgugcug

SEQ ID NO: 2966742 - RNA, 18 nt, Mycobacterium avium subsp. paratuberculosis
ucaacgugauacgccgac

SEQ ID NO: 2966743 - RNA, 12 nt, Mycobacterium avium subsp. paratuberculosis
ucaacugcacca

SEQ ID NO: 2966744 - RNA, 15 nt, Mycobacterium avium subsp. paratuberculosis
ucaacugcaccagcg

SEQ ID NO: 2966745 - RNA, 23 nt, Mycobacterium avium subsp. paratuberculosis
ucaagaacgcaaucgcccagucc

SEQ ID NO: 2966746 - RNA, 16 nt, Mycobacterium avium subsp. paratuberculosis
ucaagauaccggccgg

SEQ ID NO: 2966747 - RNA, 18 nt, Mycobacterium avium subsp. paratuberculosis
ucaccccaccgagcagcu

SEQ ID NO: 2966748 - RNA, 23 nt, Mycobacterium avium subsp. paratuberculosis
ucaccccaccgagcagcugcaug

SEQ ID NO: 2966749 - RNA, 14 nt, Mycobacterium avium subsp. paratuberculosis
ucaccccagcgcga

SEQ ID NO: 2966750 - RNA, 14 nt, Mycobacterium avium subsp. paratuberculosis
ucacccccggcgcg

SEQ ID NO: 2966751 - RNA, 22 nt, Mycobacterium avium subsp. paratuberculosis
ucaccccgaagcucaucaccgg

SEQ ID NO: 2966752 - RNA, 19 nt, Mycobacterium avium subsp. paratuberculosis
ucaccccgaguucggccag

SEQ ID NO: 2966753 - RNA, 18 nt, Mycobacterium avium subsp. paratuberculosis
ucaccccgaucaacaccg

SEQ ID NO: 2966754 - RNA, 17 nt, Mycobacterium avium subsp. paratuberculosis
ucaccccgcuugcgcag

SEQ ID NO: 2966755 - RNA, 21 nt, Mycobacterium avium subsp. paratuberculosis
ucaccccggagauccggccgc

SEQ ID NO: 2966756 - RNA, 11 nt, Mycobacterium avium subsp. paratuberculosis
ucaccccggcg

SEQ ID NO: 2966757 - RNA, 13 nt, Mycobacterium avium subsp. paratuberculosis
ucaccccggcgac

SEQ ID NO: 2966758 - RNA, 13 nt, Mycobacterium avium subsp. paratuberculosis
ucaccccggcgcg

SEQ ID NO: 2966759 - RNA, 19 nt, Mycobacterium avium subsp. paratuberculosis
ucaccccggcgcggaacgc

SEQ ID NO: 2966760 - RNA, 21 nt, Mycobacterium avium subsp. paratuberculosis
ucaccccggcgcggaacgcgc

SEQ ID NO: 2966761 - RNA, 22 nt, Mycobacterium avium subsp. paratuberculosis
ucaccccggcgcggaacgcgcc

SEQ ID NO: 2966762 - RNA, 12 nt, Mycobacterium avium subsp. paratuberculosis
ucacccgccggg

SEQ ID NO: 2966763 - RNA, 19 nt, Mycobacterium avium subsp. paratuberculosis
ucacccggcccaccggccc

SEQ ID NO: 2966764 - RNA, 20 nt, Mycobacterium avium subsp. paratuberculosis
ucacccggcccaccggcccg

SEQ ID NO: 2966765 - RNA, 22 nt, Mycobacterium avium subsp. paratuberculosis
ucacccggcccaccggcccggc

SEQ ID NO: 2966766 - RNA, 20 nt, Mycobacterium avium subsp. paratuberculosis
ucacccggcccccgagcuuc

SEQ ID NO: 2966767 - RNA, 13 nt, Mycobacterium avium subsp. paratuberculosis
ucacccggcgcgc

SEQ ID NO: 2966768 - RNA, 18 nt, Mycobacterium avium subsp. paratuberculosis
ucacccgggucgagcggc

SEQ ID NO: 2966769 - RNA, 20 nt, Mycobacterium avium subsp. paratuberculosis
ucacccguggcugaccacgc

SEQ ID NO: 2966770 - RNA, 18 nt, Mycobacterium avium subsp. paratuberculosis
ucacccgugggccgaccg

SEQ ID NO: 2966771 - RNA, 23 nt, Mycobacterium avium subsp. paratuberculosis
ucacccgugggccgaccggccgg

SEQ ID NO: 2966772 - RNA, 18 nt, Mycobacterium avium subsp. paratuberculosis
ucacccuccucgcggcgg

SEQ ID NO: 2966773 - RNA, 20 nt, Mycobacterium avium subsp. paratuberculosis
ucacccucgaggccgacgug

SEQ ID NO: 2966774 - RNA, 20 nt, Mycobacterium avium subsp. paratuberculosis
ucacccuggcgaaccgcggc

SEQ ID NO: 2966775 - RNA, 16 nt, Mycobacterium avium subsp. paratuberculosis
ucaccgaauccaccgg

SEQ ID NO: 2966776 - RNA, 15 nt, Mycobacterium avium subsp. paratuberculosis
ucaccgacagcgcgu

SEQ ID NO: 2966777 - RNA, 13 nt, Mycobacterium avium subsp. paratuberculosis
ucaccgaccagcu

SEQ ID NO: 2966778 - RNA, 14 nt, Mycobacterium avium subsp. paratuberculosis
ucaccgaccagcug

SEQ ID NO: 2966779 - RNA, 15 nt, Mycobacterium avium subsp. paratuberculosis
ucaccgaccagcugu

SEQ ID NO: 2966780 - RNA, 20 nt, Mycobacterium avium subsp. paratuberculosis
ucaccgaccccucggcggcc

SEQ ID NO: 2966781 - RNA, 15 nt, Mycobacterium avium subsp. paratuberculosis
ucaccgacgaccucg

SEQ ID NO: 2966782 - RNA, 16 nt, Mycobacterium avium subsp. paratuberculosis
ucaccgacgccagcgg

SEQ ID NO: 2966783 - RNA, 18 nt, Mycobacterium avium subsp. paratuberculosis
ucaccgacgccagcgggc

SEQ ID NO: 2966784 - RNA, 15 nt, Mycobacterium avium subsp. paratuberculosis
ucaccgacggcugga

SEQ ID NO: 2966785 - RNA, 22 nt, Mycobacterium avium subsp. paratuberculosis
ucaccgagauggccaccaucag

SEQ ID NO: 2966786 - RNA, 13 nt, Mycobacterium avium subsp. paratuberculosis
ucaccgagauggu

SEQ ID NO: 2966787 - RNA, 15 nt, Mycobacterium avium subsp. paratuberculosis
ucaccgagcggccgu

SEQ ID NO: 2966788 - RNA, 15 nt, Mycobacterium avium subsp. paratuberculosis
ucaccgagcggggug

SEQ ID NO: 2966789 - RNA, 18 nt, Mycobacterium avium subsp. paratuberculosis
ucaccgagcugggccggc

SEQ ID NO: 2966790 - RNA, 20 nt, Mycobacterium avium subsp. paratuberculosis
ucaccgagcugggccggcgc

SEQ ID NO: 2966791 - RNA, 12 nt, Mycobacterium avium subsp. paratuberculosis
ucaccgaggcga

SEQ ID NO: 2966792 - RNA, 20 nt, Mycobacterium avium subsp. paratuberculosis
ucaccgcaucgaaccgccgc

SEQ ID NO: 2966793 - RNA, 23 nt, Mycobacterium avium subsp. paratuberculosis
ucaccgcaucgaaccgccgcgcu

SEQ ID NO: 2966794 - RNA, 16 nt, Mycobacterium avium subsp. paratuberculosis
ucaccgccaccagcag

SEQ ID NO: 2966795 - RNA, 17 nt, Mycobacterium avium subsp. paratuberculosis
ucaccgccaccagcagg

SEQ ID NO: 2966796 - RNA, 15 nt, Mycobacterium avium subsp. paratuberculosis
ucaccgccagcgcgc

SEQ ID NO: 2966797 - RNA, 17 nt, Mycobacterium avium subsp. paratuberculosis
ucaccgccagcgcgccg

SEQ ID NO: 2966798 - RNA, 19 nt, Mycobacterium avium subsp. paratuberculosis
ucaccgccaggaccaccca

SEQ ID NO: 2966799 - RNA, 18 nt, Mycobacterium avium subsp. paratuberculosis
ucaccgccccgacgaucg

SEQ ID NO: 2966800 - RNA, 23 nt, Mycobacterium avium subsp. paratuberculosis
ucaccgccccgacgaucgcgccg

SEQ ID NO: 2966801 - RNA, 14 nt, Mycobacterium avium subsp. paratuberculosis
ucaccgccgagccg

SEQ ID NO: 2966802 - RNA, 17 nt, Mycobacterium avium subsp. paratuberculosis
ucaccgccgagccgcuc

SEQ ID NO: 2966803 - RNA, 17 nt, Mycobacterium avium subsp. paratuberculosis
ucaccgccgcaccgucg

SEQ ID NO: 2966804 - RNA, 14 nt, Mycobacterium avium subsp. paratuberculosis
ucaccgccgcggcg

SEQ ID NO: 2966805 - RNA, 16 nt, Mycobacterium avium subsp. paratuberculosis
ucaccgccgcggcgac

SEQ ID NO: 2966806 - RNA, 22 nt, Mycobacterium avium subsp. paratuberculosis
ucaccgccuuccgccacgccca

SEQ ID NO: 2966807 - RNA, 18 nt, Mycobacterium avium subsp. paratuberculosis
ucaccgcgaccaugcccg

SEQ ID NO: 2966808 - RNA, 13 nt, Mycobacterium avium subsp. paratuberculosis
ucaccgcgaugau

SEQ ID NO: 2966809 - RNA, 11 nt, Mycobacterium avium subsp. paratuberculosis
ucaccgcgccg

SEQ ID NO: 2966810 - RNA, 15 nt, Mycobacterium avium subsp. paratuberculosis
ucaccgcgccgggca

SEQ ID NO: 2966811 - RNA, 22 nt, Mycobacterium avium subsp. paratuberculosis
ucaccgcgccgggcaccaccac

SEQ ID NO: 2966812 - RNA, 17 nt, Mycobacterium avium subsp. paratuberculosis
ucaccgcgcucggcgac

SEQ ID NO: 2966813 - RNA, 17 nt, Mycobacterium avium subsp. paratuberculosis
ucaccgcgcuugccgcg

SEQ ID NO: 2966814 - RNA, 22 nt, Mycobacterium avium subsp. paratuberculosis
ucaccgcgcuuuggaccagggc

SEQ ID NO: 2966815 - RNA, 12 nt, Mycobacterium avium subsp. paratuberculosis
ucaccgcggcca

SEQ ID NO: 2966816 - RNA, 16 nt, Mycobacterium avium subsp. paratuberculosis
ucaccgcggccaccac

SEQ ID NO: 2966817 - RNA, 18 nt, Mycobacterium avium subsp. paratuberculosis
ucaccgcggccaccaccg

SEQ ID NO: 2966818 - RNA, 19 nt, Mycobacterium avium subsp. paratuberculosis
ucaccgcgggaauggccgc

SEQ ID NO: 2966819 - RNA, 15 nt, Mycobacterium avium subsp. paratuberculosis
ucaccgcgggccagg

SEQ ID NO: 2966820 - RNA, 16 nt, Mycobacterium avium subsp. paratuberculosis
ucaccgcgggccaggc

SEQ ID NO: 2966821 - RNA, 18 nt, Mycobacterium avium subsp. paratuberculosis
ucaccgcgggccaggccc

SEQ ID NO: 2966822 - RNA, 19 nt, Mycobacterium avium subsp. paratuberculosis
ucaccgcgggccaggccca

SEQ ID NO: 2966823 - RNA, 19 nt, Mycobacterium avium subsp. paratuberculosis
ucaccgcggggugcccggc

SEQ ID NO: 2966824 - RNA, 22 nt, Mycobacterium avium subsp. paratuberculosis
ucaccgcggggugcccggcgag

SEQ ID NO: 2966825 - RNA, 21 nt, Mycobacterium avium subsp. paratuberculosis
ucaccgcgguugcccucgguc

SEQ ID NO: 2966826 - RNA, 17 nt, Mycobacterium avium subsp. paratuberculosis
ucaccgcguagcgccgc

SEQ ID NO: 2966827 - RNA, 12 nt, Mycobacterium avium subsp. paratuberculosis
ucaccgcgucgg

SEQ ID NO: 2966828 - RNA, 19 nt, Mycobacterium avium subsp. paratuberculosis
ucaccgcgucggcccagac

SEQ ID NO: 2966829 - RNA, 19 nt, Mycobacterium avium subsp. paratuberculosis
ucaccgcguucucggcgga

SEQ ID NO: 2966830 - RNA, 22 nt, Mycobacterium avium subsp. paratuberculosis
ucaccgcguucucggcggacau

SEQ ID NO: 2966831 - RNA, 18 nt, Mycobacterium avium subsp. paratuberculosis
ucaccgcguugucggcga

SEQ ID NO: 2966832 - RNA, 22 nt, Mycobacterium avium subsp. paratuberculosis
ucacgauauggaucagacccag

SEQ ID NO: 2966833 - RNA, 18 nt, Mycobacterium avium subsp. paratuberculosis
ucacgcaucagggccagc

SEQ ID NO: 2966834 - RNA, 17 nt, Mycobacterium avium subsp. paratuberculosis
ucacgccagcgugacgc

SEQ ID NO: 2966835 - RNA, 22 nt, Mycobacterium avium subsp. paratuberculosis
ucacgccagcgugacgcccggc

SEQ ID NO: 2966836 - RNA, 20 nt, Mycobacterium avium subsp. paratuberculosis
ucacgccagcgugacgccgg

SEQ ID NO: 2966837 - RNA, 21 nt, Mycobacterium avium subsp. paratuberculosis
ucacgccagcgugacgcucgg

SEQ ID NO: 2966838 - RNA, 19 nt, Mycobacterium avium subsp. paratuberculosis
ucacgccaguguggccgcg

SEQ ID NO: 2966839 - RNA, 23 nt, Mycobacterium avium subsp. paratuberculosis
ucacgccaguguggccgcggcgg

SEQ ID NO: 2966840 - RNA, 14 nt, Mycobacterium avium subsp. paratuberculosis
ucacgccgcgcccg

SEQ ID NO: 2966841 - RNA, 22 nt, Mycobacterium avium subsp. paratuberculosis
ucacgccgggguagaggccgcg

SEQ ID NO: 2966842 - RNA, 23 nt, Mycobacterium avium subsp. paratuberculosis
ucacgccgggguagaggccgcgg

SEQ ID NO: 2966843 - RNA, 15 nt, Mycobacterium avium subsp. paratuberculosis
ucacgccggugagca

SEQ ID NO: 2966844 - RNA, 17 nt, Mycobacterium avium subsp. paratuberculosis
ucacgccucgucgagca

SEQ ID NO: 2966845 - RNA, 13 nt, Mycobacterium avium subsp. paratuberculosis
ucacgcggcggga

SEQ ID NO: 2966846 - RNA, 20 nt, Mycobacterium avium subsp. paratuberculosis
ucacgcuagcgugacagucg

SEQ ID NO: 2966847 - RNA, 21 nt, Mycobacterium avium subsp. paratuberculosis
ucacgcuagcgugacagucga

SEQ ID NO: 2966848 - RNA, 17 nt, Mycobacterium avium subsp. paratuberculosis
ucacgcucggcaggcgg

SEQ ID NO: 2966849 - RNA, 21 nt, Mycobacterium avium subsp. paratuberculosis
ucacgcucggccagggugacg

SEQ ID NO: 2966850 - RNA, 16 nt, Mycobacterium avium subsp. paratuberculosis
ucacgcucggcgccga

SEQ ID NO: 2966851 - RNA, 18 nt, Mycobacterium avium subsp. paratuberculosis
ucacgcugaacggugccg

SEQ ID NO: 2966852 - RNA, 22 nt, Mycobacterium avium subsp. paratuberculosis
ucacgcugaacggugccgucac

SEQ ID NO: 2966853 - RNA, 17 nt, Mycobacterium avium subsp. paratuberculosis
ucacgcugaucgaccgg

SEQ ID NO: 2966854 - RNA, 15 nt, Mycobacterium avium subsp. paratuberculosis
ucacgcugcgcgccg

SEQ ID NO: 2966855 - RNA, 16 nt, Mycobacterium avium subsp. paratuberculosis
ucacgcugcgcgccga

SEQ ID NO: 2966856 - RNA, 20 nt, Mycobacterium avium subsp. paratuberculosis
ucacgcuggccuccagcuuu

SEQ ID NO: 2966857 - RNA, 15 nt, Mycobacterium avium subsp. paratuberculosis
ucacgcuggcgugac

SEQ ID NO: 2966858 - RNA, 20 nt, Mycobacterium avium subsp. paratuberculosis
ucacgcuggcgugacacucg

SEQ ID NO: 2966859 - RNA, 21 nt, Mycobacterium avium subsp. paratuberculosis
ucacgcuggcgugacacucgg

SEQ ID NO: 2966860 - RNA, 20 nt, Mycobacterium avium subsp. paratuberculosis
ucacgcuggcgugacagucg

SEQ ID NO: 2966861 - RNA, 21 nt, Mycobacterium avium subsp. paratuberculosis
ucacgcuggcgugacagucga

SEQ ID NO: 2966862 - RNA, 16 nt, Mycobacterium avium subsp. paratuberculosis
ucacgcuggcgugacg

SEQ ID NO: 2966863 - RNA, 20 nt, Mycobacterium avium subsp. paratuberculosis
ucacgcuggcgugacgcucg

SEQ ID NO: 2966864 - RNA, 21 nt, Mycobacterium avium subsp. paratuberculosis
ucacgcuggcgugacgcucgg

SEQ ID NO: 2966865 - RNA, 22 nt, Mycobacterium avium subsp. paratuberculosis
ucacgcuggcgugacgcucggc

SEQ ID NO: 2966866 - RNA, 20 nt, Mycobacterium avium subsp. paratuberculosis
ucacgcuggcgugacggucg

SEQ ID NO: 2966867 - RNA, 20 nt, Mycobacterium avium subsp. paratuberculosis
ucacgcuggcgugacguucg

SEQ ID NO: 2966868 - RNA, 15 nt, Mycobacterium avium subsp. paratuberculosis
ucacgcuggcguggc

SEQ ID NO: 2966869 - RNA, 21 nt, Mycobacterium avium subsp. paratuberculosis
ucacgcuggcguggcacccgg

SEQ ID NO: 2966870 - RNA, 21 nt, Mycobacterium avium subsp. paratuberculosis
ucacgcuggcguggcgccggc

SEQ ID NO: 2966871 - RNA, 21 nt, Mycobacterium avium subsp. paratuberculosis
ucacgcugggcuccgaccgug

SEQ ID NO: 2966872 - RNA, 22 nt, Mycobacterium avium subsp. paratuberculosis
ucacgcugggcuccgaccguga

SEQ ID NO: 2966873 - RNA, 20 nt, Mycobacterium avium subsp. paratuberculosis
ucacgcuggugacgugcacc

SEQ ID NO: 2966874 - RNA, 20 nt, Mycobacterium avium subsp. paratuberculosis
ucacggauacccgcggccuc

SEQ ID NO: 2966875 - RNA, 15 nt, Mycobacterium avium subsp. paratuberculosis
ucacggccgccagca

SEQ ID NO: 2966876 - RNA, 16 nt, Mycobacterium avium subsp. paratuberculosis
ucacggccgccagcag

SEQ ID NO: 2966877 - RNA, 17 nt, Mycobacterium avium subsp. paratuberculosis
ucacggccgccagcagc

SEQ ID NO: 2966878 - RNA, 22 nt, Mycobacterium avium subsp. paratuberculosis
ucacggcgaauauuucgccgau

SEQ ID NO: 2966879 - RNA, 18 nt, Mycobacterium avium subsp. paratuberculosis
ucacggcgaggauggcga

SEQ ID NO: 2966880 - RNA, 15 nt, Mycobacterium avium subsp. paratuberculosis
ucacggcggcagcgc

SEQ ID NO: 2966881 - RNA, 18 nt, Mycobacterium avium subsp. paratuberculosis
ucacggcggcagcgcggc

SEQ ID NO: 2966882 - RNA, 21 nt, Mycobacterium avium subsp. paratuberculosis
ucacggcggcagcgcggcguu

SEQ ID NO: 2966883 - RNA, 15 nt, Mycobacterium avium subsp. paratuberculosis
ucacggcgggucggg

SEQ ID NO: 2966884 - RNA, 23 nt, Mycobacterium avium subsp. paratuberculosis
ucacggcgucggcgucgggcggg

SEQ ID NO: 2966885 - RNA, 15 nt, Mycobacterium avium subsp. paratuberculosis
ucacggcugccgacc

SEQ ID NO: 2966886 - RNA, 14 nt, Mycobacterium avium subsp. paratuberculosis
ucacgggcacaccg

SEQ ID NO: 2966887 - RNA, 22 nt, Mycobacterium avium subsp. paratuberculosis
ucacgggccaggcgcgcgcugg

SEQ ID NO: 2966888 - RNA, 17 nt, Mycobacterium avium subsp. paratuberculosis
ucacgguccaucagcac

SEQ ID NO: 2966889 - RNA, 18 nt, Mycobacterium avium subsp. paratuberculosis
ucacgguccaucagcacc

SEQ ID NO: 2966890 - RNA, 13 nt, Mycobacterium avium subsp. paratuberculosis
ucacggucggagc

SEQ ID NO: 2966891 - RNA, 13 nt, Mycobacterium avium subsp. paratuberculosis
ucacggucggcgu

SEQ ID NO: 2966892 - RNA, 23 nt, Mycobacterium avium subsp. paratuberculosis
ucacggucggcguccagcgcggu

SEQ ID NO: 2966893 - RNA, 11 nt, Mycobacterium avium subsp. paratuberculosis
ucacggugacg

SEQ ID NO: 2966894 - RNA, 23 nt, Mycobacterium avium subsp. paratuberculosis
ucacggugacgguuuuggucugc

SEQ ID NO: 2966895 - RNA, 14 nt, Mycobacterium avium subsp. paratuberculosis
ucacggugaucgcc

SEQ ID NO: 2966896 - RNA, 15 nt, Mycobacterium avium subsp. paratuberculosis
ucacggugaucgccg

SEQ ID NO: 2966897 - RNA, 16 nt, Mycobacterium avium subsp. paratuberculosis
ucacggugaucgccgg

SEQ ID NO: 2966898 - RNA, 12 nt, Mycobacterium avium subsp. paratuberculosis
ucacgguggccg

SEQ ID NO: 2966899 - RNA, 14 nt, Mycobacterium avium subsp. paratuberculosis
ucacgguggccgcc

SEQ ID NO: 2966900 - RNA, 22 nt, Mycobacterium avium subsp. paratuberculosis
ucacgguggccgccaccaacau

SEQ ID NO: 2966901 - RNA, 15 nt, Mycobacterium avium subsp. paratuberculosis
ucacggugucggcgg

SEQ ID NO: 2966902 - RNA, 21 nt, Mycobacterium avium subsp. paratuberculosis
ucacgguguuguucaccggcg

SEQ ID NO: 2966903 - RNA, 16 nt, Mycobacterium avium subsp. paratuberculosis
ucacguagcgcggccg

SEQ ID NO: 2966904 - RNA, 23 nt, Mycobacterium avium subsp. paratuberculosis
ucacguagcgcggccgcccgucg

SEQ ID NO: 2966905 - RNA, 20 nt, Mycobacterium avium subsp. paratuberculosis
ucacguccaucauggcgcug

SEQ ID NO: 2966906 - RNA, 14 nt, Mycobacterium avium subsp. paratuberculosis
ucacgucccgcucg

SEQ ID NO: 2966907 - RNA, 12 nt, Mycobacterium avium subsp. paratuberculosis
ucacgucgacgg

SEQ ID NO: 2966908 - RNA, 20 nt, Mycobacterium avium subsp. paratuberculosis
ucacgucgaucacgccgccg

SEQ ID NO: 2966909 - RNA, 21 nt, Mycobacterium avium subsp. paratuberculosis
ucacgucgaucacgccgccgg

SEQ ID NO: 2966910 - RNA, 23 nt, Mycobacterium avium subsp. paratuberculosis
ucacgucgcgcuugccgaagucc

SEQ ID NO: 2966911 - RNA, 15 nt, Mycobacterium avium subsp. paratuberculosis
ucacgucggccugca

SEQ ID NO: 2966912 - RNA, 19 nt, Mycobacterium avium subsp. paratuberculosis
ucacgucggcgagcuuggc

SEQ ID NO: 2966913 - RNA, 12 nt, Mycobacterium avium subsp. paratuberculosis
ucacgugcgcgg

SEQ ID NO: 2966914 - RNA, 17 nt, Mycobacterium avium subsp. paratuberculosis
ucacguguccgucgccg

SEQ ID NO: 2966915 - RNA, 20 nt, Mycobacterium avium subsp. paratuberculosis
ucacguucggcgagugaggc

SEQ ID NO: 2966916 - RNA, 18 nt, Mycobacterium avium subsp. paratuberculosis
ucagcagcugcuggcgug

SEQ ID NO: 2966917 - RNA, 17 nt, Mycobacterium avium subsp. paratuberculosis
ucagcaggaccgggauc

SEQ ID NO: 2966918 - RNA, 17 nt, Mycobacterium avium subsp. paratuberculosis
ucagcaggcccucggcc

SEQ ID NO: 2966919 - RNA, 18 nt, Mycobacterium avium subsp. paratuberculosis
ucagcaggcccucggcca

SEQ ID NO: 2966920 - RNA, 17 nt, Mycobacterium avium subsp. paratuberculosis
ucagcaggcuggcggcg

SEQ ID NO: 2966921 - RNA, 19 nt, Mycobacterium avium subsp. paratuberculosis
ucagcaggcuggcggcgau

SEQ ID NO: 2966922 - RNA, 21 nt, Mycobacterium avium subsp. paratuberculosis
ucagcaggcuggcggcgauca

SEQ ID NO: 2966923 - RNA, 15 nt, Mycobacterium avium subsp. paratuberculosis
ucagcagggccucgc

SEQ ID NO: 2966924 - RNA, 16 nt, Mycobacterium avium subsp. paratuberculosis
ucagcagggcggcacc

SEQ ID NO: 2966925 - RNA, 17 nt, Mycobacterium avium subsp. paratuberculosis
ucagcagggcggcaccg

SEQ ID NO: 2966926 - RNA, 18 nt, Mycobacterium avium subsp. paratuberculosis
ucagcagggcggcaccga

SEQ ID NO: 2966927 - RNA, 19 nt, Mycobacterium avium subsp. paratuberculosis
ucagcagggcggcaccgau

SEQ ID NO: 2966928 - RNA, 15 nt, Mycobacterium avium subsp. paratuberculosis
ucagcagggugacgu

SEQ ID NO: 2966929 - RNA, 17 nt, Mycobacterium avium subsp. paratuberculosis
ucagcagugccccgucc

SEQ ID NO: 2966930 - RNA, 22 nt, Mycobacterium avium subsp. paratuberculosis
ucagcagugccccguccggcgc

SEQ ID NO: 2966931 - RNA, 23 nt, Mycobacterium avium subsp. paratuberculosis
ucagcagugccccguccggcgcc

SEQ ID NO: 2966932 - RNA, 23 nt, Mycobacterium avium subsp. paratuberculosis
ucagcaguuuggucauguaccag

SEQ ID NO: 2966933 - RNA, 13 nt, Mycobacterium avium subsp. paratuberculosis
ucagcaucgccgu

SEQ ID NO: 2966934 - RNA, 13 nt, Mycobacterium avium subsp. paratuberculosis
ucagcaugucgcc

SEQ ID NO: 2966935 - RNA, 19 nt, Mycobacterium avium subsp. paratuberculosis
ucagcaugucgcccgcguc

SEQ ID NO: 2966936 - RNA, 17 nt, Mycobacterium avium subsp. paratuberculosis
ucagccaaaccgugucc

SEQ ID NO: 2966937 - RNA, 13 nt, Mycobacterium avium subsp. paratuberculosis
ucagccacaccgc

SEQ ID NO: 2966938 - RNA, 15 nt, Mycobacterium avium subsp. paratuberculosis
ucagccacaccgccg

SEQ ID NO: 2966939 - RNA, 16 nt, Mycobacterium avium subsp. paratuberculosis
ucagccacaccgccgg

SEQ ID NO: 2966940 - RNA, 22 nt, Mycobacterium avium subsp. paratuberculosis
ucagccacaccgccggcgcgga

SEQ ID NO: 2966941 - RNA, 14 nt, Mycobacterium avium subsp. paratuberculosis
ucagccacgccggc

SEQ ID NO: 2966942 - RNA, 15 nt, Mycobacterium avium subsp. paratuberculosis
ucagccacgccggca

SEQ ID NO: 2966943 - RNA, 13 nt, Mycobacterium avium subsp. paratuberculosis
ucagccacgggcg

SEQ ID NO: 2966944 - RNA, 18 nt, Mycobacterium avium subsp. paratuberculosis
ucagccacgggcggucgg

SEQ ID NO: 2966945 - RNA, 12 nt, Mycobacterium avium subsp. paratuberculosis
ucagccacucgc

SEQ ID NO: 2966946 - RNA, 20 nt, Mycobacterium avium subsp. paratuberculosis
ucagccagaucgaggccagc

SEQ ID NO: 2966947 - RNA, 21 nt, Mycobacterium avium subsp. paratuberculosis
ucagccagaucgaggccagcg

SEQ ID NO: 2966948 - RNA, 11 nt, Mycobacterium avium subsp. paratuberculosis
ucagccaggug

SEQ ID NO: 2966949 - RNA, 22 nt, Mycobacterium avium subsp. paratuberculosis
ucagccccagggugcgccgcuc

SEQ ID NO: 2966950 - RNA, 19 nt, Mycobacterium avium subsp. paratuberculosis
ucagcccccaccgcgccgu

SEQ ID NO: 2966951 - RNA, 16 nt, Mycobacterium avium subsp. paratuberculosis
ucagccccucguccag

SEQ ID NO: 2966952 - RNA, 20 nt, Mycobacterium avium subsp. paratuberculosis
ucagccccucguccaggugc

SEQ ID NO: 2966953 - RNA, 15 nt, Mycobacterium avium subsp. paratuberculosis
ucagcccgacccggc

SEQ ID NO: 2966954 - RNA, 19 nt, Mycobacterium avium subsp. paratuberculosis
ucagcccgauucagccggc

SEQ ID NO: 2966955 - RNA, 16 nt, Mycobacterium avium subsp. paratuberculosis
ucagcccgcccaccac

SEQ ID NO: 2966956 - RNA, 16 nt, Mycobacterium avium subsp. paratuberculosis
ucagcccggcccagcc

SEQ ID NO: 2966957 - RNA, 14 nt, Mycobacterium avium subsp. paratuberculosis
ucagcccggcgcug

SEQ ID NO: 2966958 - RNA, 17 nt, Mycobacterium avium subsp. paratuberculosis
ucagcccggcgcugcgc

SEQ ID NO: 2966959 - RNA, 20 nt, Mycobacterium avium subsp. paratuberculosis
ucagccgagacauagacguu

SEQ ID NO: 2966960 - RNA, 22 nt, Mycobacterium avium subsp. paratuberculosis
ucagccgauacaugugccgaug

SEQ ID NO: 2966961 - RNA, 16 nt, Mycobacterium avium subsp. paratuberculosis
ucagccgcaccagguu

SEQ ID NO: 2966962 - RNA, 14 nt, Mycobacterium avium subsp. paratuberculosis
ucagccgcccgauc

SEQ ID NO: 2966963 - RNA, 18 nt, Mycobacterium avium subsp. paratuberculosis
ucagccgcccuuguugau

SEQ ID NO: 2966964 - RNA, 13 nt, Mycobacterium avium subsp. paratuberculosis
ucagccgccuggc

SEQ ID NO: 2966965 - RNA, 19 nt, Mycobacterium avium subsp. paratuberculosis
ucagccgcgacagccgccc

SEQ ID NO: 2966966 - RNA, 15 nt, Mycobacterium avium subsp. paratuberculosis
ucagccgcggcggca

SEQ ID NO: 2966967 - RNA, 16 nt, Mycobacterium avium subsp. paratuberculosis
ucagccggagccggcc

SEQ ID NO: 2966968 - RNA, 17 nt, Mycobacterium avium subsp. paratuberculosis
ucagccggcgagcgcgc

SEQ ID NO: 2966969 - RNA, 20 nt, Mycobacterium avium subsp. paratuberculosis
ucagccggcgggcgcucgau

SEQ ID NO: 2966970 - RNA, 15 nt, Mycobacterium avium subsp. paratuberculosis
ucagccggcucggua

SEQ ID NO: 2966971 - RNA, 19 nt, Mycobacterium avium subsp. paratuberculosis
ucagccggguagcgccgcc

SEQ ID NO: 2966972 - RNA, 14 nt, Mycobacterium avium subsp. paratuberculosis
ucagccgucgucgu

SEQ ID NO: 2966973 - RNA, 16 nt, Mycobacterium avium subsp. paratuberculosis
ucagccguucgcugcc

SEQ ID NO: 2966974 - RNA, 17 nt, Mycobacterium avium subsp. paratuberculosis
ucagccguucgcugccc

SEQ ID NO: 2966975 - RNA, 14 nt, Mycobacterium avium subsp. paratuberculosis
ucagccuagccuug

SEQ ID NO: 2966976 - RNA, 23 nt, Mycobacterium avium subsp. paratuberculosis
ucagcgaaggcaugggcgugccg

SEQ ID NO: 2966977 - RNA, 16 nt, Mycobacterium avium subsp. paratuberculosis
ucagcgacgagagcgg

SEQ ID NO: 2966978 - RNA, 15 nt, Mycobacterium avium subsp. paratuberculosis
ucagcgacggcccgc

SEQ ID NO: 2966979 - RNA, 22 nt, Mycobacterium avium subsp. paratuberculosis
ucagcgacgucaggucgaccgg

SEQ ID NO: 2966980 - RNA, 17 nt, Mycobacterium avium subsp. paratuberculosis
ucagcgacucgaccccg

SEQ ID NO: 2966981 - RNA, 19 nt, Mycobacterium avium subsp. paratuberculosis
ucagcgacucgaccccgcc

SEQ ID NO: 2966982 - RNA, 19 nt, Mycobacterium avium subsp. paratuberculosis
ucagcgacuugccgccggc

SEQ ID NO: 2966983 - RNA, 21 nt, Mycobacterium avium subsp. paratuberculosis
ucagcgagacgaccaggaugc

SEQ ID NO: 2966984 - RNA, 13 nt, Mycobacterium avium subsp. paratuberculosis
ucagcgagcgguu

SEQ ID NO: 2966985 - RNA, 20 nt, Mycobacterium avium subsp. paratuberculosis
ucagcgagcgguuggcgacg

SEQ ID NO: 2966986 - RNA, 22 nt, Mycobacterium avium subsp. paratuberculosis
ucagcgaggcguagcugcaggc

SEQ ID NO: 2966987 - RNA, 14 nt, Mycobacterium avium subsp. paratuberculosis
ucagcgagugguac

SEQ ID NO: 2966988 - RNA, 17 nt, Mycobacterium avium subsp. paratuberculosis
ucagcgauugcggccgc

SEQ ID NO: 2966989 - RNA, 19 nt, Mycobacterium avium subsp. paratuberculosis
ucagcgauugcggccgccg

SEQ ID NO: 2966990 - RNA, 16 nt, Mycobacterium avium subsp. paratuberculosis
ucagcgcaccgccguc

SEQ ID NO: 2966991 - RNA, 14 nt, Mycobacterium avium subsp. paratuberculosis
ucagcgccaccagc

SEQ ID NO: 2966992 - RNA, 15 nt, Mycobacterium avium subsp. paratuberculosis
ucagcgccaccagca

SEQ ID NO: 2966993 - RNA, 17 nt, Mycobacterium avium subsp. paratuberculosis
ucagcgccaccagcacc

SEQ ID NO: 2966994 - RNA, 19 nt, Mycobacterium avium subsp. paratuberculosis
ucagcgccaccagcaccgg

SEQ ID NO: 2966995 - RNA, 21 nt, Mycobacterium avium subsp. paratuberculosis
ucagcgccagcaacacccagc

SEQ ID NO: 2966996 - RNA, 16 nt, Mycobacterium avium subsp. paratuberculosis
ucagcgccagcaugcc

SEQ ID NO: 2966997 - RNA, 16 nt, Mycobacterium avium subsp. paratuberculosis
ucagcgcccgcccggc

SEQ ID NO: 2966998 - RNA, 17 nt, Mycobacterium avium subsp. paratuberculosis
ucagcgcccgcccggcc

SEQ ID NO: 2966999 - RNA, 13 nt, Mycobacterium avium subsp. paratuberculosis
ucagcgcccgcgc

SEQ ID NO: 2967000 - RNA, 19 nt, Mycobacterium avium subsp. paratuberculosis
ucagcgccgcccgcaguuc

SEQ ID NO: 2967001 - RNA, 21 nt, Mycobacterium avium subsp. paratuberculosis
ucagcugaacggugcccgccg

SEQ ID NO: 2967002 - RNA, 19 nt, Mycobacterium avium subsp. paratuberculosis
ucagcugaccggcgaucgu

SEQ ID NO: 2967003 - RNA, 15 nt, Mycobacterium avium subsp. paratuberculosis
ucagcugcagccggc

SEQ ID NO: 2967004 - RNA, 16 nt, Mycobacterium avium subsp. paratuberculosis
ucagcugcagccggcc

SEQ ID NO: 2967005 - RNA, 15 nt, Mycobacterium avium subsp. paratuberculosis
ucagcuucaugcccu

SEQ ID NO: 2967006 - RNA, 21 nt, Mycobacterium avium subsp. paratuberculosis
ucagcuucaugcccuuggccc

SEQ ID NO: 2967007 - RNA, 21 nt, Mycobacterium avium subsp. paratuberculosis
ucagcuuggagccgagcaccg

SEQ ID NO: 2967008 - RNA, 20 nt, Mycobacterium avium subsp. paratuberculosis
ucaggaacaccgagccggcg

SEQ ID NO: 2967009 - RNA, 21 nt, Mycobacterium avium subsp. paratuberculosis
ucaggaacaccgagccggcgg

SEQ ID NO: 2967010 - RNA, 15 nt, Mycobacterium avium subsp. paratuberculosis
ucaggaacgccggcu

SEQ ID NO: 2967011 - RNA, 22 nt, Mycobacterium avium subsp. paratuberculosis
ucaggaacggccggauggccag

SEQ ID NO: 2967012 - RNA, 17 nt, Mycobacterium avium subsp. paratuberculosis
ucaggaauuugcggccc

SEQ ID NO: 2967013 - RNA, 17 nt, Mycobacterium avium subsp. paratuberculosis
ucaggagugcucggcgu

SEQ ID NO: 2967014 - RNA, 18 nt, Mycobacterium avium subsp. paratuberculosis
ucaggagugcucggcguu

SEQ ID NO: 2967015 - RNA, 16 nt, Mycobacterium avium subsp. paratuberculosis
ucaggagugguagggc

SEQ ID NO: 2967016 - RNA, 14 nt, Mycobacterium avium subsp. paratuberculosis
ucaggaucagcagc

SEQ ID NO: 2967017 - RNA, 15 nt, Mycobacterium avium subsp. paratuberculosis
ucaggaucagcagcc

SEQ ID NO: 2967018 - RNA, 14 nt, Mycobacterium avium subsp. paratuberculosis
ucaggaucgacguc

SEQ ID NO: 2967019 - RNA, 17 nt, Mycobacterium avium subsp. paratuberculosis
ucaggaucgacgucgac

SEQ ID NO: 2967020 - RNA, 17 nt, Mycobacterium avium subsp. paratuberculosis
ucaggaugacgccgcgg

SEQ ID NO: 2967021 - RNA, 18 nt, Mycobacterium avium subsp. paratuberculosis
ucaggaugacgccgcggu

SEQ ID NO: 2967022 - RNA, 14 nt, Mycobacterium avium subsp. paratuberculosis
ucaggaugauuucg

SEQ ID NO: 2967023 - RNA, 23 nt, Mycobacterium avium subsp. paratuberculosis
ucaggaugauuucggcguggcgg

SEQ ID NO: 2967024 - RNA, 19 nt, Mycobacterium avium subsp. paratuberculosis
ucaggcacucgaucagcac

SEQ ID NO: 2967025 - RNA, 16 nt, Mycobacterium avium subsp. paratuberculosis
ucaggcagcgcacgau

SEQ ID NO: 2967026 - RNA, 22 nt, Mycobacterium avium subsp. paratuberculosis
ucaggccacgcagguccaggau

SEQ ID NO: 2967027 - RNA, 22 nt, Mycobacterium avium subsp. paratuberculosis
ucaggcccagcgaggcggccag

SEQ ID NO: 2967028 - RNA, 19 nt, Mycobacterium avium subsp. paratuberculosis
ucaggcccaggcgaccucg

SEQ ID NO: 2967029 - RNA, 15 nt, Mycobacterium avium subsp. paratuberculosis
ucaggccccacccgc

SEQ ID NO: 2967030 - RNA, 16 nt, Mycobacterium avium subsp. paratuberculosis
ucaggccccacccgca

SEQ ID NO: 2967031 - RNA, 11 nt, Mycobacterium avium subsp. paratuberculosis
ucaggcccgcg

SEQ ID NO: 2967032 - RNA, 21 nt, Mycobacterium avium subsp. paratuberculosis
ucaggcccgcgccgacggccg

SEQ ID NO: 2967033 - RNA, 18 nt, Mycobacterium avium subsp. paratuberculosis
ucaggcccucgucggcga

SEQ ID NO: 2967034 - RNA, 18 nt, Mycobacterium avium subsp. paratuberculosis
ucaggcccuugccccacc

SEQ ID NO: 2967035 - RNA, 22 nt, Mycobacterium avium subsp. paratuberculosis
ucaggcccuugccccaccaccg

SEQ ID NO: 2967036 - RNA, 13 nt, Mycobacterium avium subsp. paratuberculosis
ucaggccggccug

SEQ ID NO: 2967037 - RNA, 16 nt, Mycobacterium avium subsp. paratuberculosis
ucaggccggcgccggg

SEQ ID NO: 2967038 - RNA, 22 nt, Mycobacterium avium subsp. paratuberculosis
ucaggccgggaaugucgcgcag

SEQ ID NO: 2967039 - RNA, 15 nt, Mycobacterium avium subsp. paratuberculosis
ucaggccggucagcg

SEQ ID NO: 2967040 - RNA, 19 nt, Mycobacterium avium subsp. paratuberculosis
ucaggccggucagcgacga

SEQ ID NO: 2967041 - RNA, 19 nt, Mycobacterium avium subsp. paratuberculosis
ucaggccguagcggcucgc

SEQ ID NO: 2967042 - RNA, 21 nt, Mycobacterium avium subsp. paratuberculosis
ucaggccguagcggcucgcca

SEQ ID NO: 2967043 - RNA, 15 nt, Mycobacterium avium subsp. paratuberculosis
ucaggccgugaucgg

SEQ ID NO: 2967044 - RNA, 20 nt, Mycobacterium avium subsp. paratuberculosis
ucaggccucgaggaucgcgg

SEQ ID NO: 2967045 - RNA, 16 nt, Mycobacterium avium subsp. paratuberculosis
ucaggcgcagccagcg

SEQ ID NO: 2967046 - RNA, 12 nt, Mycobacterium avium subsp. paratuberculosis
ucaggcgcgcac

SEQ ID NO: 2967047 - RNA, 23 nt, Mycobacterium avium subsp. paratuberculosis
ucaggcgcgcacguuggcggcca

SEQ ID NO: 2967048 - RNA, 16 nt, Mycobacterium avium subsp. paratuberculosis
ucaggcgcugggugcg

SEQ ID NO: 2967049 - RNA, 16 nt, Mycobacterium avium subsp. paratuberculosis
ucaggcggucgaacgc

SEQ ID NO: 2967050 - RNA, 14 nt, Mycobacterium avium subsp. paratuberculosis
ucaggcguccagca

SEQ ID NO: 2967051 - RNA, 16 nt, Mycobacterium avium subsp. paratuberculosis
ucaggcguccagcacc

SEQ ID NO: 2967052 - RNA, 18 nt, Mycobacterium avium subsp. paratuberculosis
ucaggcguccagcaccug

SEQ ID NO: 2967053 - RNA, 17 nt, Mycobacterium avium subsp. paratuberculosis
ucaggcugacgccacgc

SEQ ID NO: 2967054 - RNA, 14 nt, Mycobacterium avium subsp. paratuberculosis
ucagggcagcggug

SEQ ID NO: 2967055 - RNA, 17 nt, Mycobacterium avium subsp. paratuberculosis
ucagggccagcaacacc

SEQ ID NO: 2967056 - RNA, 21 nt, Mycobacterium avium subsp. paratuberculosis
ucagggccagcaacaccagcu

SEQ ID NO: 2967057 - RNA, 15 nt, Mycobacterium avium subsp. paratuberculosis
ucagggcccacagca

SEQ ID NO: 2967058 - RNA, 22 nt, Mycobacterium avium subsp. paratuberculosis
ucagggcccacagcagccgcac

SEQ ID NO: 2967059 - RNA, 11 nt, Mycobacterium avium subsp. paratuberculosis
ucagggccgcg

SEQ ID NO: 2967060 - RNA, 15 nt, Mycobacterium avium subsp. paratuberculosis
ucagggccgcggccg

SEQ ID NO: 2967061 - RNA, 22 nt, Mycobacterium avium subsp. paratuberculosis
ucagggccgcggccgccgcgac

SEQ ID NO: 2967062 - RNA, 18 nt, Mycobacterium avium subsp. paratuberculosis
ucagggcgacuccggcgc

SEQ ID NO: 2967063 - RNA, 19 nt, Mycobacterium avium subsp. paratuberculosis
ucagggcgcgcugucgacg

SEQ ID NO: 2967064 - RNA, 20 nt, Mycobacterium avium subsp. paratuberculosis
ucagggcgcucaucaggcgg

SEQ ID NO: 2967065 - RNA, 21 nt, Mycobacterium avium subsp. paratuberculosis
ucagggcgcucaucaggcggc

SEQ ID NO: 2967066 - RNA, 22 nt, Mycobacterium avium subsp. paratuberculosis
ucagggcggcgccgcggcccug

SEQ ID NO: 2967067 - RNA, 24 nt, Mycobacterium avium subsp. paratuberculosis
ucagggcggugcggugcgccgcau

SEQ ID NO: 2967068 - RNA, 12 nt, Mycobacterium avium subsp. paratuberculosis
ucagggcucgca

SEQ ID NO: 2967069 - RNA, 19 nt, Mycobacterium avium subsp. paratuberculosis
ucaggggugccggaggcgg

SEQ ID NO: 2967070 - RNA, 14 nt, Mycobacterium avium subsp. paratuberculosis
ucaggggugggcga

SEQ ID NO: 2967071 - RNA, 17 nt, Mycobacterium avium subsp. paratuberculosis
ucagggguuggcgcgca

SEQ ID NO: 2967072 - RNA, 20 nt, Mycobacterium avium subsp. paratuberculosis
ucagggguuggcgcgcagau

SEQ ID NO: 2967073 - RNA, 15 nt, Mycobacterium avium subsp. paratuberculosis
ucaggguccagggcg

SEQ ID NO: 2967074 - RNA, 14 nt, Mycobacterium avium subsp. paratuberculosis
ucagggugcguucc

SEQ ID NO: 2967075 - RNA, 14 nt, Mycobacterium avium subsp. paratuberculosis
ucagggugcucagc

SEQ ID NO: 2967076 - RNA, 18 nt, Mycobacterium avium subsp. paratuberculosis
ucagggugcucagccgca

SEQ ID NO: 2967077 - RNA, 18 nt, Mycobacterium avium subsp. paratuberculosis
ucagguagccgaggucgc

SEQ ID NO: 2967078 - RNA, 13 nt, Mycobacterium avium subsp. paratuberculosis
ucagguaggcgcg

SEQ ID NO: 2967079 - RNA, 15 nt, Mycobacterium avium subsp. paratuberculosis
ucagguaggcgucga

SEQ ID NO: 2967080 - RNA, 15 nt, Mycobacterium avium subsp. paratuberculosis
ucagguccgcgaguu

SEQ ID NO: 2967081 - RNA, 17 nt, Mycobacterium avium subsp. paratuberculosis
ucaggucgauggucugc

SEQ ID NO: 2967082 - RNA, 21 nt, Mycobacterium avium subsp. paratuberculosis
ucaggucggccgcggccggcg

SEQ ID NO: 2967083 - RNA, 17 nt, Mycobacterium avium subsp. paratuberculosis
ucagguggauggucacc

SEQ ID NO: 2967084 - RNA, 18 nt, Mycobacterium avium subsp. paratuberculosis
ucagguggauggucaccg

SEQ ID NO: 2967085 - RNA, 15 nt, Mycobacterium avium subsp. paratuberculosis
ucagguucaccagca

SEQ ID NO: 2967086 - RNA, 15 nt, Mycobacterium avium subsp. paratuberculosis
ucauggccagcucgu

SEQ ID NO: 2967087 - RNA, 23 nt, Mycobacterium avium subsp. paratuberculosis
ucauggccuccccauccgcggcc

SEQ ID NO: 2967088 - RNA, 17 nt, Mycobacterium avium subsp. paratuberculosis
ucauggcgaacgccuug

SEQ ID NO: 2967089 - RNA, 16 nt, Mycobacterium avium subsp. paratuberculosis
ucauggcgaccgcgac

SEQ ID NO: 2967090 - RNA, 13 nt, Mycobacterium avium subsp. paratuberculosis
ucaugggcccggc

SEQ ID NO: 2967091 - RNA, 16 nt, Mycobacterium avium subsp. paratuberculosis
ucauggucggcgacgc

SEQ ID NO: 2967092 - RNA, 22 nt, Mycobacterium avium subsp. paratuberculosis
ucauggucggcgacgccgucgg

SEQ ID NO: 2967093 - RNA, 13 nt, Mycobacterium avium subsp. paratuberculosis
ucauggucgucgu

SEQ ID NO: 2967094 - RNA, 15 nt, Mycobacterium avium subsp. paratuberculosis
ucauggucgucgucg

SEQ ID NO: 2967095 - RNA, 16 nt, Mycobacterium avium subsp. paratuberculosis
ucauggucgucgucga

SEQ ID NO: 2967096 - RNA, 14 nt, Mycobacterium avium subsp. paratuberculosis
ucaugguggcggcg

SEQ ID NO: 2967097 - RNA, 14 nt, Mycobacterium avium subsp. paratuberculosis
ucauggugucccau

SEQ ID NO: 2967098 - RNA, 19 nt, Mycobacterium avium subsp. paratuberculosis
ucaugguguuccaccagcg

SEQ ID NO: 2967099 - RNA, 17 nt, Mycobacterium avium subsp. paratuberculosis
ucauguaccaggcgacg

SEQ ID NO: 2967100 - RNA, 17 nt, Mycobacterium avium subsp. paratuberculosis
ucauguagcagcgcggc

SEQ ID NO: 2967101 - RNA, 23 nt, Mycobacterium avium subsp. paratuberculosis
ucaugucgaugccgagccggccg

SEQ ID NO: 2967102 - RNA, 21 nt, Mycobacterium avium subsp. paratuberculosis
ucaugucguccucccggccga

SEQ ID NO: 2967103 - RNA, 22 nt, Mycobacterium avium subsp. paratuberculosis
ucaugugguugggccaggccuc

SEQ ID NO: 2967104 - RNA, 18 nt, Mycobacterium avium subsp. paratuberculosis
ucauguugugcaggcagc

SEQ ID NO: 2967105 - RNA, 18 nt, Mycobacterium avium subsp. paratuberculosis
ucauugaucuccgcggcg

SEQ ID NO: 2967106 - RNA, 23 nt, Mycobacterium avium subsp. paratuberculosis
uccaaagcggcuaagccggcguc

SEQ ID NO: 2967107 - RNA, 21 nt, Mycobacterium avium subsp. paratuberculosis
uccaacaggugcuuggucagc

SEQ ID NO: 2967108 - RNA, 22 nt, Mycobacterium avium subsp. paratuberculosis
uccaacaugccuuucagcucga

SEQ ID NO: 2967109 - RNA, 19 nt, Mycobacterium avium subsp. paratuberculosis
uccaaccaccguggcccca

SEQ ID NO: 2967110 - RNA, 20 nt, Mycobacterium avium subsp. paratuberculosis
uccaacgggcucagcaccac

SEQ ID NO: 2967111 - RNA, 22 nt, Mycobacterium avium subsp. paratuberculosis
uccaagccgggcggcagcagcu

SEQ ID NO: 2967112 - RNA, 18 nt, Mycobacterium avium subsp. paratuberculosis
uccaaugcgccgauggug

SEQ ID NO: 2967113 - RNA, 20 nt, Mycobacterium avium subsp. paratuberculosis
uccaaugcgccgauggugcc

SEQ ID NO: 2967114 - RNA, 22 nt, Mycobacterium avium subsp. paratuberculosis
uccacaaccagcgauucccgcc

SEQ ID NO: 2967115 - RNA, 22 nt, Mycobacterium avium subsp. paratuberculosis
uccacacggcaggcggcccgcu

SEQ ID NO: 2967116 - RNA, 10 nt, Mycobacterium avium subsp. paratuberculosis
uccacagcag

SEQ ID NO: 2967117 - RNA, 19 nt, Mycobacterium avium subsp. paratuberculosis
uccacagcccguugcugcg

SEQ ID NO: 2967118 - RNA, 16 nt, Mycobacterium avium subsp. paratuberculosis
uccacagccggcggcu

SEQ ID NO: 2967119 - RNA, 12 nt, Mycobacterium avium subsp. paratuberculosis
uccacagcgcga

SEQ ID NO: 2967120 - RNA, 15 nt, Mycobacterium avium subsp. paratuberculosis
uccacagcugcaggc

SEQ ID NO: 2967121 - RNA, 21 nt, Mycobacterium avium subsp. paratuberculosis
uccacaucugccggcagaucu

SEQ ID NO: 2967122 - RNA, 15 nt, Mycobacterium avium subsp. paratuberculosis
uccaccaaggucucc

SEQ ID NO: 2967123 - RNA, 18 nt, Mycobacterium avium subsp. paratuberculosis
uccaccaauucgcgcugc

SEQ ID NO: 2967124 - RNA, 12 nt, Mycobacterium avium subsp. paratuberculosis
uccaccaccaca

SEQ ID NO: 2967125 - RNA, 22 nt, Mycobacterium avium subsp. paratuberculosis
uccaccaccacacccgcggccg

SEQ ID NO: 2967126 - RNA, 13 nt, Mycobacterium avium subsp. paratuberculosis
uccaccaccgcgg

SEQ ID NO: 2967127 - RNA, 16 nt, Mycobacterium avium subsp. paratuberculosis
uccaccaccggccgcg

SEQ ID NO: 2967128 - RNA, 17 nt, Mycobacterium avium subsp. paratuberculosis
uccaccaccggccgcgc

SEQ ID NO: 2967129 - RNA, 14 nt, Mycobacterium avium subsp. paratuberculosis
uccaccagcggccg

SEQ ID NO: 2967130 - RNA, 16 nt, Mycobacterium avium subsp. paratuberculosis
uccaccagcggccguc

SEQ ID NO: 2967131 - RNA, 22 nt, Mycobacterium avium subsp. paratuberculosis
uccaccagcggccgucgccggg

SEQ ID NO: 2967132 - RNA, 13 nt, Mycobacterium avium subsp. paratuberculosis
uccaccagcggcg

SEQ ID NO: 2967133 - RNA, 18 nt, Mycobacterium avium subsp. paratuberculosis
uccaccagcggcgcgucg

SEQ ID NO: 2967134 - RNA, 13 nt, Mycobacterium avium subsp. paratuberculosis
uccaccagggugg

SEQ ID NO: 2967135 - RNA, 14 nt, Mycobacterium avium subsp. paratuberculosis
uccaccaggguggc

SEQ ID NO: 2967136 - RNA, 16 nt, Mycobacterium avium subsp. paratuberculosis
uccaccaggguggccg

SEQ ID NO: 2967137 - RNA, 19 nt, Mycobacterium avium subsp. paratuberculosis
uccaccagguucgcgcagc

SEQ ID NO: 2967138 - RNA, 20 nt, Mycobacterium avium subsp. paratuberculosis
uccaccagguucgcgcagcu

SEQ ID NO: 2967139 - RNA, 15 nt, Mycobacterium avium subsp. paratuberculosis
uccaccaucuuccau

SEQ ID NO: 2967140 - RNA, 20 nt, Mycobacterium avium subsp. paratuberculosis
uccacccaccggcaugggcg

SEQ ID NO: 2967141 - RNA, 19 nt, Mycobacterium avium subsp. paratuberculosis
uccacccgccccgccgcgg

SEQ ID NO: 2967142 - RNA, 22 nt, Mycobacterium avium subsp. paratuberculosis
uccacccgccccgccgcggcca

SEQ ID NO: 2967143 - RNA, 21 nt, Mycobacterium avium subsp. paratuberculosis
uccacccgccccuccaggcau

SEQ ID NO: 2967144 - RNA, 22 nt, Mycobacterium avium subsp. paratuberculosis
uccacccgccccuccaggcaug

SEQ ID NO: 2967145 - RNA, 13 nt, Mycobacterium avium subsp. paratuberculosis
uccacccgcgccc

SEQ ID NO: 2967146 - RNA, 17 nt, Mycobacterium avium subsp. paratuberculosis
uccacccggcccaccac

SEQ ID NO: 2967147 - RNA, 19 nt, Mycobacterium avium subsp. paratuberculosis
uccacccggcccaccaccg

SEQ ID NO: 2967148 - RNA, 22 nt, Mycobacterium avium subsp. paratuberculosis
uccacccggcccaccaccgccu

SEQ ID NO: 2967149 - RNA, 20 nt, Mycobacterium avium subsp. paratuberculosis
uccacccguuccucgacgua

SEQ ID NO: 2967150 - RNA, 14 nt, Mycobacterium avium subsp. paratuberculosis
uccacccugccgac

SEQ ID NO: 2967151 - RNA, 20 nt, Mycobacterium avium subsp. paratuberculosis
uccaccgaaaagcccgccgc

SEQ ID NO: 2967152 - RNA, 13 nt, Mycobacterium avium subsp. paratuberculosis
uccaccgacgcca

SEQ ID NO: 2967153 - RNA, 19 nt, Mycobacterium avium subsp. paratuberculosis
uccaccgagugcggcgcgg

SEQ ID NO: 2967154 - RNA, 15 nt, Mycobacterium avium subsp. paratuberculosis
uccaccgccgcgccg

SEQ ID NO: 2967155 - RNA, 17 nt, Mycobacterium avium subsp. paratuberculosis
uccaccgccgcgccgag

SEQ ID NO: 2967156 - RNA, 16 nt, Mycobacterium avium subsp. paratuberculosis
uccaccgcgccggcgg

SEQ ID NO: 2967157 - RNA, 17 nt, Mycobacterium avium subsp. paratuberculosis
uccaccgcgccggcggc

SEQ ID NO: 2967158 - RNA, 16 nt, Mycobacterium avium subsp. paratuberculosis
uccaccgcgcgcgggu

SEQ ID NO: 2967159 - RNA, 17 nt, Mycobacterium avium subsp. paratuberculosis
uccaccggauggcgccc

SEQ ID NO: 2967160 - RNA, 23 nt, Mycobacterium avium subsp. paratuberculosis
uccaccggauggcgcccggcagc

SEQ ID NO: 2967161 - RNA, 15 nt, Mycobacterium avium subsp. paratuberculosis
uccaccggcaaucgg

SEQ ID NO: 2967162 - RNA, 19 nt, Mycobacterium avium subsp. paratuberculosis
uccaccggcaaucgggacg

SEQ ID NO: 2967163 - RNA, 23 nt, Mycobacterium avium subsp. paratuberculosis
uccaccggcaaucgggacgccac

SEQ ID NO: 2967164 - RNA, 18 nt, Mycobacterium avium subsp. paratuberculosis
uccaccggcacggcaccg

SEQ ID NO: 2967165 - RNA, 11 nt, Mycobacterium avium subsp. paratuberculosis
uccaccggccg

SEQ ID NO: 2967166 - RNA, 13 nt, Mycobacterium avium subsp. paratuberculosis
uccaccggccgau

SEQ ID NO: 2967167 - RNA, 17 nt, Mycobacterium avium subsp. paratuberculosis
uccaccggccgauggcc

SEQ ID NO: 2967168 - RNA, 23 nt, Mycobacterium avium subsp. paratuberculosis
uccaccggucggaaaaguggguc

SEQ ID NO: 2967169 - RNA, 22 nt, Mycobacterium avium subsp. paratuberculosis
uccaccguggucggcagcaccg

SEQ ID NO: 2967170 - RNA, 15 nt, Mycobacterium avium subsp. paratuberculosis
uccaccguugucucg

SEQ ID NO: 2967171 - RNA, 19 nt, Mycobacterium avium subsp. paratuberculosis
uccaccguugucucggcgc

SEQ ID NO: 2967172 - RNA, 15 nt, Mycobacterium avium subsp. paratuberculosis
uccaccucgggccgg

SEQ ID NO: 2967173 - RNA, 17 nt, Mycobacterium avium subsp. paratuberculosis
uccaccucgggccgggc

SEQ ID NO: 2967174 - RNA, 17 nt, Mycobacterium avium subsp. paratuberculosis
uccacgaccccggcggc

SEQ ID NO: 2967175 - RNA, 22 nt, Mycobacterium avium subsp. paratuberculosis
uccacgaccuggcgggccagcu

SEQ ID NO: 2967176 - RNA, 20 nt, Mycobacterium avium subsp. paratuberculosis
uccacgacguccucgacgau

SEQ ID NO: 2967177 - RNA, 20 nt, Mycobacterium avium subsp. paratuberculosis
uccacgacuucacaggccgc

SEQ ID NO: 2967178 - RNA, 12 nt, Mycobacterium avium subsp. paratuberculosis
uccacgaugacg

SEQ ID NO: 2967179 - RNA, 20 nt, Mycobacterium avium subsp. paratuberculosis
uccacgaugcggugccgggu

SEQ ID NO: 2967180 - RNA, 19 nt, Mycobacterium avium subsp. paratuberculosis
uccacgcccagcgccccga

SEQ ID NO: 2967181 - RNA, 17 nt, Mycobacterium avium subsp. paratuberculosis
uccacgcccggacccgc

SEQ ID NO: 2967182 - RNA, 19 nt, Mycobacterium avium subsp. paratuberculosis
uccacgccgccgggaacag

SEQ ID NO: 2967183 - RNA, 17 nt, Mycobacterium avium subsp. paratuberculosis
uccacgcggugauccag

SEQ ID NO: 2967184 - RNA, 18 nt, Mycobacterium avium subsp. paratuberculosis
uccacgcguagccgacca

SEQ ID NO: 2967185 - RNA, 12 nt, Mycobacterium avium subsp. paratuberculosis
uccacgcuggcg

SEQ ID NO: 2967186 - RNA, 19 nt, Mycobacterium avium subsp. paratuberculosis
uccacggcauggugaugau

SEQ ID NO: 2967187 - RNA, 12 nt, Mycobacterium avium subsp. paratuberculosis
uccacggccggu

SEQ ID NO: 2967188 - RNA, 15 nt, Mycobacterium avium subsp. paratuberculosis
uccacggucagcgcg

SEQ ID NO: 2967189 - RNA, 20 nt, Mycobacterium avium subsp. paratuberculosis
uccacggucagcgcgucggc

SEQ ID NO: 2967190 - RNA, 13 nt, Mycobacterium avium subsp. paratuberculosis
uccacggugcgca

SEQ ID NO: 2967191 - RNA, 22 nt, Mycobacterium avium subsp. paratuberculosis
uccacgucgucggacagcagca

SEQ ID NO: 2967192 - RNA, 14 nt, Mycobacterium avium subsp. paratuberculosis
uccacgugucggcg

SEQ ID NO: 2967193 - RNA, 15 nt, Mycobacterium avium subsp. paratuberculosis
uccacgugucggcgu

SEQ ID NO: 2967194 - RNA, 19 nt, Mycobacterium avium subsp. paratuberculosis
uccacgugucggcgucgau

SEQ ID NO: 2967195 - RNA, 16 nt, Mycobacterium avium subsp. paratuberculosis
uccacguugaugccgc

SEQ ID NO: 2967196 - RNA, 22 nt, Mycobacterium avium subsp. paratuberculosis
uccacguugaugccgcccagca

SEQ ID NO: 2967197 - RNA, 15 nt, Mycobacterium avium subsp. paratuberculosis
uccacuccagcaccg

SEQ ID NO: 2967198 - RNA, 13 nt, Mycobacterium avium subsp. paratuberculosis
uccagaacagcca

SEQ ID NO: 2967199 - RNA, 17 nt, Mycobacterium avium subsp. paratuberculosis
uccagaacucggcggcg

SEQ ID NO: 2967200 - RNA, 14 nt, Mycobacterium avium subsp. paratuberculosis
uccagaccggccgg

SEQ ID NO: 2967201 - RNA, 18 nt, Mycobacterium avium subsp. paratuberculosis
uccagaccggccggggcg

SEQ ID NO: 2967202 - RNA, 21 nt, Mycobacterium avium subsp. paratuberculosis
uccagaccggccggggcgggc

SEQ ID NO: 2967203 - RNA, 17 nt, Mycobacterium avium subsp. paratuberculosis
uccagaccggcggcgau

SEQ ID NO: 2967204 - RNA, 18 nt, Mycobacterium avium subsp. paratuberculosis
uccagaccggcggcgauc

SEQ ID NO: 2967205 - RNA, 15 nt, Mycobacterium avium subsp. paratuberculosis
uccagacggucuugg

SEQ ID NO: 2967206 - RNA, 15 nt, Mycobacterium avium subsp. paratuberculosis
uccagacguugaucu

SEQ ID NO: 2967207 - RNA, 18 nt, Mycobacterium avium subsp. paratuberculosis
uccagagcaucagggcgu

SEQ ID NO: 2967208 - RNA, 16 nt, Mycobacterium avium subsp. paratuberculosis
uccagaucgccgccca

SEQ ID NO: 2967209 - RNA, 17 nt, Mycobacterium avium subsp. paratuberculosis
uccagaucggccagcgc

SEQ ID NO: 2967210 - RNA, 20 nt, Mycobacterium avium subsp. paratuberculosis
uccagaucggccagcgcggc

SEQ ID NO: 2967211 - RNA, 13 nt, Mycobacterium avium subsp. paratuberculosis
uccagaucggcgc

SEQ ID NO: 2967212 - RNA, 15 nt, Mycobacterium avium subsp. paratuberculosis
uccagaugcccagca

SEQ ID NO: 2967213 - RNA, 16 nt, Mycobacterium avium subsp. paratuberculosis
uccagaugcccagcag

SEQ ID NO: 2967214 - RNA, 14 nt, Mycobacterium avium subsp. paratuberculosis
uccagaugccgggu

SEQ ID NO: 2967215 - RNA, 21 nt, Mycobacterium avium subsp. paratuberculosis
uccagaugccgggugggcagc

SEQ ID NO: 2967216 - RNA, 15 nt, Mycobacterium avium subsp. paratuberculosis
uccagcaacgccgac

SEQ ID NO: 2967217 - RNA, 17 nt, Mycobacterium avium subsp. paratuberculosis
uccagcaccacccgguc

SEQ ID NO: 2967218 - RNA, 14 nt, Mycobacterium avium subsp. paratuberculosis
uccagcaccagcac

SEQ ID NO: 2967219 - RNA, 18 nt, Mycobacterium avium subsp. paratuberculosis
uccagcaccagcacggcg

SEQ ID NO: 2967220 - RNA, 19 nt, Mycobacterium avium subsp. paratuberculosis
uccagcaccccgucgaggu

SEQ ID NO: 2967221 - RNA, 14 nt, Mycobacterium avium subsp. paratuberculosis
uccagcacccggcc

SEQ ID NO: 2967222 - RNA, 17 nt, Mycobacterium avium subsp. paratuberculosis
uccagcaccggcgccau

SEQ ID NO: 2967223 - RNA, 13 nt, Mycobacterium avium subsp. paratuberculosis
uccagcaccggcu

SEQ ID NO: 2967224 - RNA, 21 nt, Mycobacterium avium subsp. paratuberculosis
uccagcaccugaccgucggcc

SEQ ID NO: 2967225 - RNA, 19 nt, Mycobacterium avium subsp. paratuberculosis
uccagcacgaaggccgccg

SEQ ID NO: 2967226 - RNA, 22 nt, Mycobacterium avium subsp. paratuberculosis
uccagcacgaaggccgccgggu

SEQ ID NO: 2967227 - RNA, 13 nt, Mycobacterium avium subsp. paratuberculosis
uccagcacgccca

SEQ ID NO: 2967228 - RNA, 16 nt, Mycobacterium avium subsp. paratuberculosis
uccagcacgcccagau

SEQ ID NO: 2967229 - RNA, 14 nt, Mycobacterium avium subsp. paratuberculosis
uccagcacggccgc

SEQ ID NO: 2967230 - RNA, 20 nt, Mycobacterium avium subsp. paratuberculosis
uccagcacggccgccaggau

SEQ ID NO: 2967231 - RNA, 14 nt, Mycobacterium avium subsp. paratuberculosis
uccagcacgucggg

SEQ ID NO: 2967232 - RNA, 16 nt, Mycobacterium avium subsp. paratuberculosis
uccagcacgugcccag

SEQ ID NO: 2967233 - RNA, 18 nt, Mycobacterium avium subsp. paratuberculosis
uccagcacgugcccagcc

SEQ ID NO: 2967234 - RNA, 22 nt, Mycobacterium avium subsp. paratuberculosis
uccagcacgugcccagcccgcg

SEQ ID NO: 2967235 - RNA, 16 nt, Mycobacterium avium subsp. paratuberculosis
uccagcagcagcgcgc

SEQ ID NO: 2967236 - RNA, 23 nt, Mycobacterium avium subsp. paratuberculosis
uccagcagcccgggcugcagcag

SEQ ID NO: 2967237 - RNA, 18 nt, Mycobacterium avium subsp. paratuberculosis
uccagcagcgccagcacc

SEQ ID NO: 2967238 - RNA, 21 nt, Mycobacterium avium subsp. paratuberculosis
uccagcagcgccagcaccgcc

SEQ ID NO: 2967239 - RNA, 13 nt, Mycobacterium avium subsp. paratuberculosis
uccagcagcgccg

SEQ ID NO: 2967240 - RNA, 22 nt, Mycobacterium avium subsp. paratuberculosis
uccagcagcgccggcagcgccu

SEQ ID NO: 2967241 - RNA, 22 nt, Mycobacterium avium subsp. paratuberculosis
uccagcagcgccucggcgaucg

SEQ ID NO: 2967242 - RNA, 21 nt, Mycobacterium avium subsp. paratuberculosis
uccagcagcgccuugccgacg

SEQ ID NO: 2967243 - RNA, 22 nt, Mycobacterium avium subsp. paratuberculosis
uccagcagcgccuugccgacga

SEQ ID NO: 2967244 - RNA, 13 nt, Mycobacterium avium subsp. paratuberculosis
uccagcagcggcu

SEQ ID NO: 2967245 - RNA, 11 nt, Mycobacterium avium subsp. paratuberculosis
uccagcaggcg

SEQ ID NO: 2967246 - RNA, 13 nt, Mycobacterium avium subsp. paratuberculosis
uccagcaggcgcg

SEQ ID NO: 2967247 - RNA, 15 nt, Mycobacterium avium subsp. paratuberculosis
uccagcaggcgcgcc

SEQ ID NO: 2967248 - RNA, 16 nt, Mycobacterium avium subsp. paratuberculosis
uccagcaggcgcgccg

SEQ ID NO: 2967249 - RNA, 19 nt, Mycobacterium avium subsp. paratuberculosis
uccagcaggcgcgccgagc

SEQ ID NO: 2967250 - RNA, 11 nt, Mycobacterium avium subsp. paratuberculosis
uccagcaggcu

SEQ ID NO: 2967251 - RNA, 17 nt, Mycobacterium avium subsp. paratuberculosis
uccagcaggcuggcguu

SEQ ID NO: 2967252 - RNA, 18 nt, Mycobacterium avium subsp. paratuberculosis
uccagccacuccaccacc

SEQ ID NO: 2967253 - RNA, 13 nt, Mycobacterium avium subsp. paratuberculosis
uccagccagcgcg

SEQ ID NO: 2967254 - RNA, 17 nt, Mycobacterium avium subsp. paratuberculosis
uccagccauucgucggg

SEQ ID NO: 2967255 - RNA, 19 nt, Mycobacterium avium subsp. paratuberculosis
uccaggugcacccgcggcg

SEQ ID NO: 2967256 - RNA, 22 nt, Mycobacterium avium subsp. paratuberculosis
uccaggugcacccgcggcgcga

SEQ ID NO: 2967257 - RNA, 14 nt, Mycobacterium avium subsp. paratuberculosis
uccagguggccaug

SEQ ID NO: 2967258 - RNA, 20 nt, Mycobacterium avium subsp. paratuberculosis
uccagguggggugguggaau

SEQ ID NO: 2967259 - RNA, 15 nt, Mycobacterium avium subsp. paratuberculosis
uccaguacaccgcga

SEQ ID NO: 2967260 - RNA, 13 nt, Mycobacterium avium subsp. paratuberculosis
uccagucccaguu

SEQ ID NO: 2967261 - RNA, 13 nt, Mycobacterium avium subsp. paratuberculosis
uccaguccggccg

SEQ ID NO: 2967262 - RNA, 18 nt, Mycobacterium avium subsp. paratuberculosis
uccaguccggcgcccggc

SEQ ID NO: 2967263 - RNA, 15 nt, Mycobacterium avium subsp. paratuberculosis
uccagucggcgccga

SEQ ID NO: 2967264 - RNA, 16 nt, Mycobacterium avium subsp. paratuberculosis
uccagucggcgccgau

SEQ ID NO: 2967265 - RNA, 19 nt, Mycobacterium avium subsp. paratuberculosis
uccagugacgccugcggcc

SEQ ID NO: 2967266 - RNA, 15 nt, Mycobacterium avium subsp. paratuberculosis
uccagugcaugccgg

SEQ ID NO: 2967267 - RNA, 18 nt, Mycobacterium avium subsp. paratuberculosis
uccagugcaugccggccu

SEQ ID NO: 2967268 - RNA, 18 nt, Mycobacterium avium subsp. paratuberculosis
uccagugccggcgagugc

SEQ ID NO: 2967269 - RNA, 15 nt, Mycobacterium avium subsp. paratuberculosis
uccaguucggccagc

SEQ ID NO: 2967270 - RNA, 20 nt, Mycobacterium avium subsp. paratuberculosis
uccaguucggccagcgcggu

SEQ ID NO: 2967271 - RNA, 18 nt, Mycobacterium avium subsp. paratuberculosis
uccaguugcgaccccgcc

SEQ ID NO: 2967272 - RNA, 19 nt, Mycobacterium avium subsp. paratuberculosis
uccaguugcggcacgccga

SEQ ID NO: 2967273 - RNA, 16 nt, Mycobacterium avium subsp. paratuberculosis
uccaucagcgcccgcg

SEQ ID NO: 2967274 - RNA, 19 nt, Mycobacterium avium subsp. paratuberculosis
uccaucagcgcccgcgcgg

SEQ ID NO: 2967275 - RNA, 22 nt, Mycobacterium avium subsp. paratuberculosis
uccaucagcgcccgcgcgggcu

SEQ ID NO: 2967276 - RNA, 18 nt, Mycobacterium avium subsp. paratuberculosis
uccauccgggcggccagc

SEQ ID NO: 2967277 - RNA, 14 nt, Mycobacterium avium subsp. paratuberculosis
uccaucgacgcuga

SEQ ID NO: 2967278 - RNA, 19 nt, Mycobacterium avium subsp. paratuberculosis
uccaucgacgcugagucua

SEQ ID NO: 2967279 - RNA, 17 nt, Mycobacterium avium subsp. paratuberculosis
uccaucgauggcggugu

SEQ ID NO: 2967280 - RNA, 19 nt, Mycobacterium avium subsp. paratuberculosis
uccaucgccgcgcacccgg

SEQ ID NO: 2967281 - RNA, 19 nt, Mycobacterium avium subsp. paratuberculosis
uccaugaaccacugcggca

SEQ ID NO: 2967282 - RNA, 17 nt, Mycobacterium avium subsp. paratuberculosis
uccaugaaccggucguu

SEQ ID NO: 2967283 - RNA, 15 nt, Mycobacterium avium subsp. paratuberculosis
uccaugaacggcagc

SEQ ID NO: 2967284 - RNA, 16 nt, Mycobacterium avium subsp. paratuberculosis
uccaugaacggcagcu

SEQ ID NO: 2967285 - RNA, 19 nt, Mycobacterium avium subsp. paratuberculosis
uccaugaacggcagcucgu

SEQ ID NO: 2967286 - RNA, 15 nt, Mycobacterium avium subsp. paratuberculosis
uccauggccuugacg

SEQ ID NO: 2967287 - RNA, 13 nt, Mycobacterium avium subsp. paratuberculosis
uccauggucgagc

SEQ ID NO: 2967288 - RNA, 20 nt, Mycobacterium avium subsp. paratuberculosis
uccauggugaacugguugac

SEQ ID NO: 2967289 - RNA, 18 nt, Mycobacterium avium subsp. paratuberculosis
uccauguaguucagcagc

SEQ ID NO: 2967290 - RNA, 19 nt, Mycobacterium avium subsp. paratuberculosis
uccauguaguucagcagcc

SEQ ID NO: 2967291 - RNA, 23 nt, Mycobacterium avium subsp. paratuberculosis
uccaugucgcaacggucgggauc

SEQ ID NO: 2967292 - RNA, 19 nt, Mycobacterium avium subsp. paratuberculosis
uccaugucgucggcggacu

SEQ ID NO: 2967293 - RNA, 15 nt, Mycobacterium avium subsp. paratuberculosis
uccauucgggccagc

SEQ ID NO: 2967294 - RNA, 14 nt, Mycobacterium avium subsp. paratuberculosis
uccauugggccgcg

SEQ ID NO: 2967295 - RNA, 15 nt, Mycobacterium avium subsp. paratuberculosis
uccauugggccgcgg

SEQ ID NO: 2967296 - RNA, 19 nt, Mycobacterium avium subsp. paratuberculosis
ucccaacgcagcgcauccg

SEQ ID NO: 2967297 - RNA, 17 nt, Mycobacterium avium subsp. paratuberculosis
ucccacaccaccaccga

SEQ ID NO: 2967298 - RNA, 21 nt, Mycobacterium avium subsp. paratuberculosis
ucccacaccaccaccgagccg

SEQ ID NO: 2967299 - RNA, 17 nt, Mycobacterium avium subsp. paratuberculosis
ucccacccgcaacgcug

SEQ ID NO: 2967300 - RNA, 22 nt, Mycobacterium avium subsp. paratuberculosis
ucccacccgcaacgcugaccgc

SEQ ID NO: 2967301 - RNA, 13 nt, Mycobacterium avium subsp. paratuberculosis
ucccacccggucu

SEQ ID NO: 2967302 - RNA, 15 nt, Mycobacterium avium subsp. paratuberculosis
ucccacgaacggguc

SEQ ID NO: 2967303 - RNA, 21 nt, Mycobacterium avium subsp. paratuberculosis
ucccacucguagucguuggug

SEQ ID NO: 2967304 - RNA, 14 nt, Mycobacterium avium subsp. paratuberculosis
ucccacugcccgua

SEQ ID NO: 2967305 - RNA, 18 nt, Mycobacterium avium subsp. paratuberculosis
ucccagaauucgccgggg

SEQ ID NO: 2967306 - RNA, 19 nt, Mycobacterium avium subsp. paratuberculosis
ucccagaauucgccggggc

SEQ ID NO: 2967307 - RNA, 21 nt, Mycobacterium avium subsp. paratuberculosis
ucccagaauucgccggggcac

SEQ ID NO: 2967308 - RNA, 17 nt, Mycobacterium avium subsp. paratuberculosis
ucccagcacagccgucg

SEQ ID NO: 2967309 - RNA, 21 nt, Mycobacterium avium subsp. paratuberculosis
ucccagccauacugacgccgg

SEQ ID NO: 2967310 - RNA, 14 nt, Mycobacterium avium subsp. paratuberculosis
ucccagccgccggc

SEQ ID NO: 2967311 - RNA, 19 nt, Mycobacterium avium subsp. paratuberculosis
ucccagccggacagcgggu

SEQ ID NO: 2967312 - RNA, 12 nt, Mycobacterium avium subsp. paratuberculosis
ucccagcggccg

SEQ ID NO: 2967313 - RNA, 13 nt, Mycobacterium avium subsp. paratuberculosis
ucccagcggccga

SEQ ID NO: 2967314 - RNA, 20 nt, Mycobacterium avium subsp. paratuberculosis
ucccagcgggacagcaccac

SEQ ID NO: 2967315 - RNA, 14 nt, Mycobacterium avium subsp. paratuberculosis
ucccaggaccacuc

SEQ ID NO: 2967316 - RNA, 16 nt, Mycobacterium avium subsp. paratuberculosis
ucccaggaccacuccu

SEQ ID NO: 2967317 - RNA, 14 nt, Mycobacterium avium subsp. paratuberculosis
ucccaggacgcggu

SEQ ID NO: 2967318 - RNA, 15 nt, Mycobacterium avium subsp. paratuberculosis
ucccaggacggcgcg

SEQ ID NO: 2967319 - RNA, 19 nt, Mycobacterium avium subsp. paratuberculosis
ucccaggauuccgucggcg

SEQ ID NO: 2967320 - RNA, 21 nt, Mycobacterium avium subsp. paratuberculosis
ucccaggauuccgucggcggc

SEQ ID NO: 2967321 - RNA, 13 nt, Mycobacterium avium subsp. paratuberculosis
ucccaggccagga

SEQ ID NO: 2967322 - RNA, 19 nt, Mycobacterium avium subsp. paratuberculosis
ucccaggcccaucgcgguc

SEQ ID NO: 2967323 - RNA, 15 nt, Mycobacterium avium subsp. paratuberculosis
ucccaggcgucgucg

SEQ ID NO: 2967324 - RNA, 16 nt, Mycobacterium avium subsp. paratuberculosis
ucccaggcgucgucgu

SEQ ID NO: 2967325 - RNA, 13 nt, Mycobacterium avium subsp. paratuberculosis
ucccaggcguggu

SEQ ID NO: 2967326 - RNA, 16 nt, Mycobacterium avium subsp. paratuberculosis
ucccaggcguggucgg

SEQ ID NO: 2967327 - RNA, 23 nt, Mycobacterium avium subsp. paratuberculosis
ucccaggcguggucggcgcgguc

SEQ ID NO: 2967328 - RNA, 17 nt, Mycobacterium avium subsp. paratuberculosis
ucccagucccagcacag

SEQ ID NO: 2967329 - RNA, 16 nt, Mycobacterium avium subsp. paratuberculosis
ucccaguccggccagc

SEQ ID NO: 2967330 - RNA, 15 nt, Mycobacterium avium subsp. paratuberculosis
ucccagucguuggug

SEQ ID NO: 2967331 - RNA, 23 nt, Mycobacterium avium subsp. paratuberculosis
ucccagugccaguaccagcggcc

SEQ ID NO: 2967332 - RNA, 23 nt, Mycobacterium avium subsp. paratuberculosis
ucccagugccgcagguggugggc

SEQ ID NO: 2967333 - RNA, 19 nt, Mycobacterium avium subsp. paratuberculosis
ucccaguucccggcgggca

SEQ ID NO: 2967334 - RNA, 20 nt, Mycobacterium avium subsp. paratuberculosis
ucccaguuguuuccccagcc

SEQ ID NO: 2967335 - RNA, 22 nt, Mycobacterium avium subsp. paratuberculosis
ucccaguuguuuccccagcccg

SEQ ID NO: 2967336 - RNA, 15 nt, Mycobacterium avium subsp. paratuberculosis
ucccaucagugcggc

SEQ ID NO: 2967337 - RNA, 19 nt, Mycobacterium avium subsp. paratuberculosis
ucccaucagugcggcccgc

SEQ ID NO: 2967338 - RNA, 18 nt, Mycobacterium avium subsp. paratuberculosis
ucccaucggggcuacaaa

SEQ ID NO: 2967339 - RNA, 22 nt, Mycobacterium avium subsp. paratuberculosis
ucccaucggggcuacaaaacca

SEQ ID NO: 2967340 - RNA, 19 nt, Mycobacterium avium subsp. paratuberculosis
ucccgauccgcgccgccgc

SEQ ID NO: 2967341 - RNA, 21 nt, Mycobacterium avium subsp. paratuberculosis
ucccgaucgacgucagcuccc

SEQ ID NO: 2967342 - RNA, 17 nt, Mycobacterium avium subsp. paratuberculosis
ucccgaugccgcgcagg

SEQ ID NO: 2967343 - RNA, 20 nt, Mycobacterium avium subsp. paratuberculosis
ucccgaugucggcgaacacc

SEQ ID NO: 2967344 - RNA, 19 nt, Mycobacterium avium subsp. paratuberculosis
ucccgcaauugcgccagca

SEQ ID NO: 2967345 - RNA, 17 nt, Mycobacterium avium subsp. paratuberculosis
ucccgcagccgcgacgg

SEQ ID NO: 2967346 - RNA, 20 nt, Mycobacterium avium subsp. paratuberculosis
ucccgcagccgcgacggcgg

SEQ ID NO: 2967347 - RNA, 16 nt, Mycobacterium avium subsp. paratuberculosis
ucccgcagcgccagcg

SEQ ID NO: 2967348 - RNA, 19 nt, Mycobacterium avium subsp. paratuberculosis
ucccgcagcgccagcgcgc

SEQ ID NO: 2967349 - RNA, 23 nt, Mycobacterium avium subsp. paratuberculosis
ucccgcagcgccagcgcgcccgc

SEQ ID NO: 2967350 - RNA, 18 nt, Mycobacterium avium subsp. paratuberculosis
ucccgcagcggggcgcug

SEQ ID NO: 2967351 - RNA, 21 nt, Mycobacterium avium subsp. paratuberculosis
ucccgcagcuucuggucauga

SEQ ID NO: 2967352 - RNA, 15 nt, Mycobacterium avium subsp. paratuberculosis
ucccgcccggcgccg

SEQ ID NO: 2967353 - RNA, 12 nt, Mycobacterium avium subsp. paratuberculosis
ucccgccgaccc

SEQ ID NO: 2967354 - RNA, 22 nt, Mycobacterium avium subsp. paratuberculosis
ucccgccgacggagacgaccag

SEQ ID NO: 2967355 - RNA, 16 nt, Mycobacterium avium subsp. paratuberculosis
ucccgccgccgaacag

SEQ ID NO: 2967356 - RNA, 17 nt, Mycobacterium avium subsp. paratuberculosis
ucccgccgccgaacagc

SEQ ID NO: 2967357 - RNA, 12 nt, Mycobacterium avium subsp. paratuberculosis
ucccgccgccgc

SEQ ID NO: 2967358 - RNA, 12 nt, Mycobacterium avium subsp. paratuberculosis
ucccgccgccgu

SEQ ID NO: 2967359 - RNA, 22 nt, Mycobacterium avium subsp. paratuberculosis
ucccgccggaugcggcucccac

SEQ ID NO: 2967360 - RNA, 23 nt, Mycobacterium avium subsp. paratuberculosis
ucccgccggaugcggcucccacc

SEQ ID NO: 2967361 - RNA, 19 nt, Mycobacterium avium subsp. paratuberculosis
ucccgccggcgaucgacgu

SEQ ID NO: 2967362 - RNA, 14 nt, Mycobacterium avium subsp. paratuberculosis
ucccgccggcggcc

SEQ ID NO: 2967363 - RNA, 16 nt, Mycobacterium avium subsp. paratuberculosis
ucccgccgggcaucuc

SEQ ID NO: 2967364 - RNA, 20 nt, Mycobacterium avium subsp. paratuberculosis
ucccgccggugaucucccgu

SEQ ID NO: 2967365 - RNA, 18 nt, Mycobacterium avium subsp. paratuberculosis
ucccgccgucucgaccac

SEQ ID NO: 2967366 - RNA, 16 nt, Mycobacterium avium subsp. paratuberculosis
ucccgcgagcugcccc

SEQ ID NO: 2967367 - RNA, 12 nt, Mycobacterium avium subsp. paratuberculosis
ucccgcgccgcg

SEQ ID NO: 2967368 - RNA, 16 nt, Mycobacterium avium subsp. paratuberculosis
ucccgcgccgcggcca

SEQ ID NO: 2967369 - RNA, 20 nt, Mycobacterium avium subsp. paratuberculosis
ucccgcgccgcggccagcgc

SEQ ID NO: 2967370 - RNA, 17 nt, Mycobacterium avium subsp. paratuberculosis
ucccgcgccugccuggc

SEQ ID NO: 2967371 - RNA, 19 nt, Mycobacterium avium subsp. paratuberculosis
ucccgcgcgagcagacgca

SEQ ID NO: 2967372 - RNA, 22 nt, Mycobacterium avium subsp. paratuberculosis
ucccgcgcgcaggcacucgcgc

SEQ ID NO: 2967373 - RNA, 14 nt, Mycobacterium avium subsp. paratuberculosis
ucccgcgcggcgca

SEQ ID NO: 2967374 - RNA, 15 nt, Mycobacterium avium subsp. paratuberculosis
ucccgcgcgggcaag

SEQ ID NO: 2967375 - RNA, 20 nt, Mycobacterium avium subsp. paratuberculosis
ucccgcgcgggggccgccgc

SEQ ID NO: 2967376 - RNA, 22 nt, Mycobacterium avium subsp. paratuberculosis
ucccgcggcagccgggcgauca

SEQ ID NO: 2967377 - RNA, 17 nt, Mycobacterium avium subsp. paratuberculosis
ucccgcggcggcgccau

SEQ ID NO: 2967378 - RNA, 18 nt, Mycobacterium avium subsp. paratuberculosis
ucccgcgggucgcggccc

SEQ ID NO: 2967379 - RNA, 18 nt, Mycobacterium avium subsp. paratuberculosis
ucccgcguauugcacggc

SEQ ID NO: 2967380 - RNA, 22 nt, Mycobacterium avium subsp. paratuberculosis
ucccgcguauugcacggcggcg

SEQ ID NO: 2967381 - RNA, 17 nt, Mycobacterium avium subsp. paratuberculosis
ucccgcguugugcacca

SEQ ID NO: 2967382 - RNA, 16 nt, Mycobacterium avium subsp. paratuberculosis
ucccgcuucuggcggg

SEQ ID NO: 2967383 - RNA, 18 nt, Mycobacterium avium subsp. paratuberculosis
ucccgcuucuggcgggcg

SEQ ID NO: 2967384 - RNA, 15 nt, Mycobacterium avium subsp. paratuberculosis
ucccgcuuggcgguc

SEQ ID NO: 2967385 - RNA, 14 nt, Mycobacterium avium subsp. paratuberculosis
ucccggaacagcuu

SEQ ID NO: 2967386 - RNA, 17 nt, Mycobacterium avium subsp. paratuberculosis
ucccggaagugccggcg

SEQ ID NO: 2967387 - RNA, 19 nt, Mycobacterium avium subsp. paratuberculosis
ucccggaagugccggcgaa

SEQ ID NO: 2967388 - RNA, 17 nt, Mycobacterium avium subsp. paratuberculosis
ucccggacaggucgggc

SEQ ID NO: 2967389 - RNA, 18 nt, Mycobacterium avium subsp. paratuberculosis
ucccggacauaggcgucg

SEQ ID NO: 2967390 - RNA, 14 nt, Mycobacterium avium subsp. paratuberculosis
ucccggaccaccag

SEQ ID NO: 2967391 - RNA, 22 nt, Mycobacterium avium subsp. paratuberculosis
ucccggacuccucgguggccuc

SEQ ID NO: 2967392 - RNA, 17 nt, Mycobacterium avium subsp. paratuberculosis
ucccggauggagcgcga

SEQ ID NO: 2967393 - RNA, 21 nt, Mycobacterium avium subsp. paratuberculosis
ucccggcaccaccacccccga

SEQ ID NO: 2967394 - RNA, 17 nt, Mycobacterium avium subsp. paratuberculosis
ucccggcagaacgacgc

SEQ ID NO: 2967395 - RNA, 20 nt, Mycobacterium avium subsp. paratuberculosis
ucccggcagaacgacgccag

SEQ ID NO: 2967396 - RNA, 21 nt, Mycobacterium avium subsp. paratuberculosis
ucccggcagaacgacgccagu

SEQ ID NO: 2967397 - RNA, 23 nt, Mycobacterium avium subsp. paratuberculosis
ucccggcagaucgcggcccgccg

SEQ ID NO: 2967398 - RNA, 15 nt, Mycobacterium avium subsp. paratuberculosis
ucccggccaccccgc

SEQ ID NO: 2967399 - RNA, 13 nt, Mycobacterium avium subsp. paratuberculosis
ucccggccacguc

SEQ ID NO: 2967400 - RNA, 16 nt, Mycobacterium avium subsp. paratuberculosis
ucccggccagcgcagu

SEQ ID NO: 2967401 - RNA, 17 nt, Mycobacterium avium subsp. paratuberculosis
ucccggccagcgcagug

SEQ ID NO: 2967402 - RNA, 20 nt, Mycobacterium avium subsp. paratuberculosis
ucccggccgccgggacgggc

SEQ ID NO: 2967403 - RNA, 11 nt, Mycobacterium avium subsp. paratuberculosis
ucccggccggu

SEQ ID NO: 2967404 - RNA, 17 nt, Mycobacterium avium subsp. paratuberculosis
ucccggcgagcacgccg

SEQ ID NO: 2967405 - RNA, 20 nt, Mycobacterium avium subsp. paratuberculosis
ucccggcgagcacgccgccg

SEQ ID NO: 2967406 - RNA, 16 nt, Mycobacterium avium subsp. paratuberculosis
ucccggcgcaccaggc

SEQ ID NO: 2967407 - RNA, 13 nt, Mycobacterium avium subsp. paratuberculosis
ucccggcgcagca

SEQ ID NO: 2967408 - RNA, 14 nt, Mycobacterium avium subsp. paratuberculosis
ucccggcgccacgc

SEQ ID NO: 2967409 - RNA, 17 nt, Mycobacterium avium subsp. paratuberculosis
ucccggcgccacgccgc

SEQ ID NO: 2967410 - RNA, 19 nt, Mycobacterium avium subsp. paratuberculosis
ucccggcgccacgccgcga

SEQ ID NO: 2967411 - RNA, 14 nt, Mycobacterium avium subsp. paratuberculosis
ucccggcgccgccg

SEQ ID NO: 2967412 - RNA, 15 nt, Mycobacterium avium subsp. paratuberculosis
ucccggcgccgccgu

SEQ ID NO: 2967413 - RNA, 22 nt, Mycobacterium avium subsp. paratuberculosis
ucccggcggacccggaggcggc

SEQ ID NO: 2967414 - RNA, 18 nt, Mycobacterium avium subsp. paratuberculosis
ucccggcgggcagguuca

SEQ ID NO: 2967415 - RNA, 22 nt, Mycobacterium avium subsp. paratuberculosis
ucccgggcacgcgagacgagcc

SEQ ID NO: 2967416 - RNA, 13 nt, Mycobacterium avium subsp. paratuberculosis
ucccgggcccgcu

SEQ ID NO: 2967417 - RNA, 20 nt, Mycobacterium avium subsp. paratuberculosis
ucccgggccguucagcgggc

SEQ ID NO: 2967418 - RNA, 19 nt, Mycobacterium avium subsp. paratuberculosis
ucccgggcgaucagcccgc

SEQ ID NO: 2967419 - RNA, 13 nt, Mycobacterium avium subsp. paratuberculosis
ucccgggcggcgc

SEQ ID NO: 2967420 - RNA, 14 nt, Mycobacterium avium subsp. paratuberculosis
ucccgggcggcgcc

SEQ ID NO: 2967421 - RNA, 19 nt, Mycobacterium avium subsp. paratuberculosis
ucccgggcggucgcgucgu

SEQ ID NO: 2967422 - RNA, 21 nt, Mycobacterium avium subsp. paratuberculosis
ucccgggcggucgcgucgucg

SEQ ID NO: 2967423 - RNA, 19 nt, Mycobacterium avium subsp. paratuberculosis
ucccggggacaccgggcac

SEQ ID NO: 2967424 - RNA, 15 nt, Mycobacterium avium subsp. paratuberculosis
uccgagcggcgcagg

SEQ ID NO: 2967425 - RNA, 18 nt, Mycobacterium avium subsp. paratuberculosis
uccgagcgggccguggca

SEQ ID NO: 2967426 - RNA, 14 nt, Mycobacterium avium subsp. paratuberculosis
uccgaggccccgcc

SEQ ID NO: 2967427 - RNA, 14 nt, Mycobacterium avium subsp. paratuberculosis
uccgaggcgucagg

SEQ ID NO: 2967428 - RNA, 22 nt, Mycobacterium avium subsp. paratuberculosis
uccgaggcguccuccucguccg

SEQ ID NO: 2967429 - RNA, 19 nt, Mycobacterium avium subsp. paratuberculosis
uccgaggguucgguggccc

SEQ ID NO: 2967430 - RNA, 16 nt, Mycobacterium avium subsp. paratuberculosis
uccgaggucagcgcgu

SEQ ID NO: 2967431 - RNA, 22 nt, Mycobacterium avium subsp. paratuberculosis
uccgaguugauaggucacgccg

SEQ ID NO: 2967432 - RNA, 13 nt, Mycobacterium avium subsp. paratuberculosis
uccgauaccagcc

SEQ ID NO: 2967433 - RNA, 15 nt, Mycobacterium avium subsp. paratuberculosis
uccgaucaacggcag

SEQ ID NO: 2967434 - RNA, 14 nt, Mycobacterium avium subsp. paratuberculosis
uccgaucagcagca

SEQ ID NO: 2967435 - RNA, 15 nt, Mycobacterium avium subsp. paratuberculosis
uccgaucagcagcac

SEQ ID NO: 2967436 - RNA, 18 nt, Mycobacterium avium subsp. paratuberculosis
uccgaucaucagggcaaa

SEQ ID NO: 2967437 - RNA, 14 nt, Mycobacterium avium subsp. paratuberculosis
uccgaucugcucga

SEQ ID NO: 2967438 - RNA, 13 nt, Mycobacterium avium subsp. paratuberculosis
uccgaugacgcug

SEQ ID NO: 2967439 - RNA, 15 nt, Mycobacterium avium subsp. paratuberculosis
uccgauugcccgacu

SEQ ID NO: 2967440 - RNA, 15 nt, Mycobacterium avium subsp. paratuberculosis
uccgcaaccgccggc

SEQ ID NO: 2967441 - RNA, 18 nt, Mycobacterium avium subsp. paratuberculosis
uccgcaaccgccggcagc

SEQ ID NO: 2967442 - RNA, 20 nt, Mycobacterium avium subsp. paratuberculosis
uccgcaaccgccggcagcgg

SEQ ID NO: 2967443 - RNA, 19 nt, Mycobacterium avium subsp. paratuberculosis
uccgcaacgccggcgugca

SEQ ID NO: 2967444 - RNA, 14 nt, Mycobacterium avium subsp. paratuberculosis
uccgcaacgcggcg

SEQ ID NO: 2967445 - RNA, 15 nt, Mycobacterium avium subsp. paratuberculosis
uccgcacccgggccc

SEQ ID NO: 2967446 - RNA, 23 nt, Mycobacterium avium subsp. paratuberculosis
uccgcaccgagaccaugccgccg

SEQ ID NO: 2967447 - RNA, 16 nt, Mycobacterium avium subsp. paratuberculosis
uccgcaccgcgacgag

SEQ ID NO: 2967448 - RNA, 13 nt, Mycobacterium avium subsp. paratuberculosis
uccgcacgaccug

SEQ ID NO: 2967449 - RNA, 20 nt, Mycobacterium avium subsp. paratuberculosis
uccgcagauacaucucggug

SEQ ID NO: 2967450 - RNA, 16 nt, Mycobacterium avium subsp. paratuberculosis
uccgcagcaccagggu

SEQ ID NO: 2967451 - RNA, 14 nt, Mycobacterium avium subsp. paratuberculosis
uccgcagcccgucg

SEQ ID NO: 2967452 - RNA, 17 nt, Mycobacterium avium subsp. paratuberculosis
uccgcagcccgucgauc

SEQ ID NO: 2967453 - RNA, 20 nt, Mycobacterium avium subsp. paratuberculosis
uccgcagcccgucgaucccg

SEQ ID NO: 2967454 - RNA, 13 nt, Mycobacterium avium subsp. paratuberculosis
uccgcagccgcug

SEQ ID NO: 2967455 - RNA, 18 nt, Mycobacterium avium subsp. paratuberculosis
uccgcaggccgucgccgg

SEQ ID NO: 2967456 - RNA, 14 nt, Mycobacterium avium subsp. paratuberculosis
uccgcaggcgaagg

SEQ ID NO: 2967457 - RNA, 18 nt, Mycobacterium avium subsp. paratuberculosis
uccgcaugcccgggcgac

SEQ ID NO: 2967458 - RNA, 22 nt, Mycobacterium avium subsp. paratuberculosis
uccgccacccgcugcucgaccu

SEQ ID NO: 2967459 - RNA, 22 nt, Mycobacterium avium subsp. paratuberculosis
uccgccacccugcgcaccgcgg

SEQ ID NO: 2967460 - RNA, 15 nt, Mycobacterium avium subsp. paratuberculosis
uccgccaccuccucc

SEQ ID NO: 2967461 - RNA, 16 nt, Mycobacterium avium subsp. paratuberculosis
uccgccaccuccuccg

SEQ ID NO: 2967462 - RNA, 23 nt, Mycobacterium avium subsp. paratuberculosis
uccgccaccuccuccgguccggg

SEQ ID NO: 2967463 - RNA, 20 nt, Mycobacterium avium subsp. paratuberculosis
uccgccagaucgccuggcag

SEQ ID NO: 2967464 - RNA, 17 nt, Mycobacterium avium subsp. paratuberculosis
uccgcccacuucgacgg

SEQ ID NO: 2967465 - RNA, 15 nt, Mycobacterium avium subsp. paratuberculosis
uccgcccagacgcgg

SEQ ID NO: 2967466 - RNA, 14 nt, Mycobacterium avium subsp. paratuberculosis
uccgccccgagauc

SEQ ID NO: 2967467 - RNA, 23 nt, Mycobacterium avium subsp. paratuberculosis
uccgccccgagaucccagcggga

SEQ ID NO: 2967468 - RNA, 22 nt, Mycobacterium avium subsp. paratuberculosis
uccgccccgcugccggaccucg

SEQ ID NO: 2967469 - RNA, 14 nt, Mycobacterium avium subsp. paratuberculosis
uccgcccggaccag

SEQ ID NO: 2967470 - RNA, 20 nt, Mycobacterium avium subsp. paratuberculosis
uccgcccggaccaggguggc

SEQ ID NO: 2967471 - RNA, 15 nt, Mycobacterium avium subsp. paratuberculosis
uccgcccggcccgca

SEQ ID NO: 2967472 - RNA, 23 nt, Mycobacterium avium subsp. paratuberculosis
uccgcccgggugcaggcccagcu

SEQ ID NO: 2967473 - RNA, 23 nt, Mycobacterium avium subsp. paratuberculosis
uccgcccguagaugcggcccagc

SEQ ID NO: 2967474 - RNA, 21 nt, Mycobacterium avium subsp. paratuberculosis
uccgccgaaccgaucaccggc

SEQ ID NO: 2967475 - RNA, 19 nt, Mycobacterium avium subsp. paratuberculosis
uccgccgacaccagggugc

SEQ ID NO: 2967476 - RNA, 20 nt, Mycobacterium avium subsp. paratuberculosis
uccgccgacaccagggugcg

SEQ ID NO: 2967477 - RNA, 13 nt, Mycobacterium avium subsp. paratuberculosis
uccgccgagucgc

SEQ ID NO: 2967478 - RNA, 17 nt, Mycobacterium avium subsp. paratuberculosis
uccgccgagucgcgccg

SEQ ID NO: 2967479 - RNA, 21 nt, Mycobacterium avium subsp. paratuberculosis
uccgccgcagcggcgccgcag

SEQ ID NO: 2967480 - RNA, 15 nt, Mycobacterium avium subsp. paratuberculosis
uccgccgccggcgga

SEQ ID NO: 2967481 - RNA, 14 nt, Mycobacterium avium subsp. paratuberculosis
uccgccgccgggcc

SEQ ID NO: 2967482 - RNA, 20 nt, Mycobacterium avium subsp. paratuberculosis
uccgccgccgggccugucca

SEQ ID NO: 2967483 - RNA, 20 nt, Mycobacterium avium subsp. paratuberculosis
uccgccgccgucccaccggc

SEQ ID NO: 2967484 - RNA, 12 nt, Mycobacterium avium subsp. paratuberculosis
uccgccgcgccc

SEQ ID NO: 2967485 - RNA, 13 nt, Mycobacterium avium subsp. paratuberculosis
uccgccgcgcccg

SEQ ID NO: 2967486 - RNA, 15 nt, Mycobacterium avium subsp. paratuberculosis
uccgccgcgcccguc

SEQ ID NO: 2967487 - RNA, 16 nt, Mycobacterium avium subsp. paratuberculosis
uccgccgcgcccgucg

SEQ ID NO: 2967488 - RNA, 13 nt, Mycobacterium avium subsp. paratuberculosis
uccgccggccggu

SEQ ID NO: 2967489 - RNA, 18 nt, Mycobacterium avium subsp. paratuberculosis
uccgccggcgaagcucga

SEQ ID NO: 2967490 - RNA, 20 nt, Mycobacterium avium subsp. paratuberculosis
uccgccggcgaagcucgacg

SEQ ID NO: 2967491 - RNA, 14 nt, Mycobacterium avium subsp. paratuberculosis
uccgccggcggugc

SEQ ID NO: 2967492 - RNA, 19 nt, Mycobacterium avium subsp. paratuberculosis
uccgccggcggugcgggug

SEQ ID NO: 2967493 - RNA, 14 nt, Mycobacterium avium subsp. paratuberculosis
uccgccgggcggcg

SEQ ID NO: 2967494 - RNA, 16 nt, Mycobacterium avium subsp. paratuberculosis
uccgccggugccagca

SEQ ID NO: 2967495 - RNA, 15 nt, Mycobacterium avium subsp. paratuberculosis
uccgccgguucgucg

SEQ ID NO: 2967496 - RNA, 17 nt, Mycobacterium avium subsp. paratuberculosis
uccgccgucaucggcgg

SEQ ID NO: 2967497 - RNA, 18 nt, Mycobacterium avium subsp. paratuberculosis
uccgccgucaucggcgga

SEQ ID NO: 2967498 - RNA, 14 nt, Mycobacterium avium subsp. paratuberculosis
uccgccgucgaguc

SEQ ID NO: 2967499 - RNA, 16 nt, Mycobacterium avium subsp. paratuberculosis
uccgccgucggggugc

SEQ ID NO: 2967500 - RNA, 19 nt, Mycobacterium avium subsp. paratuberculosis
uccgccguugaccggugcg

SEQ ID NO: 2967501 - RNA, 18 nt, Mycobacterium avium subsp. paratuberculosis
uccgccguugcggcccac

SEQ ID NO: 2967502 - RNA, 14 nt, Mycobacterium avium subsp. paratuberculosis
uccgccuccgacca

SEQ ID NO: 2967503 - RNA, 15 nt, Mycobacterium avium subsp. paratuberculosis
uccgccuccgaccag

SEQ ID NO: 2967504 - RNA, 19 nt, Mycobacterium avium subsp. paratuberculosis
uccgccugcccuugaagcg

SEQ ID NO: 2967505 - RNA, 16 nt, Mycobacterium avium subsp. paratuberculosis
uccgccugcgcgggcg

SEQ ID NO: 2967506 - RNA, 23 nt, Mycobacterium avium subsp. paratuberculosis
uccgccugcgcgggcgcggacag

SEQ ID NO: 2967507 - RNA, 21 nt, Mycobacterium avium subsp. paratuberculosis
uccgccuucgaaugcgaugag

SEQ ID NO: 2967508 - RNA, 20 nt, Mycobacterium avium subsp. paratuberculosis
uccgccuucgaguuuggccu

SEQ ID NO: 2967509 - RNA, 20 nt, Mycobacterium avium subsp. paratuberculosis
uccggauggcggucgcgcca

SEQ ID NO: 2967510 - RNA, 17 nt, Mycobacterium avium subsp. paratuberculosis
uccggaugggagcgggg

SEQ ID NO: 2967511 - RNA, 20 nt, Mycobacterium avium subsp. paratuberculosis
uccggauugccgggcagcgg

SEQ ID NO: 2967512 - RNA, 21 nt, Mycobacterium avium subsp. paratuberculosis
uccggauugccgggcagcggc

SEQ ID NO: 2967513 - RNA, 19 nt, Mycobacterium avium subsp. paratuberculosis
uccggcaacgaggccaggg

SEQ ID NO: 2967514 - RNA, 17 nt, Mycobacterium avium subsp. paratuberculosis
uccggcacccgccagcc

SEQ ID NO: 2967515 - RNA, 22 nt, Mycobacterium avium subsp. paratuberculosis
uccggcacugaaggcgcgggca

SEQ ID NO: 2967516 - RNA, 13 nt, Mycobacterium avium subsp. paratuberculosis
uccggcagcagcg

SEQ ID NO: 2967517 - RNA, 23 nt, Mycobacterium avium subsp. paratuberculosis
uccggcagcagcgagucgaagcc

SEQ ID NO: 2967518 - RNA, 16 nt, Mycobacterium avium subsp. paratuberculosis
uccggcagcgcgccca

SEQ ID NO: 2967519 - RNA, 20 nt, Mycobacterium avium subsp. paratuberculosis
uccggcagcgcucgucgucg

SEQ ID NO: 2967520 - RNA, 21 nt, Mycobacterium avium subsp. paratuberculosis
uccggcagcgcucgucgucgg

SEQ ID NO: 2967521 - RNA, 13 nt, Mycobacterium avium subsp. paratuberculosis
uccggcaggccgc

SEQ ID NO: 2967522 - RNA, 21 nt, Mycobacterium avium subsp. paratuberculosis
uccggcauguacaggaucaac

SEQ ID NO: 2967523 - RNA, 18 nt, Mycobacterium avium subsp. paratuberculosis
uccggccagguccacacc

SEQ ID NO: 2967524 - RNA, 18 nt, Mycobacterium avium subsp. paratuberculosis
uccggccaguccagcgaa

SEQ ID NO: 2967525 - RNA, 16 nt, Mycobacterium avium subsp. paratuberculosis
uccggccccgcugccg

SEQ ID NO: 2967526 - RNA, 20 nt, Mycobacterium avium subsp. paratuberculosis
uccggcccgagcaccaccag

SEQ ID NO: 2967527 - RNA, 19 nt, Mycobacterium avium subsp. paratuberculosis
uccggcccgcucggcgggu

SEQ ID NO: 2967528 - RNA, 16 nt, Mycobacterium avium subsp. paratuberculosis
uccggcccggcguccg

SEQ ID NO: 2967529 - RNA, 14 nt, Mycobacterium avium subsp. paratuberculosis
uccggcccggggac

SEQ ID NO: 2967530 - RNA, 17 nt, Mycobacterium avium subsp. paratuberculosis
uccggcccggggacacc

SEQ ID NO: 2967531 - RNA, 20 nt, Mycobacterium avium subsp. paratuberculosis
uccggcccggggacacccuc

SEQ ID NO: 2967532 - RNA, 17 nt, Mycobacterium avium subsp. paratuberculosis
uccggcccuggucggcc

SEQ ID NO: 2967533 - RNA, 21 nt, Mycobacterium avium subsp. paratuberculosis
uccggcccuggucggccaggg

SEQ ID NO: 2967534 - RNA, 17 nt, Mycobacterium avium subsp. paratuberculosis
uccggccgccucgucga

SEQ ID NO: 2967535 - RNA, 17 nt, Mycobacterium avium subsp. paratuberculosis
uccggccgcgccggccu

SEQ ID NO: 2967536 - RNA, 18 nt, Mycobacterium avium subsp. paratuberculosis
uccggccgcgccggccuu

SEQ ID NO: 2967537 - RNA, 17 nt, Mycobacterium avium subsp. paratuberculosis
uccggccgcggaugacc

SEQ ID NO: 2967538 - RNA, 17 nt, Mycobacterium avium subsp. paratuberculosis
uccggccggagaccgcc

SEQ ID NO: 2967539 - RNA, 21 nt, Mycobacterium avium subsp. paratuberculosis
uccggccggagaccgccgugg

SEQ ID NO: 2967540 - RNA, 12 nt, Mycobacterium avium subsp. paratuberculosis
uccggccggccg

SEQ ID NO: 2967541 - RNA, 16 nt, Mycobacterium avium subsp. paratuberculosis
uccggccggccgccgg

SEQ ID NO: 2967542 - RNA, 13 nt, Mycobacterium avium subsp. paratuberculosis
uccggccggcgag

SEQ ID NO: 2967543 - RNA, 15 nt, Mycobacterium avium subsp. paratuberculosis
uccggccggcgagga

SEQ ID NO: 2967544 - RNA, 21 nt, Mycobacterium avium subsp. paratuberculosis
uccggccgugaugcgccggcg

SEQ ID NO: 2967545 - RNA, 22 nt, Mycobacterium avium subsp. paratuberculosis
uccggccgugaugcgccggcgg

SEQ ID NO: 2967546 - RNA, 17 nt, Mycobacterium avium subsp. paratuberculosis
uccggcgaauccgaccg

SEQ ID NO: 2967547 - RNA, 19 nt, Mycobacterium avium subsp. paratuberculosis
uccggcgacacguccagcu

SEQ ID NO: 2967548 - RNA, 21 nt, Mycobacterium avium subsp. paratuberculosis
uccggcgcacggcgcccaggu

SEQ ID NO: 2967549 - RNA, 15 nt, Mycobacterium avium subsp. paratuberculosis
uccggcgccagcccg

SEQ ID NO: 2967550 - RNA, 13 nt, Mycobacterium avium subsp. paratuberculosis
uccggcgcccgau

SEQ ID NO: 2967551 - RNA, 16 nt, Mycobacterium avium subsp. paratuberculosis
uccggcgcccgaucgg

SEQ ID NO: 2967552 - RNA, 14 nt, Mycobacterium avium subsp. paratuberculosis
uccggcgcccggcu

SEQ ID NO: 2967553 - RNA, 20 nt, Mycobacterium avium subsp. paratuberculosis
uccggcgcccggcuccccga

SEQ ID NO: 2967554 - RNA, 12 nt, Mycobacterium avium subsp. paratuberculosis
uccggcgccgac

SEQ ID NO: 2967555 - RNA, 17 nt, Mycobacterium avium subsp. paratuberculosis
uccggcgccgcgggcgc

SEQ ID NO: 2967556 - RNA, 19 nt, Mycobacterium avium subsp. paratuberculosis
uccggcgccgcgggcgccg

SEQ ID NO: 2967557 - RNA, 20 nt, Mycobacterium avium subsp. paratuberculosis
uccggcgccgcgggcgccgu

SEQ ID NO: 2967558 - RNA, 13 nt, Mycobacterium avium subsp. paratuberculosis
uccggcgccgguc

SEQ ID NO: 2967559 - RNA, 17 nt, Mycobacterium avium subsp. paratuberculosis
uccggcgccggucagcg

SEQ ID NO: 2967560 - RNA, 19 nt, Mycobacterium avium subsp. paratuberculosis
uccggcgccggucagcggc

SEQ ID NO: 2967561 - RNA, 20 nt, Mycobacterium avium subsp. paratuberculosis
uccggcgccggucagcggca

SEQ ID NO: 2967562 - RNA, 14 nt, Mycobacterium avium subsp. paratuberculosis
uccggcgcgaccag

SEQ ID NO: 2967563 - RNA, 12 nt, Mycobacterium avium subsp. paratuberculosis
uccggcgcgauc

SEQ ID NO: 2967564 - RNA, 14 nt, Mycobacterium avium subsp. paratuberculosis
uccggcgcgaucgg

SEQ ID NO: 2967565 - RNA, 23 nt, Mycobacterium avium subsp. paratuberculosis
uccggcgcgaucggccgcugccc

SEQ ID NO: 2967566 - RNA, 15 nt, Mycobacterium avium subsp. paratuberculosis
uccggcgcgccgcga

SEQ ID NO: 2967567 - RNA, 20 nt, Mycobacterium avium subsp. paratuberculosis
uccggcggacccagcuccuc

SEQ ID NO: 2967568 - RNA, 23 nt, Mycobacterium avium subsp. paratuberculosis
uccggcggcaaaacgcugggcgc

SEQ ID NO: 2967569 - RNA, 18 nt, Mycobacterium avium subsp. paratuberculosis
uccggcggcaccacccgc

SEQ ID NO: 2967570 - RNA, 23 nt, Mycobacterium avium subsp. paratuberculosis
uccggcggcaccacccgcggccg

SEQ ID NO: 2967571 - RNA, 12 nt, Mycobacterium avium subsp. paratuberculosis
uccggcggcagc

SEQ ID NO: 2967572 - RNA, 17 nt, Mycobacterium avium subsp. paratuberculosis
uccggcggcagccaggc

SEQ ID NO: 2967573 - RNA, 19 nt, Mycobacterium avium subsp. paratuberculosis
uccggcggcagguggucgg

SEQ ID NO: 2967574 - RNA, 22 nt, Mycobacterium avium subsp. paratuberculosis
uccggcggccggcggcagugcg

SEQ ID NO: 2967575 - RNA, 14 nt, Mycobacterium avium subsp. paratuberculosis
uccggcggcgcuca

SEQ ID NO: 2967576 - RNA, 18 nt, Mycobacterium avium subsp. paratuberculosis
uccggcggcgcucagcgc

SEQ ID NO: 2967577 - RNA, 22 nt, Mycobacterium avium subsp. paratuberculosis
uccggcggcgcucagcgcggcg

SEQ ID NO: 2967578 - RNA, 23 nt, Mycobacterium avium subsp. paratuberculosis
uccggcggcgcucagcgcggcgg

SEQ ID NO: 2967579 - RNA, 19 nt, Mycobacterium avium subsp. paratuberculosis
uccggcggggacgugucgg

SEQ ID NO: 2967580 - RNA, 14 nt, Mycobacterium avium subsp. paratuberculosis
uccggcggucagca

SEQ ID NO: 2967581 - RNA, 19 nt, Mycobacterium avium subsp. paratuberculosis
uccggcggucagcaccguc

SEQ ID NO: 2967582 - RNA, 19 nt, Mycobacterium avium subsp. paratuberculosis
uccggcguaucuccaccgu

SEQ ID NO: 2967583 - RNA, 17 nt, Mycobacterium avium subsp. paratuberculosis
uccggcgugcagcacgc

SEQ ID NO: 2967584 - RNA, 19 nt, Mycobacterium avium subsp. paratuberculosis
uccggcgugcagcacgccc

SEQ ID NO: 2967585 - RNA, 15 nt, Mycobacterium avium subsp. paratuberculosis
uccggcgugccaccg

SEQ ID NO: 2967586 - RNA, 18 nt, Mycobacterium avium subsp. paratuberculosis
uccggcucagaaggcguc

SEQ ID NO: 2967587 - RNA, 21 nt, Mycobacterium avium subsp. paratuberculosis
uccggcucugccugcaggaug

SEQ ID NO: 2967588 - RNA, 19 nt, Mycobacterium avium subsp. paratuberculosis
uccggcugaacgccagcag

SEQ ID NO: 2967589 - RNA, 14 nt, Mycobacterium avium subsp. paratuberculosis
uccggcugagcagc

SEQ ID NO: 2967590 - RNA, 17 nt, Mycobacterium avium subsp. paratuberculosis
uccggcugagcagcucg

SEQ ID NO: 2967591 - RNA, 18 nt, Mycobacterium avium subsp. paratuberculosis
uccggcugcccugggagg

SEQ ID NO: 2967592 - RNA, 19 nt, Mycobacterium avium subsp. paratuberculosis
uccggcuggucggccuggc

SEQ ID NO: 2967593 - RNA, 13 nt, Mycobacterium avium subsp. paratuberculosis
uccguucggcggu

SEQ ID NO: 2967594 - RNA, 16 nt, Mycobacterium avium subsp. paratuberculosis
uccucacaccucgcua

SEQ ID NO: 2967595 - RNA, 22 nt, Mycobacterium avium subsp. paratuberculosis
uccucagcacggccgcggccag

SEQ ID NO: 2967596 - RNA, 14 nt, Mycobacterium avium subsp. paratuberculosis
uccucagcagcuag

SEQ ID NO: 2967597 - RNA, 18 nt, Mycobacterium avium subsp. paratuberculosis
uccucaguccgccccgau

SEQ ID NO: 2967598 - RNA, 17 nt, Mycobacterium avium subsp. paratuberculosis
uccucauagccggccgc

SEQ ID NO: 2967599 - RNA, 13 nt, Mycobacterium avium subsp. paratuberculosis
uccuccaaagcgg

SEQ ID NO: 2967600 - RNA, 20 nt, Mycobacterium avium subsp. paratuberculosis
uccuccaacggcaccaccac

SEQ ID NO: 2967601 - RNA, 14 nt, Mycobacterium avium subsp. paratuberculosis
uccucccagcccuc

SEQ ID NO: 2967602 - RNA, 16 nt, Mycobacterium avium subsp. paratuberculosis
uccucccagcccucgu

SEQ ID NO: 2967603 - RNA, 19 nt, Mycobacterium avium subsp. paratuberculosis
uccucccagcccucgucga

SEQ ID NO: 2967604 - RNA, 20 nt, Mycobacterium avium subsp. paratuberculosis
uccucccagcccucgucgau

SEQ ID NO: 2967605 - RNA, 11 nt, Mycobacterium avium subsp. paratuberculosis
uccucccagcg

SEQ ID NO: 2967606 - RNA, 13 nt, Mycobacterium avium subsp. paratuberculosis
uccucccagcgcc

SEQ ID NO: 2967607 - RNA, 18 nt, Mycobacterium avium subsp. paratuberculosis
uccuccgggcugaccucg

SEQ ID NO: 2967608 - RNA, 15 nt, Mycobacterium avium subsp. paratuberculosis
uccuccucggccagc

SEQ ID NO: 2967609 - RNA, 16 nt, Mycobacterium avium subsp. paratuberculosis
uccuccucggccagcc

SEQ ID NO: 2967610 - RNA, 23 nt, Mycobacterium avium subsp. paratuberculosis
uccuccucggccagccccaccac

SEQ ID NO: 2967611 - RNA, 13 nt, Mycobacterium avium subsp. paratuberculosis
uccuccucggcgc

SEQ ID NO: 2967612 - RNA, 13 nt, Mycobacterium avium subsp. paratuberculosis
uccuccucuucgc

SEQ ID NO: 2967613 - RNA, 22 nt, Mycobacterium avium subsp. paratuberculosis
uccuccugcgacggcagcaccu

SEQ ID NO: 2967614 - RNA, 23 nt, Mycobacterium avium subsp. paratuberculosis
uccuccugcgccggcaacuggcc

SEQ ID NO: 2967615 - RNA, 16 nt, Mycobacterium avium subsp. paratuberculosis
uccucgaaagccgcug

SEQ ID NO: 2967616 - RNA, 14 nt, Mycobacterium avium subsp. paratuberculosis
uccucgaacaccgc

SEQ ID NO: 2967617 - RNA, 21 nt, Mycobacterium avium subsp. paratuberculosis
uccucgaacaccgcaccgguc

SEQ ID NO: 2967618 - RNA, 18 nt, Mycobacterium avium subsp. paratuberculosis
uccucgaagaguuggguc

SEQ ID NO: 2967619 - RNA, 18 nt, Mycobacterium avium subsp. paratuberculosis
uccucgaauccgcgggcg

SEQ ID NO: 2967620 - RNA, 23 nt, Mycobacterium avium subsp. paratuberculosis
uccucgaccacgcacaccaccga

SEQ ID NO: 2967621 - RNA, 15 nt, Mycobacterium avium subsp. paratuberculosis
uccucgaccagcgcg

SEQ ID NO: 2967622 - RNA, 19 nt, Mycobacterium avium subsp. paratuberculosis
uccucgaccagcgcgccgc

SEQ ID NO: 2967623 - RNA, 22 nt, Mycobacterium avium subsp. paratuberculosis
uccucgaccagcgcgccgccca

SEQ ID NO: 2967624 - RNA, 14 nt, Mycobacterium avium subsp. paratuberculosis
uccucgaccccgaa

SEQ ID NO: 2967625 - RNA, 16 nt, Mycobacterium avium subsp. paratuberculosis
uccucgacgccgcgca

SEQ ID NO: 2967626 - RNA, 22 nt, Mycobacterium avium subsp. paratuberculosis
uccucgacgccgcgcaccccga

SEQ ID NO: 2967627 - RNA, 19 nt, Mycobacterium avium subsp. paratuberculosis
uccucgacgguggagcggc

SEQ ID NO: 2967628 - RNA, 13 nt, Mycobacterium avium subsp. paratuberculosis
uccucgagcgcgu

SEQ ID NO: 2967629 - RNA, 15 nt, Mycobacterium avium subsp. paratuberculosis
uccucgagcgcgucg

SEQ ID NO: 2967630 - RNA, 18 nt, Mycobacterium avium subsp. paratuberculosis
uccucgagcuggccguug

SEQ ID NO: 2967631 - RNA, 19 nt, Mycobacterium avium subsp. paratuberculosis
uccucgaggguuugagcau

SEQ ID NO: 2967632 - RNA, 21 nt, Mycobacterium avium subsp. paratuberculosis
uccucgaucaucgcgucggug

SEQ ID NO: 2967633 - RNA, 19 nt, Mycobacterium avium subsp. paratuberculosis
uccucgauccgguccagcc

SEQ ID NO: 2967634 - RNA, 15 nt, Mycobacterium avium subsp. paratuberculosis
uccucgaucguccga

SEQ ID NO: 2967635 - RNA, 15 nt, Mycobacterium avium subsp. paratuberculosis
uccucgaugacgccg

SEQ ID NO: 2967636 - RNA, 15 nt, Mycobacterium avium subsp. paratuberculosis
uccucgauggcggcg

SEQ ID NO: 2967637 - RNA, 22 nt, Mycobacterium avium subsp. paratuberculosis
uccucgauggcggcggcugccu

SEQ ID NO: 2967638 - RNA, 17 nt, Mycobacterium avium subsp. paratuberculosis
uccucgauggucgucgg

SEQ ID NO: 2967639 - RNA, 19 nt, Mycobacterium avium subsp. paratuberculosis
uccucgccgagcagaucgg

SEQ ID NO: 2967640 - RNA, 14 nt, Mycobacterium avium subsp. paratuberculosis
uccucgccgcgcca

SEQ ID NO: 2967641 - RNA, 15 nt, Mycobacterium avium subsp. paratuberculosis
uccucgccgcgccag

SEQ ID NO: 2967642 - RNA, 15 nt, Mycobacterium avium subsp. paratuberculosis
uccucgccgcgggcc

SEQ ID NO: 2967643 - RNA, 19 nt, Mycobacterium avium subsp. paratuberculosis
uccucgccgcgggccagcc

SEQ ID NO: 2967644 - RNA, 18 nt, Mycobacterium avium subsp. paratuberculosis
uccucgccguacgcgccg

SEQ ID NO: 2967645 - RNA, 19 nt, Mycobacterium avium subsp. paratuberculosis
uccucgcgccgccacgcgg

SEQ ID NO: 2967646 - RNA, 20 nt, Mycobacterium avium subsp. paratuberculosis
uccucgcgccgccacgcggc

SEQ ID NO: 2967647 - RNA, 13 nt, Mycobacterium avium subsp. paratuberculosis
uccucgcgcggca

SEQ ID NO: 2967648 - RNA, 14 nt, Mycobacterium avium subsp. paratuberculosis
uccucgcgcggcac

SEQ ID NO: 2967649 - RNA, 18 nt, Mycobacterium avium subsp. paratuberculosis
uccucgcugaccucgaca

SEQ ID NO: 2967650 - RNA, 16 nt, Mycobacterium avium subsp. paratuberculosis
uccucgcugccggccg

SEQ ID NO: 2967651 - RNA, 18 nt, Mycobacterium avium subsp. paratuberculosis
uccucggccagcaccagc

SEQ ID NO: 2967652 - RNA, 23 nt, Mycobacterium avium subsp. paratuberculosis
uccucggccagccccaccaccgc

SEQ ID NO: 2967653 - RNA, 19 nt, Mycobacterium avium subsp. paratuberculosis
uccucggccagcucaccgg

SEQ ID NO: 2967654 - RNA, 17 nt, Mycobacterium avium subsp. paratuberculosis
uccucggccgccaccgc

SEQ ID NO: 2967655 - RNA, 18 nt, Mycobacterium avium subsp. paratuberculosis
uccucggcgauguugacc

SEQ ID NO: 2967656 - RNA, 22 nt, Mycobacterium avium subsp. paratuberculosis
uccucggcgauguugaccaccc

SEQ ID NO: 2967657 - RNA, 17 nt, Mycobacterium avium subsp. paratuberculosis
uccucggcgcucgccgc

SEQ ID NO: 2967658 - RNA, 18 nt, Mycobacterium avium subsp. paratuberculosis
uccucggcgcucgccgcg

SEQ ID NO: 2967659 - RNA, 15 nt, Mycobacterium avium subsp. paratuberculosis
uccucggggugguga

SEQ ID NO: 2967660 - RNA, 17 nt, Mycobacterium avium subsp. paratuberculosis
uccucggugaccucgaa

SEQ ID NO: 2967661 - RNA, 16 nt, Mycobacterium avium subsp. paratuberculosis
uccucggugagcgugg

SEQ ID NO: 2967662 - RNA, 14 nt, Mycobacterium avium subsp. paratuberculosis
uccucgguggccuc

SEQ ID NO: 2967663 - RNA, 22 nt, Mycobacterium avium subsp. paratuberculosis
uccucggugguaaacgcuucuc

SEQ ID NO: 2967664 - RNA, 22 nt, Mycobacterium avium subsp. paratuberculosis
uccucgguguacagcgccaugu

SEQ ID NO: 2967665 - RNA, 16 nt, Mycobacterium avium subsp. paratuberculosis
uccucgucgguccagg

SEQ ID NO: 2967666 - RNA, 18 nt, Mycobacterium avium subsp. paratuberculosis
uccucguucuggcccgcc

SEQ ID NO: 2967667 - RNA, 19 nt, Mycobacterium avium subsp. paratuberculosis
uccucguucuggcccgcca

SEQ ID NO: 2967668 - RNA, 15 nt, Mycobacterium avium subsp. paratuberculosis
uccucucggcgccgu

SEQ ID NO: 2967669 - RNA, 14 nt, Mycobacterium avium subsp. paratuberculosis
uccucugcgcgcca

SEQ ID NO: 2967670 - RNA, 19 nt, Mycobacterium avium subsp. paratuberculosis
uccucuucgcugccgccgc

SEQ ID NO: 2967671 - RNA, 18 nt, Mycobacterium avium subsp. paratuberculosis
uccugagguauucgucga

SEQ ID NO: 2967672 - RNA, 16 nt, Mycobacterium avium subsp. paratuberculosis
uccugauuuuggggac

SEQ ID NO: 2967673 - RNA, 19 nt, Mycobacterium avium subsp. paratuberculosis
uccugcaccgacugcggcg

SEQ ID NO: 2967674 - RNA, 16 nt, Mycobacterium avium subsp. paratuberculosis
uccugcacgcgcgggu

SEQ ID NO: 2967675 - RNA, 22 nt, Mycobacterium avium subsp. paratuberculosis
uccugcagcgcggcgaucagcu

SEQ ID NO: 2967676 - RNA, 17 nt, Mycobacterium avium subsp. paratuberculosis
uccugcagcucgccggc

SEQ ID NO: 2967677 - RNA, 17 nt, Mycobacterium avium subsp. paratuberculosis
uccugcaggaucagcac

SEQ ID NO: 2967678 - RNA, 15 nt, Mycobacterium avium subsp. paratuberculosis
ucgaacgggccgggc

SEQ ID NO: 2967679 - RNA, 16 nt, Mycobacterium avium subsp. paratuberculosis
ucgaagaacgcguccc

SEQ ID NO: 2967680 - RNA, 14 nt, Mycobacterium avium subsp. paratuberculosis
ucgaagaagagggc

SEQ ID NO: 2967681 - RNA, 14 nt, Mycobacterium avium subsp. paratuberculosis
ucgaagaccacgaa

SEQ ID NO: 2967682 - RNA, 17 nt, Mycobacterium avium subsp. paratuberculosis
ucgaagacgccccaguu

SEQ ID NO: 2967683 - RNA, 19 nt, Mycobacterium avium subsp. paratuberculosis
ucgaagaggugcucgacgg

SEQ ID NO: 2967684 - RNA, 22 nt, Mycobacterium avium subsp. paratuberculosis
ucgaagaguugggucgcguccg

SEQ ID NO: 2967685 - RNA, 17 nt, Mycobacterium avium subsp. paratuberculosis
ucgaagaucgccugcag

SEQ ID NO: 2967686 - RNA, 15 nt, Mycobacterium avium subsp. paratuberculosis
ucgaagauggccagg

SEQ ID NO: 2967687 - RNA, 16 nt, Mycobacterium avium subsp. paratuberculosis
ucgaagauggccaggu

SEQ ID NO: 2967688 - RNA, 17 nt, Mycobacterium avium subsp. paratuberculosis
ucgaagaugucgcggcg

SEQ ID NO: 2967689 - RNA, 21 nt, Mycobacterium avium subsp. paratuberculosis
ucgaagcagccuucuuggcgg

SEQ ID NO: 2967690 - RNA, 21 nt, Mycobacterium avium subsp. paratuberculosis
ucgaagcccuucaccucggcc

SEQ ID NO: 2967691 - RNA, 12 nt, Mycobacterium avium subsp. paratuberculosis
ucgaagccgacg

SEQ ID NO: 2967692 - RNA, 17 nt, Mycobacterium avium subsp. paratuberculosis
ucgaagccgaucgcggc

SEQ ID NO: 2967693 - RNA, 20 nt, Mycobacterium avium subsp. paratuberculosis
ucgaagccguccaggccgcu

SEQ ID NO: 2967694 - RNA, 24 nt, Mycobacterium avium subsp. paratuberculosis
ucgaagccguccaggccgcugauc

SEQ ID NO: 2967695 - RNA, 16 nt, Mycobacterium avium subsp. paratuberculosis
ucgaagccguggcagg

SEQ ID NO: 2967696 - RNA, 13 nt, Mycobacterium avium subsp. paratuberculosis
ucgaagcgcagca

SEQ ID NO: 2967697 - RNA, 16 nt, Mycobacterium avium subsp. paratuberculosis
ucgaagcgcagcagcu

SEQ ID NO: 2967698 - RNA, 14 nt, Mycobacterium avium subsp. paratuberculosis
ucgaagcgcaugcc

SEQ ID NO: 2967699 - RNA, 21 nt, Mycobacterium avium subsp. paratuberculosis
ucgaagcggugcaccaccgug

SEQ ID NO: 2967700 - RNA, 16 nt, Mycobacterium avium subsp. paratuberculosis
ucgaagcugcgccaca

SEQ ID NO: 2967701 - RNA, 22 nt, Mycobacterium avium subsp. paratuberculosis
ucgaaggaggccagcugcaccg

SEQ ID NO: 2967702 - RNA, 21 nt, Mycobacterium avium subsp. paratuberculosis
ucgaaggccgggcugguccgg

SEQ ID NO: 2967703 - RNA, 23 nt, Mycobacterium avium subsp. paratuberculosis
ucgaaggcggccgcgagcccggc

SEQ ID NO: 2967704 - RNA, 16 nt, Mycobacterium avium subsp. paratuberculosis
ucgaaggcgugcucga

SEQ ID NO: 2967705 - RNA, 15 nt, Mycobacterium avium subsp. paratuberculosis
ucgaagggcgccagc

SEQ ID NO: 2967706 - RNA, 16 nt, Mycobacterium avium subsp. paratuberculosis
ucgaagggcgccagcc

SEQ ID NO: 2967707 - RNA, 16 nt, Mycobacterium avium subsp. paratuberculosis
ucgaaguagagccgcu

SEQ ID NO: 2967708 - RNA, 19 nt, Mycobacterium avium subsp. paratuberculosis
ucgaaguccugcgccgcgg

SEQ ID NO: 2967709 - RNA, 16 nt, Mycobacterium avium subsp. paratuberculosis
ucgaagugacgccgcu

SEQ ID NO: 2967710 - RNA, 12 nt, Mycobacterium avium subsp. paratuberculosis
ucgaaucacaag

SEQ ID NO: 2967711 - RNA, 16 nt, Mycobacterium avium subsp. paratuberculosis
ucgaaugcgcucaucg

SEQ ID NO: 2967712 - RNA, 17 nt, Mycobacterium avium subsp. paratuberculosis
ucgacaccccgcucggc

SEQ ID NO: 2967713 - RNA, 20 nt, Mycobacterium avium subsp. paratuberculosis
ucgacaccccgcucggccag

SEQ ID NO: 2967714 - RNA, 21 nt, Mycobacterium avium subsp. paratuberculosis
ucgacaccccgcucggccagc

SEQ ID NO: 2967715 - RNA, 17 nt, Mycobacterium avium subsp. paratuberculosis
ucgacaccggcggucac

SEQ ID NO: 2967716 - RNA, 15 nt, Mycobacterium avium subsp. paratuberculosis
ucgacaccgguggcg

SEQ ID NO: 2967717 - RNA, 20 nt, Mycobacterium avium subsp. paratuberculosis
ucgacacgggccgcgccgag

SEQ ID NO: 2967718 - RNA, 21 nt, Mycobacterium avium subsp. paratuberculosis
ucgacacgggccgcgccgagg

SEQ ID NO: 2967719 - RNA, 21 nt, Mycobacterium avium subsp. paratuberculosis
ucgacaggcagcccggcugcg

SEQ ID NO: 2967720 - RNA, 17 nt, Mycobacterium avium subsp. paratuberculosis
ucgacaugcccggcgac

SEQ ID NO: 2967721 - RNA, 18 nt, Mycobacterium avium subsp. paratuberculosis
ucgacaugcccggcgacg

SEQ ID NO: 2967722 - RNA, 23 nt, Mycobacterium avium subsp. paratuberculosis
ucgacaugcccggcgacggcgcc

SEQ ID NO: 2967723 - RNA, 18 nt, Mycobacterium avium subsp. paratuberculosis
ucgaccaacuccaccgcc

SEQ ID NO: 2967724 - RNA, 16 nt, Mycobacterium avium subsp. paratuberculosis
ucgaccacccgcagcu

SEQ ID NO: 2967725 - RNA, 13 nt, Mycobacterium avium subsp. paratuberculosis
ucgaccaccgccg

SEQ ID NO: 2967726 - RNA, 15 nt, Mycobacterium avium subsp. paratuberculosis
ucgaccaccgccggc

SEQ ID NO: 2967727 - RNA, 21 nt, Mycobacterium avium subsp. paratuberculosis
ucgaccaccgccggcccggcg

SEQ ID NO: 2967728 - RNA, 20 nt, Mycobacterium avium subsp. paratuberculosis
ucgaccaccucuucgcgguc

SEQ ID NO: 2967729 - RNA, 23 nt, Mycobacterium avium subsp. paratuberculosis
ucgaccacgcacaccaccgacgc

SEQ ID NO: 2967730 - RNA, 14 nt, Mycobacterium avium subsp. paratuberculosis
ucgaccacgcgcca

SEQ ID NO: 2967731 - RNA, 19 nt, Mycobacterium avium subsp. paratuberculosis
ucgaccagauugcggcacc

SEQ ID NO: 2967732 - RNA, 24 nt, Mycobacterium avium subsp. paratuberculosis
ucgaccagauugcggcaccagucg

SEQ ID NO: 2967733 - RNA, 15 nt, Mycobacterium avium subsp. paratuberculosis
ucgaccagccggguc

SEQ ID NO: 2967734 - RNA, 17 nt, Mycobacterium avium subsp. paratuberculosis
ucgaccagccggguccg

SEQ ID NO: 2967735 - RNA, 13 nt, Mycobacterium avium subsp. paratuberculosis
ucgaccagcgccg

SEQ ID NO: 2967736 - RNA, 16 nt, Mycobacterium avium subsp. paratuberculosis
ucgaccagcgccgagg

SEQ ID NO: 2967737 - RNA, 15 nt, Mycobacterium avium subsp. paratuberculosis
ucgaccagcgcgccg

SEQ ID NO: 2967738 - RNA, 17 nt, Mycobacterium avium subsp. paratuberculosis
ucgaccagcgcgccgcc

SEQ ID NO: 2967739 - RNA, 23 nt, Mycobacterium avium subsp. paratuberculosis
ucgaccaggacgucggccggcug

SEQ ID NO: 2967740 - RNA, 18 nt, Mycobacterium avium subsp. paratuberculosis
ucgaccaggcucacgcug

SEQ ID NO: 2967741 - RNA, 20 nt, Mycobacterium avium subsp. paratuberculosis
ucgaccaggcucacgcugcc

SEQ ID NO: 2967742 - RNA, 23 nt, Mycobacterium avium subsp. paratuberculosis
ucgaccaggcuuggcccgccgcc

SEQ ID NO: 2967743 - RNA, 22 nt, Mycobacterium avium subsp. paratuberculosis
ucgaccagggcgaucaccgcgg

SEQ ID NO: 2967744 - RNA, 22 nt, Mycobacterium avium subsp. paratuberculosis
ucgaccaggguuugggcgugcg

SEQ ID NO: 2967745 - RNA, 21 nt, Mycobacterium avium subsp. paratuberculosis
ucgaccagguaggcgcccugc

SEQ ID NO: 2967746 - RNA, 17 nt, Mycobacterium avium subsp. paratuberculosis
ucgacccccaccgcgac

SEQ ID NO: 2967747 - RNA, 12 nt, Mycobacterium avium subsp. paratuberculosis
ucgacccgcauc

SEQ ID NO: 2967748 - RNA, 14 nt, Mycobacterium avium subsp. paratuberculosis
ucgacccgcauccg

SEQ ID NO: 2967749 - RNA, 20 nt, Mycobacterium avium subsp. paratuberculosis
ucgacccgcauccgccgggc

SEQ ID NO: 2967750 - RNA, 14 nt, Mycobacterium avium subsp. paratuberculosis
ucgacccgccgcag

SEQ ID NO: 2967751 - RNA, 20 nt, Mycobacterium avium subsp. paratuberculosis
ucgacccgcggcgccgcggc

SEQ ID NO: 2967752 - RNA, 21 nt, Mycobacterium avium subsp. paratuberculosis
ucgacccgcuccccgauccgg

SEQ ID NO: 2967753 - RNA, 13 nt, Mycobacterium avium subsp. paratuberculosis
ucgacccggccgc

SEQ ID NO: 2967754 - RNA, 15 nt, Mycobacterium avium subsp. paratuberculosis
ucgacccggccgcgc

SEQ ID NO: 2967755 - RNA, 18 nt, Mycobacterium avium subsp. paratuberculosis
ucgacccggccgcgccgg

SEQ ID NO: 2967756 - RNA, 14 nt, Mycobacterium avium subsp. paratuberculosis
ucgacccgggccag

SEQ ID NO: 2967757 - RNA, 19 nt, Mycobacterium avium subsp. paratuberculosis
ucgacccgguagcgcagca

SEQ ID NO: 2967758 - RNA, 18 nt, Mycobacterium avium subsp. paratuberculosis
ucgacccguuccggcgag

SEQ ID NO: 2967759 - RNA, 13 nt, Mycobacterium avium subsp. paratuberculosis
ucgaccgccacca

SEQ ID NO: 2967760 - RNA, 12 nt, Mycobacterium avium subsp. paratuberculosis
ucgaccgccgcg

SEQ ID NO: 2967761 - RNA, 15 nt, Mycobacterium avium subsp. paratuberculosis
ucgaccgccgcgaac

SEQ ID NO: 2967762 - RNA, 13 nt, Mycobacterium avium subsp. paratuberculosis
ucgaccgccgcgu

SEQ ID NO: 2967763 - RNA, 22 nt, Mycobacterium avium subsp. paratuberculosis
ucgagaugccgggaagcgaagc

SEQ ID NO: 2967764 - RNA, 22 nt, Mycobacterium avium subsp. paratuberculosis
ucgagaugcguucggccgcagc

SEQ ID NO: 2967765 - RNA, 16 nt, Mycobacterium avium subsp. paratuberculosis
ucgagauucugcagcc

SEQ ID NO: 2967766 - RNA, 15 nt, Mycobacterium avium subsp. paratuberculosis
ucgagcaacaccacc

SEQ ID NO: 2967767 - RNA, 15 nt, Mycobacterium avium subsp. paratuberculosis
ucgagcaacggccgc

SEQ ID NO: 2967768 - RNA, 15 nt, Mycobacterium avium subsp. paratuberculosis
ucgagcacacgaucu

SEQ ID NO: 2967769 - RNA, 13 nt, Mycobacterium avium subsp. paratuberculosis
ucgagcaccaccc

SEQ ID NO: 2967770 - RNA, 19 nt, Mycobacterium avium subsp. paratuberculosis
ucgagcaccacggcccgcg

SEQ ID NO: 2967771 - RNA, 21 nt, Mycobacterium avium subsp. paratuberculosis
ucgagcaccagcaacaccagg

SEQ ID NO: 2967772 - RNA, 13 nt, Mycobacterium avium subsp. paratuberculosis
ucgagcaccagcg

SEQ ID NO: 2967773 - RNA, 17 nt, Mycobacterium avium subsp. paratuberculosis
ucgagcaccagcgucga

SEQ ID NO: 2967774 - RNA, 19 nt, Mycobacterium avium subsp. paratuberculosis
ucgagcaccagcgucgacg

SEQ ID NO: 2967775 - RNA, 20 nt, Mycobacterium avium subsp. paratuberculosis
ucgagcaccagcgucgacgc

SEQ ID NO: 2967776 - RNA, 15 nt, Mycobacterium avium subsp. paratuberculosis
ucgagcacccggcgg

SEQ ID NO: 2967777 - RNA, 16 nt, Mycobacterium avium subsp. paratuberculosis
ucgagcaccgcgacca

SEQ ID NO: 2967778 - RNA, 22 nt, Mycobacterium avium subsp. paratuberculosis
ucgagcaccgcgaccacgccgc

SEQ ID NO: 2967779 - RNA, 14 nt, Mycobacterium avium subsp. paratuberculosis
ucgagcaccgcgau

SEQ ID NO: 2967780 - RNA, 15 nt, Mycobacterium avium subsp. paratuberculosis
ucgagcaccgcgauc

SEQ ID NO: 2967781 - RNA, 16 nt, Mycobacterium avium subsp. paratuberculosis
ucgagcaccgcgauca

SEQ ID NO: 2967782 - RNA, 18 nt, Mycobacterium avium subsp. paratuberculosis
ucgagcaccggcagccgc

SEQ ID NO: 2967783 - RNA, 16 nt, Mycobacterium avium subsp. paratuberculosis
ucgagcaccggcggca

SEQ ID NO: 2967784 - RNA, 18 nt, Mycobacterium avium subsp. paratuberculosis
ucgagcaccggcggcagc

SEQ ID NO: 2967785 - RNA, 20 nt, Mycobacterium avium subsp. paratuberculosis
ucgagcaccgggcgucgggg

SEQ ID NO: 2967786 - RNA, 12 nt, Mycobacterium avium subsp. paratuberculosis
ucgagcacgccc

SEQ ID NO: 2967787 - RNA, 15 nt, Mycobacterium avium subsp. paratuberculosis
ucgagcacgcccugc

SEQ ID NO: 2967788 - RNA, 20 nt, Mycobacterium avium subsp. paratuberculosis
ucgagcacgcccugcggcug

SEQ ID NO: 2967789 - RNA, 16 nt, Mycobacterium avium subsp. paratuberculosis
ucgagcacgucgacgc

SEQ ID NO: 2967790 - RNA, 14 nt, Mycobacterium avium subsp. paratuberculosis
ucgagcacgugggu

SEQ ID NO: 2967791 - RNA, 13 nt, Mycobacterium avium subsp. paratuberculosis
ucgagcacucgcg

SEQ ID NO: 2967792 - RNA, 21 nt, Mycobacterium avium subsp. paratuberculosis
ucgagcacucgcgggacggcg

SEQ ID NO: 2967793 - RNA, 23 nt, Mycobacterium avium subsp. paratuberculosis
ucgagcacucgcgggacggcggc

SEQ ID NO: 2967794 - RNA, 20 nt, Mycobacterium avium subsp. paratuberculosis
ucgagcagaacuccauggag

SEQ ID NO: 2967795 - RNA, 15 nt, Mycobacterium avium subsp. paratuberculosis
ucgagcagcaccacc

SEQ ID NO: 2967796 - RNA, 16 nt, Mycobacterium avium subsp. paratuberculosis
ucgagcagccgcaaca

SEQ ID NO: 2967797 - RNA, 16 nt, Mycobacterium avium subsp. paratuberculosis
ucgagcagcgcccggc

SEQ ID NO: 2967798 - RNA, 19 nt, Mycobacterium avium subsp. paratuberculosis
ucgagcagcgcccggcgau

SEQ ID NO: 2967799 - RNA, 20 nt, Mycobacterium avium subsp. paratuberculosis
ucgagcagcgcccggcgauc

SEQ ID NO: 2967800 - RNA, 19 nt, Mycobacterium avium subsp. paratuberculosis
ucgagcaguagacgccgcc

SEQ ID NO: 2967801 - RNA, 20 nt, Mycobacterium avium subsp. paratuberculosis
ucgagcauccggcgcacggc

SEQ ID NO: 2967802 - RNA, 22 nt, Mycobacterium avium subsp. paratuberculosis
ucgagcauccggcgcacggcgc

SEQ ID NO: 2967803 - RNA, 17 nt, Mycobacterium avium subsp. paratuberculosis
ucgagcauccggugccg

SEQ ID NO: 2967804 - RNA, 19 nt, Mycobacterium avium subsp. paratuberculosis
ucgagcaucuccagccggc

SEQ ID NO: 2967805 - RNA, 20 nt, Mycobacterium avium subsp. paratuberculosis
ucgagcaucuccagccggcg

SEQ ID NO: 2967806 - RNA, 17 nt, Mycobacterium avium subsp. paratuberculosis
ucgagcaugcguccggu

SEQ ID NO: 2967807 - RNA, 14 nt, Mycobacterium avium subsp. paratuberculosis
ucgagccaccacug

SEQ ID NO: 2967808 - RNA, 17 nt, Mycobacterium avium subsp. paratuberculosis
ucgagccaccacugcgc

SEQ ID NO: 2967809 - RNA, 19 nt, Mycobacterium avium subsp. paratuberculosis
ucgagccagcgggccgagc

SEQ ID NO: 2967810 - RNA, 20 nt, Mycobacterium avium subsp. paratuberculosis
ucgagccauaaaccggccgg

SEQ ID NO: 2967811 - RNA, 21 nt, Mycobacterium avium subsp. paratuberculosis
ucgagccauaaaccggccggc

SEQ ID NO: 2967812 - RNA, 22 nt, Mycobacterium avium subsp. paratuberculosis
ucgagccauaaaccggccggcg

SEQ ID NO: 2967813 - RNA, 12 nt, Mycobacterium avium subsp. paratuberculosis
ucgagcccgauc

SEQ ID NO: 2967814 - RNA, 13 nt, Mycobacterium avium subsp. paratuberculosis
ucgagccgagcac

SEQ ID NO: 2967815 - RNA, 15 nt, Mycobacterium avium subsp. paratuberculosis
ucgagccgagcaccg

SEQ ID NO: 2967816 - RNA, 17 nt, Mycobacterium avium subsp. paratuberculosis
ucgagccgagcaccggc

SEQ ID NO: 2967817 - RNA, 18 nt, Mycobacterium avium subsp. paratuberculosis
ucgagccgagcaccggca

SEQ ID NO: 2967818 - RNA, 19 nt, Mycobacterium avium subsp. paratuberculosis
ucgagccgagcaccggcag

SEQ ID NO: 2967819 - RNA, 21 nt, Mycobacterium avium subsp. paratuberculosis
ucgagccgagcaccggcagca

SEQ ID NO: 2967820 - RNA, 20 nt, Mycobacterium avium subsp. paratuberculosis
ucgagccgcagucgaucacc

SEQ ID NO: 2967821 - RNA, 12 nt, Mycobacterium avium subsp. paratuberculosis
ucgagccgccgc

SEQ ID NO: 2967822 - RNA, 15 nt, Mycobacterium avium subsp. paratuberculosis
ucgagccgccgccgg

SEQ ID NO: 2967823 - RNA, 16 nt, Mycobacterium avium subsp. paratuberculosis
ucgagccgccgccggc

SEQ ID NO: 2967824 - RNA, 17 nt, Mycobacterium avium subsp. paratuberculosis
ucgagccgccgccggcg

SEQ ID NO: 2967825 - RNA, 19 nt, Mycobacterium avium subsp. paratuberculosis
ucgagccgccgccggcguc

SEQ ID NO: 2967826 - RNA, 21 nt, Mycobacterium avium subsp. paratuberculosis
ucgagccgccgccggcgucgc

SEQ ID NO: 2967827 - RNA, 15 nt, Mycobacterium avium subsp. paratuberculosis
ucgagccgccugcgc

SEQ ID NO: 2967828 - RNA, 18 nt, Mycobacterium avium subsp. paratuberculosis
ucgagccgccugcgcgcc

SEQ ID NO: 2967829 - RNA, 16 nt, Mycobacterium avium subsp. paratuberculosis
ucgagccgcggcccgc

SEQ ID NO: 2967830 - RNA, 14 nt, Mycobacterium avium subsp. paratuberculosis
ucgagccgcucgcg

SEQ ID NO: 2967831 - RNA, 22 nt, Mycobacterium avium subsp. paratuberculosis
ucgagccgcucgcgcaccggga

SEQ ID NO: 2967832 - RNA, 12 nt, Mycobacterium avium subsp. paratuberculosis
ucgagccggccg

SEQ ID NO: 2967833 - RNA, 17 nt, Mycobacterium avium subsp. paratuberculosis
ucgagccggccggacac

SEQ ID NO: 2967834 - RNA, 15 nt, Mycobacterium avium subsp. paratuberculosis
ucgagccggccguca

SEQ ID NO: 2967835 - RNA, 22 nt, Mycobacterium avium subsp. paratuberculosis
ucgagccgggcgcgggcgccgu

SEQ ID NO: 2967836 - RNA, 14 nt, Mycobacterium avium subsp. paratuberculosis
ucgagcgcccgggc

SEQ ID NO: 2967837 - RNA, 20 nt, Mycobacterium avium subsp. paratuberculosis
ucgagcgccgcggccaccgg

SEQ ID NO: 2967838 - RNA, 23 nt, Mycobacterium avium subsp. paratuberculosis
ucgagcgcgcucaaccgcccagc

SEQ ID NO: 2967839 - RNA, 20 nt, Mycobacterium avium subsp. paratuberculosis
ucgagcgcgcugugcgccau

SEQ ID NO: 2967840 - RNA, 15 nt, Mycobacterium avium subsp. paratuberculosis
ucgagcgcggcccgc

SEQ ID NO: 2967841 - RNA, 17 nt, Mycobacterium avium subsp. paratuberculosis
ucgagcgcggcccgccg

SEQ ID NO: 2967842 - RNA, 20 nt, Mycobacterium avium subsp. paratuberculosis
ucgagcgcggcccgccgaac

SEQ ID NO: 2967843 - RNA, 13 nt, Mycobacterium avium subsp. paratuberculosis
ucgagcggcccgc

SEQ ID NO: 2967844 - RNA, 18 nt, Mycobacterium avium subsp. paratuberculosis
ucgagcggcccgucgccg

SEQ ID NO: 2967845 - RNA, 20 nt, Mycobacterium avium subsp. paratuberculosis
ucgagcggcccgucgccgau

SEQ ID NO: 2967846 - RNA, 21 nt, Mycobacterium avium subsp. paratuberculosis
ucgagcggcccgucgccgauc

SEQ ID NO: 2967847 - RNA, 12 nt, Mycobacterium avium subsp. paratuberculosis
ucgagcggcgcc

SEQ ID NO: 2967848 - RNA, 22 nt, Mycobacterium avium subsp. paratuberculosis
ucgaucgacgacgccagcugcc

SEQ ID NO: 2967849 - RNA, 15 nt, Mycobacterium avium subsp. paratuberculosis
ucgaucgccaccgag

SEQ ID NO: 2967850 - RNA, 19 nt, Mycobacterium avium subsp. paratuberculosis
ucgaucgcccgcuccgcgg

SEQ ID NO: 2967851 - RNA, 18 nt, Mycobacterium avium subsp. paratuberculosis
ucgaucgccgcgcccagc

SEQ ID NO: 2967852 - RNA, 16 nt, Mycobacterium avium subsp. paratuberculosis
ucgaucgcggcgaugg

SEQ ID NO: 2967853 - RNA, 11 nt, Mycobacterium avium subsp. paratuberculosis
ucgaucgcgua

SEQ ID NO: 2967854 - RNA, 17 nt, Mycobacterium avium subsp. paratuberculosis
ucgaucggcgcgccgaa

SEQ ID NO: 2967855 - RNA, 14 nt, Mycobacterium avium subsp. paratuberculosis
ucgaucgggcgucg

SEQ ID NO: 2967856 - RNA, 15 nt, Mycobacterium avium subsp. paratuberculosis
ucgaucgggcgucgc

SEQ ID NO: 2967857 - RNA, 22 nt, Mycobacterium avium subsp. paratuberculosis
ucgaucgucaggaaugcgacga

SEQ ID NO: 2967858 - RNA, 16 nt, Mycobacterium avium subsp. paratuberculosis
ucgaucucggccaccg

SEQ ID NO: 2967859 - RNA, 13 nt, Mycobacterium avium subsp. paratuberculosis
ucgaucucggcgc

SEQ ID NO: 2967860 - RNA, 12 nt, Mycobacterium avium subsp. paratuberculosis
ucgaucucggug

SEQ ID NO: 2967861 - RNA, 19 nt, Mycobacterium avium subsp. paratuberculosis
ucgaucucggugagccgcu

SEQ ID NO: 2967862 - RNA, 15 nt, Mycobacterium avium subsp. paratuberculosis
ucgaucucgucgggu

SEQ ID NO: 2967863 - RNA, 13 nt, Mycobacterium avium subsp. paratuberculosis
ucgaucugcagcc

SEQ ID NO: 2967864 - RNA, 20 nt, Mycobacterium avium subsp. paratuberculosis
ucgaucugcagccggcgcgg

SEQ ID NO: 2967865 - RNA, 14 nt, Mycobacterium avium subsp. paratuberculosis
ucgaucuggcggac

SEQ ID NO: 2967866 - RNA, 16 nt, Mycobacterium avium subsp. paratuberculosis
ucgaucugggccagga

SEQ ID NO: 2967867 - RNA, 17 nt, Mycobacterium avium subsp. paratuberculosis
ucgaucugggccaggau

SEQ ID NO: 2967868 - RNA, 20 nt, Mycobacterium avium subsp. paratuberculosis
ucgaucugguucaccgccac

SEQ ID NO: 2967869 - RNA, 21 nt, Mycobacterium avium subsp. paratuberculosis
ucgaucugguucaccgccacc

SEQ ID NO: 2967870 - RNA, 14 nt, Mycobacterium avium subsp. paratuberculosis
ucgaucuugacgug

SEQ ID NO: 2967871 - RNA, 15 nt, Mycobacterium avium subsp. paratuberculosis
ucgaucuugucgucc

SEQ ID NO: 2967872 - RNA, 24 nt, Mycobacterium avium subsp. paratuberculosis
ucgaucuugugcucgagcucggcg

SEQ ID NO: 2967873 - RNA, 13 nt, Mycobacterium avium subsp. paratuberculosis
ucgaugaaccgcu

SEQ ID NO: 2967874 - RNA, 15 nt, Mycobacterium avium subsp. paratuberculosis
ucgaugaacucgcgg

SEQ ID NO: 2967875 - RNA, 16 nt, Mycobacterium avium subsp. paratuberculosis
ucgaugaacucgcggg

SEQ ID NO: 2967876 - RNA, 17 nt, Mycobacterium avium subsp. paratuberculosis
ucgaugaacucgcgggc

SEQ ID NO: 2967877 - RNA, 20 nt, Mycobacterium avium subsp. paratuberculosis
ucgaugaaguugaagacgcg

SEQ ID NO: 2967878 - RNA, 20 nt, Mycobacterium avium subsp. paratuberculosis
ucgaugaauuccggugugcc

SEQ ID NO: 2967879 - RNA, 20 nt, Mycobacterium avium subsp. paratuberculosis
ucgaugacccaccagccgag

SEQ ID NO: 2967880 - RNA, 19 nt, Mycobacterium avium subsp. paratuberculosis
ucgaugaccucgcgcagcc

SEQ ID NO: 2967881 - RNA, 20 nt, Mycobacterium avium subsp. paratuberculosis
ucgaugaccucgcgcccggc

SEQ ID NO: 2967882 - RNA, 13 nt, Mycobacterium avium subsp. paratuberculosis
ucgaugacgccgg

SEQ ID NO: 2967883 - RNA, 13 nt, Mycobacterium avium subsp. paratuberculosis
ucgaugacgcgcu

SEQ ID NO: 2967884 - RNA, 14 nt, Mycobacterium avium subsp. paratuberculosis
ucgaugacggcggc

SEQ ID NO: 2967885 - RNA, 15 nt, Mycobacterium avium subsp. paratuberculosis
ucgaugacggcggcg

SEQ ID NO: 2967886 - RNA, 21 nt, Mycobacterium avium subsp. paratuberculosis
ucgaugacggcggcgcccugc

SEQ ID NO: 2967887 - RNA, 20 nt, Mycobacterium avium subsp. paratuberculosis
ucgaugacggucuugcggcc

SEQ ID NO: 2967888 - RNA, 21 nt, Mycobacterium avium subsp. paratuberculosis
ucgaugacggucuugcggccg

SEQ ID NO: 2967889 - RNA, 18 nt, Mycobacterium avium subsp. paratuberculosis
ucgaugagcuggugcagc

SEQ ID NO: 2967890 - RNA, 23 nt, Mycobacterium avium subsp. paratuberculosis
ucgaugagcuggugcagcgacuc

SEQ ID NO: 2967891 - RNA, 15 nt, Mycobacterium avium subsp. paratuberculosis
ucgaugaucuggcgg

SEQ ID NO: 2967892 - RNA, 15 nt, Mycobacterium avium subsp. paratuberculosis
ucgaugaugccggcg

SEQ ID NO: 2967893 - RNA, 16 nt, Mycobacterium avium subsp. paratuberculosis
ucgaugaugccggcgg

SEQ ID NO: 2967894 - RNA, 18 nt, Mycobacterium avium subsp. paratuberculosis
ucgaugaugggcgaucga

SEQ ID NO: 2967895 - RNA, 19 nt, Mycobacterium avium subsp. paratuberculosis
ucgaugaugggcgaucgac

SEQ ID NO: 2967896 - RNA, 16 nt, Mycobacterium avium subsp. paratuberculosis
ucgaugcacggucggc

SEQ ID NO: 2967897 - RNA, 15 nt, Mycobacterium avium subsp. paratuberculosis
ucgaugcccugcccc

SEQ ID NO: 2967898 - RNA, 17 nt, Mycobacterium avium subsp. paratuberculosis
ucgaugccgagccggcc

SEQ ID NO: 2967899 - RNA, 18 nt, Mycobacterium avium subsp. paratuberculosis
ucgaugccgaucggggcg

SEQ ID NO: 2967900 - RNA, 15 nt, Mycobacterium avium subsp. paratuberculosis
ucgaugccgaugagg

SEQ ID NO: 2967901 - RNA, 18 nt, Mycobacterium avium subsp. paratuberculosis
ucgaugccgccccugcug

SEQ ID NO: 2967902 - RNA, 14 nt, Mycobacterium avium subsp. paratuberculosis
ucgaugccggcgac

SEQ ID NO: 2967903 - RNA, 15 nt, Mycobacterium avium subsp. paratuberculosis
ucgaugccggcgacg

SEQ ID NO: 2967904 - RNA, 23 nt, Mycobacterium avium subsp. paratuberculosis
ucgaugccggcgauccgcgcggc

SEQ ID NO: 2967905 - RNA, 19 nt, Mycobacterium avium subsp. paratuberculosis
ucgaugccguagaccagca

SEQ ID NO: 2967906 - RNA, 14 nt, Mycobacterium avium subsp. paratuberculosis
ucgaugccgugccg

SEQ ID NO: 2967907 - RNA, 19 nt, Mycobacterium avium subsp. paratuberculosis
ucgaugccguugugcacca

SEQ ID NO: 2967908 - RNA, 20 nt, Mycobacterium avium subsp. paratuberculosis
ucgaugcgacgcaccucggc

SEQ ID NO: 2967909 - RNA, 13 nt, Mycobacterium avium subsp. paratuberculosis
ucgaugcgcaccg

SEQ ID NO: 2967910 - RNA, 17 nt, Mycobacterium avium subsp. paratuberculosis
ucgaugcgcagcagcgg

SEQ ID NO: 2967911 - RNA, 15 nt, Mycobacterium avium subsp. paratuberculosis
ucgaugcgcagggcg

SEQ ID NO: 2967912 - RNA, 11 nt, Mycobacterium avium subsp. paratuberculosis
ucgaugcgcgc

SEQ ID NO: 2967913 - RNA, 13 nt, Mycobacterium avium subsp. paratuberculosis
ucgaugcgcgcca

SEQ ID NO: 2967914 - RNA, 16 nt, Mycobacterium avium subsp. paratuberculosis
ucgaugcgcgccagca

SEQ ID NO: 2967915 - RNA, 18 nt, Mycobacterium avium subsp. paratuberculosis
ucgaugcgcgccagcagc

SEQ ID NO: 2967916 - RNA, 22 nt, Mycobacterium avium subsp. paratuberculosis
ucgaugcggguguugcgcagcg

SEQ ID NO: 2967917 - RNA, 14 nt, Mycobacterium avium subsp. paratuberculosis
ucgauggaaggugc

SEQ ID NO: 2967918 - RNA, 15 nt, Mycobacterium avium subsp. paratuberculosis
ucgauggaaggugcu

SEQ ID NO: 2967919 - RNA, 20 nt, Mycobacterium avium subsp. paratuberculosis
ucgauggaauucgucggcgg

SEQ ID NO: 2967920 - RNA, 22 nt, Mycobacterium avium subsp. paratuberculosis
ucgauggaauucgucggcggug

SEQ ID NO: 2967921 - RNA, 14 nt, Mycobacterium avium subsp. paratuberculosis
ucgauggacagggc

SEQ ID NO: 2967922 - RNA, 16 nt, Mycobacterium avium subsp. paratuberculosis
ucgauggacagggcga

SEQ ID NO: 2967923 - RNA, 17 nt, Mycobacterium avium subsp. paratuberculosis
ucgauggacagggcgac

SEQ ID NO: 2967924 - RNA, 15 nt, Mycobacterium avium subsp. paratuberculosis
ucgauggacgcggug

SEQ ID NO: 2967925 - RNA, 13 nt, Mycobacterium avium subsp. paratuberculosis
ucgauggccaucg

SEQ ID NO: 2967926 - RNA, 12 nt, Mycobacterium avium subsp. paratuberculosis
ucgauggccggg

SEQ ID NO: 2967927 - RNA, 16 nt, Mycobacterium avium subsp. paratuberculosis
ucgauggccucgucgc

SEQ ID NO: 2967928 - RNA, 21 nt, Mycobacterium avium subsp. paratuberculosis
ucgauggccucgucgcggaac

SEQ ID NO: 2967929 - RNA, 14 nt, Mycobacterium avium subsp. paratuberculosis
ucgauggcgccgau

SEQ ID NO: 2967930 - RNA, 19 nt, Mycobacterium avium subsp. paratuberculosis
ucgauggcgcggcccaguu

SEQ ID NO: 2967931 - RNA, 16 nt, Mycobacterium avium subsp. paratuberculosis
ucgauggcggcgauga

SEQ ID NO: 2967932 - RNA, 15 nt, Mycobacterium avium subsp. paratuberculosis
ucgauggcggcggcu

SEQ ID NO: 2967933 - RNA, 23 nt, Mycobacterium avium subsp. paratuberculosis
ucgccacgccguggcccgcccag

SEQ ID NO: 2967934 - RNA, 14 nt, Mycobacterium avium subsp. paratuberculosis
ucgccacggccggc

SEQ ID NO: 2967935 - RNA, 15 nt, Mycobacterium avium subsp. paratuberculosis
ucgccacggccggca

SEQ ID NO: 2967936 - RNA, 21 nt, Mycobacterium avium subsp. paratuberculosis
ucgccacggcggugucggcgg

SEQ ID NO: 2967937 - RNA, 22 nt, Mycobacterium avium subsp. paratuberculosis
ucgccacggcggugucggcggc

SEQ ID NO: 2967938 - RNA, 14 nt, Mycobacterium avium subsp. paratuberculosis
ucgccacucgggcg

SEQ ID NO: 2967939 - RNA, 19 nt, Mycobacterium avium subsp. paratuberculosis
ucgccacugggcgucggcg

SEQ ID NO: 2967940 - RNA, 20 nt, Mycobacterium avium subsp. paratuberculosis
ucgccacugggcgucggcgc

SEQ ID NO: 2967941 - RNA, 21 nt, Mycobacterium avium subsp. paratuberculosis
ucgccacugggcgucggcgcc

SEQ ID NO: 2967942 - RNA, 11 nt, Mycobacterium avium subsp. paratuberculosis
ucgccagcaac

SEQ ID NO: 2967943 - RNA, 18 nt, Mycobacterium avium subsp. paratuberculosis
ucgccagcaacgacccgg

SEQ ID NO: 2967944 - RNA, 12 nt, Mycobacterium avium subsp. paratuberculosis
ucgccagcacca

SEQ ID NO: 2967945 - RNA, 22 nt, Mycobacterium avium subsp. paratuberculosis
ucgccagcaccaccucgcgcgg

SEQ ID NO: 2967946 - RNA, 13 nt, Mycobacterium avium subsp. paratuberculosis
ucgccagcaccgg

SEQ ID NO: 2967947 - RNA, 21 nt, Mycobacterium avium subsp. paratuberculosis
ucgccagcaccggcgcgccgc

SEQ ID NO: 2967948 - RNA, 16 nt, Mycobacterium avium subsp. paratuberculosis
ucgccagcaccgugcu

SEQ ID NO: 2967949 - RNA, 17 nt, Mycobacterium avium subsp. paratuberculosis
ucgccagcaccgugcug

SEQ ID NO: 2967950 - RNA, 14 nt, Mycobacterium avium subsp. paratuberculosis
ucgccagcccggcg

SEQ ID NO: 2967951 - RNA, 12 nt, Mycobacterium avium subsp. paratuberculosis
ucgccagccgcc

SEQ ID NO: 2967952 - RNA, 14 nt, Mycobacterium avium subsp. paratuberculosis
ucgccagccgccgg

SEQ ID NO: 2967953 - RNA, 16 nt, Mycobacterium avium subsp. paratuberculosis
ucgccagccgccggcu

SEQ ID NO: 2967954 - RNA, 21 nt, Mycobacterium avium subsp. paratuberculosis
ucgccagccgccggcucagcg

SEQ ID NO: 2967955 - RNA, 13 nt, Mycobacterium avium subsp. paratuberculosis
ucgccagccgucc

SEQ ID NO: 2967956 - RNA, 16 nt, Mycobacterium avium subsp. paratuberculosis
ucgccagcgccacgcu

SEQ ID NO: 2967957 - RNA, 12 nt, Mycobacterium avium subsp. paratuberculosis
ucgccagcgccc

SEQ ID NO: 2967958 - RNA, 15 nt, Mycobacterium avium subsp. paratuberculosis
ucgccagcgccccca

SEQ ID NO: 2967959 - RNA, 19 nt, Mycobacterium avium subsp. paratuberculosis
ucgccagcgcgcagaacac

SEQ ID NO: 2967960 - RNA, 13 nt, Mycobacterium avium subsp. paratuberculosis
ucgccagcgcggu

SEQ ID NO: 2967961 - RNA, 20 nt, Mycobacterium avium subsp. paratuberculosis
ucgccagcgcggugucgacg

SEQ ID NO: 2967962 - RNA, 21 nt, Mycobacterium avium subsp. paratuberculosis
ucgccagcgcggugucgacgu

SEQ ID NO: 2967963 - RNA, 18 nt, Mycobacterium avium subsp. paratuberculosis
ucgccagcgggccgaccu

SEQ ID NO: 2967964 - RNA, 19 nt, Mycobacterium avium subsp. paratuberculosis
ucgccagcgggccgaccug

SEQ ID NO: 2967965 - RNA, 21 nt, Mycobacterium avium subsp. paratuberculosis
ucgccaggaaccacaccccgg

SEQ ID NO: 2967966 - RNA, 12 nt, Mycobacterium avium subsp. paratuberculosis
ucgccaggaugu

SEQ ID NO: 2967967 - RNA, 15 nt, Mycobacterium avium subsp. paratuberculosis
ucgccaggccaccgc

SEQ ID NO: 2967968 - RNA, 20 nt, Mycobacterium avium subsp. paratuberculosis
ucgccaggccaccgcacguc

SEQ ID NO: 2967969 - RNA, 19 nt, Mycobacterium avium subsp. paratuberculosis
ucgccaggcguugcaccgc

SEQ ID NO: 2967970 - RNA, 15 nt, Mycobacterium avium subsp. paratuberculosis
ucgccaguccggcgc

SEQ ID NO: 2967971 - RNA, 22 nt, Mycobacterium avium subsp. paratuberculosis
ucgccaguccggcgccgacccc

SEQ ID NO: 2967972 - RNA, 21 nt, Mycobacterium avium subsp. paratuberculosis
ucgccagugccgcgcggacgc

SEQ ID NO: 2967973 - RNA, 23 nt, Mycobacterium avium subsp. paratuberculosis
ucgccaguugcacuuucggcagc

SEQ ID NO: 2967974 - RNA, 18 nt, Mycobacterium avium subsp. paratuberculosis
ucgccaucagcagcgccu

SEQ ID NO: 2967975 - RNA, 18 nt, Mycobacterium avium subsp. paratuberculosis
ucgccaucgcaccgcgag

SEQ ID NO: 2967976 - RNA, 15 nt, Mycobacterium avium subsp. paratuberculosis
ucgccaugccgucgc

SEQ ID NO: 2967977 - RNA, 16 nt, Mycobacterium avium subsp. paratuberculosis
ucgccaugcgaccacg

SEQ ID NO: 2967978 - RNA, 16 nt, Mycobacterium avium subsp. paratuberculosis
ucgccaugcuggcacu

SEQ ID NO: 2967979 - RNA, 19 nt, Mycobacterium avium subsp. paratuberculosis
ucgccaugcuggcacuccu

SEQ ID NO: 2967980 - RNA, 13 nt, Mycobacterium avium subsp. paratuberculosis
ucgcccaccacga

SEQ ID NO: 2967981 - RNA, 20 nt, Mycobacterium avium subsp. paratuberculosis
ucgcccaccacgacgacgug

SEQ ID NO: 2967982 - RNA, 13 nt, Mycobacterium avium subsp. paratuberculosis
ucgcccaccccgg

SEQ ID NO: 2967983 - RNA, 13 nt, Mycobacterium avium subsp. paratuberculosis
ucgcccacccgca

SEQ ID NO: 2967984 - RNA, 21 nt, Mycobacterium avium subsp. paratuberculosis
ucgcccacccgcacgcccggg

SEQ ID NO: 2967985 - RNA, 16 nt, Mycobacterium avium subsp. paratuberculosis
ucgcccaccgacgcgg

SEQ ID NO: 2967986 - RNA, 20 nt, Mycobacterium avium subsp. paratuberculosis
ucgcccaccugguucucccg

SEQ ID NO: 2967987 - RNA, 15 nt, Mycobacterium avium subsp. paratuberculosis
ucgcccaccuuggcg

SEQ ID NO: 2967988 - RNA, 18 nt, Mycobacterium avium subsp. paratuberculosis
ucgcccaccuuggcgucg

SEQ ID NO: 2967989 - RNA, 20 nt, Mycobacterium avium subsp. paratuberculosis
ucgcccaccuuggcgucgau

SEQ ID NO: 2967990 - RNA, 12 nt, Mycobacterium avium subsp. paratuberculosis
ucgcccacgccg

SEQ ID NO: 2967991 - RNA, 13 nt, Mycobacterium avium subsp. paratuberculosis
ucgcccacgccgg

SEQ ID NO: 2967992 - RNA, 13 nt, Mycobacterium avium subsp. paratuberculosis
ucgcccagcaccg

SEQ ID NO: 2967993 - RNA, 22 nt, Mycobacterium avium subsp. paratuberculosis
ucgcccagcaccgcgacgaucg

SEQ ID NO: 2967994 - RNA, 14 nt, Mycobacterium avium subsp. paratuberculosis
ucgcccagcaccgu

SEQ ID NO: 2967995 - RNA, 13 nt, Mycobacterium avium subsp. paratuberculosis
ucgcccagcagcc

SEQ ID NO: 2967996 - RNA, 16 nt, Mycobacterium avium subsp. paratuberculosis
ucgcccagcagcccgg

SEQ ID NO: 2967997 - RNA, 17 nt, Mycobacterium avium subsp. paratuberculosis
ucgcccagcagcccggc

SEQ ID NO: 2967998 - RNA, 20 nt, Mycobacterium avium subsp. paratuberculosis
ucgcccagcagcccggccag

SEQ ID NO: 2967999 - RNA, 21 nt, Mycobacterium avium subsp. paratuberculosis
ucgcccagcagcccggccagc

SEQ ID NO: 2968000 - RNA, 22 nt, Mycobacterium avium subsp. paratuberculosis
ucgcccagcagcccggccagcc

SEQ ID NO: 2968001 - RNA, 13 nt, Mycobacterium avium subsp. paratuberculosis
ucgcccagccggc

SEQ ID NO: 2968002 - RNA, 13 nt, Mycobacterium avium subsp. paratuberculosis
ucgcccagcgcag

SEQ ID NO: 2968003 - RNA, 15 nt, Mycobacterium avium subsp. paratuberculosis
ucgcccagcgccgcg

SEQ ID NO: 2968004 - RNA, 16 nt, Mycobacterium avium subsp. paratuberculosis
ucgcccagcgcggcgg

SEQ ID NO: 2968005 - RNA, 17 nt, Mycobacterium avium subsp. paratuberculosis
ucgcccagcgcggcggc

SEQ ID NO: 2968006 - RNA, 21 nt, Mycobacterium avium subsp. paratuberculosis
ucgcccagcgugucggcgauc

SEQ ID NO: 2968007 - RNA, 23 nt, Mycobacterium avium subsp. paratuberculosis
ucgcccagcgugucggcgaucgc

SEQ ID NO: 2968008 - RNA, 14 nt, Mycobacterium avium subsp. paratuberculosis
ucgcccaucaccag

SEQ ID NO: 2968009 - RNA, 21 nt, Mycobacterium avium subsp. paratuberculosis
ucgcccaucaccgcaccgacg

SEQ ID NO: 2968010 - RNA, 17 nt, Mycobacterium avium subsp. paratuberculosis
ucgcccauuugccggug

SEQ ID NO: 2968011 - RNA, 15 nt, Mycobacterium avium subsp. paratuberculosis
ucgcccccucggccg

SEQ ID NO: 2968012 - RNA, 20 nt, Mycobacterium avium subsp. paratuberculosis
ucgcccccucggccgguccg

SEQ ID NO: 2968013 - RNA, 14 nt, Mycobacterium avium subsp. paratuberculosis
ucgccccgcaccga

SEQ ID NO: 2968014 - RNA, 22 nt, Mycobacterium avium subsp. paratuberculosis
ucgccccgcuggaacgccgagg

SEQ ID NO: 2968015 - RNA, 23 nt, Mycobacterium avium subsp. paratuberculosis
ucgccccgcuggaacgccgagga

SEQ ID NO: 2968016 - RNA, 19 nt, Mycobacterium avium subsp. paratuberculosis
ucgccccggagaugguggc

SEQ ID NO: 2968017 - RNA, 13 nt, Mycobacterium avium subsp. paratuberculosis
ucgccccggccgc

SEQ ID NO: 2968018 - RNA, 15 nt, Mycobacterium avium subsp. paratuberculosis
ucgccgagccgcgcc

SEQ ID NO: 2968019 - RNA, 23 nt, Mycobacterium avium subsp. paratuberculosis
ucgccgagccgcgccacgcgcag

SEQ ID NO: 2968020 - RNA, 20 nt, Mycobacterium avium subsp. paratuberculosis
ucgccgagcgcaucgacugc

SEQ ID NO: 2968021 - RNA, 12 nt, Mycobacterium avium subsp. paratuberculosis
ucgccgagcucg

SEQ ID NO: 2968022 - RNA, 15 nt, Mycobacterium avium subsp. paratuberculosis
ucgccgagcucgaug

SEQ ID NO: 2968023 - RNA, 23 nt, Mycobacterium avium subsp. paratuberculosis
ucgccgaggaaccggcagccggc

SEQ ID NO: 2968024 - RNA, 17 nt, Mycobacterium avium subsp. paratuberculosis
ucgccgagggcgacgau

SEQ ID NO: 2968025 - RNA, 18 nt, Mycobacterium avium subsp. paratuberculosis
ucgccgagggcgacgaug

SEQ ID NO: 2968026 - RNA, 17 nt, Mycobacterium avium subsp. paratuberculosis
ucgccgagguagccgcg

SEQ ID NO: 2968027 - RNA, 22 nt, Mycobacterium avium subsp. paratuberculosis
ucgccgagguagccgcgcacca

SEQ ID NO: 2968028 - RNA, 16 nt, Mycobacterium avium subsp. paratuberculosis
ucgccgagguccucga

SEQ ID NO: 2968029 - RNA, 17 nt, Mycobacterium avium subsp. paratuberculosis
ucgccgaucagcaccag

SEQ ID NO: 2968030 - RNA, 17 nt, Mycobacterium avium subsp. paratuberculosis
ucgccgauccagccguc

SEQ ID NO: 2968031 - RNA, 18 nt, Mycobacterium avium subsp. paratuberculosis
ucgccgauccagccgucg

SEQ ID NO: 2968032 - RNA, 17 nt, Mycobacterium avium subsp. paratuberculosis
ucgccgauccgcgggua

SEQ ID NO: 2968033 - RNA, 17 nt, Mycobacterium avium subsp. paratuberculosis
ucgccgauccgggcggc

SEQ ID NO: 2968034 - RNA, 19 nt, Mycobacterium avium subsp. paratuberculosis
ucgccgaucucgaccagcg

SEQ ID NO: 2968035 - RNA, 16 nt, Mycobacterium avium subsp. paratuberculosis
ucgccgaucucggcca

SEQ ID NO: 2968036 - RNA, 17 nt, Mycobacterium avium subsp. paratuberculosis
ucgccgaucucggccaa

SEQ ID NO: 2968037 - RNA, 17 nt, Mycobacterium avium subsp. paratuberculosis
ucgccgaucuggcgcag

SEQ ID NO: 2968038 - RNA, 19 nt, Mycobacterium avium subsp. paratuberculosis
ucgccgaucuggcgcagcg

SEQ ID NO: 2968039 - RNA, 17 nt, Mycobacterium avium subsp. paratuberculosis
ucgccgaucugucgcgc

SEQ ID NO: 2968040 - RNA, 19 nt, Mycobacterium avium subsp. paratuberculosis
ucgccgaucugucgcgcuc

SEQ ID NO: 2968041 - RNA, 16 nt, Mycobacterium avium subsp. paratuberculosis
ucgccgaugaccaccc

SEQ ID NO: 2968042 - RNA, 22 nt, Mycobacterium avium subsp. paratuberculosis
ucgccgaugacguugcgcgcca

SEQ ID NO: 2968043 - RNA, 16 nt, Mycobacterium avium subsp. paratuberculosis
ucgccgaugcgccgca

SEQ ID NO: 2968044 - RNA, 17 nt, Mycobacterium avium subsp. paratuberculosis
ucgccgaugcgccgcac

SEQ ID NO: 2968045 - RNA, 17 nt, Mycobacterium avium subsp. paratuberculosis
ucgccgauggagaccuc

SEQ ID NO: 2968046 - RNA, 20 nt, Mycobacterium avium subsp. paratuberculosis
ucgccgauggugacggugcc

SEQ ID NO: 2968047 - RNA, 18 nt, Mycobacterium avium subsp. paratuberculosis
ucgccgaugucggccggu

SEQ ID NO: 2968048 - RNA, 16 nt, Mycobacterium avium subsp. paratuberculosis
ucgccgauguggcggg

SEQ ID NO: 2968049 - RNA, 21 nt, Mycobacterium avium subsp. paratuberculosis
ucgccgauguggcgggcgucc

SEQ ID NO: 2968050 - RNA, 23 nt, Mycobacterium avium subsp. paratuberculosis
ucgccgcacgcccacagcugacg

SEQ ID NO: 2968051 - RNA, 13 nt, Mycobacterium avium subsp. paratuberculosis
ucgccgcaggcgu

SEQ ID NO: 2968052 - RNA, 17 nt, Mycobacterium avium subsp. paratuberculosis
ucgccgccaacgcgaac

SEQ ID NO: 2968053 - RNA, 12 nt, Mycobacterium avium subsp. paratuberculosis
ucgccgccagca

SEQ ID NO: 2968054 - RNA, 16 nt, Mycobacterium avium subsp. paratuberculosis
ucgccgccagcacgug

SEQ ID NO: 2968055 - RNA, 19 nt, Mycobacterium avium subsp. paratuberculosis
ucgccgccaucgccgccgc

SEQ ID NO: 2968056 - RNA, 18 nt, Mycobacterium avium subsp. paratuberculosis
ucgccgcccaucggcagc

SEQ ID NO: 2968057 - RNA, 22 nt, Mycobacterium avium subsp. paratuberculosis
ucgccgcccccgauagccccgc

SEQ ID NO: 2968058 - RNA, 13 nt, Mycobacterium avium subsp. paratuberculosis
ucgccgccccgag

SEQ ID NO: 2968059 - RNA, 15 nt, Mycobacterium avium subsp. paratuberculosis
ucgccgccccgaguu

SEQ ID NO: 2968060 - RNA, 13 nt, Mycobacterium avium subsp. paratuberculosis
ucgccgccgacga

SEQ ID NO: 2968061 - RNA, 20 nt, Mycobacterium avium subsp. paratuberculosis
ucgccgccgcaauacaccgc

SEQ ID NO: 2968062 - RNA, 13 nt, Mycobacterium avium subsp. paratuberculosis
ucgccgccgcacc

SEQ ID NO: 2968063 - RNA, 18 nt, Mycobacterium avium subsp. paratuberculosis
ucgccgccgcaccggccg

SEQ ID NO: 2968064 - RNA, 21 nt, Mycobacterium avium subsp. paratuberculosis
ucgccgccgccagcaccaccg

SEQ ID NO: 2968065 - RNA, 13 nt, Mycobacterium avium subsp. paratuberculosis
ucgccgccgccau

SEQ ID NO: 2968066 - RNA, 16 nt, Mycobacterium avium subsp. paratuberculosis
ucgccgccgccgaucu

SEQ ID NO: 2968067 - RNA, 12 nt, Mycobacterium avium subsp. paratuberculosis
ucgccgccgcgc

SEQ ID NO: 2968068 - RNA, 16 nt, Mycobacterium avium subsp. paratuberculosis
ucgccgccgcgcaccg

SEQ ID NO: 2968069 - RNA, 14 nt, Mycobacterium avium subsp. paratuberculosis
ucgccgccgggcgc

SEQ ID NO: 2968070 - RNA, 16 nt, Mycobacterium avium subsp. paratuberculosis
ucgccgccgggcgcca

SEQ ID NO: 2968071 - RNA, 17 nt, Mycobacterium avium subsp. paratuberculosis
ucgccgccgggcgccac

SEQ ID NO: 2968072 - RNA, 21 nt, Mycobacterium avium subsp. paratuberculosis
ucgccgccggugaagaucagc

SEQ ID NO: 2968073 - RNA, 22 nt, Mycobacterium avium subsp. paratuberculosis
ucgccgccggugaagaucagcg

SEQ ID NO: 2968074 - RNA, 18 nt, Mycobacterium avium subsp. paratuberculosis
ucgccgccggugccgacg

SEQ ID NO: 2968075 - RNA, 14 nt, Mycobacterium avium subsp. paratuberculosis
ucgccgcgacccgg

SEQ ID NO: 2968076 - RNA, 17 nt, Mycobacterium avium subsp. paratuberculosis
ucgccgcgcacccggcc

SEQ ID NO: 2968077 - RNA, 16 nt, Mycobacterium avium subsp. paratuberculosis
ucgccgcgcagcaccg

SEQ ID NO: 2968078 - RNA, 17 nt, Mycobacterium avium subsp. paratuberculosis
ucgccgcgcagcaccgc

SEQ ID NO: 2968079 - RNA, 18 nt, Mycobacterium avium subsp. paratuberculosis
ucgccgcgcagcaccgcg

SEQ ID NO: 2968080 - RNA, 19 nt, Mycobacterium avium subsp. paratuberculosis
ucgccgcgcagcaccgcgu

SEQ ID NO: 2968081 - RNA, 20 nt, Mycobacterium avium subsp. paratuberculosis
ucgccgcgcagcaccgcguc

SEQ ID NO: 2968082 - RNA, 12 nt, Mycobacterium avium subsp. paratuberculosis
ucgccgcgcauc

SEQ ID NO: 2968083 - RNA, 19 nt, Mycobacterium avium subsp. paratuberculosis
ucgccgcgcaucaucgccc

SEQ ID NO: 2968084 - RNA, 21 nt, Mycobacterium avium subsp. paratuberculosis
ucgccgcgcaucaucgcccag

SEQ ID NO: 2968085 - RNA, 19 nt, Mycobacterium avium subsp. paratuberculosis
ucgccgcgcauucaccagc

SEQ ID NO: 2968086 - RNA, 14 nt, Mycobacterium avium subsp. paratuberculosis
ucgccgcgccagca

SEQ ID NO: 2968087 - RNA, 18 nt, Mycobacterium avium subsp. paratuberculosis
ucgccgcgccagcaccuc

SEQ ID NO: 2968088 - RNA, 21 nt, Mycobacterium avium subsp. paratuberculosis
ucgccgcgccagcaccucggc

SEQ ID NO: 2968089 - RNA, 14 nt, Mycobacterium avium subsp. paratuberculosis
ucgccgcgccagcc

SEQ ID NO: 2968090 - RNA, 22 nt, Mycobacterium avium subsp. paratuberculosis
ucgccgcgccagccgccgccga

SEQ ID NO: 2968091 - RNA, 16 nt, Mycobacterium avium subsp. paratuberculosis
ucgccgcgcccagcac

SEQ ID NO: 2968092 - RNA, 19 nt, Mycobacterium avium subsp. paratuberculosis
ucgccgcgcccagcacguc

SEQ ID NO: 2968093 - RNA, 15 nt, Mycobacterium avium subsp. paratuberculosis
ucgccgcgcccgccg

SEQ ID NO: 2968094 - RNA, 19 nt, Mycobacterium avium subsp. paratuberculosis
ucgccgcgcccgccggccc

SEQ ID NO: 2968095 - RNA, 20 nt, Mycobacterium avium subsp. paratuberculosis
ucgccgcgcgcgucgacguu

SEQ ID NO: 2968096 - RNA, 22 nt, Mycobacterium avium subsp. paratuberculosis
ucgccgcgcgcgucgacguucg

SEQ ID NO: 2968097 - RNA, 23 nt, Mycobacterium avium subsp. paratuberculosis
ucgccgcgcgcgucgacguucgc

SEQ ID NO: 2968098 - RNA, 23 nt, Mycobacterium avium subsp. paratuberculosis
ucgccgcgcggcccgcgacgucg

SEQ ID NO: 2968099 - RNA, 21 nt, Mycobacterium avium subsp. paratuberculosis
ucgccgcgcguuccagcacgc

SEQ ID NO: 2968100 - RNA, 21 nt, Mycobacterium avium subsp. paratuberculosis
ucgccgcgcucaacccgggcc

SEQ ID NO: 2968101 - RNA, 22 nt, Mycobacterium avium subsp. paratuberculosis
ucgccgcgcucaacccgggccg

SEQ ID NO: 2968102 - RNA, 22 nt, Mycobacterium avium subsp. paratuberculosis
ucgccgguaccgccggccaggc

SEQ ID NO: 2968103 - RNA, 16 nt, Mycobacterium avium subsp. paratuberculosis
ucgccggucagcacgu

SEQ ID NO: 2968104 - RNA, 13 nt, Mycobacterium avium subsp. paratuberculosis
ucgccggucuggu

SEQ ID NO: 2968105 - RNA, 23 nt, Mycobacterium avium subsp. paratuberculosis
ucgccggucugguacccgauggu

SEQ ID NO: 2968106 - RNA, 16 nt, Mycobacterium avium subsp. paratuberculosis
ucgccggugaccgcgc

SEQ ID NO: 2968107 - RNA, 18 nt, Mycobacterium avium subsp. paratuberculosis
ucgccggugaccgcgccg

SEQ ID NO: 2968108 - RNA, 19 nt, Mycobacterium avium subsp. paratuberculosis
ucgccggugaccgcgccgg

SEQ ID NO: 2968109 - RNA, 20 nt, Mycobacterium avium subsp. paratuberculosis
ucgccggugaccgcgccggu

SEQ ID NO: 2968110 - RNA, 16 nt, Mycobacterium avium subsp. paratuberculosis
ucgccggugaccugca

SEQ ID NO: 2968111 - RNA, 21 nt, Mycobacterium avium subsp. paratuberculosis
ucgccggugaccugcagcgcc

SEQ ID NO: 2968112 - RNA, 15 nt, Mycobacterium avium subsp. paratuberculosis
ucgccggugcgggcu

SEQ ID NO: 2968113 - RNA, 16 nt, Mycobacterium avium subsp. paratuberculosis
ucgccggugcgggcug

SEQ ID NO: 2968114 - RNA, 16 nt, Mycobacterium avium subsp. paratuberculosis
ucgccgguggccgccg

SEQ ID NO: 2968115 - RNA, 15 nt, Mycobacterium avium subsp. paratuberculosis
ucgccgguggcggcg

SEQ ID NO: 2968116 - RNA, 12 nt, Mycobacterium avium subsp. paratuberculosis
ucgccgguggug

SEQ ID NO: 2968117 - RNA, 19 nt, Mycobacterium avium subsp. paratuberculosis
ucgccgguggugcaccggu

SEQ ID NO: 2968118 - RNA, 24 nt, Mycobacterium avium subsp. paratuberculosis
ucgccggugugaucgagcaccagc

SEQ ID NO: 2968119 - RNA, 16 nt, Mycobacterium avium subsp. paratuberculosis
ucgccggugugcagcc

SEQ ID NO: 2968120 - RNA, 19 nt, Mycobacterium avium subsp. paratuberculosis
ucgccggugugcagccacc

SEQ ID NO: 2968121 - RNA, 23 nt, Mycobacterium avium subsp. paratuberculosis
ucgccguacagcugguccggccg

SEQ ID NO: 2968122 - RNA, 16 nt, Mycobacterium avium subsp. paratuberculosis
ucgccguacgcgccgg

SEQ ID NO: 2968123 - RNA, 21 nt, Mycobacterium avium subsp. paratuberculosis
ucgccguacgcgccggccagc

SEQ ID NO: 2968124 - RNA, 17 nt, Mycobacterium avium subsp. paratuberculosis
ucgccguacuugacgug

SEQ ID NO: 2968125 - RNA, 18 nt, Mycobacterium avium subsp. paratuberculosis
ucgccguagaauccgccg

SEQ ID NO: 2968126 - RNA, 20 nt, Mycobacterium avium subsp. paratuberculosis
ucgccgucacaccgcggcca

SEQ ID NO: 2968127 - RNA, 22 nt, Mycobacterium avium subsp. paratuberculosis
ucgccgucacaccgcggccagc

SEQ ID NO: 2968128 - RNA, 15 nt, Mycobacterium avium subsp. paratuberculosis
ucgccgucacugcac

SEQ ID NO: 2968129 - RNA, 20 nt, Mycobacterium avium subsp. paratuberculosis
ucgccgucacugcacgcacg

SEQ ID NO: 2968130 - RNA, 17 nt, Mycobacterium avium subsp. paratuberculosis
ucgccgucauggugucc

SEQ ID NO: 2968131 - RNA, 14 nt, Mycobacterium avium subsp. paratuberculosis
ucgccguccacggg

SEQ ID NO: 2968132 - RNA, 16 nt, Mycobacterium avium subsp. paratuberculosis
ucgccguccacggguc

SEQ ID NO: 2968133 - RNA, 17 nt, Mycobacterium avium subsp. paratuberculosis
ucgccguccccaccgau

SEQ ID NO: 2968134 - RNA, 20 nt, Mycobacterium avium subsp. paratuberculosis
ucgccguccccaccgaucag

SEQ ID NO: 2968135 - RNA, 16 nt, Mycobacterium avium subsp. paratuberculosis
ucgccguccggggccg

SEQ ID NO: 2968136 - RNA, 21 nt, Mycobacterium avium subsp. paratuberculosis
ucgccguccggggccggugcg

SEQ ID NO: 2968137 - RNA, 22 nt, Mycobacterium avium subsp. paratuberculosis
ucgccguccucgcgucgcgcgg

SEQ ID NO: 2968138 - RNA, 15 nt, Mycobacterium avium subsp. paratuberculosis
ucgccgucgccaccg

SEQ ID NO: 2968139 - RNA, 16 nt, Mycobacterium avium subsp. paratuberculosis
ucgccgucgccaccga

SEQ ID NO: 2968140 - RNA, 17 nt, Mycobacterium avium subsp. paratuberculosis
ucgccgucgccaccgag

SEQ ID NO: 2968141 - RNA, 18 nt, Mycobacterium avium subsp. paratuberculosis
ucgccgucgccgcacgcc

SEQ ID NO: 2968142 - RNA, 12 nt, Mycobacterium avium subsp. paratuberculosis
ucgccgucgcga

SEQ ID NO: 2968143 - RNA, 13 nt, Mycobacterium avium subsp. paratuberculosis
ucgccgucgcgau

SEQ ID NO: 2968144 - RNA, 12 nt, Mycobacterium avium subsp. paratuberculosis
ucgccgucgggg

SEQ ID NO: 2968145 - RNA, 21 nt, Mycobacterium avium subsp. paratuberculosis
ucgccgucggggucgcgccgg

SEQ ID NO: 2968146 - RNA, 19 nt, Mycobacterium avium subsp. paratuberculosis
ucgccgucguauucgacgg

SEQ ID NO: 2968147 - RNA, 23 nt, Mycobacterium avium subsp. paratuberculosis
ucgccgucguauucgacggcgac

SEQ ID NO: 2968148 - RNA, 21 nt, Mycobacterium avium subsp. paratuberculosis
ucgccgucgucagccgggcca

SEQ ID NO: 2968149 - RNA, 20 nt, Mycobacterium avium subsp. paratuberculosis
ucgccgucguugaucaggug

SEQ ID NO: 2968150 - RNA, 21 nt, Mycobacterium avium subsp. paratuberculosis
ucgccgugagauccagcagcc

SEQ ID NO: 2968151 - RNA, 18 nt, Mycobacterium avium subsp. paratuberculosis
ucgccgugcagcaccucg

SEQ ID NO: 2968152 - RNA, 16 nt, Mycobacterium avium subsp. paratuberculosis
ucgccgugccggaccg

SEQ ID NO: 2968153 - RNA, 21 nt, Mycobacterium avium subsp. paratuberculosis
ucgccgugccggaccgcgcgg

SEQ ID NO: 2968154 - RNA, 13 nt, Mycobacterium avium subsp. paratuberculosis
ucgccgugcggcg

SEQ ID NO: 2968155 - RNA, 14 nt, Mycobacterium avium subsp. paratuberculosis
ucgccgugcggcgu

SEQ ID NO: 2968156 - RNA, 19 nt, Mycobacterium avium subsp. paratuberculosis
ucgccguggaauucgaagu

SEQ ID NO: 2968157 - RNA, 20 nt, Mycobacterium avium subsp. paratuberculosis
ucgccguggcggcccgacca

SEQ ID NO: 2968158 - RNA, 16 nt, Mycobacterium avium subsp. paratuberculosis
ucgccguugccggccc

SEQ ID NO: 2968159 - RNA, 17 nt, Mycobacterium avium subsp. paratuberculosis
ucgccguugccggcccg

SEQ ID NO: 2968160 - RNA, 18 nt, Mycobacterium avium subsp. paratuberculosis
ucgccguugccggcccgc

SEQ ID NO: 2968161 - RNA, 15 nt, Mycobacterium avium subsp. paratuberculosis
ucgccguuggucugc

SEQ ID NO: 2968162 - RNA, 19 nt, Mycobacterium avium subsp. paratuberculosis
ucgccguuuugccgccgag

SEQ ID NO: 2968163 - RNA, 21 nt, Mycobacterium avium subsp. paratuberculosis
ucgccuccgagauggacagca

SEQ ID NO: 2968164 - RNA, 18 nt, Mycobacterium avium subsp. paratuberculosis
ucgccuccugcuggcgcu

SEQ ID NO: 2968165 - RNA, 14 nt, Mycobacterium avium subsp. paratuberculosis
ucgccucgaccagc

SEQ ID NO: 2968166 - RNA, 18 nt, Mycobacterium avium subsp. paratuberculosis
ucgccucggaggccaccg

SEQ ID NO: 2968167 - RNA, 19 nt, Mycobacterium avium subsp. paratuberculosis
ucgccucggaggccaccgc

SEQ ID NO: 2968168 - RNA, 23 nt, Mycobacterium avium subsp. paratuberculosis
ucgccucggaggccaccgcgccg

SEQ ID NO: 2968169 - RNA, 16 nt, Mycobacterium avium subsp. paratuberculosis
ucgccucggccaccag

SEQ ID NO: 2968170 - RNA, 13 nt, Mycobacterium avium subsp. paratuberculosis
ucgccucggccgc

SEQ ID NO: 2968171 - RNA, 19 nt, Mycobacterium avium subsp. paratuberculosis
ucgccucggcggccgcccg

SEQ ID NO: 2968172 - RNA, 22 nt, Mycobacterium avium subsp. paratuberculosis
ucgccucggcggccgcccgggc

SEQ ID NO: 2968173 - RNA, 12 nt, Mycobacterium avium subsp. paratuberculosis
ucgccucggcgu

SEQ ID NO: 2968174 - RNA, 23 nt, Mycobacterium avium subsp. paratuberculosis
ucgccucggucgcgugaccggcg

SEQ ID NO: 2968175 - RNA, 13 nt, Mycobacterium avium subsp. paratuberculosis
ucgccucgucccu

SEQ ID NO: 2968176 - RNA, 14 nt, Mycobacterium avium subsp. paratuberculosis
ucgccucguucgag

SEQ ID NO: 2968177 - RNA, 20 nt, Mycobacterium avium subsp. paratuberculosis
ucgccugacuaagucaccag

SEQ ID NO: 2968178 - RNA, 18 nt, Mycobacterium avium subsp. paratuberculosis
ucgccugagcaaccgguu

SEQ ID NO: 2968179 - RNA, 18 nt, Mycobacterium avium subsp. paratuberculosis
ucgccugauacgacgucc

SEQ ID NO: 2968180 - RNA, 20 nt, Mycobacterium avium subsp. paratuberculosis
ucgccugauacgacguccgg

SEQ ID NO: 2968181 - RNA, 21 nt, Mycobacterium avium subsp. paratuberculosis
ucgccugauacgacguccggg

SEQ ID NO: 2968182 - RNA, 24 nt, Mycobacterium avium subsp. paratuberculosis
ucgccugcagccgccgcgccaccg

SEQ ID NO: 2968183 - RNA, 19 nt, Mycobacterium avium subsp. paratuberculosis
ucgccugcuucuggaugcg

SEQ ID NO: 2968184 - RNA, 23 nt, Mycobacterium avium subsp. paratuberculosis
ucgccugcuucuggaugcggucg

SEQ ID NO: 2968185 - RNA, 16 nt, Mycobacterium avium subsp. paratuberculosis
ucgccuguccgaccag

SEQ ID NO: 2968186 - RNA, 16 nt, Mycobacterium avium subsp. paratuberculosis
ucgcgcagccgggcgg

SEQ ID NO: 2968187 - RNA, 17 nt, Mycobacterium avium subsp. paratuberculosis
ucgcgcagccgggcggc

SEQ ID NO: 2968188 - RNA, 19 nt, Mycobacterium avium subsp. paratuberculosis
ucgcgcagcgaagcgaggc

SEQ ID NO: 2968189 - RNA, 22 nt, Mycobacterium avium subsp. paratuberculosis
ucgcgcagcgaagcgaggcgcc

SEQ ID NO: 2968190 - RNA, 15 nt, Mycobacterium avium subsp. paratuberculosis
ucgcgcagcgcgucg

SEQ ID NO: 2968191 - RNA, 17 nt, Mycobacterium avium subsp. paratuberculosis
ucgcgcagcgcgucggg

SEQ ID NO: 2968192 - RNA, 12 nt, Mycobacterium avium subsp. paratuberculosis
ucgcgcagcguc

SEQ ID NO: 2968193 - RNA, 19 nt, Mycobacterium avium subsp. paratuberculosis
ucgcgcagcgucaucgcgu

SEQ ID NO: 2968194 - RNA, 19 nt, Mycobacterium avium subsp. paratuberculosis
ucgcgcagcugcgccgcgu

SEQ ID NO: 2968195 - RNA, 21 nt, Mycobacterium avium subsp. paratuberculosis
ucgcgcaggaacuccagcagc

SEQ ID NO: 2968196 - RNA, 23 nt, Mycobacterium avium subsp. paratuberculosis
ucgcgcaggaugcccagcaccac

SEQ ID NO: 2968197 - RNA, 20 nt, Mycobacterium avium subsp. paratuberculosis
ucgcgcagggccagcgccuc

SEQ ID NO: 2968198 - RNA, 17 nt, Mycobacterium avium subsp. paratuberculosis
ucgcgcagggucagcgc

SEQ ID NO: 2968199 - RNA, 21 nt, Mycobacterium avium subsp. paratuberculosis
ucgcgcagggucagcgcuucc

SEQ ID NO: 2968200 - RNA, 17 nt, Mycobacterium avium subsp. paratuberculosis
ucgcgcaggucgggccg

SEQ ID NO: 2968201 - RNA, 19 nt, Mycobacterium avium subsp. paratuberculosis
ucgcgcaggucgggccggc

SEQ ID NO: 2968202 - RNA, 22 nt, Mycobacterium avium subsp. paratuberculosis
ucgcgcaggucgggccggccga

SEQ ID NO: 2968203 - RNA, 19 nt, Mycobacterium avium subsp. paratuberculosis
ucgcgcaggugaugcggcc

SEQ ID NO: 2968204 - RNA, 23 nt, Mycobacterium avium subsp. paratuberculosis
ucgcgcaggugaugcggcccgac

SEQ ID NO: 2968205 - RNA, 22 nt, Mycobacterium avium subsp. paratuberculosis
ucgcgcaucagcaccuccggca

SEQ ID NO: 2968206 - RNA, 17 nt, Mycobacterium avium subsp. paratuberculosis
ucgcgcaucgccucggc

SEQ ID NO: 2968207 - RNA, 19 nt, Mycobacterium avium subsp. paratuberculosis
ucgcgcaucgccucggcgg

SEQ ID NO: 2968208 - RNA, 21 nt, Mycobacterium avium subsp. paratuberculosis
ucgcgcaucgccucggcggcc

SEQ ID NO: 2968209 - RNA, 22 nt, Mycobacterium avium subsp. paratuberculosis
ucgcgcaucgccucggcggccg

SEQ ID NO: 2968210 - RNA, 18 nt, Mycobacterium avium subsp. paratuberculosis
ucgcgccagacguccagc

SEQ ID NO: 2968211 - RNA, 23 nt, Mycobacterium avium subsp. paratuberculosis
ucgcgccagacguccagcgccgc

SEQ ID NO: 2968212 - RNA, 14 nt, Mycobacterium avium subsp. paratuberculosis
ucgcgccagcgguc

SEQ ID NO: 2968213 - RNA, 20 nt, Mycobacterium avium subsp. paratuberculosis
ucgcgcccaggaacgcgccg

SEQ ID NO: 2968214 - RNA, 21 nt, Mycobacterium avium subsp. paratuberculosis
ucgcgcccaggaacgcgccgg

SEQ ID NO: 2968215 - RNA, 22 nt, Mycobacterium avium subsp. paratuberculosis
ucgcgcccaggaacgcgccggc

SEQ ID NO: 2968216 - RNA, 15 nt, Mycobacterium avium subsp. paratuberculosis
ucgcgcccggcgccg

SEQ ID NO: 2968217 - RNA, 15 nt, Mycobacterium avium subsp. paratuberculosis
ucgcgcccggcgucg

SEQ ID NO: 2968218 - RNA, 13 nt, Mycobacterium avium subsp. paratuberculosis
ucgcgccgacccg

SEQ ID NO: 2968219 - RNA, 15 nt, Mycobacterium avium subsp. paratuberculosis
ucgcgccgacccgcc

SEQ ID NO: 2968220 - RNA, 23 nt, Mycobacterium avium subsp. paratuberculosis
ucgcgccgaccuggucgccgaac

SEQ ID NO: 2968221 - RNA, 12 nt, Mycobacterium avium subsp. paratuberculosis
ucgcgccgagac

SEQ ID NO: 2968222 - RNA, 14 nt, Mycobacterium avium subsp. paratuberculosis
ucgcgccgagacac

SEQ ID NO: 2968223 - RNA, 23 nt, Mycobacterium avium subsp. paratuberculosis
ucgcgccgagguggccgccagca

SEQ ID NO: 2968224 - RNA, 24 nt, Mycobacterium avium subsp. paratuberculosis
ucgcgccgagguggccgccagcac

SEQ ID NO: 2968225 - RNA, 16 nt, Mycobacterium avium subsp. paratuberculosis
ucgcgccgccacccca

SEQ ID NO: 2968226 - RNA, 17 nt, Mycobacterium avium subsp. paratuberculosis
ucgcgccgccacgcggc

SEQ ID NO: 2968227 - RNA, 12 nt, Mycobacterium avium subsp. paratuberculosis
ucgcgccgccag

SEQ ID NO: 2968228 - RNA, 14 nt, Mycobacterium avium subsp. paratuberculosis
ucgcgccgccagca

SEQ ID NO: 2968229 - RNA, 12 nt, Mycobacterium avium subsp. paratuberculosis
ucgcgccgccgc

SEQ ID NO: 2968230 - RNA, 12 nt, Mycobacterium avium subsp. paratuberculosis
ucgcgccgcgau

SEQ ID NO: 2968231 - RNA, 15 nt, Mycobacterium avium subsp. paratuberculosis
ucgcgccgcggcgcu

SEQ ID NO: 2968232 - RNA, 12 nt, Mycobacterium avium subsp. paratuberculosis
ucgcgccgcucg

SEQ ID NO: 2968233 - RNA, 17 nt, Mycobacterium avium subsp. paratuberculosis
ucgcgccgcucggccag

SEQ ID NO: 2968234 - RNA, 14 nt, Mycobacterium avium subsp. paratuberculosis
ucgcgccggagccg

SEQ ID NO: 2968235 - RNA, 14 nt, Mycobacterium avium subsp. paratuberculosis
ucgcgccggccgcc

SEQ ID NO: 2968236 - RNA, 13 nt, Mycobacterium avium subsp. paratuberculosis
ucgcgccgggcgg

SEQ ID NO: 2968237 - RNA, 21 nt, Mycobacterium avium subsp. paratuberculosis
ucgcgccgguaggcggccagc

SEQ ID NO: 2968238 - RNA, 22 nt, Mycobacterium avium subsp. paratuberculosis
ucgcgccgguaggcggccagcg

SEQ ID NO: 2968239 - RNA, 23 nt, Mycobacterium avium subsp. paratuberculosis
ucgcgccgguaggcggccagcgc

SEQ ID NO: 2968240 - RNA, 16 nt, Mycobacterium avium subsp. paratuberculosis
ucgcgccugcaccggc

SEQ ID NO: 2968241 - RNA, 19 nt, Mycobacterium avium subsp. paratuberculosis
ucgcgccugcaccggcgac

SEQ ID NO: 2968242 - RNA, 24 nt, Mycobacterium avium subsp. paratuberculosis
ucgcgccugcaccggcgacggcgg

SEQ ID NO: 2968243 - RNA, 18 nt, Mycobacterium avium subsp. paratuberculosis
ucgcgcgaaacccccggg

SEQ ID NO: 2968244 - RNA, 20 nt, Mycobacterium avium subsp. paratuberculosis
ucgcgcgaaacccccgggau

SEQ ID NO: 2968245 - RNA, 13 nt, Mycobacterium avium subsp. paratuberculosis
ucgcgcgcacuuc

SEQ ID NO: 2968246 - RNA, 20 nt, Mycobacterium avium subsp. paratuberculosis
ucgcgcgccggcgcagcggc

SEQ ID NO: 2968247 - RNA, 21 nt, Mycobacterium avium subsp. paratuberculosis
ucgcgcgccggcgcagcggcc

SEQ ID NO: 2968248 - RNA, 12 nt, Mycobacterium avium subsp. paratuberculosis
ucgcgcgcggcg

SEQ ID NO: 2968249 - RNA, 13 nt, Mycobacterium avium subsp. paratuberculosis
ucgcgcgcggcgu

SEQ ID NO: 2968250 - RNA, 16 nt, Mycobacterium avium subsp. paratuberculosis
ucgcgcgcggcguggu

SEQ ID NO: 2968251 - RNA, 13 nt, Mycobacterium avium subsp. paratuberculosis
ucgcgcggcacca

SEQ ID NO: 2968252 - RNA, 22 nt, Mycobacterium avium subsp. paratuberculosis
ucgcgcggcaucgucaccucga

SEQ ID NO: 2968253 - RNA, 12 nt, Mycobacterium avium subsp. paratuberculosis
ucgcgcggcgcc

SEQ ID NO: 2968254 - RNA, 14 nt, Mycobacterium avium subsp. paratuberculosis
ucgcgcggcgccca

SEQ ID NO: 2968255 - RNA, 15 nt, Mycobacterium avium subsp. paratuberculosis
ucgcgcggggcggcc

SEQ ID NO: 2968256 - RNA, 16 nt, Mycobacterium avium subsp. paratuberculosis
ucgcgcggggcggccg

SEQ ID NO: 2968257 - RNA, 19 nt, Mycobacterium avium subsp. paratuberculosis
ucgcgcggggcggccgccg

SEQ ID NO: 2968258 - RNA, 16 nt, Mycobacterium avium subsp. paratuberculosis
ucgcgcggggucgggc

SEQ ID NO: 2968259 - RNA, 18 nt, Mycobacterium avium subsp. paratuberculosis
ucgcgcggggucgggccg

SEQ ID NO: 2968260 - RNA, 20 nt, Mycobacterium avium subsp. paratuberculosis
ucgcgcggggugacgcccgu

SEQ ID NO: 2968261 - RNA, 18 nt, Mycobacterium avium subsp. paratuberculosis
ucgcgcgguuccggcgug

SEQ ID NO: 2968262 - RNA, 14 nt, Mycobacterium avium subsp. paratuberculosis
ucgcgcgucacgcu

SEQ ID NO: 2968263 - RNA, 15 nt, Mycobacterium avium subsp. paratuberculosis
ucgcgcgucacgcug

SEQ ID NO: 2968264 - RNA, 14 nt, Mycobacterium avium subsp. paratuberculosis
ucgcgcuaggacgc

SEQ ID NO: 2968265 - RNA, 19 nt, Mycobacterium avium subsp. paratuberculosis
ucgcgcuaggacgcgggcc

SEQ ID NO: 2968266 - RNA, 19 nt, Mycobacterium avium subsp. paratuberculosis
ucgcgcucagugcacgcuc

SEQ ID NO: 2968267 - RNA, 20 nt, Mycobacterium avium subsp. paratuberculosis
ucgcgcucagugcacgcucg

SEQ ID NO: 2968268 - RNA, 16 nt, Mycobacterium avium subsp. paratuberculosis
ucgcgcucauaucccg

SEQ ID NO: 2968269 - RNA, 15 nt, Mycobacterium avium subsp. paratuberculosis
ucgcgcucccggcgc

SEQ ID NO: 2968270 - RNA, 17 nt, Mycobacterium avium subsp. paratuberculosis
ucgcgcucccggcgccg

SEQ ID NO: 2968271 - RNA, 22 nt, Mycobacterium avium subsp. paratuberculosis
ucgcggcggcgcuggucggcgg

SEQ ID NO: 2968272 - RNA, 16 nt, Mycobacterium avium subsp. paratuberculosis
ucgcggcggcgucggc

SEQ ID NO: 2968273 - RNA, 20 nt, Mycobacterium avium subsp. paratuberculosis
ucgcggcggucacgcccggg

SEQ ID NO: 2968274 - RNA, 15 nt, Mycobacterium avium subsp. paratuberculosis
ucgcggcguaggcgg

SEQ ID NO: 2968275 - RNA, 18 nt, Mycobacterium avium subsp. paratuberculosis
ucgcggcguaggcggcca

SEQ ID NO: 2968276 - RNA, 18 nt, Mycobacterium avium subsp. paratuberculosis
ucgcggcguaggugggca

SEQ ID NO: 2968277 - RNA, 16 nt, Mycobacterium avium subsp. paratuberculosis
ucgcggcgucgcggua

SEQ ID NO: 2968278 - RNA, 17 nt, Mycobacterium avium subsp. paratuberculosis
ucgcggcguugcccgcu

SEQ ID NO: 2968279 - RNA, 14 nt, Mycobacterium avium subsp. paratuberculosis
ucgcggcugcgcac

SEQ ID NO: 2968280 - RNA, 17 nt, Mycobacterium avium subsp. paratuberculosis
ucgcggcugcgcacgua

SEQ ID NO: 2968281 - RNA, 15 nt, Mycobacterium avium subsp. paratuberculosis
ucgcggcuggccgcg

SEQ ID NO: 2968282 - RNA, 17 nt, Mycobacterium avium subsp. paratuberculosis
ucgcggcuggccgcggc

SEQ ID NO: 2968283 - RNA, 18 nt, Mycobacterium avium subsp. paratuberculosis
ucgcggcuggccgcggcg

SEQ ID NO: 2968284 - RNA, 23 nt, Mycobacterium avium subsp. paratuberculosis
ucgcggcuggccgcggcgaucgg

SEQ ID NO: 2968285 - RNA, 18 nt, Mycobacterium avium subsp. paratuberculosis
ucgcggcuggugccgccg

SEQ ID NO: 2968286 - RNA, 23 nt, Mycobacterium avium subsp. paratuberculosis
ucgcggcuggugccgccggcgau

SEQ ID NO: 2968287 - RNA, 15 nt, Mycobacterium avium subsp. paratuberculosis
ucgcgggacaacacc

SEQ ID NO: 2968288 - RNA, 20 nt, Mycobacterium avium subsp. paratuberculosis
ucgcgggacaacaccaccuc

SEQ ID NO: 2968289 - RNA, 23 nt, Mycobacterium avium subsp. paratuberculosis
ucgcgggacaacaccaccucuug

SEQ ID NO: 2968290 - RNA, 17 nt, Mycobacterium avium subsp. paratuberculosis
ucgcgggacaacacgau

SEQ ID NO: 2968291 - RNA, 22 nt, Mycobacterium avium subsp. paratuberculosis
ucgcgggacggcggcgaguucg

SEQ ID NO: 2968292 - RNA, 20 nt, Mycobacterium avium subsp. paratuberculosis
ucgcgggaggacagcgcggu

SEQ ID NO: 2968293 - RNA, 17 nt, Mycobacterium avium subsp. paratuberculosis
ucgcgggaguggccggc

SEQ ID NO: 2968294 - RNA, 20 nt, Mycobacterium avium subsp. paratuberculosis
ucgcgggaguggccggcguc

SEQ ID NO: 2968295 - RNA, 17 nt, Mycobacterium avium subsp. paratuberculosis
ucgcgggaucggccggc

SEQ ID NO: 2968296 - RNA, 15 nt, Mycobacterium avium subsp. paratuberculosis
ucgcgggcagccggc

SEQ ID NO: 2968297 - RNA, 16 nt, Mycobacterium avium subsp. paratuberculosis
ucgcgggcagccggcg

SEQ ID NO: 2968298 - RNA, 16 nt, Mycobacterium avium subsp. paratuberculosis
ucgcgggccacagcgg

SEQ ID NO: 2968299 - RNA, 20 nt, Mycobacterium avium subsp. paratuberculosis
ucgcgggccacagcggcgac

SEQ ID NO: 2968300 - RNA, 18 nt, Mycobacterium avium subsp. paratuberculosis
ucgcgggccaccgcggcg

SEQ ID NO: 2968301 - RNA, 17 nt, Mycobacterium avium subsp. paratuberculosis
ucgcgggccaccggcgc

SEQ ID NO: 2968302 - RNA, 13 nt, Mycobacterium avium subsp. paratuberculosis
ucgcgggcccgcg

SEQ ID NO: 2968303 - RNA, 16 nt, Mycobacterium avium subsp. paratuberculosis
ucgcgggcccgcgccg

SEQ ID NO: 2968304 - RNA, 19 nt, Mycobacterium avium subsp. paratuberculosis
ucgcgggcccgcgccgcgu

SEQ ID NO: 2968305 - RNA, 20 nt, Mycobacterium avium subsp. paratuberculosis
ucgcgggcccgcgccgcguc

SEQ ID NO: 2968306 - RNA, 18 nt, Mycobacterium avium subsp. paratuberculosis
ucgcgggcccgcgcggcg

SEQ ID NO: 2968307 - RNA, 19 nt, Mycobacterium avium subsp. paratuberculosis
ucgcgggcccgcgcggcgg

SEQ ID NO: 2968308 - RNA, 16 nt, Mycobacterium avium subsp. paratuberculosis
ucgcgggcccgggcca

SEQ ID NO: 2968309 - RNA, 21 nt, Mycobacterium avium subsp. paratuberculosis
ucgcgggcccgggccacccgc

SEQ ID NO: 2968310 - RNA, 18 nt, Mycobacterium avium subsp. paratuberculosis
ucgcgggccugcucgucg

SEQ ID NO: 2968311 - RNA, 19 nt, Mycobacterium avium subsp. paratuberculosis
ucgcgggccugcucgucgg

SEQ ID NO: 2968312 - RNA, 13 nt, Mycobacterium avium subsp. paratuberculosis
ucgcgggcgaccu

SEQ ID NO: 2968313 - RNA, 17 nt, Mycobacterium avium subsp. paratuberculosis
ucgcgggcgagcagcgc

SEQ ID NO: 2968314 - RNA, 17 nt, Mycobacterium avium subsp. paratuberculosis
ucgcgggcgaugcggcc

SEQ ID NO: 2968315 - RNA, 14 nt, Mycobacterium avium subsp. paratuberculosis
ucgcgggcgccgag

SEQ ID NO: 2968316 - RNA, 17 nt, Mycobacterium avium subsp. paratuberculosis
ucgcgggcgccgagucc

SEQ ID NO: 2968317 - RNA, 15 nt, Mycobacterium avium subsp. paratuberculosis
ucgcgggcggcgcag

SEQ ID NO: 2968318 - RNA, 20 nt, Mycobacterium avium subsp. paratuberculosis
ucgcgggcggggcgccgaca

SEQ ID NO: 2968319 - RNA, 21 nt, Mycobacterium avium subsp. paratuberculosis
ucgcgggcggggcgccgacag

SEQ ID NO: 2968320 - RNA, 14 nt, Mycobacterium avium subsp. paratuberculosis
ucgcgggcgucggg

SEQ ID NO: 2968321 - RNA, 23 nt, Mycobacterium avium subsp. paratuberculosis
ucgcgggcgucgggcagcagcuc

SEQ ID NO: 2968322 - RNA, 15 nt, Mycobacterium avium subsp. paratuberculosis
ucgcgggcugcggcg

SEQ ID NO: 2968323 - RNA, 19 nt, Mycobacterium avium subsp. paratuberculosis
ucgcgggggccgcgaugag

SEQ ID NO: 2968324 - RNA, 15 nt, Mycobacterium avium subsp. paratuberculosis
ucgcggggugucgug

SEQ ID NO: 2968325 - RNA, 15 nt, Mycobacterium avium subsp. paratuberculosis
ucgcgggucagcguc

SEQ ID NO: 2968326 - RNA, 16 nt, Mycobacterium avium subsp. paratuberculosis
ucgcgggucagcgucg

SEQ ID NO: 2968327 - RNA, 19 nt, Mycobacterium avium subsp. paratuberculosis
ucgcgggugaccggcgccg

SEQ ID NO: 2968328 - RNA, 16 nt, Mycobacterium avium subsp. paratuberculosis
ucgcgggugcgcucga

SEQ ID NO: 2968329 - RNA, 14 nt, Mycobacterium avium subsp. paratuberculosis
ucgcgggugcgcug

SEQ ID NO: 2968330 - RNA, 17 nt, Mycobacterium avium subsp. paratuberculosis
ucgcgggugcgcugcag

SEQ ID NO: 2968331 - RNA, 15 nt, Mycobacterium avium subsp. paratuberculosis
ucgcgggugcggcgc

SEQ ID NO: 2968332 - RNA, 21 nt, Mycobacterium avium subsp. paratuberculosis
ucgcgguagaucgacagggcg

SEQ ID NO: 2968333 - RNA, 12 nt, Mycobacterium avium subsp. paratuberculosis
ucgcgguccacc

SEQ ID NO: 2968334 - RNA, 17 nt, Mycobacterium avium subsp. paratuberculosis
ucgcgguccacgccggc

SEQ ID NO: 2968335 - RNA, 20 nt, Mycobacterium avium subsp. paratuberculosis
ucgcgguccacgccggcgau

SEQ ID NO: 2968336 - RNA, 12 nt, Mycobacterium avium subsp. paratuberculosis
ucgcgguccagg

SEQ ID NO: 2968337 - RNA, 19 nt, Mycobacterium avium subsp. paratuberculosis
ucgcgguccaucuccagcu

SEQ ID NO: 2968338 - RNA, 14 nt, Mycobacterium avium subsp. paratuberculosis
ucgcggucgacgga

SEQ ID NO: 2968339 - RNA, 18 nt, Mycobacterium avium subsp. paratuberculosis
ucgcggucggcgcccggc

SEQ ID NO: 2968340 - RNA, 21 nt, Mycobacterium avium subsp. paratuberculosis
ucgcggucggcgcccggccca

SEQ ID NO: 2968341 - RNA, 19 nt, Mycobacterium avium subsp. paratuberculosis
ucgcggugaaguugccgcc

SEQ ID NO: 2968342 - RNA, 20 nt, Mycobacterium avium subsp. paratuberculosis
ucgcggugaaguugccgccg

SEQ ID NO: 2968343 - RNA, 17 nt, Mycobacterium avium subsp. paratuberculosis
ucgcggugaccgccgcc

SEQ ID NO: 2968344 - RNA, 17 nt, Mycobacterium avium subsp. paratuberculosis
ucgcggugacgcgccgg

SEQ ID NO: 2968345 - RNA, 23 nt, Mycobacterium avium subsp. paratuberculosis
ucgcggugcaacgccgccgacag

SEQ ID NO: 2968346 - RNA, 15 nt, Mycobacterium avium subsp. paratuberculosis
ucgcggugcccagcc

SEQ ID NO: 2968347 - RNA, 16 nt, Mycobacterium avium subsp. paratuberculosis
ucgcggugcccagccg

SEQ ID NO: 2968348 - RNA, 17 nt, Mycobacterium avium subsp. paratuberculosis
ucgcggugcccagccgc

SEQ ID NO: 2968349 - RNA, 18 nt, Mycobacterium avium subsp. paratuberculosis
ucgcggugcccagccgca

SEQ ID NO: 2968350 - RNA, 18 nt, Mycobacterium avium subsp. paratuberculosis
ucgcggugcgcgcgcgcu

SEQ ID NO: 2968351 - RNA, 20 nt, Mycobacterium avium subsp. paratuberculosis
ucgcggugcgcgcgcgcucg

SEQ ID NO: 2968352 - RNA, 22 nt, Mycobacterium avium subsp. paratuberculosis
ucgcggugcgcgcgcgcucggc

SEQ ID NO: 2968353 - RNA, 20 nt, Mycobacterium avium subsp. paratuberculosis
ucgcgguggcgcccgcggug

SEQ ID NO: 2968354 - RNA, 18 nt, Mycobacterium avium subsp. paratuberculosis
ucgcggugggcgcgggcc

SEQ ID NO: 2968355 - RNA, 13 nt, Mycobacterium avium subsp. paratuberculosis
ucgcugcgccggc

SEQ ID NO: 2968356 - RNA, 14 nt, Mycobacterium avium subsp. paratuberculosis
ucgcugcgccggcg

SEQ ID NO: 2968357 - RNA, 23 nt, Mycobacterium avium subsp. paratuberculosis
ucgcugcgcucgccgucggccag

SEQ ID NO: 2968358 - RNA, 19 nt, Mycobacterium avium subsp. paratuberculosis
ucgcugcucaugagcccuc

SEQ ID NO: 2968359 - RNA, 22 nt, Mycobacterium avium subsp. paratuberculosis
ucgcugcucaugagcccuccag

SEQ ID NO: 2968360 - RNA, 15 nt, Mycobacterium avium subsp. paratuberculosis
ucgcugcucugcgcg

SEQ ID NO: 2968361 - RNA, 19 nt, Mycobacterium avium subsp. paratuberculosis
ucgcuggaaaccucuugcg

SEQ ID NO: 2968362 - RNA, 14 nt, Mycobacterium avium subsp. paratuberculosis
ucgcuggacagcca

SEQ ID NO: 2968363 - RNA, 18 nt, Mycobacterium avium subsp. paratuberculosis
ucgcuggacagccacagc

SEQ ID NO: 2968364 - RNA, 16 nt, Mycobacterium avium subsp. paratuberculosis
ucgcuggcgaucaccu

SEQ ID NO: 2968365 - RNA, 13 nt, Mycobacterium avium subsp. paratuberculosis
ucgcuggcgcgcu

SEQ ID NO: 2968366 - RNA, 12 nt, Mycobacterium avium subsp. paratuberculosis
ucgcuggcggcg

SEQ ID NO: 2968367 - RNA, 16 nt, Mycobacterium avium subsp. paratuberculosis
ucgcuggcggcgcggu

SEQ ID NO: 2968368 - RNA, 12 nt, Mycobacterium avium subsp. paratuberculosis
ucgcuggucgcg

SEQ ID NO: 2968369 - RNA, 13 nt, Mycobacterium avium subsp. paratuberculosis
ucgcuggucgcga

SEQ ID NO: 2968370 - RNA, 17 nt, Mycobacterium avium subsp. paratuberculosis
ucgcuguagagcaguuc

SEQ ID NO: 2968371 - RNA, 20 nt, Mycobacterium avium subsp. paratuberculosis
ucgcuguaggccagcccggc

SEQ ID NO: 2968372 - RNA, 13 nt, Mycobacterium avium subsp. paratuberculosis
ucgcuguccucga

SEQ ID NO: 2968373 - RNA, 13 nt, Mycobacterium avium subsp. paratuberculosis
ucgcugugcagcg

SEQ ID NO: 2968374 - RNA, 15 nt, Mycobacterium avium subsp. paratuberculosis
ucgcuguuggcgacg

SEQ ID NO: 2968375 - RNA, 23 nt, Mycobacterium avium subsp. paratuberculosis
ucgcuguuggcgacggugcaugc

SEQ ID NO: 2968376 - RNA, 16 nt, Mycobacterium avium subsp. paratuberculosis
ucgcuuacugcgaggc

SEQ ID NO: 2968377 - RNA, 19 nt, Mycobacterium avium subsp. paratuberculosis
ucgcuugccagccgggccg

SEQ ID NO: 2968378 - RNA, 14 nt, Mycobacterium avium subsp. paratuberculosis
ucgcuugcgccgca

SEQ ID NO: 2968379 - RNA, 15 nt, Mycobacterium avium subsp. paratuberculosis
ucgcuugcgccgcag

SEQ ID NO: 2968380 - RNA, 22 nt, Mycobacterium avium subsp. paratuberculosis
ucggaaugaacugccgcggcac

SEQ ID NO: 2968381 - RNA, 18 nt, Mycobacterium avium subsp. paratuberculosis
ucggacaccucggccagc

SEQ ID NO: 2968382 - RNA, 21 nt, Mycobacterium avium subsp. paratuberculosis
ucggacaccucggccagcgcc

SEQ ID NO: 2968383 - RNA, 22 nt, Mycobacterium avium subsp. paratuberculosis
ucggacaccucggccagcgccg

SEQ ID NO: 2968384 - RNA, 14 nt, Mycobacterium avium subsp. paratuberculosis
ucggacacggcgcc

SEQ ID NO: 2968385 - RNA, 19 nt, Mycobacterium avium subsp. paratuberculosis
ucggacacggcgccgugcg

SEQ ID NO: 2968386 - RNA, 20 nt, Mycobacterium avium subsp. paratuberculosis
ucggacagcagcaccggcac

SEQ ID NO: 2968387 - RNA, 13 nt, Mycobacterium avium subsp. paratuberculosis
ucggacagguggc

SEQ ID NO: 2968388 - RNA, 20 nt, Mycobacterium avium subsp. paratuberculosis
ucggacagguggccgaucag

SEQ ID NO: 2968389 - RNA, 12 nt, Mycobacterium avium subsp. paratuberculosis
ucggacccagcc

SEQ ID NO: 2968390 - RNA, 14 nt, Mycobacterium avium subsp. paratuberculosis
ucggacccagcccg

SEQ ID NO: 2968391 - RNA, 16 nt, Mycobacterium avium subsp. paratuberculosis
ucggacccagcccggc

SEQ ID NO: 2968392 - RNA, 17 nt, Mycobacterium avium subsp. paratuberculosis
ucggacccagcccggcg

SEQ ID NO: 2968393 - RNA, 19 nt, Mycobacterium avium subsp. paratuberculosis
ucggacccagcccggcgac

SEQ ID NO: 2968394 - RNA, 23 nt, Mycobacterium avium subsp. paratuberculosis
ucggacgacucguucgacgccgg

SEQ ID NO: 2968395 - RNA, 20 nt, Mycobacterium avium subsp. paratuberculosis
ucggacgagccgucgcggga

SEQ ID NO: 2968396 - RNA, 21 nt, Mycobacterium avium subsp. paratuberculosis
ucggacgagccgucgcgggaa

SEQ ID NO: 2968397 - RNA, 14 nt, Mycobacterium avium subsp. paratuberculosis
ucggacgccagugg

SEQ ID NO: 2968398 - RNA, 22 nt, Mycobacterium avium subsp. paratuberculosis
ucggacgccucccccacccgca

SEQ ID NO: 2968399 - RNA, 13 nt, Mycobacterium avium subsp. paratuberculosis
ucggacgcggccg

SEQ ID NO: 2968400 - RNA, 16 nt, Mycobacterium avium subsp. paratuberculosis
ucggacgcggccgagc

SEQ ID NO: 2968401 - RNA, 14 nt, Mycobacterium avium subsp. paratuberculosis
ucggacgcggggaa

SEQ ID NO: 2968402 - RNA, 18 nt, Mycobacterium avium subsp. paratuberculosis
ucggacgcggggaaguag

SEQ ID NO: 2968403 - RNA, 13 nt, Mycobacterium avium subsp. paratuberculosis
ucggacggcgacg

SEQ ID NO: 2968404 - RNA, 18 nt, Mycobacterium avium subsp. paratuberculosis
ucggacggcgacggcagc

SEQ ID NO: 2968405 - RNA, 20 nt, Mycobacterium avium subsp. paratuberculosis
ucggacggcgacggcagcgc

SEQ ID NO: 2968406 - RNA, 18 nt, Mycobacterium avium subsp. paratuberculosis
ucggacuccuccugcgac

SEQ ID NO: 2968407 - RNA, 15 nt, Mycobacterium avium subsp. paratuberculosis
ucggacucgucgcug

SEQ ID NO: 2968408 - RNA, 13 nt, Mycobacterium avium subsp. paratuberculosis
ucggagacccgcc

SEQ ID NO: 2968409 - RNA, 19 nt, Mycobacterium avium subsp. paratuberculosis
ucggagacccgcccggaga

SEQ ID NO: 2968410 - RNA, 17 nt, Mycobacterium avium subsp. paratuberculosis
ucggagacguggcggcg

SEQ ID NO: 2968411 - RNA, 19 nt, Mycobacterium avium subsp. paratuberculosis
ucggagacguggcggcggu

SEQ ID NO: 2968412 - RNA, 17 nt, Mycobacterium avium subsp. paratuberculosis
ucggagacguugccgca

SEQ ID NO: 2968413 - RNA, 23 nt, Mycobacterium avium subsp. paratuberculosis
ucggagacguugccgcacaccgc

SEQ ID NO: 2968414 - RNA, 16 nt, Mycobacterium avium subsp. paratuberculosis
ucggagaucaccggca

SEQ ID NO: 2968415 - RNA, 23 nt, Mycobacterium avium subsp. paratuberculosis
ucggagaucaccggcacccccaa

SEQ ID NO: 2968416 - RNA, 20 nt, Mycobacterium avium subsp. paratuberculosis
ucggagaugauggccgcgcc

SEQ ID NO: 2968417 - RNA, 20 nt, Mycobacterium avium subsp. paratuberculosis
ucggagcaaauccggcagcg

SEQ ID NO: 2968418 - RNA, 13 nt, Mycobacterium avium subsp. paratuberculosis
ucggagcccagcg

SEQ ID NO: 2968419 - RNA, 14 nt, Mycobacterium avium subsp. paratuberculosis
ucggagccgucggu

SEQ ID NO: 2968420 - RNA, 16 nt, Mycobacterium avium subsp. paratuberculosis
ucggagcgcuccacca

SEQ ID NO: 2968421 - RNA, 15 nt, Mycobacterium avium subsp. paratuberculosis
ucggagcugcgcgcc

SEQ ID NO: 2968422 - RNA, 20 nt, Mycobacterium avium subsp. paratuberculosis
ucggagcugcgcgccccggc

SEQ ID NO: 2968423 - RNA, 17 nt, Mycobacterium avium subsp. paratuberculosis
ucggaggacaacgcguc

SEQ ID NO: 2968424 - RNA, 14 nt, Mycobacterium avium subsp. paratuberculosis
ucggaggccaccgc

SEQ ID NO: 2968425 - RNA, 18 nt, Mycobacterium avium subsp. paratuberculosis
ucggaggccaccgcgccg

SEQ ID NO: 2968426 - RNA, 20 nt, Mycobacterium avium subsp. paratuberculosis
ucggaggccaccgcgccguc

SEQ ID NO: 2968427 - RNA, 19 nt, Mycobacterium avium subsp. paratuberculosis
ucggaggcuucgcucaucc

SEQ ID NO: 2968428 - RNA, 20 nt, Mycobacterium avium subsp. paratuberculosis
ucggaggugccgcgcggcag

SEQ ID NO: 2968429 - RNA, 19 nt, Mycobacterium avium subsp. paratuberculosis
ucggaguaguuccggcggu

SEQ ID NO: 2968430 - RNA, 17 nt, Mycobacterium avium subsp. paratuberculosis
ucggagucgcuguuggc

SEQ ID NO: 2968431 - RNA, 22 nt, Mycobacterium avium subsp. paratuberculosis
ucggaguugcgcagccgggcgg

SEQ ID NO: 2968432 - RNA, 18 nt, Mycobacterium avium subsp. paratuberculosis
ucggaucgaaggcgugcu

SEQ ID NO: 2968433 - RNA, 17 nt, Mycobacterium avium subsp. paratuberculosis
ucggaugaccaagcccc

SEQ ID NO: 2968434 - RNA, 19 nt, Mycobacterium avium subsp. paratuberculosis
ucggauucggguggcgucg

SEQ ID NO: 2968435 - RNA, 12 nt, Mycobacterium avium subsp. paratuberculosis
ucggauucgucg

SEQ ID NO: 2968436 - RNA, 13 nt, Mycobacterium avium subsp. paratuberculosis
ucggcaacccgac

SEQ ID NO: 2968437 - RNA, 23 nt, Mycobacterium avium subsp. paratuberculosis
ucggcaacccgaccucgucgacg

SEQ ID NO: 2968438 - RNA, 15 nt, Mycobacterium avium subsp. paratuberculosis
ucggcacaccaggua

SEQ ID NO: 2968439 - RNA, 16 nt, Mycobacterium avium subsp. paratuberculosis
ucggcacaccagguag

SEQ ID NO: 2968440 - RNA, 21 nt, Mycobacterium avium subsp. paratuberculosis
ucggccaggaucucgcgggcc

SEQ ID NO: 2968441 - RNA, 17 nt, Mycobacterium avium subsp. paratuberculosis
ucggccaggcgcccagc

SEQ ID NO: 2968442 - RNA, 18 nt, Mycobacterium avium subsp. paratuberculosis
ucggccaggcgcccagca

SEQ ID NO: 2968443 - RNA, 18 nt, Mycobacterium avium subsp. paratuberculosis
ucggccaggcucacguag

SEQ ID NO: 2968444 - RNA, 10 nt, Mycobacterium avium subsp. paratuberculosis
ucggccaggg

SEQ ID NO: 2968445 - RNA, 13 nt, Mycobacterium avium subsp. paratuberculosis
ucggccagggcuc

SEQ ID NO: 2968446 - RNA, 14 nt, Mycobacterium avium subsp. paratuberculosis
ucggccagggugac

SEQ ID NO: 2968447 - RNA, 20 nt, Mycobacterium avium subsp. paratuberculosis
ucggccagguacugaucacc

SEQ ID NO: 2968448 - RNA, 20 nt, Mycobacterium avium subsp. paratuberculosis
ucggccaguucaccgcgcuc

SEQ ID NO: 2968449 - RNA, 20 nt, Mycobacterium avium subsp. paratuberculosis
ucggccaguucgccggugac

SEQ ID NO: 2968450 - RNA, 18 nt, Mycobacterium avium subsp. paratuberculosis
ucggccaucagcaccgaa

SEQ ID NO: 2968451 - RNA, 13 nt, Mycobacterium avium subsp. paratuberculosis
ucggccaucagcc

SEQ ID NO: 2968452 - RNA, 17 nt, Mycobacterium avium subsp. paratuberculosis
ucggccaucagccgccg

SEQ ID NO: 2968453 - RNA, 15 nt, Mycobacterium avium subsp. paratuberculosis
ucggccauccgggcg

SEQ ID NO: 2968454 - RNA, 18 nt, Mycobacterium avium subsp. paratuberculosis
ucggccauccgggcggca

SEQ ID NO: 2968455 - RNA, 16 nt, Mycobacterium avium subsp. paratuberculosis
ucggccaucgacucca

SEQ ID NO: 2968456 - RNA, 15 nt, Mycobacterium avium subsp. paratuberculosis
ucggccaugccgcgc

SEQ ID NO: 2968457 - RNA, 15 nt, Mycobacterium avium subsp. paratuberculosis
ucggcccacggugag

SEQ ID NO: 2968458 - RNA, 21 nt, Mycobacterium avium subsp. paratuberculosis
ucggcccacggugaggacacc

SEQ ID NO: 2968459 - RNA, 22 nt, Mycobacterium avium subsp. paratuberculosis
ucggcccagacgaugucgucgc

SEQ ID NO: 2968460 - RNA, 14 nt, Mycobacterium avium subsp. paratuberculosis
ucggcccaggccaa

SEQ ID NO: 2968461 - RNA, 14 nt, Mycobacterium avium subsp. paratuberculosis
ucggcccccgggcc

SEQ ID NO: 2968462 - RNA, 23 nt, Mycobacterium avium subsp. paratuberculosis
ucggccccgcgcaucggucagca

SEQ ID NO: 2968463 - RNA, 19 nt, Mycobacterium avium subsp. paratuberculosis
ucggccccggccgagccgg

SEQ ID NO: 2968464 - RNA, 21 nt, Mycobacterium avium subsp. paratuberculosis
ucggccccggccgagccggcg

SEQ ID NO: 2968465 - RNA, 24 nt, Mycobacterium avium subsp. paratuberculosis
ucggccccggccgagccggcguac

SEQ ID NO: 2968466 - RNA, 22 nt, Mycobacterium avium subsp. paratuberculosis
ucggcccgacggguucgcgcag

SEQ ID NO: 2968467 - RNA, 19 nt, Mycobacterium avium subsp. paratuberculosis
ucggcccgaucucgcgcgg

SEQ ID NO: 2968468 - RNA, 20 nt, Mycobacterium avium subsp. paratuberculosis
ucggcccgccacccgaggcc

SEQ ID NO: 2968469 - RNA, 14 nt, Mycobacterium avium subsp. paratuberculosis
ucggcccgccgggc

SEQ ID NO: 2968470 - RNA, 16 nt, Mycobacterium avium subsp. paratuberculosis
ucggcccgccgggccg

SEQ ID NO: 2968471 - RNA, 17 nt, Mycobacterium avium subsp. paratuberculosis
ucggcccgccgggcgcc

SEQ ID NO: 2968472 - RNA, 15 nt, Mycobacterium avium subsp. paratuberculosis
ucggcccgcuccccg

SEQ ID NO: 2968473 - RNA, 14 nt, Mycobacterium avium subsp. paratuberculosis
ucggcccgcugcgg

SEQ ID NO: 2968474 - RNA, 13 nt, Mycobacterium avium subsp. paratuberculosis
ucggcccggccaa

SEQ ID NO: 2968475 - RNA, 13 nt, Mycobacterium avium subsp. paratuberculosis
ucggcccuccagc

SEQ ID NO: 2968476 - RNA, 14 nt, Mycobacterium avium subsp. paratuberculosis
ucggccgacucgau

SEQ ID NO: 2968477 - RNA, 17 nt, Mycobacterium avium subsp. paratuberculosis
ucggccgagucgacgug

SEQ ID NO: 2968478 - RNA, 22 nt, Mycobacterium avium subsp. paratuberculosis
ucggccgcacgucccgcccggc

SEQ ID NO: 2968479 - RNA, 23 nt, Mycobacterium avium subsp. paratuberculosis
ucggccgcaucguugguccaggc

SEQ ID NO: 2968480 - RNA, 13 nt, Mycobacterium avium subsp. paratuberculosis
ucggccgccaccg

SEQ ID NO: 2968481 - RNA, 16 nt, Mycobacterium avium subsp. paratuberculosis
ucggccgccaccgcca

SEQ ID NO: 2968482 - RNA, 17 nt, Mycobacterium avium subsp. paratuberculosis
ucggccgccaccgccau

SEQ ID NO: 2968483 - RNA, 18 nt, Mycobacterium avium subsp. paratuberculosis
ucggccgccaccgccauc

SEQ ID NO: 2968484 - RNA, 15 nt, Mycobacterium avium subsp. paratuberculosis
ucggccgccagggcc

SEQ ID NO: 2968485 - RNA, 19 nt, Mycobacterium avium subsp. paratuberculosis
ucggccgccagggccaggu

SEQ ID NO: 2968486 - RNA, 15 nt, Mycobacterium avium subsp. paratuberculosis
ucggccgcccguccg

SEQ ID NO: 2968487 - RNA, 22 nt, Mycobacterium avium subsp. paratuberculosis
ucggccgcccguccgggccggc

SEQ ID NO: 2968488 - RNA, 17 nt, Mycobacterium avium subsp. paratuberculosis
ucggccgccgacaccac

SEQ ID NO: 2968489 - RNA, 18 nt, Mycobacterium avium subsp. paratuberculosis
ucggccgccgacugugcg

SEQ ID NO: 2968490 - RNA, 15 nt, Mycobacterium avium subsp. paratuberculosis
ucggccgccgugcug

SEQ ID NO: 2968491 - RNA, 15 nt, Mycobacterium avium subsp. paratuberculosis
ucggccgcgacgacc

SEQ ID NO: 2968492 - RNA, 23 nt, Mycobacterium avium subsp. paratuberculosis
ucggccgcggauggugacggccg

SEQ ID NO: 2968493 - RNA, 17 nt, Mycobacterium avium subsp. paratuberculosis
ucggccgcggggccggc

SEQ ID NO: 2968494 - RNA, 23 nt, Mycobacterium avium subsp. paratuberculosis
ucggccgcggggccggcgcuggc

SEQ ID NO: 2968495 - RNA, 20 nt, Mycobacterium avium subsp. paratuberculosis
ucggccgcggucucgaccga

SEQ ID NO: 2968496 - RNA, 14 nt, Mycobacterium avium subsp. paratuberculosis
ucggccgcgucggg

SEQ ID NO: 2968497 - RNA, 15 nt, Mycobacterium avium subsp. paratuberculosis
ucggccgcgucgggc

SEQ ID NO: 2968498 - RNA, 16 nt, Mycobacterium avium subsp. paratuberculosis
ucggccgcgugcaccu

SEQ ID NO: 2968499 - RNA, 18 nt, Mycobacterium avium subsp. paratuberculosis
ucggccgcucagcgggcg

SEQ ID NO: 2968500 - RNA, 15 nt, Mycobacterium avium subsp. paratuberculosis
ucggccggauucucg

SEQ ID NO: 2968501 - RNA, 19 nt, Mycobacterium avium subsp. paratuberculosis
ucggccggauucucgcccg

SEQ ID NO: 2968502 - RNA, 12 nt, Mycobacterium avium subsp. paratuberculosis
ucggccggcagc

SEQ ID NO: 2968503 - RNA, 19 nt, Mycobacterium avium subsp. paratuberculosis
ucggccggcagcggugccg

SEQ ID NO: 2968504 - RNA, 22 nt, Mycobacterium avium subsp. paratuberculosis
ucggccggcagcggugccgccc

SEQ ID NO: 2968505 - RNA, 18 nt, Mycobacterium avium subsp. paratuberculosis
ucggccggcaggccgccc

SEQ ID NO: 2968506 - RNA, 21 nt, Mycobacterium avium subsp. paratuberculosis
ucggccggccccgcccggcgc

SEQ ID NO: 2968507 - RNA, 19 nt, Mycobacterium avium subsp. paratuberculosis
ucggccggcgaggugggca

SEQ ID NO: 2968508 - RNA, 12 nt, Mycobacterium avium subsp. paratuberculosis
ucggccggcggg

SEQ ID NO: 2968509 - RNA, 13 nt, Mycobacterium avium subsp. paratuberculosis
ucggccggcgggg

SEQ ID NO: 2968510 - RNA, 16 nt, Mycobacterium avium subsp. paratuberculosis
ucggccggcucgaccu

SEQ ID NO: 2968511 - RNA, 20 nt, Mycobacterium avium subsp. paratuberculosis
ucggccgggagauacggucg

SEQ ID NO: 2968512 - RNA, 14 nt, Mycobacterium avium subsp. paratuberculosis
ucggccgggccggc

SEQ ID NO: 2968513 - RNA, 14 nt, Mycobacterium avium subsp. paratuberculosis
ucggccgggcugcc

SEQ ID NO: 2968514 - RNA, 19 nt, Mycobacterium avium subsp. paratuberculosis
ucggccggggcgaccagua

SEQ ID NO: 2968515 - RNA, 13 nt, Mycobacterium avium subsp. paratuberculosis
ucggccggguccu

SEQ ID NO: 2968516 - RNA, 14 nt, Mycobacterium avium subsp. paratuberculosis
ucggccgggucgua

SEQ ID NO: 2968517 - RNA, 22 nt, Mycobacterium avium subsp. paratuberculosis
ucggccgguccgaucguccggc

SEQ ID NO: 2968518 - RNA, 17 nt, Mycobacterium avium subsp. paratuberculosis
ucggccgguccgugcac

SEQ ID NO: 2968519 - RNA, 20 nt, Mycobacterium avium subsp. paratuberculosis
ucggccgguccgugcacggc

SEQ ID NO: 2968520 - RNA, 18 nt, Mycobacterium avium subsp. paratuberculosis
ucggccguaccggcguac

SEQ ID NO: 2968521 - RNA, 14 nt, Mycobacterium avium subsp. paratuberculosis
ucggccgucggcgc

SEQ ID NO: 2968522 - RNA, 15 nt, Mycobacterium avium subsp. paratuberculosis
ucggccgucggcgcc

SEQ ID NO: 2968523 - RNA, 16 nt, Mycobacterium avium subsp. paratuberculosis
ucggccgucggcgccg

SEQ ID NO: 2968524 - RNA, 18 nt, Mycobacterium avium subsp. paratuberculosis
ucggccgucggcgccgcc

SEQ ID NO: 2968525 - RNA, 22 nt, Mycobacterium avium subsp. paratuberculosis
ucggcgaugcguugcgccagca

SEQ ID NO: 2968526 - RNA, 15 nt, Mycobacterium avium subsp. paratuberculosis
ucggcgauggcggcg

SEQ ID NO: 2968527 - RNA, 23 nt, Mycobacterium avium subsp. paratuberculosis
ucggcgauggugaugugcggcgc

SEQ ID NO: 2968528 - RNA, 17 nt, Mycobacterium avium subsp. paratuberculosis
ucggcgaugucgaagcc

SEQ ID NO: 2968529 - RNA, 14 nt, Mycobacterium avium subsp. paratuberculosis
ucggcgauguugac

SEQ ID NO: 2968530 - RNA, 18 nt, Mycobacterium avium subsp. paratuberculosis
ucggcgccacgaccagcg

SEQ ID NO: 2968531 - RNA, 21 nt, Mycobacterium avium subsp. paratuberculosis
ucggcgccacgaccagcggca

SEQ ID NO: 2968532 - RNA, 22 nt, Mycobacterium avium subsp. paratuberculosis
ucggcgccacgaccagcggcag

SEQ ID NO: 2968533 - RNA, 13 nt, Mycobacterium avium subsp. paratuberculosis
ucggcgccagccc

SEQ ID NO: 2968534 - RNA, 15 nt, Mycobacterium avium subsp. paratuberculosis
ucggcgccagcccgc

SEQ ID NO: 2968535 - RNA, 17 nt, Mycobacterium avium subsp. paratuberculosis
ucggcgccagcccgccg

SEQ ID NO: 2968536 - RNA, 18 nt, Mycobacterium avium subsp. paratuberculosis
ucggcgccagcccgccga

SEQ ID NO: 2968537 - RNA, 16 nt, Mycobacterium avium subsp. paratuberculosis
ucggcgccagccgcac

SEQ ID NO: 2968538 - RNA, 22 nt, Mycobacterium avium subsp. paratuberculosis
ucggcgccagccgcaccgcgac

SEQ ID NO: 2968539 - RNA, 18 nt, Mycobacterium avium subsp. paratuberculosis
ucggcgcccaccgcggcg

SEQ ID NO: 2968540 - RNA, 21 nt, Mycobacterium avium subsp. paratuberculosis
ucggcgcccaccgcggcgcgc

SEQ ID NO: 2968541 - RNA, 17 nt, Mycobacterium avium subsp. paratuberculosis
ucggcgcccagaucggc

SEQ ID NO: 2968542 - RNA, 20 nt, Mycobacterium avium subsp. paratuberculosis
ucggcgcccagaucggccag

SEQ ID NO: 2968543 - RNA, 13 nt, Mycobacterium avium subsp. paratuberculosis
ucggcgcccagga

SEQ ID NO: 2968544 - RNA, 19 nt, Mycobacterium avium subsp. paratuberculosis
ucggcgccccacgccuggc

SEQ ID NO: 2968545 - RNA, 16 nt, Mycobacterium avium subsp. paratuberculosis
ucggcgccccccugcu

SEQ ID NO: 2968546 - RNA, 23 nt, Mycobacterium avium subsp. paratuberculosis
ucggcgccccccugcucgcugug

SEQ ID NO: 2968547 - RNA, 19 nt, Mycobacterium avium subsp. paratuberculosis
ucggcgccccgcccgcgac

SEQ ID NO: 2968548 - RNA, 20 nt, Mycobacterium avium subsp. paratuberculosis
ucggcgccccgcccgcgacu

SEQ ID NO: 2968549 - RNA, 22 nt, Mycobacterium avium subsp. paratuberculosis
ucggcgccccgcccgcgacugu

SEQ ID NO: 2968550 - RNA, 15 nt, Mycobacterium avium subsp. paratuberculosis
ucggcgccccggcgc

SEQ ID NO: 2968551 - RNA, 17 nt, Mycobacterium avium subsp. paratuberculosis
ucggcgcccgcuccggc

SEQ ID NO: 2968552 - RNA, 22 nt, Mycobacterium avium subsp. paratuberculosis
ucggcgcccgcuccggcggacc

SEQ ID NO: 2968553 - RNA, 14 nt, Mycobacterium avium subsp. paratuberculosis
ucggcgcccggcac

SEQ ID NO: 2968554 - RNA, 15 nt, Mycobacterium avium subsp. paratuberculosis
ucggcgcccggcacc

SEQ ID NO: 2968555 - RNA, 19 nt, Mycobacterium avium subsp. paratuberculosis
ucggcgcccggcaccggga

SEQ ID NO: 2968556 - RNA, 15 nt, Mycobacterium avium subsp. paratuberculosis
ucggcgcccggccca

SEQ ID NO: 2968557 - RNA, 22 nt, Mycobacterium avium subsp. paratuberculosis
ucggcgcccggcccagccgcug

SEQ ID NO: 2968558 - RNA, 16 nt, Mycobacterium avium subsp. paratuberculosis
ucggcgcccucgccga

SEQ ID NO: 2968559 - RNA, 17 nt, Mycobacterium avium subsp. paratuberculosis
ucggcgcccucggcgau

SEQ ID NO: 2968560 - RNA, 18 nt, Mycobacterium avium subsp. paratuberculosis
ucggcgcccucggcgauc

SEQ ID NO: 2968561 - RNA, 18 nt, Mycobacterium avium subsp. paratuberculosis
ucggcgccgaccucggcc

SEQ ID NO: 2968562 - RNA, 20 nt, Mycobacterium avium subsp. paratuberculosis
ucggcgccgaccucggccag

SEQ ID NO: 2968563 - RNA, 21 nt, Mycobacterium avium subsp. paratuberculosis
ucggcgccgaccucggccagc

SEQ ID NO: 2968564 - RNA, 22 nt, Mycobacterium avium subsp. paratuberculosis
ucggcgccgaccucggccagcg

SEQ ID NO: 2968565 - RNA, 17 nt, Mycobacterium avium subsp. paratuberculosis
ucggcgccgacggccag

SEQ ID NO: 2968566 - RNA, 13 nt, Mycobacterium avium subsp. paratuberculosis
ucggcgccgagca

SEQ ID NO: 2968567 - RNA, 19 nt, Mycobacterium avium subsp. paratuberculosis
ucggcgccgagcgucacgc

SEQ ID NO: 2968568 - RNA, 17 nt, Mycobacterium avium subsp. paratuberculosis
ucggcgccgaugcagca

SEQ ID NO: 2968569 - RNA, 18 nt, Mycobacterium avium subsp. paratuberculosis
ucggcgccgaugcagcac

SEQ ID NO: 2968570 - RNA, 16 nt, Mycobacterium avium subsp. paratuberculosis
ucggcgccgccgagcc

SEQ ID NO: 2968571 - RNA, 19 nt, Mycobacterium avium subsp. paratuberculosis
ucggcgccgccgagccgcg

SEQ ID NO: 2968572 - RNA, 11 nt, Mycobacterium avium subsp. paratuberculosis
ucggcgccgcg

SEQ ID NO: 2968573 - RNA, 20 nt, Mycobacterium avium subsp. paratuberculosis
ucggcgccgcgaccccggac

SEQ ID NO: 2968574 - RNA, 15 nt, Mycobacterium avium subsp. paratuberculosis
ucggcgccgcgcgcc

SEQ ID NO: 2968575 - RNA, 17 nt, Mycobacterium avium subsp. paratuberculosis
ucggcgccgcgcgccag

SEQ ID NO: 2968576 - RNA, 20 nt, Mycobacterium avium subsp. paratuberculosis
ucggcgccgcgcgccagcgc

SEQ ID NO: 2968577 - RNA, 15 nt, Mycobacterium avium subsp. paratuberculosis
ucggcgccggcaucc

SEQ ID NO: 2968578 - RNA, 18 nt, Mycobacterium avium subsp. paratuberculosis
ucggcgccggcauccagc

SEQ ID NO: 2968579 - RNA, 14 nt, Mycobacterium avium subsp. paratuberculosis
ucggcgccggccag

SEQ ID NO: 2968580 - RNA, 17 nt, Mycobacterium avium subsp. paratuberculosis
ucggcgccggccagcgg

SEQ ID NO: 2968581 - RNA, 13 nt, Mycobacterium avium subsp. paratuberculosis
ucggcgccggccg

SEQ ID NO: 2968582 - RNA, 16 nt, Mycobacterium avium subsp. paratuberculosis
ucggcgccggccguca

SEQ ID NO: 2968583 - RNA, 20 nt, Mycobacterium avium subsp. paratuberculosis
ucggcgccggccgucacgcu

SEQ ID NO: 2968584 - RNA, 21 nt, Mycobacterium avium subsp. paratuberculosis
ucggcgccggccgucacgcug

SEQ ID NO: 2968585 - RNA, 12 nt, Mycobacterium avium subsp. paratuberculosis
ucggcgccggcg

SEQ ID NO: 2968586 - RNA, 12 nt, Mycobacterium avium subsp. paratuberculosis
ucggcgccggug

SEQ ID NO: 2968587 - RNA, 23 nt, Mycobacterium avium subsp. paratuberculosis
ucggcgccgguggugucgacggu

SEQ ID NO: 2968588 - RNA, 14 nt, Mycobacterium avium subsp. paratuberculosis
ucggcgccguccag

SEQ ID NO: 2968589 - RNA, 13 nt, Mycobacterium avium subsp. paratuberculosis
ucggcgccucggc

SEQ ID NO: 2968590 - RNA, 15 nt, Mycobacterium avium subsp. paratuberculosis
ucggcgccucggcgu

SEQ ID NO: 2968591 - RNA, 18 nt, Mycobacterium avium subsp. paratuberculosis
ucggcgccuugguccgca

SEQ ID NO: 2968592 - RNA, 21 nt, Mycobacterium avium subsp. paratuberculosis
ucggcgcgcaucuugaucucg

SEQ ID NO: 2968593 - RNA, 15 nt, Mycobacterium avium subsp. paratuberculosis
ucggcgcgccacccg

SEQ ID NO: 2968594 - RNA, 14 nt, Mycobacterium avium subsp. paratuberculosis
ucggcgcgccgaag

SEQ ID NO: 2968595 - RNA, 22 nt, Mycobacterium avium subsp. paratuberculosis
ucggcgcgccgaagauggccag

SEQ ID NO: 2968596 - RNA, 23 nt, Mycobacterium avium subsp. paratuberculosis
ucggcgcgccgaagauggccagc

SEQ ID NO: 2968597 - RNA, 16 nt, Mycobacterium avium subsp. paratuberculosis
ucggcgcgccggcgau

SEQ ID NO: 2968598 - RNA, 17 nt, Mycobacterium avium subsp. paratuberculosis
ucggcgcgcgccgauca

SEQ ID NO: 2968599 - RNA, 21 nt, Mycobacterium avium subsp. paratuberculosis
ucggcgcgcgcgccccagccc

SEQ ID NO: 2968600 - RNA, 15 nt, Mycobacterium avium subsp. paratuberculosis
ucggcgcgcggggcc

SEQ ID NO: 2968601 - RNA, 20 nt, Mycobacterium avium subsp. paratuberculosis
ucggcgcgcggggccggcgc

SEQ ID NO: 2968602 - RNA, 16 nt, Mycobacterium avium subsp. paratuberculosis
ucggcgcggagcgucg

SEQ ID NO: 2968603 - RNA, 22 nt, Mycobacterium avium subsp. paratuberculosis
ucggcgcggagcgucgcgauga

SEQ ID NO: 2968604 - RNA, 22 nt, Mycobacterium avium subsp. paratuberculosis
ucggcgcggaugacgugcacca

SEQ ID NO: 2968605 - RNA, 14 nt, Mycobacterium avium subsp. paratuberculosis
ucggcgcggccgga

SEQ ID NO: 2968606 - RNA, 13 nt, Mycobacterium avium subsp. paratuberculosis
ucggcgcggcgac

SEQ ID NO: 2968607 - RNA, 16 nt, Mycobacterium avium subsp. paratuberculosis
ucggcgcggcgacgug

SEQ ID NO: 2968608 - RNA, 13 nt, Mycobacterium avium subsp. paratuberculosis
ucggcgcgggcca

SEQ ID NO: 2968609 - RNA, 14 nt, Mycobacterium avium subsp. paratuberculosis
ucggcgcgggccag

SEQ ID NO: 2968610 - RNA, 22 nt, Mycobacterium avium subsp. paratuberculosis
ucggcgggaucggaccgcacca

SEQ ID NO: 2968611 - RNA, 22 nt, Mycobacterium avium subsp. paratuberculosis
ucggcgggauggguggucaccg

SEQ ID NO: 2968612 - RNA, 23 nt, Mycobacterium avium subsp. paratuberculosis
ucggcgggauggguggucaccgu

SEQ ID NO: 2968613 - RNA, 13 nt, Mycobacterium avium subsp. paratuberculosis
ucggcgggcaccu

SEQ ID NO: 2968614 - RNA, 15 nt, Mycobacterium avium subsp. paratuberculosis
ucggcgggcaccucg

SEQ ID NO: 2968615 - RNA, 17 nt, Mycobacterium avium subsp. paratuberculosis
ucggcgggcaccucggc

SEQ ID NO: 2968616 - RNA, 18 nt, Mycobacterium avium subsp. paratuberculosis
ucggcgggccgcccggcg

SEQ ID NO: 2968617 - RNA, 22 nt, Mycobacterium avium subsp. paratuberculosis
ucggcgggccgcccggcgcgcc

SEQ ID NO: 2968618 - RNA, 23 nt, Mycobacterium avium subsp. paratuberculosis
ucggcgggccuucuucucgacgu

SEQ ID NO: 2968619 - RNA, 13 nt, Mycobacterium avium subsp. paratuberculosis
ucggcgggcgcgc

SEQ ID NO: 2968620 - RNA, 14 nt, Mycobacterium avium subsp. paratuberculosis
ucggcgggcgggcg

SEQ ID NO: 2968621 - RNA, 19 nt, Mycobacterium avium subsp. paratuberculosis
ucggcgggcucgcgcuggc

SEQ ID NO: 2968622 - RNA, 21 nt, Mycobacterium avium subsp. paratuberculosis
ucggcggggaagggcuccccg

SEQ ID NO: 2968623 - RNA, 21 nt, Mycobacterium avium subsp. paratuberculosis
ucggcggggaaggugcgggcg

SEQ ID NO: 2968624 - RNA, 22 nt, Mycobacterium avium subsp. paratuberculosis
ucggcggggaaggugcgggcgg

SEQ ID NO: 2968625 - RNA, 20 nt, Mycobacterium avium subsp. paratuberculosis
ucggcggguagaaccagccc

SEQ ID NO: 2968626 - RNA, 23 nt, Mycobacterium avium subsp. paratuberculosis
ucggcggguagaaccagcccggc

SEQ ID NO: 2968627 - RNA, 16 nt, Mycobacterium avium subsp. paratuberculosis
ucggcgggucguagcc

SEQ ID NO: 2968628 - RNA, 12 nt, Mycobacterium avium subsp. paratuberculosis
ucggcgggugcg

SEQ ID NO: 2968629 - RNA, 20 nt, Mycobacterium avium subsp. paratuberculosis
ucggcgggugcgggcgcugc

SEQ ID NO: 2968630 - RNA, 22 nt, Mycobacterium avium subsp. paratuberculosis
ucggcggucaacacgaagccgg

SEQ ID NO: 2968631 - RNA, 16 nt, Mycobacterium avium subsp. paratuberculosis
ucggcggucccgugcg

SEQ ID NO: 2968632 - RNA, 21 nt, Mycobacterium avium subsp. paratuberculosis
ucggcggucccgugcgccgcc

SEQ ID NO: 2968633 - RNA, 22 nt, Mycobacterium avium subsp. paratuberculosis
ucggcggucccgugcgccgccc

SEQ ID NO: 2968634 - RNA, 22 nt, Mycobacterium avium subsp. paratuberculosis
ucggcggucgccagcgccacgc

SEQ ID NO: 2968635 - RNA, 13 nt, Mycobacterium avium subsp. paratuberculosis
ucggcggucgcgg

SEQ ID NO: 2968636 - RNA, 13 nt, Mycobacterium avium subsp. paratuberculosis
ucggcggucuugg

SEQ ID NO: 2968637 - RNA, 20 nt, Mycobacterium avium subsp. paratuberculosis
ucggcggucuuggcggccag

SEQ ID NO: 2968638 - RNA, 23 nt, Mycobacterium avium subsp. paratuberculosis
ucggcggucuuugccaucccggu

SEQ ID NO: 2968639 - RNA, 18 nt, Mycobacterium avium subsp. paratuberculosis
ucggcggugaugcgcgcc

SEQ ID NO: 2968640 - RNA, 23 nt, Mycobacterium avium subsp. paratuberculosis
ucggcggugccguccucggccgc

SEQ ID NO: 2968641 - RNA, 17 nt, Mycobacterium avium subsp. paratuberculosis
ucggcggugguccgcgc

SEQ ID NO: 2968642 - RNA, 22 nt, Mycobacterium avium subsp. paratuberculosis
ucggcggugguccgcgcgacca

SEQ ID NO: 2968643 - RNA, 21 nt, Mycobacterium avium subsp. paratuberculosis
ucggcgguucgauaccguccg

SEQ ID NO: 2968644 - RNA, 23 nt, Mycobacterium avium subsp. paratuberculosis
ucggcgguuucggugccggccca

SEQ ID NO: 2968645 - RNA, 21 nt, Mycobacterium avium subsp. paratuberculosis
ucggcguacaggccgucgggg

SEQ ID NO: 2968646 - RNA, 16 nt, Mycobacterium avium subsp. paratuberculosis
ucggcguagaggugca

SEQ ID NO: 2968647 - RNA, 22 nt, Mycobacterium avium subsp. paratuberculosis
ucggcguagcggaagcugccgu

SEQ ID NO: 2968648 - RNA, 17 nt, Mycobacterium avium subsp. paratuberculosis
ucggcguagggcagccc

SEQ ID NO: 2968649 - RNA, 20 nt, Mycobacterium avium subsp. paratuberculosis
ucggcguagggcagcccgag

SEQ ID NO: 2968650 - RNA, 21 nt, Mycobacterium avium subsp. paratuberculosis
ucggcguauucgucgucggcc

SEQ ID NO: 2968651 - RNA, 15 nt, Mycobacterium avium subsp. paratuberculosis
ucggcgucaccaggc

SEQ ID NO: 2968652 - RNA, 21 nt, Mycobacterium avium subsp. paratuberculosis
ucggcgucaccccaccgagca

SEQ ID NO: 2968653 - RNA, 20 nt, Mycobacterium avium subsp. paratuberculosis
ucggcgucacucuggcguga

SEQ ID NO: 2968654 - RNA, 15 nt, Mycobacterium avium subsp. paratuberculosis
ucggcgucacugccc

SEQ ID NO: 2968655 - RNA, 17 nt, Mycobacterium avium subsp. paratuberculosis
ucggcgucaucgacuug

SEQ ID NO: 2968656 - RNA, 13 nt, Mycobacterium avium subsp. paratuberculosis
ucggcguccagca

SEQ ID NO: 2968657 - RNA, 23 nt, Mycobacterium avium subsp. paratuberculosis
ucggcguccaugcucuugcgggc

SEQ ID NO: 2968658 - RNA, 16 nt, Mycobacterium avium subsp. paratuberculosis
ucggcgucccgcgcca

SEQ ID NO: 2968659 - RNA, 20 nt, Mycobacterium avium subsp. paratuberculosis
ucggcgucccggcgucucgg

SEQ ID NO: 2968660 - RNA, 18 nt, Mycobacterium avium subsp. paratuberculosis
ucggcguccucgacgccg

SEQ ID NO: 2968661 - RNA, 18 nt, Mycobacterium avium subsp. paratuberculosis
ucggcguccuugcccgag

SEQ ID NO: 2968662 - RNA, 16 nt, Mycobacterium avium subsp. paratuberculosis
ucggcgucgaacggcg

SEQ ID NO: 2968663 - RNA, 18 nt, Mycobacterium avium subsp. paratuberculosis
ucggcgucgacgacggcg

SEQ ID NO: 2968664 - RNA, 21 nt, Mycobacterium avium subsp. paratuberculosis
ucggcgucgacgacggcgccg

SEQ ID NO: 2968665 - RNA, 16 nt, Mycobacterium avium subsp. paratuberculosis
ucggcgucgccgagcu

SEQ ID NO: 2968666 - RNA, 16 nt, Mycobacterium avium subsp. paratuberculosis
ucggcgucgcggcgca

SEQ ID NO: 2968667 - RNA, 16 nt, Mycobacterium avium subsp. paratuberculosis
ucggcgucggaggcgg

SEQ ID NO: 2968668 - RNA, 15 nt, Mycobacterium avium subsp. paratuberculosis
ucggcgucggccacc

SEQ ID NO: 2968669 - RNA, 13 nt, Mycobacterium avium subsp. paratuberculosis
ucggcgucggcgc

SEQ ID NO: 2968670 - RNA, 12 nt, Mycobacterium avium subsp. paratuberculosis
ucggcgucgggc

SEQ ID NO: 2968671 - RNA, 14 nt, Mycobacterium avium subsp. paratuberculosis
ucggcgucgggccg

SEQ ID NO: 2968672 - RNA, 13 nt, Mycobacterium avium subsp. paratuberculosis
ucggcgucgggcg

SEQ ID NO: 2968673 - RNA, 19 nt, Mycobacterium avium subsp. paratuberculosis
ucggcgucguacagcagcc

SEQ ID NO: 2968674 - RNA, 18 nt, Mycobacterium avium subsp. paratuberculosis
ucggcgucucggcccgag

SEQ ID NO: 2968675 - RNA, 15 nt, Mycobacterium avium subsp. paratuberculosis
ucggcgucucggcgu

SEQ ID NO: 2968676 - RNA, 19 nt, Mycobacterium avium subsp. paratuberculosis
ucggcgucucggcgucucg

SEQ ID NO: 2968677 - RNA, 20 nt, Mycobacterium avium subsp. paratuberculosis
ucggcgugaauccucagcac

SEQ ID NO: 2968678 - RNA, 23 nt, Mycobacterium avium subsp. paratuberculosis
ucggcgugaauccucagcacggc

SEQ ID NO: 2968679 - RNA, 16 nt, Mycobacterium avium subsp. paratuberculosis
ucggcgugaucccgau

SEQ ID NO: 2968680 - RNA, 21 nt, Mycobacterium avium subsp. paratuberculosis
ucggcgugaucccgauccucg

SEQ ID NO: 2968681 - RNA, 14 nt, Mycobacterium avium subsp. paratuberculosis
ucggcgugcagcac

SEQ ID NO: 2968682 - RNA, 17 nt, Mycobacterium avium subsp. paratuberculosis
ucggcgugcccgccgac

SEQ ID NO: 2968683 - RNA, 14 nt, Mycobacterium avium subsp. paratuberculosis
ucggcgugcucggc

SEQ ID NO: 2968684 - RNA, 21 nt, Mycobacterium avium subsp. paratuberculosis
ucggcgugcucggccacgacg

SEQ ID NO: 2968685 - RNA, 17 nt, Mycobacterium avium subsp. paratuberculosis
ucggcgugcucgucgcg

SEQ ID NO: 2968686 - RNA, 18 nt, Mycobacterium avium subsp. paratuberculosis
ucggcgugcucgucgcgg

SEQ ID NO: 2968687 - RNA, 13 nt, Mycobacterium avium subsp. paratuberculosis
ucggcguggcagg

SEQ ID NO: 2968688 - RNA, 14 nt, Mycobacterium avium subsp. paratuberculosis
ucggcguggcaggc

SEQ ID NO: 2968689 - RNA, 15 nt, Mycobacterium avium subsp. paratuberculosis
ucggcguggccgucc

SEQ ID NO: 2968690 - RNA, 18 nt, Mycobacterium avium subsp. paratuberculosis
ucggcguggcgcucagcg

SEQ ID NO: 2968691 - RNA, 15 nt, Mycobacterium avium subsp. paratuberculosis
ucggcguggucgagg

SEQ ID NO: 2968692 - RNA, 23 nt, Mycobacterium avium subsp. paratuberculosis
ucggcgugucgugugcgugacgu

SEQ ID NO: 2968693 - RNA, 23 nt, Mycobacterium avium subsp. paratuberculosis
ucggcguguuccuugcggccgcc

SEQ ID NO: 2968694 - RNA, 17 nt, Mycobacterium avium subsp. paratuberculosis
ucgggcaacgcgccggc

SEQ ID NO: 2968695 - RNA, 17 nt, Mycobacterium avium subsp. paratuberculosis
ucgggcaaucggaccca

SEQ ID NO: 2968696 - RNA, 21 nt, Mycobacterium avium subsp. paratuberculosis
ucgggcaaucggacccagccc

SEQ ID NO: 2968697 - RNA, 15 nt, Mycobacterium avium subsp. paratuberculosis
ucgggcaccacgccg

SEQ ID NO: 2968698 - RNA, 17 nt, Mycobacterium avium subsp. paratuberculosis
ucgggcaccacgccgac

SEQ ID NO: 2968699 - RNA, 20 nt, Mycobacterium avium subsp. paratuberculosis
ucgggcaccacgccgacgug

SEQ ID NO: 2968700 - RNA, 17 nt, Mycobacterium avium subsp. paratuberculosis
ucgggcaccacggcggc

SEQ ID NO: 2968701 - RNA, 18 nt, Mycobacterium avium subsp. paratuberculosis
ucgggcaccacggcggca

SEQ ID NO: 2968702 - RNA, 13 nt, Mycobacterium avium subsp. paratuberculosis
ucgggcaccagca

SEQ ID NO: 2968703 - RNA, 18 nt, Mycobacterium avium subsp. paratuberculosis
ucgggcaccagcaccgag

SEQ ID NO: 2968704 - RNA, 22 nt, Mycobacterium avium subsp. paratuberculosis
ucgggcaccccugccgccaccg

SEQ ID NO: 2968705 - RNA, 13 nt, Mycobacterium avium subsp. paratuberculosis
ucgggcacgucca

SEQ ID NO: 2968706 - RNA, 16 nt, Mycobacterium avium subsp. paratuberculosis
ucgggcacguccagcc

SEQ ID NO: 2968707 - RNA, 19 nt, Mycobacterium avium subsp. paratuberculosis
ucgggcacguccagcccgc

SEQ ID NO: 2968708 - RNA, 21 nt, Mycobacterium avium subsp. paratuberculosis
ucgggcagauggucgccgacg

SEQ ID NO: 2968709 - RNA, 13 nt, Mycobacterium avium subsp. paratuberculosis
ucgggcagcagca

SEQ ID NO: 2968710 - RNA, 14 nt, Mycobacterium avium subsp. paratuberculosis
ucgggcagcagcac

SEQ ID NO: 2968711 - RNA, 16 nt, Mycobacterium avium subsp. paratuberculosis
ucgggcagcagcacca

SEQ ID NO: 2968712 - RNA, 23 nt, Mycobacterium avium subsp. paratuberculosis
ucgggcagcagcaccagcgccgc

SEQ ID NO: 2968713 - RNA, 13 nt, Mycobacterium avium subsp. paratuberculosis
ucgggcagcccgc

SEQ ID NO: 2968714 - RNA, 24 nt, Mycobacterium avium subsp. paratuberculosis
ucgggcaggauggucagcgagugg

SEQ ID NO: 2968715 - RNA, 21 nt, Mycobacterium avium subsp. paratuberculosis
ucgggcagugcacgacgaccg

SEQ ID NO: 2968716 - RNA, 14 nt, Mycobacterium avium subsp. paratuberculosis
ucgggcaugaugaa

SEQ ID NO: 2968717 - RNA, 16 nt, Mycobacterium avium subsp. paratuberculosis
ucgggcaugccggccg

SEQ ID NO: 2968718 - RNA, 20 nt, Mycobacterium avium subsp. paratuberculosis
ucgggcaugccggccggcac

SEQ ID NO: 2968719 - RNA, 18 nt, Mycobacterium avium subsp. paratuberculosis
ucgggcauuggcagcucg

SEQ ID NO: 2968720 - RNA, 21 nt, Mycobacterium avium subsp. paratuberculosis
ucgggcauuggcagcucgggc

SEQ ID NO: 2968721 - RNA, 17 nt, Mycobacterium avium subsp. paratuberculosis
ucgggccacaacaaggu

SEQ ID NO: 2968722 - RNA, 13 nt, Mycobacterium avium subsp. paratuberculosis
ucgggccagccca

SEQ ID NO: 2968723 - RNA, 18 nt, Mycobacterium avium subsp. paratuberculosis
ucgggccagcgccgagcc

SEQ ID NO: 2968724 - RNA, 19 nt, Mycobacterium avium subsp. paratuberculosis
ucgggccagcgccgagccg

SEQ ID NO: 2968725 - RNA, 12 nt, Mycobacterium avium subsp. paratuberculosis
ucgggcccagca

SEQ ID NO: 2968726 - RNA, 15 nt, Mycobacterium avium subsp. paratuberculosis
ucgggcccagcagcc

SEQ ID NO: 2968727 - RNA, 16 nt, Mycobacterium avium subsp. paratuberculosis
ucgggcccgcgcaccg

SEQ ID NO: 2968728 - RNA, 18 nt, Mycobacterium avium subsp. paratuberculosis
ucgggcccgcgcaccguc

SEQ ID NO: 2968729 - RNA, 14 nt, Mycobacterium avium subsp. paratuberculosis
ucgggcccggccgc

SEQ ID NO: 2968730 - RNA, 15 nt, Mycobacterium avium subsp. paratuberculosis
ucgggcccggccgcc

SEQ ID NO: 2968731 - RNA, 17 nt, Mycobacterium avium subsp. paratuberculosis
ucgggcccggccgccag

SEQ ID NO: 2968732 - RNA, 19 nt, Mycobacterium avium subsp. paratuberculosis
ucgggcccggccgccagca

SEQ ID NO: 2968733 - RNA, 13 nt, Mycobacterium avium subsp. paratuberculosis
ucgggccggcagc

SEQ ID NO: 2968734 - RNA, 19 nt, Mycobacterium avium subsp. paratuberculosis
ucgggccggcagccggcca

SEQ ID NO: 2968735 - RNA, 20 nt, Mycobacterium avium subsp. paratuberculosis
ucgggccggcagccggccac

SEQ ID NO: 2968736 - RNA, 12 nt, Mycobacterium avium subsp. paratuberculosis
ucgggccggccc

SEQ ID NO: 2968737 - RNA, 14 nt, Mycobacterium avium subsp. paratuberculosis
ucgggccggcgccg

SEQ ID NO: 2968738 - RNA, 17 nt, Mycobacterium avium subsp. paratuberculosis
ucgggccggcgccgacg

SEQ ID NO: 2968739 - RNA, 12 nt, Mycobacterium avium subsp. paratuberculosis
ucgggccgggcg

SEQ ID NO: 2968740 - RNA, 18 nt, Mycobacterium avium subsp. paratuberculosis
ucgggccgggcgggcacc

SEQ ID NO: 2968741 - RNA, 17 nt, Mycobacterium avium subsp. paratuberculosis
ucgggccgggggcggcg

SEQ ID NO: 2968742 - RNA, 16 nt, Mycobacterium avium subsp. paratuberculosis
ucgggccggucagcgc

SEQ ID NO: 2968743 - RNA, 15 nt, Mycobacterium avium subsp. paratuberculosis
ucgggccguccgccg

SEQ ID NO: 2968744 - RNA, 22 nt, Mycobacterium avium subsp. paratuberculosis
ucgggccguccgccggcuggcg

SEQ ID NO: 2968745 - RNA, 16 nt, Mycobacterium avium subsp. paratuberculosis
ucgggcgacgacgcgg

SEQ ID NO: 2968746 - RNA, 18 nt, Mycobacterium avium subsp. paratuberculosis
ucgggcgacgacgcgguc

SEQ ID NO: 2968747 - RNA, 21 nt, Mycobacterium avium subsp. paratuberculosis
ucgggcgcaccacgaccuccg

SEQ ID NO: 2968748 - RNA, 18 nt, Mycobacterium avium subsp. paratuberculosis
ucgggcgcagguccaccc

SEQ ID NO: 2968749 - RNA, 20 nt, Mycobacterium avium subsp. paratuberculosis
ucgggcgcagguccacccgc

SEQ ID NO: 2968750 - RNA, 22 nt, Mycobacterium avium subsp. paratuberculosis
ucgggcgcagguccacccgccc

SEQ ID NO: 2968751 - RNA, 15 nt, Mycobacterium avium subsp. paratuberculosis
ucgggcgccagcccg

SEQ ID NO: 2968752 - RNA, 18 nt, Mycobacterium avium subsp. paratuberculosis
ucgggcgccagcccgccc

SEQ ID NO: 2968753 - RNA, 21 nt, Mycobacterium avium subsp. paratuberculosis
ucgggcgccagcccgcccagc

SEQ ID NO: 2968754 - RNA, 11 nt, Mycobacterium avium subsp. paratuberculosis
ucgggcgccgg

SEQ ID NO: 2968755 - RNA, 13 nt, Mycobacterium avium subsp. paratuberculosis
ucgggcgccggcg

SEQ ID NO: 2968756 - RNA, 14 nt, Mycobacterium avium subsp. paratuberculosis
ucgggcgccggcgc

SEQ ID NO: 2968757 - RNA, 21 nt, Mycobacterium avium subsp. paratuberculosis
ucgggcgccgguuccuccgac

SEQ ID NO: 2968758 - RNA, 11 nt, Mycobacterium avium subsp. paratuberculosis
ucgggcgcucg

SEQ ID NO: 2968759 - RNA, 22 nt, Mycobacterium avium subsp. paratuberculosis
ucgggcgcucggccagcagugc

SEQ ID NO: 2968760 - RNA, 14 nt, Mycobacterium avium subsp. paratuberculosis
ucgggcggccgcgg

SEQ ID NO: 2968761 - RNA, 22 nt, Mycobacterium avium subsp. paratuberculosis
ucgggcggggugugcggcacgg

SEQ ID NO: 2968762 - RNA, 13 nt, Mycobacterium avium subsp. paratuberculosis
ucgggcgggugga

SEQ ID NO: 2968763 - RNA, 16 nt, Mycobacterium avium subsp. paratuberculosis
ucgggcgguggcgccg

SEQ ID NO: 2968764 - RNA, 20 nt, Mycobacterium avium subsp. paratuberculosis
ucgggcgucgcagaucccgc

SEQ ID NO: 2968765 - RNA, 18 nt, Mycobacterium avium subsp. paratuberculosis
ucgggcguugcgccgcga

SEQ ID NO: 2968766 - RNA, 23 nt, Mycobacterium avium subsp. paratuberculosis
ucgggcuaagcgauuacgaccag

SEQ ID NO: 2968767 - RNA, 14 nt, Mycobacterium avium subsp. paratuberculosis
ucgggcucgcgguc

SEQ ID NO: 2968768 - RNA, 15 nt, Mycobacterium avium subsp. paratuberculosis
ucgggcucggccgcc

SEQ ID NO: 2968769 - RNA, 17 nt, Mycobacterium avium subsp. paratuberculosis
ucgggcucgucgugaug

SEQ ID NO: 2968770 - RNA, 20 nt, Mycobacterium avium subsp. paratuberculosis
ucgggcucgucgugauggcg

SEQ ID NO: 2968771 - RNA, 17 nt, Mycobacterium avium subsp. paratuberculosis
ucggggaauuccggcgc

SEQ ID NO: 2968772 - RNA, 13 nt, Mycobacterium avium subsp. paratuberculosis
ucggggaccgucc

SEQ ID NO: 2968773 - RNA, 14 nt, Mycobacterium avium subsp. paratuberculosis
ucggggacgaagac

SEQ ID NO: 2968774 - RNA, 15 nt, Mycobacterium avium subsp. paratuberculosis
ucggggaucagcguc

SEQ ID NO: 2968775 - RNA, 16 nt, Mycobacterium avium subsp. paratuberculosis
ucggggaucgccaggc

SEQ ID NO: 2968776 - RNA, 18 nt, Mycobacterium avium subsp. paratuberculosis
ucggggauguaugcgguc

SEQ ID NO: 2968777 - RNA, 23 nt, Mycobacterium avium subsp. paratuberculosis
ucggggcaucgcagcgcgcggcg

SEQ ID NO: 2968778 - RNA, 13 nt, Mycobacterium avium subsp. paratuberculosis
ucggggccaccag

SEQ ID NO: 2968779 - RNA, 13 nt, Mycobacterium avium subsp. paratuberculosis
ucggucagcgcca

SEQ ID NO: 2968780 - RNA, 14 nt, Mycobacterium avium subsp. paratuberculosis
ucggucagcgccac

SEQ ID NO: 2968781 - RNA, 13 nt, Mycobacterium avium subsp. paratuberculosis
ucggucagcggcg

SEQ ID NO: 2968782 - RNA, 17 nt, Mycobacterium avium subsp. paratuberculosis
ucggucagcggcgugcu

SEQ ID NO: 2968783 - RNA, 14 nt, Mycobacterium avium subsp. paratuberculosis
ucggucagcgucgc

SEQ ID NO: 2968784 - RNA, 17 nt, Mycobacterium avium subsp. paratuberculosis
ucggucagcgucgccgc

SEQ ID NO: 2968785 - RNA, 14 nt, Mycobacterium avium subsp. paratuberculosis
ucggucagcucgaa

SEQ ID NO: 2968786 - RNA, 19 nt, Mycobacterium avium subsp. paratuberculosis
ucggucaggaacgcggaca

SEQ ID NO: 2968787 - RNA, 15 nt, Mycobacterium avium subsp. paratuberculosis
ucggucaggcacucg

SEQ ID NO: 2968788 - RNA, 20 nt, Mycobacterium avium subsp. paratuberculosis
ucggucaggcacucgaucag

SEQ ID NO: 2968789 - RNA, 16 nt, Mycobacterium avium subsp. paratuberculosis
ucggucaggccggcgc

SEQ ID NO: 2968790 - RNA, 12 nt, Mycobacterium avium subsp. paratuberculosis
ucggucagggug

SEQ ID NO: 2968791 - RNA, 21 nt, Mycobacterium avium subsp. paratuberculosis
ucgguccagguggccaugggg

SEQ ID NO: 2968792 - RNA, 15 nt, Mycobacterium avium subsp. paratuberculosis
ucggucccgacgcgg

SEQ ID NO: 2968793 - RNA, 19 nt, Mycobacterium avium subsp. paratuberculosis
ucggucccgacgcggcgcg

SEQ ID NO: 2968794 - RNA, 21 nt, Mycobacterium avium subsp. paratuberculosis
ucggucccggcgggggcggcg

SEQ ID NO: 2968795 - RNA, 11 nt, Mycobacterium avium subsp. paratuberculosis
ucggucgagcc

SEQ ID NO: 2968796 - RNA, 16 nt, Mycobacterium avium subsp. paratuberculosis
ucggucgagccuggcg

SEQ ID NO: 2968797 - RNA, 18 nt, Mycobacterium avium subsp. paratuberculosis
ucggucgagccuggcgcg

SEQ ID NO: 2968798 - RNA, 20 nt, Mycobacterium avium subsp. paratuberculosis
ucggucgagccuggcgcgca

SEQ ID NO: 2968799 - RNA, 15 nt, Mycobacterium avium subsp. paratuberculosis
ucggucgccacggcc

SEQ ID NO: 2968800 - RNA, 22 nt, Mycobacterium avium subsp. paratuberculosis
ucggucgccacggccggcagca

SEQ ID NO: 2968801 - RNA, 13 nt, Mycobacterium avium subsp. paratuberculosis
ucggucgccagca

SEQ ID NO: 2968802 - RNA, 15 nt, Mycobacterium avium subsp. paratuberculosis
ucggucgccagcacc

SEQ ID NO: 2968803 - RNA, 15 nt, Mycobacterium avium subsp. paratuberculosis
ucggucgcgacccgg

SEQ ID NO: 2968804 - RNA, 22 nt, Mycobacterium avium subsp. paratuberculosis
ucggucgcggucggcgcccggc

SEQ ID NO: 2968805 - RNA, 23 nt, Mycobacterium avium subsp. paratuberculosis
ucggucgcggugaucaggcccuc

SEQ ID NO: 2968806 - RNA, 13 nt, Mycobacterium avium subsp. paratuberculosis
ucggucggcgucg

SEQ ID NO: 2968807 - RNA, 18 nt, Mycobacterium avium subsp. paratuberculosis
ucggucgggcagugcacg

SEQ ID NO: 2968808 - RNA, 18 nt, Mycobacterium avium subsp. paratuberculosis
ucggucguaguaggugcg

SEQ ID NO: 2968809 - RNA, 16 nt, Mycobacterium avium subsp. paratuberculosis
ucggucucgacaccgg

SEQ ID NO: 2968810 - RNA, 14 nt, Mycobacterium avium subsp. paratuberculosis
ucggucucgacguu

SEQ ID NO: 2968811 - RNA, 13 nt, Mycobacterium avium subsp. paratuberculosis
ucggucugcaggu

SEQ ID NO: 2968812 - RNA, 20 nt, Mycobacterium avium subsp. paratuberculosis
ucggugaacugcagcccgau

SEQ ID NO: 2968813 - RNA, 18 nt, Mycobacterium avium subsp. paratuberculosis
ucggugaagccgacgccg

SEQ ID NO: 2968814 - RNA, 14 nt, Mycobacterium avium subsp. paratuberculosis
ucggugaagccgcg

SEQ ID NO: 2968815 - RNA, 17 nt, Mycobacterium avium subsp. paratuberculosis
ucggugaagccgcggac

SEQ ID NO: 2968816 - RNA, 21 nt, Mycobacterium avium subsp. paratuberculosis
ucggugaagccgcggacggcg

SEQ ID NO: 2968817 - RNA, 22 nt, Mycobacterium avium subsp. paratuberculosis
ucggugaagcggcgcgggucgc

SEQ ID NO: 2968818 - RNA, 18 nt, Mycobacterium avium subsp. paratuberculosis
ucggugaaguuggcggcg

SEQ ID NO: 2968819 - RNA, 20 nt, Mycobacterium avium subsp. paratuberculosis
ucggugaaguuggcggcggu

SEQ ID NO: 2968820 - RNA, 19 nt, Mycobacterium avium subsp. paratuberculosis
ucggugaccacggucggcg

SEQ ID NO: 2968821 - RNA, 16 nt, Mycobacterium avium subsp. paratuberculosis
ucggugaccgucgccg

SEQ ID NO: 2968822 - RNA, 15 nt, Mycobacterium avium subsp. paratuberculosis
ucggugacgaggagg

SEQ ID NO: 2968823 - RNA, 16 nt, Mycobacterium avium subsp. paratuberculosis
ucggugacgaggaggg

SEQ ID NO: 2968824 - RNA, 14 nt, Mycobacterium avium subsp. paratuberculosis
ucggugacggugug

SEQ ID NO: 2968825 - RNA, 15 nt, Mycobacterium avium subsp. paratuberculosis
ucggugagcagcucg

SEQ ID NO: 2968826 - RNA, 15 nt, Mycobacterium avium subsp. paratuberculosis
ucggugagccgcugg

SEQ ID NO: 2968827 - RNA, 19 nt, Mycobacterium avium subsp. paratuberculosis
ucggugagcgccaccccga

SEQ ID NO: 2968828 - RNA, 20 nt, Mycobacterium avium subsp. paratuberculosis
ucggugagcgccaccccgaa

SEQ ID NO: 2968829 - RNA, 17 nt, Mycobacterium avium subsp. paratuberculosis
ucggugagcuggccgcg

SEQ ID NO: 2968830 - RNA, 16 nt, Mycobacterium avium subsp. paratuberculosis
ucggugaggugggcgg

SEQ ID NO: 2968831 - RNA, 15 nt, Mycobacterium avium subsp. paratuberculosis
ucggugaucacccgc

SEQ ID NO: 2968832 - RNA, 21 nt, Mycobacterium avium subsp. paratuberculosis
ucggugaucacccgccgggug

SEQ ID NO: 2968833 - RNA, 17 nt, Mycobacterium avium subsp. paratuberculosis
ucggugaucucaccggc

SEQ ID NO: 2968834 - RNA, 21 nt, Mycobacterium avium subsp. paratuberculosis
ucggugaucucaccggcggcg

SEQ ID NO: 2968835 - RNA, 22 nt, Mycobacterium avium subsp. paratuberculosis
ucggugaucugcaccagcgugg

SEQ ID NO: 2968836 - RNA, 17 nt, Mycobacterium avium subsp. paratuberculosis
ucggugaugaucgccgg

SEQ ID NO: 2968837 - RNA, 20 nt, Mycobacterium avium subsp. paratuberculosis
ucggugaugccgagcgccgc

SEQ ID NO: 2968838 - RNA, 14 nt, Mycobacterium avium subsp. paratuberculosis
ucggugaugccggc

SEQ ID NO: 2968839 - RNA, 22 nt, Mycobacterium avium subsp. paratuberculosis
ucggugaugccggccagccgcg

SEQ ID NO: 2968840 - RNA, 18 nt, Mycobacterium avium subsp. paratuberculosis
ucggugauggccggcuac

SEQ ID NO: 2968841 - RNA, 16 nt, Mycobacterium avium subsp. paratuberculosis
ucggugaugucgacgu

SEQ ID NO: 2968842 - RNA, 22 nt, Mycobacterium avium subsp. paratuberculosis
ucggugaugucgacgucgucga

SEQ ID NO: 2968843 - RNA, 13 nt, Mycobacterium avium subsp. paratuberculosis
ucggugcacggcg

SEQ ID NO: 2968844 - RNA, 22 nt, Mycobacterium avium subsp. paratuberculosis
ucggugcacggcgccaccagcc

SEQ ID NO: 2968845 - RNA, 16 nt, Mycobacterium avium subsp. paratuberculosis
ucggugcagaccccgg

SEQ ID NO: 2968846 - RNA, 18 nt, Mycobacterium avium subsp. paratuberculosis
ucggugcagaccccggcg

SEQ ID NO: 2968847 - RNA, 12 nt, Mycobacterium avium subsp. paratuberculosis
ucggugcccagc

SEQ ID NO: 2968848 - RNA, 22 nt, Mycobacterium avium subsp. paratuberculosis
ucggugcccagcaccgccggcg

SEQ ID NO: 2968849 - RNA, 13 nt, Mycobacterium avium subsp. paratuberculosis
ucggugcccaggu

SEQ ID NO: 2968850 - RNA, 22 nt, Mycobacterium avium subsp. paratuberculosis
ucggugcccgggguccaccggc

SEQ ID NO: 2968851 - RNA, 20 nt, Mycobacterium avium subsp. paratuberculosis
ucggugcccuugguguaggc

SEQ ID NO: 2968852 - RNA, 23 nt, Mycobacterium avium subsp. paratuberculosis
ucggugccgaagcgccacggggc

SEQ ID NO: 2968853 - RNA, 16 nt, Mycobacterium avium subsp. paratuberculosis
ucggugccgagcacgc

SEQ ID NO: 2968854 - RNA, 21 nt, Mycobacterium avium subsp. paratuberculosis
ucggugccgucgaucgcccgc

SEQ ID NO: 2968855 - RNA, 23 nt, Mycobacterium avium subsp. paratuberculosis
ucggugccucuucgucggccggc

SEQ ID NO: 2968856 - RNA, 18 nt, Mycobacterium avium subsp. paratuberculosis
ucggugcgcaccccguug

SEQ ID NO: 2968857 - RNA, 21 nt, Mycobacterium avium subsp. paratuberculosis
ucggugcgcaccccguugccg

SEQ ID NO: 2968858 - RNA, 15 nt, Mycobacterium avium subsp. paratuberculosis
ucggugcgcauggcg

SEQ ID NO: 2968859 - RNA, 16 nt, Mycobacterium avium subsp. paratuberculosis
ucggugcgccagauca

SEQ ID NO: 2968860 - RNA, 23 nt, Mycobacterium avium subsp. paratuberculosis
ucggugcgccagaucagcguggu

SEQ ID NO: 2968861 - RNA, 15 nt, Mycobacterium avium subsp. paratuberculosis
ucggugcgcgccgca

SEQ ID NO: 2968862 - RNA, 19 nt, Mycobacterium avium subsp. paratuberculosis
ucggugcgcuccucgacgu

SEQ ID NO: 2968863 - RNA, 21 nt, Mycobacterium avium subsp. paratuberculosis
ucggugcggaaggcccccggc

SEQ ID NO: 2968864 - RNA, 15 nt, Mycobacterium avium subsp. paratuberculosis
ucgucacuucgccgg

SEQ ID NO: 2968865 - RNA, 12 nt, Mycobacterium avium subsp. paratuberculosis
ucgucagcagcg

SEQ ID NO: 2968866 - RNA, 13 nt, Mycobacterium avium subsp. paratuberculosis
ucgucagcagcga

SEQ ID NO: 2968867 - RNA, 16 nt, Mycobacterium avium subsp. paratuberculosis
ucgucagcgcgggcca

SEQ ID NO: 2968868 - RNA, 17 nt, Mycobacterium avium subsp. paratuberculosis
ucgucauccccuggccg

SEQ ID NO: 2968869 - RNA, 13 nt, Mycobacterium avium subsp. paratuberculosis
ucguccaccagcu

SEQ ID NO: 2968870 - RNA, 12 nt, Mycobacterium avium subsp. paratuberculosis
ucguccaccgac

SEQ ID NO: 2968871 - RNA, 14 nt, Mycobacterium avium subsp. paratuberculosis
ucguccacgcccag

SEQ ID NO: 2968872 - RNA, 15 nt, Mycobacterium avium subsp. paratuberculosis
ucguccacgcccagc

SEQ ID NO: 2968873 - RNA, 13 nt, Mycobacterium avium subsp. paratuberculosis
ucguccagcccga

SEQ ID NO: 2968874 - RNA, 22 nt, Mycobacterium avium subsp. paratuberculosis
ucguccagcgucgacugcaccg

SEQ ID NO: 2968875 - RNA, 18 nt, Mycobacterium avium subsp. paratuberculosis
ucguccagcgucgcggcc

SEQ ID NO: 2968876 - RNA, 17 nt, Mycobacterium avium subsp. paratuberculosis
ucguccagggacuccgg

SEQ ID NO: 2968877 - RNA, 17 nt, Mycobacterium avium subsp. paratuberculosis
ucguccaggguggccag

SEQ ID NO: 2968878 - RNA, 18 nt, Mycobacterium avium subsp. paratuberculosis
ucguccaggugcacccgc

SEQ ID NO: 2968879 - RNA, 22 nt, Mycobacterium avium subsp. paratuberculosis
ucguccaggugcacccgcggcg

SEQ ID NO: 2968880 - RNA, 20 nt, Mycobacterium avium subsp. paratuberculosis
ucguccauaccccccacgcu

SEQ ID NO: 2968881 - RNA, 14 nt, Mycobacterium avium subsp. paratuberculosis
ucguccauccgcuu

SEQ ID NO: 2968882 - RNA, 16 nt, Mycobacterium avium subsp. paratuberculosis
ucguccaucgcgucgu

SEQ ID NO: 2968883 - RNA, 19 nt, Mycobacterium avium subsp. paratuberculosis
ucguccaugcccgcccacg

SEQ ID NO: 2968884 - RNA, 15 nt, Mycobacterium avium subsp. paratuberculosis
ucgucccacggcggg

SEQ ID NO: 2968885 - RNA, 20 nt, Mycobacterium avium subsp. paratuberculosis
ucgucccagcgcaacggcgu

SEQ ID NO: 2968886 - RNA, 14 nt, Mycobacterium avium subsp. paratuberculosis
ucguccccuccccg

SEQ ID NO: 2968887 - RNA, 14 nt, Mycobacterium avium subsp. paratuberculosis
ucgucccggugaug

SEQ ID NO: 2968888 - RNA, 22 nt, Mycobacterium avium subsp. paratuberculosis
ucgucccggugaugacggggcg

SEQ ID NO: 2968889 - RNA, 14 nt, Mycobacterium avium subsp. paratuberculosis
ucgucccgucggcg

SEQ ID NO: 2968890 - RNA, 15 nt, Mycobacterium avium subsp. paratuberculosis
ucgucccgucggcgc

SEQ ID NO: 2968891 - RNA, 17 nt, Mycobacterium avium subsp. paratuberculosis
ucgucccgucggcgcga

SEQ ID NO: 2968892 - RNA, 16 nt, Mycobacterium avium subsp. paratuberculosis
ucguccgcaaccgccg

SEQ ID NO: 2968893 - RNA, 18 nt, Mycobacterium avium subsp. paratuberculosis
ucguccgcaaccgccggc

SEQ ID NO: 2968894 - RNA, 19 nt, Mycobacterium avium subsp. paratuberculosis
ucguccgcaaccgccggca

SEQ ID NO: 2968895 - RNA, 14 nt, Mycobacterium avium subsp. paratuberculosis
ucguccgcggcggc

SEQ ID NO: 2968896 - RNA, 15 nt, Mycobacterium avium subsp. paratuberculosis
ucguccgcggcggcg

SEQ ID NO: 2968897 - RNA, 16 nt, Mycobacterium avium subsp. paratuberculosis
ucguccggcgcgcagc

SEQ ID NO: 2968898 - RNA, 22 nt, Mycobacterium avium subsp. paratuberculosis
ucguccgguaggugaucgccuc

SEQ ID NO: 2968899 - RNA, 19 nt, Mycobacterium avium subsp. paratuberculosis
ucguccgugcugccggccg

SEQ ID NO: 2968900 - RNA, 13 nt, Mycobacterium avium subsp. paratuberculosis
ucguccucccggc

SEQ ID NO: 2968901 - RNA, 20 nt, Mycobacterium avium subsp. paratuberculosis
ucguccucccggccgacgau

SEQ ID NO: 2968902 - RNA, 18 nt, Mycobacterium avium subsp. paratuberculosis
ucguccucgaacaggcuc

SEQ ID NO: 2968903 - RNA, 15 nt, Mycobacterium avium subsp. paratuberculosis
ucguccucgaucacc

SEQ ID NO: 2968904 - RNA, 17 nt, Mycobacterium avium subsp. paratuberculosis
ucguccucgaucaccga

SEQ ID NO: 2968905 - RNA, 20 nt, Mycobacterium avium subsp. paratuberculosis
ucguccucgcgccguggccc

SEQ ID NO: 2968906 - RNA, 23 nt, Mycobacterium avium subsp. paratuberculosis
ucgucgaacaggaugcagccggc

SEQ ID NO: 2968907 - RNA, 20 nt, Mycobacterium avium subsp. paratuberculosis
ucgucgaacgcggcgaagca

SEQ ID NO: 2968908 - RNA, 22 nt, Mycobacterium avium subsp. paratuberculosis
ucgucgaacuccauccgccguc

SEQ ID NO: 2968909 - RNA, 18 nt, Mycobacterium avium subsp. paratuberculosis
ucgucgaacucgggcccg

SEQ ID NO: 2968910 - RNA, 15 nt, Mycobacterium avium subsp. paratuberculosis
ucgucgaacucgugg

SEQ ID NO: 2968911 - RNA, 22 nt, Mycobacterium avium subsp. paratuberculosis
ucgucgaagagcuggucgccca

SEQ ID NO: 2968912 - RNA, 16 nt, Mycobacterium avium subsp. paratuberculosis
ucgucgaaggucugca

SEQ ID NO: 2968913 - RNA, 20 nt, Mycobacterium avium subsp. paratuberculosis
ucgucgaaguagggccgcag

SEQ ID NO: 2968914 - RNA, 23 nt, Mycobacterium avium subsp. paratuberculosis
ucgucgaccagggcgaucaccgc

SEQ ID NO: 2968915 - RNA, 19 nt, Mycobacterium avium subsp. paratuberculosis
ucgucgacccgcuccccga

SEQ ID NO: 2968916 - RNA, 17 nt, Mycobacterium avium subsp. paratuberculosis
ucgucgaccgucacgcu

SEQ ID NO: 2968917 - RNA, 17 nt, Mycobacterium avium subsp. paratuberculosis
ucgucgacgauggcccg

SEQ ID NO: 2968918 - RNA, 23 nt, Mycobacterium avium subsp. paratuberculosis
ucgucgacgauggcccggaccgc

SEQ ID NO: 2968919 - RNA, 14 nt, Mycobacterium avium subsp. paratuberculosis
ucgucgacggccgc

SEQ ID NO: 2968920 - RNA, 13 nt, Mycobacterium avium subsp. paratuberculosis
ucgucgacggcgg

SEQ ID NO: 2968921 - RNA, 15 nt, Mycobacterium avium subsp. paratuberculosis
ucgucgacggcggcg

SEQ ID NO: 2968922 - RNA, 16 nt, Mycobacterium avium subsp. paratuberculosis
ucgucgacguccacgu

SEQ ID NO: 2968923 - RNA, 14 nt, Mycobacterium avium subsp. paratuberculosis
ucgucgacguccuc

SEQ ID NO: 2968924 - RNA, 15 nt, Mycobacterium avium subsp. paratuberculosis
ucgucgacgucggac

SEQ ID NO: 2968925 - RNA, 22 nt, Mycobacterium avium subsp. paratuberculosis
ucgucgacgucggacgcggccg

SEQ ID NO: 2968926 - RNA, 15 nt, Mycobacterium avium subsp. paratuberculosis
ucgucgacgucgggg

SEQ ID NO: 2968927 - RNA, 19 nt, Mycobacterium avium subsp. paratuberculosis
ucgucgagaagaccugguu

SEQ ID NO: 2968928 - RNA, 19 nt, Mycobacterium avium subsp. paratuberculosis
ucgucgagcaccacccggg

SEQ ID NO: 2968929 - RNA, 13 nt, Mycobacterium avium subsp. paratuberculosis
ucgucgagcaccg

SEQ ID NO: 2968930 - RNA, 15 nt, Mycobacterium avium subsp. paratuberculosis
ucgucgagcaccggc

SEQ ID NO: 2968931 - RNA, 17 nt, Mycobacterium avium subsp. paratuberculosis
ucgucgagcaccggcag

SEQ ID NO: 2968932 - RNA, 19 nt, Mycobacterium avium subsp. paratuberculosis
ucgucgagcagcgcccggc

SEQ ID NO: 2968933 - RNA, 20 nt, Mycobacterium avium subsp. paratuberculosis
ucgucgagcagcgcccggcg

SEQ ID NO: 2968934 - RNA, 16 nt, Mycobacterium avium subsp. paratuberculosis
ucgucgagcauccggc

SEQ ID NO: 2968935 - RNA, 14 nt, Mycobacterium avium subsp. paratuberculosis
ucgucgagccggcc

SEQ ID NO: 2968936 - RNA, 16 nt, Mycobacterium avium subsp. paratuberculosis
ucgucgagccggccgg

SEQ ID NO: 2968937 - RNA, 17 nt, Mycobacterium avium subsp. paratuberculosis
ucgucgagccggccgga

SEQ ID NO: 2968938 - RNA, 14 nt, Mycobacterium avium subsp. paratuberculosis
ucgucgagggccac

SEQ ID NO: 2968939 - RNA, 18 nt, Mycobacterium avium subsp. paratuberculosis
ucgucgagggccaccggc

SEQ ID NO: 2968940 - RNA, 21 nt, Mycobacterium avium subsp. paratuberculosis
ucgucgaguccguugggggcg

SEQ ID NO: 2968941 - RNA, 15 nt, Mycobacterium avium subsp. paratuberculosis
ucgucgagugcucga

SEQ ID NO: 2968942 - RNA, 17 nt, Mycobacterium avium subsp. paratuberculosis
ucgucgaguucgcggcg

SEQ ID NO: 2968943 - RNA, 20 nt, Mycobacterium avium subsp. paratuberculosis
ucgucgaguucgcggcgcag

SEQ ID NO: 2968944 - RNA, 22 nt, Mycobacterium avium subsp. paratuberculosis
ucgucgaguucgcggcgcagca

SEQ ID NO: 2968945 - RNA, 13 nt, Mycobacterium avium subsp. paratuberculosis
ucgucgaucaggg

SEQ ID NO: 2968946 - RNA, 15 nt, Mycobacterium avium subsp. paratuberculosis
ucgucgaucagggcg

SEQ ID NO: 2968947 - RNA, 12 nt, Mycobacterium avium subsp. paratuberculosis
ucgucgaucgac

SEQ ID NO: 2968948 - RNA, 17 nt, Mycobacterium avium subsp. paratuberculosis
ucgucgaucgcggcgau

SEQ ID NO: 2968949 - RNA, 20 nt, Mycobacterium avium subsp. paratuberculosis
ucgucgggccgcagcacggc

SEQ ID NO: 2968950 - RNA, 16 nt, Mycobacterium avium subsp. paratuberculosis
ucgucgggcgccagcc

SEQ ID NO: 2968951 - RNA, 19 nt, Mycobacterium avium subsp. paratuberculosis
ucgucgggcgccagcccgc

SEQ ID NO: 2968952 - RNA, 19 nt, Mycobacterium avium subsp. paratuberculosis
ucgucggggaucagcgucg

SEQ ID NO: 2968953 - RNA, 20 nt, Mycobacterium avium subsp. paratuberculosis
ucgucggggaucagcgucgc

SEQ ID NO: 2968954 - RNA, 12 nt, Mycobacterium avium subsp. paratuberculosis
ucgucggggcug

SEQ ID NO: 2968955 - RNA, 18 nt, Mycobacterium avium subsp. paratuberculosis
ucgucggggcuggcggcg

SEQ ID NO: 2968956 - RNA, 12 nt, Mycobacterium avium subsp. paratuberculosis
ucgucggucagg

SEQ ID NO: 2968957 - RNA, 23 nt, Mycobacterium avium subsp. paratuberculosis
ucgucggucaggaacgcggacag

SEQ ID NO: 2968958 - RNA, 17 nt, Mycobacterium avium subsp. paratuberculosis
ucgucggucaggccggc

SEQ ID NO: 2968959 - RNA, 21 nt, Mycobacterium avium subsp. paratuberculosis
ucgucggucaggccggcgccg

SEQ ID NO: 2968960 - RNA, 16 nt, Mycobacterium avium subsp. paratuberculosis
ucgucggucugcaggu

SEQ ID NO: 2968961 - RNA, 18 nt, Mycobacterium avium subsp. paratuberculosis
ucgucggugaacgccggu

SEQ ID NO: 2968962 - RNA, 16 nt, Mycobacterium avium subsp. paratuberculosis
ucgucggugggccgcc

SEQ ID NO: 2968963 - RNA, 22 nt, Mycobacterium avium subsp. paratuberculosis
ucgucggugggccgccgcggcg

SEQ ID NO: 2968964 - RNA, 17 nt, Mycobacterium avium subsp. paratuberculosis
ucgucguagucgaggcc

SEQ ID NO: 2968965 - RNA, 23 nt, Mycobacterium avium subsp. paratuberculosis
ucgucguccgcaaccgccggcag

SEQ ID NO: 2968966 - RNA, 14 nt, Mycobacterium avium subsp. paratuberculosis
ucgucgucgacgcu

SEQ ID NO: 2968967 - RNA, 17 nt, Mycobacterium avium subsp. paratuberculosis
ucgucgucgagcacgaa

SEQ ID NO: 2968968 - RNA, 18 nt, Mycobacterium avium subsp. paratuberculosis
ucgucgucgagccgcucg

SEQ ID NO: 2968969 - RNA, 13 nt, Mycobacterium avium subsp. paratuberculosis
ucgucgucgccga

SEQ ID NO: 2968970 - RNA, 13 nt, Mycobacterium avium subsp. paratuberculosis
ucgucgucgccgc

SEQ ID NO: 2968971 - RNA, 16 nt, Mycobacterium avium subsp. paratuberculosis
ucgucgucgccgccgg

SEQ ID NO: 2968972 - RNA, 15 nt, Mycobacterium avium subsp. paratuberculosis
ucgucgucgccgcgc

SEQ ID NO: 2968973 - RNA, 21 nt, Mycobacterium avium subsp. paratuberculosis
ucgucgucgcgcaggucgggc

SEQ ID NO: 2968974 - RNA, 15 nt, Mycobacterium avium subsp. paratuberculosis
ucgucgucggagacg

SEQ ID NO: 2968975 - RNA, 15 nt, Mycobacterium avium subsp. paratuberculosis
ucgucgucggccggg

SEQ ID NO: 2968976 - RNA, 18 nt, Mycobacterium avium subsp. paratuberculosis
ucgucgucggccgggccg

SEQ ID NO: 2968977 - RNA, 16 nt, Mycobacterium avium subsp. paratuberculosis
ucgucgucggcgacga

SEQ ID NO: 2968978 - RNA, 16 nt, Mycobacterium avium subsp. paratuberculosis
ucgucgucggugaacg

SEQ ID NO: 2968979 - RNA, 20 nt, Mycobacterium avium subsp. paratuberculosis
ucgucgucggugaacgccgg

SEQ ID NO: 2968980 - RNA, 16 nt, Mycobacterium avium subsp. paratuberculosis
ucgucgucgucgagca

SEQ ID NO: 2968981 - RNA, 15 nt, Mycobacterium avium subsp. paratuberculosis
ucgucgugcaccacg

SEQ ID NO: 2968982 - RNA, 17 nt, Mycobacterium avium subsp. paratuberculosis
ucgucgugcgcgggcga

SEQ ID NO: 2968983 - RNA, 22 nt, Mycobacterium avium subsp. paratuberculosis
ucgucgugggugacccggccgu

SEQ ID NO: 2968984 - RNA, 14 nt, Mycobacterium avium subsp. paratuberculosis
ucgucguggugacg

SEQ ID NO: 2968985 - RNA, 15 nt, Mycobacterium avium subsp. paratuberculosis
ucgucguucucgggg

SEQ ID NO: 2968986 - RNA, 20 nt, Mycobacterium avium subsp. paratuberculosis
ucgucguuguuggcggcggu

SEQ ID NO: 2968987 - RNA, 15 nt, Mycobacterium avium subsp. paratuberculosis
ucgucuacuccacca

SEQ ID NO: 2968988 - RNA, 16 nt, Mycobacterium avium subsp. paratuberculosis
ucgucuccggcggcag

SEQ ID NO: 2968989 - RNA, 18 nt, Mycobacterium avium subsp. paratuberculosis
ucgucucggaccgguagg

SEQ ID NO: 2968990 - RNA, 15 nt, Mycobacterium avium subsp. paratuberculosis
ucgucucggccgcgg

SEQ ID NO: 2968991 - RNA, 19 nt, Mycobacterium avium subsp. paratuberculosis
ucgucucggccgcggugcg

SEQ ID NO: 2968992 - RNA, 17 nt, Mycobacterium avium subsp. paratuberculosis
ucgucucuuccucgggc

SEQ ID NO: 2968993 - RNA, 14 nt, Mycobacterium avium subsp. paratuberculosis
ucgucuguggaucg

SEQ ID NO: 2968994 - RNA, 15 nt, Mycobacterium avium subsp. paratuberculosis
ucgucuuccgcggcg

SEQ ID NO: 2968995 - RNA, 15 nt, Mycobacterium avium subsp. paratuberculosis
ucgucuucuuggccg

SEQ ID NO: 2968996 - RNA, 15 nt, Mycobacterium avium subsp. paratuberculosis
ucgucuugaccgccc

SEQ ID NO: 2968997 - RNA, 18 nt, Mycobacterium avium subsp. paratuberculosis
ucgucuugaccgcccggg

SEQ ID NO: 2968998 - RNA, 14 nt, Mycobacterium avium subsp. paratuberculosis
ucgugaaacauggc

SEQ ID NO: 2968999 - RNA, 15 nt, Mycobacterium avium subsp. paratuberculosis
ucgugaaacauggcg

SEQ ID NO: 2969000 - RNA, 18 nt, Mycobacterium avium subsp. paratuberculosis
ucgugaagaucagcgaag

SEQ ID NO: 2969001 - RNA, 15 nt, Mycobacterium avium subsp. paratuberculosis
ucgugaagccggugg

SEQ ID NO: 2969002 - RNA, 17 nt, Mycobacterium avium subsp. paratuberculosis
ucgugaccgaccuccaa

SEQ ID NO: 2969003 - RNA, 14 nt, Mycobacterium avium subsp. paratuberculosis
ucgugaccggcggu

SEQ ID NO: 2969004 - RNA, 15 nt, Mycobacterium avium subsp. paratuberculosis
ucgugaccggcggug

SEQ ID NO: 2969005 - RNA, 12 nt, Mycobacterium avium subsp. paratuberculosis
ucgugacgcggc

SEQ ID NO: 2969006 - RNA, 13 nt, Mycobacterium avium subsp. paratuberculosis
ucgugacgcggcg

SEQ ID NO: 2969007 - RNA, 17 nt, Mycobacterium avium subsp. paratuberculosis
ucgugagcgguggccac

SEQ ID NO: 2969008 - RNA, 13 nt, Mycobacterium avium subsp. paratuberculosis
ucgugaucgccca

SEQ ID NO: 2969009 - RNA, 18 nt, Mycobacterium avium subsp. paratuberculosis
ucgugauggcgaaccagc

SEQ ID NO: 2969010 - RNA, 16 nt, Mycobacterium avium subsp. paratuberculosis
ucgugaugguccagca

SEQ ID NO: 2969011 - RNA, 20 nt, Mycobacterium avium subsp. paratuberculosis
ucgugaugguccagcaccgg

SEQ ID NO: 2969012 - RNA, 19 nt, Mycobacterium avium subsp. paratuberculosis
ucgugcaaaccggaccgcc

SEQ ID NO: 2969013 - RNA, 19 nt, Mycobacterium avium subsp. paratuberculosis
ucgugcaaccuuggucugc

SEQ ID NO: 2969014 - RNA, 16 nt, Mycobacterium avium subsp. paratuberculosis
ucgugcaacucccgcg

SEQ ID NO: 2969015 - RNA, 15 nt, Mycobacterium avium subsp. paratuberculosis
ucgugcaaggccugc

SEQ ID NO: 2969016 - RNA, 14 nt, Mycobacterium avium subsp. paratuberculosis
ucgugcaccacgac

SEQ ID NO: 2969017 - RNA, 19 nt, Mycobacterium avium subsp. paratuberculosis
ucgugcaccuuggucagcu

SEQ ID NO: 2969018 - RNA, 14 nt, Mycobacterium avium subsp. paratuberculosis
ucgugcacgccgug

SEQ ID NO: 2969019 - RNA, 20 nt, Mycobacterium avium subsp. paratuberculosis
ucgugcacgccguggcggcg

SEQ ID NO: 2969020 - RNA, 23 nt, Mycobacterium avium subsp. paratuberculosis
ucgugcacgccguggcggcgggc

SEQ ID NO: 2969021 - RNA, 14 nt, Mycobacterium avium subsp. paratuberculosis
ucgugcagcaccgc

SEQ ID NO: 2969022 - RNA, 19 nt, Mycobacterium avium subsp. paratuberculosis
ucgugcagcaccgccagca

SEQ ID NO: 2969023 - RNA, 16 nt, Mycobacterium avium subsp. paratuberculosis
ucgugcagugcgaucg

SEQ ID NO: 2969024 - RNA, 15 nt, Mycobacterium avium subsp. paratuberculosis
ucgugcaucggcgcc

SEQ ID NO: 2969025 - RNA, 19 nt, Mycobacterium avium subsp. paratuberculosis
ucgugcauucaggucaccg

SEQ ID NO: 2969026 - RNA, 14 nt, Mycobacterium avium subsp. paratuberculosis
ucgugccagcgcag

SEQ ID NO: 2969027 - RNA, 18 nt, Mycobacterium avium subsp. paratuberculosis
ucgugccgagcgugaagc

SEQ ID NO: 2969028 - RNA, 15 nt, Mycobacterium avium subsp. paratuberculosis
ucgugccgcacccga

SEQ ID NO: 2969029 - RNA, 23 nt, Mycobacterium avium subsp. paratuberculosis
ucgugccgcacccgauccacggc

SEQ ID NO: 2969030 - RNA, 18 nt, Mycobacterium avium subsp. paratuberculosis
ucgugccgggugaugcag

SEQ ID NO: 2969031 - RNA, 15 nt, Mycobacterium avium subsp. paratuberculosis
ucgugcgcccauccg

SEQ ID NO: 2969032 - RNA, 21 nt, Mycobacterium avium subsp. paratuberculosis
ucgugcgcccauccggcgccg

SEQ ID NO: 2969033 - RNA, 15 nt, Mycobacterium avium subsp. paratuberculosis
ucgugcggccggcgc

SEQ ID NO: 2969034 - RNA, 17 nt, Mycobacterium avium subsp. paratuberculosis
ucuccaggcucgacaac

SEQ ID NO: 2969035 - RNA, 24 nt, Mycobacterium avium subsp. paratuberculosis
ucuccaucccgcugaagccgaacg

SEQ ID NO: 2969036 - RNA, 16 nt, Mycobacterium avium subsp. paratuberculosis
ucuccauccgggcggc

SEQ ID NO: 2969037 - RNA, 14 nt, Mycobacterium avium subsp. paratuberculosis
ucuccccgccggag

SEQ ID NO: 2969038 - RNA, 13 nt, Mycobacterium avium subsp. paratuberculosis
ucucccgcggcag

SEQ ID NO: 2969039 - RNA, 14 nt, Mycobacterium avium subsp. paratuberculosis
ucucccgcggcagc

SEQ ID NO: 2969040 - RNA, 16 nt, Mycobacterium avium subsp. paratuberculosis
ucuccgaggcguccuc

SEQ ID NO: 2969041 - RNA, 15 nt, Mycobacterium avium subsp. paratuberculosis
ucuccgagucggcgu

SEQ ID NO: 2969042 - RNA, 13 nt, Mycobacterium avium subsp. paratuberculosis
ucuccgccggcag

SEQ ID NO: 2969043 - RNA, 14 nt, Mycobacterium avium subsp. paratuberculosis
ucuccgccgggcug

SEQ ID NO: 2969044 - RNA, 17 nt, Mycobacterium avium subsp. paratuberculosis
ucuccgccuucgacgau

SEQ ID NO: 2969045 - RNA, 12 nt, Mycobacterium avium subsp. paratuberculosis
ucuccggcccgc

SEQ ID NO: 2969046 - RNA, 13 nt, Mycobacterium avium subsp. paratuberculosis
ucuccggcccgcu

SEQ ID NO: 2969047 - RNA, 19 nt, Mycobacterium avium subsp. paratuberculosis
ucuccggcgcgguugcccg

SEQ ID NO: 2969048 - RNA, 12 nt, Mycobacterium avium subsp. paratuberculosis
ucuccggcgggc

SEQ ID NO: 2969049 - RNA, 22 nt, Mycobacterium avium subsp. paratuberculosis
ucuccggcgggcuggugcgcag

SEQ ID NO: 2969050 - RNA, 15 nt, Mycobacterium avium subsp. paratuberculosis
ucuccguggacggcg

SEQ ID NO: 2969051 - RNA, 17 nt, Mycobacterium avium subsp. paratuberculosis
ucuccguggacggcgag

SEQ ID NO: 2969052 - RNA, 20 nt, Mycobacterium avium subsp. paratuberculosis
ucuccguggacggcgagcgg

SEQ ID NO: 2969053 - RNA, 15 nt, Mycobacterium avium subsp. paratuberculosis
ucucgaaccgggcgg

SEQ ID NO: 2969054 - RNA, 15 nt, Mycobacterium avium subsp. paratuberculosis
ucucgaacggcccgg

SEQ ID NO: 2969055 - RNA, 18 nt, Mycobacterium avium subsp. paratuberculosis
ucucgaagaaggcgugcg

SEQ ID NO: 2969056 - RNA, 21 nt, Mycobacterium avium subsp. paratuberculosis
ucucgaagcgacaaaggaggg

SEQ ID NO: 2969057 - RNA, 14 nt, Mycobacterium avium subsp. paratuberculosis
ucucgaagcgcagc

SEQ ID NO: 2969058 - RNA, 16 nt, Mycobacterium avium subsp. paratuberculosis
ucucgaagcgcagcag

SEQ ID NO: 2969059 - RNA, 19 nt, Mycobacterium avium subsp. paratuberculosis
ucucgaagcgcagcagcuc

SEQ ID NO: 2969060 - RNA, 23 nt, Mycobacterium avium subsp. paratuberculosis
ucucgaagcgcagcagcucgucg

SEQ ID NO: 2969061 - RNA, 16 nt, Mycobacterium avium subsp. paratuberculosis
ucucgaccaagaacca

SEQ ID NO: 2969062 - RNA, 24 nt, Mycobacterium avium subsp. paratuberculosis
ucucgaccaggccguuguccgucg

SEQ ID NO: 2969063 - RNA, 18 nt, Mycobacterium avium subsp. paratuberculosis
ucucgacccgggccagca

SEQ ID NO: 2969064 - RNA, 19 nt, Mycobacterium avium subsp. paratuberculosis
ucucgacccgggccagcag

SEQ ID NO: 2969065 - RNA, 17 nt, Mycobacterium avium subsp. paratuberculosis
ucucgacccgggccagg

SEQ ID NO: 2969066 - RNA, 20 nt, Mycobacterium avium subsp. paratuberculosis
ucucgaccgcggcgccgaug

SEQ ID NO: 2969067 - RNA, 20 nt, Mycobacterium avium subsp. paratuberculosis
ucucgaccucgucggcggcg

SEQ ID NO: 2969068 - RNA, 19 nt, Mycobacterium avium subsp. paratuberculosis
ucucgacggcgccgacgau

SEQ ID NO: 2969069 - RNA, 19 nt, Mycobacterium avium subsp. paratuberculosis
ucucgagcaggaacagaca

SEQ ID NO: 2969070 - RNA, 13 nt, Mycobacterium avium subsp. paratuberculosis
ucucgagccggcg

SEQ ID NO: 2969071 - RNA, 22 nt, Mycobacterium avium subsp. paratuberculosis
ucucgaucgacgacgccagcug

SEQ ID NO: 2969072 - RNA, 17 nt, Mycobacterium avium subsp. paratuberculosis
ucucgaucuccaucccg

SEQ ID NO: 2969073 - RNA, 20 nt, Mycobacterium avium subsp. paratuberculosis
ucucgaugacccaccagccg

SEQ ID NO: 2969074 - RNA, 22 nt, Mycobacterium avium subsp. paratuberculosis
ucucgaugacccaccagccgag

SEQ ID NO: 2969075 - RNA, 14 nt, Mycobacterium avium subsp. paratuberculosis
ucucgauggccacg

SEQ ID NO: 2969076 - RNA, 17 nt, Mycobacterium avium subsp. paratuberculosis
ucucgauggucgccuug

SEQ ID NO: 2969077 - RNA, 13 nt, Mycobacterium avium subsp. paratuberculosis
ucucgcacccggu

SEQ ID NO: 2969078 - RNA, 17 nt, Mycobacterium avium subsp. paratuberculosis
ucucgcaccugccgucg

SEQ ID NO: 2969079 - RNA, 13 nt, Mycobacterium avium subsp. paratuberculosis
ucucgcccaccuu

SEQ ID NO: 2969080 - RNA, 20 nt, Mycobacterium avium subsp. paratuberculosis
ucucgcccaccuuggcgucg

SEQ ID NO: 2969081 - RNA, 13 nt, Mycobacterium avium subsp. paratuberculosis
ucucgccccggcc

SEQ ID NO: 2969082 - RNA, 19 nt, Mycobacterium avium subsp. paratuberculosis
ucucgcccggcuccacgau

SEQ ID NO: 2969083 - RNA, 18 nt, Mycobacterium avium subsp. paratuberculosis
ucucgccgagcacaccgu

SEQ ID NO: 2969084 - RNA, 20 nt, Mycobacterium avium subsp. paratuberculosis
ucucgccgagcacaccgucg

SEQ ID NO: 2969085 - RNA, 17 nt, Mycobacterium avium subsp. paratuberculosis
ucucgccggggaacacc

SEQ ID NO: 2969086 - RNA, 20 nt, Mycobacterium avium subsp. paratuberculosis
ucucgccggggaacaccggc

SEQ ID NO: 2969087 - RNA, 15 nt, Mycobacterium avium subsp. paratuberculosis
ucucgccggucagca

SEQ ID NO: 2969088 - RNA, 16 nt, Mycobacterium avium subsp. paratuberculosis
ucucgccggucagcac

SEQ ID NO: 2969089 - RNA, 20 nt, Mycobacterium avium subsp. paratuberculosis
ucucgccggucagcacgucg

SEQ ID NO: 2969090 - RNA, 21 nt, Mycobacterium avium subsp. paratuberculosis
ucucgccguacuugacgugcg

SEQ ID NO: 2969091 - RNA, 17 nt, Mycobacterium avium subsp. paratuberculosis
ucucgcucugccgggcc

SEQ ID NO: 2969092 - RNA, 18 nt, Mycobacterium avium subsp. paratuberculosis
ucucgcucugccgggccg

SEQ ID NO: 2969093 - RNA, 24 nt, Mycobacterium avium subsp. paratuberculosis
ucucgcugcucugcgcgcggugca

SEQ ID NO: 2969094 - RNA, 15 nt, Mycobacterium avium subsp. paratuberculosis
ucucggacgcccguc

SEQ ID NO: 2969095 - RNA, 12 nt, Mycobacterium avium subsp. paratuberculosis
ucucggccagcc

SEQ ID NO: 2969096 - RNA, 13 nt, Mycobacterium avium subsp. paratuberculosis
ucucggccagccg

SEQ ID NO: 2969097 - RNA, 13 nt, Mycobacterium avium subsp. paratuberculosis
ucucggccggaag

SEQ ID NO: 2969098 - RNA, 14 nt, Mycobacterium avium subsp. paratuberculosis
ucucggcgccgucg

SEQ ID NO: 2969099 - RNA, 14 nt, Mycobacterium avium subsp. paratuberculosis
ucucggcggccgcg

SEQ ID NO: 2969100 - RNA, 17 nt, Mycobacterium avium subsp. paratuberculosis
ucucggcggucugucgc

SEQ ID NO: 2969101 - RNA, 14 nt, Mycobacterium avium subsp. paratuberculosis
ucucggcggucuuu

SEQ ID NO: 2969102 - RNA, 17 nt, Mycobacterium avium subsp. paratuberculosis
ucucggcguacagcccg

SEQ ID NO: 2969103 - RNA, 18 nt, Mycobacterium avium subsp. paratuberculosis
ucucggcguacagcccgc

SEQ ID NO: 2969104 - RNA, 15 nt, Mycobacterium avium subsp. paratuberculosis
ucucgggaucgccga

SEQ ID NO: 2969105 - RNA, 20 nt, Mycobacterium avium subsp. paratuberculosis
ucucgggaucgccgaagcgg

SEQ ID NO: 2969106 - RNA, 19 nt, Mycobacterium avium subsp. paratuberculosis
ucucgggcagcagcaccag

SEQ ID NO: 2969107 - RNA, 20 nt, Mycobacterium avium subsp. paratuberculosis
ucucgggcagcagcaccagc

SEQ ID NO: 2969108 - RNA, 21 nt, Mycobacterium avium subsp. paratuberculosis
ucucgggcagcagcaccagcg

SEQ ID NO: 2969109 - RNA, 15 nt, Mycobacterium avium subsp. paratuberculosis
ucucggucgccagca

SEQ ID NO: 2969110 - RNA, 17 nt, Mycobacterium avium subsp. paratuberculosis
ucucggucgccagcacc

SEQ ID NO: 2969111 - RNA, 19 nt, Mycobacterium avium subsp. paratuberculosis
ucucggucgccagcaccgu

SEQ ID NO: 2969112 - RNA, 20 nt, Mycobacterium avium subsp. paratuberculosis
ucucggucgccagcaccgug

SEQ ID NO: 2969113 - RNA, 14 nt, Mycobacterium avium subsp. paratuberculosis
ucucggucgcggcg

SEQ ID NO: 2969114 - RNA, 14 nt, Mycobacterium avium subsp. paratuberculosis
ucucggugccgucg

SEQ ID NO: 2969115 - RNA, 22 nt, Mycobacterium avium subsp. paratuberculosis
ucucgguggggacgugcacgcg

SEQ ID NO: 2969116 - RNA, 16 nt, Mycobacterium avium subsp. paratuberculosis
ucucgguuuccacguc

SEQ ID NO: 2969117 - RNA, 18 nt, Mycobacterium avium subsp. paratuberculosis
ucucgguuuccacgucgc

SEQ ID NO: 2969118 - RNA, 21 nt, Mycobacterium avium subsp. paratuberculosis
ucucgguuuccacgucgcgau

SEQ ID NO: 2969119 - RNA, 12 nt, Mycobacterium avium subsp. paratuberculosis
ucuggcccuggc

SEQ ID NO: 2969120 - RNA, 14 nt, Mycobacterium avium subsp. paratuberculosis
ucuggcccuggcag

SEQ ID NO: 2969121 - RNA, 21 nt, Mycobacterium avium subsp. paratuberculosis
ucuggcccuggcaggugagcc

SEQ ID NO: 2969122 - RNA, 12 nt, Mycobacterium avium subsp. paratuberculosis
ucuggccgaccg

SEQ ID NO: 2969123 - RNA, 22 nt, Mycobacterium avium subsp. paratuberculosis
ucuggccgaccgccgccauccg

SEQ ID NO: 2969124 - RNA, 17 nt, Mycobacterium avium subsp. paratuberculosis
ucuggccgaucuugucg

SEQ ID NO: 2969125 - RNA, 16 nt, Mycobacterium avium subsp. paratuberculosis
ucuggccggagcggug

SEQ ID NO: 2969126 - RNA, 18 nt, Mycobacterium avium subsp. paratuberculosis
ucuggccuugcagcccgc

SEQ ID NO: 2969127 - RNA, 20 nt, Mycobacterium avium subsp. paratuberculosis
ucuggcgcagcgucaacggc

SEQ ID NO: 2969128 - RNA, 22 nt, Mycobacterium avium subsp. paratuberculosis
ucuggcggguguucagccccuc

SEQ ID NO: 2969129 - RNA, 14 nt, Mycobacterium avium subsp. paratuberculosis
ucuggcucggcacc

SEQ ID NO: 2969130 - RNA, 17 nt, Mycobacterium avium subsp. paratuberculosis
ucuggcuggugaccccg

SEQ ID NO: 2969131 - RNA, 20 nt, Mycobacterium avium subsp. paratuberculosis
ucugggaucggugcgcggcg

SEQ ID NO: 2969132 - RNA, 16 nt, Mycobacterium avium subsp. paratuberculosis
ucugggccgccaacgg

SEQ ID NO: 2969133 - RNA, 16 nt, Mycobacterium avium subsp. paratuberculosis
ucugggccgccgagca

SEQ ID NO: 2969134 - RNA, 23 nt, Mycobacterium avium subsp. paratuberculosis
ucugggcgaccaugccgcgggcc

SEQ ID NO: 2969135 - RNA, 14 nt, Mycobacterium avium subsp. paratuberculosis
ucugggcggcggga

SEQ ID NO: 2969136 - RNA, 14 nt, Mycobacterium avium subsp. paratuberculosis
ucugggcgggcucg

SEQ ID NO: 2969137 - RNA, 17 nt, Mycobacterium avium subsp. paratuberculosis
ucugggcgggcucgagc

SEQ ID NO: 2969138 - RNA, 19 nt, Mycobacterium avium subsp. paratuberculosis
ucugggcgggcucgagccc

SEQ ID NO: 2969139 - RNA, 17 nt, Mycobacterium avium subsp. paratuberculosis
ucugggugagcgacacc

SEQ ID NO: 2969140 - RNA, 14 nt, Mycobacterium avium subsp. paratuberculosis
ucugggugccgcgg

SEQ ID NO: 2969141 - RNA, 13 nt, Mycobacterium avium subsp. paratuberculosis
ucugguaggcggc

SEQ ID NO: 2969142 - RNA, 16 nt, Mycobacterium avium subsp. paratuberculosis
ucugguccagcgugcg

SEQ ID NO: 2969143 - RNA, 16 nt, Mycobacterium avium subsp. paratuberculosis
ucuggucggccagcgc

SEQ ID NO: 2969144 - RNA, 21 nt, Mycobacterium avium subsp. paratuberculosis
ucuggucggccagcgcgcgca

SEQ ID NO: 2969145 - RNA, 14 nt, Mycobacterium avium subsp. paratuberculosis
ucugguuccacagc

SEQ ID NO: 2969146 - RNA, 23 nt, Mycobacterium avium subsp. paratuberculosis
ucugguugaaccgguacaggccc

SEQ ID NO: 2969147 - RNA, 17 nt, Mycobacterium avium subsp. paratuberculosis
ucugguugacgccgaug

SEQ ID NO: 2969148 - RNA, 21 nt, Mycobacterium avium subsp. paratuberculosis
ucugguuuuacacaccagcgg

SEQ ID NO: 2969149 - RNA, 19 nt, Mycobacterium avium subsp. paratuberculosis
ucugucgcgcucagugcac

SEQ ID NO: 2969150 - RNA, 21 nt, Mycobacterium avium subsp. paratuberculosis
ucugucgcgcucagugcacgc

SEQ ID NO: 2969151 - RNA, 22 nt, Mycobacterium avium subsp. paratuberculosis
ucugucuucgcggucucucuaa

SEQ ID NO: 2969152 - RNA, 20 nt, Mycobacterium avium subsp. paratuberculosis
ucuguugcacguaggcggcg

SEQ ID NO: 2969153 - RNA, 17 nt, Mycobacterium avium subsp. paratuberculosis
ucuguugccggacaccu

SEQ ID NO: 2969154 - RNA, 16 nt, Mycobacterium avium subsp. paratuberculosis
ucuucagcgcgacagc

SEQ ID NO: 2969155 - RNA, 16 nt, Mycobacterium avium subsp. paratuberculosis
ucuucagggcggugcg

SEQ ID NO: 2969156 - RNA, 20 nt, Mycobacterium avium subsp. paratuberculosis
ucuucauaccgaaacggcag

SEQ ID NO: 2969157 - RNA, 23 nt, Mycobacterium avium subsp. paratuberculosis
ucuucaugugguugggccaggcc

SEQ ID NO: 2969158 - RNA, 15 nt, Mycobacterium avium subsp. paratuberculosis
ucuuccacgccggug

SEQ ID NO: 2969159 - RNA, 14 nt, Mycobacterium avium subsp. paratuberculosis
ucuucccgccgccg

SEQ ID NO: 2969160 - RNA, 17 nt, Mycobacterium avium subsp. paratuberculosis
ucuuccucgcuguccug

SEQ ID NO: 2969161 - RNA, 22 nt, Mycobacterium avium subsp. paratuberculosis
ucuucgacccgcauccgccggg

SEQ ID NO: 2969162 - RNA, 16 nt, Mycobacterium avium subsp. paratuberculosis
ucuucgacgauguugg

SEQ ID NO: 2969163 - RNA, 16 nt, Mycobacterium avium subsp. paratuberculosis
ucuucgaucaggcgca

SEQ ID NO: 2969164 - RNA, 15 nt, Mycobacterium avium subsp. paratuberculosis
ucuucgaugccggug

SEQ ID NO: 2969165 - RNA, 21 nt, Mycobacterium avium subsp. paratuberculosis
ucuucgccgcagccuucuugg

SEQ ID NO: 2969166 - RNA, 14 nt, Mycobacterium avium subsp. paratuberculosis
ucuucgccggacag

SEQ ID NO: 2969167 - RNA, 21 nt, Mycobacterium avium subsp. paratuberculosis
ucuucgccggggccuucuugg

SEQ ID NO: 2969168 - RNA, 18 nt, Mycobacterium avium subsp. paratuberculosis
ucuucgcgcgcggcgugg

SEQ ID NO: 2969169 - RNA, 13 nt, Mycobacterium avium subsp. paratuberculosis
ucuucgcugccgc

SEQ ID NO: 2969170 - RNA, 18 nt, Mycobacterium avium subsp. paratuberculosis
ucuucggcacgaagccga

SEQ ID NO: 2969171 - RNA, 15 nt, Mycobacterium avium subsp. paratuberculosis
ucuucggccaucgac

SEQ ID NO: 2969172 - RNA, 17 nt, Mycobacterium avium subsp. paratuberculosis
ucuucggcgccgagcgu

SEQ ID NO: 2969173 - RNA, 23 nt, Mycobacterium avium subsp. paratuberculosis
ucuucggcgccggcauccagcac

SEQ ID NO: 2969174 - RNA, 17 nt, Mycobacterium avium subsp. paratuberculosis
ucuucggcgcgccggcg

SEQ ID NO: 2969175 - RNA, 18 nt, Mycobacterium avium subsp. paratuberculosis
ucuucggggccgccgucg

SEQ ID NO: 2969176 - RNA, 15 nt, Mycobacterium avium subsp. paratuberculosis
ucuucuccaugguga

SEQ ID NO: 2969177 - RNA, 20 nt, Mycobacterium avium subsp. paratuberculosis
ucuucuccauggugaacugg

SEQ ID NO: 2969178 - RNA, 18 nt, Mycobacterium avium subsp. paratuberculosis
ucuucuccgcggccgcgc

SEQ ID NO: 2969179 - RNA, 18 nt, Mycobacterium avium subsp. paratuberculosis
ucuucucgaagcgcagca

SEQ ID NO: 2969180 - RNA, 21 nt, Mycobacterium avium subsp. paratuberculosis
ucuucucgaagcgcagcagcu

SEQ ID NO: 2969181 - RNA, 22 nt, Mycobacterium avium subsp. paratuberculosis
ucuucucgaagcgcagcagcuc

SEQ ID NO: 2969182 - RNA, 13 nt, Mycobacterium avium subsp. paratuberculosis
ucuucucgacgua

SEQ ID NO: 2969183 - RNA, 19 nt, Mycobacterium avium subsp. paratuberculosis
ucuucucgccguccccacc

SEQ ID NO: 2969184 - RNA, 22 nt, Mycobacterium avium subsp. paratuberculosis
ucuucucgcugcucugcgcgcg

SEQ ID NO: 2969185 - RNA, 18 nt, Mycobacterium avium subsp. paratuberculosis
ucuucucguucugcgugc

SEQ ID NO: 2969186 - RNA, 14 nt, Mycobacterium avium subsp. paratuberculosis
ucuucugcgcgaug

SEQ ID NO: 2969187 - RNA, 15 nt, Mycobacterium avium subsp. paratuberculosis
ucuucuuccugcuug

SEQ ID NO: 2969188 - RNA, 12 nt, Mycobacterium avium subsp. paratuberculosis
ucuucuuggccg

SEQ ID NO: 2969189 - RNA, 18 nt, Mycobacterium avium subsp. paratuberculosis
ucuugaccgcagccuucu

SEQ ID NO: 2969190 - RNA, 14 nt, Mycobacterium avium subsp. paratuberculosis
ucuugacggccgcg

SEQ ID NO: 2969191 - RNA, 16 nt, Mycobacterium avium subsp. paratuberculosis
ucuugaugucggggcg

SEQ ID NO: 2969192 - RNA, 12 nt, Mycobacterium avium subsp. paratuberculosis
ucuugcagccgg

SEQ ID NO: 2969193 - RNA, 17 nt, Mycobacterium avium subsp. paratuberculosis
ucuugcccagcggggcg

SEQ ID NO: 2969194 - RNA, 16 nt, Mycobacterium avium subsp. paratuberculosis
ucuugcccggcgagcg

SEQ ID NO: 2969195 - RNA, 14 nt, Mycobacterium avium subsp. paratuberculosis
ucuugcgcggcgcg

SEQ ID NO: 2969196 - RNA, 23 nt, Mycobacterium avium subsp. paratuberculosis
ucuugcgcggcgcgaagcccucg

SEQ ID NO: 2969197 - RNA, 19 nt, Mycobacterium avium subsp. paratuberculosis
ucuugcgggagaacaggua

SEQ ID NO: 2969198 - RNA, 20 nt, Mycobacterium avium subsp. paratuberculosis
ucuugcguuccucgacggcg

SEQ ID NO: 2969199 - RNA, 13 nt, Mycobacterium avium subsp. paratuberculosis
ucuugcugggugg

SEQ ID NO: 2969200 - RNA, 16 nt, Mycobacterium avium subsp. paratuberculosis
ucuuggacagcagcag

SEQ ID NO: 2969201 - RNA, 15 nt, Mycobacterium avium subsp. paratuberculosis
ucuuggccagcagcg

SEQ ID NO: 2969202 - RNA, 23 nt, Mycobacterium avium subsp. paratuberculosis
ucuuggccaggcccugccagcgc

SEQ ID NO: 2969203 - RNA, 12 nt, Mycobacterium avium subsp. paratuberculosis
ucuuggccgcgc

SEQ ID NO: 2969204 - RNA, 19 nt, Mycobacterium avium subsp. paratuberculosis
ugaagcuaguuucacgcuc

SEQ ID NO: 2969205 - RNA, 20 nt, Mycobacterium avium subsp. paratuberculosis
ugaagcuaguuucacgcucg

SEQ ID NO: 2969206 - RNA, 19 nt, Mycobacterium avium subsp. paratuberculosis
ugaagcuaguuucacguuc

SEQ ID NO: 2969207 - RNA, 13 nt, Mycobacterium avium subsp. paratuberculosis
ugaagcugccgac

SEQ ID NO: 2969208 - RNA, 16 nt, Mycobacterium avium subsp. paratuberculosis
ugaagcugccgaccag

SEQ ID NO: 2969209 - RNA, 15 nt, Mycobacterium avium subsp. paratuberculosis
ugaaggacuggccca

SEQ ID NO: 2969210 - RNA, 15 nt, Mycobacterium avium subsp. paratuberculosis
ugaaggaggcggucg

SEQ ID NO: 2969211 - RNA, 18 nt, Mycobacterium avium subsp. paratuberculosis
ugaaggccuggaugccgc

SEQ ID NO: 2969212 - RNA, 18 nt, Mycobacterium avium subsp. paratuberculosis
ugaaggcgaacaccagcc

SEQ ID NO: 2969213 - RNA, 20 nt, Mycobacterium avium subsp. paratuberculosis
ugaaggcgaacaccagcccg

SEQ ID NO: 2969214 - RNA, 23 nt, Mycobacterium avium subsp. paratuberculosis
ugaaggcgaacaccagcccggcc

SEQ ID NO: 2969215 - RNA, 13 nt, Mycobacterium avium subsp. paratuberculosis
ugaagggcccgcc

SEQ ID NO: 2969216 - RNA, 16 nt, Mycobacterium avium subsp. paratuberculosis
ugaaggucgcggacug

SEQ ID NO: 2969217 - RNA, 19 nt, Mycobacterium avium subsp. paratuberculosis
ugaaguaguacgaccgcga

SEQ ID NO: 2969218 - RNA, 16 nt, Mycobacterium avium subsp. paratuberculosis
ugaagucggugcccag

SEQ ID NO: 2969219 - RNA, 19 nt, Mycobacterium avium subsp. paratuberculosis
ugaaguuaacuucacgcuc

SEQ ID NO: 2969220 - RNA, 20 nt, Mycobacterium avium subsp. paratuberculosis
ugaaguuaacuucacgcucg

SEQ ID NO: 2969221 - RNA, 17 nt, Mycobacterium avium subsp. paratuberculosis
ugaauaccacugcgcgc

SEQ ID NO: 2969222 - RNA, 15 nt, Mycobacterium avium subsp. paratuberculosis
ugaaucccuccggca

SEQ ID NO: 2969223 - RNA, 16 nt, Mycobacterium avium subsp. paratuberculosis
ugaaucgguaaauuga

SEQ ID NO: 2969224 - RNA, 19 nt, Mycobacterium avium subsp. paratuberculosis
ugaaugucguagcggucgg

SEQ ID NO: 2969225 - RNA, 20 nt, Mycobacterium avium subsp. paratuberculosis
ugaauuccuggccggugcgg

SEQ ID NO: 2969226 - RNA, 15 nt, Mycobacterium avium subsp. paratuberculosis
ugaauucggccaccg

SEQ ID NO: 2969227 - RNA, 16 nt, Mycobacterium avium subsp. paratuberculosis
ugaauucggccaccga

SEQ ID NO: 2969228 - RNA, 17 nt, Mycobacterium avium subsp. paratuberculosis
ugaauucuguugucggc

SEQ ID NO: 2969229 - RNA, 21 nt, Mycobacterium avium subsp. paratuberculosis
ugaauugggcgaguacaccuc

SEQ ID NO: 2969230 - RNA, 22 nt, Mycobacterium avium subsp. paratuberculosis
ugacaaccaucgaggcgaucau

SEQ ID NO: 2969231 - RNA, 15 nt, Mycobacterium avium subsp. paratuberculosis
ugacaagccggcguc

SEQ ID NO: 2969232 - RNA, 12 nt, Mycobacterium avium subsp. paratuberculosis
ugacacagccaa

SEQ ID NO: 2969233 - RNA, 18 nt, Mycobacterium avium subsp. paratuberculosis
ugacaccgcggaccaccg

SEQ ID NO: 2969234 - RNA, 14 nt, Mycobacterium avium subsp. paratuberculosis
ugacacgaccgccu

SEQ ID NO: 2969235 - RNA, 15 nt, Mycobacterium avium subsp. paratuberculosis
ugacaggggcagcag

SEQ ID NO: 2969236 - RNA, 19 nt, Mycobacterium avium subsp. paratuberculosis
ugacauccccgguugucgc

SEQ ID NO: 2969237 - RNA, 16 nt, Mycobacterium avium subsp. paratuberculosis
ugacaucgccaccugg

SEQ ID NO: 2969238 - RNA, 21 nt, Mycobacterium avium subsp. paratuberculosis
ugacaugauggacuucgcagg

SEQ ID NO: 2969239 - RNA, 16 nt, Mycobacterium avium subsp. paratuberculosis
ugaccaacgccgccuc

SEQ ID NO: 2969240 - RNA, 18 nt, Mycobacterium avium subsp. paratuberculosis
ugaccaacgccgccuccg

SEQ ID NO: 2969241 - RNA, 16 nt, Mycobacterium avium subsp. paratuberculosis
ugaccaccagguaggc

SEQ ID NO: 2969242 - RNA, 13 nt, Mycobacterium avium subsp. paratuberculosis
ugaccaccgagcc

SEQ ID NO: 2969243 - RNA, 19 nt, Mycobacterium avium subsp. paratuberculosis
ugaccaccgagccgggcag

SEQ ID NO: 2969244 - RNA, 13 nt, Mycobacterium avium subsp. paratuberculosis
ugaccaccgcguc

SEQ ID NO: 2969245 - RNA, 14 nt, Mycobacterium avium subsp. paratuberculosis
ugaccaccgcgucg

SEQ ID NO: 2969246 - RNA, 11 nt, Mycobacterium avium subsp. paratuberculosis
ugaccaccggc

SEQ ID NO: 2969247 - RNA, 14 nt, Mycobacterium avium subsp. paratuberculosis
ugaccaccggcacc

SEQ ID NO: 2969248 - RNA, 16 nt, Mycobacterium avium subsp. paratuberculosis
ugaccaccggcaccac

SEQ ID NO: 2969249 - RNA, 20 nt, Mycobacterium avium subsp. paratuberculosis
ugaccaccuuggccggugcg

SEQ ID NO: 2969250 - RNA, 16 nt, Mycobacterium avium subsp. paratuberculosis
ugaccacgccgugccc

SEQ ID NO: 2969251 - RNA, 20 nt, Mycobacterium avium subsp. paratuberculosis
ugaccacgccgugcccggcg

SEQ ID NO: 2969252 - RNA, 17 nt, Mycobacterium avium subsp. paratuberculosis
ugaccacggcgcggaug

SEQ ID NO: 2969253 - RNA, 14 nt, Mycobacterium avium subsp. paratuberculosis
ugaccacggucggc

SEQ ID NO: 2969254 - RNA, 19 nt, Mycobacterium avium subsp. paratuberculosis
ugaccacggucggcgggua

SEQ ID NO: 2969255 - RNA, 20 nt, Mycobacterium avium subsp. paratuberculosis
ugaccagaccgaagaucacc

SEQ ID NO: 2969256 - RNA, 14 nt, Mycobacterium avium subsp. paratuberculosis
ugaccagcagcugg

SEQ ID NO: 2969257 - RNA, 20 nt, Mycobacterium avium subsp. paratuberculosis
ugaccagcccgcucagagcu

SEQ ID NO: 2969258 - RNA, 12 nt, Mycobacterium avium subsp. paratuberculosis
ugaccagcgccc

SEQ ID NO: 2969259 - RNA, 12 nt, Mycobacterium avium subsp. paratuberculosis
ugaccagcgccu

SEQ ID NO: 2969260 - RNA, 19 nt, Mycobacterium avium subsp. paratuberculosis
ugaccagcgcgaacagcgc

SEQ ID NO: 2969261 - RNA, 14 nt, Mycobacterium avium subsp. paratuberculosis
ugaccagcggcgcg

SEQ ID NO: 2969262 - RNA, 16 nt, Mycobacterium avium subsp. paratuberculosis
ugaccagcggcgcgcc

SEQ ID NO: 2969263 - RNA, 17 nt, Mycobacterium avium subsp. paratuberculosis
ugaccagcggcgcgccg

SEQ ID NO: 2969264 - RNA, 22 nt, Mycobacterium avium subsp. paratuberculosis
ugaccagcggcgcgccgggcag

SEQ ID NO: 2969265 - RNA, 14 nt, Mycobacterium avium subsp. paratuberculosis
ugaccagcgugacc

SEQ ID NO: 2969266 - RNA, 23 nt, Mycobacterium avium subsp. paratuberculosis
ugaccagcugcgaaucgucggcg

SEQ ID NO: 2969267 - RNA, 22 nt, Mycobacterium avium subsp. paratuberculosis
ugaccagcuugaagcccucguc

SEQ ID NO: 2969268 - RNA, 12 nt, Mycobacterium avium subsp. paratuberculosis
ugaccaggaugu

SEQ ID NO: 2969269 - RNA, 23 nt, Mycobacterium avium subsp. paratuberculosis
ugaccaggaugucuccgcgcagc

SEQ ID NO: 2969270 - RNA, 16 nt, Mycobacterium avium subsp. paratuberculosis
ugaccagggccucguc

SEQ ID NO: 2969271 - RNA, 17 nt, Mycobacterium avium subsp. paratuberculosis
ugaccaggguggucagc

SEQ ID NO: 2969272 - RNA, 21 nt, Mycobacterium avium subsp. paratuberculosis
ugaccaggguuccggucacgu

SEQ ID NO: 2969273 - RNA, 23 nt, Mycobacterium avium subsp. paratuberculosis
ugaccaucgggucgucggcgucg

SEQ ID NO: 2969274 - RNA, 14 nt, Mycobacterium avium subsp. paratuberculosis
ugaccaugacccac

SEQ ID NO: 2969275 - RNA, 17 nt, Mycobacterium avium subsp. paratuberculosis
ugaccaugacccacggg

SEQ ID NO: 2969276 - RNA, 18 nt, Mycobacterium avium subsp. paratuberculosis
ugaccaugaguugcgggu

SEQ ID NO: 2969277 - RNA, 23 nt, Mycobacterium avium subsp. paratuberculosis
ugaccaugucgacgcugagccgc

SEQ ID NO: 2969278 - RNA, 22 nt, Mycobacterium avium subsp. paratuberculosis
ugacccacggguuggggccgcg

SEQ ID NO: 2969279 - RNA, 21 nt, Mycobacterium avium subsp. paratuberculosis
ugacccaugccccaggugacg

SEQ ID NO: 2969280 - RNA, 18 nt, Mycobacterium avium subsp. paratuberculosis
ugaccccccgacgccgac

SEQ ID NO: 2969281 - RNA, 19 nt, Mycobacterium avium subsp. paratuberculosis
ugaccccgacggcgccgcg

SEQ ID NO: 2969282 - RNA, 12 nt, Mycobacterium avium subsp. paratuberculosis
ugacccgcccgg

SEQ ID NO: 2969283 - RNA, 13 nt, Mycobacterium avium subsp. paratuberculosis
ugacccgcccggg

SEQ ID NO: 2969284 - RNA, 15 nt, Mycobacterium avium subsp. paratuberculosis
ugacccgccgugacc

SEQ ID NO: 2969285 - RNA, 15 nt, Mycobacterium avium subsp. paratuberculosis
ugacccggcccauca

SEQ ID NO: 2969286 - RNA, 18 nt, Mycobacterium avium subsp. paratuberculosis
ugacccggcccaucaccg

SEQ ID NO: 2969287 - RNA, 20 nt, Mycobacterium avium subsp. paratuberculosis
ugacccggcccaucaccgga

SEQ ID NO: 2969288 - RNA, 23 nt, Mycobacterium avium subsp. paratuberculosis
ugacccggcccaucaccggaccg

SEQ ID NO: 2969289 - RNA, 18 nt, Mycobacterium avium subsp. paratuberculosis
ugacgaacccgccgcggc

SEQ ID NO: 2969290 - RNA, 20 nt, Mycobacterium avium subsp. paratuberculosis
ugacgaacccgccgcggccg

SEQ ID NO: 2969291 - RNA, 21 nt, Mycobacterium avium subsp. paratuberculosis
ugacgaacccgccgcggccga

SEQ ID NO: 2969292 - RNA, 15 nt, Mycobacterium avium subsp. paratuberculosis
ugacgaacgacgugu

SEQ ID NO: 2969293 - RNA, 15 nt, Mycobacterium avium subsp. paratuberculosis
ugacgaacgccacca

SEQ ID NO: 2969294 - RNA, 15 nt, Mycobacterium avium subsp. paratuberculosis
ugacgaacgcgccgc

SEQ ID NO: 2969295 - RNA, 16 nt, Mycobacterium avium subsp. paratuberculosis
ugacgaacgcgccgcc

SEQ ID NO: 2969296 - RNA, 19 nt, Mycobacterium avium subsp. paratuberculosis
ugacgaacgcgccgcccac

SEQ ID NO: 2969297 - RNA, 14 nt, Mycobacterium avium subsp. paratuberculosis
ugacgaccggcagc

SEQ ID NO: 2969298 - RNA, 15 nt, Mycobacterium avium subsp. paratuberculosis
ugacgaccggguccg

SEQ ID NO: 2969299 - RNA, 15 nt, Mycobacterium avium subsp. paratuberculosis
ugacgaccuggucgc

SEQ ID NO: 2969300 - RNA, 18 nt, Mycobacterium avium subsp. paratuberculosis
ugacgaccuggucgccgc

SEQ ID NO: 2969301 - RNA, 20 nt, Mycobacterium avium subsp. paratuberculosis
ugacgaccuggucgccgccg

SEQ ID NO: 2969302 - RNA, 15 nt, Mycobacterium avium subsp. paratuberculosis
ugacgaccuugucgc

SEQ ID NO: 2969303 - RNA, 20 nt, Mycobacterium avium subsp. paratuberculosis
ugacgaccuugucgcgcacc

SEQ ID NO: 2969304 - RNA, 21 nt, Mycobacterium avium subsp. paratuberculosis
ugacgaccuugucgcgcaccc

SEQ ID NO: 2969305 - RNA, 15 nt, Mycobacterium avium subsp. paratuberculosis
ugacgacggccaccg

SEQ ID NO: 2969306 - RNA, 18 nt, Mycobacterium avium subsp. paratuberculosis
ugacgacggucaccggca

SEQ ID NO: 2969307 - RNA, 22 nt, Mycobacterium avium subsp. paratuberculosis
ugacgacgugauaguggucguc

SEQ ID NO: 2969308 - RNA, 17 nt, Mycobacterium avium subsp. paratuberculosis
ugacgacguuggccagc

SEQ ID NO: 2969309 - RNA, 21 nt, Mycobacterium avium subsp. paratuberculosis
ugacgacguuggccagcaccg

SEQ ID NO: 2969310 - RNA, 23 nt, Mycobacterium avium subsp. paratuberculosis
ugacgacguuggccagcaccgcg

SEQ ID NO: 2969311 - RNA, 14 nt, Mycobacterium avium subsp. paratuberculosis
ugacgagcagcgug

SEQ ID NO: 2969312 - RNA, 22 nt, Mycobacterium avium subsp. paratuberculosis
ugacgaggagggugucggcggg

SEQ ID NO: 2969313 - RNA, 22 nt, Mycobacterium avium subsp. paratuberculosis
ugacgaguuccaccucgggccg

SEQ ID NO: 2969314 - RNA, 17 nt, Mycobacterium avium subsp. paratuberculosis
ugacgauccacagcgcg

SEQ ID NO: 2969315 - RNA, 23 nt, Mycobacterium avium subsp. paratuberculosis
ugacgaucuguaguugcaacccg

SEQ ID NO: 2969316 - RNA, 18 nt, Mycobacterium avium subsp. paratuberculosis
ugacgaugaugucgcccg

SEQ ID NO: 2969317 - RNA, 20 nt, Mycobacterium avium subsp. paratuberculosis
ugacgaugaugucgcccggc

SEQ ID NO: 2969318 - RNA, 22 nt, Mycobacterium avium subsp. paratuberculosis
ugacgaugaugucgcccggcgg

SEQ ID NO: 2969319 - RNA, 18 nt, Mycobacterium avium subsp. paratuberculosis
ugacgaugcggccggcgg

SEQ ID NO: 2969320 - RNA, 15 nt, Mycobacterium avium subsp. paratuberculosis
ugacgaugcugagca

SEQ ID NO: 2969321 - RNA, 19 nt, Mycobacterium avium subsp. paratuberculosis
ugacgauucuugaccaccu

SEQ ID NO: 2969322 - RNA, 22 nt, Mycobacterium avium subsp. paratuberculosis
ugacgcaccucgcucagcccgg

SEQ ID NO: 2969323 - RNA, 19 nt, Mycobacterium avium subsp. paratuberculosis
ugacgcccccggugacgau

SEQ ID NO: 2969324 - RNA, 21 nt, Mycobacterium avium subsp. paratuberculosis
ugacgcccccggugacgaucc

SEQ ID NO: 2969325 - RNA, 15 nt, Mycobacterium avium subsp. paratuberculosis
ugacgcccggcgccg

SEQ ID NO: 2969326 - RNA, 17 nt, Mycobacterium avium subsp. paratuberculosis
ugacgcccggcgccggc

SEQ ID NO: 2969327 - RNA, 19 nt, Mycobacterium avium subsp. paratuberculosis
ugacgcccgucccgccgac

SEQ ID NO: 2969328 - RNA, 16 nt, Mycobacterium avium subsp. paratuberculosis
ugacgcccuuguccuc

SEQ ID NO: 2969329 - RNA, 19 nt, Mycobacterium avium subsp. paratuberculosis
ugacgcccuuguccucgag

SEQ ID NO: 2969330 - RNA, 23 nt, Mycobacterium avium subsp. paratuberculosis
ugacgccgacguaggacagcacc

SEQ ID NO: 2969331 - RNA, 14 nt, Mycobacterium avium subsp. paratuberculosis
ugacgccgagcagc

SEQ ID NO: 2969332 - RNA, 18 nt, Mycobacterium avium subsp. paratuberculosis
ugacgccgaugugcucgg

SEQ ID NO: 2969333 - RNA, 13 nt, Mycobacterium avium subsp. paratuberculosis
ugacgccgcgccg

SEQ ID NO: 2969334 - RNA, 11 nt, Mycobacterium avium subsp. paratuberculosis
ugacgccgcgg

SEQ ID NO: 2969335 - RNA, 22 nt, Mycobacterium avium subsp. paratuberculosis
ugacgccgcgguuggucaccag

SEQ ID NO: 2969336 - RNA, 19 nt, Mycobacterium avium subsp. paratuberculosis
ugacgccgcucggccagcg

SEQ ID NO: 2969337 - RNA, 21 nt, Mycobacterium avium subsp. paratuberculosis
ugacgccgcuguccucgucgg

SEQ ID NO: 2969338 - RNA, 20 nt, Mycobacterium avium subsp. paratuberculosis
ugacgccggacagcuggcgg

SEQ ID NO: 2969339 - RNA, 13 nt, Mycobacterium avium subsp. paratuberculosis
ugacgccgggccg

SEQ ID NO: 2969340 - RNA, 17 nt, Mycobacterium avium subsp. paratuberculosis
ugacgccgggccgccgc

SEQ ID NO: 2969341 - RNA, 15 nt, Mycobacterium avium subsp. paratuberculosis
ugacgccguccgacg

SEQ ID NO: 2969342 - RNA, 19 nt, Mycobacterium avium subsp. paratuberculosis
ugacgccugcggcccagcg

SEQ ID NO: 2969343 - RNA, 22 nt, Mycobacterium avium subsp. paratuberculosis
ugacgcgaagucgccgcccggg

SEQ ID NO: 2969344 - RNA, 19 nt, Mycobacterium avium subsp. paratuberculosis
ugacgcgaaugucgaccac

SEQ ID NO: 2969345 - RNA, 21 nt, Mycobacterium avium subsp. paratuberculosis
ugacgcgaaugucgaccaccg

SEQ ID NO: 2969346 - RNA, 16 nt, Mycobacterium avium subsp. paratuberculosis
ugacgcgaccgcgcgg

SEQ ID NO: 2969347 - RNA, 17 nt, Mycobacterium avium subsp. paratuberculosis
ugacgcgaccgcgcggc

SEQ ID NO: 2969348 - RNA, 19 nt, Mycobacterium avium subsp. paratuberculosis
ugacgcgccggcccagacg

SEQ ID NO: 2969349 - RNA, 20 nt, Mycobacterium avium subsp. paratuberculosis
ugacgcgcgugacggcgggg

SEQ ID NO: 2969350 - RNA, 16 nt, Mycobacterium avium subsp. paratuberculosis
ugacgcggcgucgggc

SEQ ID NO: 2969351 - RNA, 17 nt, Mycobacterium avium subsp. paratuberculosis
ugacgcucgaggccccg

SEQ ID NO: 2969352 - RNA, 13 nt, Mycobacterium avium subsp. paratuberculosis
ugacgcucgccgg

SEQ ID NO: 2969353 - RNA, 14 nt, Mycobacterium avium subsp. paratuberculosis
ugacgcucgccggc

SEQ ID NO: 2969354 - RNA, 20 nt, Mycobacterium avium subsp. paratuberculosis
ugacgcucgccggcggccgc

SEQ ID NO: 2969355 - RNA, 22 nt, Mycobacterium avium subsp. paratuberculosis
ugacgcucgccggcggccgcca

SEQ ID NO: 2969356 - RNA, 21 nt, Mycobacterium avium subsp. paratuberculosis
ugacgcucgcgguugggccgc

SEQ ID NO: 2969357 - RNA, 14 nt, Mycobacterium avium subsp. paratuberculosis
ugacgcucggccgu

SEQ ID NO: 2969358 - RNA, 17 nt, Mycobacterium avium subsp. paratuberculosis
ugacgcucggccguggc

SEQ ID NO: 2969359 - RNA, 19 nt, Mycobacterium avium subsp. paratuberculosis
ugacgcucggccguggccg

SEQ ID NO: 2969360 - RNA, 17 nt, Mycobacterium avium subsp. paratuberculosis
ugacgcucggcgccggc

SEQ ID NO: 2969361 - RNA, 19 nt, Mycobacterium avium subsp. paratuberculosis
ugacgcucggcgccggccg

SEQ ID NO: 2969362 - RNA, 17 nt, Mycobacterium avium subsp. paratuberculosis
ugacgcucggcgcgucg

SEQ ID NO: 2969363 - RNA, 14 nt, Mycobacterium avium subsp. paratuberculosis
ugacgcucggcggc

SEQ ID NO: 2969364 - RNA, 12 nt, Mycobacterium avium subsp. paratuberculosis
ugacgcucgggg

SEQ ID NO: 2969365 - RNA, 15 nt, Mycobacterium avium subsp. paratuberculosis
ugacgcucggggccg

SEQ ID NO: 2969366 - RNA, 21 nt, Mycobacterium avium subsp. paratuberculosis
ugacgcucggucgccacggcc

SEQ ID NO: 2969367 - RNA, 14 nt, Mycobacterium avium subsp. paratuberculosis
ugacgcugccgcgc

SEQ ID NO: 2969368 - RNA, 17 nt, Mycobacterium avium subsp. paratuberculosis
ugacgcugccgcgccgc

SEQ ID NO: 2969369 - RNA, 14 nt, Mycobacterium avium subsp. paratuberculosis
ugacgcugggcggc

SEQ ID NO: 2969370 - RNA, 15 nt, Mycobacterium avium subsp. paratuberculosis
ugacgcugggcggcg

SEQ ID NO: 2969371 - RNA, 17 nt, Mycobacterium avium subsp. paratuberculosis
ugacggauguggucggc

SEQ ID NO: 2969372 - RNA, 13 nt, Mycobacterium avium subsp. paratuberculosis
ugacggccgcggc

SEQ ID NO: 2969373 - RNA, 17 nt, Mycobacterium avium subsp. paratuberculosis
ugagcagcccgaccacc

SEQ ID NO: 2969374 - RNA, 17 nt, Mycobacterium avium subsp. paratuberculosis
ugagcagcucgcggauc

SEQ ID NO: 2969375 - RNA, 14 nt, Mycobacterium avium subsp. paratuberculosis
ugagcagggccagc

SEQ ID NO: 2969376 - RNA, 17 nt, Mycobacterium avium subsp. paratuberculosis
ugagcaggucagccagg

SEQ ID NO: 2969377 - RNA, 19 nt, Mycobacterium avium subsp. paratuberculosis
ugagcauguugaacgccgc

SEQ ID NO: 2969378 - RNA, 19 nt, Mycobacterium avium subsp. paratuberculosis
ugagcauuggcgauggccu

SEQ ID NO: 2969379 - RNA, 13 nt, Mycobacterium avium subsp. paratuberculosis
ugagccacaacau

SEQ ID NO: 2969380 - RNA, 21 nt, Mycobacterium avium subsp. paratuberculosis
ugagcccccaccugaucgcgg

SEQ ID NO: 2969381 - RNA, 23 nt, Mycobacterium avium subsp. paratuberculosis
ugagcccccaccugaucgcggcg

SEQ ID NO: 2969382 - RNA, 13 nt, Mycobacterium avium subsp. paratuberculosis
ugagcccggaccg

SEQ ID NO: 2969383 - RNA, 17 nt, Mycobacterium avium subsp. paratuberculosis
ugagcccggaccggccg

SEQ ID NO: 2969384 - RNA, 20 nt, Mycobacterium avium subsp. paratuberculosis
ugagcccggaccggccgugc

SEQ ID NO: 2969385 - RNA, 13 nt, Mycobacterium avium subsp. paratuberculosis
ugagcccgggcag

SEQ ID NO: 2969386 - RNA, 17 nt, Mycobacterium avium subsp. paratuberculosis
ugagcccgucgacgucg

SEQ ID NO: 2969387 - RNA, 18 nt, Mycobacterium avium subsp. paratuberculosis
ugagccgccacagcgccu

SEQ ID NO: 2969388 - RNA, 15 nt, Mycobacterium avium subsp. paratuberculosis
ugagccgccgagccg

SEQ ID NO: 2969389 - RNA, 21 nt, Mycobacterium avium subsp. paratuberculosis
ugagccgccgagccggcacgg

SEQ ID NO: 2969390 - RNA, 14 nt, Mycobacterium avium subsp. paratuberculosis
ugagccgccgcggc

SEQ ID NO: 2969391 - RNA, 11 nt, Mycobacterium avium subsp. paratuberculosis
ugagccgccgg

SEQ ID NO: 2969392 - RNA, 15 nt, Mycobacterium avium subsp. paratuberculosis
ugagccgccggggcg

SEQ ID NO: 2969393 - RNA, 20 nt, Mycobacterium avium subsp. paratuberculosis
ugagccgccggggcgccgcc

SEQ ID NO: 2969394 - RNA, 20 nt, Mycobacterium avium subsp. paratuberculosis
ugagccgcucgccggggacg

SEQ ID NO: 2969395 - RNA, 15 nt, Mycobacterium avium subsp. paratuberculosis
ugagccgcucgucga

SEQ ID NO: 2969396 - RNA, 18 nt, Mycobacterium avium subsp. paratuberculosis
ugagccggcgcaccgcgu

SEQ ID NO: 2969397 - RNA, 20 nt, Mycobacterium avium subsp. paratuberculosis
ugagccggucgugcgacucc

SEQ ID NO: 2969398 - RNA, 17 nt, Mycobacterium avium subsp. paratuberculosis
ugagccuaugaggcgac

SEQ ID NO: 2969399 - RNA, 19 nt, Mycobacterium avium subsp. paratuberculosis
ugagccuaugaggcgaccc

SEQ ID NO: 2969400 - RNA, 22 nt, Mycobacterium avium subsp. paratuberculosis
ugagccuaugaggcgacccccg

SEQ ID NO: 2969401 - RNA, 17 nt, Mycobacterium avium subsp. paratuberculosis
ugagccucagggcgcgc

SEQ ID NO: 2969402 - RNA, 14 nt, Mycobacterium avium subsp. paratuberculosis
ugagcgacaccagg

SEQ ID NO: 2969403 - RNA, 16 nt, Mycobacterium avium subsp. paratuberculosis
ugagcgacauggucgg

SEQ ID NO: 2969404 - RNA, 19 nt, Mycobacterium avium subsp. paratuberculosis
ugagcgagaugaucagccg

SEQ ID NO: 2969405 - RNA, 21 nt, Mycobacterium avium subsp. paratuberculosis
ugagcgagaugaucagccgcc

SEQ ID NO: 2969406 - RNA, 20 nt, Mycobacterium avium subsp. paratuberculosis
ugagcgaggacgucgagcgg

SEQ ID NO: 2969407 - RNA, 22 nt, Mycobacterium avium subsp. paratuberculosis
ugagcgccaccccgaacccggc

SEQ ID NO: 2969408 - RNA, 15 nt, Mycobacterium avium subsp. paratuberculosis
ugagcgccagcgcgg

SEQ ID NO: 2969409 - RNA, 16 nt, Mycobacterium avium subsp. paratuberculosis
ugagcgccagcgcggu

SEQ ID NO: 2969410 - RNA, 17 nt, Mycobacterium avium subsp. paratuberculosis
ugagcgccagcgcggug

SEQ ID NO: 2969411 - RNA, 13 nt, Mycobacterium avium subsp. paratuberculosis
ugagcgccaggcc

SEQ ID NO: 2969412 - RNA, 12 nt, Mycobacterium avium subsp. paratuberculosis
ugagcgcccggu

SEQ ID NO: 2969413 - RNA, 13 nt, Mycobacterium avium subsp. paratuberculosis
ugagcgccggggc

SEQ ID NO: 2969414 - RNA, 15 nt, Mycobacterium avium subsp. paratuberculosis
ugagcgccggggcgg

SEQ ID NO: 2969415 - RNA, 15 nt, Mycobacterium avium subsp. paratuberculosis
ugagcgcgucgucgc

SEQ ID NO: 2969416 - RNA, 14 nt, Mycobacterium avium subsp. paratuberculosis
ugagcggccgcagc

SEQ ID NO: 2969417 - RNA, 21 nt, Mycobacterium avium subsp. paratuberculosis
ugagcgggaacgcgucgaaca

SEQ ID NO: 2969418 - RNA, 18 nt, Mycobacterium avium subsp. paratuberculosis
ugagcgggacgcgcagau

SEQ ID NO: 2969419 - RNA, 16 nt, Mycobacterium avium subsp. paratuberculosis
ugagcgucgccaccac

SEQ ID NO: 2969420 - RNA, 17 nt, Mycobacterium avium subsp. paratuberculosis
ugagcgucgccaccacc

SEQ ID NO: 2969421 - RNA, 15 nt, Mycobacterium avium subsp. paratuberculosis
ugagcguggacaccg

SEQ ID NO: 2969422 - RNA, 19 nt, Mycobacterium avium subsp. paratuberculosis
ugagcguggacaccgcacc

SEQ ID NO: 2969423 - RNA, 15 nt, Mycobacterium avium subsp. paratuberculosis
ugagcuaucagcucg

SEQ ID NO: 2969424 - RNA, 15 nt, Mycobacterium avium subsp. paratuberculosis
ugagcucgcggcgca

SEQ ID NO: 2969425 - RNA, 17 nt, Mycobacterium avium subsp. paratuberculosis
ugagcucgcggcgcagc

SEQ ID NO: 2969426 - RNA, 22 nt, Mycobacterium avium subsp. paratuberculosis
ugagcucggccuuacgcugcgc

SEQ ID NO: 2969427 - RNA, 14 nt, Mycobacterium avium subsp. paratuberculosis
ugagcuggccgcgc

SEQ ID NO: 2969428 - RNA, 23 nt, Mycobacterium avium subsp. paratuberculosis
ugagcugggcggcgcgcugcggc

SEQ ID NO: 2969429 - RNA, 15 nt, Mycobacterium avium subsp. paratuberculosis
ugagcuggugcagcg

SEQ ID NO: 2969430 - RNA, 16 nt, Mycobacterium avium subsp. paratuberculosis
ugagcuucccggcggu

SEQ ID NO: 2969431 - RNA, 16 nt, Mycobacterium avium subsp. paratuberculosis
ugagcuucugcccggc

SEQ ID NO: 2969432 - RNA, 22 nt, Mycobacterium avium subsp. paratuberculosis
ugagcuuuucgucggugcgcgc

SEQ ID NO: 2969433 - RNA, 12 nt, Mycobacterium avium subsp. paratuberculosis
ugaggaacgcga

SEQ ID NO: 2969434 - RNA, 17 nt, Mycobacterium avium subsp. paratuberculosis
ugaggaacgcgaccguc

SEQ ID NO: 2969435 - RNA, 14 nt, Mycobacterium avium subsp. paratuberculosis
ugaggacgaggcgg

SEQ ID NO: 2969436 - RNA, 21 nt, Mycobacterium avium subsp. paratuberculosis
ugaggagacgaucucgccguc

SEQ ID NO: 2969437 - RNA, 15 nt, Mycobacterium avium subsp. paratuberculosis
ugaggaugcgcacca

SEQ ID NO: 2969438 - RNA, 19 nt, Mycobacterium avium subsp. paratuberculosis
ugaggcacccgcugcacca

SEQ ID NO: 2969439 - RNA, 14 nt, Mycobacterium avium subsp. paratuberculosis
ugaggccagcaccc

SEQ ID NO: 2969440 - RNA, 21 nt, Mycobacterium avium subsp. paratuberculosis
ugaggccaggcguuuggugug

SEQ ID NO: 2969441 - RNA, 21 nt, Mycobacterium avium subsp. paratuberculosis
ugaggcccacguugagcacgc

SEQ ID NO: 2969442 - RNA, 12 nt, Mycobacterium avium subsp. paratuberculosis
ugaggccgaggc

SEQ ID NO: 2969443 - RNA, 17 nt, Mycobacterium avium subsp. paratuberculosis
ugaggccgaggcgagug

SEQ ID NO: 2969444 - RNA, 14 nt, Mycobacterium avium subsp. paratuberculosis
ugaggcgagccgau

SEQ ID NO: 2969445 - RNA, 22 nt, Mycobacterium avium subsp. paratuberculosis
ugaggcggcggcgggccagggc

SEQ ID NO: 2969446 - RNA, 17 nt, Mycobacterium avium subsp. paratuberculosis
ugaggcguuggcccgca

SEQ ID NO: 2969447 - RNA, 20 nt, Mycobacterium avium subsp. paratuberculosis
ugaggcucaggccgguggcg

SEQ ID NO: 2969448 - RNA, 13 nt, Mycobacterium avium subsp. paratuberculosis
ugagggugaugac

SEQ ID NO: 2969449 - RNA, 17 nt, Mycobacterium avium subsp. paratuberculosis
ugagguagucgcgcagc

SEQ ID NO: 2969450 - RNA, 18 nt, Mycobacterium avium subsp. paratuberculosis
ugagguagucggcccagg

SEQ ID NO: 2969451 - RNA, 17 nt, Mycobacterium avium subsp. paratuberculosis
ugaggucgcgaccgccg

SEQ ID NO: 2969452 - RNA, 19 nt, Mycobacterium avium subsp. paratuberculosis
ugaggucgcgaccgccgga

SEQ ID NO: 2969453 - RNA, 14 nt, Mycobacterium avium subsp. paratuberculosis
ugaggucgggcucg

SEQ ID NO: 2969454 - RNA, 14 nt, Mycobacterium avium subsp. paratuberculosis
ugagguggcugggc

SEQ ID NO: 2969455 - RNA, 22 nt, Mycobacterium avium subsp. paratuberculosis
ugagucccucggcgagcgaggc

SEQ ID NO: 2969456 - RNA, 20 nt, Mycobacterium avium subsp. paratuberculosis
ugagugcgccgugcagcacg

SEQ ID NO: 2969457 - RNA, 22 nt, Mycobacterium avium subsp. paratuberculosis
ugagugcgccgugcagcacgcc

SEQ ID NO: 2969458 - RNA, 13 nt, Mycobacterium avium subsp. paratuberculosis
ugaugagcgagga

SEQ ID NO: 2969459 - RNA, 16 nt, Mycobacterium avium subsp. paratuberculosis
ugaugaggucgcgacc

SEQ ID NO: 2969460 - RNA, 13 nt, Mycobacterium avium subsp. paratuberculosis
ugaugaucgccgg

SEQ ID NO: 2969461 - RNA, 17 nt, Mycobacterium avium subsp. paratuberculosis
ugaugaugucggcggcc

SEQ ID NO: 2969462 - RNA, 12 nt, Mycobacterium avium subsp. paratuberculosis
ugaugcccaggc

SEQ ID NO: 2969463 - RNA, 21 nt, Mycobacterium avium subsp. paratuberculosis
ugaugcccuuggcggccacga

SEQ ID NO: 2969464 - RNA, 15 nt, Mycobacterium avium subsp. paratuberculosis
ugaugccgagcgccg

SEQ ID NO: 2969465 - RNA, 14 nt, Mycobacterium avium subsp. paratuberculosis
ugaugccgcccagc

SEQ ID NO: 2969466 - RNA, 23 nt, Mycobacterium avium subsp. paratuberculosis
ugaugccggccagccgcgcgacg

SEQ ID NO: 2969467 - RNA, 15 nt, Mycobacterium avium subsp. paratuberculosis
ugaugccggccgcgu

SEQ ID NO: 2969468 - RNA, 14 nt, Mycobacterium avium subsp. paratuberculosis
ugaugccggcggua

SEQ ID NO: 2969469 - RNA, 19 nt, Mycobacterium avium subsp. paratuberculosis
ugaugccgucgaucaccug

SEQ ID NO: 2969470 - RNA, 13 nt, Mycobacterium avium subsp. paratuberculosis
ugaugccgugcgc

SEQ ID NO: 2969471 - RNA, 20 nt, Mycobacterium avium subsp. paratuberculosis
ugaugcgaugggugaucgcg

SEQ ID NO: 2969472 - RNA, 18 nt, Mycobacterium avium subsp. paratuberculosis
ugaugcgcaagcaccggc

SEQ ID NO: 2969473 - RNA, 12 nt, Mycobacterium avium subsp. paratuberculosis
ugaugcgccggc

SEQ ID NO: 2969474 - RNA, 16 nt, Mycobacterium avium subsp. paratuberculosis
ugaugcgcggcgacgg

SEQ ID NO: 2969475 - RNA, 20 nt, Mycobacterium avium subsp. paratuberculosis
ugaugcggaugcccgccggc

SEQ ID NO: 2969476 - RNA, 15 nt, Mycobacterium avium subsp. paratuberculosis
ugaugcggcccgacc

SEQ ID NO: 2969477 - RNA, 13 nt, Mycobacterium avium subsp. paratuberculosis
ugaugcggccgga

SEQ ID NO: 2969478 - RNA, 21 nt, Mycobacterium avium subsp. paratuberculosis
ugaugcgucccguuggcgccg

SEQ ID NO: 2969479 - RNA, 22 nt, Mycobacterium avium subsp. paratuberculosis
ugaugcugcccggcgccacgca

SEQ ID NO: 2969480 - RNA, 16 nt, Mycobacterium avium subsp. paratuberculosis
ugaugcuggcaacguc

SEQ ID NO: 2969481 - RNA, 15 nt, Mycobacterium avium subsp. paratuberculosis
ugauggcacccucgg

SEQ ID NO: 2969482 - RNA, 18 nt, Mycobacterium avium subsp. paratuberculosis
ugauggccaucuggccgc

SEQ ID NO: 2969483 - RNA, 15 nt, Mycobacterium avium subsp. paratuberculosis
ugauggccgccgcag

SEQ ID NO: 2969484 - RNA, 12 nt, Mycobacterium avium subsp. paratuberculosis
ugauggccgcgc

SEQ ID NO: 2969485 - RNA, 15 nt, Mycobacterium avium subsp. paratuberculosis
ugauggccgcgccgc

SEQ ID NO: 2969486 - RNA, 20 nt, Mycobacterium avium subsp. paratuberculosis
ugauggcgaaccagcgcccg

SEQ ID NO: 2969487 - RNA, 23 nt, Mycobacterium avium subsp. paratuberculosis
ugauggcgucgacgugcgcggcg

SEQ ID NO: 2969488 - RNA, 14 nt, Mycobacterium avium subsp. paratuberculosis
ugaugggcagcgcc

SEQ ID NO: 2969489 - RNA, 23 nt, Mycobacterium avium subsp. paratuberculosis
ugaugggcagcgccccgguccgg

SEQ ID NO: 2969490 - RNA, 13 nt, Mycobacterium avium subsp. paratuberculosis
ugauggucgucgu

SEQ ID NO: 2969491 - RNA, 13 nt, Mycobacterium avium subsp. paratuberculosis
ugauggugaucuc

SEQ ID NO: 2969492 - RNA, 14 nt, Mycobacterium avium subsp. paratuberculosis
ugauggugaucucg

SEQ ID NO: 2969493 - RNA, 21 nt, Mycobacterium avium subsp. paratuberculosis
ugauggugugguagggccgcu

SEQ ID NO: 2969494 - RNA, 19 nt, Mycobacterium avium subsp. paratuberculosis
ugauguaagcgaauaccau

SEQ ID NO: 2969495 - RNA, 14 nt, Mycobacterium avium subsp. paratuberculosis
ugaugucgcccggc

SEQ ID NO: 2969496 - RNA, 18 nt, Mycobacterium avium subsp. paratuberculosis
ugaugucgccggcggcga

SEQ ID NO: 2969497 - RNA, 14 nt, Mycobacterium avium subsp. paratuberculosis
ugaugucgcgcggc

SEQ ID NO: 2969498 - RNA, 18 nt, Mycobacterium avium subsp. paratuberculosis
ugaugucgcugccgccgc

SEQ ID NO: 2969499 - RNA, 15 nt, Mycobacterium avium subsp. paratuberculosis
ugaugucggccagga

SEQ ID NO: 2969500 - RNA, 20 nt, Mycobacterium avium subsp. paratuberculosis
ugaugucggccaggaucgcg

SEQ ID NO: 2969501 - RNA, 14 nt, Mycobacterium avium subsp. paratuberculosis
ugaugucggcgggc

SEQ ID NO: 2969502 - RNA, 13 nt, Mycobacterium avium subsp. paratuberculosis
ugaugucggugag

SEQ ID NO: 2969503 - RNA, 21 nt, Mycobacterium avium subsp. paratuberculosis
ugaugucggugguguggcagg

SEQ ID NO: 2969504 - RNA, 18 nt, Mycobacterium avium subsp. paratuberculosis
ugaugucguuggugucga

SEQ ID NO: 2969505 - RNA, 13 nt, Mycobacterium avium subsp. paratuberculosis
ugauguucacccc

SEQ ID NO: 2969506 - RNA, 14 nt, Mycobacterium avium subsp. paratuberculosis
ugauucgggucaga

SEQ ID NO: 2969507 - RNA, 19 nt, Mycobacterium avium subsp. paratuberculosis
ugauugcgcccgccgaaca

SEQ ID NO: 2969508 - RNA, 18 nt, Mycobacterium avium subsp. paratuberculosis
ugauuguugacggugacc

SEQ ID NO: 2969509 - RNA, 22 nt, Mycobacterium avium subsp. paratuberculosis
ugauuucggcguggcgguggcg

SEQ ID NO: 2969510 - RNA, 22 nt, Mycobacterium avium subsp. paratuberculosis
ugcaacacaugguccugcaccg

SEQ ID NO: 2969511 - RNA, 21 nt, Mycobacterium avium subsp. paratuberculosis
ugcaaccgcuuuuccaccauc

SEQ ID NO: 2969512 - RNA, 13 nt, Mycobacterium avium subsp. paratuberculosis
ugcaaccgguccg

SEQ ID NO: 2969513 - RNA, 17 nt, Mycobacterium avium subsp. paratuberculosis
ugcaacgccgccgacag

SEQ ID NO: 2969514 - RNA, 21 nt, Mycobacterium avium subsp. paratuberculosis
ugcaacgccgccgacagcacc

SEQ ID NO: 2969515 - RNA, 22 nt, Mycobacterium avium subsp. paratuberculosis
ugcaacgccgccgacagcaccu

SEQ ID NO: 2969516 - RNA, 23 nt, Mycobacterium avium subsp. paratuberculosis
ugcaacuaccgacggcaccucuc

SEQ ID NO: 2969517 - RNA, 18 nt, Mycobacterium avium subsp. paratuberculosis
ugcaacuagcgacggccg

SEQ ID NO: 2969518 - RNA, 13 nt, Mycobacterium avium subsp. paratuberculosis
ugcaacucccgcg

SEQ ID NO: 2969519 - RNA, 16 nt, Mycobacterium avium subsp. paratuberculosis
ugcaacucccgcgccg

SEQ ID NO: 2969520 - RNA, 18 nt, Mycobacterium avium subsp. paratuberculosis
ugcaacucccgcgccgcg

SEQ ID NO: 2969521 - RNA, 15 nt, Mycobacterium avium subsp. paratuberculosis
ugcaagcucgccagg

SEQ ID NO: 2969522 - RNA, 22 nt, Mycobacterium avium subsp. paratuberculosis
ugcaaggcccccgccucgccgg

SEQ ID NO: 2969523 - RNA, 14 nt, Mycobacterium avium subsp. paratuberculosis
ugcaaggcgggggu

SEQ ID NO: 2969524 - RNA, 21 nt, Mycobacterium avium subsp. paratuberculosis
ugcaagggcuugggcgcgauc

SEQ ID NO: 2969525 - RNA, 16 nt, Mycobacterium avium subsp. paratuberculosis
ugcaaucucgucgggg

SEQ ID NO: 2969526 - RNA, 20 nt, Mycobacterium avium subsp. paratuberculosis
ugcaaucucgucggggcgcc

SEQ ID NO: 2969527 - RNA, 21 nt, Mycobacterium avium subsp. paratuberculosis
ugcaaucucgucggggcgccu

SEQ ID NO: 2969528 - RNA, 18 nt, Mycobacterium avium subsp. paratuberculosis
ugcacaccaccagcgagg

SEQ ID NO: 2969529 - RNA, 20 nt, Mycobacterium avium subsp. paratuberculosis
ugcacacccggugcgccggu

SEQ ID NO: 2969530 - RNA, 21 nt, Mycobacterium avium subsp. paratuberculosis
ugcacacccuuuuccaucugg

SEQ ID NO: 2969531 - RNA, 22 nt, Mycobacterium avium subsp. paratuberculosis
ugcacaccgcuuugugaggcgc

SEQ ID NO: 2969532 - RNA, 12 nt, Mycobacterium avium subsp. paratuberculosis
ugcacacgccga

SEQ ID NO: 2969533 - RNA, 22 nt, Mycobacterium avium subsp. paratuberculosis
ugcacacgggcccguccgcgaa

SEQ ID NO: 2969534 - RNA, 16 nt, Mycobacterium avium subsp. paratuberculosis
ugcacaggccgccgca

SEQ ID NO: 2969535 - RNA, 15 nt, Mycobacterium avium subsp. paratuberculosis
ugcacagugcgucgc

SEQ ID NO: 2969536 - RNA, 16 nt, Mycobacterium avium subsp. paratuberculosis
ugcaccaccacaccca

SEQ ID NO: 2969537 - RNA, 19 nt, Mycobacterium avium subsp. paratuberculosis
ugcaccaccacacccagcg

SEQ ID NO: 2969538 - RNA, 22 nt, Mycobacterium avium subsp. paratuberculosis
ugcaccaccacacccagcgcca

SEQ ID NO: 2969539 - RNA, 13 nt, Mycobacterium avium subsp. paratuberculosis
ugcaccacccagg

SEQ ID NO: 2969540 - RNA, 19 nt, Mycobacterium avium subsp. paratuberculosis
ugcaccaccgugccgucgc

SEQ ID NO: 2969541 - RNA, 21 nt, Mycobacterium avium subsp. paratuberculosis
ugcaccaccgugccgucgcgg

SEQ ID NO: 2969542 - RNA, 18 nt, Mycobacterium avium subsp. paratuberculosis
ugcaccacgaagcgggcg

SEQ ID NO: 2969543 - RNA, 13 nt, Mycobacterium avium subsp. paratuberculosis
ugcacguggugac

SEQ ID NO: 2969544 - RNA, 17 nt, Mycobacterium avium subsp. paratuberculosis
ugcacucagagcagcgc

SEQ ID NO: 2969545 - RNA, 15 nt, Mycobacterium avium subsp. paratuberculosis
ugcacucggcgaugc

SEQ ID NO: 2969546 - RNA, 20 nt, Mycobacterium avium subsp. paratuberculosis
ugcacucggcgaugcgccgu

SEQ ID NO: 2969547 - RNA, 19 nt, Mycobacterium avium subsp. paratuberculosis
ugcacucucgcggcaaggc

SEQ ID NO: 2969548 - RNA, 23 nt, Mycobacterium avium subsp. paratuberculosis
ugcacuucgcuguaguagccggg

SEQ ID NO: 2969549 - RNA, 22 nt, Mycobacterium avium subsp. paratuberculosis
ugcagaacaauguuuuucugcu

SEQ ID NO: 2969550 - RNA, 14 nt, Mycobacterium avium subsp. paratuberculosis
ugcagaacgcgcgg

SEQ ID NO: 2969551 - RNA, 12 nt, Mycobacterium avium subsp. paratuberculosis
ugcagaccagcc

SEQ ID NO: 2969552 - RNA, 14 nt, Mycobacterium avium subsp. paratuberculosis
ugcagaccggacag

SEQ ID NO: 2969553 - RNA, 21 nt, Mycobacterium avium subsp. paratuberculosis
ugcagagcgaugggcgcgauc

SEQ ID NO: 2969554 - RNA, 21 nt, Mycobacterium avium subsp. paratuberculosis
ugcagauagguggucucccag

SEQ ID NO: 2969555 - RNA, 13 nt, Mycobacterium avium subsp. paratuberculosis
ugcagaucaccac

SEQ ID NO: 2969556 - RNA, 19 nt, Mycobacterium avium subsp. paratuberculosis
ugcagauccagaugccggg

SEQ ID NO: 2969557 - RNA, 20 nt, Mycobacterium avium subsp. paratuberculosis
ugcagauccagaugccgggu

SEQ ID NO: 2969558 - RNA, 21 nt, Mycobacterium avium subsp. paratuberculosis
ugcagaugucgguggccuugg

SEQ ID NO: 2969559 - RNA, 15 nt, Mycobacterium avium subsp. paratuberculosis
ugcagcaacaugauu

SEQ ID NO: 2969560 - RNA, 17 nt, Mycobacterium avium subsp. paratuberculosis
ugcagcaacucgcgcuc

SEQ ID NO: 2969561 - RNA, 12 nt, Mycobacterium avium subsp. paratuberculosis
ugcagcacaccg

SEQ ID NO: 2969562 - RNA, 13 nt, Mycobacterium avium subsp. paratuberculosis
ugcagcacaccgg

SEQ ID NO: 2969563 - RNA, 15 nt, Mycobacterium avium subsp. paratuberculosis
ugcagcacaccggca

SEQ ID NO: 2969564 - RNA, 12 nt, Mycobacterium avium subsp. paratuberculosis
ugcagcaccagg

SEQ ID NO: 2969565 - RNA, 18 nt, Mycobacterium avium subsp. paratuberculosis
ugcagcaccgaaccggcg

SEQ ID NO: 2969566 - RNA, 21 nt, Mycobacterium avium subsp. paratuberculosis
ugcagcaccgaaccggcgggg

SEQ ID NO: 2969567 - RNA, 14 nt, Mycobacterium avium subsp. paratuberculosis
ugcagcaccgccag

SEQ ID NO: 2969568 - RNA, 16 nt, Mycobacterium avium subsp. paratuberculosis
ugcagcaccgccagca

SEQ ID NO: 2969569 - RNA, 19 nt, Mycobacterium avium subsp. paratuberculosis
ugcagcaccgccagcaucc

SEQ ID NO: 2969570 - RNA, 21 nt, Mycobacterium avium subsp. paratuberculosis
ugcagcaccucgaagccgacg

SEQ ID NO: 2969571 - RNA, 22 nt, Mycobacterium avium subsp. paratuberculosis
ugcagcacgcccagaucgacgc

SEQ ID NO: 2969572 - RNA, 13 nt, Mycobacterium avium subsp. paratuberculosis
ugcagcacgccgc

SEQ ID NO: 2969573 - RNA, 14 nt, Mycobacterium avium subsp. paratuberculosis
ugcagcagcccgau

SEQ ID NO: 2969574 - RNA, 15 nt, Mycobacterium avium subsp. paratuberculosis
ugcagcagcccgauc

SEQ ID NO: 2969575 - RNA, 12 nt, Mycobacterium avium subsp. paratuberculosis
ugcagcagccgg

SEQ ID NO: 2969576 - RNA, 16 nt, Mycobacterium avium subsp. paratuberculosis
ugcagcagccggaccc

SEQ ID NO: 2969577 - RNA, 21 nt, Mycobacterium avium subsp. paratuberculosis
ugcagcagcgacuugaccagc

SEQ ID NO: 2969578 - RNA, 23 nt, Mycobacterium avium subsp. paratuberculosis
ugcagcagcgacuugaccagcag

SEQ ID NO: 2969579 - RNA, 16 nt, Mycobacterium avium subsp. paratuberculosis
ugcagcagcgccgcga

SEQ ID NO: 2969580 - RNA, 21 nt, Mycobacterium avium subsp. paratuberculosis
ugcagcagcucggcgaucacc

SEQ ID NO: 2969581 - RNA, 23 nt, Mycobacterium avium subsp. paratuberculosis
ugcagcagcucggcgaucaccgc

SEQ ID NO: 2969582 - RNA, 15 nt, Mycobacterium avium subsp. paratuberculosis
ugcagcagggcgcgc

SEQ ID NO: 2969583 - RNA, 18 nt, Mycobacterium avium subsp. paratuberculosis
ugcagccacccgucggug

SEQ ID NO: 2969584 - RNA, 12 nt, Mycobacterium avium subsp. paratuberculosis
ugcagcccgauc

SEQ ID NO: 2969585 - RNA, 15 nt, Mycobacterium avium subsp. paratuberculosis
ugcagcccgcgucca

SEQ ID NO: 2969586 - RNA, 17 nt, Mycobacterium avium subsp. paratuberculosis
ugcagcccgcugaccag

SEQ ID NO: 2969587 - RNA, 14 nt, Mycobacterium avium subsp. paratuberculosis
ugcagccgcacuug

SEQ ID NO: 2969588 - RNA, 17 nt, Mycobacterium avium subsp. paratuberculosis
ugcagccgcccguccug

SEQ ID NO: 2969589 - RNA, 22 nt, Mycobacterium avium subsp. paratuberculosis
ugcagccgcccguccuggauga

SEQ ID NO: 2969590 - RNA, 16 nt, Mycobacterium avium subsp. paratuberculosis
ugcagccgcugccgca

SEQ ID NO: 2969591 - RNA, 21 nt, Mycobacterium avium subsp. paratuberculosis
ugcagccggccaacagcagcg

SEQ ID NO: 2969592 - RNA, 17 nt, Mycobacterium avium subsp. paratuberculosis
ugcagccggcgcggcag

SEQ ID NO: 2969593 - RNA, 19 nt, Mycobacterium avium subsp. paratuberculosis
ugcagccgggccugcagca

SEQ ID NO: 2969594 - RNA, 16 nt, Mycobacterium avium subsp. paratuberculosis
ugcagccgggcggcgc

SEQ ID NO: 2969595 - RNA, 22 nt, Mycobacterium avium subsp. paratuberculosis
ugcagccgggcggcgccgaacc

SEQ ID NO: 2969596 - RNA, 21 nt, Mycobacterium avium subsp. paratuberculosis
ugcagccgggggcggugcagc

SEQ ID NO: 2969597 - RNA, 18 nt, Mycobacterium avium subsp. paratuberculosis
ugcagccgggugcggugc

SEQ ID NO: 2969598 - RNA, 14 nt, Mycobacterium avium subsp. paratuberculosis
ugcagccgguccgg

SEQ ID NO: 2969599 - RNA, 23 nt, Mycobacterium avium subsp. paratuberculosis
ugcagccgguccggcggcaccac

SEQ ID NO: 2969600 - RNA, 20 nt, Mycobacterium avium subsp. paratuberculosis
ugcagcgacggaucggccgc

SEQ ID NO: 2969601 - RNA, 15 nt, Mycobacterium avium subsp. paratuberculosis
ugcagcgacuggccc

SEQ ID NO: 2969602 - RNA, 17 nt, Mycobacterium avium subsp. paratuberculosis
ugcagcgccagcaccgg

SEQ ID NO: 2969603 - RNA, 14 nt, Mycobacterium avium subsp. paratuberculosis
ugcagcgcccagcc

SEQ ID NO: 2969604 - RNA, 16 nt, Mycobacterium avium subsp. paratuberculosis
ugcagcgcccagccga

SEQ ID NO: 2969605 - RNA, 17 nt, Mycobacterium avium subsp. paratuberculosis
ugcagcgcccagccgag

SEQ ID NO: 2969606 - RNA, 16 nt, Mycobacterium avium subsp. paratuberculosis
ugcagcgcccgggcca

SEQ ID NO: 2969607 - RNA, 18 nt, Mycobacterium avium subsp. paratuberculosis
ugcagcgcccgggccagg

SEQ ID NO: 2969608 - RNA, 22 nt, Mycobacterium avium subsp. paratuberculosis
ugcagcgcccgggccaggaccg

SEQ ID NO: 2969609 - RNA, 13 nt, Mycobacterium avium subsp. paratuberculosis
ugcagcgccgagg

SEQ ID NO: 2969610 - RNA, 15 nt, Mycobacterium avium subsp. paratuberculosis
ugcagcgccgaggcc

SEQ ID NO: 2969611 - RNA, 14 nt, Mycobacterium avium subsp. paratuberculosis
ugcagcgccucggu

SEQ ID NO: 2969612 - RNA, 14 nt, Mycobacterium avium subsp. paratuberculosis
ugcagcgcggcgau

SEQ ID NO: 2969613 - RNA, 16 nt, Mycobacterium avium subsp. paratuberculosis
ugcagcgcggcgauca

SEQ ID NO: 2969614 - RNA, 16 nt, Mycobacterium avium subsp. paratuberculosis
ugcagcgcggcgauga

SEQ ID NO: 2969615 - RNA, 21 nt, Mycobacterium avium subsp. paratuberculosis
ugcagcgcgguggucagcacc

SEQ ID NO: 2969616 - RNA, 19 nt, Mycobacterium avium subsp. paratuberculosis
ugcagcggaaacgacgucg

SEQ ID NO: 2969617 - RNA, 18 nt, Mycobacterium avium subsp. paratuberculosis
ugcagcggcuccgagcgg

SEQ ID NO: 2969618 - RNA, 20 nt, Mycobacterium avium subsp. paratuberculosis
ugcagcggguuuggccgcgg

SEQ ID NO: 2969619 - RNA, 23 nt, Mycobacterium avium subsp. paratuberculosis
ugcagcggguuuggccgcgggcg

SEQ ID NO: 2969620 - RNA, 19 nt, Mycobacterium avium subsp. paratuberculosis
ugcagcgugguccagcacg

SEQ ID NO: 2969621 - RNA, 20 nt, Mycobacterium avium subsp. paratuberculosis
ugcagcgugguccagcacgu

SEQ ID NO: 2969622 - RNA, 22 nt, Mycobacterium avium subsp. paratuberculosis
ugcagcuccucggcggccucgg

SEQ ID NO: 2969623 - RNA, 21 nt, Mycobacterium avium subsp. paratuberculosis
ugcagcucgccggcgcgcagc

SEQ ID NO: 2969624 - RNA, 23 nt, Mycobacterium avium subsp. paratuberculosis
ugcagcucggugcagaccccggc

SEQ ID NO: 2969625 - RNA, 13 nt, Mycobacterium avium subsp. paratuberculosis
ugcagcugcucgu

SEQ ID NO: 2969626 - RNA, 14 nt, Mycobacterium avium subsp. paratuberculosis
ugcagcugcucguc

SEQ ID NO: 2969627 - RNA, 22 nt, Mycobacterium avium subsp. paratuberculosis
ugcagcuggcgaauccgggccu

SEQ ID NO: 2969628 - RNA, 13 nt, Mycobacterium avium subsp. paratuberculosis
ugccagccggccg

SEQ ID NO: 2969629 - RNA, 14 nt, Mycobacterium avium subsp. paratuberculosis
ugccagccggccgc

SEQ ID NO: 2969630 - RNA, 21 nt, Mycobacterium avium subsp. paratuberculosis
ugccagcuucgggcgcgcgcg

SEQ ID NO: 2969631 - RNA, 23 nt, Mycobacterium avium subsp. paratuberculosis
ugccagggcagcgcgaccagccc

SEQ ID NO: 2969632 - RNA, 20 nt, Mycobacterium avium subsp. paratuberculosis
ugccaguccugggccggggc

SEQ ID NO: 2969633 - RNA, 20 nt, Mycobacterium avium subsp. paratuberculosis
ugccaucgcugguggugaga

SEQ ID NO: 2969634 - RNA, 24 nt, Mycobacterium avium subsp. paratuberculosis
ugccaugccggguuucggcccggc

SEQ ID NO: 2969635 - RNA, 18 nt, Mycobacterium avium subsp. paratuberculosis
ugcccaacagcucgcggg

SEQ ID NO: 2969636 - RNA, 22 nt, Mycobacterium avium subsp. paratuberculosis
ugcccaacagcucgcgggccug

SEQ ID NO: 2969637 - RNA, 16 nt, Mycobacterium avium subsp. paratuberculosis
ugcccaacgucgacuu

SEQ ID NO: 2969638 - RNA, 16 nt, Mycobacterium avium subsp. paratuberculosis
ugcccaagccggccag

SEQ ID NO: 2969639 - RNA, 17 nt, Mycobacterium avium subsp. paratuberculosis
ugcccaagccggccagg

SEQ ID NO: 2969640 - RNA, 18 nt, Mycobacterium avium subsp. paratuberculosis
ugcccaagccggccaggc

SEQ ID NO: 2969641 - RNA, 22 nt, Mycobacterium avium subsp. paratuberculosis
ugcccaaugaucugggccgcca

SEQ ID NO: 2969642 - RNA, 15 nt, Mycobacterium avium subsp. paratuberculosis
ugcccaauucgacug

SEQ ID NO: 2969643 - RNA, 14 nt, Mycobacterium avium subsp. paratuberculosis
ugcccacagccagg

SEQ ID NO: 2969644 - RNA, 14 nt, Mycobacterium avium subsp. paratuberculosis
ugcccaccaccagg

SEQ ID NO: 2969645 - RNA, 16 nt, Mycobacterium avium subsp. paratuberculosis
ugcccaccaccagggg

SEQ ID NO: 2969646 - RNA, 18 nt, Mycobacterium avium subsp. paratuberculosis
ugcccaccaccugcuucc

SEQ ID NO: 2969647 - RNA, 13 nt, Mycobacterium avium subsp. paratuberculosis
ugcccaccagcau

SEQ ID NO: 2969648 - RNA, 20 nt, Mycobacterium avium subsp. paratuberculosis
ugcccaccaucccgccgccg

SEQ ID NO: 2969649 - RNA, 23 nt, Mycobacterium avium subsp. paratuberculosis
ugcccaccaucccgccgccgaac

SEQ ID NO: 2969650 - RNA, 20 nt, Mycobacterium avium subsp. paratuberculosis
ugcccacccgcucggcgauc

SEQ ID NO: 2969651 - RNA, 14 nt, Mycobacterium avium subsp. paratuberculosis
ugcccaccgggcag

SEQ ID NO: 2969652 - RNA, 17 nt, Mycobacterium avium subsp. paratuberculosis
ugcccaccgggcagccg

SEQ ID NO: 2969653 - RNA, 21 nt, Mycobacterium avium subsp. paratuberculosis
ugcccaccgggcagccgcaca

SEQ ID NO: 2969654 - RNA, 18 nt, Mycobacterium avium subsp. paratuberculosis
ugcccacgccgucgaccc

SEQ ID NO: 2969655 - RNA, 20 nt, Mycobacterium avium subsp. paratuberculosis
ugcccagcacgacgccgcug

SEQ ID NO: 2969656 - RNA, 12 nt, Mycobacterium avium subsp. paratuberculosis
ugcccagcagcg

SEQ ID NO: 2969657 - RNA, 21 nt, Mycobacterium avium subsp. paratuberculosis
ugcccagcagcggggcgagcu

SEQ ID NO: 2969658 - RNA, 15 nt, Mycobacterium avium subsp. paratuberculosis
ugcccagcagggcgg

SEQ ID NO: 2969659 - RNA, 20 nt, Mycobacterium avium subsp. paratuberculosis
ugcccagcagggcggcgauc

SEQ ID NO: 2969660 - RNA, 14 nt, Mycobacterium avium subsp. paratuberculosis
ugcccagccacgcc

SEQ ID NO: 2969661 - RNA, 24 nt, Mycobacterium avium subsp. paratuberculosis
ugcccagccacgccaacugguccu

SEQ ID NO: 2969662 - RNA, 15 nt, Mycobacterium avium subsp. paratuberculosis
ugcccagccaggccg

SEQ ID NO: 2969663 - RNA, 17 nt, Mycobacterium avium subsp. paratuberculosis
ugcccagccaucugcug

SEQ ID NO: 2969664 - RNA, 18 nt, Mycobacterium avium subsp. paratuberculosis
ugcccagccccucgacgu

SEQ ID NO: 2969665 - RNA, 12 nt, Mycobacterium avium subsp. paratuberculosis
ugcccagcgcgg

SEQ ID NO: 2969666 - RNA, 13 nt, Mycobacterium avium subsp. paratuberculosis
ugcccagcgcggu

SEQ ID NO: 2969667 - RNA, 14 nt, Mycobacterium avium subsp. paratuberculosis
ugcccagcgcgguc

SEQ ID NO: 2969668 - RNA, 15 nt, Mycobacterium avium subsp. paratuberculosis
ugcccagcgcggucg

SEQ ID NO: 2969669 - RNA, 23 nt, Mycobacterium avium subsp. paratuberculosis
ugcccagcggcauggcgaugacc

SEQ ID NO: 2969670 - RNA, 13 nt, Mycobacterium avium subsp. paratuberculosis
ugcccagcggggc

SEQ ID NO: 2969671 - RNA, 24 nt, Mycobacterium avium subsp. paratuberculosis
ugcccagcggggcgaccuugcgca

SEQ ID NO: 2969672 - RNA, 20 nt, Mycobacterium avium subsp. paratuberculosis
ugcccaggaucaccgggacg

SEQ ID NO: 2969673 - RNA, 18 nt, Mycobacterium avium subsp. paratuberculosis
ugcccaggcccaccagcu

SEQ ID NO: 2969674 - RNA, 18 nt, Mycobacterium avium subsp. paratuberculosis
ugcccaggccggcgagcu

SEQ ID NO: 2969675 - RNA, 16 nt, Mycobacterium avium subsp. paratuberculosis
ugcccaucacgcccca

SEQ ID NO: 2969676 - RNA, 22 nt, Mycobacterium avium subsp. paratuberculosis
ugcccauccaggccagcaccug

SEQ ID NO: 2969677 - RNA, 15 nt, Mycobacterium avium subsp. paratuberculosis
ugcccaucgacccgu

SEQ ID NO: 2969678 - RNA, 18 nt, Mycobacterium avium subsp. paratuberculosis
ugcccaucugcacagcuu

SEQ ID NO: 2969679 - RNA, 20 nt, Mycobacterium avium subsp. paratuberculosis
ugccccaccaccgccggccc

SEQ ID NO: 2969680 - RNA, 13 nt, Mycobacterium avium subsp. paratuberculosis
ugccccaccccgg

SEQ ID NO: 2969681 - RNA, 14 nt, Mycobacterium avium subsp. paratuberculosis
ugccccacgccaug

SEQ ID NO: 2969682 - RNA, 12 nt, Mycobacterium avium subsp. paratuberculosis
ugccccaggcga

SEQ ID NO: 2969683 - RNA, 12 nt, Mycobacterium avium subsp. paratuberculosis
ugccccagggac

SEQ ID NO: 2969684 - RNA, 23 nt, Mycobacterium avium subsp. paratuberculosis
ugccccaggucggggugggcgac

SEQ ID NO: 2969685 - RNA, 21 nt, Mycobacterium avium subsp. paratuberculosis
ugccccccuugagccgguccg

SEQ ID NO: 2969686 - RNA, 15 nt, Mycobacterium avium subsp. paratuberculosis
ugcccccgcccggcc

SEQ ID NO: 2969687 - RNA, 16 nt, Mycobacterium avium subsp. paratuberculosis
ugcccccgcccggccg

SEQ ID NO: 2969688 - RNA, 16 nt, Mycobacterium avium subsp. paratuberculosis
ugccccgcaccgccag

SEQ ID NO: 2969689 - RNA, 20 nt, Mycobacterium avium subsp. paratuberculosis
ugccccgccguuucagcagc

SEQ ID NO: 2969690 - RNA, 21 nt, Mycobacterium avium subsp. paratuberculosis
ugccccgccguuucagcagcg

SEQ ID NO: 2969691 - RNA, 22 nt, Mycobacterium avium subsp. paratuberculosis
ugccccgccguuucagcagcgc

SEQ ID NO: 2969692 - RNA, 20 nt, Mycobacterium avium subsp. paratuberculosis
ugccccgcgaccgcagcagg

SEQ ID NO: 2969693 - RNA, 20 nt, Mycobacterium avium subsp. paratuberculosis
ugccccgcuccuccucgcgc

SEQ ID NO: 2969694 - RNA, 19 nt, Mycobacterium avium subsp. paratuberculosis
ugccccggcgaggccaggc

SEQ ID NO: 2969695 - RNA, 20 nt, Mycobacterium avium subsp. paratuberculosis
ugccccggcgaggccaggcg

SEQ ID NO: 2969696 - RNA, 13 nt, Mycobacterium avium subsp. paratuberculosis
ugccccucgacga

SEQ ID NO: 2969697 - RNA, 21 nt, Mycobacterium avium subsp. paratuberculosis
ugccccucgacgaacgcggcg

SEQ ID NO: 2969698 - RNA, 15 nt, Mycobacterium avium subsp. paratuberculosis
ugcccgaacgcgcgu

SEQ ID NO: 2969699 - RNA, 17 nt, Mycobacterium avium subsp. paratuberculosis
ugcccgaacgcgcgucg

SEQ ID NO: 2969700 - RNA, 19 nt, Mycobacterium avium subsp. paratuberculosis
ugcccgaagcugagguggc

SEQ ID NO: 2969701 - RNA, 21 nt, Mycobacterium avium subsp. paratuberculosis
ugcccgaauugcgcugcaccg

SEQ ID NO: 2969702 - RNA, 21 nt, Mycobacterium avium subsp. paratuberculosis
ugcccgacaccgccccgccgc

SEQ ID NO: 2969703 - RNA, 16 nt, Mycobacterium avium subsp. paratuberculosis
ugcccgacccgcacca

SEQ ID NO: 2969704 - RNA, 18 nt, Mycobacterium avium subsp. paratuberculosis
ugcccgaccgcgccgaac

SEQ ID NO: 2969705 - RNA, 22 nt, Mycobacterium avium subsp. paratuberculosis
ugcccgaccugaucuucgagac

SEQ ID NO: 2969706 - RNA, 18 nt, Mycobacterium avium subsp. paratuberculosis
ugcccgacgagucgccgu

SEQ ID NO: 2969707 - RNA, 20 nt, Mycobacterium avium subsp. paratuberculosis
ugcccgacgagucgccguug

SEQ ID NO: 2969708 - RNA, 20 nt, Mycobacterium avium subsp. paratuberculosis
ugcccgacuccucacaccuc

SEQ ID NO: 2969709 - RNA, 17 nt, Mycobacterium avium subsp. paratuberculosis
ugcccgagaucaccggc

SEQ ID NO: 2969710 - RNA, 18 nt, Mycobacterium avium subsp. paratuberculosis
ugcccgagaucaccggcu

SEQ ID NO: 2969711 - RNA, 14 nt, Mycobacterium avium subsp. paratuberculosis
ugcccgagcaccug

SEQ ID NO: 2969712 - RNA, 23 nt, Mycobacterium avium subsp. paratuberculosis
ugcccgucggccucggcgguggc

SEQ ID NO: 2969713 - RNA, 12 nt, Mycobacterium avium subsp. paratuberculosis
ugcccgucgggc

SEQ ID NO: 2969714 - RNA, 18 nt, Mycobacterium avium subsp. paratuberculosis
ugcccgucgggcgcggcg

SEQ ID NO: 2969715 - RNA, 20 nt, Mycobacterium avium subsp. paratuberculosis
ugcccgucgggcgcggcggc

SEQ ID NO: 2969716 - RNA, 19 nt, Mycobacterium avium subsp. paratuberculosis
ugcccgugaucgccacggc

SEQ ID NO: 2969717 - RNA, 16 nt, Mycobacterium avium subsp. paratuberculosis
ugcccguugcccgauc

SEQ ID NO: 2969718 - RNA, 20 nt, Mycobacterium avium subsp. paratuberculosis
ugcccuccagcaccgucggc

SEQ ID NO: 2969719 - RNA, 16 nt, Mycobacterium avium subsp. paratuberculosis
ugcccuccucgccgga

SEQ ID NO: 2969720 - RNA, 17 nt, Mycobacterium avium subsp. paratuberculosis
ugcccucguagcggccg

SEQ ID NO: 2969721 - RNA, 18 nt, Mycobacterium avium subsp. paratuberculosis
ugcccucguagcggccgc

SEQ ID NO: 2969722 - RNA, 13 nt, Mycobacterium avium subsp. paratuberculosis
ugcccugaccccg

SEQ ID NO: 2969723 - RNA, 18 nt, Mycobacterium avium subsp. paratuberculosis
ugcccugcgugcagacaa

SEQ ID NO: 2969724 - RNA, 16 nt, Mycobacterium avium subsp. paratuberculosis
ugcccuuccccggcgg

SEQ ID NO: 2969725 - RNA, 14 nt, Mycobacterium avium subsp. paratuberculosis
ugcccuugauguag

SEQ ID NO: 2969726 - RNA, 14 nt, Mycobacterium avium subsp. paratuberculosis
ugcccuuggacacc

SEQ ID NO: 2969727 - RNA, 18 nt, Mycobacterium avium subsp. paratuberculosis
ugcccuuggacaccugca

SEQ ID NO: 2969728 - RNA, 15 nt, Mycobacterium avium subsp. paratuberculosis
ugcccuuggccagca

SEQ ID NO: 2969729 - RNA, 21 nt, Mycobacterium avium subsp. paratuberculosis
ugcccuuggccagcagugcca

SEQ ID NO: 2969730 - RNA, 16 nt, Mycobacterium avium subsp. paratuberculosis
ugcccuuggcggccac

SEQ ID NO: 2969731 - RNA, 19 nt, Mycobacterium avium subsp. paratuberculosis
ugcccuugguguaggcgau

SEQ ID NO: 2969732 - RNA, 15 nt, Mycobacterium avium subsp. paratuberculosis
ugcccuugugguugc

SEQ ID NO: 2969733 - RNA, 21 nt, Mycobacterium avium subsp. paratuberculosis
ugccgaacaacagggccgcgc

SEQ ID NO: 2969734 - RNA, 23 nt, Mycobacterium avium subsp. paratuberculosis
ugccgaacaacagggccgcgcgg

SEQ ID NO: 2969735 - RNA, 13 nt, Mycobacterium avium subsp. paratuberculosis
ugccgaacagcga

SEQ ID NO: 2969736 - RNA, 15 nt, Mycobacterium avium subsp. paratuberculosis
ugccgaacaggcgca

SEQ ID NO: 2969737 - RNA, 14 nt, Mycobacterium avium subsp. paratuberculosis
ugccgaacggcgcu

SEQ ID NO: 2969738 - RNA, 22 nt, Mycobacterium avium subsp. paratuberculosis
ugccgaacgucaccaacaugau

SEQ ID NO: 2969739 - RNA, 18 nt, Mycobacterium avium subsp. paratuberculosis
ugccgaacuccgccgaac

SEQ ID NO: 2969740 - RNA, 23 nt, Mycobacterium avium subsp. paratuberculosis
ugccgaacugguuguagucgucg

SEQ ID NO: 2969741 - RNA, 16 nt, Mycobacterium avium subsp. paratuberculosis
ugccgaagaugucggu

SEQ ID NO: 2969742 - RNA, 18 nt, Mycobacterium avium subsp. paratuberculosis
ugccgaagaugucggugc

SEQ ID NO: 2969743 - RNA, 21 nt, Mycobacterium avium subsp. paratuberculosis
ugccgaagaugucggugccga

SEQ ID NO: 2969744 - RNA, 23 nt, Mycobacterium avium subsp. paratuberculosis
ugccgaagaugucggugccgauc

SEQ ID NO: 2969745 - RNA, 23 nt, Mycobacterium avium subsp. paratuberculosis
ugccgaagccguugacgguguuc

SEQ ID NO: 2969746 - RNA, 17 nt, Mycobacterium avium subsp. paratuberculosis
ugccgaagcgccgcaug

SEQ ID NO: 2969747 - RNA, 18 nt, Mycobacterium avium subsp. paratuberculosis
ugccgaagcgccgcaugc

SEQ ID NO: 2969748 - RNA, 23 nt, Mycobacterium avium subsp. paratuberculosis
ugccgaagggcaaccgcagcauc

SEQ ID NO: 2969749 - RNA, 17 nt, Mycobacterium avium subsp. paratuberculosis
ugccgacccgcugcagc

SEQ ID NO: 2969750 - RNA, 19 nt, Mycobacterium avium subsp. paratuberculosis
ugccgaccucgauggcgac

SEQ ID NO: 2969751 - RNA, 20 nt, Mycobacterium avium subsp. paratuberculosis
ugccgaccucgauggcgacg

SEQ ID NO: 2969752 - RNA, 14 nt, Mycobacterium avium subsp. paratuberculosis
ugccgacgaccucg

SEQ ID NO: 2969753 - RNA, 22 nt, Mycobacterium avium subsp. paratuberculosis
ugccgacgaccucgucgucgau

SEQ ID NO: 2969754 - RNA, 20 nt, Mycobacterium avium subsp. paratuberculosis
ugccgacgagcucgccgcug

SEQ ID NO: 2969755 - RNA, 17 nt, Mycobacterium avium subsp. paratuberculosis
ugccgacgauccgggcg

SEQ ID NO: 2969756 - RNA, 21 nt, Mycobacterium avium subsp. paratuberculosis
ugccgacgaugagggccagca

SEQ ID NO: 2969757 - RNA, 14 nt, Mycobacterium avium subsp. paratuberculosis
ugccgacggcgccg

SEQ ID NO: 2969758 - RNA, 15 nt, Mycobacterium avium subsp. paratuberculosis
ugccgacggcgccgg

SEQ ID NO: 2969759 - RNA, 16 nt, Mycobacterium avium subsp. paratuberculosis
ugccgacggcgccggu

SEQ ID NO: 2969760 - RNA, 20 nt, Mycobacterium avium subsp. paratuberculosis
ugccgacggucccacucggg

SEQ ID NO: 2969761 - RNA, 21 nt, Mycobacterium avium subsp. paratuberculosis
ugccgacggugcgugccagca

SEQ ID NO: 2969762 - RNA, 22 nt, Mycobacterium avium subsp. paratuberculosis
ugccgacggugucguagacgac

SEQ ID NO: 2969763 - RNA, 14 nt, Mycobacterium avium subsp. paratuberculosis
ugccgacgucggug

SEQ ID NO: 2969764 - RNA, 16 nt, Mycobacterium avium subsp. paratuberculosis
ugccgacgugaugcac

SEQ ID NO: 2969765 - RNA, 21 nt, Mycobacterium avium subsp. paratuberculosis
ugccgacgugaugcacccgga

SEQ ID NO: 2969766 - RNA, 16 nt, Mycobacterium avium subsp. paratuberculosis
ugccgagcaccccguc

SEQ ID NO: 2969767 - RNA, 20 nt, Mycobacterium avium subsp. paratuberculosis
ugccgagcaccccgucgagc

SEQ ID NO: 2969768 - RNA, 17 nt, Mycobacterium avium subsp. paratuberculosis
ugccgagcacgcggccg

SEQ ID NO: 2969769 - RNA, 22 nt, Mycobacterium avium subsp. paratuberculosis
ugccgagcacgcggccgcgccg

SEQ ID NO: 2969770 - RNA, 13 nt, Mycobacterium avium subsp. paratuberculosis
ugccgagcagcac

SEQ ID NO: 2969771 - RNA, 14 nt, Mycobacterium avium subsp. paratuberculosis
ugccgagcagcacc

SEQ ID NO: 2969772 - RNA, 16 nt, Mycobacterium avium subsp. paratuberculosis
ugccgagcagcaccgc

SEQ ID NO: 2969773 - RNA, 17 nt, Mycobacterium avium subsp. paratuberculosis
ugccgagcagcaccgcg

SEQ ID NO: 2969774 - RNA, 12 nt, Mycobacterium avium subsp. paratuberculosis
ugccgagcagcu

SEQ ID NO: 2969775 - RNA, 19 nt, Mycobacterium avium subsp. paratuberculosis
ugccgagcagcucggcggc

SEQ ID NO: 2969776 - RNA, 16 nt, Mycobacterium avium subsp. paratuberculosis
ugccgagcaucagcug

SEQ ID NO: 2969777 - RNA, 19 nt, Mycobacterium avium subsp. paratuberculosis
ugccgagcaucagcugccg

SEQ ID NO: 2969778 - RNA, 21 nt, Mycobacterium avium subsp. paratuberculosis
ugccgagcaucagcugccguc

SEQ ID NO: 2969779 - RNA, 22 nt, Mycobacterium avium subsp. paratuberculosis
ugccgagcaucagcugccgucc

SEQ ID NO: 2969780 - RNA, 14 nt, Mycobacterium avium subsp. paratuberculosis
ugccgagcccgccg

SEQ ID NO: 2969781 - RNA, 16 nt, Mycobacterium avium subsp. paratuberculosis
ugccgagcccgccggc

SEQ ID NO: 2969782 - RNA, 19 nt, Mycobacterium avium subsp. paratuberculosis
ugccgagcccuuugcgcug

SEQ ID NO: 2969783 - RNA, 22 nt, Mycobacterium avium subsp. paratuberculosis
ugccgagcccuuugcgcugccc

SEQ ID NO: 2969784 - RNA, 19 nt, Mycobacterium avium subsp. paratuberculosis
ugccgagccgcuugguggc

SEQ ID NO: 2969785 - RNA, 13 nt, Mycobacterium avium subsp. paratuberculosis
ugccgagccggcc

SEQ ID NO: 2969786 - RNA, 14 nt, Mycobacterium avium subsp. paratuberculosis
ugccgagccggccg

SEQ ID NO: 2969787 - RNA, 15 nt, Mycobacterium avium subsp. paratuberculosis
ugccgagccggccga

SEQ ID NO: 2969788 - RNA, 21 nt, Mycobacterium avium subsp. paratuberculosis
ugccgaggauuucgcgaucga

SEQ ID NO: 2969789 - RNA, 14 nt, Mycobacterium avium subsp. paratuberculosis
ugccgaggcacagc

SEQ ID NO: 2969790 - RNA, 19 nt, Mycobacterium avium subsp. paratuberculosis
ugccgaggcacagcagcac

SEQ ID NO: 2969791 - RNA, 14 nt, Mycobacterium avium subsp. paratuberculosis
ugccgaggcaguuc

SEQ ID NO: 2969792 - RNA, 15 nt, Mycobacterium avium subsp. paratuberculosis
ugccgaguuccugcg

SEQ ID NO: 2969793 - RNA, 21 nt, Mycobacterium avium subsp. paratuberculosis
ugccgaucaccucgccggccg

SEQ ID NO: 2969794 - RNA, 18 nt, Mycobacterium avium subsp. paratuberculosis
ugccgaucacggugaucg

SEQ ID NO: 2969795 - RNA, 18 nt, Mycobacterium avium subsp. paratuberculosis
ugccgaucagcgucagca

SEQ ID NO: 2969796 - RNA, 12 nt, Mycobacterium avium subsp. paratuberculosis
ugccgcgcggcg

SEQ ID NO: 2969797 - RNA, 13 nt, Mycobacterium avium subsp. paratuberculosis
ugccgcgcggcga

SEQ ID NO: 2969798 - RNA, 14 nt, Mycobacterium avium subsp. paratuberculosis
ugccgcgcggcgau

SEQ ID NO: 2969799 - RNA, 22 nt, Mycobacterium avium subsp. paratuberculosis
ugccgcgcggcgauggccgaca

SEQ ID NO: 2969800 - RNA, 13 nt, Mycobacterium avium subsp. paratuberculosis
ugccgcgcggcgc

SEQ ID NO: 2969801 - RNA, 15 nt, Mycobacterium avium subsp. paratuberculosis
ugccgcgcggcgcca

SEQ ID NO: 2969802 - RNA, 21 nt, Mycobacterium avium subsp. paratuberculosis
ugccgcgcggcgccagcggcc

SEQ ID NO: 2969803 - RNA, 14 nt, Mycobacterium avium subsp. paratuberculosis
ugccgcgcggcggu

SEQ ID NO: 2969804 - RNA, 16 nt, Mycobacterium avium subsp. paratuberculosis
ugccgcgcugcgccgg

SEQ ID NO: 2969805 - RNA, 18 nt, Mycobacterium avium subsp. paratuberculosis
ugccgcgcugcgccgggu

SEQ ID NO: 2969806 - RNA, 16 nt, Mycobacterium avium subsp. paratuberculosis
ugccgcggaucagcag

SEQ ID NO: 2969807 - RNA, 11 nt, Mycobacterium avium subsp. paratuberculosis
ugccgcggccg

SEQ ID NO: 2969808 - RNA, 13 nt, Mycobacterium avium subsp. paratuberculosis
ugccgcggccgcg

SEQ ID NO: 2969809 - RNA, 23 nt, Mycobacterium avium subsp. paratuberculosis
ugccgcggccgcguugucgacca

SEQ ID NO: 2969810 - RNA, 12 nt, Mycobacterium avium subsp. paratuberculosis
ugccgcggcgca

SEQ ID NO: 2969811 - RNA, 18 nt, Mycobacterium avium subsp. paratuberculosis
ugccgcggcgcaccccga

SEQ ID NO: 2969812 - RNA, 23 nt, Mycobacterium avium subsp. paratuberculosis
ugccgcggcgcaccccgaaccag

SEQ ID NO: 2969813 - RNA, 13 nt, Mycobacterium avium subsp. paratuberculosis
ugccgcggcggcg

SEQ ID NO: 2969814 - RNA, 20 nt, Mycobacterium avium subsp. paratuberculosis
ugccgcggcggcgccgacgg

SEQ ID NO: 2969815 - RNA, 13 nt, Mycobacterium avium subsp. paratuberculosis
ugccgcggcgucc

SEQ ID NO: 2969816 - RNA, 14 nt, Mycobacterium avium subsp. paratuberculosis
ugccgcgggccagc

SEQ ID NO: 2969817 - RNA, 18 nt, Mycobacterium avium subsp. paratuberculosis
ugccgcgggccagcagcc

SEQ ID NO: 2969818 - RNA, 19 nt, Mycobacterium avium subsp. paratuberculosis
ugccgcggugcggcccgcg

SEQ ID NO: 2969819 - RNA, 20 nt, Mycobacterium avium subsp. paratuberculosis
ugccgcgguugaacaggcug

SEQ ID NO: 2969820 - RNA, 22 nt, Mycobacterium avium subsp. paratuberculosis
ugccgcgugacaggggcagcag

SEQ ID NO: 2969821 - RNA, 20 nt, Mycobacterium avium subsp. paratuberculosis
ugccgcguuccacgcagauc

SEQ ID NO: 2969822 - RNA, 19 nt, Mycobacterium avium subsp. paratuberculosis
ugccgcguucggaggcuuc

SEQ ID NO: 2969823 - RNA, 19 nt, Mycobacterium avium subsp. paratuberculosis
ugccgcuccggucgcgucg

SEQ ID NO: 2969824 - RNA, 14 nt, Mycobacterium avium subsp. paratuberculosis
ugccgcucggcgcu

SEQ ID NO: 2969825 - RNA, 15 nt, Mycobacterium avium subsp. paratuberculosis
ugccgcugacggucg

SEQ ID NO: 2969826 - RNA, 22 nt, Mycobacterium avium subsp. paratuberculosis
ugccgcugcauccgcagcacca

SEQ ID NO: 2969827 - RNA, 14 nt, Mycobacterium avium subsp. paratuberculosis
ugccgcugcgccgg

SEQ ID NO: 2969828 - RNA, 22 nt, Mycobacterium avium subsp. paratuberculosis
ugccgcugcgccggcgcggcca

SEQ ID NO: 2969829 - RNA, 14 nt, Mycobacterium avium subsp. paratuberculosis
ugccgcuggcgucg

SEQ ID NO: 2969830 - RNA, 16 nt, Mycobacterium avium subsp. paratuberculosis
ugccgcuggcgucgau

SEQ ID NO: 2969831 - RNA, 18 nt, Mycobacterium avium subsp. paratuberculosis
ugccgcugggagcacgug

SEQ ID NO: 2969832 - RNA, 20 nt, Mycobacterium avium subsp. paratuberculosis
ugccgcugguaggcggcgca

SEQ ID NO: 2969833 - RNA, 18 nt, Mycobacterium avium subsp. paratuberculosis
ugccgcuggucaggccga

SEQ ID NO: 2969834 - RNA, 19 nt, Mycobacterium avium subsp. paratuberculosis
ugccgcugugauagcggcg

SEQ ID NO: 2969835 - RNA, 20 nt, Mycobacterium avium subsp. paratuberculosis
ugccgcugugauagcggcgu

SEQ ID NO: 2969836 - RNA, 19 nt, Mycobacterium avium subsp. paratuberculosis
ugccggaacaccucgaagu

SEQ ID NO: 2969837 - RNA, 20 nt, Mycobacterium avium subsp. paratuberculosis
ugccggaacgagccggacau

SEQ ID NO: 2969838 - RNA, 14 nt, Mycobacterium avium subsp. paratuberculosis
ugccggaagcggcg

SEQ ID NO: 2969839 - RNA, 14 nt, Mycobacterium avium subsp. paratuberculosis
ugccggacaccccg

SEQ ID NO: 2969840 - RNA, 16 nt, Mycobacterium avium subsp. paratuberculosis
ugccggacaccccggc

SEQ ID NO: 2969841 - RNA, 22 nt, Mycobacterium avium subsp. paratuberculosis
ugccggacaccccggccagucc

SEQ ID NO: 2969842 - RNA, 24 nt, Mycobacterium avium subsp. paratuberculosis
ugccggaccgcgcgggccagcgcc

SEQ ID NO: 2969843 - RNA, 17 nt, Mycobacterium avium subsp. paratuberculosis
ugccggaccucgaccag

SEQ ID NO: 2969844 - RNA, 15 nt, Mycobacterium avium subsp. paratuberculosis
ugccggaggcgccgu

SEQ ID NO: 2969845 - RNA, 15 nt, Mycobacterium avium subsp. paratuberculosis
ugccggaucgggacc

SEQ ID NO: 2969846 - RNA, 14 nt, Mycobacterium avium subsp. paratuberculosis
ugccggaugccgcg

SEQ ID NO: 2969847 - RNA, 17 nt, Mycobacterium avium subsp. paratuberculosis
ugccggaugccgcgcgg

SEQ ID NO: 2969848 - RNA, 18 nt, Mycobacterium avium subsp. paratuberculosis
ugccggaugccgcgcggc

SEQ ID NO: 2969849 - RNA, 16 nt, Mycobacterium avium subsp. paratuberculosis
ugccggcaaccgcugc

SEQ ID NO: 2969850 - RNA, 18 nt, Mycobacterium avium subsp. paratuberculosis
ugccggcauaggccagca

SEQ ID NO: 2969851 - RNA, 20 nt, Mycobacterium avium subsp. paratuberculosis
ugccggcauaggccagcacc

SEQ ID NO: 2969852 - RNA, 22 nt, Mycobacterium avium subsp. paratuberculosis
ugccggcauaggccagcaccag

SEQ ID NO: 2969853 - RNA, 19 nt, Mycobacterium avium subsp. paratuberculosis
ugccggcauccucggcgcg

SEQ ID NO: 2969854 - RNA, 22 nt, Mycobacterium avium subsp. paratuberculosis
ugccggccaaggcaagucgucg

SEQ ID NO: 2969855 - RNA, 23 nt, Mycobacterium avium subsp. paratuberculosis
ugccggccaaggcaagucgucgg

SEQ ID NO: 2969856 - RNA, 14 nt, Mycobacterium avium subsp. paratuberculosis
ugccggccaccggc

SEQ ID NO: 2969857 - RNA, 24 nt, Mycobacterium avium subsp. paratuberculosis
ugccggccagaucgacgccgcggu

SEQ ID NO: 2969858 - RNA, 14 nt, Mycobacterium avium subsp. paratuberculosis
ugccggccagcggc

SEQ ID NO: 2969859 - RNA, 15 nt, Mycobacterium avium subsp. paratuberculosis
ugccggccagcggcc

SEQ ID NO: 2969860 - RNA, 20 nt, Mycobacterium avium subsp. paratuberculosis
ugccggccagcucgccgccg

SEQ ID NO: 2969861 - RNA, 21 nt, Mycobacterium avium subsp. paratuberculosis
ugccggccagcucgccgccga

SEQ ID NO: 2969862 - RNA, 22 nt, Mycobacterium avium subsp. paratuberculosis
ugccggccagcucgccgccgac

SEQ ID NO: 2969863 - RNA, 21 nt, Mycobacterium avium subsp. paratuberculosis
ugccggccagcuuuccggccg

SEQ ID NO: 2969864 - RNA, 12 nt, Mycobacterium avium subsp. paratuberculosis
ugccggccaggc

SEQ ID NO: 2969865 - RNA, 16 nt, Mycobacterium avium subsp. paratuberculosis
ugccggccaucugcug

SEQ ID NO: 2969866 - RNA, 22 nt, Mycobacterium avium subsp. paratuberculosis
ugccggcccgcagcgccucggc

SEQ ID NO: 2969867 - RNA, 20 nt, Mycobacterium avium subsp. paratuberculosis
ugccggccgccgcgcauccg

SEQ ID NO: 2969868 - RNA, 14 nt, Mycobacterium avium subsp. paratuberculosis
ugccggccgcgauc

SEQ ID NO: 2969869 - RNA, 15 nt, Mycobacterium avium subsp. paratuberculosis
ugccggccggcacga

SEQ ID NO: 2969870 - RNA, 16 nt, Mycobacterium avium subsp. paratuberculosis
ugccggccggcagcug

SEQ ID NO: 2969871 - RNA, 18 nt, Mycobacterium avium subsp. paratuberculosis
ugccggccggcagcugcc

SEQ ID NO: 2969872 - RNA, 14 nt, Mycobacterium avium subsp. paratuberculosis
ugccggccgggacg

SEQ ID NO: 2969873 - RNA, 19 nt, Mycobacterium avium subsp. paratuberculosis
ugccggccgggacgcgguc

SEQ ID NO: 2969874 - RNA, 13 nt, Mycobacterium avium subsp. paratuberculosis
ugccggccggggc

SEQ ID NO: 2969875 - RNA, 22 nt, Mycobacterium avium subsp. paratuberculosis
ugccggccgggucgaccgcgau

SEQ ID NO: 2969876 - RNA, 17 nt, Mycobacterium avium subsp. paratuberculosis
ugccggccggucgaagg

SEQ ID NO: 2969877 - RNA, 18 nt, Mycobacterium avium subsp. paratuberculosis
ugccggccucgucggcga

SEQ ID NO: 2969878 - RNA, 20 nt, Mycobacterium avium subsp. paratuberculosis
ugccggccucgucggcgagc

SEQ ID NO: 2969879 - RNA, 21 nt, Mycobacterium avium subsp. paratuberculosis
ugccggccucgucggcgagca

SEQ ID NO: 2969880 - RNA, 19 nt, Mycobacterium avium subsp. paratuberculosis
ugccggccuggcccagccg

SEQ ID NO: 2969881 - RNA, 22 nt, Mycobacterium avium subsp. paratuberculosis
ugccgucaccggccauccgcug

SEQ ID NO: 2969882 - RNA, 18 nt, Mycobacterium avium subsp. paratuberculosis
ugccgucacugucggcgc

SEQ ID NO: 2969883 - RNA, 19 nt, Mycobacterium avium subsp. paratuberculosis
ugccgucacugucggcgcg

SEQ ID NO: 2969884 - RNA, 15 nt, Mycobacterium avium subsp. paratuberculosis
ugccguccacccggc

SEQ ID NO: 2969885 - RNA, 21 nt, Mycobacterium avium subsp. paratuberculosis
ugccguccagcaacgccgaca

SEQ ID NO: 2969886 - RNA, 14 nt, Mycobacterium avium subsp. paratuberculosis
ugccguccagcucc

SEQ ID NO: 2969887 - RNA, 18 nt, Mycobacterium avium subsp. paratuberculosis
ugccguccagcuccgccg

SEQ ID NO: 2969888 - RNA, 22 nt, Mycobacterium avium subsp. paratuberculosis
ugccguccagcuccgccgacac

SEQ ID NO: 2969889 - RNA, 17 nt, Mycobacterium avium subsp. paratuberculosis
ugccgucccccgagcgg

SEQ ID NO: 2969890 - RNA, 13 nt, Mycobacterium avium subsp. paratuberculosis
ugccguccggccg

SEQ ID NO: 2969891 - RNA, 15 nt, Mycobacterium avium subsp. paratuberculosis
ugccguccggccggu

SEQ ID NO: 2969892 - RNA, 15 nt, Mycobacterium avium subsp. paratuberculosis
ugccguccggguccg

SEQ ID NO: 2969893 - RNA, 14 nt, Mycobacterium avium subsp. paratuberculosis
ugccguccgggucg

SEQ ID NO: 2969894 - RNA, 20 nt, Mycobacterium avium subsp. paratuberculosis
ugccguccucggccgccacc

SEQ ID NO: 2969895 - RNA, 13 nt, Mycobacterium avium subsp. paratuberculosis
ugccgucgacgac

SEQ ID NO: 2969896 - RNA, 21 nt, Mycobacterium avium subsp. paratuberculosis
ugccgucgacgaccaccacca

SEQ ID NO: 2969897 - RNA, 14 nt, Mycobacterium avium subsp. paratuberculosis
ugccgucgacgacg

SEQ ID NO: 2969898 - RNA, 18 nt, Mycobacterium avium subsp. paratuberculosis
ugccgucgaucgcccgcu

SEQ ID NO: 2969899 - RNA, 14 nt, Mycobacterium avium subsp. paratuberculosis
ugccgucgaucuug

SEQ ID NO: 2969900 - RNA, 14 nt, Mycobacterium avium subsp. paratuberculosis
ugccgucgcgcucg

SEQ ID NO: 2969901 - RNA, 20 nt, Mycobacterium avium subsp. paratuberculosis
ugccgucgcgcucgacgaug

SEQ ID NO: 2969902 - RNA, 14 nt, Mycobacterium avium subsp. paratuberculosis
ugccgucgcgggcg

SEQ ID NO: 2969903 - RNA, 16 nt, Mycobacterium avium subsp. paratuberculosis
ugccgucggccgccga

SEQ ID NO: 2969904 - RNA, 17 nt, Mycobacterium avium subsp. paratuberculosis
ugccgucggccgccgac

SEQ ID NO: 2969905 - RNA, 17 nt, Mycobacterium avium subsp. paratuberculosis
ugccgucggcgcccggc

SEQ ID NO: 2969906 - RNA, 22 nt, Mycobacterium avium subsp. paratuberculosis
ugccgucggcgucgacgacggc

SEQ ID NO: 2969907 - RNA, 19 nt, Mycobacterium avium subsp. paratuberculosis
ugccgucgggacgcggcag

SEQ ID NO: 2969908 - RNA, 13 nt, Mycobacterium avium subsp. paratuberculosis
ugccgucggugcg

SEQ ID NO: 2969909 - RNA, 14 nt, Mycobacterium avium subsp. paratuberculosis
ugccgucggugguc

SEQ ID NO: 2969910 - RNA, 21 nt, Mycobacterium avium subsp. paratuberculosis
ugccgucggugguccagucga

SEQ ID NO: 2969911 - RNA, 12 nt, Mycobacterium avium subsp. paratuberculosis
ugccgucguuga

SEQ ID NO: 2969912 - RNA, 17 nt, Mycobacterium avium subsp. paratuberculosis
ugccgucguugacgccc

SEQ ID NO: 2969913 - RNA, 23 nt, Mycobacterium avium subsp. paratuberculosis
ugccgucucgauaaacgguugcg

SEQ ID NO: 2969914 - RNA, 22 nt, Mycobacterium avium subsp. paratuberculosis
ugccgugccagccggccgcuga

SEQ ID NO: 2969915 - RNA, 14 nt, Mycobacterium avium subsp. paratuberculosis
ugccgugcgcgcug

SEQ ID NO: 2969916 - RNA, 20 nt, Mycobacterium avium subsp. paratuberculosis
ugccgugcgcgcuggugcug

SEQ ID NO: 2969917 - RNA, 17 nt, Mycobacterium avium subsp. paratuberculosis
ugccgugcucggcggcg

SEQ ID NO: 2969918 - RNA, 19 nt, Mycobacterium avium subsp. paratuberculosis
ugccgugcugggacagcga

SEQ ID NO: 2969919 - RNA, 13 nt, Mycobacterium avium subsp. paratuberculosis
ugccguggcggcg

SEQ ID NO: 2969920 - RNA, 23 nt, Mycobacterium avium subsp. paratuberculosis
ugccguggcggcggugucgccca

SEQ ID NO: 2969921 - RNA, 13 nt, Mycobacterium avium subsp. paratuberculosis
ugccguggucggc

SEQ ID NO: 2969922 - RNA, 15 nt, Mycobacterium avium subsp. paratuberculosis
ugccguggucggcga

SEQ ID NO: 2969923 - RNA, 16 nt, Mycobacterium avium subsp. paratuberculosis
ugccguggucggugcc

SEQ ID NO: 2969924 - RNA, 15 nt, Mycobacterium avium subsp. paratuberculosis
ugccguggugcccuc

SEQ ID NO: 2969925 - RNA, 14 nt, Mycobacterium avium subsp. paratuberculosis
ugccguucagcgcg

SEQ ID NO: 2969926 - RNA, 15 nt, Mycobacterium avium subsp. paratuberculosis
ugccguucagcgcgg

SEQ ID NO: 2969927 - RNA, 17 nt, Mycobacterium avium subsp. paratuberculosis
ugccguucagcgcggcc

SEQ ID NO: 2969928 - RNA, 18 nt, Mycobacterium avium subsp. paratuberculosis
ugccguucagcgcggcca

SEQ ID NO: 2969929 - RNA, 21 nt, Mycobacterium avium subsp. paratuberculosis
ugccguucagcgcggccaccu

SEQ ID NO: 2969930 - RNA, 12 nt, Mycobacterium avium subsp. paratuberculosis
ugccguuccagc

SEQ ID NO: 2969931 - RNA, 15 nt, Mycobacterium avium subsp. paratuberculosis
ugccguuccagccgg

SEQ ID NO: 2969932 - RNA, 21 nt, Mycobacterium avium subsp. paratuberculosis
ugccguuccagccggcccgca

SEQ ID NO: 2969933 - RNA, 19 nt, Mycobacterium avium subsp. paratuberculosis
ugccguuccagggugucga

SEQ ID NO: 2969934 - RNA, 14 nt, Mycobacterium avium subsp. paratuberculosis
ugccguucgcgccg

SEQ ID NO: 2969935 - RNA, 16 nt, Mycobacterium avium subsp. paratuberculosis
ugccguucgcgccgua

SEQ ID NO: 2969936 - RNA, 22 nt, Mycobacterium avium subsp. paratuberculosis
ugccguucggccagcgccgcca

SEQ ID NO: 2969937 - RNA, 19 nt, Mycobacterium avium subsp. paratuberculosis
ugccguugaucagggcggc

SEQ ID NO: 2969938 - RNA, 22 nt, Mycobacterium avium subsp. paratuberculosis
ugccguugaucagggcggcgcg

SEQ ID NO: 2969939 - RNA, 23 nt, Mycobacterium avium subsp. paratuberculosis
ugccguugaugaagaccuggccg

SEQ ID NO: 2969940 - RNA, 16 nt, Mycobacterium avium subsp. paratuberculosis
ugccguugccaggccg

SEQ ID NO: 2969941 - RNA, 17 nt, Mycobacterium avium subsp. paratuberculosis
ugccguugccaggccgc

SEQ ID NO: 2969942 - RNA, 19 nt, Mycobacterium avium subsp. paratuberculosis
ugccguugccaggccgcga

SEQ ID NO: 2969943 - RNA, 17 nt, Mycobacterium avium subsp. paratuberculosis
ugccguugcgccagcgg

SEQ ID NO: 2969944 - RNA, 19 nt, Mycobacterium avium subsp. paratuberculosis
ugccuacaggugccggcgg

SEQ ID NO: 2969945 - RNA, 20 nt, Mycobacterium avium subsp. paratuberculosis
ugccuacaggugccggcggc

SEQ ID NO: 2969946 - RNA, 17 nt, Mycobacterium avium subsp. paratuberculosis
ugccuacuugcggccgc

SEQ ID NO: 2969947 - RNA, 19 nt, Mycobacterium avium subsp. paratuberculosis
ugccuaggggagcagcacg

SEQ ID NO: 2969948 - RNA, 17 nt, Mycobacterium avium subsp. paratuberculosis
ugccuccacgucaccga

SEQ ID NO: 2969949 - RNA, 21 nt, Mycobacterium avium subsp. paratuberculosis
ugccucgacgauggguguggu

SEQ ID NO: 2969950 - RNA, 21 nt, Mycobacterium avium subsp. paratuberculosis
ugccucgccacugggcgucgg

SEQ ID NO: 2969951 - RNA, 18 nt, Mycobacterium avium subsp. paratuberculosis
ugccucuucggcgcgccg

SEQ ID NO: 2969952 - RNA, 20 nt, Mycobacterium avium subsp. paratuberculosis
ugccucuucggcgcgccggc

SEQ ID NO: 2969953 - RNA, 23 nt, Mycobacterium avium subsp. paratuberculosis
ugccucuucggcgcgccggcgau

SEQ ID NO: 2969954 - RNA, 23 nt, Mycobacterium avium subsp. paratuberculosis
ugccucuucgucggccggcaguu

SEQ ID NO: 2969955 - RNA, 22 nt, Mycobacterium avium subsp. paratuberculosis
ugccugcccgcgcaggccccgg

SEQ ID NO: 2969956 - RNA, 23 nt, Mycobacterium avium subsp. paratuberculosis
ugccugcgcccacagguccagcg

SEQ ID NO: 2969957 - RNA, 10 nt, Mycobacterium avium subsp. paratuberculosis
ugccugcggg

SEQ ID NO: 2969958 - RNA, 12 nt, Mycobacterium avium subsp. paratuberculosis
ugccugcgggcc

SEQ ID NO: 2969959 - RNA, 21 nt, Mycobacterium avium subsp. paratuberculosis
ugccugcugcccauccaggcc

SEQ ID NO: 2969960 - RNA, 17 nt, Mycobacterium avium subsp. paratuberculosis
ugccuggccacgugguc

SEQ ID NO: 2969961 - RNA, 20 nt, Mycobacterium avium subsp. paratuberculosis
ugccuggcuccccggcgauc

SEQ ID NO: 2969962 - RNA, 15 nt, Mycobacterium avium subsp. paratuberculosis
ugccugguucgacgu

SEQ ID NO: 2969963 - RNA, 16 nt, Mycobacterium avium subsp. paratuberculosis
ugccugguucgacgug

SEQ ID NO: 2969964 - RNA, 17 nt, Mycobacterium avium subsp. paratuberculosis
ugccuuggcccgcgcgg

SEQ ID NO: 2969965 - RNA, 13 nt, Mycobacterium avium subsp. paratuberculosis
ugcgccaccgaca

SEQ ID NO: 2969966 - RNA, 14 nt, Mycobacterium avium subsp. paratuberculosis
ugcgccaccgacac

SEQ ID NO: 2969967 - RNA, 19 nt, Mycobacterium avium subsp. paratuberculosis
ugcgccaccgacaccaccg

SEQ ID NO: 2969968 - RNA, 21 nt, Mycobacterium avium subsp. paratuberculosis
ugcgccacgcccgcagcgcau

SEQ ID NO: 2969969 - RNA, 17 nt, Mycobacterium avium subsp. paratuberculosis
ugcgccacugcgggaac

SEQ ID NO: 2969970 - RNA, 14 nt, Mycobacterium avium subsp. paratuberculosis
ugcgccagaucagc

SEQ ID NO: 2969971 - RNA, 18 nt, Mycobacterium avium subsp. paratuberculosis
ugcgccagaucagcgugg

SEQ ID NO: 2969972 - RNA, 20 nt, Mycobacterium avium subsp. paratuberculosis
ugcgccagaucgcugaugcg

SEQ ID NO: 2969973 - RNA, 14 nt, Mycobacterium avium subsp. paratuberculosis
ugcgccagcaccga

SEQ ID NO: 2969974 - RNA, 13 nt, Mycobacterium avium subsp. paratuberculosis
ugcgccagcagca

SEQ ID NO: 2969975 - RNA, 16 nt, Mycobacterium avium subsp. paratuberculosis
ugcgccagcagcaacg

SEQ ID NO: 2969976 - RNA, 21 nt, Mycobacterium avium subsp. paratuberculosis
ugcgccagcagcaacgcggug

SEQ ID NO: 2969977 - RNA, 19 nt, Mycobacterium avium subsp. paratuberculosis
ugcgccagcagcagcgcgg

SEQ ID NO: 2969978 - RNA, 15 nt, Mycobacterium avium subsp. paratuberculosis
ugcgccagcagggca

SEQ ID NO: 2969979 - RNA, 19 nt, Mycobacterium avium subsp. paratuberculosis
ugcgccagcagggcaucuc

SEQ ID NO: 2969980 - RNA, 16 nt, Mycobacterium avium subsp. paratuberculosis
ugcgccagcgaccgca

SEQ ID NO: 2969981 - RNA, 17 nt, Mycobacterium avium subsp. paratuberculosis
ugcgccagcgaccgcag

SEQ ID NO: 2969982 - RNA, 17 nt, Mycobacterium avium subsp. paratuberculosis
ugcgccagcgacggccg

SEQ ID NO: 2969983 - RNA, 18 nt, Mycobacterium avium subsp. paratuberculosis
ugcgccagcgacggccgg

SEQ ID NO: 2969984 - RNA, 18 nt, Mycobacterium avium subsp. paratuberculosis
ugcgccagcgugaacagc

SEQ ID NO: 2969985 - RNA, 19 nt, Mycobacterium avium subsp. paratuberculosis
ugcgccagcuccagcagcc

SEQ ID NO: 2969986 - RNA, 21 nt, Mycobacterium avium subsp. paratuberculosis
ugcgccagcuccagcagcccg

SEQ ID NO: 2969987 - RNA, 18 nt, Mycobacterium avium subsp. paratuberculosis
ugcgccaggauccgcccg

SEQ ID NO: 2969988 - RNA, 21 nt, Mycobacterium avium subsp. paratuberculosis
ugcgccaggauccgcccgccg

SEQ ID NO: 2969989 - RNA, 18 nt, Mycobacterium avium subsp. paratuberculosis
ugcgccaguuugccgucg

SEQ ID NO: 2969990 - RNA, 24 nt, Mycobacterium avium subsp. paratuberculosis
ugcgccaucuucacgugcgcggcg

SEQ ID NO: 2969991 - RNA, 23 nt, Mycobacterium avium subsp. paratuberculosis
ugcgccauguccggcaggcucag

SEQ ID NO: 2969992 - RNA, 16 nt, Mycobacterium avium subsp. paratuberculosis
ugcgcccacaguccgc

SEQ ID NO: 2969993 - RNA, 19 nt, Mycobacterium avium subsp. paratuberculosis
ugcgcccacgugccaucgc

SEQ ID NO: 2969994 - RNA, 18 nt, Mycobacterium avium subsp. paratuberculosis
ugcgcccagaugccggcg

SEQ ID NO: 2969995 - RNA, 14 nt, Mycobacterium avium subsp. paratuberculosis
ugcgcccagguacu

SEQ ID NO: 2969996 - RNA, 19 nt, Mycobacterium avium subsp. paratuberculosis
ugcgcccauccggcgccgc

SEQ ID NO: 2969997 - RNA, 20 nt, Mycobacterium avium subsp. paratuberculosis
ugcgcccauccggcgccgcg

SEQ ID NO: 2969998 - RNA, 17 nt, Mycobacterium avium subsp. paratuberculosis
ugcgcccgaucgugcgc

SEQ ID NO: 2969999 - RNA, 14 nt, Mycobacterium avium subsp. paratuberculosis
ugcgcccgccgaac

SEQ ID NO: 2970000 - RNA, 21 nt, Mycobacterium avium subsp. paratuberculosis
ugcgcccgccgaacaccggca

SEQ ID NO: 2970001 - RNA, 17 nt, Mycobacterium avium subsp. paratuberculosis
ugcgcccgccgccacca

SEQ ID NO: 2970002 - RNA, 19 nt, Mycobacterium avium subsp. paratuberculosis
ugcgcccgccgccaccacg

SEQ ID NO: 2970003 - RNA, 21 nt, Mycobacterium avium subsp. paratuberculosis
ugcgcccgccgccaccacggc

SEQ ID NO: 2970004 - RNA, 14 nt, Mycobacterium avium subsp. paratuberculosis
ugcgcccgcugcgg

SEQ ID NO: 2970005 - RNA, 10 nt, Mycobacterium avium subsp. paratuberculosis
ugcgcccggc

SEQ ID NO: 2970006 - RNA, 13 nt, Mycobacterium avium subsp. paratuberculosis
ugcgcccggucac

SEQ ID NO: 2970007 - RNA, 20 nt, Mycobacterium avium subsp. paratuberculosis
ugcgcccguagcggcggaac

SEQ ID NO: 2970008 - RNA, 21 nt, Mycobacterium avium subsp. paratuberculosis
ugcgcccguagcggcggaacu

SEQ ID NO: 2970009 - RNA, 20 nt, Mycobacterium avium subsp. paratuberculosis
ugcgcccgucgucgccgaug

SEQ ID NO: 2970010 - RNA, 20 nt, Mycobacterium avium subsp. paratuberculosis
ugcgcccugguugauccagc

SEQ ID NO: 2970011 - RNA, 19 nt, Mycobacterium avium subsp. paratuberculosis
ugcgccgacagcugagcag

SEQ ID NO: 2970012 - RNA, 19 nt, Mycobacterium avium subsp. paratuberculosis
ugcgccgaccgcgaucgag

SEQ ID NO: 2970013 - RNA, 21 nt, Mycobacterium avium subsp. paratuberculosis
ugcgccgacuugaucgcggcg

SEQ ID NO: 2970014 - RNA, 16 nt, Mycobacterium avium subsp. paratuberculosis
ugcgccgaggucaccg

SEQ ID NO: 2970015 - RNA, 18 nt, Mycobacterium avium subsp. paratuberculosis
ugcgccgaggucaccgcg

SEQ ID NO: 2970016 - RNA, 17 nt, Mycobacterium avium subsp. paratuberculosis
ugcgccgcaacggcgca

SEQ ID NO: 2970017 - RNA, 12 nt, Mycobacterium avium subsp. paratuberculosis
ugcgccgcacca

SEQ ID NO: 2970018 - RNA, 22 nt, Mycobacterium avium subsp. paratuberculosis
ugcgccgcaccaguuccugcau

SEQ ID NO: 2970019 - RNA, 19 nt, Mycobacterium avium subsp. paratuberculosis
ugcgccgcagcggugaucg

SEQ ID NO: 2970020 - RNA, 21 nt, Mycobacterium avium subsp. paratuberculosis
ugcgccgcauuggugccggcc

SEQ ID NO: 2970021 - RNA, 21 nt, Mycobacterium avium subsp. paratuberculosis
ugcgccgcccacaccgacacc

SEQ ID NO: 2970022 - RNA, 13 nt, Mycobacterium avium subsp. paratuberculosis
ugcgccgccgcgu

SEQ ID NO: 2970023 - RNA, 12 nt, Mycobacterium avium subsp. paratuberculosis
ugcgccgccgua

SEQ ID NO: 2970024 - RNA, 18 nt, Mycobacterium avium subsp. paratuberculosis
ugcgccgccuccgggcug

SEQ ID NO: 2970025 - RNA, 17 nt, Mycobacterium avium subsp. paratuberculosis
ugcgccgcgagcgcagc

SEQ ID NO: 2970026 - RNA, 20 nt, Mycobacterium avium subsp. paratuberculosis
ugcgccgcgagcgcagcagg

SEQ ID NO: 2970027 - RNA, 21 nt, Mycobacterium avium subsp. paratuberculosis
ugcgccgcgagcgcagcaggu

SEQ ID NO: 2970028 - RNA, 22 nt, Mycobacterium avium subsp. paratuberculosis
ugcgccgcgcuugcgaucgccg

SEQ ID NO: 2970029 - RNA, 20 nt, Mycobacterium avium subsp. paratuberculosis
ugcgccgcggcggcucggcg

SEQ ID NO: 2970030 - RNA, 14 nt, Mycobacterium avium subsp. paratuberculosis
ugcgccgcggugcg

SEQ ID NO: 2970031 - RNA, 16 nt, Mycobacterium avium subsp. paratuberculosis
ugcgccgcgucgacgc

SEQ ID NO: 2970032 - RNA, 17 nt, Mycobacterium avium subsp. paratuberculosis
ugcgccgcgucgacgcc

SEQ ID NO: 2970033 - RNA, 18 nt, Mycobacterium avium subsp. paratuberculosis
ugcgccgcgucgacgccg

SEQ ID NO: 2970034 - RNA, 20 nt, Mycobacterium avium subsp. paratuberculosis
ugcgccgcucgucggccagc

SEQ ID NO: 2970035 - RNA, 14 nt, Mycobacterium avium subsp. paratuberculosis
ugcgccggauucgg

SEQ ID NO: 2970036 - RNA, 19 nt, Mycobacterium avium subsp. paratuberculosis
ugcgccggauucggcgcgg

SEQ ID NO: 2970037 - RNA, 15 nt, Mycobacterium avium subsp. paratuberculosis
ugcgccggcaacugg

SEQ ID NO: 2970038 - RNA, 12 nt, Mycobacterium avium subsp. paratuberculosis
ugcgccggcggc

SEQ ID NO: 2970039 - RNA, 17 nt, Mycobacterium avium subsp. paratuberculosis
ugcgccggcggccgcga

SEQ ID NO: 2970040 - RNA, 12 nt, Mycobacterium avium subsp. paratuberculosis
ugcgccggcggu

SEQ ID NO: 2970041 - RNA, 20 nt, Mycobacterium avium subsp. paratuberculosis
ugcgccggcgguaugcccgg

SEQ ID NO: 2970042 - RNA, 14 nt, Mycobacterium avium subsp. paratuberculosis
ugcgccggcggugc

SEQ ID NO: 2970043 - RNA, 15 nt, Mycobacterium avium subsp. paratuberculosis
ugcgccggcggugcg

SEQ ID NO: 2970044 - RNA, 16 nt, Mycobacterium avium subsp. paratuberculosis
ugcgccggcuccaccg

SEQ ID NO: 2970045 - RNA, 17 nt, Mycobacterium avium subsp. paratuberculosis
ugcgccggcuccaccgc

SEQ ID NO: 2970046 - RNA, 21 nt, Mycobacterium avium subsp. paratuberculosis
ugcgccggcuccaccgcgccg

SEQ ID NO: 2970047 - RNA, 22 nt, Mycobacterium avium subsp. paratuberculosis
ugcgccggcuuucgaagagccg

SEQ ID NO: 2970048 - RNA, 13 nt, Mycobacterium avium subsp. paratuberculosis
ugcgccggggccg

SEQ ID NO: 2970049 - RNA, 13 nt, Mycobacterium avium subsp. paratuberculosis
ugcgccgggucca

SEQ ID NO: 2970050 - RNA, 18 nt, Mycobacterium avium subsp. paratuberculosis
ugcgcgucggagaucacc

SEQ ID NO: 2970051 - RNA, 15 nt, Mycobacterium avium subsp. paratuberculosis
ugcgcgucggccgca

SEQ ID NO: 2970052 - RNA, 16 nt, Mycobacterium avium subsp. paratuberculosis
ugcgcgugacgcgcgu

SEQ ID NO: 2970053 - RNA, 20 nt, Mycobacterium avium subsp. paratuberculosis
ugcgcguggggcgucgccgc

SEQ ID NO: 2970054 - RNA, 22 nt, Mycobacterium avium subsp. paratuberculosis
ugcgcguggggcgucgccgccc

SEQ ID NO: 2970055 - RNA, 19 nt, Mycobacterium avium subsp. paratuberculosis
ugcgcguucggcgccaccc

SEQ ID NO: 2970056 - RNA, 15 nt, Mycobacterium avium subsp. paratuberculosis
ugcgcguugcgcgga

SEQ ID NO: 2970057 - RNA, 16 nt, Mycobacterium avium subsp. paratuberculosis
ugcgcuccucgacgua

SEQ ID NO: 2970058 - RNA, 16 nt, Mycobacterium avium subsp. paratuberculosis
ugcgcucgaccucggc

SEQ ID NO: 2970059 - RNA, 12 nt, Mycobacterium avium subsp. paratuberculosis
ugcgcucgacgg

SEQ ID NO: 2970060 - RNA, 13 nt, Mycobacterium avium subsp. paratuberculosis
ugcgcucggccgg

SEQ ID NO: 2970061 - RNA, 14 nt, Mycobacterium avium subsp. paratuberculosis
ugcgcucggccggg

SEQ ID NO: 2970062 - RNA, 17 nt, Mycobacterium avium subsp. paratuberculosis
ugcgcucggucgcggcg

SEQ ID NO: 2970063 - RNA, 16 nt, Mycobacterium avium subsp. paratuberculosis
ugcgcugcaaccgguc

SEQ ID NO: 2970064 - RNA, 18 nt, Mycobacterium avium subsp. paratuberculosis
ugcgcugcaaccgguccg

SEQ ID NO: 2970065 - RNA, 19 nt, Mycobacterium avium subsp. paratuberculosis
ugcgcugcagcgagaccuc

SEQ ID NO: 2970066 - RNA, 13 nt, Mycobacterium avium subsp. paratuberculosis
ugcgcugcccgau

SEQ ID NO: 2970067 - RNA, 19 nt, Mycobacterium avium subsp. paratuberculosis
ugcgcugcuuagccccucc

SEQ ID NO: 2970068 - RNA, 14 nt, Mycobacterium avium subsp. paratuberculosis
ugcgcuguggugac

SEQ ID NO: 2970069 - RNA, 15 nt, Mycobacterium avium subsp. paratuberculosis
ugcgcuguggugacg

SEQ ID NO: 2970070 - RNA, 15 nt, Mycobacterium avium subsp. paratuberculosis
ugcgcuugcggcgca

SEQ ID NO: 2970071 - RNA, 17 nt, Mycobacterium avium subsp. paratuberculosis
ugcgcuugggucgccgg

SEQ ID NO: 2970072 - RNA, 15 nt, Mycobacterium avium subsp. paratuberculosis
ugcgcuugucagcgg

SEQ ID NO: 2970073 - RNA, 13 nt, Mycobacterium avium subsp. paratuberculosis
ugcggaacaccgc

SEQ ID NO: 2970074 - RNA, 14 nt, Mycobacterium avium subsp. paratuberculosis
ugcggaacaccgcc

SEQ ID NO: 2970075 - RNA, 20 nt, Mycobacterium avium subsp. paratuberculosis
ugcggacccaggcagcgcga

SEQ ID NO: 2970076 - RNA, 19 nt, Mycobacterium avium subsp. paratuberculosis
ugcggacgcguugaaaguc

SEQ ID NO: 2970077 - RNA, 16 nt, Mycobacterium avium subsp. paratuberculosis
ugcggacggucgccga

SEQ ID NO: 2970078 - RNA, 20 nt, Mycobacterium avium subsp. paratuberculosis
ugcggacggucgccgacgua

SEQ ID NO: 2970079 - RNA, 16 nt, Mycobacterium avium subsp. paratuberculosis
ugcggagaucgugcug

SEQ ID NO: 2970080 - RNA, 14 nt, Mycobacterium avium subsp. paratuberculosis
ugcggaucgggcgu

SEQ ID NO: 2970081 - RNA, 20 nt, Mycobacterium avium subsp. paratuberculosis
ugcggaucgggcguggcguc

SEQ ID NO: 2970082 - RNA, 23 nt, Mycobacterium avium subsp. paratuberculosis
ugcggaucgggcguggcgucggu

SEQ ID NO: 2970083 - RNA, 20 nt, Mycobacterium avium subsp. paratuberculosis
ugcggaucggugcaggccgc

SEQ ID NO: 2970084 - RNA, 15 nt, Mycobacterium avium subsp. paratuberculosis
ugcggaucucgaccu

SEQ ID NO: 2970085 - RNA, 21 nt, Mycobacterium avium subsp. paratuberculosis
ugcggaugaagugcgccagcg

SEQ ID NO: 2970086 - RNA, 16 nt, Mycobacterium avium subsp. paratuberculosis
ugcggaugcgggccac

SEQ ID NO: 2970087 - RNA, 14 nt, Mycobacterium avium subsp. paratuberculosis
ugcggauggccccg

SEQ ID NO: 2970088 - RNA, 14 nt, Mycobacterium avium subsp. paratuberculosis
ugcggaugucggug

SEQ ID NO: 2970089 - RNA, 14 nt, Mycobacterium avium subsp. paratuberculosis
ugcggcaacccgau

SEQ ID NO: 2970090 - RNA, 12 nt, Mycobacterium avium subsp. paratuberculosis
ugcggcacacca

SEQ ID NO: 2970091 - RNA, 13 nt, Mycobacterium avium subsp. paratuberculosis
ugcggcacaccag

SEQ ID NO: 2970092 - RNA, 21 nt, Mycobacterium avium subsp. paratuberculosis
ugcggcacaggcgaaucggcg

SEQ ID NO: 2970093 - RNA, 13 nt, Mycobacterium avium subsp. paratuberculosis
ugcggcaccagcc

SEQ ID NO: 2970094 - RNA, 16 nt, Mycobacterium avium subsp. paratuberculosis
ugcggcaccagcccgc

SEQ ID NO: 2970095 - RNA, 20 nt, Mycobacterium avium subsp. paratuberculosis
ugcggcaccagcccgccguc

SEQ ID NO: 2970096 - RNA, 12 nt, Mycobacterium avium subsp. paratuberculosis
ugcggcaccucg

SEQ ID NO: 2970097 - RNA, 16 nt, Mycobacterium avium subsp. paratuberculosis
ugcggcaccucggccu

SEQ ID NO: 2970098 - RNA, 12 nt, Mycobacterium avium subsp. paratuberculosis
ugcggcacgccg

SEQ ID NO: 2970099 - RNA, 19 nt, Mycobacterium avium subsp. paratuberculosis
ugcggcacgccgaccaccc

SEQ ID NO: 2970100 - RNA, 15 nt, Mycobacterium avium subsp. paratuberculosis
ugcggcacggcgagg

SEQ ID NO: 2970101 - RNA, 18 nt, Mycobacterium avium subsp. paratuberculosis
ugcggcacggugcgggug

SEQ ID NO: 2970102 - RNA, 18 nt, Mycobacterium avium subsp. paratuberculosis
ugcggcagaccgguggcg

SEQ ID NO: 2970103 - RNA, 15 nt, Mycobacterium avium subsp. paratuberculosis
ugcggcagcucggcg

SEQ ID NO: 2970104 - RNA, 16 nt, Mycobacterium avium subsp. paratuberculosis
ugcggcagcucggcgg

SEQ ID NO: 2970105 - RNA, 21 nt, Mycobacterium avium subsp. paratuberculosis
ugcggcagcucggcggcccgc

SEQ ID NO: 2970106 - RNA, 18 nt, Mycobacterium avium subsp. paratuberculosis
ugcggcagggccaccguc

SEQ ID NO: 2970107 - RNA, 20 nt, Mycobacterium avium subsp. paratuberculosis
ugcggcaggucggccagcgc

SEQ ID NO: 2970108 - RNA, 14 nt, Mycobacterium avium subsp. paratuberculosis
ugcggccagcgcag

SEQ ID NO: 2970109 - RNA, 15 nt, Mycobacterium avium subsp. paratuberculosis
ugcggccagcgcagg

SEQ ID NO: 2970110 - RNA, 17 nt, Mycobacterium avium subsp. paratuberculosis
ugcggccagcgcaggua

SEQ ID NO: 2970111 - RNA, 18 nt, Mycobacterium avium subsp. paratuberculosis
ugcggccagcgcagguac

SEQ ID NO: 2970112 - RNA, 16 nt, Mycobacterium avium subsp. paratuberculosis
ugcggccagugccggg

SEQ ID NO: 2970113 - RNA, 13 nt, Mycobacterium avium subsp. paratuberculosis
ugcggcccacccg

SEQ ID NO: 2970114 - RNA, 13 nt, Mycobacterium avium subsp. paratuberculosis
ugcggcccagccc

SEQ ID NO: 2970115 - RNA, 16 nt, Mycobacterium avium subsp. paratuberculosis
ugcggcccagcccggc

SEQ ID NO: 2970116 - RNA, 21 nt, Mycobacterium avium subsp. paratuberculosis
ugcggcccagcccggccagca

SEQ ID NO: 2970117 - RNA, 23 nt, Mycobacterium avium subsp. paratuberculosis
ugcggcccagcccggccagcacc

SEQ ID NO: 2970118 - RNA, 12 nt, Mycobacterium avium subsp. paratuberculosis
ugcggcccagcg

SEQ ID NO: 2970119 - RNA, 16 nt, Mycobacterium avium subsp. paratuberculosis
ugcggccccugcgggg

SEQ ID NO: 2970120 - RNA, 14 nt, Mycobacterium avium subsp. paratuberculosis
ugcggcccgacccg

SEQ ID NO: 2970121 - RNA, 15 nt, Mycobacterium avium subsp. paratuberculosis
ugcggcccgacccgg

SEQ ID NO: 2970122 - RNA, 16 nt, Mycobacterium avium subsp. paratuberculosis
ugcggcccgacccggu

SEQ ID NO: 2970123 - RNA, 20 nt, Mycobacterium avium subsp. paratuberculosis
ugcggcccgccgggcgucgc

SEQ ID NO: 2970124 - RNA, 23 nt, Mycobacterium avium subsp. paratuberculosis
ugcggcccgcggcaucgucgggg

SEQ ID NO: 2970125 - RNA, 13 nt, Mycobacterium avium subsp. paratuberculosis
ugcggcccggcac

SEQ ID NO: 2970126 - RNA, 16 nt, Mycobacterium avium subsp. paratuberculosis
ugcggcccggcacugg

SEQ ID NO: 2970127 - RNA, 23 nt, Mycobacterium avium subsp. paratuberculosis
ugcggcccggccacucgccgcga

SEQ ID NO: 2970128 - RNA, 11 nt, Mycobacterium avium subsp. paratuberculosis
ugcggcccguc

SEQ ID NO: 2970129 - RNA, 17 nt, Mycobacterium avium subsp. paratuberculosis
ugcggcccgucgccgug

SEQ ID NO: 2970130 - RNA, 22 nt, Mycobacterium avium subsp. paratuberculosis
ugcggcccugguugagcaccgc

SEQ ID NO: 2970131 - RNA, 20 nt, Mycobacterium avium subsp. paratuberculosis
ugcggccgacuuggucagcc

SEQ ID NO: 2970132 - RNA, 22 nt, Mycobacterium avium subsp. paratuberculosis
ugcggccgcagcgcccggcagc

SEQ ID NO: 2970133 - RNA, 14 nt, Mycobacterium avium subsp. paratuberculosis
ugcggccgccgauc

SEQ ID NO: 2970134 - RNA, 16 nt, Mycobacterium avium subsp. paratuberculosis
ugcggccgccggccag

SEQ ID NO: 2970135 - RNA, 19 nt, Mycobacterium avium subsp. paratuberculosis
ugcggggccuucucgccgu

SEQ ID NO: 2970136 - RNA, 16 nt, Mycobacterium avium subsp. paratuberculosis
ugcggggugugcaggc

SEQ ID NO: 2970137 - RNA, 16 nt, Mycobacterium avium subsp. paratuberculosis
ugcgggucacacccuc

SEQ ID NO: 2970138 - RNA, 18 nt, Mycobacterium avium subsp. paratuberculosis
ugcgggucacggucaggc

SEQ ID NO: 2970139 - RNA, 14 nt, Mycobacterium avium subsp. paratuberculosis
ugcgggucagcagc

SEQ ID NO: 2970140 - RNA, 12 nt, Mycobacterium avium subsp. paratuberculosis
ugcgggucucga

SEQ ID NO: 2970141 - RNA, 18 nt, Mycobacterium avium subsp. paratuberculosis
ugcgggucugcucacgca

SEQ ID NO: 2970142 - RNA, 16 nt, Mycobacterium avium subsp. paratuberculosis
ugcgggugcggccagc

SEQ ID NO: 2970143 - RNA, 18 nt, Mycobacterium avium subsp. paratuberculosis
ugcgggugcggccagcgc

SEQ ID NO: 2970144 - RNA, 16 nt, Mycobacterium avium subsp. paratuberculosis
ugcgggugcggccggu

SEQ ID NO: 2970145 - RNA, 21 nt, Mycobacterium avium subsp. paratuberculosis
ugcggguggccgggucgccgu

SEQ ID NO: 2970146 - RNA, 21 nt, Mycobacterium avium subsp. paratuberculosis
ugcgggugguguggcgucggc

SEQ ID NO: 2970147 - RNA, 22 nt, Mycobacterium avium subsp. paratuberculosis
ugcggguguccgagcgggccgu

SEQ ID NO: 2970148 - RNA, 15 nt, Mycobacterium avium subsp. paratuberculosis
ugcgggugucgccgg

SEQ ID NO: 2970149 - RNA, 13 nt, Mycobacterium avium subsp. paratuberculosis
ugcggguguugac

SEQ ID NO: 2970150 - RNA, 15 nt, Mycobacterium avium subsp. paratuberculosis
ugcggguugcgggcc

SEQ ID NO: 2970151 - RNA, 19 nt, Mycobacterium avium subsp. paratuberculosis
ugcggguugcgggccaggc

SEQ ID NO: 2970152 - RNA, 16 nt, Mycobacterium avium subsp. paratuberculosis
ugcgguacaucccgcc

SEQ ID NO: 2970153 - RNA, 21 nt, Mycobacterium avium subsp. paratuberculosis
ugcgguacaucccgccgggca

SEQ ID NO: 2970154 - RNA, 13 nt, Mycobacterium avium subsp. paratuberculosis
ugcgguccaggau

SEQ ID NO: 2970155 - RNA, 20 nt, Mycobacterium avium subsp. paratuberculosis
ugcgguccaggauccgcacc

SEQ ID NO: 2970156 - RNA, 15 nt, Mycobacterium avium subsp. paratuberculosis
ugcgguccccggaga

SEQ ID NO: 2970157 - RNA, 17 nt, Mycobacterium avium subsp. paratuberculosis
ugcgguccucgagcugg

SEQ ID NO: 2970158 - RNA, 19 nt, Mycobacterium avium subsp. paratuberculosis
ugcggucgaugacgccgcg

SEQ ID NO: 2970159 - RNA, 22 nt, Mycobacterium avium subsp. paratuberculosis
ugcggucgaugacgccgcgccg

SEQ ID NO: 2970160 - RNA, 14 nt, Mycobacterium avium subsp. paratuberculosis
ugcggucgcgcagc

SEQ ID NO: 2970161 - RNA, 20 nt, Mycobacterium avium subsp. paratuberculosis
ugcggucgcgcagccgggcg

SEQ ID NO: 2970162 - RNA, 22 nt, Mycobacterium avium subsp. paratuberculosis
ugcggucgcgcagccgggcggc

SEQ ID NO: 2970163 - RNA, 12 nt, Mycobacterium avium subsp. paratuberculosis
ugcggucggcgc

SEQ ID NO: 2970164 - RNA, 12 nt, Mycobacterium avium subsp. paratuberculosis
ugcggugacgau

SEQ ID NO: 2970165 - RNA, 17 nt, Mycobacterium avium subsp. paratuberculosis
ugcggugaugcgcggcg

SEQ ID NO: 2970166 - RNA, 13 nt, Mycobacterium avium subsp. paratuberculosis
ugcggugcaccgc

SEQ ID NO: 2970167 - RNA, 19 nt, Mycobacterium avium subsp. paratuberculosis
ugcggugcaccgcggcgcg

SEQ ID NO: 2970168 - RNA, 20 nt, Mycobacterium avium subsp. paratuberculosis
ugcggugcaucgucgcggcg

SEQ ID NO: 2970169 - RNA, 12 nt, Mycobacterium avium subsp. paratuberculosis
ugcggugccggg

SEQ ID NO: 2970170 - RNA, 14 nt, Mycobacterium avium subsp. paratuberculosis
ugcggugccgggcc

SEQ ID NO: 2970171 - RNA, 16 nt, Mycobacterium avium subsp. paratuberculosis
ugcggugccgggccag

SEQ ID NO: 2970172 - RNA, 17 nt, Mycobacterium avium subsp. paratuberculosis
ugcggugccgggccagg

SEQ ID NO: 2970173 - RNA, 18 nt, Mycobacterium avium subsp. paratuberculosis
ugcggugccgggccaggu

SEQ ID NO: 2970174 - RNA, 14 nt, Mycobacterium avium subsp. paratuberculosis
ugcggugcggccgc

SEQ ID NO: 2970175 - RNA, 15 nt, Mycobacterium avium subsp. paratuberculosis
ugcggugcggccgcg

SEQ ID NO: 2970176 - RNA, 16 nt, Mycobacterium avium subsp. paratuberculosis
ugcggugcggccgcgc

SEQ ID NO: 2970177 - RNA, 20 nt, Mycobacterium avium subsp. paratuberculosis
ugcggugcggccgcgcagcu

SEQ ID NO: 2970178 - RNA, 22 nt, Mycobacterium avium subsp. paratuberculosis
ugcggugcggccgcgcagcucg

SEQ ID NO: 2970179 - RNA, 15 nt, Mycobacterium avium subsp. paratuberculosis
ugcggugcucgucga

SEQ ID NO: 2970180 - RNA, 18 nt, Mycobacterium avium subsp. paratuberculosis
ugcggugcucgucgagca

SEQ ID NO: 2970181 - RNA, 16 nt, Mycobacterium avium subsp. paratuberculosis
ugcgguggccgaucag

SEQ ID NO: 2970182 - RNA, 18 nt, Mycobacterium avium subsp. paratuberculosis
ugcgguggucgaaaucgc

SEQ ID NO: 2970183 - RNA, 17 nt, Mycobacterium avium subsp. paratuberculosis
ugcgguggucggcguca

SEQ ID NO: 2970184 - RNA, 20 nt, Mycobacterium avium subsp. paratuberculosis
ugcgguguaaccguggcagg

SEQ ID NO: 2970185 - RNA, 14 nt, Mycobacterium avium subsp. paratuberculosis
ugcgguuccgggcg

SEQ ID NO: 2970186 - RNA, 17 nt, Mycobacterium avium subsp. paratuberculosis
ugcgguugagcaccagc

SEQ ID NO: 2970187 - RNA, 18 nt, Mycobacterium avium subsp. paratuberculosis
ugcgguugagcaccagcc

SEQ ID NO: 2970188 - RNA, 20 nt, Mycobacterium avium subsp. paratuberculosis
ugcgguugccccaccccgga

SEQ ID NO: 2970189 - RNA, 20 nt, Mycobacterium avium subsp. paratuberculosis
ugcgguuggcccgcggcgcc

SEQ ID NO: 2970190 - RNA, 14 nt, Mycobacterium avium subsp. paratuberculosis
ugcgguuggccgga

SEQ ID NO: 2970191 - RNA, 19 nt, Mycobacterium avium subsp. paratuberculosis
ugcgguuggccggaaucgc

SEQ ID NO: 2970192 - RNA, 18 nt, Mycobacterium avium subsp. paratuberculosis
ugcgguugucggucaggc

SEQ ID NO: 2970193 - RNA, 18 nt, Mycobacterium avium subsp. paratuberculosis
ugcguacuucgcguuccg

SEQ ID NO: 2970194 - RNA, 15 nt, Mycobacterium avium subsp. paratuberculosis
ugcguagcggcccga

SEQ ID NO: 2970195 - RNA, 12 nt, Mycobacterium avium subsp. paratuberculosis
ugcgucacgcug

SEQ ID NO: 2970196 - RNA, 19 nt, Mycobacterium avium subsp. paratuberculosis
ugcguccagaccggccggg

SEQ ID NO: 2970197 - RNA, 21 nt, Mycobacterium avium subsp. paratuberculosis
ugcguccagaccggccggggc

SEQ ID NO: 2970198 - RNA, 12 nt, Mycobacterium avium subsp. paratuberculosis
ugcguccaggac

SEQ ID NO: 2970199 - RNA, 19 nt, Mycobacterium avium subsp. paratuberculosis
ugcgucccguuggcgccgg

SEQ ID NO: 2970200 - RNA, 16 nt, Mycobacterium avium subsp. paratuberculosis
ugcguccgauaccagc

SEQ ID NO: 2970201 - RNA, 21 nt, Mycobacterium avium subsp. paratuberculosis
ugcguccgauaccagccgcgg

SEQ ID NO: 2970202 - RNA, 12 nt, Mycobacterium avium subsp. paratuberculosis
ugcguccggccc

SEQ ID NO: 2970203 - RNA, 14 nt, Mycobacterium avium subsp. paratuberculosis
ugcguccggcccgg

SEQ ID NO: 2970204 - RNA, 23 nt, Mycobacterium avium subsp. paratuberculosis
ugcguccggcccggcguccgcga

SEQ ID NO: 2970205 - RNA, 12 nt, Mycobacterium avium subsp. paratuberculosis
ugcgucgcggcg

SEQ ID NO: 2970206 - RNA, 16 nt, Mycobacterium avium subsp. paratuberculosis
ugcgucggcaccagcg

SEQ ID NO: 2970207 - RNA, 15 nt, Mycobacterium avium subsp. paratuberculosis
ugcgucgggcgccgg

SEQ ID NO: 2970208 - RNA, 23 nt, Mycobacterium avium subsp. paratuberculosis
ugcgucgggcgccggcgcguccg

SEQ ID NO: 2970209 - RNA, 13 nt, Mycobacterium avium subsp. paratuberculosis
ugcgucugcucgc

SEQ ID NO: 2970210 - RNA, 18 nt, Mycobacterium avium subsp. paratuberculosis
ugcgucugcucgccguca

SEQ ID NO: 2970211 - RNA, 18 nt, Mycobacterium avium subsp. paratuberculosis
ugcgugaccugcugggcg

SEQ ID NO: 2970212 - RNA, 14 nt, Mycobacterium avium subsp. paratuberculosis
ugcgugacgggcug

SEQ ID NO: 2970213 - RNA, 19 nt, Mycobacterium avium subsp. paratuberculosis
ugcgugacuugucgggccg

SEQ ID NO: 2970214 - RNA, 23 nt, Mycobacterium avium subsp. paratuberculosis
ugcgugaugaccagggccucguc

SEQ ID NO: 2970215 - RNA, 15 nt, Mycobacterium avium subsp. paratuberculosis
ugcgugcagccgcaa

SEQ ID NO: 2970216 - RNA, 15 nt, Mycobacterium avium subsp. paratuberculosis
ugcgugccagcagcu

SEQ ID NO: 2970217 - RNA, 13 nt, Mycobacterium avium subsp. paratuberculosis
ugcgugcgcucga

SEQ ID NO: 2970218 - RNA, 20 nt, Mycobacterium avium subsp. paratuberculosis
ugcgugguggggccgaugac

SEQ ID NO: 2970219 - RNA, 18 nt, Mycobacterium avium subsp. paratuberculosis
ugcguuccucgacggcga

SEQ ID NO: 2970220 - RNA, 21 nt, Mycobacterium avium subsp. paratuberculosis
ugcguucgggauccucgccgc

SEQ ID NO: 2970221 - RNA, 13 nt, Mycobacterium avium subsp. paratuberculosis
ugcguugcggcac

SEQ ID NO: 2970222 - RNA, 19 nt, Mycobacterium avium subsp. paratuberculosis
ugcuagcgagcgggcacgc

SEQ ID NO: 2970223 - RNA, 23 nt, Mycobacterium avium subsp. paratuberculosis
ugcuagcgagcgggcacgccgcc

SEQ ID NO: 2970224 - RNA, 16 nt, Mycobacterium avium subsp. paratuberculosis
ugcucaccccggccag

SEQ ID NO: 2970225 - RNA, 18 nt, Mycobacterium avium subsp. paratuberculosis
ugcucaccccggccaggg

SEQ ID NO: 2970226 - RNA, 13 nt, Mycobacterium avium subsp. paratuberculosis
ugcucaccgagcu

SEQ ID NO: 2970227 - RNA, 14 nt, Mycobacterium avium subsp. paratuberculosis
ugcucaccgagcug

SEQ ID NO: 2970228 - RNA, 13 nt, Mycobacterium avium subsp. paratuberculosis
ugcucagccgcac

SEQ ID NO: 2970229 - RNA, 16 nt, Mycobacterium avium subsp. paratuberculosis
ugcucagccuagccuu

SEQ ID NO: 2970230 - RNA, 21 nt, Mycobacterium avium subsp. paratuberculosis
ugcucagcggccaucgccgcc

SEQ ID NO: 2970231 - RNA, 13 nt, Mycobacterium avium subsp. paratuberculosis
ugcucaggaugau

SEQ ID NO: 2970232 - RNA, 17 nt, Mycobacterium avium subsp. paratuberculosis
ugcucaugagcccucca

SEQ ID NO: 2970233 - RNA, 19 nt, Mycobacterium avium subsp. paratuberculosis
ugcucaugagcccuccagc

SEQ ID NO: 2970234 - RNA, 15 nt, Mycobacterium avium subsp. paratuberculosis
ugcuccacacuggcu

SEQ ID NO: 2970235 - RNA, 19 nt, Mycobacterium avium subsp. paratuberculosis
ugcuccgggggcaccgcca

SEQ ID NO: 2970236 - RNA, 22 nt, Mycobacterium avium subsp. paratuberculosis
ugcuccggugaaccgcugacca

SEQ ID NO: 2970237 - RNA, 23 nt, Mycobacterium avium subsp. paratuberculosis
ugcuccggugaaccgcugaccag

SEQ ID NO: 2970238 - RNA, 22 nt, Mycobacterium avium subsp. paratuberculosis
ugcucgaaccgcgagacccggu

SEQ ID NO: 2970239 - RNA, 16 nt, Mycobacterium avium subsp. paratuberculosis
ugcucgaacgcgccga

SEQ ID NO: 2970240 - RNA, 13 nt, Mycobacterium avium subsp. paratuberculosis
ugcucgacacgau

SEQ ID NO: 2970241 - RNA, 16 nt, Mycobacterium avium subsp. paratuberculosis
ugcucgaccagcgccg

SEQ ID NO: 2970242 - RNA, 19 nt, Mycobacterium avium subsp. paratuberculosis
ugcucgaccagcgccgagg

SEQ ID NO: 2970243 - RNA, 16 nt, Mycobacterium avium subsp. paratuberculosis
ugcucgaccucggcga

SEQ ID NO: 2970244 - RNA, 20 nt, Mycobacterium avium subsp. paratuberculosis
ugcucgaccucggcgaccag

SEQ ID NO: 2970245 - RNA, 11 nt, Mycobacterium avium subsp. paratuberculosis
ugcucgacgua

SEQ ID NO: 2970246 - RNA, 12 nt, Mycobacterium avium subsp. paratuberculosis
ugcucgagcaca

SEQ ID NO: 2970247 - RNA, 21 nt, Mycobacterium avium subsp. paratuberculosis
ugcucgagcaucucggugccg

SEQ ID NO: 2970248 - RNA, 17 nt, Mycobacterium avium subsp. paratuberculosis
ugcucgagggccuccac

SEQ ID NO: 2970249 - RNA, 19 nt, Mycobacterium avium subsp. paratuberculosis
ugcucgagggccuccacca

SEQ ID NO: 2970250 - RNA, 15 nt, Mycobacterium avium subsp. paratuberculosis
ugcucgaucggcgcg

SEQ ID NO: 2970251 - RNA, 19 nt, Mycobacterium avium subsp. paratuberculosis
ugcucgaucggcgcgccga

SEQ ID NO: 2970252 - RNA, 16 nt, Mycobacterium avium subsp. paratuberculosis
ugcucgaucucggcca

SEQ ID NO: 2970253 - RNA, 13 nt, Mycobacterium avium subsp. paratuberculosis
ugcucgaugaaga

SEQ ID NO: 2970254 - RNA, 14 nt, Mycobacterium avium subsp. paratuberculosis
ugcucgaugcgcgc

SEQ ID NO: 2970255 - RNA, 22 nt, Mycobacterium avium subsp. paratuberculosis
ugcucgaugcgcgccagcagcg

SEQ ID NO: 2970256 - RNA, 17 nt, Mycobacterium avium subsp. paratuberculosis
ugcucgccggcuaccgg

SEQ ID NO: 2970257 - RNA, 22 nt, Mycobacterium avium subsp. paratuberculosis
ugcucgccugacuaagucacca

SEQ ID NO: 2970258 - RNA, 18 nt, Mycobacterium avium subsp. paratuberculosis
ugcucgcgauuggccucg

SEQ ID NO: 2970259 - RNA, 16 nt, Mycobacterium avium subsp. paratuberculosis
ugcucgcgcaggaacu

SEQ ID NO: 2970260 - RNA, 15 nt, Mycobacterium avium subsp. paratuberculosis
ugcucgcgccgggcg

SEQ ID NO: 2970261 - RNA, 17 nt, Mycobacterium avium subsp. paratuberculosis
ugcucgcgccgggcggc

SEQ ID NO: 2970262 - RNA, 18 nt, Mycobacterium avium subsp. paratuberculosis
ugcucgcgccgggcggcc

SEQ ID NO: 2970263 - RNA, 18 nt, Mycobacterium avium subsp. paratuberculosis
ugcucgcgcucguccagg

SEQ ID NO: 2970264 - RNA, 21 nt, Mycobacterium avium subsp. paratuberculosis
ugcucgcgggccaccgcggcg

SEQ ID NO: 2970265 - RNA, 16 nt, Mycobacterium avium subsp. paratuberculosis
ugcucgcuguggcgga

SEQ ID NO: 2970266 - RNA, 22 nt, Mycobacterium avium subsp. paratuberculosis
ugcucgcuugccagccgggccg

SEQ ID NO: 2970267 - RNA, 17 nt, Mycobacterium avium subsp. paratuberculosis
ugcucggaggaaccgug

SEQ ID NO: 2970268 - RNA, 21 nt, Mycobacterium avium subsp. paratuberculosis
ugcucggaguaguccagcacc

SEQ ID NO: 2970269 - RNA, 22 nt, Mycobacterium avium subsp. paratuberculosis
ugcucggaguaguccagcaccg

SEQ ID NO: 2970270 - RNA, 14 nt, Mycobacterium avium subsp. paratuberculosis
ugcucggccaccgc

SEQ ID NO: 2970271 - RNA, 18 nt, Mycobacterium avium subsp. paratuberculosis
ugcucggccaccgcgcgg

SEQ ID NO: 2970272 - RNA, 15 nt, Mycobacterium avium subsp. paratuberculosis
ugcucggccagcggg

SEQ ID NO: 2970273 - RNA, 22 nt, Mycobacterium avium subsp. paratuberculosis
ugcucggcgacgcugugcucgg

SEQ ID NO: 2970274 - RNA, 18 nt, Mycobacterium avium subsp. paratuberculosis
ugcucggcgagcaccgug

SEQ ID NO: 2970275 - RNA, 21 nt, Mycobacterium avium subsp. paratuberculosis
ugcucggcgcgcggggccggc

SEQ ID NO: 2970276 - RNA, 14 nt, Mycobacterium avium subsp. paratuberculosis
ugcucggcggcgca

SEQ ID NO: 2970277 - RNA, 23 nt, Mycobacterium avium subsp. paratuberculosis
ugcucggggcaguagugguccac

SEQ ID NO: 2970278 - RNA, 18 nt, Mycobacterium avium subsp. paratuberculosis
ugcucggggcucgcggug

SEQ ID NO: 2970279 - RNA, 23 nt, Mycobacterium avium subsp. paratuberculosis
ugcucggugaugccgagcgccgc

SEQ ID NO: 2970280 - RNA, 14 nt, Mycobacterium avium subsp. paratuberculosis
ugcucgucgcgggc

SEQ ID NO: 2970281 - RNA, 15 nt, Mycobacterium avium subsp. paratuberculosis
ugcucgucgcgggcg

SEQ ID NO: 2970282 - RNA, 16 nt, Mycobacterium avium subsp. paratuberculosis
ugcucgugcaaaccgg

SEQ ID NO: 2970283 - RNA, 21 nt, Mycobacterium avium subsp. paratuberculosis
ugcucgugguucuccgcgaca

SEQ ID NO: 2970284 - RNA, 22 nt, Mycobacterium avium subsp. paratuberculosis
ugcucuccgcuguucggguaga

SEQ ID NO: 2970285 - RNA, 14 nt, Mycobacterium avium subsp. paratuberculosis
ugcucuccugcuug

SEQ ID NO: 2970286 - RNA, 20 nt, Mycobacterium avium subsp. paratuberculosis
ugcucuccugcuugaccgug

SEQ ID NO: 2970287 - RNA, 12 nt, Mycobacterium avium subsp. paratuberculosis
ugcucugcgcgc

SEQ ID NO: 2970288 - RNA, 17 nt, Mycobacterium avium subsp. paratuberculosis
ugcucugcgcgcggugc

SEQ ID NO: 2970289 - RNA, 19 nt, Mycobacterium avium subsp. paratuberculosis
ugcugaacgccugccggcg

SEQ ID NO: 2970290 - RNA, 23 nt, Mycobacterium avium subsp. paratuberculosis
ugcugaacgccugccggcgccgg

SEQ ID NO: 2970291 - RNA, 21 nt, Mycobacterium avium subsp. paratuberculosis
ugcugacaccucggaucgucu

SEQ ID NO: 2970292 - RNA, 18 nt, Mycobacterium avium subsp. paratuberculosis
ugcugaccaugacccacg

SEQ ID NO: 2970293 - RNA, 15 nt, Mycobacterium avium subsp. paratuberculosis
ugcugacgucgucgc

SEQ ID NO: 2970294 - RNA, 18 nt, Mycobacterium avium subsp. paratuberculosis
ugcugacgucgucgccca

SEQ ID NO: 2970295 - RNA, 21 nt, Mycobacterium avium subsp. paratuberculosis
ugcugagccgccgagccggca

SEQ ID NO: 2970296 - RNA, 20 nt, Mycobacterium avium subsp. paratuberculosis
ugcugagcgggucggccggc

SEQ ID NO: 2970297 - RNA, 18 nt, Mycobacterium avium subsp. paratuberculosis
ugcugauacccgcgcggc

SEQ ID NO: 2970298 - RNA, 13 nt, Mycobacterium avium subsp. paratuberculosis
ugcugauccccag

SEQ ID NO: 2970299 - RNA, 14 nt, Mycobacterium avium subsp. paratuberculosis
ugcugcacccaccg

SEQ ID NO: 2970300 - RNA, 14 nt, Mycobacterium avium subsp. paratuberculosis
ugcugcacgacgac

SEQ ID NO: 2970301 - RNA, 17 nt, Mycobacterium avium subsp. paratuberculosis
ugcugcacgacgaccgc

SEQ ID NO: 2970302 - RNA, 22 nt, Mycobacterium avium subsp. paratuberculosis
ugcugcacgacgaccgcgacgg

SEQ ID NO: 2970303 - RNA, 22 nt, Mycobacterium avium subsp. paratuberculosis
ugcugcagaccgaacgucacgg

SEQ ID NO: 2970304 - RNA, 17 nt, Mycobacterium avium subsp. paratuberculosis
uggaagcgcccgcgcgc

SEQ ID NO: 2970305 - RNA, 18 nt, Mycobacterium avium subsp. paratuberculosis
uggaagcggugauggcga

SEQ ID NO: 2970306 - RNA, 13 nt, Mycobacterium avium subsp. paratuberculosis
uggaaggacguca

SEQ ID NO: 2970307 - RNA, 20 nt, Mycobacterium avium subsp. paratuberculosis
uggaaggcgccggcgcgggg

SEQ ID NO: 2970308 - RNA, 13 nt, Mycobacterium avium subsp. paratuberculosis
uggaaggugcuga

SEQ ID NO: 2970309 - RNA, 18 nt, Mycobacterium avium subsp. paratuberculosis
uggaagucgccguccggg

SEQ ID NO: 2970310 - RNA, 15 nt, Mycobacterium avium subsp. paratuberculosis
uggaauaggccgcgu

SEQ ID NO: 2970311 - RNA, 15 nt, Mycobacterium avium subsp. paratuberculosis
uggacaccgcgauca

SEQ ID NO: 2970312 - RNA, 22 nt, Mycobacterium avium subsp. paratuberculosis
uggacaccugcaguucgaucac

SEQ ID NO: 2970313 - RNA, 16 nt, Mycobacterium avium subsp. paratuberculosis
uggacagcagcagcuc

SEQ ID NO: 2970314 - RNA, 18 nt, Mycobacterium avium subsp. paratuberculosis
uggacagcagcagcuccc

SEQ ID NO: 2970315 - RNA, 12 nt, Mycobacterium avium subsp. paratuberculosis
uggacagcagcc

SEQ ID NO: 2970316 - RNA, 14 nt, Mycobacterium avium subsp. paratuberculosis
uggacagccaccgu

SEQ ID NO: 2970317 - RNA, 12 nt, Mycobacterium avium subsp. paratuberculosis
uggacagcgcga

SEQ ID NO: 2970318 - RNA, 14 nt, Mycobacterium avium subsp. paratuberculosis
uggacaggccggcg

SEQ ID NO: 2970319 - RNA, 19 nt, Mycobacterium avium subsp. paratuberculosis
uggacaggccggcgacggc

SEQ ID NO: 2970320 - RNA, 22 nt, Mycobacterium avium subsp. paratuberculosis
uggacaggucgaugauguugcc

SEQ ID NO: 2970321 - RNA, 18 nt, Mycobacterium avium subsp. paratuberculosis
uggacaguucgguggggc

SEQ ID NO: 2970322 - RNA, 15 nt, Mycobacterium avium subsp. paratuberculosis
uggacaugcagccgc

SEQ ID NO: 2970323 - RNA, 19 nt, Mycobacterium avium subsp. paratuberculosis
uggacauucacgaggccgg

SEQ ID NO: 2970324 - RNA, 23 nt, Mycobacterium avium subsp. paratuberculosis
uggacauucacgaggccgggcug

SEQ ID NO: 2970325 - RNA, 21 nt, Mycobacterium avium subsp. paratuberculosis
uggaccagggcgguggcggcg

SEQ ID NO: 2970326 - RNA, 22 nt, Mycobacterium avium subsp. paratuberculosis
uggaccagggcgguggcggcga

SEQ ID NO: 2970327 - RNA, 22 nt, Mycobacterium avium subsp. paratuberculosis
uggacccgaagucgacgcacca

SEQ ID NO: 2970328 - RNA, 14 nt, Mycobacterium avium subsp. paratuberculosis
uggaccgagcgcgc

SEQ ID NO: 2970329 - RNA, 16 nt, Mycobacterium avium subsp. paratuberculosis
uggaccgcgugugccc

SEQ ID NO: 2970330 - RNA, 18 nt, Mycobacterium avium subsp. paratuberculosis
uggacgaaacccggcgga

SEQ ID NO: 2970331 - RNA, 20 nt, Mycobacterium avium subsp. paratuberculosis
uggacgaaacccggcggacg

SEQ ID NO: 2970332 - RNA, 16 nt, Mycobacterium avium subsp. paratuberculosis
uggacgaacgcggcga

SEQ ID NO: 2970333 - RNA, 12 nt, Mycobacterium avium subsp. paratuberculosis
uggacgacgucg

SEQ ID NO: 2970334 - RNA, 12 nt, Mycobacterium avium subsp. paratuberculosis
uggacgagcagc

SEQ ID NO: 2970335 - RNA, 19 nt, Mycobacterium avium subsp. paratuberculosis
uggacgaggugaccggcga

SEQ ID NO: 2970336 - RNA, 20 nt, Mycobacterium avium subsp. paratuberculosis
uggacgagucccaugggcug

SEQ ID NO: 2970337 - RNA, 21 nt, Mycobacterium avium subsp. paratuberculosis
uggacgaguggucggccgccc

SEQ ID NO: 2970338 - RNA, 23 nt, Mycobacterium avium subsp. paratuberculosis
uggacgaugcggggccggcggcg

SEQ ID NO: 2970339 - RNA, 21 nt, Mycobacterium avium subsp. paratuberculosis
uggacgccagcaugaucaccg

SEQ ID NO: 2970340 - RNA, 16 nt, Mycobacterium avium subsp. paratuberculosis
uggacgcccgcgaccc

SEQ ID NO: 2970341 - RNA, 18 nt, Mycobacterium avium subsp. paratuberculosis
uggacgccgcacgcgacc

SEQ ID NO: 2970342 - RNA, 19 nt, Mycobacterium avium subsp. paratuberculosis
uggacgccgcacgcgaccg

SEQ ID NO: 2970343 - RNA, 20 nt, Mycobacterium avium subsp. paratuberculosis
uggacgccgcacgcgaccgc

SEQ ID NO: 2970344 - RNA, 21 nt, Mycobacterium avium subsp. paratuberculosis
uggacgccgcacgcgaccgcg

SEQ ID NO: 2970345 - RNA, 12 nt, Mycobacterium avium subsp. paratuberculosis
uggacgcgacca

SEQ ID NO: 2970346 - RNA, 14 nt, Mycobacterium avium subsp. paratuberculosis
uggacgcgcgcggc

SEQ ID NO: 2970347 - RNA, 21 nt, Mycobacterium avium subsp. paratuberculosis
uggacgcgcgcggcgucaggg

SEQ ID NO: 2970348 - RNA, 21 nt, Mycobacterium avium subsp. paratuberculosis
uggacgcgguggugcucgccc

SEQ ID NO: 2970349 - RNA, 21 nt, Mycobacterium avium subsp. paratuberculosis
uggacggggcgaugccgacac

SEQ ID NO: 2970350 - RNA, 16 nt, Mycobacterium avium subsp. paratuberculosis
uggacggucagcgcgc

SEQ ID NO: 2970351 - RNA, 18 nt, Mycobacterium avium subsp. paratuberculosis
uggacggucagcgcgccg

SEQ ID NO: 2970352 - RNA, 14 nt, Mycobacterium avium subsp. paratuberculosis
uggacgguuucacc

SEQ ID NO: 2970353 - RNA, 15 nt, Mycobacterium avium subsp. paratuberculosis
uggacgucaggccgu

SEQ ID NO: 2970354 - RNA, 15 nt, Mycobacterium avium subsp. paratuberculosis
uggacguccagcggc

SEQ ID NO: 2970355 - RNA, 21 nt, Mycobacterium avium subsp. paratuberculosis
uggacgucguuuuccagccgg

SEQ ID NO: 2970356 - RNA, 22 nt, Mycobacterium avium subsp. paratuberculosis
uggacgucguuuuccagccggc

SEQ ID NO: 2970357 - RNA, 19 nt, Mycobacterium avium subsp. paratuberculosis
uggacuccaccgccaccgc

SEQ ID NO: 2970358 - RNA, 22 nt, Mycobacterium avium subsp. paratuberculosis
uggagaagaucuucucgguguc

SEQ ID NO: 2970359 - RNA, 20 nt, Mycobacterium avium subsp. paratuberculosis
uggagaaguccuuguggccc

SEQ ID NO: 2970360 - RNA, 23 nt, Mycobacterium avium subsp. paratuberculosis
uggagaaguccuuguggcccagg

SEQ ID NO: 2970361 - RNA, 23 nt, Mycobacterium avium subsp. paratuberculosis
uggagaaguggcuggucacaccc

SEQ ID NO: 2970362 - RNA, 13 nt, Mycobacterium avium subsp. paratuberculosis
uggagaccagguc

SEQ ID NO: 2970363 - RNA, 20 nt, Mycobacterium avium subsp. paratuberculosis
uggagaggcccggcagccgg

SEQ ID NO: 2970364 - RNA, 15 nt, Mycobacterium avium subsp. paratuberculosis
uggagaucaccgcgu

SEQ ID NO: 2970365 - RNA, 23 nt, Mycobacterium avium subsp. paratuberculosis
uggagaucaccgcguagcgccgc

SEQ ID NO: 2970366 - RNA, 16 nt, Mycobacterium avium subsp. paratuberculosis
uggagaugcuucagcc

SEQ ID NO: 2970367 - RNA, 17 nt, Mycobacterium avium subsp. paratuberculosis
uggagauggccagcacc

SEQ ID NO: 2970368 - RNA, 19 nt, Mycobacterium avium subsp. paratuberculosis
uggagauggccagcaccac

SEQ ID NO: 2970369 - RNA, 14 nt, Mycobacterium avium subsp. paratuberculosis
uggagcacagcacg

SEQ ID NO: 2970370 - RNA, 12 nt, Mycobacterium avium subsp. paratuberculosis
uggagccgacca

SEQ ID NO: 2970371 - RNA, 14 nt, Mycobacterium avium subsp. paratuberculosis
uggagccguccggg

SEQ ID NO: 2970372 - RNA, 22 nt, Mycobacterium avium subsp. paratuberculosis
uggagcgcgacgggcugcugca

SEQ ID NO: 2970373 - RNA, 17 nt, Mycobacterium avium subsp. paratuberculosis
uggagcgcggcaugccg

SEQ ID NO: 2970374 - RNA, 23 nt, Mycobacterium avium subsp. paratuberculosis
uggagcggcccagcucggugauc

SEQ ID NO: 2970375 - RNA, 20 nt, Mycobacterium avium subsp. paratuberculosis
uggagcggguccgccccgag

SEQ ID NO: 2970376 - RNA, 16 nt, Mycobacterium avium subsp. paratuberculosis
uggaggccaacgagcg

SEQ ID NO: 2970377 - RNA, 21 nt, Mycobacterium avium subsp. paratuberculosis
uggaggcgagcaacucuugcg

SEQ ID NO: 2970378 - RNA, 19 nt, Mycobacterium avium subsp. paratuberculosis
uggagggagcacucgaugg

SEQ ID NO: 2970379 - RNA, 16 nt, Mycobacterium avium subsp. paratuberculosis
uggagucguccgaacc

SEQ ID NO: 2970380 - RNA, 23 nt, Mycobacterium avium subsp. paratuberculosis
uggauauccagccuugcagccgc

SEQ ID NO: 2970381 - RNA, 17 nt, Mycobacterium avium subsp. paratuberculosis
uggauauuucgcggccg

SEQ ID NO: 2970382 - RNA, 14 nt, Mycobacterium avium subsp. paratuberculosis
uggaucaucccgac

SEQ ID NO: 2970383 - RNA, 13 nt, Mycobacterium avium subsp. paratuberculosis
uggaucccgaacu

SEQ ID NO: 2970384 - RNA, 14 nt, Mycobacterium avium subsp. paratuberculosis
uggaucgccgcaac

SEQ ID NO: 2970385 - RNA, 13 nt, Mycobacterium avium subsp. paratuberculosis
uggaucgcgcagg

SEQ ID NO: 2970386 - RNA, 19 nt, Mycobacterium avium subsp. paratuberculosis
uggaucgcgcaggugaugc

SEQ ID NO: 2970387 - RNA, 18 nt, Mycobacterium avium subsp. paratuberculosis
uggaucgcuucggccagc

SEQ ID NO: 2970388 - RNA, 23 nt, Mycobacterium avium subsp. paratuberculosis
uggccagcgucagggcgacuccg

SEQ ID NO: 2970389 - RNA, 12 nt, Mycobacterium avium subsp. paratuberculosis
uggccagcucgg

SEQ ID NO: 2970390 - RNA, 15 nt, Mycobacterium avium subsp. paratuberculosis
uggccagcucggcca

SEQ ID NO: 2970391 - RNA, 19 nt, Mycobacterium avium subsp. paratuberculosis
uggccagcucggccauccc

SEQ ID NO: 2970392 - RNA, 16 nt, Mycobacterium avium subsp. paratuberculosis
uggccagcucggcggc

SEQ ID NO: 2970393 - RNA, 17 nt, Mycobacterium avium subsp. paratuberculosis
uggccagcucggcggcc

SEQ ID NO: 2970394 - RNA, 22 nt, Mycobacterium avium subsp. paratuberculosis
uggccagcucggcguggucgag

SEQ ID NO: 2970395 - RNA, 13 nt, Mycobacterium avium subsp. paratuberculosis
uggccagcucggu

SEQ ID NO: 2970396 - RNA, 21 nt, Mycobacterium avium subsp. paratuberculosis
uggccagcucgucgcggaaca

SEQ ID NO: 2970397 - RNA, 15 nt, Mycobacterium avium subsp. paratuberculosis
uggccagcuugcagc

SEQ ID NO: 2970398 - RNA, 17 nt, Mycobacterium avium subsp. paratuberculosis
uggccagcuugcagcug

SEQ ID NO: 2970399 - RNA, 17 nt, Mycobacterium avium subsp. paratuberculosis
uggccaggcccugccag

SEQ ID NO: 2970400 - RNA, 19 nt, Mycobacterium avium subsp. paratuberculosis
uggccaggcgggccaccac

SEQ ID NO: 2970401 - RNA, 21 nt, Mycobacterium avium subsp. paratuberculosis
uggccaggcgggccaccacag

SEQ ID NO: 2970402 - RNA, 17 nt, Mycobacterium avium subsp. paratuberculosis
uggccaggcuggcgucg

SEQ ID NO: 2970403 - RNA, 20 nt, Mycobacterium avium subsp. paratuberculosis
uggccagguacaccaccagg

SEQ ID NO: 2970404 - RNA, 19 nt, Mycobacterium avium subsp. paratuberculosis
uggccagguauucgcggga

SEQ ID NO: 2970405 - RNA, 16 nt, Mycobacterium avium subsp. paratuberculosis
uggccagguggccgcu

SEQ ID NO: 2970406 - RNA, 22 nt, Mycobacterium avium subsp. paratuberculosis
uggccagguugcgccguccggc

SEQ ID NO: 2970407 - RNA, 18 nt, Mycobacterium avium subsp. paratuberculosis
uggccagguuggucagca

SEQ ID NO: 2970408 - RNA, 15 nt, Mycobacterium avium subsp. paratuberculosis
uggccaucgcggccc

SEQ ID NO: 2970409 - RNA, 17 nt, Mycobacterium avium subsp. paratuberculosis
uggccaucgcggccccc

SEQ ID NO: 2970410 - RNA, 12 nt, Mycobacterium avium subsp. paratuberculosis
uggccaucguca

SEQ ID NO: 2970411 - RNA, 16 nt, Mycobacterium avium subsp. paratuberculosis
uggccaucuggccgcg

SEQ ID NO: 2970412 - RNA, 22 nt, Mycobacterium avium subsp. paratuberculosis
uggcccaaccgcauucggccgc

SEQ ID NO: 2970413 - RNA, 16 nt, Mycobacterium avium subsp. paratuberculosis
uggcccaccgaaucac

SEQ ID NO: 2970414 - RNA, 21 nt, Mycobacterium avium subsp. paratuberculosis
uggcccaccgaaucacccacg

SEQ ID NO: 2970415 - RNA, 16 nt, Mycobacterium avium subsp. paratuberculosis
uggcccacgcagccgu

SEQ ID NO: 2970416 - RNA, 22 nt, Mycobacterium avium subsp. paratuberculosis
uggcccagacaggccggccgcu

SEQ ID NO: 2970417 - RNA, 23 nt, Mycobacterium avium subsp. paratuberculosis
uggcccagacaggccggccgcua

SEQ ID NO: 2970418 - RNA, 14 nt, Mycobacterium avium subsp. paratuberculosis
uggcccagccgcgu

SEQ ID NO: 2970419 - RNA, 15 nt, Mycobacterium avium subsp. paratuberculosis
uggcccagccggccg

SEQ ID NO: 2970420 - RNA, 22 nt, Mycobacterium avium subsp. paratuberculosis
uggcccagccggugcgagccgc

SEQ ID NO: 2970421 - RNA, 18 nt, Mycobacterium avium subsp. paratuberculosis
uggcccaggccgcggucg

SEQ ID NO: 2970422 - RNA, 13 nt, Mycobacterium avium subsp. paratuberculosis
uggccccagccac

SEQ ID NO: 2970423 - RNA, 12 nt, Mycobacterium avium subsp. paratuberculosis
uggccccagccc

SEQ ID NO: 2970424 - RNA, 18 nt, Mycobacterium avium subsp. paratuberculosis
uggcccccgccccagccc

SEQ ID NO: 2970425 - RNA, 13 nt, Mycobacterium avium subsp. paratuberculosis
uggccccgggccg

SEQ ID NO: 2970426 - RNA, 15 nt, Mycobacterium avium subsp. paratuberculosis
uggccccgggccgca

SEQ ID NO: 2970427 - RNA, 15 nt, Mycobacterium avium subsp. paratuberculosis
uggcccgcaccaccc

SEQ ID NO: 2970428 - RNA, 17 nt, Mycobacterium avium subsp. paratuberculosis
uggcccgcaccacccag

SEQ ID NO: 2970429 - RNA, 21 nt, Mycobacterium avium subsp. paratuberculosis
uggcccgcaccacccagcccu

SEQ ID NO: 2970430 - RNA, 21 nt, Mycobacterium avium subsp. paratuberculosis
uggcccgccacgugcggcugc

SEQ ID NO: 2970431 - RNA, 17 nt, Mycobacterium avium subsp. paratuberculosis
uggcccgcucggucuug

SEQ ID NO: 2970432 - RNA, 18 nt, Mycobacterium avium subsp. paratuberculosis
uggcccgcucggucuuga

SEQ ID NO: 2970433 - RNA, 22 nt, Mycobacterium avium subsp. paratuberculosis
uggcccgcucggucuugaucag

SEQ ID NO: 2970434 - RNA, 19 nt, Mycobacterium avium subsp. paratuberculosis
uggcccggaccgccgcggc

SEQ ID NO: 2970435 - RNA, 22 nt, Mycobacterium avium subsp. paratuberculosis
uggcccggaccgccgcggcggc

SEQ ID NO: 2970436 - RNA, 17 nt, Mycobacterium avium subsp. paratuberculosis
uggcccggcgcggcggc

SEQ ID NO: 2970437 - RNA, 22 nt, Mycobacterium avium subsp. paratuberculosis
uggcccggcgcggcggcgccgc

SEQ ID NO: 2970438 - RNA, 13 nt, Mycobacterium avium subsp. paratuberculosis
uggcccggcguuc

SEQ ID NO: 2970439 - RNA, 12 nt, Mycobacterium avium subsp. paratuberculosis
uggcccgggcgu

SEQ ID NO: 2970440 - RNA, 22 nt, Mycobacterium avium subsp. paratuberculosis
uggcccgguacagcgccgcggc

SEQ ID NO: 2970441 - RNA, 20 nt, Mycobacterium avium subsp. paratuberculosis
uggcccggucggaguccagc

SEQ ID NO: 2970442 - RNA, 17 nt, Mycobacterium avium subsp. paratuberculosis
uggcccgugucgcggcc

SEQ ID NO: 2970443 - RNA, 24 nt, Mycobacterium avium subsp. paratuberculosis
uggcccucggaggugccgcgcggc

SEQ ID NO: 2970444 - RNA, 12 nt, Mycobacterium avium subsp. paratuberculosis
uggcccuggcag

SEQ ID NO: 2970445 - RNA, 20 nt, Mycobacterium avium subsp. paratuberculosis
uggccgaacgggucggcgac

SEQ ID NO: 2970446 - RNA, 22 nt, Mycobacterium avium subsp. paratuberculosis
uggccgacaacauccgcgacga

SEQ ID NO: 2970447 - RNA, 14 nt, Mycobacterium avium subsp. paratuberculosis
uggccgaccgccgc

SEQ ID NO: 2970448 - RNA, 12 nt, Mycobacterium avium subsp. paratuberculosis
uggccgagcagc

SEQ ID NO: 2970449 - RNA, 20 nt, Mycobacterium avium subsp. paratuberculosis
uggccgagcagccgggccag

SEQ ID NO: 2970450 - RNA, 22 nt, Mycobacterium avium subsp. paratuberculosis
uggccgagcagccgggccagca

SEQ ID NO: 2970451 - RNA, 15 nt, Mycobacterium avium subsp. paratuberculosis
uggccgagccgggcg

SEQ ID NO: 2970452 - RNA, 17 nt, Mycobacterium avium subsp. paratuberculosis
uggccgagccgggcggc

SEQ ID NO: 2970453 - RNA, 15 nt, Mycobacterium avium subsp. paratuberculosis
uggccgagcggcugc

SEQ ID NO: 2970454 - RNA, 17 nt, Mycobacterium avium subsp. paratuberculosis
uggccgagcggcugcug

SEQ ID NO: 2970455 - RNA, 14 nt, Mycobacterium avium subsp. paratuberculosis
uggccgaggauggg

SEQ ID NO: 2970456 - RNA, 14 nt, Mycobacterium avium subsp. paratuberculosis
uggccgaggggucc

SEQ ID NO: 2970457 - RNA, 22 nt, Mycobacterium avium subsp. paratuberculosis
uggccgaguaggaagccaugcc

SEQ ID NO: 2970458 - RNA, 16 nt, Mycobacterium avium subsp. paratuberculosis
uggccgaucagcggcg

SEQ ID NO: 2970459 - RNA, 15 nt, Mycobacterium avium subsp. paratuberculosis
uggccgauggucagc

SEQ ID NO: 2970460 - RNA, 23 nt, Mycobacterium avium subsp. paratuberculosis
uggccgauggucagcugccgcac

SEQ ID NO: 2970461 - RNA, 17 nt, Mycobacterium avium subsp. paratuberculosis
uggccgcaggcggccag

SEQ ID NO: 2970462 - RNA, 20 nt, Mycobacterium avium subsp. paratuberculosis
uggccgccaagugcggugug

SEQ ID NO: 2970463 - RNA, 13 nt, Mycobacterium avium subsp. paratuberculosis
uggccgccaccag

SEQ ID NO: 2970464 - RNA, 22 nt, Mycobacterium avium subsp. paratuberculosis
uggccgccaccaggcugaacgu

SEQ ID NO: 2970465 - RNA, 15 nt, Mycobacterium avium subsp. paratuberculosis
uggccgccacgaugc

SEQ ID NO: 2970466 - RNA, 17 nt, Mycobacterium avium subsp. paratuberculosis
uggccgccagcaccucc

SEQ ID NO: 2970467 - RNA, 17 nt, Mycobacterium avium subsp. paratuberculosis
uggccgcccaccacgaa

SEQ ID NO: 2970468 - RNA, 18 nt, Mycobacterium avium subsp. paratuberculosis
uggccgccgcaggcgaag

SEQ ID NO: 2970469 - RNA, 15 nt, Mycobacterium avium subsp. paratuberculosis
uggccgccgccugag

SEQ ID NO: 2970470 - RNA, 20 nt, Mycobacterium avium subsp. paratuberculosis
uggccgccgccugagcccgc

SEQ ID NO: 2970471 - RNA, 10 nt, Mycobacterium avium subsp. paratuberculosis
uggccgccgg

SEQ ID NO: 2970472 - RNA, 18 nt, Mycobacterium avium subsp. paratuberculosis
uggccgccgugcagggug

SEQ ID NO: 2970473 - RNA, 15 nt, Mycobacterium avium subsp. paratuberculosis
uggccuuguggucga

SEQ ID NO: 2970474 - RNA, 19 nt, Mycobacterium avium subsp. paratuberculosis
uggcgaacauggucgccca

SEQ ID NO: 2970475 - RNA, 19 nt, Mycobacterium avium subsp. paratuberculosis
uggcgaaccagcgcccgcu

SEQ ID NO: 2970476 - RNA, 12 nt, Mycobacterium avium subsp. paratuberculosis
uggcgaaccgcg

SEQ ID NO: 2970477 - RNA, 15 nt, Mycobacterium avium subsp. paratuberculosis
uggcgaacucgacgg

SEQ ID NO: 2970478 - RNA, 16 nt, Mycobacterium avium subsp. paratuberculosis
uggcgaacucgcgcag

SEQ ID NO: 2970479 - RNA, 17 nt, Mycobacterium avium subsp. paratuberculosis
uggcgaacugcaccagc

SEQ ID NO: 2970480 - RNA, 18 nt, Mycobacterium avium subsp. paratuberculosis
uggcgaacugcaccagca

SEQ ID NO: 2970481 - RNA, 21 nt, Mycobacterium avium subsp. paratuberculosis
uggcgaagcaggggucguugu

SEQ ID NO: 2970482 - RNA, 16 nt, Mycobacterium avium subsp. paratuberculosis
uggcgaagcccaugcc

SEQ ID NO: 2970483 - RNA, 20 nt, Mycobacterium avium subsp. paratuberculosis
uggcgaagcccaugccgaug

SEQ ID NO: 2970484 - RNA, 21 nt, Mycobacterium avium subsp. paratuberculosis
uggcgaagcguuucagcaacc

SEQ ID NO: 2970485 - RNA, 22 nt, Mycobacterium avium subsp. paratuberculosis
uggcgaagcguuucagcaaccc

SEQ ID NO: 2970486 - RNA, 20 nt, Mycobacterium avium subsp. paratuberculosis
uggcgaaguagucggcgucc

SEQ ID NO: 2970487 - RNA, 20 nt, Mycobacterium avium subsp. paratuberculosis
uggcgaaguucggcaucccg

SEQ ID NO: 2970488 - RNA, 21 nt, Mycobacterium avium subsp. paratuberculosis
uggcgaauuccccguagucac

SEQ ID NO: 2970489 - RNA, 19 nt, Mycobacterium avium subsp. paratuberculosis
uggcgacaggaaccugguc

SEQ ID NO: 2970490 - RNA, 20 nt, Mycobacterium avium subsp. paratuberculosis
uggcgaccaccgaccccugc

SEQ ID NO: 2970491 - RNA, 15 nt, Mycobacterium avium subsp. paratuberculosis
uggcgaccgcgcagg

SEQ ID NO: 2970492 - RNA, 20 nt, Mycobacterium avium subsp. paratuberculosis
uggcgaccgcgcaggcggcg

SEQ ID NO: 2970493 - RNA, 15 nt, Mycobacterium avium subsp. paratuberculosis
uggcgaccgcggccg

SEQ ID NO: 2970494 - RNA, 14 nt, Mycobacterium avium subsp. paratuberculosis
uggcgaccgguccg

SEQ ID NO: 2970495 - RNA, 14 nt, Mycobacterium avium subsp. paratuberculosis
uggcgaccucgugg

SEQ ID NO: 2970496 - RNA, 20 nt, Mycobacterium avium subsp. paratuberculosis
uggcgacgaagucgacggcg

SEQ ID NO: 2970497 - RNA, 21 nt, Mycobacterium avium subsp. paratuberculosis
uggcgacgaagucgacggcgg

SEQ ID NO: 2970498 - RNA, 13 nt, Mycobacterium avium subsp. paratuberculosis
uggcgacgacgcc

SEQ ID NO: 2970499 - RNA, 15 nt, Mycobacterium avium subsp. paratuberculosis
uggcgacgacggcgg

SEQ ID NO: 2970500 - RNA, 17 nt, Mycobacterium avium subsp. paratuberculosis
uggcgacgacggcggag

SEQ ID NO: 2970501 - RNA, 21 nt, Mycobacterium avium subsp. paratuberculosis
uggcgacgcugaacagcagca

SEQ ID NO: 2970502 - RNA, 14 nt, Mycobacterium avium subsp. paratuberculosis
uggcgacggggugg

SEQ ID NO: 2970503 - RNA, 20 nt, Mycobacterium avium subsp. paratuberculosis
uggcgacggucugccgggac

SEQ ID NO: 2970504 - RNA, 22 nt, Mycobacterium avium subsp. paratuberculosis
uggcgacggucugccgggacag

SEQ ID NO: 2970505 - RNA, 21 nt, Mycobacterium avium subsp. paratuberculosis
uggcgacggugcaugcgcugg

SEQ ID NO: 2970506 - RNA, 14 nt, Mycobacterium avium subsp. paratuberculosis
uggcgaucaccccg

SEQ ID NO: 2970507 - RNA, 16 nt, Mycobacterium avium subsp. paratuberculosis
uggcgaucaccccggc

SEQ ID NO: 2970508 - RNA, 24 nt, Mycobacterium avium subsp. paratuberculosis
uggcgaucaccccggcgacggcgg

SEQ ID NO: 2970509 - RNA, 20 nt, Mycobacterium avium subsp. paratuberculosis
uggcgaucaccuugcggccg

SEQ ID NO: 2970510 - RNA, 22 nt, Mycobacterium avium subsp. paratuberculosis
uggcgaucaccuugcggccggc

SEQ ID NO: 2970511 - RNA, 22 nt, Mycobacterium avium subsp. paratuberculosis
uggcgaucagaugcucgucggu

SEQ ID NO: 2970512 - RNA, 15 nt, Mycobacterium avium subsp. paratuberculosis
uggcgaucaucagga

SEQ ID NO: 2970513 - RNA, 23 nt, Mycobacterium avium subsp. paratuberculosis
uggcgaucgaugcccagcgcgcg

SEQ ID NO: 2970514 - RNA, 18 nt, Mycobacterium avium subsp. paratuberculosis
uggcgaugaccagcgcga

SEQ ID NO: 2970515 - RNA, 22 nt, Mycobacterium avium subsp. paratuberculosis
uggcgaugacgaauuccgcacc

SEQ ID NO: 2970516 - RNA, 16 nt, Mycobacterium avium subsp. paratuberculosis
uggcgaugacgucguc

SEQ ID NO: 2970517 - RNA, 22 nt, Mycobacterium avium subsp. paratuberculosis
uggcgaugaucaacaggauucc

SEQ ID NO: 2970518 - RNA, 17 nt, Mycobacterium avium subsp. paratuberculosis
uggcgaugaucaccucg

SEQ ID NO: 2970519 - RNA, 21 nt, Mycobacterium avium subsp. paratuberculosis
uggcgaugaucaccucgguga

SEQ ID NO: 2970520 - RNA, 22 nt, Mycobacterium avium subsp. paratuberculosis
uggcgaugccggacucugacuc

SEQ ID NO: 2970521 - RNA, 23 nt, Mycobacterium avium subsp. paratuberculosis
uggcgaugggcaauaccggcagc

SEQ ID NO: 2970522 - RNA, 13 nt, Mycobacterium avium subsp. paratuberculosis
uggcgauggugcu

SEQ ID NO: 2970523 - RNA, 19 nt, Mycobacterium avium subsp. paratuberculosis
uggcgcacaacccggacag

SEQ ID NO: 2970524 - RNA, 22 nt, Mycobacterium avium subsp. paratuberculosis
uggcgcacagaucgucucggcc

SEQ ID NO: 2970525 - RNA, 23 nt, Mycobacterium avium subsp. paratuberculosis
uggcgcacagaucgucucggcca

SEQ ID NO: 2970526 - RNA, 23 nt, Mycobacterium avium subsp. paratuberculosis
uggcgcacagcuuucgggcggcc

SEQ ID NO: 2970527 - RNA, 14 nt, Mycobacterium avium subsp. paratuberculosis
uggcgcaccgccgc

SEQ ID NO: 2970528 - RNA, 14 nt, Mycobacterium avium subsp. paratuberculosis
uggcgcaccgggac

SEQ ID NO: 2970529 - RNA, 18 nt, Mycobacterium avium subsp. paratuberculosis
uggcgcagcgucaacggc

SEQ ID NO: 2970530 - RNA, 18 nt, Mycobacterium avium subsp. paratuberculosis
uggcgcaggcgcugggug

SEQ ID NO: 2970531 - RNA, 13 nt, Mycobacterium avium subsp. paratuberculosis
uggcgcagggcgu

SEQ ID NO: 2970532 - RNA, 20 nt, Mycobacterium avium subsp. paratuberculosis
uggcgcagggcguucgacgu

SEQ ID NO: 2970533 - RNA, 16 nt, Mycobacterium avium subsp. paratuberculosis
uggcgccaccuccgac

SEQ ID NO: 2970534 - RNA, 21 nt, Mycobacterium avium subsp. paratuberculosis
uggcgccaguaguggaucagc

SEQ ID NO: 2970535 - RNA, 12 nt, Mycobacterium avium subsp. paratuberculosis
uggcgcccagcg

SEQ ID NO: 2970536 - RNA, 18 nt, Mycobacterium avium subsp. paratuberculosis
uggcgcccagcgagcugc

SEQ ID NO: 2970537 - RNA, 22 nt, Mycobacterium avium subsp. paratuberculosis
uggcgcccagcgucucggcggc

SEQ ID NO: 2970538 - RNA, 15 nt, Mycobacterium avium subsp. paratuberculosis
uggcgcccagcgugg

SEQ ID NO: 2970539 - RNA, 17 nt, Mycobacterium avium subsp. paratuberculosis
uggcgcccgcguacagc

SEQ ID NO: 2970540 - RNA, 21 nt, Mycobacterium avium subsp. paratuberculosis
uggcgcccggcagccgcuccg

SEQ ID NO: 2970541 - RNA, 13 nt, Mycobacterium avium subsp. paratuberculosis
uggcgccgaacag

SEQ ID NO: 2970542 - RNA, 23 nt, Mycobacterium avium subsp. paratuberculosis
uggcgccgaacagaugccugccc

SEQ ID NO: 2970543 - RNA, 23 nt, Mycobacterium avium subsp. paratuberculosis
uggcgccgaggaucuugaucgcg

SEQ ID NO: 2970544 - RNA, 17 nt, Mycobacterium avium subsp. paratuberculosis
uggcgccgaucgcgcgc

SEQ ID NO: 2970545 - RNA, 16 nt, Mycobacterium avium subsp. paratuberculosis
uggcgccgcccaccag

SEQ ID NO: 2970546 - RNA, 18 nt, Mycobacterium avium subsp. paratuberculosis
uggcgccgcccaccagca

SEQ ID NO: 2970547 - RNA, 14 nt, Mycobacterium avium subsp. paratuberculosis
uggcgccgcgcagc

SEQ ID NO: 2970548 - RNA, 14 nt, Mycobacterium avium subsp. paratuberculosis
uggcgccgcgggcg

SEQ ID NO: 2970549 - RNA, 14 nt, Mycobacterium avium subsp. paratuberculosis
uggcgccgcggucg

SEQ ID NO: 2970550 - RNA, 15 nt, Mycobacterium avium subsp. paratuberculosis
uggcgccggcaucga

SEQ ID NO: 2970551 - RNA, 21 nt, Mycobacterium avium subsp. paratuberculosis
uggcgccggcaucgaccgccc

SEQ ID NO: 2970552 - RNA, 12 nt, Mycobacterium avium subsp. paratuberculosis
uggcgccggcca

SEQ ID NO: 2970553 - RNA, 14 nt, Mycobacterium avium subsp. paratuberculosis
uggcgccggccagc

SEQ ID NO: 2970554 - RNA, 22 nt, Mycobacterium avium subsp. paratuberculosis
uggcgccggccagcaccacggu

SEQ ID NO: 2970555 - RNA, 13 nt, Mycobacterium avium subsp. paratuberculosis
uggcgccggcguc

SEQ ID NO: 2970556 - RNA, 17 nt, Mycobacterium avium subsp. paratuberculosis
uggcgccggcguccagc

SEQ ID NO: 2970557 - RNA, 15 nt, Mycobacterium avium subsp. paratuberculosis
uggcgggcccgggcg

SEQ ID NO: 2970558 - RNA, 21 nt, Mycobacterium avium subsp. paratuberculosis
uggcgggcccgggcgcugagc

SEQ ID NO: 2970559 - RNA, 17 nt, Mycobacterium avium subsp. paratuberculosis
uggcgggcgaucgccuc

SEQ ID NO: 2970560 - RNA, 23 nt, Mycobacterium avium subsp. paratuberculosis
uggcgggcgcgccggcgcgcagc

SEQ ID NO: 2970561 - RNA, 18 nt, Mycobacterium avium subsp. paratuberculosis
uggcggguacagccgcag

SEQ ID NO: 2970562 - RNA, 13 nt, Mycobacterium avium subsp. paratuberculosis
uggcggguggcga

SEQ ID NO: 2970563 - RNA, 17 nt, Mycobacterium avium subsp. paratuberculosis
uggcggucgcgccagac

SEQ ID NO: 2970564 - RNA, 18 nt, Mycobacterium avium subsp. paratuberculosis
uggcggucggugcgcagc

SEQ ID NO: 2970565 - RNA, 15 nt, Mycobacterium avium subsp. paratuberculosis
uggcggugccgcggc

SEQ ID NO: 2970566 - RNA, 21 nt, Mycobacterium avium subsp. paratuberculosis
uggcggugccgcggcggcgcc

SEQ ID NO: 2970567 - RNA, 20 nt, Mycobacterium avium subsp. paratuberculosis
uggcggugcggucgcgcagc

SEQ ID NO: 2970568 - RNA, 16 nt, Mycobacterium avium subsp. paratuberculosis
uggcgguggccacggc

SEQ ID NO: 2970569 - RNA, 16 nt, Mycobacterium avium subsp. paratuberculosis
uggcgguggcccggua

SEQ ID NO: 2970570 - RNA, 19 nt, Mycobacterium avium subsp. paratuberculosis
uggcgguggcccgguacag

SEQ ID NO: 2970571 - RNA, 21 nt, Mycobacterium avium subsp. paratuberculosis
uggcgguggcggcgaaaucgc

SEQ ID NO: 2970572 - RNA, 16 nt, Mycobacterium avium subsp. paratuberculosis
uggcggugucgaagac

SEQ ID NO: 2970573 - RNA, 23 nt, Mycobacterium avium subsp. paratuberculosis
uggcggugucgaagaccggugcg

SEQ ID NO: 2970574 - RNA, 22 nt, Mycobacterium avium subsp. paratuberculosis
uggcgguguucgagggcgcggc

SEQ ID NO: 2970575 - RNA, 16 nt, Mycobacterium avium subsp. paratuberculosis
uggcgguuggacaggc

SEQ ID NO: 2970576 - RNA, 23 nt, Mycobacterium avium subsp. paratuberculosis
uggcgguuggacaggccggcgac

SEQ ID NO: 2970577 - RNA, 14 nt, Mycobacterium avium subsp. paratuberculosis
uggcguagagccgc

SEQ ID NO: 2970578 - RNA, 20 nt, Mycobacterium avium subsp. paratuberculosis
uggcguagaucugcacgcug

SEQ ID NO: 2970579 - RNA, 23 nt, Mycobacterium avium subsp. paratuberculosis
uggcguaggacagcagccgcuca

SEQ ID NO: 2970580 - RNA, 14 nt, Mycobacterium avium subsp. paratuberculosis
uggcguagucgacu

SEQ ID NO: 2970581 - RNA, 17 nt, Mycobacterium avium subsp. paratuberculosis
uggcguagucgucgauc

SEQ ID NO: 2970582 - RNA, 20 nt, Mycobacterium avium subsp. paratuberculosis
uggcguagugggucggcggc

SEQ ID NO: 2970583 - RNA, 17 nt, Mycobacterium avium subsp. paratuberculosis
uggcguaguggugcagg

SEQ ID NO: 2970584 - RNA, 22 nt, Mycobacterium avium subsp. paratuberculosis
uggcguaugccuccucggugag

SEQ ID NO: 2970585 - RNA, 20 nt, Mycobacterium avium subsp. paratuberculosis
uggcgucacgcugcgcgccg

SEQ ID NO: 2970586 - RNA, 13 nt, Mycobacterium avium subsp. paratuberculosis
uggcgucgaacgu

SEQ ID NO: 2970587 - RNA, 12 nt, Mycobacterium avium subsp. paratuberculosis
uggcgucgacgg

SEQ ID NO: 2970588 - RNA, 12 nt, Mycobacterium avium subsp. paratuberculosis
uggcgucgacgu

SEQ ID NO: 2970589 - RNA, 13 nt, Mycobacterium avium subsp. paratuberculosis
uggcgucgacgug

SEQ ID NO: 2970590 - RNA, 14 nt, Mycobacterium avium subsp. paratuberculosis
uggcgucgacgugc

SEQ ID NO: 2970591 - RNA, 18 nt, Mycobacterium avium subsp. paratuberculosis
uggcgucgaucagcgcgc

SEQ ID NO: 2970592 - RNA, 23 nt, Mycobacterium avium subsp. paratuberculosis
uggcgucgaucagcgcgccgccc

SEQ ID NO: 2970593 - RNA, 12 nt, Mycobacterium avium subsp. paratuberculosis
uggcgucgaugc

SEQ ID NO: 2970594 - RNA, 17 nt, Mycobacterium avium subsp. paratuberculosis
uggcgucgccgccggug

SEQ ID NO: 2970595 - RNA, 21 nt, Mycobacterium avium subsp. paratuberculosis
uggcgucgccgccggugccga

SEQ ID NO: 2970596 - RNA, 17 nt, Mycobacterium avium subsp. paratuberculosis
uggcgucggccagcggc

SEQ ID NO: 2970597 - RNA, 14 nt, Mycobacterium avium subsp. paratuberculosis
uggcgucggccggg

SEQ ID NO: 2970598 - RNA, 20 nt, Mycobacterium avium subsp. paratuberculosis
uggcgucggccgggggcgcg

SEQ ID NO: 2970599 - RNA, 21 nt, Mycobacterium avium subsp. paratuberculosis
uggcgucggugaacucgucca

SEQ ID NO: 2970600 - RNA, 14 nt, Mycobacterium avium subsp. paratuberculosis
uggcgucggugaug

SEQ ID NO: 2970601 - RNA, 18 nt, Mycobacterium avium subsp. paratuberculosis
uggcgucggugaugccgg

SEQ ID NO: 2970602 - RNA, 12 nt, Mycobacterium avium subsp. paratuberculosis
uggcgucggugg

SEQ ID NO: 2970603 - RNA, 14 nt, Mycobacterium avium subsp. paratuberculosis
uggcgucgguggcg

SEQ ID NO: 2970604 - RNA, 16 nt, Mycobacterium avium subsp. paratuberculosis
uggcgucgguggcggc

SEQ ID NO: 2970605 - RNA, 12 nt, Mycobacterium avium subsp. paratuberculosis
uggcgucgucgg

SEQ ID NO: 2970606 - RNA, 16 nt, Mycobacterium avium subsp. paratuberculosis
uggcgucgucggcggc

SEQ ID NO: 2970607 - RNA, 16 nt, Mycobacterium avium subsp. paratuberculosis
uggcgucguuggcgcc

SEQ ID NO: 2970608 - RNA, 18 nt, Mycobacterium avium subsp. paratuberculosis
uggcgucguuggcgccgu

SEQ ID NO: 2970609 - RNA, 19 nt, Mycobacterium avium subsp. paratuberculosis
uggcgucguuggcgccguc

SEQ ID NO: 2970610 - RNA, 18 nt, Mycobacterium avium subsp. paratuberculosis
uggcgugacgcucgacgg

SEQ ID NO: 2970611 - RNA, 15 nt, Mycobacterium avium subsp. paratuberculosis
uggcgugacgcucgg

SEQ ID NO: 2970612 - RNA, 18 nt, Mycobacterium avium subsp. paratuberculosis
uggcgugacgcucggccu

SEQ ID NO: 2970613 - RNA, 17 nt, Mycobacterium avium subsp. paratuberculosis
uggcgugacgcucggcg

SEQ ID NO: 2970614 - RNA, 19 nt, Mycobacterium avium subsp. paratuberculosis
uggcgugacggucgaccuc

SEQ ID NO: 2970615 - RNA, 20 nt, Mycobacterium avium subsp. paratuberculosis
uggcgugacguucggccaau

SEQ ID NO: 2970616 - RNA, 19 nt, Mycobacterium avium subsp. paratuberculosis
uggcgugacguucgucagc

SEQ ID NO: 2970617 - RNA, 17 nt, Mycobacterium avium subsp. paratuberculosis
uggcgugccacagcaug

SEQ ID NO: 2970618 - RNA, 17 nt, Mycobacterium avium subsp. paratuberculosis
uggcgugccggcgcugc

SEQ ID NO: 2970619 - RNA, 19 nt, Mycobacterium avium subsp. paratuberculosis
uggcgugccgggcgguacg

SEQ ID NO: 2970620 - RNA, 17 nt, Mycobacterium avium subsp. paratuberculosis
uggcgugcggccucggc

SEQ ID NO: 2970621 - RNA, 22 nt, Mycobacterium avium subsp. paratuberculosis
uggcgugcggccucggcaccgu

SEQ ID NO: 2970622 - RNA, 16 nt, Mycobacterium avium subsp. paratuberculosis
uggcgugcggcgcggu

SEQ ID NO: 2970623 - RNA, 21 nt, Mycobacterium avium subsp. paratuberculosis
uggcgugcuugaacgccgccc

SEQ ID NO: 2970624 - RNA, 19 nt, Mycobacterium avium subsp. paratuberculosis
uggcguggauggccggccg

SEQ ID NO: 2970625 - RNA, 16 nt, Mycobacterium avium subsp. paratuberculosis
uggcguggcacccggg

SEQ ID NO: 2970626 - RNA, 18 nt, Mycobacterium avium subsp. paratuberculosis
uggcguggcucggcccgc

SEQ ID NO: 2970627 - RNA, 20 nt, Mycobacterium avium subsp. paratuberculosis
uggcgugguggaaggugacg

SEQ ID NO: 2970628 - RNA, 16 nt, Mycobacterium avium subsp. paratuberculosis
uggcgugucggugaug

SEQ ID NO: 2970629 - RNA, 15 nt, Mycobacterium avium subsp. paratuberculosis
uggcguuacacccgc

SEQ ID NO: 2970630 - RNA, 18 nt, Mycobacterium avium subsp. paratuberculosis
uggcguucugcaccgacu

SEQ ID NO: 2970631 - RNA, 15 nt, Mycobacterium avium subsp. paratuberculosis
uggcguugaugcggg

SEQ ID NO: 2970632 - RNA, 14 nt, Mycobacterium avium subsp. paratuberculosis
uggcguugcgggcg

SEQ ID NO: 2970633 - RNA, 20 nt, Mycobacterium avium subsp. paratuberculosis
uggcguuuuccuucggugcg

SEQ ID NO: 2970634 - RNA, 17 nt, Mycobacterium avium subsp. paratuberculosis
uggcguuuuugugggug

SEQ ID NO: 2970635 - RNA, 19 nt, Mycobacterium avium subsp. paratuberculosis
uggcuaccgccgggcgggc

SEQ ID NO: 2970636 - RNA, 19 nt, Mycobacterium avium subsp. paratuberculosis
uggcuagcgggcgcgcagc

SEQ ID NO: 2970637 - RNA, 21 nt, Mycobacterium avium subsp. paratuberculosis
uggcuagcgggcgcgcagcca

SEQ ID NO: 2970638 - RNA, 19 nt, Mycobacterium avium subsp. paratuberculosis
uggcucaacacguccuggc

SEQ ID NO: 2970639 - RNA, 17 nt, Mycobacterium avium subsp. paratuberculosis
uggcucagcgcaccgcc

SEQ ID NO: 2970640 - RNA, 20 nt, Mycobacterium avium subsp. paratuberculosis
uggcucagcgcaccgccguc

SEQ ID NO: 2970641 - RNA, 23 nt, Mycobacterium avium subsp. paratuberculosis
ugggcgauugcguugaucgacgg

SEQ ID NO: 2970642 - RNA, 17 nt, Mycobacterium avium subsp. paratuberculosis
ugggcgccagcagcacc

SEQ ID NO: 2970643 - RNA, 11 nt, Mycobacterium avium subsp. paratuberculosis
ugggcgccgag

SEQ ID NO: 2970644 - RNA, 21 nt, Mycobacterium avium subsp. paratuberculosis
ugggcgccgaguccgggccgc

SEQ ID NO: 2970645 - RNA, 14 nt, Mycobacterium avium subsp. paratuberculosis
ugggcgccggcguc

SEQ ID NO: 2970646 - RNA, 15 nt, Mycobacterium avium subsp. paratuberculosis
ugggcgccggcguca

SEQ ID NO: 2970647 - RNA, 13 nt, Mycobacterium avium subsp. paratuberculosis
ugggcgccgucaa

SEQ ID NO: 2970648 - RNA, 15 nt, Mycobacterium avium subsp. paratuberculosis
ugggcgccgucgccg

SEQ ID NO: 2970649 - RNA, 17 nt, Mycobacterium avium subsp. paratuberculosis
ugggcgccgucgccgcc

SEQ ID NO: 2970650 - RNA, 18 nt, Mycobacterium avium subsp. paratuberculosis
ugggcgccgucgccgccg

SEQ ID NO: 2970651 - RNA, 17 nt, Mycobacterium avium subsp. paratuberculosis
ugggcgcgaucggcagg

SEQ ID NO: 2970652 - RNA, 14 nt, Mycobacterium avium subsp. paratuberculosis
ugggcgcgcagcac

SEQ ID NO: 2970653 - RNA, 15 nt, Mycobacterium avium subsp. paratuberculosis
ugggcgcgggccgcg

SEQ ID NO: 2970654 - RNA, 16 nt, Mycobacterium avium subsp. paratuberculosis
ugggcgcgggccgcgu

SEQ ID NO: 2970655 - RNA, 17 nt, Mycobacterium avium subsp. paratuberculosis
ugggcgcguuggccggc

SEQ ID NO: 2970656 - RNA, 21 nt, Mycobacterium avium subsp. paratuberculosis
ugggcggacgggaccacccgc

SEQ ID NO: 2970657 - RNA, 13 nt, Mycobacterium avium subsp. paratuberculosis
ugggcggauccgc

SEQ ID NO: 2970658 - RNA, 15 nt, Mycobacterium avium subsp. paratuberculosis
ugggcggccaccaac

SEQ ID NO: 2970659 - RNA, 21 nt, Mycobacterium avium subsp. paratuberculosis
ugggcggccaccaacggcagc

SEQ ID NO: 2970660 - RNA, 15 nt, Mycobacterium avium subsp. paratuberculosis
ugggcggccaccacu

SEQ ID NO: 2970661 - RNA, 16 nt, Mycobacterium avium subsp. paratuberculosis
ugggcggccaccacuu

SEQ ID NO: 2970662 - RNA, 18 nt, Mycobacterium avium subsp. paratuberculosis
ugggcggccaccacuucc

SEQ ID NO: 2970663 - RNA, 23 nt, Mycobacterium avium subsp. paratuberculosis
ugggcggccugcacccaggucau

SEQ ID NO: 2970664 - RNA, 20 nt, Mycobacterium avium subsp. paratuberculosis
ugggcggcgacacgccgacg

SEQ ID NO: 2970665 - RNA, 12 nt, Mycobacterium avium subsp. paratuberculosis
ugggcggcggcc

SEQ ID NO: 2970666 - RNA, 16 nt, Mycobacterium avium subsp. paratuberculosis
ugggcgguccgcucca

SEQ ID NO: 2970667 - RNA, 21 nt, Mycobacterium avium subsp. paratuberculosis
ugggcgguccgcuccaccagc

SEQ ID NO: 2970668 - RNA, 22 nt, Mycobacterium avium subsp. paratuberculosis
ugggcgguccgcuccaccagcg

SEQ ID NO: 2970669 - RNA, 13 nt, Mycobacterium avium subsp. paratuberculosis
ugggcgucgagug

SEQ ID NO: 2970670 - RNA, 16 nt, Mycobacterium avium subsp. paratuberculosis
ugggcgucgucgauga

SEQ ID NO: 2970671 - RNA, 19 nt, Mycobacterium avium subsp. paratuberculosis
ugggcgucguggucgacgc

SEQ ID NO: 2970672 - RNA, 19 nt, Mycobacterium avium subsp. paratuberculosis
ugggcgugcaggccgcggg

SEQ ID NO: 2970673 - RNA, 23 nt, Mycobacterium avium subsp. paratuberculosis
ugggcguggugcggugcaccgcg

SEQ ID NO: 2970674 - RNA, 20 nt, Mycobacterium avium subsp. paratuberculosis
ugggcuaccagccccaggag

SEQ ID NO: 2970675 - RNA, 21 nt, Mycobacterium avium subsp. paratuberculosis
ugggcuccgaccgugaagcua

SEQ ID NO: 2970676 - RNA, 21 nt, Mycobacterium avium subsp. paratuberculosis
ugggcuccucgaccacgcaca

SEQ ID NO: 2970677 - RNA, 13 nt, Mycobacterium avium subsp. paratuberculosis
ugggcucgaccac

SEQ ID NO: 2970678 - RNA, 12 nt, Mycobacterium avium subsp. paratuberculosis
ugggcucgagca

SEQ ID NO: 2970679 - RNA, 17 nt, Mycobacterium avium subsp. paratuberculosis
ugggcucgagcaacacc

SEQ ID NO: 2970680 - RNA, 20 nt, Mycobacterium avium subsp. paratuberculosis
ugggcucgagcaacaccacc

SEQ ID NO: 2970681 - RNA, 17 nt, Mycobacterium avium subsp. paratuberculosis
ugggcucggccaucccg

SEQ ID NO: 2970682 - RNA, 15 nt, Mycobacterium avium subsp. paratuberculosis
ugggcuggccguccg

SEQ ID NO: 2970683 - RNA, 14 nt, Mycobacterium avium subsp. paratuberculosis
ugggcugggucacc

SEQ ID NO: 2970684 - RNA, 19 nt, Mycobacterium avium subsp. paratuberculosis
ugggcugggucaccacggu

SEQ ID NO: 2970685 - RNA, 17 nt, Mycobacterium avium subsp. paratuberculosis
uggggacgacgccgaac

SEQ ID NO: 2970686 - RNA, 20 nt, Mycobacterium avium subsp. paratuberculosis
uggggacgugcacgcguucg

SEQ ID NO: 2970687 - RNA, 21 nt, Mycobacterium avium subsp. paratuberculosis
uggggaucaggaugacgccgc

SEQ ID NO: 2970688 - RNA, 12 nt, Mycobacterium avium subsp. paratuberculosis
uggggcagcacc

SEQ ID NO: 2970689 - RNA, 20 nt, Mycobacterium avium subsp. paratuberculosis
uggggcagcaccucgcgcgc

SEQ ID NO: 2970690 - RNA, 16 nt, Mycobacterium avium subsp. paratuberculosis
uggggcaguagcgacg

SEQ ID NO: 2970691 - RNA, 17 nt, Mycobacterium avium subsp. paratuberculosis
uggggcaguagcgacgc

SEQ ID NO: 2970692 - RNA, 20 nt, Mycobacterium avium subsp. paratuberculosis
uggggcccgguccgcugugc

SEQ ID NO: 2970693 - RNA, 18 nt, Mycobacterium avium subsp. paratuberculosis
uggggccgaagccgacac

SEQ ID NO: 2970694 - RNA, 19 nt, Mycobacterium avium subsp. paratuberculosis
uggggccgaagccgacacc

SEQ ID NO: 2970695 - RNA, 21 nt, Mycobacterium avium subsp. paratuberculosis
uggggccgaagccgacaccgg

SEQ ID NO: 2970696 - RNA, 19 nt, Mycobacterium avium subsp. paratuberculosis
uggggccgccgucuuccca

SEQ ID NO: 2970697 - RNA, 14 nt, Mycobacterium avium subsp. paratuberculosis
uggggcgcaccgcc

SEQ ID NO: 2970698 - RNA, 14 nt, Mycobacterium avium subsp. paratuberculosis
ugggggccagcgcc

SEQ ID NO: 2970699 - RNA, 12 nt, Mycobacterium avium subsp. paratuberculosis
ugggggccaggc

SEQ ID NO: 2970700 - RNA, 13 nt, Mycobacterium avium subsp. paratuberculosis
ugggggucgacug

SEQ ID NO: 2970701 - RNA, 18 nt, Mycobacterium avium subsp. paratuberculosis
uggggguggcgucgacgg

SEQ ID NO: 2970702 - RNA, 13 nt, Mycobacterium avium subsp. paratuberculosis
uggggucgcgggc

SEQ ID NO: 2970703 - RNA, 14 nt, Mycobacterium avium subsp. paratuberculosis
uggggucgcgggcg

SEQ ID NO: 2970704 - RNA, 17 nt, Mycobacterium avium subsp. paratuberculosis
uggggucgcgggcgccg

SEQ ID NO: 2970705 - RNA, 20 nt, Mycobacterium avium subsp. paratuberculosis
uggggugaggcacccgcugc

SEQ ID NO: 2970706 - RNA, 16 nt, Mycobacterium avium subsp. paratuberculosis
uggggugucagcgcga

SEQ ID NO: 2970707 - RNA, 18 nt, Mycobacterium avium subsp. paratuberculosis
uggggugucagcgcgacc

SEQ ID NO: 2970708 - RNA, 14 nt, Mycobacterium avium subsp. paratuberculosis
ugggguuuggcgac

SEQ ID NO: 2970709 - RNA, 18 nt, Mycobacterium avium subsp. paratuberculosis
ugggguuuggcgacgucc

SEQ ID NO: 2970710 - RNA, 15 nt, Mycobacterium avium subsp. paratuberculosis
uggguauccgccgcc

SEQ ID NO: 2970711 - RNA, 16 nt, Mycobacterium avium subsp. paratuberculosis
uggguauccgccgcca

SEQ ID NO: 2970712 - RNA, 12 nt, Mycobacterium avium subsp. paratuberculosis
ugggucacgcug

SEQ ID NO: 2970713 - RNA, 22 nt, Mycobacterium avium subsp. paratuberculosis
ugggucacgcugaacggugccg

SEQ ID NO: 2970714 - RNA, 22 nt, Mycobacterium avium subsp. paratuberculosis
ugggucagccacgggcggucgg

SEQ ID NO: 2970715 - RNA, 22 nt, Mycobacterium avium subsp. paratuberculosis
ugggucagcucccccgucgggc

SEQ ID NO: 2970716 - RNA, 21 nt, Mycobacterium avium subsp. paratuberculosis
uggguccgauugcccgacucc

SEQ ID NO: 2970717 - RNA, 15 nt, Mycobacterium avium subsp. paratuberculosis
uggguccgccgggcg

SEQ ID NO: 2970718 - RNA, 17 nt, Mycobacterium avium subsp. paratuberculosis
uggguccggucagcacc

SEQ ID NO: 2970719 - RNA, 13 nt, Mycobacterium avium subsp. paratuberculosis
ugggucucggcga

SEQ ID NO: 2970720 - RNA, 16 nt, Mycobacterium avium subsp. paratuberculosis
ugggucugcggccggg

SEQ ID NO: 2970721 - RNA, 20 nt, Mycobacterium avium subsp. paratuberculosis
ugggugagcgacaccagguc

SEQ ID NO: 2970722 - RNA, 15 nt, Mycobacterium avium subsp. paratuberculosis
ugggugaucgcggcc

SEQ ID NO: 2970723 - RNA, 18 nt, Mycobacterium avium subsp. paratuberculosis
ugggugaucgcggcccgc

SEQ ID NO: 2970724 - RNA, 20 nt, Mycobacterium avium subsp. paratuberculosis
ugggugccgcguuccccggc

SEQ ID NO: 2970725 - RNA, 17 nt, Mycobacterium avium subsp. paratuberculosis
ugggugcucaccccggc

SEQ ID NO: 2970726 - RNA, 21 nt, Mycobacterium avium subsp. paratuberculosis
uggucgcggccuugcgggccg

SEQ ID NO: 2970727 - RNA, 21 nt, Mycobacterium avium subsp. paratuberculosis
uggucgcggcguugcccgcug

SEQ ID NO: 2970728 - RNA, 18 nt, Mycobacterium avium subsp. paratuberculosis
uggucggagccgucggug

SEQ ID NO: 2970729 - RNA, 11 nt, Mycobacterium avium subsp. paratuberculosis
uggucggcagc

SEQ ID NO: 2970730 - RNA, 16 nt, Mycobacterium avium subsp. paratuberculosis
uggucggcagcaccgg

SEQ ID NO: 2970731 - RNA, 20 nt, Mycobacterium avium subsp. paratuberculosis
uggucggcagcaccggcagc

SEQ ID NO: 2970732 - RNA, 13 nt, Mycobacterium avium subsp. paratuberculosis
uggucggccaggg

SEQ ID NO: 2970733 - RNA, 18 nt, Mycobacterium avium subsp. paratuberculosis
uggucggcgaacugcuug

SEQ ID NO: 2970734 - RNA, 17 nt, Mycobacterium avium subsp. paratuberculosis
uggucggcgacgccguc

SEQ ID NO: 2970735 - RNA, 20 nt, Mycobacterium avium subsp. paratuberculosis
uggucggcgacgccgucggg

SEQ ID NO: 2970736 - RNA, 17 nt, Mycobacterium avium subsp. paratuberculosis
uggucggcgcggcgacg

SEQ ID NO: 2970737 - RNA, 14 nt, Mycobacterium avium subsp. paratuberculosis
uggucggcgcgguc

SEQ ID NO: 2970738 - RNA, 15 nt, Mycobacterium avium subsp. paratuberculosis
uggucggcgggcagc

SEQ ID NO: 2970739 - RNA, 23 nt, Mycobacterium avium subsp. paratuberculosis
uggucggcggguaugucggcgac

SEQ ID NO: 2970740 - RNA, 19 nt, Mycobacterium avium subsp. paratuberculosis
uggucgggcaugccggccg

SEQ ID NO: 2970741 - RNA, 23 nt, Mycobacterium avium subsp. paratuberculosis
uggucgggcgcaccacgaccucc

SEQ ID NO: 2970742 - RNA, 17 nt, Mycobacterium avium subsp. paratuberculosis
uggucggguucgcccuc

SEQ ID NO: 2970743 - RNA, 12 nt, Mycobacterium avium subsp. paratuberculosis
uggucggucagc

SEQ ID NO: 2970744 - RNA, 13 nt, Mycobacterium avium subsp. paratuberculosis
uggucggucagcu

SEQ ID NO: 2970745 - RNA, 14 nt, Mycobacterium avium subsp. paratuberculosis
uggucgucgacgag

SEQ ID NO: 2970746 - RNA, 16 nt, Mycobacterium avium subsp. paratuberculosis
uggucgucgucgaagg

SEQ ID NO: 2970747 - RNA, 18 nt, Mycobacterium avium subsp. paratuberculosis
uggucgugcucgucggcg

SEQ ID NO: 2970748 - RNA, 15 nt, Mycobacterium avium subsp. paratuberculosis
uggucguugcacacc

SEQ ID NO: 2970749 - RNA, 17 nt, Mycobacterium avium subsp. paratuberculosis
uggucguugcacacccg

SEQ ID NO: 2970750 - RNA, 15 nt, Mycobacterium avium subsp. paratuberculosis
uggucucccgggcgg

SEQ ID NO: 2970751 - RNA, 20 nt, Mycobacterium avium subsp. paratuberculosis
uggucuccggccccgagccg

SEQ ID NO: 2970752 - RNA, 15 nt, Mycobacterium avium subsp. paratuberculosis
uggucuccuggccgc

SEQ ID NO: 2970753 - RNA, 21 nt, Mycobacterium avium subsp. paratuberculosis
uggucucgcugaucucgacgg

SEQ ID NO: 2970754 - RNA, 13 nt, Mycobacterium avium subsp. paratuberculosis
uggucucguugug

SEQ ID NO: 2970755 - RNA, 17 nt, Mycobacterium avium subsp. paratuberculosis
uggucugaaagugacgg

SEQ ID NO: 2970756 - RNA, 20 nt, Mycobacterium avium subsp. paratuberculosis
uggucugaccccccgacgcc

SEQ ID NO: 2970757 - RNA, 21 nt, Mycobacterium avium subsp. paratuberculosis
uggucugaccccccgacgccg

SEQ ID NO: 2970758 - RNA, 24 nt, Mycobacterium avium subsp. paratuberculosis
uggucugcagcgacggaucggccg

SEQ ID NO: 2970759 - RNA, 13 nt, Mycobacterium avium subsp. paratuberculosis
uggucugcgccgg

SEQ ID NO: 2970760 - RNA, 16 nt, Mycobacterium avium subsp. paratuberculosis
uggucuggugggugug

SEQ ID NO: 2970761 - RNA, 14 nt, Mycobacterium avium subsp. paratuberculosis
uggucuucgguguc

SEQ ID NO: 2970762 - RNA, 19 nt, Mycobacterium avium subsp. paratuberculosis
uggugaaaccguuggccug

SEQ ID NO: 2970763 - RNA, 22 nt, Mycobacterium avium subsp. paratuberculosis
uggugaacagguaggcggcgcc

SEQ ID NO: 2970764 - RNA, 16 nt, Mycobacterium avium subsp. paratuberculosis
uggugaaccacuucug

SEQ ID NO: 2970765 - RNA, 23 nt, Mycobacterium avium subsp. paratuberculosis
uggugaaccacuucuggcgcugc

SEQ ID NO: 2970766 - RNA, 15 nt, Mycobacterium avium subsp. paratuberculosis
uggugaagcccagcg

SEQ ID NO: 2970767 - RNA, 18 nt, Mycobacterium avium subsp. paratuberculosis
uggugaagccguagacgg

SEQ ID NO: 2970768 - RNA, 22 nt, Mycobacterium avium subsp. paratuberculosis
uggugaagccgugcacgccguc

SEQ ID NO: 2970769 - RNA, 15 nt, Mycobacterium avium subsp. paratuberculosis
uggugaaggcgaaca

SEQ ID NO: 2970770 - RNA, 20 nt, Mycobacterium avium subsp. paratuberculosis
uggugaaggugcccuccucg

SEQ ID NO: 2970771 - RNA, 14 nt, Mycobacterium avium subsp. paratuberculosis
uggugaaguugccg

SEQ ID NO: 2970772 - RNA, 12 nt, Mycobacterium avium subsp. paratuberculosis
uggugacccgga

SEQ ID NO: 2970773 - RNA, 21 nt, Mycobacterium avium subsp. paratuberculosis
uggugaccguacucgugggcc

SEQ ID NO: 2970774 - RNA, 17 nt, Mycobacterium avium subsp. paratuberculosis
uggugaccugcggaucg

SEQ ID NO: 2970775 - RNA, 20 nt, Mycobacterium avium subsp. paratuberculosis
uggugaccugcggaucgcgg

SEQ ID NO: 2970776 - RNA, 12 nt, Mycobacterium avium subsp. paratuberculosis
uggugacgccgc

SEQ ID NO: 2970777 - RNA, 16 nt, Mycobacterium avium subsp. paratuberculosis
uggugacggugccgcc

SEQ ID NO: 2970778 - RNA, 16 nt, Mycobacterium avium subsp. paratuberculosis
uggugagacccuggau

SEQ ID NO: 2970779 - RNA, 17 nt, Mycobacterium avium subsp. paratuberculosis
uggugagcaccgcgauc

SEQ ID NO: 2970780 - RNA, 15 nt, Mycobacterium avium subsp. paratuberculosis
uggugaucagcaucc

SEQ ID NO: 2970781 - RNA, 18 nt, Mycobacterium avium subsp. paratuberculosis
uggugauccucgucuccg

SEQ ID NO: 2970782 - RNA, 21 nt, Mycobacterium avium subsp. paratuberculosis
uggugauccucgucuccggcg

SEQ ID NO: 2970783 - RNA, 15 nt, Mycobacterium avium subsp. paratuberculosis
uggugaucgccgacg

SEQ ID NO: 2970784 - RNA, 21 nt, Mycobacterium avium subsp. paratuberculosis
uggugaucgccgcggacccca

SEQ ID NO: 2970785 - RNA, 14 nt, Mycobacterium avium subsp. paratuberculosis
uggugaucgcggcg

SEQ ID NO: 2970786 - RNA, 13 nt, Mycobacterium avium subsp. paratuberculosis
uggugaucggcca

SEQ ID NO: 2970787 - RNA, 15 nt, Mycobacterium avium subsp. paratuberculosis
uggugaucggccagg

SEQ ID NO: 2970788 - RNA, 16 nt, Mycobacterium avium subsp. paratuberculosis
uggugaucggccaggc

SEQ ID NO: 2970789 - RNA, 14 nt, Mycobacterium avium subsp. paratuberculosis
uggugaugaucccg

SEQ ID NO: 2970790 - RNA, 17 nt, Mycobacterium avium subsp. paratuberculosis
uggugauggacggggcg

SEQ ID NO: 2970791 - RNA, 20 nt, Mycobacterium avium subsp. paratuberculosis
uggugaugugcggcgcggcg

SEQ ID NO: 2970792 - RNA, 17 nt, Mycobacterium avium subsp. paratuberculosis
uggugauuguaggugug

SEQ ID NO: 2970793 - RNA, 15 nt, Mycobacterium avium subsp. paratuberculosis
uggugcaacaccgaa

SEQ ID NO: 2970794 - RNA, 17 nt, Mycobacterium avium subsp. paratuberculosis
uggugcaacaccgaaag

SEQ ID NO: 2970795 - RNA, 14 nt, Mycobacterium avium subsp. paratuberculosis
uggugcaccaggua

SEQ ID NO: 2970796 - RNA, 13 nt, Mycobacterium avium subsp. paratuberculosis
uggugcacccgau

SEQ ID NO: 2970797 - RNA, 13 nt, Mycobacterium avium subsp. paratuberculosis
uggugcaccgcca

SEQ ID NO: 2970798 - RNA, 20 nt, Mycobacterium avium subsp. paratuberculosis
uggugcaccgccagcgcggc

SEQ ID NO: 2970799 - RNA, 17 nt, Mycobacterium avium subsp. paratuberculosis
uggugcccccgcccggc

SEQ ID NO: 2970800 - RNA, 21 nt, Mycobacterium avium subsp. paratuberculosis
uggugcccucgugguggacgg

SEQ ID NO: 2970801 - RNA, 18 nt, Mycobacterium avium subsp. paratuberculosis
uggugccgaagcgccgca

SEQ ID NO: 2970802 - RNA, 14 nt, Mycobacterium avium subsp. paratuberculosis
uggugccgaucacc

SEQ ID NO: 2970803 - RNA, 22 nt, Mycobacterium avium subsp. paratuberculosis
uggugccgaucaccucgccggc

SEQ ID NO: 2970804 - RNA, 22 nt, Mycobacterium avium subsp. paratuberculosis
uggugccgccgaugacggcgcg

SEQ ID NO: 2970805 - RNA, 13 nt, Mycobacterium avium subsp. paratuberculosis
uggugccgccggc

SEQ ID NO: 2970806 - RNA, 14 nt, Mycobacterium avium subsp. paratuberculosis
uggugccgccggug

SEQ ID NO: 2970807 - RNA, 21 nt, Mycobacterium avium subsp. paratuberculosis
uggugccgccggugaacacga

SEQ ID NO: 2970808 - RNA, 21 nt, Mycobacterium avium subsp. paratuberculosis
uggugccgccgucgacgacga

SEQ ID NO: 2970809 - RNA, 18 nt, Mycobacterium avium subsp. paratuberculosis
uggugccgcugacggucg

SEQ ID NO: 2970810 - RNA, 15 nt, Mycobacterium avium subsp. paratuberculosis
uggugccggccucgu

SEQ ID NO: 2970811 - RNA, 20 nt, Mycobacterium avium subsp. paratuberculosis
ugucggggaccguccccguc

SEQ ID NO: 2970812 - RNA, 19 nt, Mycobacterium avium subsp. paratuberculosis
ugucggggucgcggcccgc

SEQ ID NO: 2970813 - RNA, 23 nt, Mycobacterium avium subsp. paratuberculosis
ugucggggucgcggcccgccuuc

SEQ ID NO: 2970814 - RNA, 15 nt, Mycobacterium avium subsp. paratuberculosis
ugucggggucggcgc

SEQ ID NO: 2970815 - RNA, 21 nt, Mycobacterium avium subsp. paratuberculosis
ugucggucaggcacucgauca

SEQ ID NO: 2970816 - RNA, 17 nt, Mycobacterium avium subsp. paratuberculosis
ugucggugaaugucgug

SEQ ID NO: 2970817 - RNA, 16 nt, Mycobacterium avium subsp. paratuberculosis
ugucggugcggccgca

SEQ ID NO: 2970818 - RNA, 16 nt, Mycobacterium avium subsp. paratuberculosis
ugucgguggcgcgcag

SEQ ID NO: 2970819 - RNA, 17 nt, Mycobacterium avium subsp. paratuberculosis
ugucguacgggcgcagc

SEQ ID NO: 2970820 - RNA, 19 nt, Mycobacterium avium subsp. paratuberculosis
ugucguagaacucgccgug

SEQ ID NO: 2970821 - RNA, 20 nt, Mycobacterium avium subsp. paratuberculosis
ugucguagcggcgccaccgg

SEQ ID NO: 2970822 - RNA, 14 nt, Mycobacterium avium subsp. paratuberculosis
ugucguagcggucg

SEQ ID NO: 2970823 - RNA, 16 nt, Mycobacterium avium subsp. paratuberculosis
ugucguaggcgcgguc

SEQ ID NO: 2970824 - RNA, 15 nt, Mycobacterium avium subsp. paratuberculosis
ugucguccagugacg

SEQ ID NO: 2970825 - RNA, 17 nt, Mycobacterium avium subsp. paratuberculosis
ugucguccagugacgcc

SEQ ID NO: 2970826 - RNA, 18 nt, Mycobacterium avium subsp. paratuberculosis
ugucgucgaccucgauca

SEQ ID NO: 2970827 - RNA, 20 nt, Mycobacterium avium subsp. paratuberculosis
ugucgucgccggccgcggug

SEQ ID NO: 2970828 - RNA, 13 nt, Mycobacterium avium subsp. paratuberculosis
ugucgucgcgcac

SEQ ID NO: 2970829 - RNA, 14 nt, Mycobacterium avium subsp. paratuberculosis
ugucgucgcugacg

SEQ ID NO: 2970830 - RNA, 19 nt, Mycobacterium avium subsp. paratuberculosis
ugucgucgggcaccacggc

SEQ ID NO: 2970831 - RNA, 14 nt, Mycobacterium avium subsp. paratuberculosis
ugucgucgggccgc

SEQ ID NO: 2970832 - RNA, 17 nt, Mycobacterium avium subsp. paratuberculosis
ugucgucgggcgcggug

SEQ ID NO: 2970833 - RNA, 22 nt, Mycobacterium avium subsp. paratuberculosis
ugucgucgucgccgccggugaa

SEQ ID NO: 2970834 - RNA, 16 nt, Mycobacterium avium subsp. paratuberculosis
ugucgugugcgugacg

SEQ ID NO: 2970835 - RNA, 15 nt, Mycobacterium avium subsp. paratuberculosis
ugucguuggugucga

SEQ ID NO: 2970836 - RNA, 16 nt, Mycobacterium avium subsp. paratuberculosis
ugucuagccgccgagc

SEQ ID NO: 2970837 - RNA, 16 nt, Mycobacterium avium subsp. paratuberculosis
ugucucacgccucguc

SEQ ID NO: 2970838 - RNA, 23 nt, Mycobacterium avium subsp. paratuberculosis
ugucucacgccucgucgagcagc

SEQ ID NO: 2970839 - RNA, 14 nt, Mycobacterium avium subsp. paratuberculosis
ugucuccgcgcagc

SEQ ID NO: 2970840 - RNA, 20 nt, Mycobacterium avium subsp. paratuberculosis
ugucuccgcgcagccaggug

SEQ ID NO: 2970841 - RNA, 18 nt, Mycobacterium avium subsp. paratuberculosis
ugucugaccucgcgccgc

SEQ ID NO: 2970842 - RNA, 16 nt, Mycobacterium avium subsp. paratuberculosis
ugucugaucgcguagc

SEQ ID NO: 2970843 - RNA, 13 nt, Mycobacterium avium subsp. paratuberculosis
ugucugcucgccu

SEQ ID NO: 2970844 - RNA, 23 nt, Mycobacterium avium subsp. paratuberculosis
ugugaccggggucggcgcccucg

SEQ ID NO: 2970845 - RNA, 17 nt, Mycobacterium avium subsp. paratuberculosis
ugugacggauccgggcg

SEQ ID NO: 2970846 - RNA, 14 nt, Mycobacterium avium subsp. paratuberculosis
ugugagcggugacc

SEQ ID NO: 2970847 - RNA, 18 nt, Mycobacterium avium subsp. paratuberculosis
ugugagcuuccugccaac

SEQ ID NO: 2970848 - RNA, 18 nt, Mycobacterium avium subsp. paratuberculosis
ugugaggcaccgaacgcc

SEQ ID NO: 2970849 - RNA, 21 nt, Mycobacterium avium subsp. paratuberculosis
ugugaggcaccgaacgccagc

SEQ ID NO: 2970850 - RNA, 18 nt, Mycobacterium avium subsp. paratuberculosis
ugugaucggcggccacca

SEQ ID NO: 2970851 - RNA, 22 nt, Mycobacterium avium subsp. paratuberculosis
ugugcaccagcgauccggcgcg

SEQ ID NO: 2970852 - RNA, 13 nt, Mycobacterium avium subsp. paratuberculosis
ugugcagccaccc

SEQ ID NO: 2970853 - RNA, 23 nt, Mycobacterium avium subsp. paratuberculosis
ugugccaccgccgauggcgacgg

SEQ ID NO: 2970854 - RNA, 16 nt, Mycobacterium avium subsp. paratuberculosis
ugugccacuucgacgg

SEQ ID NO: 2970855 - RNA, 21 nt, Mycobacterium avium subsp. paratuberculosis
ugugccacuucgacggcagcg

SEQ ID NO: 2970856 - RNA, 12 nt, Mycobacterium avium subsp. paratuberculosis
ugugccagcccg

SEQ ID NO: 2970857 - RNA, 22 nt, Mycobacterium avium subsp. paratuberculosis
ugugcccgacggcgcgcccgac

SEQ ID NO: 2970858 - RNA, 17 nt, Mycobacterium avium subsp. paratuberculosis
ugugcccgcgggccaga

SEQ ID NO: 2970859 - RNA, 19 nt, Mycobacterium avium subsp. paratuberculosis
ugugccggaagcggcggua

SEQ ID NO: 2970860 - RNA, 14 nt, Mycobacterium avium subsp. paratuberculosis
ugugccggcgcucg

SEQ ID NO: 2970861 - RNA, 18 nt, Mycobacterium avium subsp. paratuberculosis
ugugccggcgggucagca

SEQ ID NO: 2970862 - RNA, 15 nt, Mycobacterium avium subsp. paratuberculosis
ugugcgacggcgucg

SEQ ID NO: 2970863 - RNA, 19 nt, Mycobacterium avium subsp. paratuberculosis
ugugcgcaucggcgacgcc

SEQ ID NO: 2970864 - RNA, 12 nt, Mycobacterium avium subsp. paratuberculosis
ugugcgcgcugg

SEQ ID NO: 2970865 - RNA, 20 nt, Mycobacterium avium subsp. paratuberculosis
ugugcggcagcucggcggcc

SEQ ID NO: 2970866 - RNA, 15 nt, Mycobacterium avium subsp. paratuberculosis
ugugcgggucggugg

SEQ ID NO: 2970867 - RNA, 18 nt, Mycobacterium avium subsp. paratuberculosis
ugugcgggugaggccagg

SEQ ID NO: 2970868 - RNA, 19 nt, Mycobacterium avium subsp. paratuberculosis
ugugcgggugaggccaggc

SEQ ID NO: 2970869 - RNA, 20 nt, Mycobacterium avium subsp. paratuberculosis
ugugcgggugaggccaggcg

SEQ ID NO: 2970870 - RNA, 21 nt, Mycobacterium avium subsp. paratuberculosis
ugugcgguucacgcggcuggc

SEQ ID NO: 2970871 - RNA, 13 nt, Mycobacterium avium subsp. paratuberculosis
ugugcucgacgaa

SEQ ID NO: 2970872 - RNA, 19 nt, Mycobacterium avium subsp. paratuberculosis
ugugcucgagcucggcgag

SEQ ID NO: 2970873 - RNA, 12 nt, Mycobacterium avium subsp. paratuberculosis
ugugcucggcgg

SEQ ID NO: 2970874 - RNA, 13 nt, Mycobacterium avium subsp. paratuberculosis
ugugcucgucgau

SEQ ID NO: 2970875 - RNA, 12 nt, Mycobacterium avium subsp. paratuberculosis
ugugcugaccca

SEQ ID NO: 2970876 - RNA, 14 nt, Mycobacterium avium subsp. paratuberculosis
ugugcuggccagca

SEQ ID NO: 2970877 - RNA, 20 nt, Mycobacterium avium subsp. paratuberculosis
ugugcuggccagcaccagcg

SEQ ID NO: 2970878 - RNA, 21 nt, Mycobacterium avium subsp. paratuberculosis
uguggaccgcgcagucggcgu

SEQ ID NO: 2970879 - RNA, 22 nt, Mycobacterium avium subsp. paratuberculosis
uguggacgaugcggggccggcg

SEQ ID NO: 2970880 - RNA, 21 nt, Mycobacterium avium subsp. paratuberculosis
uguggagauagugauaucccc

SEQ ID NO: 2970881 - RNA, 20 nt, Mycobacterium avium subsp. paratuberculosis
uguggaucgcuucggccagc

SEQ ID NO: 2970882 - RNA, 21 nt, Mycobacterium avium subsp. paratuberculosis
uguggaucgcuucggccagcg

SEQ ID NO: 2970883 - RNA, 18 nt, Mycobacterium avium subsp. paratuberculosis
uguggaucuccagcagcu

SEQ ID NO: 2970884 - RNA, 15 nt, Mycobacterium avium subsp. paratuberculosis
uguggaugacgcagc

SEQ ID NO: 2970885 - RNA, 20 nt, Mycobacterium avium subsp. paratuberculosis
uguggcccaggccggcggug

SEQ ID NO: 2970886 - RNA, 20 nt, Mycobacterium avium subsp. paratuberculosis
uguggccgcccucgcugccg

SEQ ID NO: 2970887 - RNA, 16 nt, Mycobacterium avium subsp. paratuberculosis
uguggccgcggcggcc

SEQ ID NO: 2970888 - RNA, 19 nt, Mycobacterium avium subsp. paratuberculosis
uguggcgccgugcaggaug

SEQ ID NO: 2970889 - RNA, 23 nt, Mycobacterium avium subsp. paratuberculosis
uguggcguucgaugcccugcccc

SEQ ID NO: 2970890 - RNA, 14 nt, Mycobacterium avium subsp. paratuberculosis
ugugggcgccguca

SEQ ID NO: 2970891 - RNA, 13 nt, Mycobacterium avium subsp. paratuberculosis
ugugggcgggcgc

SEQ ID NO: 2970892 - RNA, 21 nt, Mycobacterium avium subsp. paratuberculosis
uguggggcccacugccugacc

SEQ ID NO: 2970893 - RNA, 22 nt, Mycobacterium avium subsp. paratuberculosis
uguggggcccacugccugaccc

SEQ ID NO: 2970894 - RNA, 16 nt, Mycobacterium avium subsp. paratuberculosis
ugugggugguccaggc

SEQ ID NO: 2970895 - RNA, 22 nt, Mycobacterium avium subsp. paratuberculosis
uuccaacggaagcgguugagcc

SEQ ID NO: 2970896 - RNA, 18 nt, Mycobacterium avium subsp. paratuberculosis
uuccacagcugcaggcug

SEQ ID NO: 2970897 - RNA, 23 nt, Mycobacterium avium subsp. paratuberculosis
uuccacagcugcaggcuggucug

SEQ ID NO: 2970898 - RNA, 14 nt, Mycobacterium avium subsp. paratuberculosis
uuccacaucagguu

SEQ ID NO: 2970899 - RNA, 22 nt, Mycobacterium avium subsp. paratuberculosis
uuccaccagcggccgucgccgg

SEQ ID NO: 2970900 - RNA, 16 nt, Mycobacterium avium subsp. paratuberculosis
uuccaccccggcgguc

SEQ ID NO: 2970901 - RNA, 18 nt, Mycobacterium avium subsp. paratuberculosis
uuccaccccggcggucgg

SEQ ID NO: 2970902 - RNA, 22 nt, Mycobacterium avium subsp. paratuberculosis
uuccaccgggccgccaucaccg

SEQ ID NO: 2970903 - RNA, 15 nt, Mycobacterium avium subsp. paratuberculosis
uuccaccguggucgg

SEQ ID NO: 2970904 - RNA, 23 nt, Mycobacterium avium subsp. paratuberculosis
uuccaccguggucggcagcaccg

SEQ ID NO: 2970905 - RNA, 22 nt, Mycobacterium avium subsp. paratuberculosis
uuccaccugcgguucgucgcgg

SEQ ID NO: 2970906 - RNA, 14 nt, Mycobacterium avium subsp. paratuberculosis
uuccacgccgguga

SEQ ID NO: 2970907 - RNA, 17 nt, Mycobacterium avium subsp. paratuberculosis
uuccagaaccggcagga

SEQ ID NO: 2970908 - RNA, 15 nt, Mycobacterium avium subsp. paratuberculosis
uuccagaccggcggc

SEQ ID NO: 2970909 - RNA, 16 nt, Mycobacterium avium subsp. paratuberculosis
uuccagcacccggccc

SEQ ID NO: 2970910 - RNA, 23 nt, Mycobacterium avium subsp. paratuberculosis
uuccagcaccggcuggucggcgg

SEQ ID NO: 2970911 - RNA, 19 nt, Mycobacterium avium subsp. paratuberculosis
uuccagcccguugucgagc

SEQ ID NO: 2970912 - RNA, 13 nt, Mycobacterium avium subsp. paratuberculosis
uuccagccggccc

SEQ ID NO: 2970913 - RNA, 20 nt, Mycobacterium avium subsp. paratuberculosis
uuccagcgccggcaccagca

SEQ ID NO: 2970914 - RNA, 21 nt, Mycobacterium avium subsp. paratuberculosis
uuccagcgccggcaccagcag

SEQ ID NO: 2970915 - RNA, 23 nt, Mycobacterium avium subsp. paratuberculosis
uuccagcgccggcaccagcagcc

SEQ ID NO: 2970916 - RNA, 12 nt, Mycobacterium avium subsp. paratuberculosis
uuccagcggcac

SEQ ID NO: 2970917 - RNA, 19 nt, Mycobacterium avium subsp. paratuberculosis
uuccagguguaggcguggc

SEQ ID NO: 2970918 - RNA, 22 nt, Mycobacterium avium subsp. paratuberculosis
uuccagguguaggcguggcagg

SEQ ID NO: 2970919 - RNA, 16 nt, Mycobacterium avium subsp. paratuberculosis
uuccagguucagcccg

SEQ ID NO: 2970920 - RNA, 22 nt, Mycobacterium avium subsp. paratuberculosis
uuccaguggcugucgggugccg

SEQ ID NO: 2970921 - RNA, 13 nt, Mycobacterium avium subsp. paratuberculosis
uuccaucacgccc

SEQ ID NO: 2970922 - RNA, 22 nt, Mycobacterium avium subsp. paratuberculosis
uuccaucacgccccggcgucgg

SEQ ID NO: 2970923 - RNA, 20 nt, Mycobacterium avium subsp. paratuberculosis
uuccaugucgucgagcucga

SEQ ID NO: 2970924 - RNA, 18 nt, Mycobacterium avium subsp. paratuberculosis
uucccacacgcucggcga

SEQ ID NO: 2970925 - RNA, 16 nt, Mycobacterium avium subsp. paratuberculosis
uucccacagucgcugg

SEQ ID NO: 2970926 - RNA, 18 nt, Mycobacterium avium subsp. paratuberculosis
uucccaguccggccagcg

SEQ ID NO: 2970927 - RNA, 12 nt, Mycobacterium avium subsp. paratuberculosis
uuccccggccga

SEQ ID NO: 2970928 - RNA, 22 nt, Mycobacterium avium subsp. paratuberculosis
uuccccguugucguucuccccg

SEQ ID NO: 2970929 - RNA, 21 nt, Mycobacterium avium subsp. paratuberculosis
uucccgaccccgccagcaccg

SEQ ID NO: 2970930 - RNA, 18 nt, Mycobacterium avium subsp. paratuberculosis
uucccgaguggcgccguc

SEQ ID NO: 2970931 - RNA, 20 nt, Mycobacterium avium subsp. paratuberculosis
uucccgaguggcgccgucgg

SEQ ID NO: 2970932 - RNA, 14 nt, Mycobacterium avium subsp. paratuberculosis
uucccgccgccgcg

SEQ ID NO: 2970933 - RNA, 16 nt, Mycobacterium avium subsp. paratuberculosis
uucccgccgccgucgg

SEQ ID NO: 2970934 - RNA, 16 nt, Mycobacterium avium subsp. paratuberculosis
uucccgcuuggcgguc

SEQ ID NO: 2970935 - RNA, 23 nt, Mycobacterium avium subsp. paratuberculosis
uucccggaugcugcgggucagca

SEQ ID NO: 2970936 - RNA, 15 nt, Mycobacterium avium subsp. paratuberculosis
uucccggcaccacca

SEQ ID NO: 2970937 - RNA, 15 nt, Mycobacterium avium subsp. paratuberculosis
uucccggccgccggg

SEQ ID NO: 2970938 - RNA, 12 nt, Mycobacterium avium subsp. paratuberculosis
uucccggcgggc

SEQ ID NO: 2970939 - RNA, 23 nt, Mycobacterium avium subsp. paratuberculosis
uucccgggcccgcugcagcgccg

SEQ ID NO: 2970940 - RNA, 19 nt, Mycobacterium avium subsp. paratuberculosis
uucccgggcgaucagcccg

SEQ ID NO: 2970941 - RNA, 14 nt, Mycobacterium avium subsp. paratuberculosis
uucccugcgcggcg

SEQ ID NO: 2970942 - RNA, 18 nt, Mycobacterium avium subsp. paratuberculosis
uuccgcccggcgagcaca

SEQ ID NO: 2970943 - RNA, 15 nt, Mycobacterium avium subsp. paratuberculosis
uuccgccgcgcccgu

SEQ ID NO: 2970944 - RNA, 16 nt, Mycobacterium avium subsp. paratuberculosis
uuccgccgcgcccguc

SEQ ID NO: 2970945 - RNA, 14 nt, Mycobacterium avium subsp. paratuberculosis
uuccgccucggcga

SEQ ID NO: 2970946 - RNA, 15 nt, Mycobacterium avium subsp. paratuberculosis
uuccgcgcggcgggc

SEQ ID NO: 2970947 - RNA, 19 nt, Mycobacterium avium subsp. paratuberculosis
uuccgcgcgucgggggugc

SEQ ID NO: 2970948 - RNA, 19 nt, Mycobacterium avium subsp. paratuberculosis
uuccggaucaaccacacca

SEQ ID NO: 2970949 - RNA, 13 nt, Mycobacterium avium subsp. paratuberculosis
uuccggaugccgg

SEQ ID NO: 2970950 - RNA, 13 nt, Mycobacterium avium subsp. paratuberculosis
uuccggcacccgc

SEQ ID NO: 2970951 - RNA, 17 nt, Mycobacterium avium subsp. paratuberculosis
uuccggccggccgccgg

SEQ ID NO: 2970952 - RNA, 17 nt, Mycobacterium avium subsp. paratuberculosis
uuccgggcgaccccggc

SEQ ID NO: 2970953 - RNA, 22 nt, Mycobacterium avium subsp. paratuberculosis
uuccgggcgaccccggccagga

SEQ ID NO: 2970954 - RNA, 21 nt, Mycobacterium avium subsp. paratuberculosis
uuccggggaaccgcccuucca

SEQ ID NO: 2970955 - RNA, 16 nt, Mycobacterium avium subsp. paratuberculosis
uuccggugucgagccg

SEQ ID NO: 2970956 - RNA, 17 nt, Mycobacterium avium subsp. paratuberculosis
uuccggugucgagccgg

SEQ ID NO: 2970957 - RNA, 20 nt, Mycobacterium avium subsp. paratuberculosis
uuccggugucgagccggugc

SEQ ID NO: 2970958 - RNA, 16 nt, Mycobacterium avium subsp. paratuberculosis
uuccgguuccucggcg

SEQ ID NO: 2970959 - RNA, 16 nt, Mycobacterium avium subsp. paratuberculosis
uuccgguuggccaggu

SEQ ID NO: 2970960 - RNA, 18 nt, Mycobacterium avium subsp. paratuberculosis
uuccgucgguggcggugg

SEQ ID NO: 2970961 - RNA, 13 nt, Mycobacterium avium subsp. paratuberculosis
uuccucagcgccc

SEQ ID NO: 2970962 - RNA, 22 nt, Mycobacterium avium subsp. paratuberculosis
uuccuccacgacuucacaggcc

SEQ ID NO: 2970963 - RNA, 13 nt, Mycobacterium avium subsp. paratuberculosis
uuccuccucggcg

SEQ ID NO: 2970964 - RNA, 12 nt, Mycobacterium avium subsp. paratuberculosis
uuccuccucuuc

SEQ ID NO: 2970965 - RNA, 11 nt, Mycobacterium avium subsp. paratuberculosis
uuccucgacgu

SEQ ID NO: 2970966 - RNA, 19 nt, Mycobacterium avium subsp. paratuberculosis
uuccucgacguaggccaga

SEQ ID NO: 2970967 - RNA, 16 nt, Mycobacterium avium subsp. paratuberculosis
uuccugcgaccgccgc

SEQ ID NO: 2970968 - RNA, 19 nt, Mycobacterium avium subsp. paratuberculosis
uuccugcgaccgccgccgc

SEQ ID NO: 2970969 - RNA, 14 nt, Mycobacterium avium subsp. paratuberculosis
uuccuggccgauga

SEQ ID NO: 2970970 - RNA, 16 nt, Mycobacterium avium subsp. paratuberculosis
uuccugguagucgucg

SEQ ID NO: 2970971 - RNA, 17 nt, Mycobacterium avium subsp. paratuberculosis
uuccuugauccggccgc

SEQ ID NO: 2970972 - RNA, 24 nt, Mycobacterium avium subsp. paratuberculosis
uucgaagaacacgcaggugcgccg

SEQ ID NO: 2970973 - RNA, 19 nt, Mycobacterium avium subsp. paratuberculosis
uucgaagcugucgccgagg

SEQ ID NO: 2970974 - RNA, 20 nt, Mycobacterium avium subsp. paratuberculosis
uucgacccgcauccgccggg

SEQ ID NO: 2970975 - RNA, 13 nt, Mycobacterium avium subsp. paratuberculosis
uucgaccggcguc

SEQ ID NO: 2970976 - RNA, 20 nt, Mycobacterium avium subsp. paratuberculosis
uucgacgaugccguagagcc

SEQ ID NO: 2970977 - RNA, 13 nt, Mycobacterium avium subsp. paratuberculosis
uucgacgccucgg

SEQ ID NO: 2970978 - RNA, 16 nt, Mycobacterium avium subsp. paratuberculosis
uucgacugcaggaaca

SEQ ID NO: 2970979 - RNA, 17 nt, Mycobacterium avium subsp. paratuberculosis
uucgagacacgcgccgg

SEQ ID NO: 2970980 - RNA, 19 nt, Mycobacterium avium subsp. paratuberculosis
uucgggccagcgccgagcc

SEQ ID NO: 2970981 - RNA, 13 nt, Mycobacterium avium subsp. paratuberculosis
uucgggccugacc

SEQ ID NO: 2970982 - RNA, 22 nt, Mycobacterium avium subsp. paratuberculosis
uucgggccugaccaaggacaag

SEQ ID NO: 2970983 - RNA, 20 nt, Mycobacterium avium subsp. paratuberculosis
uucgggcgcgcgcgccacga

SEQ ID NO: 2970984 - RNA, 11 nt, Mycobacterium avium subsp. paratuberculosis
uucgggcggcc

SEQ ID NO: 2970985 - RNA, 20 nt, Mycobacterium avium subsp. paratuberculosis
uucggggauguagccgccgg

SEQ ID NO: 2970986 - RNA, 22 nt, Mycobacterium avium subsp. paratuberculosis
uucggggccaccaggccgaaga

SEQ ID NO: 2970987 - RNA, 23 nt, Mycobacterium avium subsp. paratuberculosis
uucggggcguguggggaauccgg

SEQ ID NO: 2970988 - RNA, 22 nt, Mycobacterium avium subsp. paratuberculosis
uucggggguaaaccgccagcag

SEQ ID NO: 2970989 - RNA, 14 nt, Mycobacterium avium subsp. paratuberculosis
uucggggguggcca

SEQ ID NO: 2970990 - RNA, 20 nt, Mycobacterium avium subsp. paratuberculosis
uucggggugacuucgagccg

SEQ ID NO: 2970991 - RNA, 21 nt, Mycobacterium avium subsp. paratuberculosis
uucggggugacuucgagccgg

SEQ ID NO: 2970992 - RNA, 17 nt, Mycobacterium avium subsp. paratuberculosis
uucggggugguggaagg

SEQ ID NO: 2970993 - RNA, 19 nt, Mycobacterium avium subsp. paratuberculosis
uucgggucagaccgcggcg

SEQ ID NO: 2970994 - RNA, 14 nt, Mycobacterium avium subsp. paratuberculosis
uucgggucgacgag

SEQ ID NO: 2970995 - RNA, 13 nt, Mycobacterium avium subsp. paratuberculosis
uucgggucgccgg

SEQ ID NO: 2970996 - RNA, 14 nt, Mycobacterium avium subsp. paratuberculosis
uucggguggcgucg

SEQ ID NO: 2970997 - RNA, 11 nt, Mycobacterium avium subsp. paratuberculosis
uucgggugugg

SEQ ID NO: 2970998 - RNA, 15 nt, Mycobacterium avium subsp. paratuberculosis
uucggguuacgugga

SEQ ID NO: 2970999 - RNA, 23 nt, Mycobacterium avium subsp. paratuberculosis
uucggugcccgggguccaccggc

SEQ ID NO: 2971000 - RNA, 15 nt, Mycobacterium avium subsp. paratuberculosis
uucgguggccccggg

SEQ ID NO: 2971001 - RNA, 23 nt, Mycobacterium avium subsp. paratuberculosis
uucggugucccaguucccggcgg

SEQ ID NO: 2971002 - RNA, 21 nt, Mycobacterium avium subsp. paratuberculosis
uucguaccuagggcccacgcu

SEQ ID NO: 2971003 - RNA, 18 nt, Mycobacterium avium subsp. paratuberculosis
uucguagggacugcgccg

SEQ ID NO: 2971004 - RNA, 12 nt, Mycobacterium avium subsp. paratuberculosis
uucgucagcagc

SEQ ID NO: 2971005 - RNA, 23 nt, Mycobacterium avium subsp. paratuberculosis
uucgucggccgucggcgccgccg

SEQ ID NO: 2971006 - RNA, 20 nt, Mycobacterium avium subsp. paratuberculosis
uucgucggcggucuuggcgg

SEQ ID NO: 2971007 - RNA, 13 nt, Mycobacterium avium subsp. paratuberculosis
uucgucggcggug

SEQ ID NO: 2971008 - RNA, 14 nt, Mycobacterium avium subsp. paratuberculosis
uucgucggcggugg

SEQ ID NO: 2971009 - RNA, 14 nt, Mycobacterium avium subsp. paratuberculosis
uucgucggguucga

SEQ ID NO: 2971010 - RNA, 22 nt, Mycobacterium avium subsp. paratuberculosis
uucgucggucacggacagccgg

SEQ ID NO: 2971011 - RNA, 16 nt, Mycobacterium avium subsp. paratuberculosis
uucgucgucgcgcagg

SEQ ID NO: 2971012 - RNA, 22 nt, Mycobacterium avium subsp. paratuberculosis
uucgugagcgguggccacgccc

SEQ ID NO: 2971013 - RNA, 17 nt, Mycobacterium avium subsp. paratuberculosis
uucguguggcgcacgcu

SEQ ID NO: 2971014 - RNA, 20 nt, Mycobacterium avium subsp. paratuberculosis
uucgugugguacagcgccag

SEQ ID NO: 2971015 - RNA, 14 nt, Mycobacterium avium subsp. paratuberculosis
uucguugucgagcg

SEQ ID NO: 2971016 - RNA, 17 nt, Mycobacterium avium subsp. paratuberculosis
uucguuguuggcggugg

SEQ ID NO: 2971017 - RNA, 17 nt, Mycobacterium avium subsp. paratuberculosis
uucuacggcgggccggc

SEQ ID NO: 2971018 - RNA, 22 nt, Mycobacterium avium subsp. paratuberculosis
uucuacggcgggccggcgccgg

SEQ ID NO: 2971019 - RNA, 21 nt, Mycobacterium avium subsp. paratuberculosis
uucucagcagcgggccgaaga

SEQ ID NO: 2971020 - RNA, 17 nt, Mycobacterium avium subsp. paratuberculosis
uucuccaccgcgcgcgg

SEQ ID NO: 2971021 - RNA, 11 nt, Mycobacterium avium subsp. paratuberculosis
uucuccagcac

SEQ ID NO: 2971022 - RNA, 14 nt, Mycobacterium avium subsp. paratuberculosis
uucuccagcccucg

SEQ ID NO: 2971023 - RNA, 15 nt, Mycobacterium avium subsp. paratuberculosis
uucuccagcggccgc

SEQ ID NO: 2971024 - RNA, 15 nt, Mycobacterium avium subsp. paratuberculosis
uucuccagcuccucg

SEQ ID NO: 2971025 - RNA, 19 nt, Mycobacterium avium subsp. paratuberculosis
uucuccagcuccucgguca

SEQ ID NO: 2971026 - RNA, 21 nt, Mycobacterium avium subsp. paratuberculosis
uucuccauggugaacugguug

SEQ ID NO: 2971027 - RNA, 15 nt, Mycobacterium avium subsp. paratuberculosis
uucuccccgccucgg

SEQ ID NO: 2971028 - RNA, 20 nt, Mycobacterium avium subsp. paratuberculosis
uucuccgaggcguccuccuc

SEQ ID NO: 2971029 - RNA, 13 nt, Mycobacterium avium subsp. paratuberculosis
uucuccgcggccg

SEQ ID NO: 2971030 - RNA, 14 nt, Mycobacterium avium subsp. paratuberculosis
uucuccgcggccgc

SEQ ID NO: 2971031 - RNA, 19 nt, Mycobacterium avium subsp. paratuberculosis
uucuccggcccgcucggcg

SEQ ID NO: 2971032 - RNA, 18 nt, Mycobacterium avium subsp. paratuberculosis
uucuccucccagcccucg

SEQ ID NO: 2971033 - RNA, 15 nt, Mycobacterium avium subsp. paratuberculosis
uucuccucgucgcgg

SEQ ID NO: 2971034 - RNA, 22 nt, Mycobacterium avium subsp. paratuberculosis
uucuccucgucgcgggcgaagg

SEQ ID NO: 2971035 - RNA, 18 nt, Mycobacterium avium subsp. paratuberculosis
uucucgaacgggucgagg

SEQ ID NO: 2971036 - RNA, 14 nt, Mycobacterium avium subsp. paratuberculosis
uucucgaagcgcag

SEQ ID NO: 2971037 - RNA, 17 nt, Mycobacterium avium subsp. paratuberculosis
uucucgaagcgcagcag

SEQ ID NO: 2971038 - RNA, 22 nt, Mycobacterium avium subsp. paratuberculosis
uucucgaagcgcagcagcucgu

SEQ ID NO: 2971039 - RNA, 14 nt, Mycobacterium avium subsp. paratuberculosis
uucucgaccaagaa

SEQ ID NO: 2971040 - RNA, 17 nt, Mycobacterium avium subsp. paratuberculosis
uucucgcacagcaccag

SEQ ID NO: 2971041 - RNA, 14 nt, Mycobacterium avium subsp. paratuberculosis
uucucgccaauaaa

SEQ ID NO: 2971042 - RNA, 16 nt, Mycobacterium avium subsp. paratuberculosis
uucucgccgugcagca

SEQ ID NO: 2971043 - RNA, 20 nt, Mycobacterium avium subsp. paratuberculosis
uucucgcucugccgggccgc

SEQ ID NO: 2971044 - RNA, 18 nt, Mycobacterium avium subsp. paratuberculosis
uucucgggggcgggcacc

SEQ ID NO: 2971045 - RNA, 18 nt, Mycobacterium avium subsp. paratuberculosis
uucucggugucgucgacc

SEQ ID NO: 2971046 - RNA, 16 nt, Mycobacterium avium subsp. paratuberculosis
uucugcccggccagca

SEQ ID NO: 2971047 - RNA, 13 nt, Mycobacterium avium subsp. paratuberculosis
uucugccggccgc

SEQ ID NO: 2971048 - RNA, 12 nt, Mycobacterium avium subsp. paratuberculosis
uucugcgcccga

SEQ ID NO: 2971049 - RNA, 21 nt, Mycobacterium avium subsp. paratuberculosis
uucugcgccuuuugcacccgc

SEQ ID NO: 2971050 - RNA, 19 nt, Mycobacterium avium subsp. paratuberculosis
uucuggcccgccaucgccc

SEQ ID NO: 2971051 - RNA, 14 nt, Mycobacterium avium subsp. paratuberculosis
uucuucagccgcag

SEQ ID NO: 2971052 - RNA, 12 nt, Mycobacterium avium subsp. paratuberculosis
uucuucgccgca

SEQ ID NO: 2971053 - RNA, 20 nt, Mycobacterium avium subsp. paratuberculosis
uucuucgccgcaaccuucuu

SEQ ID NO: 2971054 - RNA, 21 nt, Mycobacterium avium subsp. paratuberculosis
uucuucgccgcaaccuucuug

SEQ ID NO: 2971055 - RNA, 18 nt, Mycobacterium avium subsp. paratuberculosis
uucuucgcgggugccuuc

SEQ ID NO: 2971056 - RNA, 20 nt, Mycobacterium avium subsp. paratuberculosis
uucuucgcgggugccuucuu

SEQ ID NO: 2971057 - RNA, 16 nt, Mycobacterium avium subsp. paratuberculosis
uucuucucacagguga

SEQ ID NO: 2971058 - RNA, 14 nt, Mycobacterium avium subsp. paratuberculosis
uucuugaccaccuu

SEQ ID NO: 2971059 - RNA, 21 nt, Mycobacterium avium subsp. paratuberculosis
uucuugaccgcagccuucuuc

SEQ ID NO: 2971060 - RNA, 13 nt, Mycobacterium avium subsp. paratuberculosis
uucuugacgccga

SEQ ID NO: 2971061 - RNA, 16 nt, Mycobacterium avium subsp. paratuberculosis
uucuuggccgcgccgc

SEQ ID NO: 2971062 - RNA, 14 nt, Mycobacterium avium subsp. paratuberculosis
uucuuggccgcggc

SEQ ID NO: 2971063 - RNA, 19 nt, Mycobacterium avium subsp. paratuberculosis
uucuuggccggagccuucu

SEQ ID NO: 2971064 - RNA, 21 nt, Mycobacterium avium subsp. paratuberculosis
uucuuggccggagccuucuuc

SEQ ID NO: 2971065 - RNA, 16 nt, Mycobacterium avium subsp. paratuberculosis
uugccgacggcgccgg

SEQ ID NO: 2971066 - RNA, 17 nt, Mycobacterium avium subsp. paratuberculosis
uugccgagcaccccguc

SEQ ID NO: 2971067 - RNA, 15 nt, Mycobacterium avium subsp. paratuberculosis
uugccgaucgccgcg

SEQ ID NO: 2971068 - RNA, 21 nt, Mycobacterium avium subsp. paratuberculosis
uugccgauggcgguccaccac

SEQ ID NO: 2971069 - RNA, 16 nt, Mycobacterium avium subsp. paratuberculosis
uugccgcccucggccg

SEQ ID NO: 2971070 - RNA, 10 nt, Mycobacterium avium subsp. paratuberculosis
uugccgccgc

SEQ ID NO: 2971071 - RNA, 12 nt, Mycobacterium avium subsp. paratuberculosis
uugccgccgcgc

SEQ ID NO: 2971072 - RNA, 15 nt, Mycobacterium avium subsp. paratuberculosis
uugccgccggcgcgg

SEQ ID NO: 2971073 - RNA, 19 nt, Mycobacterium avium subsp. paratuberculosis
uugccgcgacccgggccgc

SEQ ID NO: 2971074 - RNA, 19 nt, Mycobacterium avium subsp. paratuberculosis
uugccgcuggucaggccga

SEQ ID NO: 2971075 - RNA, 12 nt, Mycobacterium avium subsp. paratuberculosis
uugccggauugc

SEQ ID NO: 2971076 - RNA, 19 nt, Mycobacterium avium subsp. paratuberculosis
uugccggauugcgagccgg

SEQ ID NO: 2971077 - RNA, 22 nt, Mycobacterium avium subsp. paratuberculosis
uugccggcccgcagcgccucgg

SEQ ID NO: 2971078 - RNA, 12 nt, Mycobacterium avium subsp. paratuberculosis
uugccggcggcc

SEQ ID NO: 2971079 - RNA, 22 nt, Mycobacterium avium subsp. paratuberculosis
uugccggcggcgggcucggagu

SEQ ID NO: 2971080 - RNA, 16 nt, Mycobacterium avium subsp. paratuberculosis
uugccgguguauccca

SEQ ID NO: 2971081 - RNA, 22 nt, Mycobacterium avium subsp. paratuberculosis
uugccgucgagggggagcagga

SEQ ID NO: 2971082 - RNA, 16 nt, Mycobacterium avium subsp. paratuberculosis
uugccgugcucggcgg

SEQ ID NO: 2971083 - RNA, 19 nt, Mycobacterium avium subsp. paratuberculosis
uugccguuguccuugagcc

SEQ ID NO: 2971084 - RNA, 18 nt, Mycobacterium avium subsp. paratuberculosis
uugccuuuccgcgcggcg

SEQ ID NO: 2971085 - RNA, 21 nt, Mycobacterium avium subsp. paratuberculosis
uugccuuuccgcgcggcgggc

SEQ ID NO: 2971086 - RNA, 21 nt, Mycobacterium avium subsp. paratuberculosis
uugcgaccccgccgucgacgc

SEQ ID NO: 2971087 - RNA, 11 nt, Mycobacterium avium subsp. paratuberculosis
uugcgaccgcc

SEQ ID NO: 2971088 - RNA, 19 nt, Mycobacterium avium subsp. paratuberculosis
uugcgagcaggccgaggcc

SEQ ID NO: 2971089 - RNA, 13 nt, Mycobacterium avium subsp. paratuberculosis
uugcgcagcagcc

SEQ ID NO: 2971090 - RNA, 15 nt, Mycobacterium avium subsp. paratuberculosis
uugcgcagcagccag

SEQ ID NO: 2971091 - RNA, 14 nt, Mycobacterium avium subsp. paratuberculosis
uugcgcagccgggc

SEQ ID NO: 2971092 - RNA, 19 nt, Mycobacterium avium subsp. paratuberculosis
uugcgcaucagcgccacca

SEQ ID NO: 2971093 - RNA, 15 nt, Mycobacterium avium subsp. paratuberculosis
uugcgccagcagcaa

SEQ ID NO: 2971094 - RNA, 22 nt, Mycobacterium avium subsp. paratuberculosis
uugcgccagcagcaacgcggug

SEQ ID NO: 2971095 - RNA, 21 nt, Mycobacterium avium subsp. paratuberculosis
uugcgcccggccaucugcgcg

SEQ ID NO: 2971096 - RNA, 11 nt, Mycobacterium avium subsp. paratuberculosis
uugcgcccgua

SEQ ID NO: 2971097 - RNA, 16 nt, Mycobacterium avium subsp. paratuberculosis
uugcgccgcaacggcg

SEQ ID NO: 2971098 - RNA, 21 nt, Mycobacterium avium subsp. paratuberculosis
uugcgccgccagggcgcggcg

SEQ ID NO: 2971099 - RNA, 15 nt, Mycobacterium avium subsp. paratuberculosis
uugcgcgacgccguc

SEQ ID NO: 2971100 - RNA, 13 nt, Mycobacterium avium subsp. paratuberculosis
uugcgcgccgcga

SEQ ID NO: 2971101 - RNA, 14 nt, Mycobacterium avium subsp. paratuberculosis
uugcgcggcgccgg

SEQ ID NO: 2971102 - RNA, 17 nt, Mycobacterium avium subsp. paratuberculosis
uugcgcgggucgccggg

SEQ ID NO: 2971103 - RNA, 11 nt, Mycobacterium avium subsp. paratuberculosis
uugcgcugccc

SEQ ID NO: 2971104 - RNA, 17 nt, Mycobacterium avium subsp. paratuberculosis
uugcggaucggugcagg

SEQ ID NO: 2971105 - RNA, 14 nt, Mycobacterium avium subsp. paratuberculosis
uugcggccccgcca

SEQ ID NO: 2971106 - RNA, 22 nt, Mycobacterium avium subsp. paratuberculosis
uugcggcgcagccagcucggcg

SEQ ID NO: 2971107 - RNA, 11 nt, Mycobacterium avium subsp. paratuberculosis
uugcggcggcc

SEQ ID NO: 2971108 - RNA, 11 nt, Mycobacterium avium subsp. paratuberculosis
uugcggcgggc

SEQ ID NO: 2971109 - RNA, 16 nt, Mycobacterium avium subsp. paratuberculosis
uugcggcgggccgcaa

SEQ ID NO: 2971110 - RNA, 13 nt, Mycobacterium avium subsp. paratuberculosis
uugcggcucaacg

SEQ ID NO: 2971111 - RNA, 14 nt, Mycobacterium avium subsp. paratuberculosis
uugcgggccagguc

SEQ ID NO: 2971112 - RNA, 20 nt, Mycobacterium avium subsp. paratuberculosis
uugcgggccgaacugccgau

SEQ ID NO: 2971113 - RNA, 19 nt, Mycobacterium avium subsp. paratuberculosis
uugcgggccggagccuucu

SEQ ID NO: 2971114 - RNA, 20 nt, Mycobacterium avium subsp. paratuberculosis
uugcgggccggagccuucuu

SEQ ID NO: 2971115 - RNA, 17 nt, Mycobacterium avium subsp. paratuberculosis
uugcgggcggcgcggcg

SEQ ID NO: 2971116 - RNA, 14 nt, Mycobacterium avium subsp. paratuberculosis
uugcgggucggugg

SEQ ID NO: 2971117 - RNA, 18 nt, Mycobacterium avium subsp. paratuberculosis
uugcgucugcucgccguc

SEQ ID NO: 2971118 - RNA, 16 nt, Mycobacterium avium subsp. paratuberculosis
uugcgucugcucggcg

SEQ ID NO: 2971119 - RNA, 11 nt, Mycobacterium avium subsp. paratuberculosis
uugcgugcagc

SEQ ID NO: 2971120 - RNA, 14 nt, Mycobacterium avium subsp. paratuberculosis
uugcguucccagcc

SEQ ID NO: 2971121 - RNA, 16 nt, Mycobacterium avium subsp. paratuberculosis
uugcguuccucgacgg

SEQ ID NO: 2971122 - RNA, 15 nt, Mycobacterium avium subsp. paratuberculosis
uugcguugcgcggcg

SEQ ID NO: 2971123 - RNA, 14 nt, Mycobacterium avium subsp. paratuberculosis
uugcucggggcucg

SEQ ID NO: 2971124 - RNA, 22 nt, Mycobacterium avium subsp. paratuberculosis
uugcugacgccgcggugcagca

SEQ ID NO: 2971125 - RNA, 15 nt, Mycobacterium avium subsp. paratuberculosis
uugcugagccgccga

SEQ ID NO: 2971126 - RNA, 14 nt, Mycobacterium avium subsp. paratuberculosis
uugcugcccgcggc

SEQ ID NO: 2971127 - RNA, 22 nt, Mycobacterium avium subsp. paratuberculosis
uugcugccgucgguuucggucg

SEQ ID NO: 2971128 - RNA, 20 nt, Mycobacterium avium subsp. paratuberculosis
uugcuuuuugaccaccggca

SEQ ID NO: 2971129 - RNA, 15 nt, Mycobacterium avium subsp. paratuberculosis
uuggaagagggccau

SEQ ID NO: 2971130 - RNA, 13 nt, Mycobacterium avium subsp. paratuberculosis
uuggaaggggucg

SEQ ID NO: 2971131 - RNA, 13 nt, Mycobacterium avium subsp. paratuberculosis
uuggacagcagca

SEQ ID NO: 2971132 - RNA, 13 nt, Mycobacterium avium subsp. paratuberculosis
uuggacagcggcg

SEQ ID NO: 2971133 - RNA, 22 nt, Mycobacterium avium subsp. paratuberculosis
uuggaccagggcgguggcggcg

SEQ ID NO: 2971134 - RNA, 16 nt, Mycobacterium avium subsp. paratuberculosis
uuggacuccaccgcca

SEQ ID NO: 2971135 - RNA, 21 nt, Mycobacterium avium subsp. paratuberculosis
uuggcaaggagguggucgagc

SEQ ID NO: 2971136 - RNA, 23 nt, Mycobacterium avium subsp. paratuberculosis
uuggcacccgaccgacgcccggc

SEQ ID NO: 2971137 - RNA, 24 nt, Mycobacterium avium subsp. paratuberculosis
uuggccagauacuccucggugacg

SEQ ID NO: 2971138 - RNA, 23 nt, Mycobacterium avium subsp. paratuberculosis
uuggccagcagcgugggauccga

SEQ ID NO: 2971139 - RNA, 18 nt, Mycobacterium avium subsp. paratuberculosis
uuggccagcgccuccagc

SEQ ID NO: 2971140 - RNA, 13 nt, Mycobacterium avium subsp. paratuberculosis
uuggccagcucgg

SEQ ID NO: 2971141 - RNA, 15 nt, Mycobacterium avium subsp. paratuberculosis
uuggccagcucggcg

SEQ ID NO: 2971142 - RNA, 11 nt, Mycobacterium avium subsp. paratuberculosis
uuggccaggug

SEQ ID NO: 2971143 - RNA, 18 nt, Mycobacterium avium subsp. paratuberculosis
uuggccagguggccgcuu

SEQ ID NO: 2971144 - RNA, 20 nt, Mycobacterium avium subsp. paratuberculosis
uuggccgcaggcggccagca

SEQ ID NO: 2971145 - RNA, 15 nt, Mycobacterium avium subsp. paratuberculosis
uuggccgcgacgccg

SEQ ID NO: 2971146 - RNA, 19 nt, Mycobacterium avium subsp. paratuberculosis
uuggccgcgacgccgccgc

SEQ ID NO: 2971147 - RNA, 15 nt, Mycobacterium avium subsp. paratuberculosis
uuggccgcgcagcuc

SEQ ID NO: 2971148 - RNA, 19 nt, Mycobacterium avium subsp. paratuberculosis
uuggccgcgcagcucgggg

SEQ ID NO: 2971149 - RNA, 15 nt, Mycobacterium avium subsp. paratuberculosis
uuggccgcgccgccg

SEQ ID NO: 2971150 - RNA, 21 nt, Mycobacterium avium subsp. paratuberculosis
uugucgucggggcuggcggcg

SEQ ID NO: 2971151 - RNA, 23 nt, Mycobacterium avium subsp. paratuberculosis
uugucguugaacaguucggugca

SEQ ID NO: 2971152 - RNA, 14 nt, Mycobacterium avium subsp. paratuberculosis
uugucucggcgccg

SEQ ID NO: 2971153 - RNA, 13 nt, Mycobacterium avium subsp. paratuberculosis
uugucuguucacu

SEQ ID NO: 2971154 - RNA, 18 nt, Mycobacterium avium subsp. paratuberculosis
uugugaaugggcugcgcg

SEQ ID NO: 2971155 - RNA, 13 nt, Mycobacterium avium subsp. paratuberculosis
uugugaggcgcgc

SEQ ID NO: 2971156 - RNA, 15 nt, Mycobacterium avium subsp. paratuberculosis
uugugcccgacggcg

SEQ ID NO: 2971157 - RNA, 22 nt, Mycobacterium avium subsp. paratuberculosis
uuguggccacccucgccgccgc

SEQ ID NO: 2971158 - RNA, 20 nt, Mycobacterium avium subsp. paratuberculosis
uuguggcggcccaauucgua

SEQ ID NO: 2971159 - RNA, 21 nt, Mycobacterium avium subsp. paratuberculosis
uuguuccacgugucggcgucg

SEQ ID NO: 2971160 - RNA, 19 nt, Mycobacterium avium subsp. paratuberculosis
uuguugaccguugcgcccc

SEQ ID NO: 2971161 - RNA, 21 nt, Mycobacterium avium subsp. paratuberculosis
uuguuuuggccgugaaauauc

SEQ ID NO: 2971162 - RNA, 15 nt, Mycobacterium avium subsp. paratuberculosis
uuucaccgugcgcgc

SEQ ID NO: 2971163 - RNA, 21 nt, Mycobacterium avium subsp. paratuberculosis
uuucagcagcgcguaggugcg

SEQ ID NO: 2971164 - RNA, 22 nt, Mycobacterium avium subsp. paratuberculosis
uuuccacgugcacggcgccgug

SEQ ID NO: 2971165 - RNA, 13 nt, Mycobacterium avium subsp. paratuberculosis
uuuccacugccaa

SEQ ID NO: 2971166 - RNA, 23 nt, Mycobacterium avium subsp. paratuberculosis
uuuccccagcccggaucccagaa

SEQ ID NO: 2971167 - RNA, 15 nt, Mycobacterium avium subsp. paratuberculosis
uuucccgacuccuca

SEQ ID NO: 2971168 - RNA, 16 nt, Mycobacterium avium subsp. paratuberculosis
uuucccgacuccucac

SEQ ID NO: 2971169 - RNA, 15 nt, Mycobacterium avium subsp. paratuberculosis
uuuccguccggcgac

SEQ ID NO: 2971170 - RNA, 14 nt, Mycobacterium avium subsp. paratuberculosis
uuuccuucggugcg

SEQ ID NO: 2971171 - RNA, 19 nt, Mycobacterium avium subsp. paratuberculosis
uuucgcgcaccaccucggc

SEQ ID NO: 2971172 - RNA, 12 nt, Mycobacterium avium subsp. paratuberculosis
uuucggccgcgg

SEQ ID NO: 2971173 - RNA, 23 nt, Mycobacterium avium subsp. paratuberculosis
uuucggggguaaaccgccagcag

SEQ ID NO: 2971174 - RNA, 14 nt, Mycobacterium avium subsp. paratuberculosis
uuucggucgcggug

SEQ ID NO: 2971175 - RNA, 17 nt, Mycobacterium avium subsp. paratuberculosis
uuucugccggccgccgu

SEQ ID NO: 2971176 - RNA, 18 nt, Mycobacterium avium subsp. paratuberculosis
uuugaucagcucgccgau

SEQ ID NO: 2971177 - RNA, 18 nt, Mycobacterium avium subsp. paratuberculosis
uuugccaucccgguggac

SEQ ID NO: 2971178 - RNA, 10 nt, Mycobacterium avium subsp. paratuberculosis
uuugcccagc

SEQ ID NO: 2971179 - RNA, 19 nt, Mycobacterium avium subsp. paratuberculosis
uuugcccagcagggcggcg

SEQ ID NO: 2971180 - RNA, 20 nt, Mycobacterium avium subsp. paratuberculosis
uuugcccagcagggcggcga

SEQ ID NO: 2971181 - RNA, 16 nt, Mycobacterium avium subsp. paratuberculosis
uuugccgucggugcgg

SEQ ID NO: 2971182 - RNA, 21 nt, Mycobacterium avium subsp. paratuberculosis
uuugcugccaagauugggcca

SEQ ID NO: 2971183 - RNA, 17 nt, Mycobacterium avium subsp. paratuberculosis
uuuggccugaaccagcu

SEQ ID NO: 2971184 - RNA, 17 nt, Mycobacterium avium subsp. paratuberculosis
uuuguccggcucugccu

SEQ ID NO: 2971185 - RNA, 22 nt, Mycobacterium avium subsp. paratuberculosis
uuuguccggcucugccugcagg

SEQ ID NO: 2971186 - RNA, 18 nt, Mycobacterium avium subsp. paratuberculosis
uuuucggugugccgcugc

SEQ ID NO: 2971187 - RNA, 22 nt, Mycobacterium avium subsp. paratuberculosis
uuuugugucugcucgccugacu

SEQ ID NO: 2971188 - RNA, 13 nt, Mycobacterium avium subsp. paratuberculosis
aggcugaucucgg

SEQ ID NO: 2971189 - RNA, 18 nt, Mycobacterium avium subsp. paratuberculosis
aggcugaucucggcgguc

SEQ ID NO: 2971190 - RNA, 16 nt, Mycobacterium avium subsp. paratuberculosis
aggcugaucuggaugc

SEQ ID NO: 2971191 - RNA, 22 nt, Mycobacterium avium subsp. paratuberculosis
aggcugcccucuuccucgcugu

SEQ ID NO: 2971192 - RNA, 23 nt, Mycobacterium avium subsp. paratuberculosis
aggcugcccucuuccucgcuguc

SEQ ID NO: 2971193 - RNA, 17 nt, Mycobacterium avium subsp. paratuberculosis
aggcugccgcugcgccg

SEQ ID NO: 2971194 - RNA, 20 nt, Mycobacterium avium subsp. paratuberculosis
aggcugccgcugcgccggcg

SEQ ID NO: 2971195 - RNA, 14 nt, Mycobacterium avium subsp. paratuberculosis
aggcugcucggcgg

SEQ ID NO: 2971196 - RNA, 16 nt, Mycobacterium avium subsp. paratuberculosis
aggcugcucggcgggc

SEQ ID NO: 2971197 - RNA, 17 nt, Mycobacterium avium subsp. paratuberculosis
aggcugcucggcgggcu

SEQ ID NO: 2971198 - RNA, 13 nt, Mycobacterium avium subsp. paratuberculosis
aggcuggaguagg

SEQ ID NO: 2971199 - RNA, 17 nt, Mycobacterium avium subsp. paratuberculosis
aggcuggcaucgucggc

SEQ ID NO: 2971200 - RNA, 22 nt, Mycobacterium avium subsp. paratuberculosis
aggcuggcaucgucggcgccgg

SEQ ID NO: 2971201 - RNA, 18 nt, Mycobacterium avium subsp. paratuberculosis
aggcuggcggcgaucacc

SEQ ID NO: 2971202 - RNA, 12 nt, Mycobacterium avium subsp. paratuberculosis
aggcuggucugg

SEQ ID NO: 2971203 - RNA, 16 nt, Mycobacterium avium subsp. paratuberculosis
aggcuggucugguggg

SEQ ID NO: 2971204 - RNA, 16 nt, Mycobacterium avium subsp. paratuberculosis
aggcugugggccagca

SEQ ID NO: 2971205 - RNA, 11 nt, Mycobacterium avium subsp. paratuberculosis
aggcuuggccc

SEQ ID NO: 2971206 - RNA, 15 nt, Mycobacterium avium subsp. paratuberculosis
agggaaaggcagcag

SEQ ID NO: 2971207 - RNA, 21 nt, Mycobacterium avium subsp. paratuberculosis
agggacauccgugagggaccu

SEQ ID NO: 2971208 - RNA, 16 nt, Mycobacterium avium subsp. paratuberculosis
agggacaugccgagca

SEQ ID NO: 2971209 - RNA, 17 nt, Mycobacterium avium subsp. paratuberculosis
agggacaugccgagcag

SEQ ID NO: 2971210 - RNA, 20 nt, Mycobacterium avium subsp. paratuberculosis
agggacaugccgagcagcac

SEQ ID NO: 2971211 - RNA, 13 nt, Mycobacterium avium subsp. paratuberculosis
agggacugcgccg

SEQ ID NO: 2971212 - RNA, 15 nt, Mycobacterium avium subsp. paratuberculosis
agggacugcgccggg

SEQ ID NO: 2971213 - RNA, 22 nt, Mycobacterium avium subsp. paratuberculosis
agggagcacucgauggcggcga

SEQ ID NO: 2971214 - RNA, 14 nt, Mycobacterium avium subsp. paratuberculosis
agggaggacagcac

SEQ ID NO: 2971215 - RNA, 14 nt, Mycobacterium avium subsp. paratuberculosis
agggauucggccau

SEQ ID NO: 2971216 - RNA, 16 nt, Mycobacterium avium subsp. paratuberculosis
agggcaaccgcagcau

SEQ ID NO: 2971217 - RNA, 23 nt, Mycobacterium avium subsp. paratuberculosis
agggcaaccgcagcaucuuggcc

SEQ ID NO: 2971218 - RNA, 15 nt, Mycobacterium avium subsp. paratuberculosis
agggcacaccggugc

SEQ ID NO: 2971219 - RNA, 16 nt, Mycobacterium avium subsp. paratuberculosis
agggcacaccggugcu

SEQ ID NO: 2971220 - RNA, 23 nt, Mycobacterium avium subsp. paratuberculosis
agggcaccgacggccgcacccca

SEQ ID NO: 2971221 - RNA, 18 nt, Mycobacterium avium subsp. paratuberculosis
agggcagauaggcggcga

SEQ ID NO: 2971222 - RNA, 12 nt, Mycobacterium avium subsp. paratuberculosis
agggcagccagc

SEQ ID NO: 2971223 - RNA, 13 nt, Mycobacterium avium subsp. paratuberculosis
agggcagccagcc

SEQ ID NO: 2971224 - RNA, 12 nt, Mycobacterium avium subsp. paratuberculosis
agggcagcgccu

SEQ ID NO: 2971225 - RNA, 19 nt, Mycobacterium avium subsp. paratuberculosis
agggcagcgccucggcggg

SEQ ID NO: 2971226 - RNA, 14 nt, Mycobacterium avium subsp. paratuberculosis
agggcagcgcgacc

SEQ ID NO: 2971227 - RNA, 18 nt, Mycobacterium avium subsp. paratuberculosis
agggcagcgcgaccagcc

SEQ ID NO: 2971228 - RNA, 20 nt, Mycobacterium avium subsp. paratuberculosis
agggcagcgcgaccagcccg

SEQ ID NO: 2971229 - RNA, 21 nt, Mycobacterium avium subsp. paratuberculosis
agggcagcgucccgucggcca

SEQ ID NO: 2971230 - RNA, 14 nt, Mycobacterium avium subsp. paratuberculosis
agggcagggucgcg

SEQ ID NO: 2971231 - RNA, 20 nt, Mycobacterium avium subsp. paratuberculosis
agggcauccgggaggccagc

SEQ ID NO: 2971232 - RNA, 21 nt, Mycobacterium avium subsp. paratuberculosis
agggcauccgggaggccagca

SEQ ID NO: 2971233 - RNA, 14 nt, Mycobacterium avium subsp. paratuberculosis
agggccaccacgcc

SEQ ID NO: 2971234 - RNA, 13 nt, Mycobacterium avium subsp. paratuberculosis
agggccaccgcgu

SEQ ID NO: 2971235 - RNA, 11 nt, Mycobacterium avium subsp. paratuberculosis
agggccaccgg

SEQ ID NO: 2971236 - RNA, 14 nt, Mycobacterium avium subsp. paratuberculosis
agggccagcaacac

SEQ ID NO: 2971237 - RNA, 22 nt, Mycobacterium avium subsp. paratuberculosis
agggccagcaacaccagcugga

SEQ ID NO: 2971238 - RNA, 15 nt, Mycobacterium avium subsp. paratuberculosis
agggccagcagucgu

SEQ ID NO: 2971239 - RNA, 21 nt, Mycobacterium avium subsp. paratuberculosis
agggccagccgaugcgcccgc

SEQ ID NO: 2971240 - RNA, 13 nt, Mycobacterium avium subsp. paratuberculosis
agggccagcggca

SEQ ID NO: 2971241 - RNA, 14 nt, Mycobacterium avium subsp. paratuberculosis
agggccagcggcaa

SEQ ID NO: 2971242 - RNA, 18 nt, Mycobacterium avium subsp. paratuberculosis
agggccaggccgugaucg

SEQ ID NO: 2971243 - RNA, 20 nt, Mycobacterium avium subsp. paratuberculosis
agggccagggcuuugcccug

SEQ ID NO: 2971244 - RNA, 14 nt, Mycobacterium avium subsp. paratuberculosis
agggccauccggcc

SEQ ID NO: 2971245 - RNA, 20 nt, Mycobacterium avium subsp. paratuberculosis
agggccauccggccggcgag

SEQ ID NO: 2971246 - RNA, 19 nt, Mycobacterium avium subsp. paratuberculosis
agggcccacagcagccgca

SEQ ID NO: 2971247 - RNA, 14 nt, Mycobacterium avium subsp. paratuberculosis
agggccccggcauc

SEQ ID NO: 2971248 - RNA, 22 nt, Mycobacterium avium subsp. paratuberculosis
agggccccguuggugcggugca

SEQ ID NO: 2971249 - RNA, 14 nt, Mycobacterium avium subsp. paratuberculosis
agggcccgccggug

SEQ ID NO: 2971250 - RNA, 17 nt, Mycobacterium avium subsp. paratuberculosis
agggcccgggcaggcau

SEQ ID NO: 2971251 - RNA, 21 nt, Mycobacterium avium subsp. paratuberculosis
agggccgaaaaaccugcggug

SEQ ID NO: 2971252 - RNA, 14 nt, Mycobacterium avium subsp. paratuberculosis
agggccgcagcgca

SEQ ID NO: 2971253 - RNA, 22 nt, Mycobacterium avium subsp. paratuberculosis
agggccgccgcauaccgcccgc

SEQ ID NO: 2971254 - RNA, 19 nt, Mycobacterium avium subsp. paratuberculosis
agggccgccuugaucuugg

SEQ ID NO: 2971255 - RNA, 13 nt, Mycobacterium avium subsp. paratuberculosis
agggccgcgcggg

SEQ ID NO: 2971256 - RNA, 19 nt, Mycobacterium avium subsp. paratuberculosis
agggccgcgcgggcgaccu

SEQ ID NO: 2971257 - RNA, 15 nt, Mycobacterium avium subsp. paratuberculosis
agggccgcggccgcc

SEQ ID NO: 2971258 - RNA, 17 nt, Mycobacterium avium subsp. paratuberculosis
agggccgcggccgccgc

SEQ ID NO: 2971259 - RNA, 19 nt, Mycobacterium avium subsp. paratuberculosis
agggccgcggccgccgcga

SEQ ID NO: 2971260 - RNA, 11 nt, Mycobacterium avium subsp. paratuberculosis
agggccgggcg

SEQ ID NO: 2971261 - RNA, 17 nt, Mycobacterium avium subsp. paratuberculosis
agggccgggcgcuggcc

SEQ ID NO: 2971262 - RNA, 21 nt, Mycobacterium avium subsp. paratuberculosis
agggccggguuuucgggccgg

SEQ ID NO: 2971263 - RNA, 13 nt, Mycobacterium avium subsp. paratuberculosis
agggccuccacca

SEQ ID NO: 2971264 - RNA, 15 nt, Mycobacterium avium subsp. paratuberculosis
agggccuccaccacc

SEQ ID NO: 2971265 - RNA, 16 nt, Mycobacterium avium subsp. paratuberculosis
agggccuccaccacca

SEQ ID NO: 2971266 - RNA, 23 nt, Mycobacterium avium subsp. paratuberculosis
agggccucgccguugccggcccg

SEQ ID NO: 2971267 - RNA, 16 nt, Mycobacterium avium subsp. paratuberculosis
agggccucgucgucgu

SEQ ID NO: 2971268 - RNA, 19 nt, Mycobacterium avium subsp. paratuberculosis
agggccucgucgucgucga

SEQ ID NO: 2971269 - RNA, 14 nt, Mycobacterium avium subsp. paratuberculosis
agggccugcagcac

SEQ ID NO: 2971270 - RNA, 19 nt, Mycobacterium avium subsp. paratuberculosis
agggcgacauguccgggau

SEQ ID NO: 2971271 - RNA, 13 nt, Mycobacterium avium subsp. paratuberculosis
agggcgaccacca

SEQ ID NO: 2971272 - RNA, 17 nt, Mycobacterium avium subsp. paratuberculosis
agggcgacgaugccggc

SEQ ID NO: 2971273 - RNA, 13 nt, Mycobacterium avium subsp. paratuberculosis
agggcgacgccgc

SEQ ID NO: 2971274 - RNA, 15 nt, Mycobacterium avium subsp. paratuberculosis
agggcgacggcggcg

SEQ ID NO: 2971275 - RNA, 16 nt, Mycobacterium avium subsp. paratuberculosis
agggcgacggcggcga

SEQ ID NO: 2971276 - RNA, 17 nt, Mycobacterium avium subsp. paratuberculosis
agggcgacggcggcgac

SEQ ID NO: 2971277 - RNA, 18 nt, Mycobacterium avium subsp. paratuberculosis
agggcgaggaacccgacc

SEQ ID NO: 2971278 - RNA, 20 nt, Mycobacterium avium subsp. paratuberculosis
agggcgaggaacccgaccgc

SEQ ID NO: 2971279 - RNA, 22 nt, Mycobacterium avium subsp. paratuberculosis
agggcgauaaccucggcggcgg

SEQ ID NO: 2971280 - RNA, 17 nt, Mycobacterium avium subsp. paratuberculosis
agggcgaucaccgcggc

SEQ ID NO: 2971281 - RNA, 16 nt, Mycobacterium avium subsp. paratuberculosis
agggcgccgucggcgg

SEQ ID NO: 2971282 - RNA, 14 nt, Mycobacterium avium subsp. paratuberculosis
agggcgcgcagcga

SEQ ID NO: 2971283 - RNA, 17 nt, Mycobacterium avium subsp. paratuberculosis
agggcgcgcugucgacg

SEQ ID NO: 2971284 - RNA, 14 nt, Mycobacterium avium subsp. paratuberculosis
agggcgcgucgauc

SEQ ID NO: 2971285 - RNA, 20 nt, Mycobacterium avium subsp. paratuberculosis
agggcgcgucguagccggca

SEQ ID NO: 2971286 - RNA, 24 nt, Mycobacterium avium subsp. paratuberculosis
agggcgcgucguagccggcacgca

SEQ ID NO: 2971287 - RNA, 21 nt, Mycobacterium avium subsp. paratuberculosis
agggcgcucaucaggcggccg

SEQ ID NO: 2971288 - RNA, 23 nt, Mycobacterium avium subsp. paratuberculosis
agggcgcucaucaggcggccggc

SEQ ID NO: 2971289 - RNA, 13 nt, Mycobacterium avium subsp. paratuberculosis
agggcggcaccga

SEQ ID NO: 2971290 - RNA, 15 nt, Mycobacterium avium subsp. paratuberculosis
agggcggccggccag

SEQ ID NO: 2971291 - RNA, 13 nt, Mycobacterium avium subsp. paratuberculosis
agggcggcgaccu

SEQ ID NO: 2971292 - RNA, 17 nt, Mycobacterium avium subsp. paratuberculosis
agggcggcgccgcggcc

SEQ ID NO: 2971293 - RNA, 22 nt, Mycobacterium avium subsp. paratuberculosis
agggcggcgccggcacugcugc

SEQ ID NO: 2971294 - RNA, 20 nt, Mycobacterium avium subsp. paratuberculosis
agggcgggcaggcccgagcc

SEQ ID NO: 2971295 - RNA, 18 nt, Mycobacterium avium subsp. paratuberculosis
agggcggguaggcgccga

SEQ ID NO: 2971296 - RNA, 19 nt, Mycobacterium avium subsp. paratuberculosis
agggcggguaggcgccgau

SEQ ID NO: 2971297 - RNA, 21 nt, Mycobacterium avium subsp. paratuberculosis
agggcggguaggcgccgaugc

SEQ ID NO: 2971298 - RNA, 16 nt, Mycobacterium avium subsp. paratuberculosis
agggcggugcggugcg

SEQ ID NO: 2971299 - RNA, 20 nt, Mycobacterium avium subsp. paratuberculosis
agggcgucacgagcuccagc

SEQ ID NO: 2971300 - RNA, 13 nt, Mycobacterium avium subsp. paratuberculosis
agggcgucaggcg

SEQ ID NO: 2971301 - RNA, 17 nt, Mycobacterium avium subsp. paratuberculosis
agggcguccuuccaacg

SEQ ID NO: 2971302 - RNA, 18 nt, Mycobacterium avium subsp. paratuberculosis
agggcgugacgccgcugc

SEQ ID NO: 2971303 - RNA, 23 nt, Mycobacterium avium subsp. paratuberculosis
agggcgugacgccgcugcgugcc

SEQ ID NO: 2971304 - RNA, 23 nt, Mycobacterium avium subsp. paratuberculosis
agggcgugaucuguucggcggcg

SEQ ID NO: 2971305 - RNA, 14 nt, Mycobacterium avium subsp. paratuberculosis
agggcgugcgcggc

SEQ ID NO: 2971306 - RNA, 18 nt, Mycobacterium avium subsp. paratuberculosis
agggcgugcgcggccgcc

SEQ ID NO: 2971307 - RNA, 17 nt, Mycobacterium avium subsp. paratuberculosis
agggcguguugcaggcg

SEQ ID NO: 2971308 - RNA, 19 nt, Mycobacterium avium subsp. paratuberculosis
agggcguucgacguccacc

SEQ ID NO: 2971309 - RNA, 16 nt, Mycobacterium avium subsp. paratuberculosis
agggcguucgcggugg

SEQ ID NO: 2971310 - RNA, 17 nt, Mycobacterium avium subsp. paratuberculosis
agggcguuugccacuga

SEQ ID NO: 2971311 - RNA, 23 nt, Mycobacterium avium subsp. paratuberculosis
agggcguuugccacugagcgcag

SEQ ID NO: 2971312 - RNA, 14 nt, Mycobacterium avium subsp. paratuberculosis
agggcuccgcgcug

SEQ ID NO: 2971313 - RNA, 16 nt, Mycobacterium avium subsp. paratuberculosis
agggcuccgcgcugac

SEQ ID NO: 2971314 - RNA, 17 nt, Mycobacterium avium subsp. paratuberculosis
agggcuccgcgcugacc

SEQ ID NO: 2971315 - RNA, 19 nt, Mycobacterium avium subsp. paratuberculosis
agggcucgugcagccggcg

SEQ ID NO: 2971316 - RNA, 20 nt, Mycobacterium avium subsp. paratuberculosis
agggcuuuagaaggccgccu

SEQ ID NO: 2971317 - RNA, 16 nt, Mycobacterium avium subsp. paratuberculosis
aggggaacaacgcgca

SEQ ID NO: 2971318 - RNA, 22 nt, Mycobacterium avium subsp. paratuberculosis
aggggagcagcacgaucgagcc

SEQ ID NO: 2971319 - RNA, 20 nt, Mycobacterium avium subsp. paratuberculosis
aggggauccagcggcggccu

SEQ ID NO: 2971320 - RNA, 13 nt, Mycobacterium avium subsp. paratuberculosis
aggggcagcagca

SEQ ID NO: 2971321 - RNA, 15 nt, Mycobacterium avium subsp. paratuberculosis
aggggcagcagcgcc

SEQ ID NO: 2971322 - RNA, 16 nt, Mycobacterium avium subsp. paratuberculosis
aggggcagcagcgccc

SEQ ID NO: 2971323 - RNA, 18 nt, Mycobacterium avium subsp. paratuberculosis
aggggcagcagcgcccac

SEQ ID NO: 2971324 - RNA, 23 nt, Mycobacterium avium subsp. paratuberculosis
aggggccggacggugacgccgga

SEQ ID NO: 2971325 - RNA, 12 nt, Mycobacterium avium subsp. paratuberculosis
aggggccgggcu

SEQ ID NO: 2971326 - RNA, 16 nt, Mycobacterium avium subsp. paratuberculosis
aggggcgacgggccga

SEQ ID NO: 2971327 - RNA, 19 nt, Mycobacterium avium subsp. paratuberculosis
aggggcgacgggccgauca

SEQ ID NO: 2971328 - RNA, 16 nt, Mycobacterium avium subsp. paratuberculosis
aggggcgcgcgccggg

SEQ ID NO: 2971329 - RNA, 17 nt, Mycobacterium avium subsp. paratuberculosis
aggggcgcgcgccggga

SEQ ID NO: 2971330 - RNA, 21 nt, Mycobacterium avium subsp. paratuberculosis
aggggcuguccucccagcgcc

SEQ ID NO: 2971331 - RNA, 21 nt, Mycobacterium avium subsp. paratuberculosis
aggggcuuggcgacgaagucg

SEQ ID NO: 2971332 - RNA, 20 nt, Mycobacterium avium subsp. paratuberculosis
aggggcuuuugcgucugcuc

SEQ ID NO: 2971333 - RNA, 15 nt, Mycobacterium avium subsp. paratuberculosis
agggggaagucgacc

SEQ ID NO: 2971334 - RNA, 19 nt, Mycobacterium avium subsp. paratuberculosis
aggggguggguccggucag

SEQ ID NO: 2971335 - RNA, 20 nt, Mycobacterium avium subsp. paratuberculosis
aggggguggguccggucagc

SEQ ID NO: 2971336 - RNA, 17 nt, Mycobacterium avium subsp. paratuberculosis
aggggucguaccaccac

SEQ ID NO: 2971337 - RNA, 16 nt, Mycobacterium avium subsp. paratuberculosis
aggggugggcgacgag

SEQ ID NO: 2971338 - RNA, 16 nt, Mycobacterium avium subsp. paratuberculosis
aggguaacccgggacc

SEQ ID NO: 2971339 - RNA, 14 nt, Mycobacterium avium subsp. paratuberculosis
agggucagcagcac

SEQ ID NO: 2971340 - RNA, 20 nt, Mycobacterium avium subsp. paratuberculosis
agggucagcagcacccgguc

SEQ ID NO: 2971341 - RNA, 21 nt, Mycobacterium avium subsp. paratuberculosis
agggucagcagcacccggucg

SEQ ID NO: 2971342 - RNA, 15 nt, Mycobacterium avium subsp. paratuberculosis
agggucaucgcgccg

SEQ ID NO: 2971343 - RNA, 12 nt, Mycobacterium avium subsp. paratuberculosis
agggucccgguc

SEQ ID NO: 2971344 - RNA, 14 nt, Mycobacterium avium subsp. paratuberculosis
agggucccggucag

SEQ ID NO: 2971345 - RNA, 22 nt, Mycobacterium avium subsp. paratuberculosis
agggucgagacaccgucgcgca

SEQ ID NO: 2971346 - RNA, 22 nt, Mycobacterium avium subsp. paratuberculosis
agggucgagaucagcaccgggu

SEQ ID NO: 2971347 - RNA, 17 nt, Mycobacterium avium subsp. paratuberculosis
agggucgccaggccacc

SEQ ID NO: 2971348 - RNA, 19 nt, Mycobacterium avium subsp. paratuberculosis
agggucgcggagcggguca

SEQ ID NO: 2971349 - RNA, 15 nt, Mycobacterium avium subsp. paratuberculosis
agggucggucgagcc

SEQ ID NO: 2971350 - RNA, 20 nt, Mycobacterium avium subsp. paratuberculosis
agggucucgggcagcagcac

SEQ ID NO: 2971351 - RNA, 23 nt, Mycobacterium avium subsp. paratuberculosis
agggucuggcccggugcgacgcc

SEQ ID NO: 2971352 - RNA, 23 nt, Mycobacterium avium subsp. paratuberculosis
agggugaaacacaaacucgccca

SEQ ID NO: 2971353 - RNA, 22 nt, Mycobacterium avium subsp. paratuberculosis
agggugacccgggcgauggugc

SEQ ID NO: 2971354 - RNA, 16 nt, Mycobacterium avium subsp. paratuberculosis
agggugacggaguugg

SEQ ID NO: 2971355 - RNA, 20 nt, Mycobacterium avium subsp. paratuberculosis
agggugaugacguuggugau

SEQ ID NO: 2971356 - RNA, 17 nt, Mycobacterium avium subsp. paratuberculosis
agggugaugucgcugcc

SEQ ID NO: 2971357 - RNA, 22 nt, Mycobacterium avium subsp. paratuberculosis
agggugaugucgcugccgccgc

SEQ ID NO: 2971358 - RNA, 23 nt, Mycobacterium avium subsp. paratuberculosis
agggugccccgcaccgccaggcu

SEQ ID NO: 2971359 - RNA, 21 nt, Mycobacterium avium subsp. paratuberculosis
agggugccccgcgaccgcagc

SEQ ID NO: 2971360 - RNA, 22 nt, Mycobacterium avium subsp. paratuberculosis
agggugccgaacagcgacgucu

SEQ ID NO: 2971361 - RNA, 16 nt, Mycobacterium avium subsp. paratuberculosis
agggugccgauguagg

SEQ ID NO: 2971362 - RNA, 13 nt, Mycobacterium avium subsp. paratuberculosis
agggugccgcugc

SEQ ID NO: 2971363 - RNA, 14 nt, Mycobacterium avium subsp. paratuberculosis
agggugccgcugcc

SEQ ID NO: 2971364 - RNA, 22 nt, Mycobacterium avium subsp. paratuberculosis
agggugccgcugcccgccgcgu

SEQ ID NO: 2971365 - RNA, 18 nt, Mycobacterium avium subsp. paratuberculosis
agggugcgcagcgcgucg

SEQ ID NO: 2971366 - RNA, 19 nt, Mycobacterium avium subsp. paratuberculosis
agggugcgcagcgcgucgu

SEQ ID NO: 2971367 - RNA, 17 nt, Mycobacterium avium subsp. paratuberculosis
aggguggccagcaccgc

SEQ ID NO: 2971368 - RNA, 20 nt, Mycobacterium avium subsp. paratuberculosis
aggguggccagcaccgcguc

SEQ ID NO: 2971369 - RNA, 15 nt, Mycobacterium avium subsp. paratuberculosis
aggguggccagcacg

SEQ ID NO: 2971370 - RNA, 17 nt, Mycobacterium avium subsp. paratuberculosis
aggguggccccagcccg

SEQ ID NO: 2971371 - RNA, 14 nt, Mycobacterium avium subsp. paratuberculosis
aggguggccgccac

SEQ ID NO: 2971372 - RNA, 17 nt, Mycobacterium avium subsp. paratuberculosis
aggguggccucgucggc

SEQ ID NO: 2971373 - RNA, 20 nt, Mycobacterium avium subsp. paratuberculosis
aggguggggaucacgucggc

SEQ ID NO: 2971374 - RNA, 17 nt, Mycobacterium avium subsp. paratuberculosis
aggguggugguggugcc

SEQ ID NO: 2971375 - RNA, 13 nt, Mycobacterium avium subsp. paratuberculosis
agggugucgauga

SEQ ID NO: 2971376 - RNA, 18 nt, Mycobacterium avium subsp. paratuberculosis
agggugucggcggggccg

SEQ ID NO: 2971377 - RNA, 15 nt, Mycobacterium avium subsp. paratuberculosis
aggguguuggacgag

SEQ ID NO: 2971378 - RNA, 15 nt, Mycobacterium avium subsp. paratuberculosis
aggguugccccaaaa

SEQ ID NO: 2971379 - RNA, 18 nt, Mycobacterium avium subsp. paratuberculosis
aggguugccgcacgacca

SEQ ID NO: 2971380 - RNA, 16 nt, Mycobacterium avium subsp. paratuberculosis
agguaaaccagcagcg

SEQ ID NO: 2971381 - RNA, 18 nt, Mycobacterium avium subsp. paratuberculosis
agguaaaccagcagcgcc

SEQ ID NO: 2971382 - RNA, 20 nt, Mycobacterium avium subsp. paratuberculosis
agguacaccaccagguugga

SEQ ID NO: 2971383 - RNA, 16 nt, Mycobacterium avium subsp. paratuberculosis
agguacucgaguggcg

SEQ ID NO: 2971384 - RNA, 13 nt, Mycobacterium avium subsp. paratuberculosis
agguacugcagca

SEQ ID NO: 2971385 - RNA, 18 nt, Mycobacterium avium subsp. paratuberculosis
agguacugggcguggucg

SEQ ID NO: 2971386 - RNA, 14 nt, Mycobacterium avium subsp. paratuberculosis
agguagcaggcgcg

SEQ ID NO: 2971387 - RNA, 16 nt, Mycobacterium avium subsp. paratuberculosis
agguagcccaugucgc

SEQ ID NO: 2971388 - RNA, 13 nt, Mycobacterium avium subsp. paratuberculosis
agguagccgccgu

SEQ ID NO: 2971389 - RNA, 16 nt, Mycobacterium avium subsp. paratuberculosis
agguagccgcgcacca

SEQ ID NO: 2971390 - RNA, 13 nt, Mycobacterium avium subsp. paratuberculosis
agguagcggcuga

SEQ ID NO: 2971391 - RNA, 14 nt, Mycobacterium avium subsp. paratuberculosis
agguagcgugcgcc

SEQ ID NO: 2971392 - RNA, 14 nt, Mycobacterium avium subsp. paratuberculosis
agguaggcgccgcu

SEQ ID NO: 2971393 - RNA, 13 nt, Mycobacterium avium subsp. paratuberculosis
agguaggcggcgc

SEQ ID NO: 2971394 - RNA, 14 nt, Mycobacterium avium subsp. paratuberculosis
agguaggcggcgcc

SEQ ID NO: 2971395 - RNA, 14 nt, Mycobacterium avium subsp. paratuberculosis
agguaggcgucgaa

SEQ ID NO: 2971396 - RNA, 21 nt, Mycobacterium avium subsp. paratuberculosis
agguaguccagcacagcauca

SEQ ID NO: 2971397 - RNA, 15 nt, Mycobacterium avium subsp. paratuberculosis
agguagucgcgcagc

SEQ ID NO: 2971398 - RNA, 19 nt, Mycobacterium avium subsp. paratuberculosis
agucugagcccgggcaggc

SEQ ID NO: 2971399 - RNA, 15 nt, Mycobacterium avium subsp. paratuberculosis
agugaaccccgggcu

SEQ ID NO: 2971400 - RNA, 14 nt, Mycobacterium avium subsp. paratuberculosis
agugacgccugcgg

SEQ ID NO: 2971401 - RNA, 15 nt, Mycobacterium avium subsp. paratuberculosis
agugacgccugcggc

SEQ ID NO: 2971402 - RNA, 20 nt, Mycobacterium avium subsp. paratuberculosis
agugacgccugcggcccagc

SEQ ID NO: 2971403 - RNA, 20 nt, Mycobacterium avium subsp. paratuberculosis
agugacggguuggucggcgc

SEQ ID NO: 2971404 - RNA, 15 nt, Mycobacterium avium subsp. paratuberculosis
agugaggacgaggcg

SEQ ID NO: 2971405 - RNA, 22 nt, Mycobacterium avium subsp. paratuberculosis
agugaggccgaggcgagugagg

SEQ ID NO: 2971406 - RNA, 22 nt, Mycobacterium avium subsp. paratuberculosis
agugauccugguuucagguggc

SEQ ID NO: 2971407 - RNA, 14 nt, Mycobacterium avium subsp. paratuberculosis
agugaugaccugga

SEQ ID NO: 2971408 - RNA, 22 nt, Mycobacterium avium subsp. paratuberculosis
agugcaacuaccgacggcaccu

SEQ ID NO: 2971409 - RNA, 17 nt, Mycobacterium avium subsp. paratuberculosis
agugcaagcucgccagg

SEQ ID NO: 2971410 - RNA, 16 nt, Mycobacterium avium subsp. paratuberculosis
agugcaccucgacgaa

SEQ ID NO: 2971411 - RNA, 20 nt, Mycobacterium avium subsp. paratuberculosis
agugcaccuugaucucgucg

SEQ ID NO: 2971412 - RNA, 14 nt, Mycobacterium avium subsp. paratuberculosis
agugcacgacgacc

SEQ ID NO: 2971413 - RNA, 16 nt, Mycobacterium avium subsp. paratuberculosis
agugcacgcucggcgc

SEQ ID NO: 2971414 - RNA, 21 nt, Mycobacterium avium subsp. paratuberculosis
agugcacucggcgaugcgccg

SEQ ID NO: 2971415 - RNA, 22 nt, Mycobacterium avium subsp. paratuberculosis
agugcacugccgacccggcgua

SEQ ID NO: 2971416 - RNA, 15 nt, Mycobacterium avium subsp. paratuberculosis
agugcagccgcccgu

SEQ ID NO: 2971417 - RNA, 23 nt, Mycobacterium avium subsp. paratuberculosis
agugcaggcugacgcgaccgcgc

SEQ ID NO: 2971418 - RNA, 14 nt, Mycobacterium avium subsp. paratuberculosis
agugcaugccggcc

SEQ ID NO: 2971419 - RNA, 15 nt, Mycobacterium avium subsp. paratuberculosis
agugcaugccggccu

SEQ ID NO: 2971420 - RNA, 13 nt, Mycobacterium avium subsp. paratuberculosis
agugccaccacca

SEQ ID NO: 2971421 - RNA, 14 nt, Mycobacterium avium subsp. paratuberculosis
agugccaccaccac

SEQ ID NO: 2971422 - RNA, 18 nt, Mycobacterium avium subsp. paratuberculosis
agugccaccaccacggcc

SEQ ID NO: 2971423 - RNA, 20 nt, Mycobacterium avium subsp. paratuberculosis
agugccaccaccacggccag

SEQ ID NO: 2971424 - RNA, 22 nt, Mycobacterium avium subsp. paratuberculosis
agugccaccaccacggccagga

SEQ ID NO: 2971425 - RNA, 19 nt, Mycobacterium avium subsp. paratuberculosis
agugccaguaccagcggcc

SEQ ID NO: 2971426 - RNA, 17 nt, Mycobacterium avium subsp. paratuberculosis
agugccccguccggcgc

SEQ ID NO: 2971427 - RNA, 19 nt, Mycobacterium avium subsp. paratuberculosis
agugcccgcccagcugcac

SEQ ID NO: 2971428 - RNA, 16 nt, Mycobacterium avium subsp. paratuberculosis
agugccgcaccagcac

SEQ ID NO: 2971429 - RNA, 15 nt, Mycobacterium avium subsp. paratuberculosis
agugccgcagguggu

SEQ ID NO: 2971430 - RNA, 17 nt, Mycobacterium avium subsp. paratuberculosis
agugccggacccccucg

SEQ ID NO: 2971431 - RNA, 21 nt, Mycobacterium avium subsp. paratuberculosis
agugccggccagcucgccgcc

SEQ ID NO: 2971432 - RNA, 23 nt, Mycobacterium avium subsp. paratuberculosis
agugccggccagcucgccgccga

SEQ ID NO: 2971433 - RNA, 17 nt, Mycobacterium avium subsp. paratuberculosis
agugccggcgcaccgcg

SEQ ID NO: 2971434 - RNA, 11 nt, Mycobacterium avium subsp. paratuberculosis
agugccgggcc

SEQ ID NO: 2971435 - RNA, 18 nt, Mycobacterium avium subsp. paratuberculosis
agugccgguccagccgcc

SEQ ID NO: 2971436 - RNA, 15 nt, Mycobacterium avium subsp. paratuberculosis
agugcgaaucaucgu

SEQ ID NO: 2971437 - RNA, 15 nt, Mycobacterium avium subsp. paratuberculosis
agugcgcccagaugc

SEQ ID NO: 2971438 - RNA, 14 nt, Mycobacterium avium subsp. paratuberculosis
agugcgcgauggcg

SEQ ID NO: 2971439 - RNA, 18 nt, Mycobacterium avium subsp. paratuberculosis
agugcgcggcguccucga

SEQ ID NO: 2971440 - RNA, 22 nt, Mycobacterium avium subsp. paratuberculosis
agugcgcuguggugacggcccc

SEQ ID NO: 2971441 - RNA, 17 nt, Mycobacterium avium subsp. paratuberculosis
agugcggcccgccgggc

SEQ ID NO: 2971442 - RNA, 21 nt, Mycobacterium avium subsp. paratuberculosis
agugcggucgguucauccacu

SEQ ID NO: 2971443 - RNA, 18 nt, Mycobacterium avium subsp. paratuberculosis
agugcgucagaaccgggg

SEQ ID NO: 2971444 - RNA, 17 nt, Mycobacterium avium subsp. paratuberculosis
agugcgucgcccaucac

SEQ ID NO: 2971445 - RNA, 16 nt, Mycobacterium avium subsp. paratuberculosis
agugcgucuuuuccca

SEQ ID NO: 2971446 - RNA, 17 nt, Mycobacterium avium subsp. paratuberculosis
agugcgucuuuucccac

SEQ ID NO: 2971447 - RNA, 20 nt, Mycobacterium avium subsp. paratuberculosis
agugcgugaccugcugggcg

SEQ ID NO: 2971448 - RNA, 19 nt, Mycobacterium avium subsp. paratuberculosis
agugcucaugugauuacuc

SEQ ID NO: 2971449 - RNA, 17 nt, Mycobacterium avium subsp. paratuberculosis
agugcucgauggccagc

SEQ ID NO: 2971450 - RNA, 18 nt, Mycobacterium avium subsp. paratuberculosis
agugcucgauggccagcg

SEQ ID NO: 2971451 - RNA, 20 nt, Mycobacterium avium subsp. paratuberculosis
agugcucgauggccagcgcg

SEQ ID NO: 2971452 - RNA, 21 nt, Mycobacterium avium subsp. paratuberculosis
agugcucgauggccagcgcgu

SEQ ID NO: 2971453 - RNA, 19 nt, Mycobacterium avium subsp. paratuberculosis
agugcucggcguugagccg

SEQ ID NO: 2971454 - RNA, 23 nt, Mycobacterium avium subsp. paratuberculosis
agugcucggcguugagccggcgc

SEQ ID NO: 2971455 - RNA, 16 nt, Mycobacterium avium subsp. paratuberculosis
agugcuggacggcccg

SEQ ID NO: 2971456 - RNA, 22 nt, Mycobacterium avium subsp. paratuberculosis
agugcuggacggcccgacgacg

SEQ ID NO: 2971457 - RNA, 14 nt, Mycobacterium avium subsp. paratuberculosis
agugcuucuugaag

SEQ ID NO: 2971458 - RNA, 22 nt, Mycobacterium avium subsp. paratuberculosis
agugcuucuugaagaaccggga

SEQ ID NO: 2971459 - RNA, 21 nt, Mycobacterium avium subsp. paratuberculosis
aguggaagucagcgcgugacc

SEQ ID NO: 2971460 - RNA, 14 nt, Mycobacterium avium subsp. paratuberculosis
aguggaucagccag

SEQ ID NO: 2971461 - RNA, 20 nt, Mycobacterium avium subsp. paratuberculosis
aguggaucggcccgacgggu

SEQ ID NO: 2971462 - RNA, 14 nt, Mycobacterium avium subsp. paratuberculosis
aguggccggcgucc

SEQ ID NO: 2971463 - RNA, 14 nt, Mycobacterium avium subsp. paratuberculosis
aguggcgccgcggu

SEQ ID NO: 2971464 - RNA, 21 nt, Mycobacterium avium subsp. paratuberculosis
aguggcguccaaugcgccgau

SEQ ID NO: 2971465 - RNA, 18 nt, Mycobacterium avium subsp. paratuberculosis
aguggcuggucacacccu

SEQ ID NO: 2971466 - RNA, 20 nt, Mycobacterium avium subsp. paratuberculosis
agugguagggcuccgcgcug

SEQ ID NO: 2971467 - RNA, 16 nt, Mycobacterium avium subsp. paratuberculosis
agugguccaccgccgc

SEQ ID NO: 2971468 - RNA, 13 nt, Mycobacterium avium subsp. paratuberculosis
aguggucggccgc

SEQ ID NO: 2971469 - RNA, 14 nt, Mycobacterium avium subsp. paratuberculosis
aguggucgucgucg

SEQ ID NO: 2971470 - RNA, 17 nt, Mycobacterium avium subsp. paratuberculosis
aguggucgucgucgaac

SEQ ID NO: 2971471 - RNA, 19 nt, Mycobacterium avium subsp. paratuberculosis
agugguggccgaacggguc

SEQ ID NO: 2971472 - RNA, 23 nt, Mycobacterium avium subsp. paratuberculosis
agugguggccgaacgggucggcg

SEQ ID NO: 2971473 - RNA, 17 nt, Mycobacterium avium subsp. paratuberculosis
agugucagggcagcggu

SEQ ID NO: 2971474 - RNA, 16 nt, Mycobacterium avium subsp. paratuberculosis
aguguccagucggccg

SEQ ID NO: 2971475 - RNA, 14 nt, Mycobacterium avium subsp. paratuberculosis
agugucgcaaagac

SEQ ID NO: 2971476 - RNA, 17 nt, Mycobacterium avium subsp. paratuberculosis
agugucggaaucggcgc

SEQ ID NO: 2971477 - RNA, 23 nt, Mycobacterium avium subsp. paratuberculosis
agugucguggcgacaucgccgcg

SEQ ID NO: 2971478 - RNA, 14 nt, Mycobacterium avium subsp. paratuberculosis
aguucaccaccgcg

SEQ ID NO: 2971479 - RNA, 16 nt, Mycobacterium avium subsp. paratuberculosis
aguucaccaccgcgcu

SEQ ID NO: 2971480 - RNA, 23 nt, Mycobacterium avium subsp. paratuberculosis
aguucaugaucucguugcggcgc

SEQ ID NO: 2971481 - RNA, 23 nt, Mycobacterium avium subsp. paratuberculosis
aguuccgacaucagugcgggcau

SEQ ID NO: 2971482 - RNA, 19 nt, Mycobacterium avium subsp. paratuberculosis
aguuccgcgucggccccca

SEQ ID NO: 2971483 - RNA, 18 nt, Mycobacterium avium subsp. paratuberculosis
aguuccggcgguccugcg

SEQ ID NO: 2971484 - RNA, 18 nt, Mycobacterium avium subsp. paratuberculosis
aguuccucgccggaguuc

SEQ ID NO: 2971485 - RNA, 16 nt, Mycobacterium avium subsp. paratuberculosis
aguuccucggcgaugc

SEQ ID NO: 2971486 - RNA, 19 nt, Mycobacterium avium subsp. paratuberculosis
aguuccugcaugccgggca

SEQ ID NO: 2971487 - RNA, 17 nt, Mycobacterium avium subsp. paratuberculosis
aguuccuugauccggcc

SEQ ID NO: 2971488 - RNA, 22 nt, Mycobacterium avium subsp. paratuberculosis
aguucgaccggcaccagcagcc

SEQ ID NO: 2971489 - RNA, 17 nt, Mycobacterium avium subsp. paratuberculosis
aguucgaccuccacccg

SEQ ID NO: 2971490 - RNA, 18 nt, Mycobacterium avium subsp. paratuberculosis
aguucgaccuccacccgc

SEQ ID NO: 2971491 - RNA, 15 nt, Mycobacterium avium subsp. paratuberculosis
aguucgacguagccc

SEQ ID NO: 2971492 - RNA, 16 nt, Mycobacterium avium subsp. paratuberculosis
aguucgagcgccgcgg

SEQ ID NO: 2971493 - RNA, 14 nt, Mycobacterium avium subsp. paratuberculosis
aguucgaucagcag

SEQ ID NO: 2971494 - RNA, 17 nt, Mycobacterium avium subsp. paratuberculosis
aguucgaugacgucgcg

SEQ ID NO: 2971495 - RNA, 20 nt, Mycobacterium avium subsp. paratuberculosis
aguucgaugccgggcauggc

SEQ ID NO: 2971496 - RNA, 19 nt, Mycobacterium avium subsp. paratuberculosis
aguucgaugcgcucggcga

SEQ ID NO: 2971497 - RNA, 17 nt, Mycobacterium avium subsp. paratuberculosis
aguucgccagcaugcga

SEQ ID NO: 2971498 - RNA, 13 nt, Mycobacterium avium subsp. paratuberculosis
aguucgcccgcag

SEQ ID NO: 2971499 - RNA, 18 nt, Mycobacterium avium subsp. paratuberculosis
aguucgcccgcagcacgc

SEQ ID NO: 2971500 - RNA, 16 nt, Mycobacterium avium subsp. paratuberculosis
aguucgccgccgccag

SEQ ID NO: 2971501 - RNA, 20 nt, Mycobacterium avium subsp. paratuberculosis
aguucgccgccgccagcacc

SEQ ID NO: 2971502 - RNA, 13 nt, Mycobacterium avium subsp. paratuberculosis
aguucgcggcgca

SEQ ID NO: 2971503 - RNA, 20 nt, Mycobacterium avium subsp. paratuberculosis
aguucggcaucucggccgga

SEQ ID NO: 2971504 - RNA, 17 nt, Mycobacterium avium subsp. paratuberculosis
aguucggccaccgcguc

SEQ ID NO: 2971505 - RNA, 15 nt, Mycobacterium avium subsp. paratuberculosis
aguucggccagcgcg

SEQ ID NO: 2971506 - RNA, 18 nt, Mycobacterium avium subsp. paratuberculosis
aguucggccagcgcggug

SEQ ID NO: 2971507 - RNA, 14 nt, Mycobacterium avium subsp. paratuberculosis
aguucggccgccgu

SEQ ID NO: 2971508 - RNA, 22 nt, Mycobacterium avium subsp. paratuberculosis
aguucggccggcuugaucucga

SEQ ID NO: 2971509 - RNA, 17 nt, Mycobacterium avium subsp. paratuberculosis
aguucggcgcgcaucuu

SEQ ID NO: 2971510 - RNA, 14 nt, Mycobacterium avium subsp. paratuberculosis
aguucggcggcccg

SEQ ID NO: 2971511 - RNA, 12 nt, Mycobacterium avium subsp. paratuberculosis
aguucggcgggg

SEQ ID NO: 2971512 - RNA, 20 nt, Mycobacterium avium subsp. paratuberculosis
aguucggugaacugcagccc

SEQ ID NO: 2971513 - RNA, 19 nt, Mycobacterium avium subsp. paratuberculosis
aguucgguggggccgccgu

SEQ ID NO: 2971514 - RNA, 13 nt, Mycobacterium avium subsp. paratuberculosis
aguucuccagcac

SEQ ID NO: 2971515 - RNA, 20 nt, Mycobacterium avium subsp. paratuberculosis
aguugaagacgcgaaagcag

SEQ ID NO: 2971516 - RNA, 22 nt, Mycobacterium avium subsp. paratuberculosis
aguugcaacccggugcccgaga

SEQ ID NO: 2971517 - RNA, 16 nt, Mycobacterium avium subsp. paratuberculosis
aguugcaccggcaccg

SEQ ID NO: 2971518 - RNA, 17 nt, Mycobacterium avium subsp. paratuberculosis
aguugcaccggcaccgc

SEQ ID NO: 2971519 - RNA, 22 nt, Mycobacterium avium subsp. paratuberculosis
aguugcaccggcaccgcggucu

SEQ ID NO: 2971520 - RNA, 14 nt, Mycobacterium avium subsp. paratuberculosis
aguugcacggugua

SEQ ID NO: 2971521 - RNA, 22 nt, Mycobacterium avium subsp. paratuberculosis
aguugcacucucgcggcaaggc

SEQ ID NO: 2971522 - RNA, 21 nt, Mycobacterium avium subsp. paratuberculosis
aguugcacuuucggcagcuga

SEQ ID NO: 2971523 - RNA, 17 nt, Mycobacterium avium subsp. paratuberculosis
aguugccgccgccggga

SEQ ID NO: 2971524 - RNA, 13 nt, Mycobacterium avium subsp. paratuberculosis
aguugccggccau

SEQ ID NO: 2971525 - RNA, 19 nt, Mycobacterium avium subsp. paratuberculosis
aguugccggccaucugcug

SEQ ID NO: 2971526 - RNA, 15 nt, Mycobacterium avium subsp. paratuberculosis
aguugccggucaggc

SEQ ID NO: 2971527 - RNA, 22 nt, Mycobacterium avium subsp. paratuberculosis
aguugccguuguccuugagccg

SEQ ID NO: 2971528 - RNA, 22 nt, Mycobacterium avium subsp. paratuberculosis
aguugcgaccccgccgucgacg

SEQ ID NO: 2971529 - RNA, 21 nt, Mycobacterium avium subsp. paratuberculosis
aguugcgcgccgaugccgcgc

SEQ ID NO: 2971530 - RNA, 15 nt, Mycobacterium avium subsp. paratuberculosis
aguuggcggcgguga

SEQ ID NO: 2971531 - RNA, 23 nt, Mycobacterium avium subsp. paratuberculosis
aguuggcggcggugaucgccgga

SEQ ID NO: 2971532 - RNA, 15 nt, Mycobacterium avium subsp. paratuberculosis
aguuggcgucgggca

SEQ ID NO: 2971533 - RNA, 13 nt, Mycobacterium avium subsp. paratuberculosis
aguuggggccggc

SEQ ID NO: 2971534 - RNA, 14 nt, Mycobacterium avium subsp. paratuberculosis
aguugggggccagc

SEQ ID NO: 2971535 - RNA, 22 nt, Mycobacterium avium subsp. paratuberculosis
aguuggucaccaccaacgccac

SEQ ID NO: 2971536 - RNA, 21 nt, Mycobacterium avium subsp. paratuberculosis
aguuggucugaaagugacggg

SEQ ID NO: 2971537 - RNA, 15 nt, Mycobacterium avium subsp. paratuberculosis
aguuggugcugggca

SEQ ID NO: 2971538 - RNA, 23 nt, Mycobacterium avium subsp. paratuberculosis
aguuguagacguagugcagccgc

SEQ ID NO: 2971539 - RNA, 13 nt, Mycobacterium avium subsp. paratuberculosis
aguuguagcgcag

SEQ ID NO: 2971540 - RNA, 22 nt, Mycobacterium avium subsp. paratuberculosis
aguuguccccgauuucgcggcc

SEQ ID NO: 2971541 - RNA, 22 nt, Mycobacterium avium subsp. paratuberculosis
aguugucgaucuccucgcgcgg

SEQ ID NO: 2971542 - RNA, 14 nt, Mycobacterium avium subsp. paratuberculosis
aguuguuuccccag

SEQ ID NO: 2971543 - RNA, 18 nt, Mycobacterium avium subsp. paratuberculosis
aguuguuuccccagcccg

SEQ ID NO: 2971544 - RNA, 18 nt, Mycobacterium avium subsp. paratuberculosis
aguuuaccgugccucgcc

SEQ ID NO: 2971545 - RNA, 13 nt, Mycobacterium avium subsp. paratuberculosis
aguuucacgcugg

SEQ ID NO: 2971546 - RNA, 18 nt, Mycobacterium avium subsp. paratuberculosis
aguuucacgucggcgaug

SEQ ID NO: 2971547 - RNA, 20 nt, Mycobacterium avium subsp. paratuberculosis
aguuucacguucggcgggcg

SEQ ID NO: 2971548 - RNA, 18 nt, Mycobacterium avium subsp. paratuberculosis
aguuugcggugaucccag

SEQ ID NO: 2971549 - RNA, 14 nt, Mycobacterium avium subsp. paratuberculosis
auaaaccggccggc

SEQ ID NO: 2971550 - RNA, 13 nt, Mycobacterium avium subsp. paratuberculosis
auaaagcgggccc

SEQ ID NO: 2971551 - RNA, 16 nt, Mycobacterium avium subsp. paratuberculosis
auaaccgcgcggcgcc

SEQ ID NO: 2971552 - RNA, 19 nt, Mycobacterium avium subsp. paratuberculosis
auaaccgcgcggcgccccc

SEQ ID NO: 2971553 - RNA, 17 nt, Mycobacterium avium subsp. paratuberculosis
auaaccguucaccucuu

SEQ ID NO: 2971554 - RNA, 17 nt, Mycobacterium avium subsp. paratuberculosis
auaagcggauugaccag

SEQ ID NO: 2971555 - RNA, 19 nt, Mycobacterium avium subsp. paratuberculosis
auaagcggauugaccagca

SEQ ID NO: 2971556 - RNA, 22 nt, Mycobacterium avium subsp. paratuberculosis
auacaccguccagcucagcgcg

SEQ ID NO: 2971557 - RNA, 13 nt, Mycobacterium avium subsp. paratuberculosis
auacacgggccgu

SEQ ID NO: 2971558 - RNA, 17 nt, Mycobacterium avium subsp. paratuberculosis
auacaggagggccaggg

SEQ ID NO: 2971559 - RNA, 18 nt, Mycobacterium avium subsp. paratuberculosis
auaccacugcgcgcccga

SEQ ID NO: 2971560 - RNA, 14 nt, Mycobacterium avium subsp. paratuberculosis
auaccagccgcgga

SEQ ID NO: 2971561 - RNA, 15 nt, Mycobacterium avium subsp. paratuberculosis
auaccagccgcggac

SEQ ID NO: 2971562 - RNA, 17 nt, Mycobacterium avium subsp. paratuberculosis
auaccagugcccgagca

SEQ ID NO: 2971563 - RNA, 14 nt, Mycobacterium avium subsp. paratuberculosis
auacccgaccagca

SEQ ID NO: 2971564 - RNA, 15 nt, Mycobacterium avium subsp. paratuberculosis
auacccgaccagcac

SEQ ID NO: 2971565 - RNA, 21 nt, Mycobacterium avium subsp. paratuberculosis
auacccgaccagcaccgcggc

SEQ ID NO: 2971566 - RNA, 13 nt, Mycobacterium avium subsp. paratuberculosis
auacccgcccagc

SEQ ID NO: 2971567 - RNA, 23 nt, Mycobacterium avium subsp. paratuberculosis
auggcgcccagcgucucggcggc

SEQ ID NO: 2971568 - RNA, 22 nt, Mycobacterium avium subsp. paratuberculosis
auggcgcccggcagccgcuccg

SEQ ID NO: 2971569 - RNA, 23 nt, Mycobacterium avium subsp. paratuberculosis
auggcgccgaucgcgcgcaggaa

SEQ ID NO: 2971570 - RNA, 18 nt, Mycobacterium avium subsp. paratuberculosis
auggcgcggccggccgac

SEQ ID NO: 2971571 - RNA, 12 nt, Mycobacterium avium subsp. paratuberculosis
auggcgcggcgc

SEQ ID NO: 2971572 - RNA, 19 nt, Mycobacterium avium subsp. paratuberculosis
auggcggaacugacuucgg

SEQ ID NO: 2971573 - RNA, 15 nt, Mycobacterium avium subsp. paratuberculosis
auggcggcaucccca

SEQ ID NO: 2971574 - RNA, 14 nt, Mycobacterium avium subsp. paratuberculosis
auggcggccagccg

SEQ ID NO: 2971575 - RNA, 16 nt, Mycobacterium avium subsp. paratuberculosis
auggcggccagccggu

SEQ ID NO: 2971576 - RNA, 16 nt, Mycobacterium avium subsp. paratuberculosis
auggcggcccgcgccg

SEQ ID NO: 2971577 - RNA, 18 nt, Mycobacterium avium subsp. paratuberculosis
auggcggcccgcgccggc

SEQ ID NO: 2971578 - RNA, 13 nt, Mycobacterium avium subsp. paratuberculosis
auggcggccgccg

SEQ ID NO: 2971579 - RNA, 17 nt, Mycobacterium avium subsp. paratuberculosis
auggcggccgccgcgau

SEQ ID NO: 2971580 - RNA, 14 nt, Mycobacterium avium subsp. paratuberculosis
auggcggcgcgcuc

SEQ ID NO: 2971581 - RNA, 17 nt, Mycobacterium avium subsp. paratuberculosis
auggcggcggcccgccg

SEQ ID NO: 2971582 - RNA, 22 nt, Mycobacterium avium subsp. paratuberculosis
auggcggcggcccgccgcgccc

SEQ ID NO: 2971583 - RNA, 12 nt, Mycobacterium avium subsp. paratuberculosis
auggcggcggcu

SEQ ID NO: 2971584 - RNA, 13 nt, Mycobacterium avium subsp. paratuberculosis
auggcggcggcug

SEQ ID NO: 2971585 - RNA, 15 nt, Mycobacterium avium subsp. paratuberculosis
auggcggcggcugcc

SEQ ID NO: 2971586 - RNA, 15 nt, Mycobacterium avium subsp. paratuberculosis
auggcgggccgcuuc

SEQ ID NO: 2971587 - RNA, 14 nt, Mycobacterium avium subsp. paratuberculosis
auggcgggcgcgcc

SEQ ID NO: 2971588 - RNA, 17 nt, Mycobacterium avium subsp. paratuberculosis
auggcggucgcgccaga

SEQ ID NO: 2971589 - RNA, 15 nt, Mycobacterium avium subsp. paratuberculosis
auggcgguguggaga

SEQ ID NO: 2971590 - RNA, 17 nt, Mycobacterium avium subsp. paratuberculosis
auggcguagcgggucag

SEQ ID NO: 2971591 - RNA, 20 nt, Mycobacterium avium subsp. paratuberculosis
auggcgucgacgugcgcggc

SEQ ID NO: 2971592 - RNA, 13 nt, Mycobacterium avium subsp. paratuberculosis
auggcgucggcca

SEQ ID NO: 2971593 - RNA, 14 nt, Mycobacterium avium subsp. paratuberculosis
auggcgucggccag

SEQ ID NO: 2971594 - RNA, 16 nt, Mycobacterium avium subsp. paratuberculosis
auggcgugccggcgcu

SEQ ID NO: 2971595 - RNA, 17 nt, Mycobacterium avium subsp. paratuberculosis
auggcgugccggcgcug

SEQ ID NO: 2971596 - RNA, 14 nt, Mycobacterium avium subsp. paratuberculosis
auggcgugcugaug

SEQ ID NO: 2971597 - RNA, 20 nt, Mycobacterium avium subsp. paratuberculosis
auggcguucaucguccacac

SEQ ID NO: 2971598 - RNA, 18 nt, Mycobacterium avium subsp. paratuberculosis
auggcguucugcaccgac

SEQ ID NO: 2971599 - RNA, 18 nt, Mycobacterium avium subsp. paratuberculosis
auggcucagcgcaccgcc

SEQ ID NO: 2971600 - RNA, 14 nt, Mycobacterium avium subsp. paratuberculosis
auggcuguggauga

SEQ ID NO: 2971601 - RNA, 14 nt, Mycobacterium avium subsp. paratuberculosis
augggaucagcagc

SEQ ID NO: 2971602 - RNA, 12 nt, Mycobacterium avium subsp. paratuberculosis
augggcagcgcc

SEQ ID NO: 2971603 - RNA, 13 nt, Mycobacterium avium subsp. paratuberculosis
augggcagcgccc

SEQ ID NO: 2971604 - RNA, 22 nt, Mycobacterium avium subsp. paratuberculosis
augggcagcgccccgguccggc

SEQ ID NO: 2971605 - RNA, 11 nt, Mycobacterium avium subsp. paratuberculosis
augggcaucgu

SEQ ID NO: 2971606 - RNA, 21 nt, Mycobacterium avium subsp. paratuberculosis
augggcauugcccaucgccac

SEQ ID NO: 2971607 - RNA, 21 nt, Mycobacterium avium subsp. paratuberculosis
augggccagguccucgcuggc

SEQ ID NO: 2971608 - RNA, 14 nt, Mycobacterium avium subsp. paratuberculosis
augggcccggcccg

SEQ ID NO: 2971609 - RNA, 15 nt, Mycobacterium avium subsp. paratuberculosis
augggcccggcccgu

SEQ ID NO: 2971610 - RNA, 21 nt, Mycobacterium avium subsp. paratuberculosis
augggcgcacgaucgggcgca

SEQ ID NO: 2971611 - RNA, 18 nt, Mycobacterium avium subsp. paratuberculosis
augggcugcgcgucgagc

SEQ ID NO: 2971612 - RNA, 21 nt, Mycobacterium avium subsp. paratuberculosis
augggcugcgcgucgagcagc

SEQ ID NO: 2971613 - RNA, 15 nt, Mycobacterium avium subsp. paratuberculosis
auggggacgucgacg

SEQ ID NO: 2971614 - RNA, 22 nt, Mycobacterium avium subsp. paratuberculosis
auggggaucgaacggcaccucg

SEQ ID NO: 2971615 - RNA, 13 nt, Mycobacterium avium subsp. paratuberculosis
auggggauggugc

SEQ ID NO: 2971616 - RNA, 19 nt, Mycobacterium avium subsp. paratuberculosis
auggggauggugcgccggg

SEQ ID NO: 2971617 - RNA, 19 nt, Mycobacterium avium subsp. paratuberculosis
augggugaucgcggcccgc

SEQ ID NO: 2971618 - RNA, 21 nt, Mycobacterium avium subsp. paratuberculosis
auggucaccggagagcaacac

SEQ ID NO: 2971619 - RNA, 13 nt, Mycobacterium avium subsp. paratuberculosis
auggucaccgugu

SEQ ID NO: 2971620 - RNA, 13 nt, Mycobacterium avium subsp. paratuberculosis
auggucagcugcc

SEQ ID NO: 2971621 - RNA, 19 nt, Mycobacterium avium subsp. paratuberculosis
auggucagcugccgcaccg

SEQ ID NO: 2971622 - RNA, 15 nt, Mycobacterium avium subsp. paratuberculosis
auggucaggguguag

SEQ ID NO: 2971623 - RNA, 18 nt, Mycobacterium avium subsp. paratuberculosis
augguccccgggcccagc

SEQ ID NO: 2971624 - RNA, 15 nt, Mycobacterium avium subsp. paratuberculosis
auggucgagccgcag

SEQ ID NO: 2971625 - RNA, 22 nt, Mycobacterium avium subsp. paratuberculosis
auggucgagccgcagucgauca

SEQ ID NO: 2971626 - RNA, 12 nt, Mycobacterium avium subsp. paratuberculosis
auggucgcggcc

SEQ ID NO: 2971627 - RNA, 16 nt, Mycobacterium avium subsp. paratuberculosis
auggucgcggccgugu

SEQ ID NO: 2971628 - RNA, 23 nt, Mycobacterium avium subsp. paratuberculosis
auggucggcgacgccgucggggu

SEQ ID NO: 2971629 - RNA, 22 nt, Mycobacterium avium subsp. paratuberculosis
auggucgucggguuggccaggg

SEQ ID NO: 2971630 - RNA, 22 nt, Mycobacterium avium subsp. paratuberculosis
auggucgucguggugacgggcg

SEQ ID NO: 2971631 - RNA, 16 nt, Mycobacterium avium subsp. paratuberculosis
auggucucccgggcgg

SEQ ID NO: 2971632 - RNA, 17 nt, Mycobacterium avium subsp. paratuberculosis
auggucucccgggcggu

SEQ ID NO: 2971633 - RNA, 19 nt, Mycobacterium avium subsp. paratuberculosis
auggucugcccgccgccga

SEQ ID NO: 2971634 - RNA, 13 nt, Mycobacterium avium subsp. paratuberculosis
auggucuggauga

SEQ ID NO: 2971635 - RNA, 20 nt, Mycobacterium avium subsp. paratuberculosis
auggugaagcccagcgcguu

SEQ ID NO: 2971636 - RNA, 15 nt, Mycobacterium avium subsp. paratuberculosis
auggugaagccgugc

SEQ ID NO: 2971637 - RNA, 20 nt, Mycobacterium avium subsp. paratuberculosis
auggugaaggcgaacaccag

SEQ ID NO: 2971638 - RNA, 18 nt, Mycobacterium avium subsp. paratuberculosis
auggugaugugcggcgcg

SEQ ID NO: 2971639 - RNA, 23 nt, Mycobacterium avium subsp. paratuberculosis
auggugccgccggugaacacgaa

SEQ ID NO: 2971640 - RNA, 17 nt, Mycobacterium avium subsp. paratuberculosis
augguggccgucggccu

SEQ ID NO: 2971641 - RNA, 20 nt, Mycobacterium avium subsp. paratuberculosis
augguggccgucggccugcg

SEQ ID NO: 2971642 - RNA, 14 nt, Mycobacterium avium subsp. paratuberculosis
augguggcgcugcc

SEQ ID NO: 2971643 - RNA, 15 nt, Mycobacterium avium subsp. paratuberculosis
augguggcgcugccg

SEQ ID NO: 2971644 - RNA, 22 nt, Mycobacterium avium subsp. paratuberculosis
augguggcgcugccgagcaccu

SEQ ID NO: 2971645 - RNA, 13 nt, Mycobacterium avium subsp. paratuberculosis
augguggcggcca

SEQ ID NO: 2971646 - RNA, 15 nt, Mycobacterium avium subsp. paratuberculosis
augguggcggccacc

SEQ ID NO: 2971647 - RNA, 19 nt, Mycobacterium avium subsp. paratuberculosis
augguggcggcgccggaug

SEQ ID NO: 2971648 - RNA, 13 nt, Mycobacterium avium subsp. paratuberculosis
auggugggcaccg

SEQ ID NO: 2971649 - RNA, 23 nt, Mycobacterium avium subsp. paratuberculosis
auggugggcguggcgggccaggc

SEQ ID NO: 2971650 - RNA, 16 nt, Mycobacterium avium subsp. paratuberculosis
augguggucgccgucg

SEQ ID NO: 2971651 - RNA, 17 nt, Mycobacterium avium subsp. paratuberculosis
augguggucgccgucgu

SEQ ID NO: 2971652 - RNA, 23 nt, Mycobacterium avium subsp. paratuberculosis
augguguggaucgcuucggccag

SEQ ID NO: 2971653 - RNA, 20 nt, Mycobacterium avium subsp. paratuberculosis
augguguuccaccagcggcc

SEQ ID NO: 2971654 - RNA, 22 nt, Mycobacterium avium subsp. paratuberculosis
augguguuccaccagcggccgu

SEQ ID NO: 2971655 - RNA, 15 nt, Mycobacterium avium subsp. paratuberculosis
augguuuccacugcc

SEQ ID NO: 2971656 - RNA, 16 nt, Mycobacterium avium subsp. paratuberculosis
auguaagcgaauacca

SEQ ID NO: 2971657 - RNA, 15 nt, Mycobacterium avium subsp. paratuberculosis
auguagagcgggaug

SEQ ID NO: 2971658 - RNA, 14 nt, Mycobacterium avium subsp. paratuberculosis
auguagcagcgcgg

SEQ ID NO: 2971659 - RNA, 21 nt, Mycobacterium avium subsp. paratuberculosis
auguagcggcggucggcgccg

SEQ ID NO: 2971660 - RNA, 12 nt, Mycobacterium avium subsp. paratuberculosis
auguaggacagg

SEQ ID NO: 2971661 - RNA, 18 nt, Mycobacterium avium subsp. paratuberculosis
auguaguucagcagccgg

SEQ ID NO: 2971662 - RNA, 15 nt, Mycobacterium avium subsp. paratuberculosis
auguccacucgaugu

SEQ ID NO: 2971663 - RNA, 22 nt, Mycobacterium avium subsp. paratuberculosis
auguccccgcgggugacgcuga

SEQ ID NO: 2971664 - RNA, 13 nt, Mycobacterium avium subsp. paratuberculosis
auguccgaccggu

SEQ ID NO: 2971665 - RNA, 20 nt, Mycobacterium avium subsp. paratuberculosis
auguccggcaggcucagcag

SEQ ID NO: 2971666 - RNA, 22 nt, Mycobacterium avium subsp. paratuberculosis
auguccggcaggcucagcagca

SEQ ID NO: 2971667 - RNA, 15 nt, Mycobacterium avium subsp. paratuberculosis
auguccuacggcggg

SEQ ID NO: 2971668 - RNA, 16 nt, Mycobacterium avium subsp. paratuberculosis
auguccuccugcgccg

SEQ ID NO: 2971669 - RNA, 17 nt, Mycobacterium avium subsp. paratuberculosis
auguccucgggaaccca

SEQ ID NO: 2971670 - RNA, 19 nt, Mycobacterium avium subsp. paratuberculosis
auguccuuggugaugucgg

SEQ ID NO: 2971671 - RNA, 18 nt, Mycobacterium avium subsp. paratuberculosis
augucgaccucggccacc

SEQ ID NO: 2971672 - RNA, 20 nt, Mycobacterium avium subsp. paratuberculosis
augucgaccucggccaccac

SEQ ID NO: 2971673 - RNA, 21 nt, Mycobacterium avium subsp. paratuberculosis
augucgacgacguugcgggcc

SEQ ID NO: 2971674 - RNA, 19 nt, Mycobacterium avium subsp. paratuberculosis
augucgacgccgugcugcc

SEQ ID NO: 2971675 - RNA, 21 nt, Mycobacterium avium subsp. paratuberculosis
augucgacgccgugcugccgg

SEQ ID NO: 2971676 - RNA, 18 nt, Mycobacterium avium subsp. paratuberculosis
augucgaugacggcggcg

SEQ ID NO: 2971677 - RNA, 13 nt, Mycobacterium avium subsp. paratuberculosis
augucgcaacggu

SEQ ID NO: 2971678 - RNA, 18 nt, Mycobacterium avium subsp. paratuberculosis
augucgcaacggucggga

SEQ ID NO: 2971679 - RNA, 14 nt, Mycobacterium avium subsp. paratuberculosis
augucgcccggcgc

SEQ ID NO: 2971680 - RNA, 14 nt, Mycobacterium avium subsp. paratuberculosis
augucgccgaacgc

SEQ ID NO: 2971681 - RNA, 13 nt, Mycobacterium avium subsp. paratuberculosis
augucgccgcaga

SEQ ID NO: 2971682 - RNA, 14 nt, Mycobacterium avium subsp. paratuberculosis
augucgccggcggc

SEQ ID NO: 2971683 - RNA, 15 nt, Mycobacterium avium subsp. paratuberculosis
augucgccggcggcg

SEQ ID NO: 2971684 - RNA, 22 nt, Mycobacterium avium subsp. paratuberculosis
augucgcgcagcauccgcacca

SEQ ID NO: 2971685 - RNA, 18 nt, Mycobacterium avium subsp. paratuberculosis
augucgcgggcgaaagau

SEQ ID NO: 2971686 - RNA, 16 nt, Mycobacterium avium subsp. paratuberculosis
augucgcugccgccgc

SEQ ID NO: 2971687 - RNA, 20 nt, Mycobacterium avium subsp. paratuberculosis
augucggccagcgcggcggc

SEQ ID NO: 2971688 - RNA, 13 nt, Mycobacterium avium subsp. paratuberculosis
augucggccggca

SEQ ID NO: 2971689 - RNA, 14 nt, Mycobacterium avium subsp. paratuberculosis
augucggccggcag

SEQ ID NO: 2971690 - RNA, 16 nt, Mycobacterium avium subsp. paratuberculosis
augucggccgguccgu

SEQ ID NO: 2971691 - RNA, 18 nt, Mycobacterium avium subsp. paratuberculosis
augucggcgaaccagggc

SEQ ID NO: 2971692 - RNA, 14 nt, Mycobacterium avium subsp. paratuberculosis
augucggcggcccg

SEQ ID NO: 2971693 - RNA, 13 nt, Mycobacterium avium subsp. paratuberculosis
augucggcggccg

SEQ ID NO: 2971694 - RNA, 15 nt, Mycobacterium avium subsp. paratuberculosis
augucggcggccggg

SEQ ID NO: 2971695 - RNA, 12 nt, Mycobacterium avium subsp. paratuberculosis
augucggcgggc

SEQ ID NO: 2971696 - RNA, 17 nt, Mycobacterium avium subsp. paratuberculosis
augucggcgucgccgag

SEQ ID NO: 2971697 - RNA, 16 nt, Mycobacterium avium subsp. paratuberculosis
augucggcguuggucc

SEQ ID NO: 2971698 - RNA, 15 nt, Mycobacterium avium subsp. paratuberculosis
augucggugagcgcc

SEQ ID NO: 2971699 - RNA, 22 nt, Mycobacterium avium subsp. paratuberculosis
augucggugccgauccgcaccg

SEQ ID NO: 2971700 - RNA, 18 nt, Mycobacterium avium subsp. paratuberculosis
augucggugcggcgggcu

SEQ ID NO: 2971701 - RNA, 20 nt, Mycobacterium avium subsp. paratuberculosis
augucgguggacagcgcgac

SEQ ID NO: 2971702 - RNA, 17 nt, Mycobacterium avium subsp. paratuberculosis
augucggugggccgcac

SEQ ID NO: 2971703 - RNA, 16 nt, Mycobacterium avium subsp. paratuberculosis
augucguacgggcgca

SEQ ID NO: 2971704 - RNA, 23 nt, Mycobacterium avium subsp. paratuberculosis
augucguagaacucgccguggaa

SEQ ID NO: 2971705 - RNA, 15 nt, Mycobacterium avium subsp. paratuberculosis
augucguccucgguc

SEQ ID NO: 2971706 - RNA, 22 nt, Mycobacterium avium subsp. paratuberculosis
augucguccucggucaggccgu

SEQ ID NO: 2971707 - RNA, 13 nt, Mycobacterium avium subsp. paratuberculosis
augucgucgccgg

SEQ ID NO: 2971708 - RNA, 23 nt, Mycobacterium avium subsp. paratuberculosis
augucgucgccgguggccgccgg

SEQ ID NO: 2971709 - RNA, 16 nt, Mycobacterium avium subsp. paratuberculosis
augucgucgucgacgc

SEQ ID NO: 2971710 - RNA, 21 nt, Mycobacterium avium subsp. paratuberculosis
augucgucguugugggccagc

SEQ ID NO: 2971711 - RNA, 19 nt, Mycobacterium avium subsp. paratuberculosis
augucgugcggucgcacca

SEQ ID NO: 2971712 - RNA, 16 nt, Mycobacterium avium subsp. paratuberculosis
augucguugaugccgu

SEQ ID NO: 2971713 - RNA, 17 nt, Mycobacterium avium subsp. paratuberculosis
augugaucggcggccac

SEQ ID NO: 2971714 - RNA, 18 nt, Mycobacterium avium subsp. paratuberculosis
augugaucggcggccacc

SEQ ID NO: 2971715 - RNA, 23 nt, Mycobacterium avium subsp. paratuberculosis
augugccacagguacagggucau

SEQ ID NO: 2971716 - RNA, 15 nt, Mycobacterium avium subsp. paratuberculosis
augugccugcgggcc

SEQ ID NO: 2971717 - RNA, 16 nt, Mycobacterium avium subsp. paratuberculosis
augugccugcgggccc

SEQ ID NO: 2971718 - RNA, 19 nt, Mycobacterium avium subsp. paratuberculosis
augugccugcgggcccagc

SEQ ID NO: 2971719 - RNA, 22 nt, Mycobacterium avium subsp. paratuberculosis
augugcgcgcuggccgcgugca

SEQ ID NO: 2971720 - RNA, 20 nt, Mycobacterium avium subsp. paratuberculosis
augugcgugguugcaaucuc

SEQ ID NO: 2971721 - RNA, 20 nt, Mycobacterium avium subsp. paratuberculosis
augugcucggucaacccgau

SEQ ID NO: 2971722 - RNA, 19 nt, Mycobacterium avium subsp. paratuberculosis
augugcuugaucagcgggc

SEQ ID NO: 2971723 - RNA, 20 nt, Mycobacterium avium subsp. paratuberculosis
augugcuugaucagcgggcu

SEQ ID NO: 2971724 - RNA, 16 nt, Mycobacterium avium subsp. paratuberculosis
auguggaagccgcgau

SEQ ID NO: 2971725 - RNA, 13 nt, Mycobacterium avium subsp. paratuberculosis
auguggccgucgc

SEQ ID NO: 2971726 - RNA, 16 nt, Mycobacterium avium subsp. paratuberculosis
auguggccgucgccga

SEQ ID NO: 2971727 - RNA, 22 nt, Mycobacterium avium subsp. paratuberculosis
auguggcgggcguccugcgggg

SEQ ID NO: 2971728 - RNA, 22 nt, Mycobacterium avium subsp. paratuberculosis
auguggcguucgaugcccugcc

SEQ ID NO: 2971729 - RNA, 14 nt, Mycobacterium avium subsp. paratuberculosis
augugggccgcagc

SEQ ID NO: 2971730 - RNA, 15 nt, Mycobacterium avium subsp. paratuberculosis
augugggccgcagca

SEQ ID NO: 2971731 - RNA, 17 nt, Mycobacterium avium subsp. paratuberculosis
auguggggggucggagc

SEQ ID NO: 2971732 - RNA, 14 nt, Mycobacterium avium subsp. paratuberculosis
auguggucggccac

SEQ ID NO: 2971733 - RNA, 19 nt, Mycobacterium avium subsp. paratuberculosis
auguggucggccacgacgc

SEQ ID NO: 2971734 - RNA, 20 nt, Mycobacterium avium subsp. paratuberculosis
auguggucggccacgacgcg

SEQ ID NO: 2971735 - RNA, 17 nt, Mycobacterium avium subsp. paratuberculosis
augugguugcuggcguc

SEQ ID NO: 2971736 - RNA, 17 nt, Mycobacterium avium subsp. paratuberculosis
augugguugggccaggc

SEQ ID NO: 2971737 - RNA, 21 nt, Mycobacterium avium subsp. paratuberculosis
auguucaaucccguugcggug

SEQ ID NO: 2971738 - RNA, 18 nt, Mycobacterium avium subsp. paratuberculosis
auguucaccccggcgcgg

SEQ ID NO: 2971739 - RNA, 16 nt, Mycobacterium avium subsp. paratuberculosis
auguucaguucgucca

SEQ ID NO: 2971740 - RNA, 16 nt, Mycobacterium avium subsp. paratuberculosis
auguucuccggcccgg

SEQ ID NO: 2971741 - RNA, 17 nt, Mycobacterium avium subsp. paratuberculosis
auguugaccacccgcag

SEQ ID NO: 2971742 - RNA, 23 nt, Mycobacterium avium subsp. paratuberculosis
auguugcggcggccggccagcag

SEQ ID NO: 2971743 - RNA, 16 nt, Mycobacterium avium subsp. paratuberculosis
auuaaccggcaggccg

SEQ ID NO: 2971744 - RNA, 23 nt, Mycobacterium avium subsp. paratuberculosis
auuagcgcguguccagaacucgg

SEQ ID NO: 2971745 - RNA, 18 nt, Mycobacterium avium subsp. paratuberculosis
auucagcaccuuccaucg

SEQ ID NO: 2971746 - RNA, 18 nt, Mycobacterium avium subsp. paratuberculosis
auucagccggcgguucgg

SEQ ID NO: 2971747 - RNA, 13 nt, Mycobacterium avium subsp. paratuberculosis
auucaggccacgc

SEQ ID NO: 2971748 - RNA, 17 nt, Mycobacterium avium subsp. paratuberculosis
auucaucgcgcaccagg

SEQ ID NO: 2971749 - RNA, 17 nt, Mycobacterium avium subsp. paratuberculosis
auuccagaucugucuuc

SEQ ID NO: 2971750 - RNA, 21 nt, Mycobacterium avium subsp. paratuberculosis
auuccagcgacaacagcacga

SEQ ID NO: 2971751 - RNA, 12 nt, Mycobacterium avium subsp. paratuberculosis
auuccagcgcca

SEQ ID NO: 2971752 - RNA, 22 nt, Mycobacterium avium subsp. paratuberculosis
auuccagcgcgaccgcccgggc

SEQ ID NO: 2971753 - RNA, 21 nt, Mycobacterium avium subsp. paratuberculosis
auuccccggcgugucgcgugc

SEQ ID NO: 2971754 - RNA, 20 nt, Mycobacterium avium subsp. paratuberculosis
auuccccguagucacccggc

SEQ ID NO: 2971755 - RNA, 17 nt, Mycobacterium avium subsp. paratuberculosis
auucccgaccccgccag

SEQ ID NO: 2971756 - RNA, 21 nt, Mycobacterium avium subsp. paratuberculosis
auucccgaccccgccagcacc

SEQ ID NO: 2971757 - RNA, 15 nt, Mycobacterium avium subsp. paratuberculosis
auuccgccgaaaccc

SEQ ID NO: 2971758 - RNA, 16 nt, Mycobacterium avium subsp. paratuberculosis
auuccgccgcgcccgu

SEQ ID NO: 2971759 - RNA, 20 nt, Mycobacterium avium subsp. paratuberculosis
auuccggcacccgccagccc

SEQ ID NO: 2971760 - RNA, 18 nt, Mycobacterium avium subsp. paratuberculosis
auuccggcaucggcucgu

SEQ ID NO: 2971761 - RNA, 15 nt, Mycobacterium avium subsp. paratuberculosis
auuccggccggccgc

SEQ ID NO: 2971762 - RNA, 17 nt, Mycobacterium avium subsp. paratuberculosis
auuccggccggccgccg

SEQ ID NO: 2971763 - RNA, 19 nt, Mycobacterium avium subsp. paratuberculosis
auuccggccggccgccggc

SEQ ID NO: 2971764 - RNA, 16 nt, Mycobacterium avium subsp. paratuberculosis
auuccggcgcgaucgg

SEQ ID NO: 2971765 - RNA, 15 nt, Mycobacterium avium subsp. paratuberculosis
auuccgucuuggcca

SEQ ID NO: 2971766 - RNA, 18 nt, Mycobacterium avium subsp. paratuberculosis
auuccgucuuggccaggc

SEQ ID NO: 2971767 - RNA, 15 nt, Mycobacterium avium subsp. paratuberculosis
auuccucggaccggu

SEQ ID NO: 2971768 - RNA, 18 nt, Mycobacterium avium subsp. paratuberculosis
auucgaacugggugggca

SEQ ID NO: 2971769 - RNA, 20 nt, Mycobacterium avium subsp. paratuberculosis
auucgaagaacacgcaggug

SEQ ID NO: 2971770 - RNA, 12 nt, Mycobacterium avium subsp. paratuberculosis
auucgaagcccg

SEQ ID NO: 2971771 - RNA, 17 nt, Mycobacterium avium subsp. paratuberculosis
auucgaggucaucgagc

SEQ ID NO: 2971772 - RNA, 22 nt, Mycobacterium avium subsp. paratuberculosis
auucgaucaaaucccgcagcuc

SEQ ID NO: 2971773 - RNA, 15 nt, Mycobacterium avium subsp. paratuberculosis
auucgcccagcggca

SEQ ID NO: 2971774 - RNA, 13 nt, Mycobacterium avium subsp. paratuberculosis
auucgcgcaccuu

SEQ ID NO: 2971775 - RNA, 14 nt, Mycobacterium avium subsp. paratuberculosis
auucgcgcugccag

SEQ ID NO: 2971776 - RNA, 18 nt, Mycobacterium avium subsp. paratuberculosis
auucgcgggugcgcucga

SEQ ID NO: 2971777 - RNA, 19 nt, Mycobacterium avium subsp. paratuberculosis
auucgcgggugcgcucgac

SEQ ID NO: 2971778 - RNA, 22 nt, Mycobacterium avium subsp. paratuberculosis
auucgcgugugcccagcacgac

SEQ ID NO: 2971779 - RNA, 15 nt, Mycobacterium avium subsp. paratuberculosis
auucgcugccccggc

SEQ ID NO: 2971780 - RNA, 15 nt, Mycobacterium avium subsp. paratuberculosis
auucggaacccugcc

SEQ ID NO: 2971781 - RNA, 18 nt, Mycobacterium avium subsp. paratuberculosis
auucggcgaucucgucgc

SEQ ID NO: 2971782 - RNA, 19 nt, Mycobacterium avium subsp. paratuberculosis
auucggcgccgcgaccccg

SEQ ID NO: 2971783 - RNA, 21 nt, Mycobacterium avium subsp. paratuberculosis
auucggcgccgcgaccccgga

SEQ ID NO: 2971784 - RNA, 13 nt, Mycobacterium avium subsp. paratuberculosis
auucggcuccugc

SEQ ID NO: 2971785 - RNA, 13 nt, Mycobacterium avium subsp. paratuberculosis
auucgggccagcg

SEQ ID NO: 2971786 - RNA, 21 nt, Mycobacterium avium subsp. paratuberculosis
auucgggccugaccaaggaca

SEQ ID NO: 2971787 - RNA, 19 nt, Mycobacterium avium subsp. paratuberculosis
auucggguggcgucgccgc

SEQ ID NO: 2971788 - RNA, 23 nt, Mycobacterium avium subsp. paratuberculosis
auucggugagccaguucgccagc

SEQ ID NO: 2971789 - RNA, 19 nt, Mycobacterium avium subsp. paratuberculosis
auucgucauggacagccac

SEQ ID NO: 2971790 - RNA, 15 nt, Mycobacterium avium subsp. paratuberculosis
auucugcagccgcac

SEQ ID NO: 2971791 - RNA, 15 nt, Mycobacterium avium subsp. paratuberculosis
auucuggccgaccgc

SEQ ID NO: 2971792 - RNA, 17 nt, Mycobacterium avium subsp. paratuberculosis
auucuucuucagccccu

SEQ ID NO: 2971793 - RNA, 17 nt, Mycobacterium avium subsp. paratuberculosis
auugaagaagcgggcca

SEQ ID NO: 2971794 - RNA, 18 nt, Mycobacterium avium subsp. paratuberculosis
auugaagaagcgggccaa

SEQ ID NO: 2971795 - RNA, 23 nt, Mycobacterium avium subsp. paratuberculosis
auugaagcccugcucggugaugc

SEQ ID NO: 2971796 - RNA, 24 nt, Mycobacterium avium subsp. paratuberculosis
auugaagcccugcucggugaugcc

SEQ ID NO: 2971797 - RNA, 13 nt, Mycobacterium avium subsp. paratuberculosis
auugacggcccac

SEQ ID NO: 2971798 - RNA, 20 nt, Mycobacterium avium subsp. paratuberculosis
auugacggcccacgucgcgc

SEQ ID NO: 2971799 - RNA, 15 nt, Mycobacterium avium subsp. paratuberculosis
auugaggcuggcgau

SEQ ID NO: 2971800 - RNA, 17 nt, Mycobacterium avium subsp. paratuberculosis
auugaggcuggcgauca

SEQ ID NO: 2971801 - RNA, 17 nt, Mycobacterium avium subsp. paratuberculosis
auugagguagucggccc

SEQ ID NO: 2971802 - RNA, 15 nt, Mycobacterium avium subsp. paratuberculosis
auugcacggcggcga

SEQ ID NO: 2971803 - RNA, 17 nt, Mycobacterium avium subsp. paratuberculosis
auugccagcuucgggcg

SEQ ID NO: 2971804 - RNA, 15 nt, Mycobacterium avium subsp. paratuberculosis
auugcccgacuccuc

SEQ ID NO: 2971805 - RNA, 22 nt, Mycobacterium avium subsp. paratuberculosis
auugcccgacuccucacaccuc

SEQ ID NO: 2971806 - RNA, 16 nt, Mycobacterium avium subsp. paratuberculosis
auugccgagcaccccg

SEQ ID NO: 2971807 - RNA, 20 nt, Mycobacterium avium subsp. paratuberculosis
auugccgagcaccccgucga

SEQ ID NO: 2971808 - RNA, 18 nt, Mycobacterium avium subsp. paratuberculosis
auugccgggcaccagcga

SEQ ID NO: 2971809 - RNA, 20 nt, Mycobacterium avium subsp. paratuberculosis
auugccgguggugcggcccu

SEQ ID NO: 2971810 - RNA, 14 nt, Mycobacterium avium subsp. paratuberculosis
auugcgagcaggcc

SEQ ID NO: 2971811 - RNA, 15 nt, Mycobacterium avium subsp. paratuberculosis
auugcgagccggucu

SEQ ID NO: 2971812 - RNA, 13 nt, Mycobacterium avium subsp. paratuberculosis
auugcgccagcag

SEQ ID NO: 2971813 - RNA, 16 nt, Mycobacterium avium subsp. paratuberculosis
auugcgcugcaccgca

SEQ ID NO: 2971814 - RNA, 17 nt, Mycobacterium avium subsp. paratuberculosis
auugcgcugcaccgcag

SEQ ID NO: 2971815 - RNA, 19 nt, Mycobacterium avium subsp. paratuberculosis
auugcgcuugucagcggcc

SEQ ID NO: 2971816 - RNA, 19 nt, Mycobacterium avium subsp. paratuberculosis
auugcggcaccagucgcgc

SEQ ID NO: 2971817 - RNA, 23 nt, Mycobacterium avium subsp. paratuberculosis
auugcggcccuugcggccgauca

SEQ ID NO: 2971818 - RNA, 14 nt, Mycobacterium avium subsp. paratuberculosis
auugcgugcccggc

SEQ ID NO: 2971819 - RNA, 17 nt, Mycobacterium avium subsp. paratuberculosis
auugcuuacgcaucgcc

SEQ ID NO: 2971820 - RNA, 19 nt, Mycobacterium avium subsp. paratuberculosis
auugcuuuuugaccaccgg

SEQ ID NO: 2971821 - RNA, 14 nt, Mycobacterium avium subsp. paratuberculosis
auuggacagcggcg

SEQ ID NO: 2971822 - RNA, 15 nt, Mycobacterium avium subsp. paratuberculosis
auuggacagcggcgc

SEQ ID NO: 2971823 - RNA, 18 nt, Mycobacterium avium subsp. paratuberculosis
auuggccuuuugcaccaa

SEQ ID NO: 2971824 - RNA, 21 nt, Mycobacterium avium subsp. paratuberculosis
auuggcgucgguggcggcggc

SEQ ID NO: 2971825 - RNA, 11 nt, Mycobacterium avium subsp. paratuberculosis
auugggcuggg

SEQ ID NO: 2971826 - RNA, 21 nt, Mycobacterium avium subsp. paratuberculosis
auugucgcuguuagccucgcc

SEQ ID NO: 2971827 - RNA, 11 nt, Mycobacterium avium subsp. paratuberculosis
auugucggccg

SEQ ID NO: 2971828 - RNA, 13 nt, Mycobacterium avium subsp. paratuberculosis
auuguucggccac

SEQ ID NO: 2971829 - RNA, 14 nt, Mycobacterium avium subsp. paratuberculosis
auuguucggccacc

SEQ ID NO: 2971830 - RNA, 16 nt, Mycobacterium avium subsp. paratuberculosis
auuguucggccaccgc

SEQ ID NO: 2971831 - RNA, 17 nt, Mycobacterium avium subsp. paratuberculosis
auuucacgucugcucgg

SEQ ID NO: 2971832 - RNA, 15 nt, Mycobacterium avium subsp. paratuberculosis
auuucaucgcggcga

SEQ ID NO: 2971833 - RNA, 21 nt, Mycobacterium avium subsp. paratuberculosis
auuucccgacuccucacaccu

SEQ ID NO: 2971834 - RNA, 22 nt, Mycobacterium avium subsp. paratuberculosis
auuucccgacuccucacaccuc

SEQ ID NO: 2971835 - RNA, 19 nt, Mycobacterium avium subsp. paratuberculosis
auuuccgguuccucggcgu

SEQ ID NO: 2971836 - RNA, 23 nt, Mycobacterium avium subsp. paratuberculosis
auuuccguugugccaccgccgau

SEQ ID NO: 2971837 - RNA, 15 nt, Mycobacterium avium subsp. paratuberculosis
auuucggccagccgg

SEQ ID NO: 2971838 - RNA, 15 nt, Mycobacterium avium subsp. paratuberculosis
auuucggucggcagg

SEQ ID NO: 2971839 - RNA, 18 nt, Mycobacterium avium subsp. paratuberculosis
auuugccgacaugcuggg

SEQ ID NO: 2971840 - RNA, 15 nt, Mycobacterium avium subsp. paratuberculosis
auuuguuguuuuugg

SEQ ID NO: 2971841 - RNA, 21 nt, Mycobacterium avium subsp. paratuberculosis
auuuucgguuucauucaccgc

SEQ ID NO: 2971842 - RNA, 17 nt, Mycobacterium avium subsp. paratuberculosis
auuuugaaauagccgcg

SEQ ID NO: 2971843 - RNA, 17 nt, Mycobacterium avium subsp. paratuberculosis
caaaaacgagaugcccc

SEQ ID NO: 2971844 - RNA, 12 nt, Mycobacterium avium subsp. paratuberculosis
caaaacaucccg

SEQ ID NO: 2971845 - RNA, 13 nt, Mycobacterium avium subsp. paratuberculosis
caaaacgcugggc

SEQ ID NO: 2971846 - RNA, 18 nt, Mycobacterium avium subsp. paratuberculosis
caaaacgcugggcgccgg

SEQ ID NO: 2971847 - RNA, 20 nt, Mycobacterium avium subsp. paratuberculosis
caaaacgugauagcggccgc

SEQ ID NO: 2971848 - RNA, 19 nt, Mycobacterium avium subsp. paratuberculosis
caaaagcauccggccgucg

SEQ ID NO: 2971849 - RNA, 20 nt, Mycobacterium avium subsp. paratuberculosis
caaaagccccgcgacacgcc

SEQ ID NO: 2971850 - RNA, 22 nt, Mycobacterium avium subsp. paratuberculosis
caaaagggcccaugccgccauc

SEQ ID NO: 2971851 - RNA, 22 nt, Mycobacterium avium subsp. paratuberculosis
caaaaguguuuccgcugaggcg

SEQ ID NO: 2971852 - RNA, 18 nt, Mycobacterium avium subsp. paratuberculosis
caaaaugcguuccgcgac

SEQ ID NO: 2971853 - RNA, 15 nt, Mycobacterium avium subsp. paratuberculosis
caaacacgagcagac

SEQ ID NO: 2971854 - RNA, 21 nt, Mycobacterium avium subsp. paratuberculosis
caaacacgagcagacccgccg

SEQ ID NO: 2971855 - RNA, 16 nt, Mycobacterium avium subsp. paratuberculosis
caaacagcgcggccgg

SEQ ID NO: 2971856 - RNA, 18 nt, Mycobacterium avium subsp. paratuberculosis
caaacagguuggcgccga

SEQ ID NO: 2971857 - RNA, 22 nt, Mycobacterium avium subsp. paratuberculosis
caaacagguuggcgccgaaggc

SEQ ID NO: 2971858 - RNA, 19 nt, Mycobacterium avium subsp. paratuberculosis
caaacccauugucgccgug

SEQ ID NO: 2971859 - RNA, 21 nt, Mycobacterium avium subsp. paratuberculosis
caaaccccuuggcguccaugu

SEQ ID NO: 2971860 - RNA, 13 nt, Mycobacterium avium subsp. paratuberculosis
caaacccgggaug

SEQ ID NO: 2971861 - RNA, 14 nt, Mycobacterium avium subsp. paratuberculosis
caaaccgaccgccg

SEQ ID NO: 2971862 - RNA, 15 nt, Mycobacterium avium subsp. paratuberculosis
caaaccgcgucuugg

SEQ ID NO: 2971863 - RNA, 15 nt, Mycobacterium avium subsp. paratuberculosis
caaaccggaccgccg

SEQ ID NO: 2971864 - RNA, 16 nt, Mycobacterium avium subsp. paratuberculosis
caaaccggaccgccgc

SEQ ID NO: 2971865 - RNA, 19 nt, Mycobacterium avium subsp. paratuberculosis
caaaccggaccgccgcggc

SEQ ID NO: 2971866 - RNA, 18 nt, Mycobacterium avium subsp. paratuberculosis
caaaccguugaccaccag

SEQ ID NO: 2971867 - RNA, 19 nt, Mycobacterium avium subsp. paratuberculosis
caaaccguugaccaccagg

SEQ ID NO: 2971868 - RNA, 17 nt, Mycobacterium avium subsp. paratuberculosis
caaaccguuuucggcgc

SEQ ID NO: 2971869 - RNA, 23 nt, Mycobacterium avium subsp. paratuberculosis
caaaccguuuucggcgcgcagcu

SEQ ID NO: 2971870 - RNA, 16 nt, Mycobacterium avium subsp. paratuberculosis
caaagacgacggcucc

SEQ ID NO: 2971871 - RNA, 13 nt, Mycobacterium avium subsp. paratuberculosis
caaagccguucgc

SEQ ID NO: 2971872 - RNA, 19 nt, Mycobacterium avium subsp. paratuberculosis
caaagguaguccagcacag

SEQ ID NO: 2971873 - RNA, 21 nt, Mycobacterium avium subsp. paratuberculosis
caaagguaguccagcacagca

SEQ ID NO: 2971874 - RNA, 19 nt, Mycobacterium avium subsp. paratuberculosis
caaauagccgucggcggcc

SEQ ID NO: 2971875 - RNA, 14 nt, Mycobacterium avium subsp. paratuberculosis
caaaucccgcagcu

SEQ ID NO: 2971876 - RNA, 14 nt, Mycobacterium avium subsp. paratuberculosis
caaauccggcagcg

SEQ ID NO: 2971877 - RNA, 16 nt, Mycobacterium avium subsp. paratuberculosis
caaauccggcagcgcu

SEQ ID NO: 2971878 - RNA, 21 nt, Mycobacterium avium subsp. paratuberculosis
caaaucgcuugcgccgcagcg

SEQ ID NO: 2971879 - RNA, 18 nt, Mycobacterium avium subsp. paratuberculosis
caacaacucgacgcucgg

SEQ ID NO: 2971880 - RNA, 19 nt, Mycobacterium avium subsp. paratuberculosis
caacaacucgacguucggc

SEQ ID NO: 2971881 - RNA, 21 nt, Mycobacterium avium subsp. paratuberculosis
caacaacucgacguucggcgg

SEQ ID NO: 2971882 - RNA, 21 nt, Mycobacterium avium subsp. paratuberculosis
caacacagccaaucgccgaug

SEQ ID NO: 2971883 - RNA, 21 nt, Mycobacterium avium subsp. paratuberculosis
caacaccagcuggauggcgcc

SEQ ID NO: 2971884 - RNA, 18 nt, Mycobacterium avium subsp. paratuberculosis
caacaccagggugcgcag

SEQ ID NO: 2971885 - RNA, 19 nt, Mycobacterium avium subsp. paratuberculosis
caacaccagggugcgcagc

SEQ ID NO: 2971886 - RNA, 23 nt, Mycobacterium avium subsp. paratuberculosis
caacaccagggugcgcagcgcgu

SEQ ID NO: 2971887 - RNA, 15 nt, Mycobacterium avium subsp. paratuberculosis
caacacccagccgcu

SEQ ID NO: 2971888 - RNA, 20 nt, Mycobacterium avium subsp. paratuberculosis
caacacccccgcgcugccca

SEQ ID NO: 2971889 - RNA, 17 nt, Mycobacterium avium subsp. paratuberculosis
caacaccgaaagccgac

SEQ ID NO: 2971890 - RNA, 14 nt, Mycobacterium avium subsp. paratuberculosis
caacaccgccagca

SEQ ID NO: 2971891 - RNA, 17 nt, Mycobacterium avium subsp. paratuberculosis
caacaccgccagcaccg

SEQ ID NO: 2971892 - RNA, 18 nt, Mycobacterium avium subsp. paratuberculosis
caacaccgccagcaccgc

SEQ ID NO: 2971893 - RNA, 14 nt, Mycobacterium avium subsp. paratuberculosis
caacaccggcacga

SEQ ID NO: 2971894 - RNA, 14 nt, Mycobacterium avium subsp. paratuberculosis
caacaccggcggcg

SEQ ID NO: 2971895 - RNA, 22 nt, Mycobacterium avium subsp. paratuberculosis
caacaccggcggcgacggcacc

SEQ ID NO: 2971896 - RNA, 23 nt, Mycobacterium avium subsp. paratuberculosis
caacaccgggauccggcgcgccg

SEQ ID NO: 2971897 - RNA, 18 nt, Mycobacterium avium subsp. paratuberculosis
caacaccgguccggccgu

SEQ ID NO: 2971898 - RNA, 14 nt, Mycobacterium avium subsp. paratuberculosis
caacaccucggcga

SEQ ID NO: 2971899 - RNA, 14 nt, Mycobacterium avium subsp. paratuberculosis
caacaccucgggca

SEQ ID NO: 2971900 - RNA, 14 nt, Mycobacterium avium subsp. paratuberculosis
caacacgcccugca

SEQ ID NO: 2971901 - RNA, 14 nt, Mycobacterium avium subsp. paratuberculosis
caacacgccggcgg

SEQ ID NO: 2971902 - RNA, 15 nt, Mycobacterium avium subsp. paratuberculosis
caacacgccggcggc

SEQ ID NO: 2971903 - RNA, 16 nt, Mycobacterium avium subsp. paratuberculosis
caacacgccggcggcc

SEQ ID NO: 2971904 - RNA, 16 nt, Mycobacterium avium subsp. paratuberculosis
caacacggccucgauc

SEQ ID NO: 2971905 - RNA, 13 nt, Mycobacterium avium subsp. paratuberculosis
caacacggcggcg

SEQ ID NO: 2971906 - RNA, 19 nt, Mycobacterium avium subsp. paratuberculosis
caacacggcggcgcgcacg

SEQ ID NO: 2971907 - RNA, 16 nt, Mycobacterium avium subsp. paratuberculosis
caacacguagucgccg

SEQ ID NO: 2971908 - RNA, 19 nt, Mycobacterium avium subsp. paratuberculosis
caacacguagucgccgaug

SEQ ID NO: 2971909 - RNA, 18 nt, Mycobacterium avium subsp. paratuberculosis
caacacguccuggcgcca

SEQ ID NO: 2971910 - RNA, 18 nt, Mycobacterium avium subsp. paratuberculosis
caacacgucgucgugcgc

SEQ ID NO: 2971911 - RNA, 22 nt, Mycobacterium avium subsp. paratuberculosis
caacacguugagucccucggcg

SEQ ID NO: 2971912 - RNA, 23 nt, Mycobacterium avium subsp. paratuberculosis
caacacguugagucccucggcga

SEQ ID NO: 2971913 - RNA, 15 nt, Mycobacterium avium subsp. paratuberculosis
caacacucgagcgcg

SEQ ID NO: 2971914 - RNA, 18 nt, Mycobacterium avium subsp. paratuberculosis
caacacuuuuaaggagca

SEQ ID NO: 2971915 - RNA, 15 nt, Mycobacterium avium subsp. paratuberculosis
caacagcaccagcac

SEQ ID NO: 2971916 - RNA, 22 nt, Mycobacterium avium subsp. paratuberculosis
caacagcaccagcaccaccgug

SEQ ID NO: 2971917 - RNA, 18 nt, Mycobacterium avium subsp. paratuberculosis
caacagcagcagaaccag

SEQ ID NO: 2971918 - RNA, 23 nt, Mycobacterium avium subsp. paratuberculosis
caacagcagcagaaccagcaccg

SEQ ID NO: 2971919 - RNA, 13 nt, Mycobacterium avium subsp. paratuberculosis
caacagcagcggc

SEQ ID NO: 2971920 - RNA, 14 nt, Mycobacterium avium subsp. paratuberculosis
caacagcagcggca

SEQ ID NO: 2971921 - RNA, 19 nt, Mycobacterium avium subsp. paratuberculosis
caacagcauuucgcgcggc

SEQ ID NO: 2971922 - RNA, 14 nt, Mycobacterium avium subsp. paratuberculosis
caacagcccgaccg

SEQ ID NO: 2971923 - RNA, 12 nt, Mycobacterium avium subsp. paratuberculosis
caacagccggcc

SEQ ID NO: 2971924 - RNA, 14 nt, Mycobacterium avium subsp. paratuberculosis
caacagccggcccg

SEQ ID NO: 2971925 - RNA, 15 nt, Mycobacterium avium subsp. paratuberculosis
caacagccggcccga

SEQ ID NO: 2971926 - RNA, 20 nt, Mycobacterium avium subsp. paratuberculosis
caacagccggcccgagcccu

SEQ ID NO: 2971927 - RNA, 14 nt, Mycobacterium avium subsp. paratuberculosis
caacagcgccgaga

SEQ ID NO: 2971928 - RNA, 16 nt, Mycobacterium avium subsp. paratuberculosis
caacagcgccgagacg

SEQ ID NO: 2971929 - RNA, 13 nt, Mycobacterium avium subsp. paratuberculosis
caacagcgcgccg

SEQ ID NO: 2971930 - RNA, 16 nt, Mycobacterium avium subsp. paratuberculosis
caacagcgcgccggcc

SEQ ID NO: 2971931 - RNA, 13 nt, Mycobacterium avium subsp. paratuberculosis
caacagcggcccg

SEQ ID NO: 2971932 - RNA, 19 nt, Mycobacterium avium subsp. paratuberculosis
caacagcggcccgaucacc

SEQ ID NO: 2971933 - RNA, 16 nt, Mycobacterium avium subsp. paratuberculosis
caacagcgucucgacg

SEQ ID NO: 2971934 - RNA, 22 nt, Mycobacterium avium subsp. paratuberculosis
caacagcucuugaaucgguucg

SEQ ID NO: 2971935 - RNA, 17 nt, Mycobacterium avium subsp. paratuberculosis
caacaggcccagcagcg

SEQ ID NO: 2971936 - RNA, 15 nt, Mycobacterium avium subsp. paratuberculosis
caacagggccgcgcg

SEQ ID NO: 2971937 - RNA, 16 nt, Mycobacterium avium subsp. paratuberculosis
caacagggccgcgcgg

SEQ ID NO: 2971938 - RNA, 14 nt, Mycobacterium avium subsp. paratuberculosis
caacaggucggcgu

SEQ ID NO: 2971939 - RNA, 17 nt, Mycobacterium avium subsp. paratuberculosis
caacaggucggcgugca

SEQ ID NO: 2971940 - RNA, 22 nt, Mycobacterium avium subsp. paratuberculosis
caacaggucggcgugcagcacg

SEQ ID NO: 2971941 - RNA, 16 nt, Mycobacterium avium subsp. paratuberculosis
caacagguucgacagc

SEQ ID NO: 2971942 - RNA, 23 nt, Mycobacterium avium subsp. paratuberculosis
caacagguuucgcucgucggcgc

SEQ ID NO: 2971943 - RNA, 19 nt, Mycobacterium avium subsp. paratuberculosis
caacagugcgcaggcggcg

SEQ ID NO: 2971944 - RNA, 21 nt, Mycobacterium avium subsp. paratuberculosis
caacagugcgcaggcggcgcg

SEQ ID NO: 2971945 - RNA, 20 nt, Mycobacterium avium subsp. paratuberculosis
caacauccgcgacgacacca

SEQ ID NO: 2971946 - RNA, 21 nt, Mycobacterium avium subsp. paratuberculosis
caacauccugguccggcgccc

SEQ ID NO: 2971947 - RNA, 16 nt, Mycobacterium avium subsp. paratuberculosis
caacaucgacgugccg

SEQ ID NO: 2971948 - RNA, 15 nt, Mycobacterium avium subsp. paratuberculosis
caacaucgucaacau

SEQ ID NO: 2971949 - RNA, 17 nt, Mycobacterium avium subsp. paratuberculosis
caacaugaucggcgcga

SEQ ID NO: 2971950 - RNA, 19 nt, Mycobacterium avium subsp. paratuberculosis
caacaugcugcacggggug

SEQ ID NO: 2971951 - RNA, 20 nt, Mycobacterium avium subsp. paratuberculosis
caacauggcgcagaacacca

SEQ ID NO: 2971952 - RNA, 17 nt, Mycobacterium avium subsp. paratuberculosis
caacauugugcuguugg

SEQ ID NO: 2971953 - RNA, 22 nt, Mycobacterium avium subsp. paratuberculosis
caaccaaaaagcuagcgggagg

SEQ ID NO: 2971954 - RNA, 15 nt, Mycobacterium avium subsp. paratuberculosis
caaccacaccagcau

SEQ ID NO: 2971955 - RNA, 16 nt, Mycobacterium avium subsp. paratuberculosis
caaccacaccagcaug

SEQ ID NO: 2971956 - RNA, 14 nt, Mycobacterium avium subsp. paratuberculosis
caaccacagcggcg

SEQ ID NO: 2971957 - RNA, 12 nt, Mycobacterium avium subsp. paratuberculosis
caaccaccggca

SEQ ID NO: 2971958 - RNA, 15 nt, Mycobacterium avium subsp. paratuberculosis
caaccaccggcaucg

SEQ ID NO: 2971959 - RNA, 19 nt, Mycobacterium avium subsp. paratuberculosis
caaccaccguggccccagc

SEQ ID NO: 2971960 - RNA, 20 nt, Mycobacterium avium subsp. paratuberculosis
caaccaccguggccccagcc

SEQ ID NO: 2971961 - RNA, 22 nt, Mycobacterium avium subsp. paratuberculosis
caaccacuuucgcgagcgcgcu

SEQ ID NO: 2971962 - RNA, 20 nt, Mycobacterium avium subsp. paratuberculosis
caaccaggcgcucgucgaug

SEQ ID NO: 2971963 - RNA, 16 nt, Mycobacterium avium subsp. paratuberculosis
caaccaggucgcggcg

SEQ ID NO: 2971964 - RNA, 17 nt, Mycobacterium avium subsp. paratuberculosis
caaccaggucgcggcgc

SEQ ID NO: 2971965 - RNA, 20 nt, Mycobacterium avium subsp. paratuberculosis
caaccagugcacgcucggcg

SEQ ID NO: 2971966 - RNA, 21 nt, Mycobacterium avium subsp. paratuberculosis
caaccagugcacgcucggcgg

SEQ ID NO: 2971967 - RNA, 18 nt, Mycobacterium avium subsp. paratuberculosis
caaccaucgaggcgauca

SEQ ID NO: 2971968 - RNA, 12 nt, Mycobacterium avium subsp. paratuberculosis
caaccccgcgcg

SEQ ID NO: 2971969 - RNA, 13 nt, Mycobacterium avium subsp. paratuberculosis
caaccccgcggug

SEQ ID NO: 2971970 - RNA, 14 nt, Mycobacterium avium subsp. paratuberculosis
caacccgaccucgu

SEQ ID NO: 2971971 - RNA, 17 nt, Mycobacterium avium subsp. paratuberculosis
caacccgaccucgucga

SEQ ID NO: 2971972 - RNA, 21 nt, Mycobacterium avium subsp. paratuberculosis
caacccgaccucgucgacggc

SEQ ID NO: 2971973 - RNA, 16 nt, Mycobacterium avium subsp. paratuberculosis
caacccgagcaccggg

SEQ ID NO: 2971974 - RNA, 22 nt, Mycobacterium avium subsp. paratuberculosis
caacccgcucaggucggccgcg

SEQ ID NO: 2971975 - RNA, 23 nt, Mycobacterium avium subsp. paratuberculosis
caacccgcucaggucggccgcgg

SEQ ID NO: 2971976 - RNA, 12 nt, Mycobacterium avium subsp. paratuberculosis
caacccggccgc

SEQ ID NO: 2971977 - RNA, 16 nt, Mycobacterium avium subsp. paratuberculosis
caacccgggccggaca

SEQ ID NO: 2971978 - RNA, 22 nt, Mycobacterium avium subsp. paratuberculosis
caacccggucuuguugugcugc

SEQ ID NO: 2971979 - RNA, 19 nt, Mycobacterium avium subsp. paratuberculosis
caaccgaaucgagccgagg

SEQ ID NO: 2971980 - RNA, 22 nt, Mycobacterium avium subsp. paratuberculosis
caaccgaggcaaucgagcgggc

SEQ ID NO: 2971981 - RNA, 15 nt, Mycobacterium avium subsp. paratuberculosis
caaccgagucgcugc

SEQ ID NO: 2971982 - RNA, 18 nt, Mycobacterium avium subsp. paratuberculosis
caaccgagucgcugcagc

SEQ ID NO: 2971983 - RNA, 16 nt, Mycobacterium avium subsp. paratuberculosis
caaccgauuucggcca

SEQ ID NO: 2971984 - RNA, 19 nt, Mycobacterium avium subsp. paratuberculosis
caaccgauuucggccagcc

SEQ ID NO: 2971985 - RNA, 11 nt, Mycobacterium avium subsp. paratuberculosis
caaccgcagca

SEQ ID NO: 2971986 - RNA, 16 nt, Mycobacterium avium subsp. paratuberculosis
caaccgcagcaucuug

SEQ ID NO: 2971987 - RNA, 14 nt, Mycobacterium avium subsp. paratuberculosis
caaccgcagcggcu

SEQ ID NO: 2971988 - RNA, 20 nt, Mycobacterium avium subsp. paratuberculosis
caaccgcagucguucggcca

SEQ ID NO: 2971989 - RNA, 14 nt, Mycobacterium avium subsp. paratuberculosis
caaccgcauucggc

SEQ ID NO: 2971990 - RNA, 19 nt, Mycobacterium avium subsp. paratuberculosis
caaccgcauucggccgcca

SEQ ID NO: 2971991 - RNA, 15 nt, Mycobacterium avium subsp. paratuberculosis
caaccgccacgacgc

SEQ ID NO: 2971992 - RNA, 13 nt, Mycobacterium avium subsp. paratuberculosis
caaccgcccggcg

SEQ ID NO: 2971993 - RNA, 16 nt, Mycobacterium avium subsp. paratuberculosis
caaccgcccggcgccg

SEQ ID NO: 2971994 - RNA, 21 nt, Mycobacterium avium subsp. paratuberculosis
caaccgccgaaacaccggcuu

SEQ ID NO: 2971995 - RNA, 15 nt, Mycobacterium avium subsp. paratuberculosis
caaccgccggcagcg

SEQ ID NO: 2971996 - RNA, 13 nt, Mycobacterium avium subsp. paratuberculosis
caaccgcggcggc

SEQ ID NO: 2971997 - RNA, 20 nt, Mycobacterium avium subsp. paratuberculosis
caaccgcggcggcggcccgu

SEQ ID NO: 2971998 - RNA, 15 nt, Mycobacterium avium subsp. paratuberculosis
caaccgcucggcgau

SEQ ID NO: 2971999 - RNA, 16 nt, Mycobacterium avium subsp. paratuberculosis
caaccgcucggcgauc

SEQ ID NO: 2972000 - RNA, 14 nt, Mycobacterium avium subsp. paratuberculosis
caaccgcugcugcu

SEQ ID NO: 2972001 - RNA, 23 nt, Mycobacterium avium subsp. paratuberculosis
caaccgcuuugaauugagcgccg

SEQ ID NO: 2972002 - RNA, 14 nt, Mycobacterium avium subsp. paratuberculosis
caaccggccccgag

SEQ ID NO: 2972003 - RNA, 16 nt, Mycobacterium avium subsp. paratuberculosis
caaccggccccgagcg

SEQ ID NO: 2972004 - RNA, 23 nt, Mycobacterium avium subsp. paratuberculosis
caaccggcggcugggcagccgcg

SEQ ID NO: 2972005 - RNA, 22 nt, Mycobacterium avium subsp. paratuberculosis
caaccgggauaccgcgaccgcc

SEQ ID NO: 2972006 - RNA, 23 nt, Mycobacterium avium subsp. paratuberculosis
caaccgggcaggcacggugucga

SEQ ID NO: 2972007 - RNA, 14 nt, Mycobacterium avium subsp. paratuberculosis
caaccgggccgcac

SEQ ID NO: 2972008 - RNA, 19 nt, Mycobacterium avium subsp. paratuberculosis
caaccgggccgcacccccu

SEQ ID NO: 2972009 - RNA, 23 nt, Mycobacterium avium subsp. paratuberculosis
caaccgggucacgaacuccuuga

SEQ ID NO: 2972010 - RNA, 21 nt, Mycobacterium avium subsp. paratuberculosis
caaccgguccgccgucggggu

SEQ ID NO: 2972011 - RNA, 16 nt, Mycobacterium avium subsp. paratuberculosis
caaccggugugccugg

SEQ ID NO: 2972012 - RNA, 22 nt, Mycobacterium avium subsp. paratuberculosis
caaccgguucggacacggcgcc

SEQ ID NO: 2972013 - RNA, 15 nt, Mycobacterium avium subsp. paratuberculosis
caaccgucaguucgu

SEQ ID NO: 2972014 - RNA, 19 nt, Mycobacterium avium subsp. paratuberculosis
caaccgugacuggguggga

SEQ ID NO: 2972015 - RNA, 21 nt, Mycobacterium avium subsp. paratuberculosis
caaccuguuuggcugucgcgc

SEQ ID NO: 2972016 - RNA, 12 nt, Mycobacterium avium subsp. paratuberculosis
caaccuucuugg

SEQ ID NO: 2972017 - RNA, 13 nt, Mycobacterium avium subsp. paratuberculosis
caacgacagcgac

SEQ ID NO: 2972018 - RNA, 14 nt, Mycobacterium avium subsp. paratuberculosis
caacgacagcgacg

SEQ ID NO: 2972019 - RNA, 18 nt, Mycobacterium avium subsp. paratuberculosis
caacgacagcgacgggcc

SEQ ID NO: 2972020 - RNA, 24 nt, Mycobacterium avium subsp. paratuberculosis
caacgacagcgacgggccgggcac

SEQ ID NO: 2972021 - RNA, 13 nt, Mycobacterium avium subsp. paratuberculosis
caacgacccggcc

SEQ ID NO: 2972022 - RNA, 17 nt, Mycobacterium avium subsp. paratuberculosis
caacgacccggccaccg

SEQ ID NO: 2972023 - RNA, 21 nt, Mycobacterium avium subsp. paratuberculosis
caacgacccggccaccgccgc

SEQ ID NO: 2972024 - RNA, 13 nt, Mycobacterium avium subsp. paratuberculosis
caacgacccgucg

SEQ ID NO: 2972025 - RNA, 16 nt, Mycobacterium avium subsp. paratuberculosis
caacgacccgucgggg

SEQ ID NO: 2972026 - RNA, 18 nt, Mycobacterium avium subsp. paratuberculosis
caacgacgaagucgguca

SEQ ID NO: 2972027 - RNA, 16 nt, Mycobacterium avium subsp. paratuberculosis
caacgacgucggcguc

SEQ ID NO: 2972028 - RNA, 19 nt, Mycobacterium avium subsp. paratuberculosis
caacgacucauucgacucc

SEQ ID NO: 2972029 - RNA, 14 nt, Mycobacterium avium subsp. paratuberculosis
caacgagcgcgccg

SEQ ID NO: 2972030 - RNA, 18 nt, Mycobacterium avium subsp. paratuberculosis
caacgaggcacggcccgc

SEQ ID NO: 2972031 - RNA, 14 nt, Mycobacterium avium subsp. paratuberculosis
caacgaggccaggg

SEQ ID NO: 2972032 - RNA, 19 nt, Mycobacterium avium subsp. paratuberculosis
caacgauucacccagcgag

SEQ ID NO: 2972033 - RNA, 16 nt, Mycobacterium avium subsp. paratuberculosis
caacgcaaugcgucgc

SEQ ID NO: 2972034 - RNA, 20 nt, Mycobacterium avium subsp. paratuberculosis
caacgcaaugcgucgcggcg

SEQ ID NO: 2972035 - RNA, 21 nt, Mycobacterium avium subsp. paratuberculosis
caacgcaaugcgucgcggcgg

SEQ ID NO: 2972036 - RNA, 17 nt, Mycobacterium avium subsp. paratuberculosis
caacgcacgggcggcgg

SEQ ID NO: 2972037 - RNA, 19 nt, Mycobacterium avium subsp. paratuberculosis
caacgcacgggcggcgggg

SEQ ID NO: 2972038 - RNA, 20 nt, Mycobacterium avium subsp. paratuberculosis
caacgccacaaacagcgcgg

SEQ ID NO: 2972039 - RNA, 19 nt, Mycobacterium avium subsp. paratuberculosis
caacgccacguagcagcag

SEQ ID NO: 2972040 - RNA, 22 nt, Mycobacterium avium subsp. paratuberculosis
caacgccagccagaacacgccc

SEQ ID NO: 2972041 - RNA, 13 nt, Mycobacterium avium subsp. paratuberculosis
caacgccagcgcg

SEQ ID NO: 2972042 - RNA, 19 nt, Mycobacterium avium subsp. paratuberculosis
caacgccagcgugagcuca

SEQ ID NO: 2972043 - RNA, 17 nt, Mycobacterium avium subsp. paratuberculosis
caacgccgccgacagca

SEQ ID NO: 2972044 - RNA, 20 nt, Mycobacterium avium subsp. paratuberculosis
caacgccgccgacagcaccu

SEQ ID NO: 2972045 - RNA, 16 nt, Mycobacterium avium subsp. paratuberculosis
caacgccgcgcgcagc

SEQ ID NO: 2972046 - RNA, 21 nt, Mycobacterium avium subsp. paratuberculosis
caacgccggcgugcacaggcc

SEQ ID NO: 2972047 - RNA, 22 nt, Mycobacterium avium subsp. paratuberculosis
caacgccuccgaauccagcgcg

SEQ ID NO: 2972048 - RNA, 15 nt, Mycobacterium avium subsp. paratuberculosis
caacgccucgucgac

SEQ ID NO: 2972049 - RNA, 14 nt, Mycobacterium avium subsp. paratuberculosis
caacgcgacgaagc

SEQ ID NO: 2972050 - RNA, 23 nt, Mycobacterium avium subsp. paratuberculosis
caacgcgacgaagccggugccca

SEQ ID NO: 2972051 - RNA, 21 nt, Mycobacterium avium subsp. paratuberculosis
caacgcgauucucgcugcggc

SEQ ID NO: 2972052 - RNA, 14 nt, Mycobacterium avium subsp. paratuberculosis
caacgcgcacauca

SEQ ID NO: 2972053 - RNA, 22 nt, Mycobacterium avium subsp. paratuberculosis
caacgcgcacaucacgguggcc

SEQ ID NO: 2972054 - RNA, 12 nt, Mycobacterium avium subsp. paratuberculosis
caacgcgcagcc

SEQ ID NO: 2972055 - RNA, 17 nt, Mycobacterium avium subsp. paratuberculosis
caacgcgccgaacaacg

SEQ ID NO: 2972056 - RNA, 23 nt, Mycobacterium avium subsp. paratuberculosis
caacgcgccgaacaacggcggac

SEQ ID NO: 2972057 - RNA, 12 nt, Mycobacterium avium subsp. paratuberculosis
caacgcgccggc

SEQ ID NO: 2972058 - RNA, 13 nt, Mycobacterium avium subsp. paratuberculosis
caacgcgccggcg

SEQ ID NO: 2972059 - RNA, 14 nt, Mycobacterium avium subsp. paratuberculosis
caacgcgcgcgacg

SEQ ID NO: 2972060 - RNA, 15 nt, Mycobacterium avium subsp. paratuberculosis
caacgcgcgcgacgg

SEQ ID NO: 2972061 - RNA, 19 nt, Mycobacterium avium subsp. paratuberculosis
caacgcgcgcgacggcgcg

SEQ ID NO: 2972062 - RNA, 20 nt, Mycobacterium avium subsp. paratuberculosis
caacgcgcgcgacggcgcgu

SEQ ID NO: 2972063 - RNA, 17 nt, Mycobacterium avium subsp. paratuberculosis
caacgcggacacggccg

SEQ ID NO: 2972064 - RNA, 18 nt, Mycobacterium avium subsp. paratuberculosis
caacgcggacacggccgg

SEQ ID NO: 2972065 - RNA, 19 nt, Mycobacterium avium subsp. paratuberculosis
caacgcggcaugaccggcc

SEQ ID NO: 2972066 - RNA, 20 nt, Mycobacterium avium subsp. paratuberculosis
caacgcggcaugaccggcca

SEQ ID NO: 2972067 - RNA, 15 nt, Mycobacterium avium subsp. paratuberculosis
caacgcggccaccac

SEQ ID NO: 2972068 - RNA, 13 nt, Mycobacterium avium subsp. paratuberculosis
caacgcggcgccg

SEQ ID NO: 2972069 - RNA, 15 nt, Mycobacterium avium subsp. paratuberculosis
caacgcggcgccggu

SEQ ID NO: 2972070 - RNA, 14 nt, Mycobacterium avium subsp. paratuberculosis
caacgcggugaccg

SEQ ID NO: 2972071 - RNA, 18 nt, Mycobacterium avium subsp. paratuberculosis
caacgcggugaccgcggc

SEQ ID NO: 2972072 - RNA, 19 nt, Mycobacterium avium subsp. paratuberculosis
caacgcggugaccgcggcc

SEQ ID NO: 2972073 - RNA, 20 nt, Mycobacterium avium subsp. paratuberculosis
caacgcggugaccgcggccu

SEQ ID NO: 2972074 - RNA, 14 nt, Mycobacterium avium subsp. paratuberculosis
caacgcgucgaaca

SEQ ID NO: 2972075 - RNA, 23 nt, Mycobacterium avium subsp. paratuberculosis
caacgcgucgaacagccgggccg

SEQ ID NO: 2972076 - RNA, 14 nt, Mycobacterium avium subsp. paratuberculosis
caacgcgucggcgc

SEQ ID NO: 2972077 - RNA, 16 nt, Mycobacterium avium subsp. paratuberculosis
caacgcgucggcgccg

SEQ ID NO: 2972078 - RNA, 14 nt, Mycobacterium avium subsp. paratuberculosis
caacgcugaccgca

SEQ ID NO: 2972079 - RNA, 19 nt, Mycobacterium avium subsp. paratuberculosis
caacgcugaccgcaggaaa

SEQ ID NO: 2972080 - RNA, 15 nt, Mycobacterium avium subsp. paratuberculosis
caacggcagcgagua

SEQ ID NO: 2972081 - RNA, 18 nt, Mycobacterium avium subsp. paratuberculosis
caacggccaaccgcccgg

SEQ ID NO: 2972082 - RNA, 17 nt, Mycobacterium avium subsp. paratuberculosis
caacggccaugaagccg

SEQ ID NO: 2972083 - RNA, 21 nt, Mycobacterium avium subsp. paratuberculosis
caacggccaugaagccguugc

SEQ ID NO: 2972084 - RNA, 23 nt, Mycobacterium avium subsp. paratuberculosis
caacggccaugaagccguugccg

SEQ ID NO: 2972085 - RNA, 15 nt, Mycobacterium avium subsp. paratuberculosis
caacggcccccacga

SEQ ID NO: 2972086 - RNA, 13 nt, Mycobacterium avium subsp. paratuberculosis
caacggccgcacg

SEQ ID NO: 2972087 - RNA, 13 nt, Mycobacterium avium subsp. paratuberculosis
caacggccgcagc

SEQ ID NO: 2972088 - RNA, 14 nt, Mycobacterium avium subsp. paratuberculosis
caacggccgcagcg

SEQ ID NO: 2972089 - RNA, 16 nt, Mycobacterium avium subsp. paratuberculosis
caacggccgcagcgac

SEQ ID NO: 2972090 - RNA, 19 nt, Mycobacterium avium subsp. paratuberculosis
caacggccgcagcgacucc

SEQ ID NO: 2972091 - RNA, 18 nt, Mycobacterium avium subsp. paratuberculosis
caacggccggcgccgccg

SEQ ID NO: 2972092 - RNA, 22 nt, Mycobacterium avium subsp. paratuberculosis
caacggccggcgccgccggggc

SEQ ID NO: 2972093 - RNA, 20 nt, Mycobacterium avium subsp. paratuberculosis
caacggcggaccggcggccg

SEQ ID NO: 2972094 - RNA, 23 nt, Mycobacterium avium subsp. paratuberculosis
caacggcggaccggcggccgcca

SEQ ID NO: 2972095 - RNA, 15 nt, Mycobacterium avium subsp. paratuberculosis
caacggcggcggcac

SEQ ID NO: 2972096 - RNA, 14 nt, Mycobacterium avium subsp. paratuberculosis
caacggcggcggcg

SEQ ID NO: 2972097 - RNA, 16 nt, Mycobacterium avium subsp. paratuberculosis
caacggcggcggcggc

SEQ ID NO: 2972098 - RNA, 22 nt, Mycobacterium avium subsp. paratuberculosis
caacggcggcggcggcagguug

SEQ ID NO: 2972099 - RNA, 19 nt, Mycobacterium avium subsp. paratuberculosis
caacggcggucgugcggcu

SEQ ID NO: 2972100 - RNA, 14 nt, Mycobacterium avium subsp. paratuberculosis
caacggcgucgaca

SEQ ID NO: 2972101 - RNA, 16 nt, Mycobacterium avium subsp. paratuberculosis
caacggcucccaggcc

SEQ ID NO: 2972102 - RNA, 17 nt, Mycobacterium avium subsp. paratuberculosis
caacggcucgccgcgca

SEQ ID NO: 2972103 - RNA, 18 nt, Mycobacterium avium subsp. paratuberculosis
caacggcucgccgcgcau

SEQ ID NO: 2972104 - RNA, 19 nt, Mycobacterium avium subsp. paratuberculosis
caacggcuugcgcagguug

SEQ ID NO: 2972105 - RNA, 18 nt, Mycobacterium avium subsp. paratuberculosis
caacgggaagagcggcgu

SEQ ID NO: 2972106 - RNA, 14 nt, Mycobacterium avium subsp. paratuberculosis
caacgggccgcagc

SEQ ID NO: 2972107 - RNA, 15 nt, Mycobacterium avium subsp. paratuberculosis
caacgggccgcagcc

SEQ ID NO: 2972108 - RNA, 16 nt, Mycobacterium avium subsp. paratuberculosis
caacgggccgcagccg

SEQ ID NO: 2972109 - RNA, 18 nt, Mycobacterium avium subsp. paratuberculosis
caacgggccgcagccgcg

SEQ ID NO: 2972110 - RNA, 14 nt, Mycobacterium avium subsp. paratuberculosis
caacgggcggcgga

SEQ ID NO: 2972111 - RNA, 23 nt, Mycobacterium avium subsp. paratuberculosis
caacgggcggcggaucagcaccg

SEQ ID NO: 2972112 - RNA, 14 nt, Mycobacterium avium subsp. paratuberculosis
caacgggcucagca

SEQ ID NO: 2972113 - RNA, 19 nt, Mycobacterium avium subsp. paratuberculosis
caacgggcucagcaccaca

SEQ ID NO: 2972114 - RNA, 16 nt, Mycobacterium avium subsp. paratuberculosis
caacgggucgagcacg

SEQ ID NO: 2972115 - RNA, 17 nt, Mycobacterium avium subsp. paratuberculosis
caacgggucgagcacgu

SEQ ID NO: 2972116 - RNA, 21 nt, Mycobacterium avium subsp. paratuberculosis
caacggguugcgaaagcccag

SEQ ID NO: 2972117 - RNA, 17 nt, Mycobacterium avium subsp. paratuberculosis
caacgguacgugcgccg

SEQ ID NO: 2972118 - RNA, 19 nt, Mycobacterium avium subsp. paratuberculosis
caacgguacgugcgccggc

SEQ ID NO: 2972119 - RNA, 20 nt, Mycobacterium avium subsp. paratuberculosis
caacgguacgugcgccggcg

SEQ ID NO: 2972120 - RNA, 22 nt, Mycobacterium avium subsp. paratuberculosis
caacgguacgugcgccggcggu

SEQ ID NO: 2972121 - RNA, 15 nt, Mycobacterium avium subsp. paratuberculosis
caacgguucggccgc

SEQ ID NO: 2972122 - RNA, 18 nt, Mycobacterium avium subsp. paratuberculosis
caacgguucggccgcucg

SEQ ID NO: 2972123 - RNA, 23 nt, Mycobacterium avium subsp. paratuberculosis
caacgguuuccaccaccacccgg

SEQ ID NO: 2972124 - RNA, 21 nt, Mycobacterium avium subsp. paratuberculosis
caacgucucugucgucgacca

SEQ ID NO: 2972125 - RNA, 15 nt, Mycobacterium avium subsp. paratuberculosis
caacgugauacgccg

SEQ ID NO: 2972126 - RNA, 15 nt, Mycobacterium avium subsp. paratuberculosis
caacgugaugagcgc

SEQ ID NO: 2972127 - RNA, 17 nt, Mycobacterium avium subsp. paratuberculosis
caacgugaugagcgcgu

SEQ ID NO: 2972128 - RNA, 14 nt, Mycobacterium avium subsp. paratuberculosis
caacgugccacagg

SEQ ID NO: 2972129 - RNA, 15 nt, Mycobacterium avium subsp. paratuberculosis
caacgugcgccggcc

SEQ ID NO: 2972130 - RNA, 17 nt, Mycobacterium avium subsp. paratuberculosis
caacguguacucggcgu

SEQ ID NO: 2972131 - RNA, 19 nt, Mycobacterium avium subsp. paratuberculosis
caacguguacucggcgucg

SEQ ID NO: 2972132 - RNA, 22 nt, Mycobacterium avium subsp. paratuberculosis
caacguguacucggcgucgccg

SEQ ID NO: 2972133 - RNA, 14 nt, Mycobacterium avium subsp. paratuberculosis
caacuacccgccga

SEQ ID NO: 2972134 - RNA, 21 nt, Mycobacterium avium subsp. paratuberculosis
caacuacccgccgacgccugc

SEQ ID NO: 2972135 - RNA, 22 nt, Mycobacterium avium subsp. paratuberculosis
caacucacuaucgacaacacga

SEQ ID NO: 2972136 - RNA, 18 nt, Mycobacterium avium subsp. paratuberculosis
caacucaguccucgccga

SEQ ID NO: 2972137 - RNA, 14 nt, Mycobacterium avium subsp. paratuberculosis
caacucccgcgccg

SEQ ID NO: 2972138 - RNA, 16 nt, Mycobacterium avium subsp. paratuberculosis
caacucccgcgccgcg

SEQ ID NO: 2972139 - RNA, 17 nt, Mycobacterium avium subsp. paratuberculosis
caacucccgcgccgcgg

SEQ ID NO: 2972140 - RNA, 14 nt, Mycobacterium avium subsp. paratuberculosis
caacuccggcggca

SEQ ID NO: 2972141 - RNA, 18 nt, Mycobacterium avium subsp. paratuberculosis
caacucgacgcucggcga

SEQ ID NO: 2972142 - RNA, 20 nt, Mycobacterium avium subsp. paratuberculosis
caacucgacgcucggcgaug

SEQ ID NO: 2972143 - RNA, 17 nt, Mycobacterium avium subsp. paratuberculosis
caacucgccggagcgcc

SEQ ID NO: 2972144 - RNA, 14 nt, Mycobacterium avium subsp. paratuberculosis
caacucgcgaggcc

SEQ ID NO: 2972145 - RNA, 19 nt, Mycobacterium avium subsp. paratuberculosis
caacucgcgcucccggcgc

SEQ ID NO: 2972146 - RNA, 13 nt, Mycobacterium avium subsp. paratuberculosis
caacucgggugug

SEQ ID NO: 2972147 - RNA, 21 nt, Mycobacterium avium subsp. paratuberculosis
caacucggguguggacggcga

SEQ ID NO: 2972148 - RNA, 22 nt, Mycobacterium avium subsp. paratuberculosis
caacucggguguggacggcgag

SEQ ID NO: 2972149 - RNA, 19 nt, Mycobacterium avium subsp. paratuberculosis
caacucguccagcgucgcg

SEQ ID NO: 2972150 - RNA, 18 nt, Mycobacterium avium subsp. paratuberculosis
caacucgucggcgaacuc

SEQ ID NO: 2972151 - RNA, 15 nt, Mycobacterium avium subsp. paratuberculosis
caacugagcgcggcg

SEQ ID NO: 2972152 - RNA, 16 nt, Mycobacterium avium subsp. paratuberculosis
caacugcaccagcggc

SEQ ID NO: 2972153 - RNA, 20 nt, Mycobacterium avium subsp. paratuberculosis
caacugcagauaggacccgg

SEQ ID NO: 2972154 - RNA, 21 nt, Mycobacterium avium subsp. paratuberculosis
caacugcagauaggacccggc

SEQ ID NO: 2972155 - RNA, 17 nt, Mycobacterium avium subsp. paratuberculosis
caacugcaucgccagca

SEQ ID NO: 2972156 - RNA, 18 nt, Mycobacterium avium subsp. paratuberculosis
caacugcaucgccagcac

SEQ ID NO: 2972157 - RNA, 19 nt, Mycobacterium avium subsp. paratuberculosis
caacugcaucgccagcaca

SEQ ID NO: 2972158 - RNA, 13 nt, Mycobacterium avium subsp. paratuberculosis
caacuggccgccc

SEQ ID NO: 2972159 - RNA, 13 nt, Mycobacterium avium subsp. paratuberculosis
caacuggcgaccg

SEQ ID NO: 2972160 - RNA, 19 nt, Mycobacterium avium subsp. paratuberculosis
caacuggcgaccgguccgc

SEQ ID NO: 2972161 - RNA, 17 nt, Mycobacterium avium subsp. paratuberculosis
caacuggucgugcagca

SEQ ID NO: 2972162 - RNA, 13 nt, Mycobacterium avium subsp. paratuberculosis
cacaccgucggcg

SEQ ID NO: 2972163 - RNA, 16 nt, Mycobacterium avium subsp. paratuberculosis
cacaccgucggcgauc

SEQ ID NO: 2972164 - RNA, 20 nt, Mycobacterium avium subsp. paratuberculosis
cacaccgucucccacgaacg

SEQ ID NO: 2972165 - RNA, 23 nt, Mycobacterium avium subsp. paratuberculosis
cacaccucgcuacgcgagcugcu

SEQ ID NO: 2972166 - RNA, 14 nt, Mycobacterium avium subsp. paratuberculosis
cacaccucggcgac

SEQ ID NO: 2972167 - RNA, 18 nt, Mycobacterium avium subsp. paratuberculosis
cacaccucggcgaccucg

SEQ ID NO: 2972168 - RNA, 22 nt, Mycobacterium avium subsp. paratuberculosis
cacaccuuccaccaccgcggcg

SEQ ID NO: 2972169 - RNA, 12 nt, Mycobacterium avium subsp. paratuberculosis
cacacgaacacc

SEQ ID NO: 2972170 - RNA, 14 nt, Mycobacterium avium subsp. paratuberculosis
cacacgccgaggcg

SEQ ID NO: 2972171 - RNA, 17 nt, Mycobacterium avium subsp. paratuberculosis
cacacgcgauagaccuc

SEQ ID NO: 2972172 - RNA, 13 nt, Mycobacterium avium subsp. paratuberculosis
cacacgcgcgccc

SEQ ID NO: 2972173 - RNA, 12 nt, Mycobacterium avium subsp. paratuberculosis
cacacgcggaca

SEQ ID NO: 2972174 - RNA, 14 nt, Mycobacterium avium subsp. paratuberculosis
cacacgcggacagg

SEQ ID NO: 2972175 - RNA, 23 nt, Mycobacterium avium subsp. paratuberculosis
cacacgcggacagggcggcgacc

SEQ ID NO: 2972176 - RNA, 13 nt, Mycobacterium avium subsp. paratuberculosis
cacacgcucggcg

SEQ ID NO: 2972177 - RNA, 14 nt, Mycobacterium avium subsp. paratuberculosis
cacacgcucggcga

SEQ ID NO: 2972178 - RNA, 17 nt, Mycobacterium avium subsp. paratuberculosis
cacacgcucggcgagcu

SEQ ID NO: 2972179 - RNA, 14 nt, Mycobacterium avium subsp. paratuberculosis
cacacgcucggcgc

SEQ ID NO: 2972180 - RNA, 15 nt, Mycobacterium avium subsp. paratuberculosis
cacacgcucggcgcg

SEQ ID NO: 2972181 - RNA, 19 nt, Mycobacterium avium subsp. paratuberculosis
cacacgcucggcgcgcggg

SEQ ID NO: 2972182 - RNA, 22 nt, Mycobacterium avium subsp. paratuberculosis
cacacggccucgcccagcgccg

SEQ ID NO: 2972183 - RNA, 13 nt, Mycobacterium avium subsp. paratuberculosis
cacacguccugga

SEQ ID NO: 2972184 - RNA, 13 nt, Mycobacterium avium subsp. paratuberculosis
cacacgugcggau

SEQ ID NO: 2972185 - RNA, 21 nt, Mycobacterium avium subsp. paratuberculosis
cacacgugcggauggccccgg

SEQ ID NO: 2972186 - RNA, 20 nt, Mycobacterium avium subsp. paratuberculosis
cacacguugagcccggaccg

SEQ ID NO: 2972187 - RNA, 21 nt, Mycobacterium avium subsp. paratuberculosis
cacacguugagcccggaccgg

SEQ ID NO: 2972188 - RNA, 17 nt, Mycobacterium avium subsp. paratuberculosis
cacacugaaagccgagg

SEQ ID NO: 2972189 - RNA, 15 nt, Mycobacterium avium subsp. paratuberculosis
cacacuggcgugacg

SEQ ID NO: 2972190 - RNA, 19 nt, Mycobacterium avium subsp. paratuberculosis
cacacuggcgugacgcucg

SEQ ID NO: 2972191 - RNA, 22 nt, Mycobacterium avium subsp. paratuberculosis
cacacuggcgugacgcucggcc

SEQ ID NO: 2972192 - RNA, 15 nt, Mycobacterium avium subsp. paratuberculosis
cacagauacgcgacg

SEQ ID NO: 2972193 - RNA, 19 nt, Mycobacterium avium subsp. paratuberculosis
cacagauacgcgacgaacc

SEQ ID NO: 2972194 - RNA, 16 nt, Mycobacterium avium subsp. paratuberculosis
cacagcaacgacaucc

SEQ ID NO: 2972195 - RNA, 12 nt, Mycobacterium avium subsp. paratuberculosis
cacagcacggca

SEQ ID NO: 2972196 - RNA, 15 nt, Mycobacterium avium subsp. paratuberculosis
cacagcacggcaucg

SEQ ID NO: 2972197 - RNA, 16 nt, Mycobacterium avium subsp. paratuberculosis
cacagcacggcaucga

SEQ ID NO: 2972198 - RNA, 13 nt, Mycobacterium avium subsp. paratuberculosis
cacagcagcacgc

SEQ ID NO: 2972199 - RNA, 18 nt, Mycobacterium avium subsp. paratuberculosis
cacagcagcacgcccagc

SEQ ID NO: 2972200 - RNA, 16 nt, Mycobacterium avium subsp. paratuberculosis
cacagcagcagcacca

SEQ ID NO: 2972201 - RNA, 21 nt, Mycobacterium avium subsp. paratuberculosis
cacagcagcagcaccaggcug

SEQ ID NO: 2972202 - RNA, 15 nt, Mycobacterium avium subsp. paratuberculosis
cacagcagggcaccg

SEQ ID NO: 2972203 - RNA, 16 nt, Mycobacterium avium subsp. paratuberculosis
cacagcagggcaccga

SEQ ID NO: 2972204 - RNA, 17 nt, Mycobacterium avium subsp. paratuberculosis
cacagcagggcaccgac

SEQ ID NO: 2972205 - RNA, 20 nt, Mycobacterium avium subsp. paratuberculosis
cacagcagggcaccgacggc

SEQ ID NO: 2972206 - RNA, 22 nt, Mycobacterium avium subsp. paratuberculosis
cacagcaugaagaucagcaccg

SEQ ID NO: 2972207 - RNA, 23 nt, Mycobacterium avium subsp. paratuberculosis
cacagcaugaagaucagcaccgu

SEQ ID NO: 2972208 - RNA, 24 nt, Mycobacterium avium subsp. paratuberculosis
cacagcaugaagaucagcaccguc

SEQ ID NO: 2972209 - RNA, 23 nt, Mycobacterium avium subsp. paratuberculosis
cacagccaaagccuacggcgccg

SEQ ID NO: 2972210 - RNA, 15 nt, Mycobacterium avium subsp. paratuberculosis
cacagccagcgcccg

SEQ ID NO: 2972211 - RNA, 21 nt, Mycobacterium avium subsp. paratuberculosis
cacagccagcgcccggcgacc

SEQ ID NO: 2972212 - RNA, 20 nt, Mycobacterium avium subsp. paratuberculosis
cacagcccccacgcucggcg

SEQ ID NO: 2972213 - RNA, 23 nt, Mycobacterium avium subsp. paratuberculosis
cacagcccguugcugcguucggc

SEQ ID NO: 2972214 - RNA, 13 nt, Mycobacterium avium subsp. paratuberculosis
cacagccgcagca

SEQ ID NO: 2972215 - RNA, 22 nt, Mycobacterium avium subsp. paratuberculosis
cacagccgcagcagccgcgcca

SEQ ID NO: 2972216 - RNA, 15 nt, Mycobacterium avium subsp. paratuberculosis
cacagccgcuuggcg

SEQ ID NO: 2972217 - RNA, 19 nt, Mycobacterium avium subsp. paratuberculosis
cacagccgcuuggcgcgcc

SEQ ID NO: 2972218 - RNA, 20 nt, Mycobacterium avium subsp. paratuberculosis
cacagccgcuuggcgcgccg

SEQ ID NO: 2972219 - RNA, 13 nt, Mycobacterium avium subsp. paratuberculosis
cacagccggcgcg

SEQ ID NO: 2972220 - RNA, 14 nt, Mycobacterium avium subsp. paratuberculosis
cacagccggcgcgc

SEQ ID NO: 2972221 - RNA, 15 nt, Mycobacterium avium subsp. paratuberculosis
cacagccggcgcgcg

SEQ ID NO: 2972222 - RNA, 14 nt, Mycobacterium avium subsp. paratuberculosis
cacagccggcggcg

SEQ ID NO: 2972223 - RNA, 23 nt, Mycobacterium avium subsp. paratuberculosis
cacagccggucauaggccgcgca

SEQ ID NO: 2972224 - RNA, 13 nt, Mycobacterium avium subsp. paratuberculosis
cacagcgacaacg

SEQ ID NO: 2972225 - RNA, 20 nt, Mycobacterium avium subsp. paratuberculosis
cacagcgacaacgggccgcc

SEQ ID NO: 2972226 - RNA, 22 nt, Mycobacterium avium subsp. paratuberculosis
cacagcgacaacgggccgccuc

SEQ ID NO: 2972227 - RNA, 15 nt, Mycobacterium avium subsp. paratuberculosis
cacagcgaggcgacg

SEQ ID NO: 2972228 - RNA, 16 nt, Mycobacterium avium subsp. paratuberculosis
cacagcgaggcgacgu

SEQ ID NO: 2972229 - RNA, 14 nt, Mycobacterium avium subsp. paratuberculosis
cacagcgccacacc

SEQ ID NO: 2972230 - RNA, 15 nt, Mycobacterium avium subsp. paratuberculosis
cacagcgccacaccg

SEQ ID NO: 2972231 - RNA, 15 nt, Mycobacterium avium subsp. paratuberculosis
cacagcgccagcacg

SEQ ID NO: 2972232 - RNA, 19 nt, Mycobacterium avium subsp. paratuberculosis
cacagcgccagcacggcca

SEQ ID NO: 2972233 - RNA, 19 nt, Mycobacterium avium subsp. paratuberculosis
cacagcgcccuugagcacg

SEQ ID NO: 2972234 - RNA, 23 nt, Mycobacterium avium subsp. paratuberculosis
cacagcgcccuugagcacgguga

SEQ ID NO: 2972235 - RNA, 14 nt, Mycobacterium avium subsp. paratuberculosis
cacagcgccgcguu

SEQ ID NO: 2972236 - RNA, 22 nt, Mycobacterium avium subsp. paratuberculosis
cacagcgccgcguugucggcgu

SEQ ID NO: 2972237 - RNA, 21 nt, Mycobacterium avium subsp. paratuberculosis
cacagcgccucgcggucgacg

SEQ ID NO: 2972238 - RNA, 22 nt, Mycobacterium avium subsp. paratuberculosis
cacagcgccucgucgagccggg

SEQ ID NO: 2972239 - RNA, 13 nt, Mycobacterium avium subsp. paratuberculosis
cacagcgcggcgg

SEQ ID NO: 2972240 - RNA, 14 nt, Mycobacterium avium subsp. paratuberculosis
cacagcgcggcggu

SEQ ID NO: 2972241 - RNA, 19 nt, Mycobacterium avium subsp. paratuberculosis
cacagcggcgacagcggcc

SEQ ID NO: 2972242 - RNA, 22 nt, Mycobacterium avium subsp. paratuberculosis
cacagcggcgcaugaccgaucc

SEQ ID NO: 2972243 - RNA, 14 nt, Mycobacterium avium subsp. paratuberculosis
cacagcgguucggc

SEQ ID NO: 2972244 - RNA, 15 nt, Mycobacterium avium subsp. paratuberculosis
cacagcgguucggcg

SEQ ID NO: 2972245 - RNA, 16 nt, Mycobacterium avium subsp. paratuberculosis
cacagcgugacccugc

SEQ ID NO: 2972246 - RNA, 21 nt, Mycobacterium avium subsp. paratuberculosis
cacagcgugacccugccguca

SEQ ID NO: 2972247 - RNA, 22 nt, Mycobacterium avium subsp. paratuberculosis
cacagcguuauccaccagguug

SEQ ID NO: 2972248 - RNA, 21 nt, Mycobacterium avium subsp. paratuberculosis
cacagcuaggucguggcgccg

SEQ ID NO: 2972249 - RNA, 22 nt, Mycobacterium avium subsp. paratuberculosis
cacagcuaggucguggcgccga

SEQ ID NO: 2972250 - RNA, 17 nt, Mycobacterium avium subsp. paratuberculosis
cacagcucaccugcgug

SEQ ID NO: 2972251 - RNA, 18 nt, Mycobacterium avium subsp. paratuberculosis
cacagcucaccugcgugc

SEQ ID NO: 2972252 - RNA, 19 nt, Mycobacterium avium subsp. paratuberculosis
cacagcucaccugcgugcc

SEQ ID NO: 2972253 - RNA, 12 nt, Mycobacterium avium subsp. paratuberculosis
cacagcucgggc

SEQ ID NO: 2972254 - RNA, 14 nt, Mycobacterium avium subsp. paratuberculosis
cacagcucgggcag

SEQ ID NO: 2972255 - RNA, 17 nt, Mycobacterium avium subsp. paratuberculosis
cacagcucgggcagcgu

SEQ ID NO: 2972256 - RNA, 24 nt, Mycobacterium avium subsp. paratuberculosis
cacagcucgggcagcgugucccgg

SEQ ID NO: 2972257 - RNA, 19 nt, Mycobacterium avium subsp. paratuberculosis
cacagcugacgggccggcg

SEQ ID NO: 2972258 - RNA, 21 nt, Mycobacterium avium subsp. paratuberculosis
cacagcugacgggccggcggg

SEQ ID NO: 2972259 - RNA, 23 nt, Mycobacterium avium subsp. paratuberculosis
cacagcugacgggccggcggggu

SEQ ID NO: 2972260 - RNA, 13 nt, Mycobacterium avium subsp. paratuberculosis
cacagcugcaggc

SEQ ID NO: 2972261 - RNA, 22 nt, Mycobacterium avium subsp. paratuberculosis
cacagcugcuggcugcggcccc

SEQ ID NO: 2972262 - RNA, 16 nt, Mycobacterium avium subsp. paratuberculosis
cacagcuucggcgccg

SEQ ID NO: 2972263 - RNA, 20 nt, Mycobacterium avium subsp. paratuberculosis
cacagcuugccggagcccag

SEQ ID NO: 2972264 - RNA, 15 nt, Mycobacterium avium subsp. paratuberculosis
cacaggaacgcgacg

SEQ ID NO: 2972265 - RNA, 16 nt, Mycobacterium avium subsp. paratuberculosis
cacaggaacgcgacgg

SEQ ID NO: 2972266 - RNA, 18 nt, Mycobacterium avium subsp. paratuberculosis
cacaggaacgcgucgacc

SEQ ID NO: 2972267 - RNA, 21 nt, Mycobacterium avium subsp. paratuberculosis
cacaggaacgcgucgaccgcc

SEQ ID NO: 2972268 - RNA, 22 nt, Mycobacterium avium subsp. paratuberculosis
cacaggaacgcgucgaccgccg

SEQ ID NO: 2972269 - RNA, 20 nt, Mycobacterium avium subsp. paratuberculosis
cacaggacguugaggcggcg

SEQ ID NO: 2972270 - RNA, 23 nt, Mycobacterium avium subsp. paratuberculosis
cacaggacguugaggcggcggcg

SEQ ID NO: 2972271 - RNA, 20 nt, Mycobacterium avium subsp. paratuberculosis
cacaggaugcccaacagcuc

SEQ ID NO: 2972272 - RNA, 18 nt, Mycobacterium avium subsp. paratuberculosis
cacaggcacacgaacacc

SEQ ID NO: 2972273 - RNA, 19 nt, Mycobacterium avium subsp. paratuberculosis
cacaggccgaacagcagcg

SEQ ID NO: 2972274 - RNA, 12 nt, Mycobacterium avium subsp. paratuberculosis
cacaggccgccg

SEQ ID NO: 2972275 - RNA, 16 nt, Mycobacterium avium subsp. paratuberculosis
cacaggccgccgcauu

SEQ ID NO: 2972276 - RNA, 12 nt, Mycobacterium avium subsp. paratuberculosis
cacaggccgccu

SEQ ID NO: 2972277 - RNA, 13 nt, Mycobacterium avium subsp. paratuberculosis
cacaggccgccuc

SEQ ID NO: 2972278 - RNA, 12 nt, Mycobacterium avium subsp. paratuberculosis
cacagggcggcg

SEQ ID NO: 2972279 - RNA, 15 nt, Mycobacterium avium subsp. paratuberculosis
cacagggcggcgaca

SEQ ID NO: 2972280 - RNA, 23 nt, Mycobacterium avium subsp. paratuberculosis
cacagggcggcgacacgccgacg

SEQ ID NO: 2972281 - RNA, 14 nt, Mycobacterium avium subsp. paratuberculosis
cacaggggcgcgua

SEQ ID NO: 2972282 - RNA, 20 nt, Mycobacterium avium subsp. paratuberculosis
cacagguccagcguccgggc

SEQ ID NO: 2972283 - RNA, 15 nt, Mycobacterium avium subsp. paratuberculosis
cacaggucgcccggc

SEQ ID NO: 2972284 - RNA, 17 nt, Mycobacterium avium subsp. paratuberculosis
cacaggucgcccggcuc

SEQ ID NO: 2972285 - RNA, 18 nt, Mycobacterium avium subsp. paratuberculosis
cacaggucgcccggcucg

SEQ ID NO: 2972286 - RNA, 21 nt, Mycobacterium avium subsp. paratuberculosis
cacaggucgcccggcucgccg

SEQ ID NO: 2972287 - RNA, 15 nt, Mycobacterium avium subsp. paratuberculosis
cacaggugacgacgc

SEQ ID NO: 2972288 - RNA, 16 nt, Mycobacterium avium subsp. paratuberculosis
cacaggugacgacgcu

SEQ ID NO: 2972289 - RNA, 14 nt, Mycobacterium avium subsp. paratuberculosis
cacaguggccgcca

SEQ ID NO: 2972290 - RNA, 15 nt, Mycobacterium avium subsp. paratuberculosis
cacauacgccucacc

SEQ ID NO: 2972291 - RNA, 16 nt, Mycobacterium avium subsp. paratuberculosis
cacauacgcggcggcc

SEQ ID NO: 2972292 - RNA, 22 nt, Mycobacterium avium subsp. paratuberculosis
cacaucacgguggccgccacca

SEQ ID NO: 2972293 - RNA, 15 nt, Mycobacterium avium subsp. paratuberculosis
cacaucagcucggcg

SEQ ID NO: 2972294 - RNA, 17 nt, Mycobacterium avium subsp. paratuberculosis
cacaucagcucggcggc

SEQ ID NO: 2972295 - RNA, 18 nt, Mycobacterium avium subsp. paratuberculosis
cacaucagcucggcggcc

SEQ ID NO: 2972296 - RNA, 22 nt, Mycobacterium avium subsp. paratuberculosis
cacaucagcucggcggccucgc

SEQ ID NO: 2972297 - RNA, 19 nt, Mycobacterium avium subsp. paratuberculosis
cacaucaggaucgacgucg

SEQ ID NO: 2972298 - RNA, 15 nt, Mycobacterium avium subsp. paratuberculosis
cacaucccgaaugag

SEQ ID NO: 2972299 - RNA, 22 nt, Mycobacterium avium subsp. paratuberculosis
cacaucccgcaauugcgccagc

SEQ ID NO: 2972300 - RNA, 15 nt, Mycobacterium avium subsp. paratuberculosis
cacauccgucacgcc

SEQ ID NO: 2972301 - RNA, 19 nt, Mycobacterium avium subsp. paratuberculosis
cacauccgucacgcccguc

SEQ ID NO: 2972302 - RNA, 19 nt, Mycobacterium avium subsp. paratuberculosis
cacaucggacaucggcagc

SEQ ID NO: 2972303 - RNA, 14 nt, Mycobacterium avium subsp. paratuberculosis
cacaucggagagcu

SEQ ID NO: 2972304 - RNA, 20 nt, Mycobacterium avium subsp. paratuberculosis
cacaucggagagcuugccgc

SEQ ID NO: 2972305 - RNA, 23 nt, Mycobacterium avium subsp. paratuberculosis
cacaucgguugcuccggcgucga

SEQ ID NO: 2972306 - RNA, 13 nt, Mycobacterium avium subsp. paratuberculosis
cacaucguggcga

SEQ ID NO: 2972307 - RNA, 15 nt, Mycobacterium avium subsp. paratuberculosis
cacaucguggcgacg

SEQ ID NO: 2972308 - RNA, 19 nt, Mycobacterium avium subsp. paratuberculosis
cacaucguggcgacgacgc

SEQ ID NO: 2972309 - RNA, 14 nt, Mycobacterium avium subsp. paratuberculosis
cacaucugccggca

SEQ ID NO: 2972310 - RNA, 15 nt, Mycobacterium avium subsp. paratuberculosis
cacaucugccggcag

SEQ ID NO: 2972311 - RNA, 16 nt, Mycobacterium avium subsp. paratuberculosis
cacaucugccggcaga

SEQ ID NO: 2972312 - RNA, 16 nt, Mycobacterium avium subsp. paratuberculosis
cacaugccgaggcaca

SEQ ID NO: 2972313 - RNA, 17 nt, Mycobacterium avium subsp. paratuberculosis
cacaugccgaggcacag

SEQ ID NO: 2972314 - RNA, 18 nt, Mycobacterium avium subsp. paratuberculosis
cacaugggccacggcgcg

SEQ ID NO: 2972315 - RNA, 14 nt, Mycobacterium avium subsp. paratuberculosis
cacaugguccugca

SEQ ID NO: 2972316 - RNA, 16 nt, Mycobacterium avium subsp. paratuberculosis
cacaugguccugcacc

SEQ ID NO: 2972317 - RNA, 13 nt, Mycobacterium avium subsp. paratuberculosis
cacauuggcgacc

SEQ ID NO: 2972318 - RNA, 22 nt, Mycobacterium avium subsp. paratuberculosis
caccaaaaguguuuccgcugag

SEQ ID NO: 2972319 - RNA, 17 nt, Mycobacterium avium subsp. paratuberculosis
caccaaacgaagugaug

SEQ ID NO: 2972320 - RNA, 21 nt, Mycobacterium avium subsp. paratuberculosis
caccaaauagccgucggcggc

SEQ ID NO: 2972321 - RNA, 14 nt, Mycobacterium avium subsp. paratuberculosis
caccaacagcagcg

SEQ ID NO: 2972322 - RNA, 13 nt, Mycobacterium avium subsp. paratuberculosis
caccaacagcggc

SEQ ID NO: 2972323 - RNA, 17 nt, Mycobacterium avium subsp. paratuberculosis
caccaacagcggcccga

SEQ ID NO: 2972324 - RNA, 22 nt, Mycobacterium avium subsp. paratuberculosis
caccaacagcggcccgaucacc

SEQ ID NO: 2972325 - RNA, 23 nt, Mycobacterium avium subsp. paratuberculosis
caccaacagcggcccgaucaccg

SEQ ID NO: 2972326 - RNA, 13 nt, Mycobacterium avium subsp. paratuberculosis
caccaacaggucg

SEQ ID NO: 2972327 - RNA, 16 nt, Mycobacterium avium subsp. paratuberculosis
caccaacaggucggcg

SEQ ID NO: 2972328 - RNA, 17 nt, Mycobacterium avium subsp. paratuberculosis
caccaacaggucggcgu

SEQ ID NO: 2972329 - RNA, 17 nt, Mycobacterium avium subsp. paratuberculosis
caccaacaucgacgugc

SEQ ID NO: 2972330 - RNA, 20 nt, Mycobacterium avium subsp. paratuberculosis
caccaacaucgacgugccgu

SEQ ID NO: 2972331 - RNA, 22 nt, Mycobacterium avium subsp. paratuberculosis
caccaacccgaucggcccggcc

SEQ ID NO: 2972332 - RNA, 14 nt, Mycobacterium avium subsp. paratuberculosis
caccaaccgcucgg

SEQ ID NO: 2972333 - RNA, 17 nt, Mycobacterium avium subsp. paratuberculosis
caccaaccgcucggcga

SEQ ID NO: 2972334 - RNA, 18 nt, Mycobacterium avium subsp. paratuberculosis
caccaaccgcucggcgau

SEQ ID NO: 2972335 - RNA, 19 nt, Mycobacterium avium subsp. paratuberculosis
caccaaccgcucggcgauc

SEQ ID NO: 2972336 - RNA, 20 nt, Mycobacterium avium subsp. paratuberculosis
caccaaccggccccgagcgu

SEQ ID NO: 2972337 - RNA, 16 nt, Mycobacterium avium subsp. paratuberculosis
caccaacgacagcgac

SEQ ID NO: 2972338 - RNA, 13 nt, Mycobacterium avium subsp. paratuberculosis
caccaacgccacg

SEQ ID NO: 2972339 - RNA, 14 nt, Mycobacterium avium subsp. paratuberculosis
caccaacgccacgu

SEQ ID NO: 2972340 - RNA, 13 nt, Mycobacterium avium subsp. paratuberculosis
caccaacggcagc

SEQ ID NO: 2972341 - RNA, 14 nt, Mycobacterium avium subsp. paratuberculosis
caccaagcgcgaca

SEQ ID NO: 2972342 - RNA, 20 nt, Mycobacterium avium subsp. paratuberculosis
caccaaggcgauuucgggau

SEQ ID NO: 2972343 - RNA, 18 nt, Mycobacterium avium subsp. paratuberculosis
caccaaggucuccgggcu

SEQ ID NO: 2972344 - RNA, 13 nt, Mycobacterium avium subsp. paratuberculosis
caccaaugcgccg

SEQ ID NO: 2972345 - RNA, 17 nt, Mycobacterium avium subsp. paratuberculosis
caccaaugcgccggcgg

SEQ ID NO: 2972346 - RNA, 18 nt, Mycobacterium avium subsp. paratuberculosis
caccaaugcgccggcggc

SEQ ID NO: 2972347 - RNA, 20 nt, Mycobacterium avium subsp. paratuberculosis
caccaaugcgccggcggccg

SEQ ID NO: 2972348 - RNA, 22 nt, Mycobacterium avium subsp. paratuberculosis
caccaaugcgccggcggccgcg

SEQ ID NO: 2972349 - RNA, 23 nt, Mycobacterium avium subsp. paratuberculosis
caccaaugcgccggcggccgcga

SEQ ID NO: 2972350 - RNA, 14 nt, Mycobacterium avium subsp. paratuberculosis
caccaauggcggcc

SEQ ID NO: 2972351 - RNA, 16 nt, Mycobacterium avium subsp. paratuberculosis
caccaauggcggccac

SEQ ID NO: 2972352 - RNA, 18 nt, Mycobacterium avium subsp. paratuberculosis
caccaauucgcgcugcca

SEQ ID NO: 2972353 - RNA, 20 nt, Mycobacterium avium subsp. paratuberculosis
caccacaucggucucgacac

SEQ ID NO: 2972354 - RNA, 21 nt, Mycobacterium avium subsp. paratuberculosis
caccacaucgguugcuccggc

SEQ ID NO: 2972355 - RNA, 23 nt, Mycobacterium avium subsp. paratuberculosis
caccacaucgguugcuccggcgu

SEQ ID NO: 2972356 - RNA, 17 nt, Mycobacterium avium subsp. paratuberculosis
caccacauucccgccgc

SEQ ID NO: 2972357 - RNA, 19 nt, Mycobacterium avium subsp. paratuberculosis
caccacauucccgccgccg

SEQ ID NO: 2972358 - RNA, 21 nt, Mycobacterium avium subsp. paratuberculosis
caccacauucccgccgccgcg

SEQ ID NO: 2972359 - RNA, 20 nt, Mycobacterium avium subsp. paratuberculosis
caccacauuggcgaccgcgg

SEQ ID NO: 2972360 - RNA, 22 nt, Mycobacterium avium subsp. paratuberculosis
caccacauuggcgaccgcggcc

SEQ ID NO: 2972361 - RNA, 13 nt, Mycobacterium avium subsp. paratuberculosis
caccaccaacgcc

SEQ ID NO: 2972362 - RNA, 19 nt, Mycobacterium avium subsp. paratuberculosis
caccaccaacggcucgccg

SEQ ID NO: 2972363 - RNA, 13 nt, Mycobacterium avium subsp. paratuberculosis
caccaccacaccc

SEQ ID NO: 2972364 - RNA, 21 nt, Mycobacterium avium subsp. paratuberculosis
caccaccacacccgcggccgc

SEQ ID NO: 2972365 - RNA, 16 nt, Mycobacterium avium subsp. paratuberculosis
caccaccaccaguucc

SEQ ID NO: 2972366 - RNA, 15 nt, Mycobacterium avium subsp. paratuberculosis
caccaccaccgagcc

SEQ ID NO: 2972367 - RNA, 13 nt, Mycobacterium avium subsp. paratuberculosis
caccaccaccgcc

SEQ ID NO: 2972368 - RNA, 14 nt, Mycobacterium avium subsp. paratuberculosis
caccaccaccgccg

SEQ ID NO: 2972369 - RNA, 15 nt, Mycobacterium avium subsp. paratuberculosis
caccaccaccgccgu

SEQ ID NO: 2972370 - RNA, 16 nt, Mycobacterium avium subsp. paratuberculosis
caccaccacgaacugg

SEQ ID NO: 2972371 - RNA, 21 nt, Mycobacterium avium subsp. paratuberculosis
caccaccacggagcgcccggc

SEQ ID NO: 2972372 - RNA, 13 nt, Mycobacterium avium subsp. paratuberculosis
caccaccacggcc

SEQ ID NO: 2972373 - RNA, 15 nt, Mycobacterium avium subsp. paratuberculosis
caccaccacggccag

SEQ ID NO: 2972374 - RNA, 16 nt, Mycobacterium avium subsp. paratuberculosis
caccaccacggccaug

SEQ ID NO: 2972375 - RNA, 15 nt, Mycobacterium avium subsp. paratuberculosis
caccaccacggccgc

SEQ ID NO: 2972376 - RNA, 22 nt, Mycobacterium avium subsp. paratuberculosis
caccaccacggccgccgaggcg

SEQ ID NO: 2972377 - RNA, 15 nt, Mycobacterium avium subsp. paratuberculosis
caccaccacggggcg

SEQ ID NO: 2972378 - RNA, 23 nt, Mycobacterium avium subsp. paratuberculosis
caccaccacgugccccuccucgg

SEQ ID NO: 2972379 - RNA, 20 nt, Mycobacterium avium subsp. paratuberculosis
caccaccagcgggcugugcc

SEQ ID NO: 2972380 - RNA, 19 nt, Mycobacterium avium subsp. paratuberculosis
caccaccagcucgucgccg

SEQ ID NO: 2972381 - RNA, 22 nt, Mycobacterium avium subsp. paratuberculosis
caccaccagcucgucgccgacc

SEQ ID NO: 2972382 - RNA, 13 nt, Mycobacterium avium subsp. paratuberculosis
caccaccaggggc

SEQ ID NO: 2972383 - RNA, 13 nt, Mycobacterium avium subsp. paratuberculosis
caccaccaggucu

SEQ ID NO: 2972384 - RNA, 22 nt, Mycobacterium avium subsp. paratuberculosis
caccaccaggucuccgucggcg

SEQ ID NO: 2972385 - RNA, 14 nt, Mycobacterium avium subsp. paratuberculosis
caccacccagcccu

SEQ ID NO: 2972386 - RNA, 17 nt, Mycobacterium avium subsp. paratuberculosis
caccacccaggccaccc

SEQ ID NO: 2972387 - RNA, 21 nt, Mycobacterium avium subsp. paratuberculosis
caccacccaggccacccgggc

SEQ ID NO: 2972388 - RNA, 22 nt, Mycobacterium avium subsp. paratuberculosis
caccacccaggccacccgggcg

SEQ ID NO: 2972389 - RNA, 14 nt, Mycobacterium avium subsp. paratuberculosis
caccacccccgacc

SEQ ID NO: 2972390 - RNA, 17 nt, Mycobacterium avium subsp. paratuberculosis
caccacccccgacccga

SEQ ID NO: 2972391 - RNA, 14 nt, Mycobacterium avium subsp. paratuberculosis
caccaccccggugc

SEQ ID NO: 2972392 - RNA, 15 nt, Mycobacterium avium subsp. paratuberculosis
caccacccgcggccg

SEQ ID NO: 2972393 - RNA, 17 nt, Mycobacterium avium subsp. paratuberculosis
caccacccgcggccggc

SEQ ID NO: 2972394 - RNA, 18 nt, Mycobacterium avium subsp. paratuberculosis
caccacccgguccuucuc

SEQ ID NO: 2972395 - RNA, 16 nt, Mycobacterium avium subsp. paratuberculosis
caccaccgacaccccg

SEQ ID NO: 2972396 - RNA, 17 nt, Mycobacterium avium subsp. paratuberculosis
caccaccgacagcaccc

SEQ ID NO: 2972397 - RNA, 21 nt, Mycobacterium avium subsp. paratuberculosis
caccaccgacagcacccggcc

SEQ ID NO: 2972398 - RNA, 11 nt, Mycobacterium avium subsp. paratuberculosis
caccaccgaga

SEQ ID NO: 2972399 - RNA, 16 nt, Mycobacterium avium subsp. paratuberculosis
caccaccgagccggcg

SEQ ID NO: 2972400 - RNA, 17 nt, Mycobacterium avium subsp. paratuberculosis
caccaccgagccggcgu

SEQ ID NO: 2972401 - RNA, 19 nt, Mycobacterium avium subsp. paratuberculosis
caccaccgagccggcgucg

SEQ ID NO: 2972402 - RNA, 16 nt, Mycobacterium avium subsp. paratuberculosis
caccaccgagccggug

SEQ ID NO: 2972403 - RNA, 13 nt, Mycobacterium avium subsp. paratuberculosis
caccaccgccacc

SEQ ID NO: 2972404 - RNA, 16 nt, Mycobacterium avium subsp. paratuberculosis
caccaccgccaccagc

SEQ ID NO: 2972405 - RNA, 13 nt, Mycobacterium avium subsp. paratuberculosis
caccaccgccagg

SEQ ID NO: 2972406 - RNA, 13 nt, Mycobacterium avium subsp. paratuberculosis
caccaccgcccac

SEQ ID NO: 2972407 - RNA, 16 nt, Mycobacterium avium subsp. paratuberculosis
caccaccgcccacagc

SEQ ID NO: 2972408 - RNA, 17 nt, Mycobacterium avium subsp. paratuberculosis
caccaccgcccacagca

SEQ ID NO: 2972409 - RNA, 23 nt, Mycobacterium avium subsp. paratuberculosis
caccaccgcccacagcaacgaca

SEQ ID NO: 2972410 - RNA, 22 nt, Mycobacterium avium subsp. paratuberculosis
caccaccgcccggaccggcucg

SEQ ID NO: 2972411 - RNA, 14 nt, Mycobacterium avium subsp. paratuberculosis
caccaccgccgccg

SEQ ID NO: 2972412 - RNA, 17 nt, Mycobacterium avium subsp. paratuberculosis
caccaccgccgccgacu

SEQ ID NO: 2972413 - RNA, 12 nt, Mycobacterium avium subsp. paratuberculosis
caccaccgccgg

SEQ ID NO: 2972414 - RNA, 13 nt, Mycobacterium avium subsp. paratuberculosis
caccaccgccggc

SEQ ID NO: 2972415 - RNA, 14 nt, Mycobacterium avium subsp. paratuberculosis
caccaccgccggcc

SEQ ID NO: 2972416 - RNA, 21 nt, Mycobacterium avium subsp. paratuberculosis
caccaccgccggcccaggcag

SEQ ID NO: 2972417 - RNA, 22 nt, Mycobacterium avium subsp. paratuberculosis
caccaccgccggcccaggcagu

SEQ ID NO: 2972418 - RNA, 16 nt, Mycobacterium avium subsp. paratuberculosis
caccaccgccucgacg

SEQ ID NO: 2972419 - RNA, 22 nt, Mycobacterium avium subsp. paratuberculosis
caccaccgccucgacggugacc

SEQ ID NO: 2972420 - RNA, 12 nt, Mycobacterium avium subsp. paratuberculosis
caccaccgcgag

SEQ ID NO: 2972421 - RNA, 11 nt, Mycobacterium avium subsp. paratuberculosis
caccaccgcgc

SEQ ID NO: 2972422 - RNA, 15 nt, Mycobacterium avium subsp. paratuberculosis
caccaccgcgccguc

SEQ ID NO: 2972423 - RNA, 16 nt, Mycobacterium avium subsp. paratuberculosis
caccaccgcgccgucg

SEQ ID NO: 2972424 - RNA, 17 nt, Mycobacterium avium subsp. paratuberculosis
caccaccgcgccgucgu

SEQ ID NO: 2972425 - RNA, 13 nt, Mycobacterium avium subsp. paratuberculosis
caccaccgcgcgc

SEQ ID NO: 2972426 - RNA, 14 nt, Mycobacterium avium subsp. paratuberculosis
caccaccgcgcgca

SEQ ID NO: 2972427 - RNA, 20 nt, Mycobacterium avium subsp. paratuberculosis
caccaccgcgcugcgcgcgu

SEQ ID NO: 2972428 - RNA, 21 nt, Mycobacterium avium subsp. paratuberculosis
caccaccgcggugagcggccg

SEQ ID NO: 2972429 - RNA, 16 nt, Mycobacterium avium subsp. paratuberculosis
caccaccgcggugggc

SEQ ID NO: 2972430 - RNA, 22 nt, Mycobacterium avium subsp. paratuberculosis
caccaccgcguugaucagcgcc

SEQ ID NO: 2972431 - RNA, 13 nt, Mycobacterium avium subsp. paratuberculosis
caccaccggagcg

SEQ ID NO: 2972432 - RNA, 14 nt, Mycobacterium avium subsp. paratuberculosis
caccaccggcaacc

SEQ ID NO: 2972433 - RNA, 23 nt, Mycobacterium avium subsp. paratuberculosis
caccaccggcaaccgccacgacg

SEQ ID NO: 2972434 - RNA, 12 nt, Mycobacterium avium subsp. paratuberculosis
caccaccggccg

SEQ ID NO: 2972435 - RNA, 15 nt, Mycobacterium avium subsp. paratuberculosis
caccaccggccgccc

SEQ ID NO: 2972436 - RNA, 17 nt, Mycobacterium avium subsp. paratuberculosis
caccaccggccgcccgg

SEQ ID NO: 2972437 - RNA, 21 nt, Mycobacterium avium subsp. paratuberculosis
caccaccggccgcccggcgag

SEQ ID NO: 2972438 - RNA, 14 nt, Mycobacterium avium subsp. paratuberculosis
caccaccgggucgu

SEQ ID NO: 2972439 - RNA, 18 nt, Mycobacterium avium subsp. paratuberculosis
caccaccgggucgucgcg

SEQ ID NO: 2972440 - RNA, 14 nt, Mycobacterium avium subsp. paratuberculosis
caccaccggugaac

SEQ ID NO: 2972441 - RNA, 19 nt, Mycobacterium avium subsp. paratuberculosis
caccaccgucaccgccgca

SEQ ID NO: 2972442 - RNA, 11 nt, Mycobacterium avium subsp. paratuberculosis
caccaccgugc

SEQ ID NO: 2972443 - RNA, 18 nt, Mycobacterium avium subsp. paratuberculosis
caccaccgugccgucgcg

SEQ ID NO: 2972444 - RNA, 19 nt, Mycobacterium avium subsp. paratuberculosis
caccaccgugccgucgcgg

SEQ ID NO: 2972445 - RNA, 23 nt, Mycobacterium avium subsp. paratuberculosis
caccaccgugccgucgcgggcgu

SEQ ID NO: 2972446 - RNA, 16 nt, Mycobacterium avium subsp. paratuberculosis
caccaccguggcgaug

SEQ ID NO: 2972447 - RNA, 17 nt, Mycobacterium avium subsp. paratuberculosis
caccaccguggcgaugg

SEQ ID NO: 2972448 - RNA, 20 nt, Mycobacterium avium subsp. paratuberculosis
caccaccuccucgcgggcga

SEQ ID NO: 2972449 - RNA, 14 nt, Mycobacterium avium subsp. paratuberculosis
caccaccucgcgcg

SEQ ID NO: 2972450 - RNA, 18 nt, Mycobacterium avium subsp. paratuberculosis
caccaccucgcgggcgac

SEQ ID NO: 2972451 - RNA, 14 nt, Mycobacterium avium subsp. paratuberculosis
caccaccucggcga

SEQ ID NO: 2972452 - RNA, 15 nt, Mycobacterium avium subsp. paratuberculosis
caccaccucggcgau

SEQ ID NO: 2972453 - RNA, 16 nt, Mycobacterium avium subsp. paratuberculosis
caccaccucggcgauc

SEQ ID NO: 2972454 - RNA, 14 nt, Mycobacterium avium subsp. paratuberculosis
caccaccugcacgg

SEQ ID NO: 2972455 - RNA, 15 nt, Mycobacterium avium subsp. paratuberculosis
caccaccugcuucca

SEQ ID NO: 2972456 - RNA, 16 nt, Mycobacterium avium subsp. paratuberculosis
caccaccuggccggcc

SEQ ID NO: 2972457 - RNA, 18 nt, Mycobacterium avium subsp. paratuberculosis
caccaccugguccugccc

SEQ ID NO: 2972458 - RNA, 17 nt, Mycobacterium avium subsp. paratuberculosis
caccaccuucaucgccg

SEQ ID NO: 2972459 - RNA, 19 nt, Mycobacterium avium subsp. paratuberculosis
caccaccuucaucgccguc

SEQ ID NO: 2972460 - RNA, 17 nt, Mycobacterium avium subsp. paratuberculosis
caccaccuugguggccg

SEQ ID NO: 2972461 - RNA, 20 nt, Mycobacterium avium subsp. paratuberculosis
caccaccuugguggccgcgg

SEQ ID NO: 2972462 - RNA, 22 nt, Mycobacterium avium subsp. paratuberculosis
caccaccuugguggccgcggcc

SEQ ID NO: 2972463 - RNA, 21 nt, Mycobacterium avium subsp. paratuberculosis
caccacgaaccaggcgccggc

SEQ ID NO: 2972464 - RNA, 16 nt, Mycobacterium avium subsp. paratuberculosis
caccacgaacgcgccg

SEQ ID NO: 2972465 - RNA, 19 nt, Mycobacterium avium subsp. paratuberculosis
caccacgaacgcgccgccg

SEQ ID NO: 2972466 - RNA, 23 nt, Mycobacterium avium subsp. paratuberculosis
caccacgaacgcgccgccgagca

SEQ ID NO: 2972467 - RNA, 17 nt, Mycobacterium avium subsp. paratuberculosis
caccacgaacugggugc

SEQ ID NO: 2972468 - RNA, 15 nt, Mycobacterium avium subsp. paratuberculosis
caccacgaagcgggc

SEQ ID NO: 2972469 - RNA, 12 nt, Mycobacterium avium subsp. paratuberculosis
caccacgaccag

SEQ ID NO: 2972470 - RNA, 16 nt, Mycobacterium avium subsp. paratuberculosis
caccacgaccagugcc

SEQ ID NO: 2972471 - RNA, 21 nt, Mycobacterium avium subsp. paratuberculosis
caccacgaccagugcccggcc

SEQ ID NO: 2972472 - RNA, 20 nt, Mycobacterium avium subsp. paratuberculosis
caccacgaccuccgugccga

SEQ ID NO: 2972473 - RNA, 13 nt, Mycobacterium avium subsp. paratuberculosis
caccacgacgccg

SEQ ID NO: 2972474 - RNA, 14 nt, Mycobacterium avium subsp. paratuberculosis
caccacgacgccgg

SEQ ID NO: 2972475 - RNA, 19 nt, Mycobacterium avium subsp. paratuberculosis
caccacgacgccgggcgcc

SEQ ID NO: 2972476 - RNA, 20 nt, Mycobacterium avium subsp. paratuberculosis
caccacgacgccgggcgccc

SEQ ID NO: 2972477 - RNA, 13 nt, Mycobacterium avium subsp. paratuberculosis
caccacgacgggg

SEQ ID NO: 2972478 - RNA, 23 nt, Mycobacterium avium subsp. paratuberculosis
caccacgacggggaacucgguga

SEQ ID NO: 2972479 - RNA, 22 nt, Mycobacterium avium subsp. paratuberculosis
caccacgacgucgagccagcgg

SEQ ID NO: 2972480 - RNA, 21 nt, Mycobacterium avium subsp. paratuberculosis
caccacgaggaccagcaugug

SEQ ID NO: 2972481 - RNA, 13 nt, Mycobacterium avium subsp. paratuberculosis
caccacgaucacc

SEQ ID NO: 2972482 - RNA, 16 nt, Mycobacterium avium subsp. paratuberculosis
caccacgaucaccaga

SEQ ID NO: 2972483 - RNA, 16 nt, Mycobacterium avium subsp. paratuberculosis
caccacgaucagcgcg

SEQ ID NO: 2972484 - RNA, 21 nt, Mycobacterium avium subsp. paratuberculosis
caccacgauccaaccgagucg

SEQ ID NO: 2972485 - RNA, 14 nt, Mycobacterium avium subsp. paratuberculosis
caccacgaugaagc

SEQ ID NO: 2972486 - RNA, 21 nt, Mycobacterium avium subsp. paratuberculosis
caccacgaugaagccgugccc

SEQ ID NO: 2972487 - RNA, 21 nt, Mycobacterium avium subsp. paratuberculosis
caccacgcccuuguuguucca

SEQ ID NO: 2972488 - RNA, 14 nt, Mycobacterium avium subsp. paratuberculosis
caccacgccgacgu

SEQ ID NO: 2972489 - RNA, 22 nt, Mycobacterium avium subsp. paratuberculosis
caccacgccgacguggguggug

SEQ ID NO: 2972490 - RNA, 14 nt, Mycobacterium avium subsp. paratuberculosis
caccacgccgagca

SEQ ID NO: 2972491 - RNA, 14 nt, Mycobacterium avium subsp. paratuberculosis
caccacgcuggccc

SEQ ID NO: 2972492 - RNA, 21 nt, Mycobacterium avium subsp. paratuberculosis
caccacgcuguagggccacca

SEQ ID NO: 2972493 - RNA, 18 nt, Mycobacterium avium subsp. paratuberculosis
caccacggagcgcccggc

SEQ ID NO: 2972494 - RNA, 19 nt, Mycobacterium avium subsp. paratuberculosis
caccacggagcgcccggcc

SEQ ID NO: 2972495 - RNA, 12 nt, Mycobacterium avium subsp. paratuberculosis
caccacggcacc

SEQ ID NO: 2972496 - RNA, 13 nt, Mycobacterium avium subsp. paratuberculosis
caccacggcaccg

SEQ ID NO: 2972497 - RNA, 18 nt, Mycobacterium avium subsp. paratuberculosis
caccacggcaccgccgcg

SEQ ID NO: 2972498 - RNA, 19 nt, Mycobacterium avium subsp. paratuberculosis
caccacggcaccgccgcgc

SEQ ID NO: 2972499 - RNA, 14 nt, Mycobacterium avium subsp. paratuberculosis
caccacggccagga

SEQ ID NO: 2972500 - RNA, 22 nt, Mycobacterium avium subsp. paratuberculosis
caccacggccaggaagccggcg

SEQ ID NO: 2972501 - RNA, 14 nt, Mycobacterium avium subsp. paratuberculosis
caccacggccaugc

SEQ ID NO: 2972502 - RNA, 14 nt, Mycobacterium avium subsp. paratuberculosis
caccacggcccgcg

SEQ ID NO: 2972503 - RNA, 18 nt, Mycobacterium avium subsp. paratuberculosis
caccacggcccgcgcccc

SEQ ID NO: 2972504 - RNA, 16 nt, Mycobacterium avium subsp. paratuberculosis
caccacggccgaugca

SEQ ID NO: 2972505 - RNA, 16 nt, Mycobacterium avium subsp. paratuberculosis
caccacggccgcagcg

SEQ ID NO: 2972506 - RNA, 13 nt, Mycobacterium avium subsp. paratuberculosis
caccacggccgcc

SEQ ID NO: 2972507 - RNA, 15 nt, Mycobacterium avium subsp. paratuberculosis
caccacggccgccga

SEQ ID NO: 2972508 - RNA, 22 nt, Mycobacterium avium subsp. paratuberculosis
caccacggccgccgaggcgaug

SEQ ID NO: 2972509 - RNA, 13 nt, Mycobacterium avium subsp. paratuberculosis
caccacggccggc

SEQ ID NO: 2972510 - RNA, 16 nt, Mycobacterium avium subsp. paratuberculosis
caccacggccggcaac

SEQ ID NO: 2972511 - RNA, 13 nt, Mycobacterium avium subsp. paratuberculosis
caccacggcgccc

SEQ ID NO: 2972512 - RNA, 17 nt, Mycobacterium avium subsp. paratuberculosis
caccacgggucggucgg

SEQ ID NO: 2972513 - RNA, 19 nt, Mycobacterium avium subsp. paratuberculosis
caccacgggucggucggcc

SEQ ID NO: 2972514 - RNA, 20 nt, Mycobacterium avium subsp. paratuberculosis
caccacgggucggucggccc

SEQ ID NO: 2972515 - RNA, 21 nt, Mycobacterium avium subsp. paratuberculosis
caccacgggucggucggcccg

SEQ ID NO: 2972516 - RNA, 17 nt, Mycobacterium avium subsp. paratuberculosis
caccacggucaccccga

SEQ ID NO: 2972517 - RNA, 16 nt, Mycobacterium avium subsp. paratuberculosis
caccacggucagggcc

SEQ ID NO: 2972518 - RNA, 17 nt, Mycobacterium avium subsp. paratuberculosis
caccacgguccccgcgc

SEQ ID NO: 2972519 - RNA, 19 nt, Mycobacterium avium subsp. paratuberculosis
caccacgguccccgcgccc

SEQ ID NO: 2972520 - RNA, 23 nt, Mycobacterium avium subsp. paratuberculosis
caccacgguccccgcgcccgccg

SEQ ID NO: 2972521 - RNA, 18 nt, Mycobacterium avium subsp. paratuberculosis
caccacggucgccgcgcc

SEQ ID NO: 2972522 - RNA, 19 nt, Mycobacterium avium subsp. paratuberculosis
caccacggucgccgcgccg

SEQ ID NO: 2972523 - RNA, 17 nt, Mycobacterium avium subsp. paratuberculosis
caccacggugaacgggc

SEQ ID NO: 2972524 - RNA, 20 nt, Mycobacterium avium subsp. paratuberculosis
caccacggugaacgggccgc

SEQ ID NO: 2972525 - RNA, 21 nt, Mycobacterium avium subsp. paratuberculosis
caccacggugaacgggccgca

SEQ ID NO: 2972526 - RNA, 19 nt, Mycobacterium avium subsp. paratuberculosis
caccacggugaucucgccg

SEQ ID NO: 2972527 - RNA, 21 nt, Mycobacterium avium subsp. paratuberculosis
caccacggugaucucgccgag

SEQ ID NO: 2972528 - RNA, 22 nt, Mycobacterium avium subsp. paratuberculosis
caccacggugaucucgccgagc

SEQ ID NO: 2972529 - RNA, 23 nt, Mycobacterium avium subsp. paratuberculosis
caccacggugaucucgccgagca

SEQ ID NO: 2972530 - RNA, 14 nt, Mycobacterium avium subsp. paratuberculosis
caccacgguggccg

SEQ ID NO: 2972531 - RNA, 19 nt, Mycobacterium avium subsp. paratuberculosis
caccacgguggccgcgaag

SEQ ID NO: 2972532 - RNA, 13 nt, Mycobacterium avium subsp. paratuberculosis
caccacgguggcg

SEQ ID NO: 2972533 - RNA, 18 nt, Mycobacterium avium subsp. paratuberculosis
caccacgguggcgccgcg

SEQ ID NO: 2972534 - RNA, 19 nt, Mycobacterium avium subsp. paratuberculosis
caccacgguggcgccgcgc

SEQ ID NO: 2972535 - RNA, 22 nt, Mycobacterium avium subsp. paratuberculosis
caccacgguggcgccgcgcagc

SEQ ID NO: 2972536 - RNA, 24 nt, Mycobacterium avium subsp. paratuberculosis
caccacgguggcgccgcgcagcca

SEQ ID NO: 2972537 - RNA, 14 nt, Mycobacterium avium subsp. paratuberculosis
caccacgguggcgu

SEQ ID NO: 2972538 - RNA, 21 nt, Mycobacterium avium subsp. paratuberculosis
caccacgguggcguccagcgg

SEQ ID NO: 2972539 - RNA, 17 nt, Mycobacterium avium subsp. paratuberculosis
caccacgguggugucgu

SEQ ID NO: 2972540 - RNA, 21 nt, Mycobacterium avium subsp. paratuberculosis
caccacgguguagcggcggcu

SEQ ID NO: 2972541 - RNA, 17 nt, Mycobacterium avium subsp. paratuberculosis
caccacguacuccugcg

SEQ ID NO: 2972542 - RNA, 19 nt, Mycobacterium avium subsp. paratuberculosis
caccacguacuccugcgcg

SEQ ID NO: 2972543 - RNA, 13 nt, Mycobacterium avium subsp. paratuberculosis
caccacguaggcg

SEQ ID NO: 2972544 - RNA, 17 nt, Mycobacterium avium subsp. paratuberculosis
caccacguaggcgauca

SEQ ID NO: 2972545 - RNA, 23 nt, Mycobacterium avium subsp. paratuberculosis
caccacguaggcgaucagcgcgc

SEQ ID NO: 2972546 - RNA, 18 nt, Mycobacterium avium subsp. paratuberculosis
caccacguccaccagcac

SEQ ID NO: 2972547 - RNA, 14 nt, Mycobacterium avium subsp. paratuberculosis
caccacguccgcgg

SEQ ID NO: 2972548 - RNA, 16 nt, Mycobacterium avium subsp. paratuberculosis
caccacgucggguucg

SEQ ID NO: 2972549 - RNA, 21 nt, Mycobacterium avium subsp. paratuberculosis
caccacgucggguucgccggu

SEQ ID NO: 2972550 - RNA, 15 nt, Mycobacterium avium subsp. paratuberculosis
caccacgucggugcc

SEQ ID NO: 2972551 - RNA, 16 nt, Mycobacterium avium subsp. paratuberculosis
caccacgucggugccg

SEQ ID NO: 2972552 - RNA, 17 nt, Mycobacterium avium subsp. paratuberculosis
caccacgucggugccgc

SEQ ID NO: 2972553 - RNA, 19 nt, Mycobacterium avium subsp. paratuberculosis
caccacgucggugccgcgu

SEQ ID NO: 2972554 - RNA, 20 nt, Mycobacterium avium subsp. paratuberculosis
caccacgucggugccgcguu

SEQ ID NO: 2972555 - RNA, 14 nt, Mycobacterium avium subsp. paratuberculosis
caccacgucgucgg

SEQ ID NO: 2972556 - RNA, 16 nt, Mycobacterium avium subsp. paratuberculosis
caccacgucgucggcc

SEQ ID NO: 2972557 - RNA, 19 nt, Mycobacterium avium subsp. paratuberculosis
caccacgucgucggccugc

SEQ ID NO: 2972558 - RNA, 16 nt, Mycobacterium avium subsp. paratuberculosis
caccacgugccacugg

SEQ ID NO: 2972559 - RNA, 15 nt, Mycobacterium avium subsp. paratuberculosis
caccacgugcgcguu

SEQ ID NO: 2972560 - RNA, 17 nt, Mycobacterium avium subsp. paratuberculosis
caccacguugcacggca

SEQ ID NO: 2972561 - RNA, 19 nt, Mycobacterium avium subsp. paratuberculosis
caccacguugcacggcagc

SEQ ID NO: 2972562 - RNA, 23 nt, Mycobacterium avium subsp. paratuberculosis
caccacguugcacggcagcaacu

SEQ ID NO: 2972563 - RNA, 17 nt, Mycobacterium avium subsp. paratuberculosis
caccacguugcgcggcc

SEQ ID NO: 2972564 - RNA, 19 nt, Mycobacterium avium subsp. paratuberculosis
caccacguugcgcggccgc

SEQ ID NO: 2972565 - RNA, 21 nt, Mycobacterium avium subsp. paratuberculosis
caccacguugcgcggccgcau

SEQ ID NO: 2972566 - RNA, 16 nt, Mycobacterium avium subsp. paratuberculosis
caccacugcgccguca

SEQ ID NO: 2972567 - RNA, 17 nt, Mycobacterium avium subsp. paratuberculosis
caccacugcgccgucau

SEQ ID NO: 2972568 - RNA, 17 nt, Mycobacterium avium subsp. paratuberculosis
caccacuuccagcaccg

SEQ ID NO: 2972569 - RNA, 21 nt, Mycobacterium avium subsp. paratuberculosis
caccacuuccagcaccggcug

SEQ ID NO: 2972570 - RNA, 23 nt, Mycobacterium avium subsp. paratuberculosis
caccacuugcccagauugcggcc

SEQ ID NO: 2972571 - RNA, 22 nt, Mycobacterium avium subsp. paratuberculosis
caccagaaccauuugcccagca

SEQ ID NO: 2972572 - RNA, 23 nt, Mycobacterium avium subsp. paratuberculosis
caccagaaccauuugcccagcag

SEQ ID NO: 2972573 - RNA, 23 nt, Mycobacterium avium subsp. paratuberculosis
caccagaccggguuugaggccca

SEQ ID NO: 2972574 - RNA, 14 nt, Mycobacterium avium subsp. paratuberculosis
caccagagcgccgg

SEQ ID NO: 2972575 - RNA, 20 nt, Mycobacterium avium subsp. paratuberculosis
caccagaucgccccgcugga

SEQ ID NO: 2972576 - RNA, 19 nt, Mycobacterium avium subsp. paratuberculosis
caccagaucgucgggcacc

SEQ ID NO: 2972577 - RNA, 14 nt, Mycobacterium avium subsp. paratuberculosis
caccagaucguguc

SEQ ID NO: 2972578 - RNA, 21 nt, Mycobacterium avium subsp. paratuberculosis
caccagaucguguccgcgccg

SEQ ID NO: 2972579 - RNA, 18 nt, Mycobacterium avium subsp. paratuberculosis
caccagaugcaccucgcc

SEQ ID NO: 2972580 - RNA, 18 nt, Mycobacterium avium subsp. paratuberculosis
caccagaugccgcucggc

SEQ ID NO: 2972581 - RNA, 19 nt, Mycobacterium avium subsp. paratuberculosis
caccagaugccgcucggcg

SEQ ID NO: 2972582 - RNA, 16 nt, Mycobacterium avium subsp. paratuberculosis
caccagaugccgggcu

SEQ ID NO: 2972583 - RNA, 17 nt, Mycobacterium avium subsp. paratuberculosis
caccagaugccgggcuc

SEQ ID NO: 2972584 - RNA, 18 nt, Mycobacterium avium subsp. paratuberculosis
caccagaugccgggcucc

SEQ ID NO: 2972585 - RNA, 19 nt, Mycobacterium avium subsp. paratuberculosis
caccagaugccgggcuccg

SEQ ID NO: 2972586 - RNA, 21 nt, Mycobacterium avium subsp. paratuberculosis
caccagaugccgggcuccgcg

SEQ ID NO: 2972587 - RNA, 19 nt, Mycobacterium avium subsp. paratuberculosis
caccagauucaccagcgcc

SEQ ID NO: 2972588 - RNA, 17 nt, Mycobacterium avium subsp. paratuberculosis
caccagcaacaccaggg

SEQ ID NO: 2972589 - RNA, 18 nt, Mycobacterium avium subsp. paratuberculosis
caccagcaacaccagggu

SEQ ID NO: 2972590 - RNA, 13 nt, Mycobacterium avium subsp. paratuberculosis
caccagcacaccg

SEQ ID NO: 2972591 - RNA, 17 nt, Mycobacterium avium subsp. paratuberculosis
caccagcacaccggauc

SEQ ID NO: 2972592 - RNA, 18 nt, Mycobacterium avium subsp. paratuberculosis
caccagcacaccggaucg

SEQ ID NO: 2972593 - RNA, 17 nt, Mycobacterium avium subsp. paratuberculosis
caccagcaccaccgugg

SEQ ID NO: 2972594 - RNA, 18 nt, Mycobacterium avium subsp. paratuberculosis
caccagcaccaggcgggu

SEQ ID NO: 2972595 - RNA, 20 nt, Mycobacterium avium subsp. paratuberculosis
caccagcaccaggcggguca

SEQ ID NO: 2972596 - RNA, 15 nt, Mycobacterium avium subsp. paratuberculosis
caccagcacccagca

SEQ ID NO: 2972597 - RNA, 17 nt, Mycobacterium avium subsp. paratuberculosis
caccagcacccagcaca

SEQ ID NO: 2972598 - RNA, 20 nt, Mycobacterium avium subsp. paratuberculosis
caccagcacccagcacagcg

SEQ ID NO: 2972599 - RNA, 14 nt, Mycobacterium avium subsp. paratuberculosis
caccagcaccccgc

SEQ ID NO: 2972600 - RNA, 15 nt, Mycobacterium avium subsp. paratuberculosis
caccagcaccccgcc

SEQ ID NO: 2972601 - RNA, 16 nt, Mycobacterium avium subsp. paratuberculosis
caccagcaccccgccg

SEQ ID NO: 2972602 - RNA, 15 nt, Mycobacterium avium subsp. paratuberculosis
caccagcacgacacc

SEQ ID NO: 2972603 - RNA, 16 nt, Mycobacterium avium subsp. paratuberculosis
caccagcacgacaccg

SEQ ID NO: 2972604 - RNA, 15 nt, Mycobacterium avium subsp. paratuberculosis
caccagcacggcgac

SEQ ID NO: 2972605 - RNA, 16 nt, Mycobacterium avium subsp. paratuberculosis
caccagcacggcgacc

SEQ ID NO: 2972606 - RNA, 24 nt, Mycobacterium avium subsp. paratuberculosis
caccagcacggcgaccagcgagcc

SEQ ID NO: 2972607 - RNA, 14 nt, Mycobacterium avium subsp. paratuberculosis
caccagcacggcgg

SEQ ID NO: 2972608 - RNA, 16 nt, Mycobacterium avium subsp. paratuberculosis
caccagcacggcggcg

SEQ ID NO: 2972609 - RNA, 18 nt, Mycobacterium avium subsp. paratuberculosis
caccagcacggcggcgcu

SEQ ID NO: 2972610 - RNA, 20 nt, Mycobacterium avium subsp. paratuberculosis
caccagcacggcggcgcuga

SEQ ID NO: 2972611 - RNA, 18 nt, Mycobacterium avium subsp. paratuberculosis
caccagcacggucccguc

SEQ ID NO: 2972612 - RNA, 14 nt, Mycobacterium avium subsp. paratuberculosis
caccagcagacccg

SEQ ID NO: 2972613 - RNA, 10 nt, Mycobacterium avium subsp. paratuberculosis
caccagcagc

SEQ ID NO: 2972614 - RNA, 13 nt, Mycobacterium avium subsp. paratuberculosis
caccagcagcagg

SEQ ID NO: 2972615 - RNA, 17 nt, Mycobacterium avium subsp. paratuberculosis
caccagcagcagguugu

SEQ ID NO: 2972616 - RNA, 20 nt, Mycobacterium avium subsp. paratuberculosis
caccagcagccagcccagcc

SEQ ID NO: 2972617 - RNA, 15 nt, Mycobacterium avium subsp. paratuberculosis
caccagcagccgcag

SEQ ID NO: 2972618 - RNA, 22 nt, Mycobacterium avium subsp. paratuberculosis
caccagcagccgcagcgcgcga

SEQ ID NO: 2972619 - RNA, 15 nt, Mycobacterium avium subsp. paratuberculosis
caccagcagccgguc

SEQ ID NO: 2972620 - RNA, 16 nt, Mycobacterium avium subsp. paratuberculosis
caccagcagccggucg

SEQ ID NO: 2972621 - RNA, 17 nt, Mycobacterium avium subsp. paratuberculosis
caccagcagccggucga

SEQ ID NO: 2972622 - RNA, 17 nt, Mycobacterium avium subsp. paratuberculosis
caccagcagcgagaccg

SEQ ID NO: 2972623 - RNA, 22 nt, Mycobacterium avium subsp. paratuberculosis
caccagcagcgagaccggcacg

SEQ ID NO: 2972624 - RNA, 13 nt, Mycobacterium avium subsp. paratuberculosis
caccagcagcgcg

SEQ ID NO: 2972625 - RNA, 14 nt, Mycobacterium avium subsp. paratuberculosis
caccagcagcgcga

SEQ ID NO: 2972626 - RNA, 18 nt, Mycobacterium avium subsp. paratuberculosis
caccagcagcgcgacgcc

SEQ ID NO: 2972627 - RNA, 20 nt, Mycobacterium avium subsp. paratuberculosis
caccagcagcgcgacgccga

SEQ ID NO: 2972628 - RNA, 13 nt, Mycobacterium avium subsp. paratuberculosis
caccagcaggccc

SEQ ID NO: 2972629 - RNA, 19 nt, Mycobacterium avium subsp. paratuberculosis
caccagcaggccccguucg

SEQ ID NO: 2972630 - RNA, 13 nt, Mycobacterium avium subsp. paratuberculosis
caccagcaggucg

SEQ ID NO: 2972631 - RNA, 13 nt, Mycobacterium avium subsp. paratuberculosis
caccagcauggcg

SEQ ID NO: 2972632 - RNA, 17 nt, Mycobacterium avium subsp. paratuberculosis
caccagcauggcgauca

SEQ ID NO: 2972633 - RNA, 19 nt, Mycobacterium avium subsp. paratuberculosis
caccagcauggcgaucacc

SEQ ID NO: 2972634 - RNA, 20 nt, Mycobacterium avium subsp. paratuberculosis
caccagccacaccgccgcgg

SEQ ID NO: 2972635 - RNA, 21 nt, Mycobacterium avium subsp. paratuberculosis
caccagccacaccgccgcggc

SEQ ID NO: 2972636 - RNA, 17 nt, Mycobacterium avium subsp. paratuberculosis
caccagcccgaugccgc

SEQ ID NO: 2972637 - RNA, 18 nt, Mycobacterium avium subsp. paratuberculosis
caccagcccgaugccgcc

SEQ ID NO: 2972638 - RNA, 23 nt, Mycobacterium avium subsp. paratuberculosis
caccagcccgaugccgccgaggg

SEQ ID NO: 2972639 - RNA, 12 nt, Mycobacterium avium subsp. paratuberculosis
caccagcccgcc

SEQ ID NO: 2972640 - RNA, 16 nt, Mycobacterium avium subsp. paratuberculosis
caccagcccggccgag

SEQ ID NO: 2972641 - RNA, 13 nt, Mycobacterium avium subsp. paratuberculosis
caccagcccgucg

SEQ ID NO: 2972642 - RNA, 16 nt, Mycobacterium avium subsp. paratuberculosis
caccagccggccggcc

SEQ ID NO: 2972643 - RNA, 19 nt, Mycobacterium avium subsp. paratuberculosis
caccagccggccggcgaag

SEQ ID NO: 2972644 - RNA, 13 nt, Mycobacterium avium subsp. paratuberculosis
caccagcgacagc

SEQ ID NO: 2972645 - RNA, 16 nt, Mycobacterium avium subsp. paratuberculosis
caccagcgacagcacc

SEQ ID NO: 2972646 - RNA, 17 nt, Mycobacterium avium subsp. paratuberculosis
caccagcgacagcaccc

SEQ ID NO: 2972647 - RNA, 19 nt, Mycobacterium avium subsp. paratuberculosis
caccagcgauccggcgcgu

SEQ ID NO: 2972648 - RNA, 19 nt, Mycobacterium avium subsp. paratuberculosis
caccagcgcacacagcagc

SEQ ID NO: 2972649 - RNA, 14 nt, Mycobacterium avium subsp. paratuberculosis
caccagcgcagguc

SEQ ID NO: 2972650 - RNA, 15 nt, Mycobacterium avium subsp. paratuberculosis
caccagcgcaggucc

SEQ ID NO: 2972651 - RNA, 19 nt, Mycobacterium avium subsp. paratuberculosis
caccagcgcagguccucgg

SEQ ID NO: 2972652 - RNA, 15 nt, Mycobacterium avium subsp. paratuberculosis
caccagcgcccgccc

SEQ ID NO: 2972653 - RNA, 14 nt, Mycobacterium avium subsp. paratuberculosis
caccagcgccgcga

SEQ ID NO: 2972654 - RNA, 17 nt, Mycobacterium avium subsp. paratuberculosis
caccagcgccgcgauga

SEQ ID NO: 2972655 - RNA, 15 nt, Mycobacterium avium subsp. paratuberculosis
caccagcgccucggc

SEQ ID NO: 2972656 - RNA, 21 nt, Mycobacterium avium subsp. paratuberculosis
caccagcgccucggccucguc

SEQ ID NO: 2972657 - RNA, 14 nt, Mycobacterium avium subsp. paratuberculosis
caccagcgccuggg

SEQ ID NO: 2972658 - RNA, 13 nt, Mycobacterium avium subsp. paratuberculosis
caccagcgcgacg

SEQ ID NO: 2972659 - RNA, 12 nt, Mycobacterium avium subsp. paratuberculosis
caccagcgcgca

SEQ ID NO: 2972660 - RNA, 15 nt, Mycobacterium avium subsp. paratuberculosis
caccagcgcgcacgc

SEQ ID NO: 2972661 - RNA, 23 nt, Mycobacterium avium subsp. paratuberculosis
caccagcgcgcacgcggacacga

SEQ ID NO: 2972662 - RNA, 15 nt, Mycobacterium avium subsp. paratuberculosis
caccagcgcgcgggu

SEQ ID NO: 2972663 - RNA, 16 nt, Mycobacterium avium subsp. paratuberculosis
caccagcgcgcgggug

SEQ ID NO: 2972664 - RNA, 17 nt, Mycobacterium avium subsp. paratuberculosis
caccagcgcgcggguga

SEQ ID NO: 2972665 - RNA, 17 nt, Mycobacterium avium subsp. paratuberculosis
caccagcgcggacacca

SEQ ID NO: 2972666 - RNA, 18 nt, Mycobacterium avium subsp. paratuberculosis
caccagcgcggacaccag

SEQ ID NO: 2972667 - RNA, 21 nt, Mycobacterium avium subsp. paratuberculosis
caccagcgcggacaccagguu

SEQ ID NO: 2972668 - RNA, 22 nt, Mycobacterium avium subsp. paratuberculosis
caccagcgcggacaccagguug

SEQ ID NO: 2972669 - RNA, 17 nt, Mycobacterium avium subsp. paratuberculosis
caccagcgcggccacca

SEQ ID NO: 2972670 - RNA, 15 nt, Mycobacterium avium subsp. paratuberculosis
caccagcgcggugau

SEQ ID NO: 2972671 - RNA, 21 nt, Mycobacterium avium subsp. paratuberculosis
caccagcgcguagagcaucag

SEQ ID NO: 2972672 - RNA, 22 nt, Mycobacterium avium subsp. paratuberculosis
caccagcgcguagagcaucagg

SEQ ID NO: 2972673 - RNA, 20 nt, Mycobacterium avium subsp. paratuberculosis
caccagcgcuuucgcgcacg

SEQ ID NO: 2972674 - RNA, 23 nt, Mycobacterium avium subsp. paratuberculosis
caccagcgcuuucgcgcacgcca

SEQ ID NO: 2972675 - RNA, 17 nt, Mycobacterium avium subsp. paratuberculosis
caccagcggaucggcgg

SEQ ID NO: 2972676 - RNA, 17 nt, Mycobacterium avium subsp. paratuberculosis
caccagcggcaccaggu

SEQ ID NO: 2972677 - RNA, 13 nt, Mycobacterium avium subsp. paratuberculosis
caccagcggcauc

SEQ ID NO: 2972678 - RNA, 14 nt, Mycobacterium avium subsp. paratuberculosis
caccagcggcaucg

SEQ ID NO: 2972679 - RNA, 13 nt, Mycobacterium avium subsp. paratuberculosis
caccagcggcccg

SEQ ID NO: 2972680 - RNA, 13 nt, Mycobacterium avium subsp. paratuberculosis
caccagcggccgu

SEQ ID NO: 2972681 - RNA, 15 nt, Mycobacterium avium subsp. paratuberculosis
caccagcggccgucg

SEQ ID NO: 2972682 - RNA, 18 nt, Mycobacterium avium subsp. paratuberculosis
caccagcggccgucgccg

SEQ ID NO: 2972683 - RNA, 19 nt, Mycobacterium avium subsp. paratuberculosis
caccagcggccgucgccgg

SEQ ID NO: 2972684 - RNA, 22 nt, Mycobacterium avium subsp. paratuberculosis
caccagcggccgucgccgggcg

SEQ ID NO: 2972685 - RNA, 13 nt, Mycobacterium avium subsp. paratuberculosis
caccagcggcgcc

SEQ ID NO: 2972686 - RNA, 14 nt, Mycobacterium avium subsp. paratuberculosis
caccagcggcgccc

SEQ ID NO: 2972687 - RNA, 15 nt, Mycobacterium avium subsp. paratuberculosis
caccagcggcgccca

SEQ ID NO: 2972688 - RNA, 17 nt, Mycobacterium avium subsp. paratuberculosis
caccagcggcgcccacg

SEQ ID NO: 2972689 - RNA, 14 nt, Mycobacterium avium subsp. paratuberculosis
caccagcggcgcgu

SEQ ID NO: 2972690 - RNA, 17 nt, Mycobacterium avium subsp. paratuberculosis
caccagcggcugcagca

SEQ ID NO: 2972691 - RNA, 12 nt, Mycobacterium avium subsp. paratuberculosis
caccagcgggcu

SEQ ID NO: 2972692 - RNA, 13 nt, Mycobacterium avium subsp. paratuberculosis
caccagcgggcug

SEQ ID NO: 2972693 - RNA, 22 nt, Mycobacterium avium subsp. paratuberculosis
caccagcgggcugugccggcgg

SEQ ID NO: 2972694 - RNA, 21 nt, Mycobacterium avium subsp. paratuberculosis
caccagcgguaaccacccgug

SEQ ID NO: 2972695 - RNA, 22 nt, Mycobacterium avium subsp. paratuberculosis
caccagcgguaaccacccgugg

SEQ ID NO: 2972696 - RNA, 21 nt, Mycobacterium avium subsp. paratuberculosis
caccagcggucggcgguucga

SEQ ID NO: 2972697 - RNA, 20 nt, Mycobacterium avium subsp. paratuberculosis
caccagcgucgacgcgguga

SEQ ID NO: 2972698 - RNA, 14 nt, Mycobacterium avium subsp. paratuberculosis
caccagcgucgcga

SEQ ID NO: 2972699 - RNA, 22 nt, Mycobacterium avium subsp. paratuberculosis
caccagcgugcugccggacacc

SEQ ID NO: 2972700 - RNA, 19 nt, Mycobacterium avium subsp. paratuberculosis
caccagcguggccggcagg

SEQ ID NO: 2972701 - RNA, 14 nt, Mycobacterium avium subsp. paratuberculosis
caccagcguggugc

SEQ ID NO: 2972702 - RNA, 17 nt, Mycobacterium avium subsp. paratuberculosis
caccagcguggugcgcc

SEQ ID NO: 2972703 - RNA, 21 nt, Mycobacterium avium subsp. paratuberculosis
caccagcguggugcgcccguc

SEQ ID NO: 2972704 - RNA, 18 nt, Mycobacterium avium subsp. paratuberculosis
caccagcguuccagcacc

SEQ ID NO: 2972705 - RNA, 19 nt, Mycobacterium avium subsp. paratuberculosis
caccagcguuccagcaccc

SEQ ID NO: 2972706 - RNA, 22 nt, Mycobacterium avium subsp. paratuberculosis
caccagcguuccagcacccggc

SEQ ID NO: 2972707 - RNA, 14 nt, Mycobacterium avium subsp. paratuberculosis
caccagcguucguc

SEQ ID NO: 2972708 - RNA, 19 nt, Mycobacterium avium subsp. paratuberculosis
caccagcguucgucgccgg

SEQ ID NO: 2972709 - RNA, 22 nt, Mycobacterium avium subsp. paratuberculosis
caccagcguucgucgccgguga

SEQ ID NO: 2972710 - RNA, 17 nt, Mycobacterium avium subsp. paratuberculosis
caccagcucgaggccgc

SEQ ID NO: 2972711 - RNA, 21 nt, Mycobacterium avium subsp. paratuberculosis
caccagcucgaugccguucgc

SEQ ID NO: 2972712 - RNA, 14 nt, Mycobacterium avium subsp. paratuberculosis
caccagcucggcgc

SEQ ID NO: 2972713 - RNA, 15 nt, Mycobacterium avium subsp. paratuberculosis
caccagcucggugau

SEQ ID NO: 2972714 - RNA, 22 nt, Mycobacterium avium subsp. paratuberculosis
caccagcucggugaucaccaug

SEQ ID NO: 2972715 - RNA, 17 nt, Mycobacterium avium subsp. paratuberculosis
caccagcucgucgccga

SEQ ID NO: 2972716 - RNA, 18 nt, Mycobacterium avium subsp. paratuberculosis
caccagcugauucgcggu

SEQ ID NO: 2972717 - RNA, 20 nt, Mycobacterium avium subsp. paratuberculosis
caccagcugauucgcggugg

SEQ ID NO: 2972718 - RNA, 22 nt, Mycobacterium avium subsp. paratuberculosis
caccagcugcggaaaugcccgc

SEQ ID NO: 2972719 - RNA, 14 nt, Mycobacterium avium subsp. paratuberculosis
caccagcuggaugg

SEQ ID NO: 2972720 - RNA, 17 nt, Mycobacterium avium subsp. paratuberculosis
caccagcugggaggcgc

SEQ ID NO: 2972721 - RNA, 15 nt, Mycobacterium avium subsp. paratuberculosis
caccagcugucccag

SEQ ID NO: 2972722 - RNA, 14 nt, Mycobacterium avium subsp. paratuberculosis
caccaggacgcgac

SEQ ID NO: 2972723 - RNA, 15 nt, Mycobacterium avium subsp. paratuberculosis
caccaggacgcgacc

SEQ ID NO: 2972724 - RNA, 20 nt, Mycobacterium avium subsp. paratuberculosis
caccaggacgcgaccggcca

SEQ ID NO: 2972725 - RNA, 20 nt, Mycobacterium avium subsp. paratuberculosis
caccaggagcaccugcgcga

SEQ ID NO: 2972726 - RNA, 14 nt, Mycobacterium avium subsp. paratuberculosis
caccaggcccaggc

SEQ ID NO: 2972727 - RNA, 19 nt, Mycobacterium avium subsp. paratuberculosis
caccaggcccucgccgcgg

SEQ ID NO: 2972728 - RNA, 20 nt, Mycobacterium avium subsp. paratuberculosis
caccaggccgaagacgauga

SEQ ID NO: 2972729 - RNA, 13 nt, Mycobacterium avium subsp. paratuberculosis
caccaggccgacg

SEQ ID NO: 2972730 - RNA, 13 nt, Mycobacterium avium subsp. paratuberculosis
caccaggcgcacc

SEQ ID NO: 2972731 - RNA, 14 nt, Mycobacterium avium subsp. paratuberculosis
caccaggcgcacca

SEQ ID NO: 2972732 - RNA, 18 nt, Mycobacterium avium subsp. paratuberculosis
caccaggcgcaccagcug

SEQ ID NO: 2972733 - RNA, 12 nt, Mycobacterium avium subsp. paratuberculosis
caccaggcgcca

SEQ ID NO: 2972734 - RNA, 18 nt, Mycobacterium avium subsp. paratuberculosis
caccaggcgccacagcag

SEQ ID NO: 2972735 - RNA, 23 nt, Mycobacterium avium subsp. paratuberculosis
caccaggcgccacagcagcacca

SEQ ID NO: 2972736 - RNA, 14 nt, Mycobacterium avium subsp. paratuberculosis
caccaggcgccguc

SEQ ID NO: 2972737 - RNA, 18 nt, Mycobacterium avium subsp. paratuberculosis
caccaggcgccgucgaug

SEQ ID NO: 2972738 - RNA, 21 nt, Mycobacterium avium subsp. paratuberculosis
caccaggcucgcucccgcgcg

SEQ ID NO: 2972739 - RNA, 17 nt, Mycobacterium avium subsp. paratuberculosis
caccaggcugaccagcg

SEQ ID NO: 2972740 - RNA, 17 nt, Mycobacterium avium subsp. paratuberculosis
caccaggcugcucggcg

SEQ ID NO: 2972741 - RNA, 18 nt, Mycobacterium avium subsp. paratuberculosis
caccaggcugcucggcgg

SEQ ID NO: 2972742 - RNA, 20 nt, Mycobacterium avium subsp. paratuberculosis
caccaggcugcucggcgggc

SEQ ID NO: 2972743 - RNA, 20 nt, Mycobacterium avium subsp. paratuberculosis
caccagggacaugccgagca

SEQ ID NO: 2972744 - RNA, 13 nt, Mycobacterium avium subsp. paratuberculosis
caccagggccgcg

SEQ ID NO: 2972745 - RNA, 15 nt, Mycobacterium avium subsp. paratuberculosis
caccagggccgcgag

SEQ ID NO: 2972746 - RNA, 16 nt, Mycobacterium avium subsp. paratuberculosis
caccagggccgcgagc

SEQ ID NO: 2972747 - RNA, 17 nt, Mycobacterium avium subsp. paratuberculosis
caccagggccgcgagcg

SEQ ID NO: 2972748 - RNA, 17 nt, Mycobacterium avium subsp. paratuberculosis
caccagggccugcagca

SEQ ID NO: 2972749 - RNA, 19 nt, Mycobacterium avium subsp. paratuberculosis
caccagggccugcagcacc

SEQ ID NO: 2972750 - RNA, 20 nt, Mycobacterium avium subsp. paratuberculosis
caccagggccugcagcacca

SEQ ID NO: 2972751 - RNA, 17 nt, Mycobacterium avium subsp. paratuberculosis
caccagggcgaccgccg

SEQ ID NO: 2972752 - RNA, 19 nt, Mycobacterium avium subsp. paratuberculosis
caccagggcgaccgccgcg

SEQ ID NO: 2972753 - RNA, 20 nt, Mycobacterium avium subsp. paratuberculosis
caccagggcgaccgccgcgu

SEQ ID NO: 2972754 - RNA, 16 nt, Mycobacterium avium subsp. paratuberculosis
caccagggcggugaac

SEQ ID NO: 2972755 - RNA, 14 nt, Mycobacterium avium subsp. paratuberculosis
caccagggcgucga

SEQ ID NO: 2972756 - RNA, 17 nt, Mycobacterium avium subsp. paratuberculosis
caccagggcgucgagcg

SEQ ID NO: 2972757 - RNA, 23 nt, Mycobacterium avium subsp. paratuberculosis
caccagggcgucgagcgcgucgu

SEQ ID NO: 2972758 - RNA, 22 nt, Mycobacterium avium subsp. paratuberculosis
caccagggucucgcgcagcacg

SEQ ID NO: 2972759 - RNA, 22 nt, Mycobacterium avium subsp. paratuberculosis
caccagggucuucagcccgcgc

SEQ ID NO: 2972760 - RNA, 14 nt, Mycobacterium avium subsp. paratuberculosis
caccagggugccgc

SEQ ID NO: 2972761 - RNA, 16 nt, Mycobacterium avium subsp. paratuberculosis
caccagggugccgccg

SEQ ID NO: 2972762 - RNA, 17 nt, Mycobacterium avium subsp. paratuberculosis
caccagggugccgccgg

SEQ ID NO: 2972763 - RNA, 19 nt, Mycobacterium avium subsp. paratuberculosis
caccagggugccgccgggc

SEQ ID NO: 2972764 - RNA, 20 nt, Mycobacterium avium subsp. paratuberculosis
caccagggugccgccgggca

SEQ ID NO: 2972765 - RNA, 21 nt, Mycobacterium avium subsp. paratuberculosis
caccagggugccgccgggcac

SEQ ID NO: 2972766 - RNA, 14 nt, Mycobacterium avium subsp. paratuberculosis
caccagggugcgca

SEQ ID NO: 2972767 - RNA, 17 nt, Mycobacterium avium subsp. paratuberculosis
caccagggugcgcagcg

SEQ ID NO: 2972768 - RNA, 20 nt, Mycobacterium avium subsp. paratuberculosis
caccagggugcgcagcgcgu

SEQ ID NO: 2972769 - RNA, 23 nt, Mycobacterium avium subsp. paratuberculosis
caccagggugcgcagcgcgucgu

SEQ ID NO: 2972770 - RNA, 17 nt, Mycobacterium avium subsp. paratuberculosis
caccaggguggccgcca

SEQ ID NO: 2972771 - RNA, 18 nt, Mycobacterium avium subsp. paratuberculosis
caccaggguggccgccac

SEQ ID NO: 2972772 - RNA, 14 nt, Mycobacterium avium subsp. paratuberculosis
caccagggugucga

SEQ ID NO: 2972773 - RNA, 19 nt, Mycobacterium avium subsp. paratuberculosis
caccagggugucgaugacg

SEQ ID NO: 2972774 - RNA, 14 nt, Mycobacterium avium subsp. paratuberculosis
caccagggugucgu

SEQ ID NO: 2972775 - RNA, 19 nt, Mycobacterium avium subsp. paratuberculosis
caccagguagauggugauc

SEQ ID NO: 2972776 - RNA, 16 nt, Mycobacterium avium subsp. paratuberculosis
caccagguaggcgacc

SEQ ID NO: 2972777 - RNA, 14 nt, Mycobacterium avium subsp. paratuberculosis
caccagguaggcgg

SEQ ID NO: 2972778 - RNA, 19 nt, Mycobacterium avium subsp. paratuberculosis
caccagguccuugaucggg

SEQ ID NO: 2972779 - RNA, 22 nt, Mycobacterium avium subsp. paratuberculosis
caccaggucgagguccucggcg

SEQ ID NO: 2972780 - RNA, 23 nt, Mycobacterium avium subsp. paratuberculosis
caccaggucgagguccucggcga

SEQ ID NO: 2972781 - RNA, 16 nt, Mycobacterium avium subsp. paratuberculosis
caccaggucgcacacc

SEQ ID NO: 2972782 - RNA, 17 nt, Mycobacterium avium subsp. paratuberculosis
caccaggucgcacacca

SEQ ID NO: 2972783 - RNA, 18 nt, Mycobacterium avium subsp. paratuberculosis
caccaggucgcacaccag

SEQ ID NO: 2972784 - RNA, 15 nt, Mycobacterium avium subsp. paratuberculosis
caccaggucgcggua

SEQ ID NO: 2972785 - RNA, 20 nt, Mycobacterium avium subsp. paratuberculosis
caccaggucguugccggugc

SEQ ID NO: 2972786 - RNA, 19 nt, Mycobacterium avium subsp. paratuberculosis
caccaggucuccgucggcg

SEQ ID NO: 2972787 - RNA, 16 nt, Mycobacterium avium subsp. paratuberculosis
caccaggugaccggcc

SEQ ID NO: 2972788 - RNA, 17 nt, Mycobacterium avium subsp. paratuberculosis
caccaggugaccggccu

SEQ ID NO: 2972789 - RNA, 17 nt, Mycobacterium avium subsp. paratuberculosis
caccagguggcccgacc

SEQ ID NO: 2972790 - RNA, 13 nt, Mycobacterium avium subsp. paratuberculosis
caccagguucgcg

SEQ ID NO: 2972791 - RNA, 18 nt, Mycobacterium avium subsp. paratuberculosis
caccagguucgcgcagcu

SEQ ID NO: 2972792 - RNA, 14 nt, Mycobacterium avium subsp. paratuberculosis
caccagguugcgga

SEQ ID NO: 2972793 - RNA, 17 nt, Mycobacterium avium subsp. paratuberculosis
caccagguugcggauca

SEQ ID NO: 2972794 - RNA, 17 nt, Mycobacterium avium subsp. paratuberculosis
caccagguuggucucga

SEQ ID NO: 2972795 - RNA, 17 nt, Mycobacterium avium subsp. paratuberculosis
caccagguugucgccgc

SEQ ID NO: 2972796 - RNA, 18 nt, Mycobacterium avium subsp. paratuberculosis
caccagguugucgccgcg

SEQ ID NO: 2972797 - RNA, 20 nt, Mycobacterium avium subsp. paratuberculosis
caccagguugucgccgcgcc

SEQ ID NO: 2972798 - RNA, 21 nt, Mycobacterium avium subsp. paratuberculosis
caccagguugucgccgcgcca

SEQ ID NO: 2972799 - RNA, 15 nt, Mycobacterium avium subsp. paratuberculosis
caccagucgcacaac

SEQ ID NO: 2972800 - RNA, 17 nt, Mycobacterium avium subsp. paratuberculosis
caccagucgcgcagcgu

SEQ ID NO: 2972801 - RNA, 22 nt, Mycobacterium avium subsp. paratuberculosis
caccagucggccaucagcaccg

SEQ ID NO: 2972802 - RNA, 14 nt, Mycobacterium avium subsp. paratuberculosis
caccagucggcgcg

SEQ ID NO: 2972803 - RNA, 17 nt, Mycobacterium avium subsp. paratuberculosis
caccaguguccgggcgc

SEQ ID NO: 2972804 - RNA, 18 nt, Mycobacterium avium subsp. paratuberculosis
caccaguguccgggcgcc

SEQ ID NO: 2972805 - RNA, 20 nt, Mycobacterium avium subsp. paratuberculosis
caccaguguccgggcgccca

SEQ ID NO: 2972806 - RNA, 21 nt, Mycobacterium avium subsp. paratuberculosis
caccaguguccgggcgcccag

SEQ ID NO: 2972807 - RNA, 23 nt, Mycobacterium avium subsp. paratuberculosis
caccaguguccgggcgcccagaa

SEQ ID NO: 2972808 - RNA, 19 nt, Mycobacterium avium subsp. paratuberculosis
caccaguuccugcaugccg

SEQ ID NO: 2972809 - RNA, 22 nt, Mycobacterium avium subsp. paratuberculosis
caccaguuccugcaugccgggc

SEQ ID NO: 2972810 - RNA, 23 nt, Mycobacterium avium subsp. paratuberculosis
caccaguuccugcaugccgggca

SEQ ID NO: 2972811 - RNA, 22 nt, Mycobacterium avium subsp. paratuberculosis
caccaguucgcguacccgcgcg

SEQ ID NO: 2972812 - RNA, 16 nt, Mycobacterium avium subsp. paratuberculosis
caccaguugcaccggc

SEQ ID NO: 2972813 - RNA, 17 nt, Mycobacterium avium subsp. paratuberculosis
caccaguugcaccggca

SEQ ID NO: 2972814 - RNA, 18 nt, Mycobacterium avium subsp. paratuberculosis
caccaguugcaccggcac

SEQ ID NO: 2972815 - RNA, 20 nt, Mycobacterium avium subsp. paratuberculosis
caccaguuucacgucggcga

SEQ ID NO: 2972816 - RNA, 13 nt, Mycobacterium avium subsp. paratuberculosis
caccaucaccugu

SEQ ID NO: 2972817 - RNA, 15 nt, Mycobacterium avium subsp. paratuberculosis
caccaucacgucgcg

SEQ ID NO: 2972818 - RNA, 16 nt, Mycobacterium avium subsp. paratuberculosis
caccaucagcaccgcc

SEQ ID NO: 2972819 - RNA, 12 nt, Mycobacterium avium subsp. paratuberculosis
caccaucagcgg

SEQ ID NO: 2972820 - RNA, 13 nt, Mycobacterium avium subsp. paratuberculosis
caccaucagcggc

SEQ ID NO: 2972821 - RNA, 16 nt, Mycobacterium avium subsp. paratuberculosis
caccaucaggccggcc

SEQ ID NO: 2972822 - RNA, 14 nt, Mycobacterium avium subsp. paratuberculosis
caccaucccgccgc

SEQ ID NO: 2972823 - RNA, 17 nt, Mycobacterium avium subsp. paratuberculosis
caccaucccgccgccga

SEQ ID NO: 2972824 - RNA, 18 nt, Mycobacterium avium subsp. paratuberculosis
caccaucccgccgccgaa

SEQ ID NO: 2972825 - RNA, 14 nt, Mycobacterium avium subsp. paratuberculosis
caccauccgcgacg

SEQ ID NO: 2972826 - RNA, 17 nt, Mycobacterium avium subsp. paratuberculosis
caccauccgcgacgcca

SEQ ID NO: 2972827 - RNA, 21 nt, Mycobacterium avium subsp. paratuberculosis
caccaucgaguaggcccaguc

SEQ ID NO: 2972828 - RNA, 20 nt, Mycobacterium avium subsp. paratuberculosis
caccaucgcgauggaagcgc

SEQ ID NO: 2972829 - RNA, 23 nt, Mycobacterium avium subsp. paratuberculosis
caccaucuucacgaagugcccgg

SEQ ID NO: 2972830 - RNA, 17 nt, Mycobacterium avium subsp. paratuberculosis
caccaugaucagcgccg

SEQ ID NO: 2972831 - RNA, 18 nt, Mycobacterium avium subsp. paratuberculosis
caccaugaucagcgccgu

SEQ ID NO: 2972832 - RNA, 21 nt, Mycobacterium avium subsp. paratuberculosis
caccaugaucaggccccaccc

SEQ ID NO: 2972833 - RNA, 23 nt, Mycobacterium avium subsp. paratuberculosis
caccaugaucaggccccacccgc

SEQ ID NO: 2972834 - RNA, 20 nt, Mycobacterium avium subsp. paratuberculosis
caccaugauguagcggcggu

SEQ ID NO: 2972835 - RNA, 22 nt, Mycobacterium avium subsp. paratuberculosis
caccaugccggcguccaguucg

SEQ ID NO: 2972836 - RNA, 15 nt, Mycobacterium avium subsp. paratuberculosis
caccaugucggcguc

SEQ ID NO: 2972837 - RNA, 16 nt, Mycobacterium avium subsp. paratuberculosis
caccaugucggcgucg

SEQ ID NO: 2972838 - RNA, 22 nt, Mycobacterium avium subsp. paratuberculosis
caccauguuccagaaccggcag

SEQ ID NO: 2972839 - RNA, 19 nt, Mycobacterium avium subsp. paratuberculosis
cacccaaaaaggcgcgggu

SEQ ID NO: 2972840 - RNA, 20 nt, Mycobacterium avium subsp. paratuberculosis
cacccaaaacaucggcgugu

SEQ ID NO: 2972841 - RNA, 12 nt, Mycobacterium avium subsp. paratuberculosis
cacccaccggca

SEQ ID NO: 2972842 - RNA, 20 nt, Mycobacterium avium subsp. paratuberculosis
cacccaccggcaugggcggc

SEQ ID NO: 2972843 - RNA, 12 nt, Mycobacterium avium subsp. paratuberculosis
cacccaccggcc

SEQ ID NO: 2972844 - RNA, 20 nt, Mycobacterium avium subsp. paratuberculosis
cacccaccggcccagccggc

SEQ ID NO: 2972845 - RNA, 22 nt, Mycobacterium avium subsp. paratuberculosis
cacccaccggcccagccggcgg

SEQ ID NO: 2972846 - RNA, 14 nt, Mycobacterium avium subsp. paratuberculosis
cacccaccggcgca

SEQ ID NO: 2972847 - RNA, 15 nt, Mycobacterium avium subsp. paratuberculosis
cacccaccggcgcag

SEQ ID NO: 2972848 - RNA, 17 nt, Mycobacterium avium subsp. paratuberculosis
cacccaccggcgcagcg

SEQ ID NO: 2972849 - RNA, 21 nt, Mycobacterium avium subsp. paratuberculosis
cacccaccggcgcagcgcguc

SEQ ID NO: 2972850 - RNA, 19 nt, Mycobacterium avium subsp. paratuberculosis
cacccacgaacgucugcgg

SEQ ID NO: 2972851 - RNA, 15 nt, Mycobacterium avium subsp. paratuberculosis
cacccacgccagccg

SEQ ID NO: 2972852 - RNA, 16 nt, Mycobacterium avium subsp. paratuberculosis
cacccacggccacaac

SEQ ID NO: 2972853 - RNA, 18 nt, Mycobacterium avium subsp. paratuberculosis
cacccacucccagccgcc

SEQ ID NO: 2972854 - RNA, 22 nt, Mycobacterium avium subsp. paratuberculosis
cacccacucggacagguggccg

SEQ ID NO: 2972855 - RNA, 13 nt, Mycobacterium avium subsp. paratuberculosis
cacccacuggcgg

SEQ ID NO: 2972856 - RNA, 15 nt, Mycobacterium avium subsp. paratuberculosis
cacccacuggcggcc

SEQ ID NO: 2972857 - RNA, 16 nt, Mycobacterium avium subsp. paratuberculosis
cacccacuggcggccg

SEQ ID NO: 2972858 - RNA, 20 nt, Mycobacterium avium subsp. paratuberculosis
cacccacuggcggccggccg

SEQ ID NO: 2972859 - RNA, 21 nt, Mycobacterium avium subsp. paratuberculosis
cacccacuggcggccggccgc

SEQ ID NO: 2972860 - RNA, 21 nt, Mycobacterium avium subsp. paratuberculosis
cacccagaaacgacaucacga

SEQ ID NO: 2972861 - RNA, 18 nt, Mycobacterium avium subsp. paratuberculosis
cacccagacguguggcac

SEQ ID NO: 2972862 - RNA, 19 nt, Mycobacterium avium subsp. paratuberculosis
cacccagaucgcccgggcg

SEQ ID NO: 2972863 - RNA, 18 nt, Mycobacterium avium subsp. paratuberculosis
cacccagaugcccagcgg

SEQ ID NO: 2972864 - RNA, 19 nt, Mycobacterium avium subsp. paratuberculosis
cacccagaugcccagcggc

SEQ ID NO: 2972865 - RNA, 13 nt, Mycobacterium avium subsp. paratuberculosis
cacccagccgcug

SEQ ID NO: 2972866 - RNA, 17 nt, Mycobacterium avium subsp. paratuberculosis
cacccagccgcugaacg

SEQ ID NO: 2972867 - RNA, 24 nt, Mycobacterium avium subsp. paratuberculosis
cacccagccgcugaacgcgaucca

SEQ ID NO: 2972868 - RNA, 14 nt, Mycobacterium avium subsp. paratuberculosis
cacccagccgugcc

SEQ ID NO: 2972869 - RNA, 18 nt, Mycobacterium avium subsp. paratuberculosis
cacccagccguugggcag

SEQ ID NO: 2972870 - RNA, 13 nt, Mycobacterium avium subsp. paratuberculosis
cacccagcggcgc

SEQ ID NO: 2972871 - RNA, 14 nt, Mycobacterium avium subsp. paratuberculosis
cacccagcggcgcg

SEQ ID NO: 2972872 - RNA, 16 nt, Mycobacterium avium subsp. paratuberculosis
cacccagcggcgcggc

SEQ ID NO: 2972873 - RNA, 15 nt, Mycobacterium avium subsp. paratuberculosis
cacccagcgggcgac

SEQ ID NO: 2972874 - RNA, 21 nt, Mycobacterium avium subsp. paratuberculosis
cacccagcgggcgacgucggg

SEQ ID NO: 2972875 - RNA, 18 nt, Mycobacterium avium subsp. paratuberculosis
cacccaggaaaaccagcg

SEQ ID NO: 2972876 - RNA, 20 nt, Mycobacterium avium subsp. paratuberculosis
cacccaggaaaaccagcgac

SEQ ID NO: 2972877 - RNA, 14 nt, Mycobacterium avium subsp. paratuberculosis
cacccaggccaccc

SEQ ID NO: 2972878 - RNA, 15 nt, Mycobacterium avium subsp. paratuberculosis
cacccaggccacccg

SEQ ID NO: 2972879 - RNA, 16 nt, Mycobacterium avium subsp. paratuberculosis
cacccaggccacccgg

SEQ ID NO: 2972880 - RNA, 17 nt, Mycobacterium avium subsp. paratuberculosis
cacccaggccacccggg

SEQ ID NO: 2972881 - RNA, 18 nt, Mycobacterium avium subsp. paratuberculosis
cacccaggucaugguggc

SEQ ID NO: 2972882 - RNA, 20 nt, Mycobacterium avium subsp. paratuberculosis
cacccaggucuuccggaugc

SEQ ID NO: 2972883 - RNA, 19 nt, Mycobacterium avium subsp. paratuberculosis
cacccagguguccggcccg

SEQ ID NO: 2972884 - RNA, 15 nt, Mycobacterium avium subsp. paratuberculosis
cacccauccccagga

SEQ ID NO: 2972885 - RNA, 20 nt, Mycobacterium avium subsp. paratuberculosis
cacccaugauggugggcacc

SEQ ID NO: 2972886 - RNA, 21 nt, Mycobacterium avium subsp. paratuberculosis
cacccaugauggugggcaccg

SEQ ID NO: 2972887 - RNA, 23 nt, Mycobacterium avium subsp. paratuberculosis
cacccaugauggugggcaccgcg

SEQ ID NO: 2972888 - RNA, 16 nt, Mycobacterium avium subsp. paratuberculosis
cacccauucacgcagc

SEQ ID NO: 2972889 - RNA, 19 nt, Mycobacterium avium subsp. paratuberculosis
cacccauucacgcagcugg

SEQ ID NO: 2972890 - RNA, 22 nt, Mycobacterium avium subsp. paratuberculosis
cacccauucacgcagcuggcca

SEQ ID NO: 2972891 - RNA, 12 nt, Mycobacterium avium subsp. paratuberculosis
caccccacaccg

SEQ ID NO: 2972892 - RNA, 15 nt, Mycobacterium avium subsp. paratuberculosis
caccccacccgcgcg

SEQ ID NO: 2972893 - RNA, 16 nt, Mycobacterium avium subsp. paratuberculosis
caccccaccgacagcc

SEQ ID NO: 2972894 - RNA, 20 nt, Mycobacterium avium subsp. paratuberculosis
caccccaccgagcagcugca

SEQ ID NO: 2972895 - RNA, 13 nt, Mycobacterium avium subsp. paratuberculosis
caccccagcgcga

SEQ ID NO: 2972896 - RNA, 16 nt, Mycobacterium avium subsp. paratuberculosis
caccccagcgcgacca

SEQ ID NO: 2972897 - RNA, 13 nt, Mycobacterium avium subsp. paratuberculosis
caccccaggcgau

SEQ ID NO: 2972898 - RNA, 15 nt, Mycobacterium avium subsp. paratuberculosis
caccccaucggccag

SEQ ID NO: 2972899 - RNA, 12 nt, Mycobacterium avium subsp. paratuberculosis
cacccccggcgc

SEQ ID NO: 2972900 - RNA, 13 nt, Mycobacterium avium subsp. paratuberculosis
cacccccggcgcg

SEQ ID NO: 2972901 - RNA, 13 nt, Mycobacterium avium subsp. paratuberculosis
cacccccggggcc

SEQ ID NO: 2972902 - RNA, 22 nt, Mycobacterium avium subsp. paratuberculosis
cacccccucggcgccgguggug

SEQ ID NO: 2972903 - RNA, 20 nt, Mycobacterium avium subsp. paratuberculosis
cacccccuucuccacgcucg

SEQ ID NO: 2972904 - RNA, 19 nt, Mycobacterium avium subsp. paratuberculosis
caccccgaacccggccagc

SEQ ID NO: 2972905 - RNA, 16 nt, Mycobacterium avium subsp. paratuberculosis
caccccgaaccgcccg

SEQ ID NO: 2972906 - RNA, 17 nt, Mycobacterium avium subsp. paratuberculosis
caccccgaaccgcccgc

SEQ ID NO: 2972907 - RNA, 22 nt, Mycobacterium avium subsp. paratuberculosis
caccccgaaccgcccgcccggc

SEQ ID NO: 2972908 - RNA, 16 nt, Mycobacterium avium subsp. paratuberculosis
caccccgaccgacgcg

SEQ ID NO: 2972909 - RNA, 16 nt, Mycobacterium avium subsp. paratuberculosis
caccccgacggagacg

SEQ ID NO: 2972910 - RNA, 13 nt, Mycobacterium avium subsp. paratuberculosis
caccccgagcucg

SEQ ID NO: 2972911 - RNA, 18 nt, Mycobacterium avium subsp. paratuberculosis
caccccgaguucggccag

SEQ ID NO: 2972912 - RNA, 22 nt, Mycobacterium avium subsp. paratuberculosis
caccccgaguucggccagaucg

SEQ ID NO: 2972913 - RNA, 20 nt, Mycobacterium avium subsp. paratuberculosis
caccccgaucaacaccgcca

SEQ ID NO: 2972914 - RNA, 17 nt, Mycobacterium avium subsp. paratuberculosis
caccccgaucaggucag

SEQ ID NO: 2972915 - RNA, 15 nt, Mycobacterium avium subsp. paratuberculosis
caccccgaugccgaa

SEQ ID NO: 2972916 - RNA, 21 nt, Mycobacterium avium subsp. paratuberculosis
caccccgaugcggugccgggc

SEQ ID NO: 2972917 - RNA, 16 nt, Mycobacterium avium subsp. paratuberculosis
caccccgcagaacacc

SEQ ID NO: 2972918 - RNA, 15 nt, Mycobacterium avium subsp. paratuberculosis
caccccgcccagcgc

SEQ ID NO: 2972919 - RNA, 16 nt, Mycobacterium avium subsp. paratuberculosis
caccccgcccagcgca

SEQ ID NO: 2972920 - RNA, 20 nt, Mycobacterium avium subsp. paratuberculosis
caccccgccgcagcccaggc

SEQ ID NO: 2972921 - RNA, 23 nt, Mycobacterium avium subsp. paratuberculosis
caccccgcgagucaccggcucgc

SEQ ID NO: 2972922 - RNA, 13 nt, Mycobacterium avium subsp. paratuberculosis
caccccgcgccgg

SEQ ID NO: 2972923 - RNA, 22 nt, Mycobacterium avium subsp. paratuberculosis
caccccgcgggaguccacgccg

SEQ ID NO: 2972924 - RNA, 17 nt, Mycobacterium avium subsp. paratuberculosis
caccccgcggucggcgg

SEQ ID NO: 2972925 - RNA, 21 nt, Mycobacterium avium subsp. paratuberculosis
caccccgcucggccagcgcgc

SEQ ID NO: 2972926 - RNA, 15 nt, Mycobacterium avium subsp. paratuberculosis
caccccggacggccg

SEQ ID NO: 2972927 - RNA, 15 nt, Mycobacterium avium subsp. paratuberculosis
caccccggagauccg

SEQ ID NO: 2972928 - RNA, 19 nt, Mycobacterium avium subsp. paratuberculosis
caccccggagauccggccg

SEQ ID NO: 2972929 - RNA, 20 nt, Mycobacterium avium subsp. paratuberculosis
caccccggagauccggccgc

SEQ ID NO: 2972930 - RNA, 13 nt, Mycobacterium avium subsp. paratuberculosis
caccccggccacc

SEQ ID NO: 2972931 - RNA, 14 nt, Mycobacterium avium subsp. paratuberculosis
caccccggccacca

SEQ ID NO: 2972932 - RNA, 20 nt, Mycobacterium avium subsp. paratuberculosis
caccccggccagggugccga

SEQ ID NO: 2972933 - RNA, 16 nt, Mycobacterium avium subsp. paratuberculosis
caccccggccaguccg

SEQ ID NO: 2972934 - RNA, 16 nt, Mycobacterium avium subsp. paratuberculosis
caccccggcgacggcg

SEQ ID NO: 2972935 - RNA, 17 nt, Mycobacterium avium subsp. paratuberculosis
caccccggcgacggcgg

SEQ ID NO: 2972936 - RNA, 13 nt, Mycobacterium avium subsp. paratuberculosis
caccccggcgaug

SEQ ID NO: 2972937 - RNA, 14 nt, Mycobacterium avium subsp. paratuberculosis
caccccggcgauga

SEQ ID NO: 2972938 - RNA, 18 nt, Mycobacterium avium subsp. paratuberculosis
caccccggcgcggaacgc

SEQ ID NO: 2972939 - RNA, 12 nt, Mycobacterium avium subsp. paratuberculosis
caccccggcggc

SEQ ID NO: 2972940 - RNA, 14 nt, Mycobacterium avium subsp. paratuberculosis
caccccggcggccg

SEQ ID NO: 2972941 - RNA, 15 nt, Mycobacterium avium subsp. paratuberculosis
caccccggcggccgc

SEQ ID NO: 2972942 - RNA, 19 nt, Mycobacterium avium subsp. paratuberculosis
caccccggcggccgcgucg

SEQ ID NO: 2972943 - RNA, 23 nt, Mycobacterium avium subsp. paratuberculosis
caccccggcggccgcgucggcgg

SEQ ID NO: 2972944 - RNA, 14 nt, Mycobacterium avium subsp. paratuberculosis
caccccggcgucca

SEQ ID NO: 2972945 - RNA, 18 nt, Mycobacterium avium subsp. paratuberculosis
caccccggcguccacgcc

SEQ ID NO: 2972946 - RNA, 21 nt, Mycobacterium avium subsp. paratuberculosis
caccccggcguccacgccgug

SEQ ID NO: 2972947 - RNA, 16 nt, Mycobacterium avium subsp. paratuberculosis
caccccgggaacgacg

SEQ ID NO: 2972948 - RNA, 20 nt, Mycobacterium avium subsp. paratuberculosis
caccccgguccaggcgaccg

SEQ ID NO: 2972949 - RNA, 22 nt, Mycobacterium avium subsp. paratuberculosis
caccccgguccaggcgaccggc

SEQ ID NO: 2972950 - RNA, 23 nt, Mycobacterium avium subsp. paratuberculosis
caccccggugccgcagugccggc

SEQ ID NO: 2972951 - RNA, 22 nt, Mycobacterium avium subsp. paratuberculosis
caccccguaggugcacagcccg

SEQ ID NO: 2972952 - RNA, 18 nt, Mycobacterium avium subsp. paratuberculosis
caccccgucgagcagccg

SEQ ID NO: 2972953 - RNA, 13 nt, Mycobacterium avium subsp. paratuberculosis
caccccgucgcgg

SEQ ID NO: 2972954 - RNA, 19 nt, Mycobacterium avium subsp. paratuberculosis
caccccgugguagacgccg

SEQ ID NO: 2972955 - RNA, 17 nt, Mycobacterium avium subsp. paratuberculosis
caccccguugccgccgg

SEQ ID NO: 2972956 - RNA, 21 nt, Mycobacterium avium subsp. paratuberculosis
caccccguugccgccggcgcc

SEQ ID NO: 2972957 - RNA, 22 nt, Mycobacterium avium subsp. paratuberculosis
caccccguugccgccggcgccc

SEQ ID NO: 2972958 - RNA, 23 nt, Mycobacterium avium subsp. paratuberculosis
caccccuggcggguacagccgca

SEQ ID NO: 2972959 - RNA, 18 nt, Mycobacterium avium subsp. paratuberculosis
cacccgaauuccgcuggg

SEQ ID NO: 2972960 - RNA, 14 nt, Mycobacterium avium subsp. paratuberculosis
cacccgacacgccg

SEQ ID NO: 2972961 - RNA, 15 nt, Mycobacterium avium subsp. paratuberculosis
cacccgacacgccga

SEQ ID NO: 2972962 - RNA, 18 nt, Mycobacterium avium subsp. paratuberculosis
cacccgacacgccgaucg

SEQ ID NO: 2972963 - RNA, 18 nt, Mycobacterium avium subsp. paratuberculosis
cacccgacgaaaucgucg

SEQ ID NO: 2972964 - RNA, 14 nt, Mycobacterium avium subsp. paratuberculosis
cacccgacgaagcc

SEQ ID NO: 2972965 - RNA, 19 nt, Mycobacterium avium subsp. paratuberculosis
cacccgacgaagccgccgc

SEQ ID NO: 2972966 - RNA, 21 nt, Mycobacterium avium subsp. paratuberculosis
cacccgacgaagccgccgccc

SEQ ID NO: 2972967 - RNA, 12 nt, Mycobacterium avium subsp. paratuberculosis
cacccgacgucg

SEQ ID NO: 2972968 - RNA, 20 nt, Mycobacterium avium subsp. paratuberculosis
cacccgacuucggcucggcg

SEQ ID NO: 2972969 - RNA, 21 nt, Mycobacterium avium subsp. paratuberculosis
cacccgacuucggcucggcga

SEQ ID NO: 2972970 - RNA, 22 nt, Mycobacterium avium subsp. paratuberculosis
cacccgacuucggcucggcgac

SEQ ID NO: 2972971 - RNA, 23 nt, Mycobacterium avium subsp. paratuberculosis
cacccgacuucggcucggcgaca

SEQ ID NO: 2972972 - RNA, 24 nt, Mycobacterium avium subsp. paratuberculosis
cacccgacuucggcucggcgacaa

SEQ ID NO: 2972973 - RNA, 16 nt, Mycobacterium avium subsp. paratuberculosis
cacccgaggccguuca

SEQ ID NO: 2972974 - RNA, 14 nt, Mycobacterium avium subsp. paratuberculosis
cacccgauccacgg

SEQ ID NO: 2972975 - RNA, 20 nt, Mycobacterium avium subsp. paratuberculosis
cacccgauccacggcgaccc

SEQ ID NO: 2972976 - RNA, 17 nt, Mycobacterium avium subsp. paratuberculosis
cacccgaugaccggccc

SEQ ID NO: 2972977 - RNA, 18 nt, Mycobacterium avium subsp. paratuberculosis
cacccgaugaccggcccg

SEQ ID NO: 2972978 - RNA, 22 nt, Mycobacterium avium subsp. paratuberculosis
cacccgaugaccggcccggcgg

SEQ ID NO: 2972979 - RNA, 18 nt, Mycobacterium avium subsp. paratuberculosis
cacccgaugcucgaugcg

SEQ ID NO: 2972980 - RNA, 20 nt, Mycobacterium avium subsp. paratuberculosis
cacccgcaacaccacgucgg

SEQ ID NO: 2972981 - RNA, 20 nt, Mycobacterium avium subsp. paratuberculosis
cacccgcaacgcgcgcgacg

SEQ ID NO: 2972982 - RNA, 23 nt, Mycobacterium avium subsp. paratuberculosis
cacccgcaacgcgcgcgacggcg

SEQ ID NO: 2972983 - RNA, 18 nt, Mycobacterium avium subsp. paratuberculosis
cacccgcaacgcugaccg

SEQ ID NO: 2972984 - RNA, 23 nt, Mycobacterium avium subsp. paratuberculosis
cacccgcaccguguagccgaccg

SEQ ID NO: 2972985 - RNA, 21 nt, Mycobacterium avium subsp. paratuberculosis
cacccgcaccucgcccggcuc

SEQ ID NO: 2972986 - RNA, 23 nt, Mycobacterium avium subsp. paratuberculosis
cacccgcaccucgcccggcucga

SEQ ID NO: 2972987 - RNA, 16 nt, Mycobacterium avium subsp. paratuberculosis
cacccgcaccucgcug

SEQ ID NO: 2972988 - RNA, 13 nt, Mycobacterium avium subsp. paratuberculosis
cacccgcacgccc

SEQ ID NO: 2972989 - RNA, 17 nt, Mycobacterium avium subsp. paratuberculosis
cacccgcacgcccgggc

SEQ ID NO: 2972990 - RNA, 21 nt, Mycobacterium avium subsp. paratuberculosis
cacccgcacgcccgggcaugc

SEQ ID NO: 2972991 - RNA, 19 nt, Mycobacterium avium subsp. paratuberculosis
cacccgcacgcugucgggg

SEQ ID NO: 2972992 - RNA, 16 nt, Mycobacterium avium subsp. paratuberculosis
cacccgcacggucgcg

SEQ ID NO: 2972993 - RNA, 23 nt, Mycobacterium avium subsp. paratuberculosis
cacccgcacggucgcggugucgg

SEQ ID NO: 2972994 - RNA, 24 nt, Mycobacterium avium subsp. paratuberculosis
cacccgcacgugcgcgccgaccgc

SEQ ID NO: 2972995 - RNA, 16 nt, Mycobacterium avium subsp. paratuberculosis
cacccgcagcccgacc

SEQ ID NO: 2972996 - RNA, 19 nt, Mycobacterium avium subsp. paratuberculosis
cacccgcagccgcgagucg

SEQ ID NO: 2972997 - RNA, 14 nt, Mycobacterium avium subsp. paratuberculosis
cacccgcagcgacc

SEQ ID NO: 2972998 - RNA, 13 nt, Mycobacterium avium subsp. paratuberculosis
cacccgcagcgcg

SEQ ID NO: 2972999 - RNA, 15 nt, Mycobacterium avium subsp. paratuberculosis
cacccgcagcgcggc

SEQ ID NO: 2973000 - RNA, 16 nt, Mycobacterium avium subsp. paratuberculosis
cacccgcagcgcggcg

SEQ ID NO: 2973001 - RNA, 18 nt, Mycobacterium avium subsp. paratuberculosis
cacccgcagcuccagcga

SEQ ID NO: 2973002 - RNA, 15 nt, Mycobacterium avium subsp. paratuberculosis
cacccgcagggcgcc

SEQ ID NO: 2973003 - RNA, 17 nt, Mycobacterium avium subsp. paratuberculosis
cacccgcagggcgccgg

SEQ ID NO: 2973004 - RNA, 18 nt, Mycobacterium avium subsp. paratuberculosis
cacccgcagggcgccggu

SEQ ID NO: 2973005 - RNA, 13 nt, Mycobacterium avium subsp. paratuberculosis
cacccgccagccc

SEQ ID NO: 2973006 - RNA, 14 nt, Mycobacterium avium subsp. paratuberculosis
cacccgccagcccg

SEQ ID NO: 2973007 - RNA, 19 nt, Mycobacterium avium subsp. paratuberculosis
cacccgccagcccgcgucg

SEQ ID NO: 2973008 - RNA, 16 nt, Mycobacterium avium subsp. paratuberculosis
cacccgccauggcggc

SEQ ID NO: 2973009 - RNA, 18 nt, Mycobacterium avium subsp. paratuberculosis
cacccgccauggcggcau

SEQ ID NO: 2973010 - RNA, 12 nt, Mycobacterium avium subsp. paratuberculosis
cacccgccccgc

SEQ ID NO: 2973011 - RNA, 13 nt, Mycobacterium avium subsp. paratuberculosis
cacccgccccgcc

SEQ ID NO: 2973012 - RNA, 16 nt, Mycobacterium avium subsp. paratuberculosis
cacccgccccgccgcg

SEQ ID NO: 2973013 - RNA, 18 nt, Mycobacterium avium subsp. paratuberculosis
cacccgccccgccgcggc

SEQ ID NO: 2973014 - RNA, 20 nt, Mycobacterium avium subsp. paratuberculosis
cacccgccggguggccgcca

SEQ ID NO: 2973015 - RNA, 21 nt, Mycobacterium avium subsp. paratuberculosis
cacccgccggguggccgccac

SEQ ID NO: 2973016 - RNA, 16 nt, Mycobacterium avium subsp. paratuberculosis
cacccgcgcacgcucg

SEQ ID NO: 2973017 - RNA, 17 nt, Mycobacterium avium subsp. paratuberculosis
cacccgcgcacgcucgc

SEQ ID NO: 2973018 - RNA, 14 nt, Mycobacterium avium subsp. paratuberculosis
cacccgcgccggca

SEQ ID NO: 2973019 - RNA, 16 nt, Mycobacterium avium subsp. paratuberculosis
cacccgcgccggcaga

SEQ ID NO: 2973020 - RNA, 15 nt, Mycobacterium avium subsp. paratuberculosis
cacccgcgcgucgcg

SEQ ID NO: 2973021 - RNA, 14 nt, Mycobacterium avium subsp. paratuberculosis
cacccgcggaacgc

SEQ ID NO: 2973022 - RNA, 19 nt, Mycobacterium avium subsp. paratuberculosis
cacccgcggaacgcucacu

SEQ ID NO: 2973023 - RNA, 16 nt, Mycobacterium avium subsp. paratuberculosis
cacccgcggccgcugc

SEQ ID NO: 2973024 - RNA, 17 nt, Mycobacterium avium subsp. paratuberculosis
cacccgcggccgcugcg

SEQ ID NO: 2973025 - RNA, 21 nt, Mycobacterium avium subsp. paratuberculosis
cacccgcggccgcugcgccca

SEQ ID NO: 2973026 - RNA, 22 nt, Mycobacterium avium subsp. paratuberculosis
cacccgcggccgcugcgcccag

SEQ ID NO: 2973027 - RNA, 14 nt, Mycobacterium avium subsp. paratuberculosis
cacccgcggccggc

SEQ ID NO: 2973028 - RNA, 21 nt, Mycobacterium avium subsp. paratuberculosis
cacccgcggccggcccagcgc

SEQ ID NO: 2973029 - RNA, 22 nt, Mycobacterium avium subsp. paratuberculosis
cacccgcggccggcccagcgcg

SEQ ID NO: 2973030 - RNA, 23 nt, Mycobacterium avium subsp. paratuberculosis
cacccgcggccggcccagcgcgc

SEQ ID NO: 2973031 - RNA, 12 nt, Mycobacterium avium subsp. paratuberculosis
cacccgcggcgc

SEQ ID NO: 2973032 - RNA, 14 nt, Mycobacterium avium subsp. paratuberculosis
cacccgcggcgcga

SEQ ID NO: 2973033 - RNA, 14 nt, Mycobacterium avium subsp. paratuberculosis
cacccgcgggucgu

SEQ ID NO: 2973034 - RNA, 22 nt, Mycobacterium avium subsp. paratuberculosis
cacccgcgggucgucgggcggc

SEQ ID NO: 2973035 - RNA, 15 nt, Mycobacterium avium subsp. paratuberculosis
cacccgcucgcgggc

SEQ ID NO: 2973036 - RNA, 21 nt, Mycobacterium avium subsp. paratuberculosis
cacccgcucgcgggcccgcgc

SEQ ID NO: 2973037 - RNA, 23 nt, Mycobacterium avium subsp. paratuberculosis
cacccgcucgcgggcccgcgccg

SEQ ID NO: 2973038 - RNA, 14 nt, Mycobacterium avium subsp. paratuberculosis
cacccgcucggcga

SEQ ID NO: 2973039 - RNA, 16 nt, Mycobacterium avium subsp. paratuberculosis
cacccgcucggcgauc

SEQ ID NO: 2973040 - RNA, 17 nt, Mycobacterium avium subsp. paratuberculosis
cacccgcugcaccagcc

SEQ ID NO: 2973041 - RNA, 21 nt, Mycobacterium avium subsp. paratuberculosis
cacccgcugcaccagcccguc

SEQ ID NO: 2973042 - RNA, 19 nt, Mycobacterium avium subsp. paratuberculosis
cacccgcugcagccggucc

SEQ ID NO: 2973043 - RNA, 20 nt, Mycobacterium avium subsp. paratuberculosis
cacccgcugcagccgguccg

SEQ ID NO: 2973044 - RNA, 23 nt, Mycobacterium avium subsp. paratuberculosis
cacccgcugcucgaccucggcga

SEQ ID NO: 2973045 - RNA, 13 nt, Mycobacterium avium subsp. paratuberculosis
cacccgcugguca

SEQ ID NO: 2973046 - RNA, 18 nt, Mycobacterium avium subsp. paratuberculosis
cacccggacgugaucgcg

SEQ ID NO: 2973047 - RNA, 23 nt, Mycobacterium avium subsp. paratuberculosis
cacccggauggucugcagcgacg

SEQ ID NO: 2973048 - RNA, 22 nt, Mycobacterium avium subsp. paratuberculosis
cacccggaugucgugcggucgc

SEQ ID NO: 2973049 - RNA, 16 nt, Mycobacterium avium subsp. paratuberculosis
cacccggccacgccgg

SEQ ID NO: 2973050 - RNA, 14 nt, Mycobacterium avium subsp. paratuberculosis
cacccggcccacca

SEQ ID NO: 2973051 - RNA, 16 nt, Mycobacterium avium subsp. paratuberculosis
cacccggcccaccacc

SEQ ID NO: 2973052 - RNA, 19 nt, Mycobacterium avium subsp. paratuberculosis
cacccggcccaccggcccg

SEQ ID NO: 2973053 - RNA, 23 nt, Mycobacterium avium subsp. paratuberculosis
cacccggcccaccggcccggcgg

SEQ ID NO: 2973054 - RNA, 15 nt, Mycobacterium avium subsp. paratuberculosis
cacccggcccacgcc

SEQ ID NO: 2973055 - RNA, 16 nt, Mycobacterium avium subsp. paratuberculosis
cacccggcccacgccg

SEQ ID NO: 2973056 - RNA, 19 nt, Mycobacterium avium subsp. paratuberculosis
cacccggcccacgccgucg

SEQ ID NO: 2973057 - RNA, 21 nt, Mycobacterium avium subsp. paratuberculosis
cacccggcccuauggcaucgc

SEQ ID NO: 2973058 - RNA, 15 nt, Mycobacterium avium subsp. paratuberculosis
cacccggccggcgaa

SEQ ID NO: 2973059 - RNA, 24 nt, Mycobacterium avium subsp. paratuberculosis
cacccggccggcgaaacacagcag

SEQ ID NO: 2973060 - RNA, 17 nt, Mycobacterium avium subsp. paratuberculosis
cacccggcgcgcggaga

SEQ ID NO: 2973061 - RNA, 12 nt, Mycobacterium avium subsp. paratuberculosis
cacccggcgcgg

SEQ ID NO: 2973062 - RNA, 14 nt, Mycobacterium avium subsp. paratuberculosis
cacccggcgcggcc

SEQ ID NO: 2973063 - RNA, 18 nt, Mycobacterium avium subsp. paratuberculosis
cacccggcgcggccgccc

SEQ ID NO: 2973064 - RNA, 15 nt, Mycobacterium avium subsp. paratuberculosis
cacccggcggcaccg

SEQ ID NO: 2973065 - RNA, 18 nt, Mycobacterium avium subsp. paratuberculosis
cacccggcggcaccgcgg

SEQ ID NO: 2973066 - RNA, 20 nt, Mycobacterium avium subsp. paratuberculosis
cacccggcggcaccgcggcu

SEQ ID NO: 2973067 - RNA, 15 nt, Mycobacterium avium subsp. paratuberculosis
cacccggcggggacc

SEQ ID NO: 2973068 - RNA, 23 nt, Mycobacterium avium subsp. paratuberculosis
cacccgggcccggucgucgccgg

SEQ ID NO: 2973069 - RNA, 18 nt, Mycobacterium avium subsp. paratuberculosis
cacccgggccugcggcgg

SEQ ID NO: 2973070 - RNA, 21 nt, Mycobacterium avium subsp. paratuberculosis
cacccgggccugcggcggccg

SEQ ID NO: 2973071 - RNA, 22 nt, Mycobacterium avium subsp. paratuberculosis
cacccgggccugcggcggccgc

SEQ ID NO: 2973072 - RNA, 20 nt, Mycobacterium avium subsp. paratuberculosis
cacccgggccuuguugcggc

SEQ ID NO: 2973073 - RNA, 22 nt, Mycobacterium avium subsp. paratuberculosis
cacccgggccuuguugcggcgc

SEQ ID NO: 2973074 - RNA, 23 nt, Mycobacterium avium subsp. paratuberculosis
cacccgggccuuguugcggcgca

SEQ ID NO: 2973075 - RNA, 12 nt, Mycobacterium avium subsp. paratuberculosis
cacccgggcgcc

SEQ ID NO: 2973076 - RNA, 13 nt, Mycobacterium avium subsp. paratuberculosis
cacccgggcgccg

SEQ ID NO: 2973077 - RNA, 15 nt, Mycobacterium avium subsp. paratuberculosis
cacccgggcgccggc

SEQ ID NO: 2973078 - RNA, 19 nt, Mycobacterium avium subsp. paratuberculosis
cacccgggcgccggcgaug

SEQ ID NO: 2973079 - RNA, 20 nt, Mycobacterium avium subsp. paratuberculosis
cacccgggcgccggcgauga

SEQ ID NO: 2973080 - RNA, 13 nt, Mycobacterium avium subsp. paratuberculosis
cacccgggcgcga

SEQ ID NO: 2973081 - RNA, 18 nt, Mycobacterium avium subsp. paratuberculosis
cacccgggcgcgacgguc

SEQ ID NO: 2973082 - RNA, 16 nt, Mycobacterium avium subsp. paratuberculosis
cacccgggucaggucg

SEQ ID NO: 2973083 - RNA, 12 nt, Mycobacterium avium subsp. paratuberculosis
cacccgggucga

SEQ ID NO: 2973084 - RNA, 15 nt, Mycobacterium avium subsp. paratuberculosis
cacccgggucgagcg

SEQ ID NO: 2973085 - RNA, 20 nt, Mycobacterium avium subsp. paratuberculosis
cacccgggugaucaacgcgg

SEQ ID NO: 2973086 - RNA, 23 nt, Mycobacterium avium subsp. paratuberculosis
cacccgggugaucaacgcggaca

SEQ ID NO: 2973087 - RNA, 14 nt, Mycobacterium avium subsp. paratuberculosis
cacccgggugcccg

SEQ ID NO: 2973088 - RNA, 15 nt, Mycobacterium avium subsp. paratuberculosis
cacccgggugcccgg

SEQ ID NO: 2973089 - RNA, 23 nt, Mycobacterium avium subsp. paratuberculosis
cacccgggugcccggcugggcgc

SEQ ID NO: 2973090 - RNA, 17 nt, Mycobacterium avium subsp. paratuberculosis
cacccggguggacaccg

SEQ ID NO: 2973091 - RNA, 19 nt, Mycobacterium avium subsp. paratuberculosis
cacccggguggacaccgcg

SEQ ID NO: 2973092 - RNA, 20 nt, Mycobacterium avium subsp. paratuberculosis
cacccggguggacaccgcga

SEQ ID NO: 2973093 - RNA, 23 nt, Mycobacterium avium subsp. paratuberculosis
cacccggguguuggagccguccg

SEQ ID NO: 2973094 - RNA, 14 nt, Mycobacterium avium subsp. paratuberculosis
cacccgguccccgg

SEQ ID NO: 2973095 - RNA, 20 nt, Mycobacterium avium subsp. paratuberculosis
cacccgguccggcuggucgg

SEQ ID NO: 2973096 - RNA, 21 nt, Mycobacterium avium subsp. paratuberculosis
cacccgguccggcuggucggc

SEQ ID NO: 2973097 - RNA, 23 nt, Mycobacterium avium subsp. paratuberculosis
cacccgguccuucucgcacagca

SEQ ID NO: 2973098 - RNA, 23 nt, Mycobacterium avium subsp. paratuberculosis
cacccggucgccggugugaucga

SEQ ID NO: 2973099 - RNA, 16 nt, Mycobacterium avium subsp. paratuberculosis
cacccggugcgccggu

SEQ ID NO: 2973100 - RNA, 17 nt, Mycobacterium avium subsp. paratuberculosis
cacccggugggacuggg

SEQ ID NO: 2973101 - RNA, 18 nt, Mycobacterium avium subsp. paratuberculosis
cacccgguuccaccgggc

SEQ ID NO: 2973102 - RNA, 21 nt, Mycobacterium avium subsp. paratuberculosis
cacccgguuccaccgggccgc

SEQ ID NO: 2973103 - RNA, 17 nt, Mycobacterium avium subsp. paratuberculosis
cacccgucgacucggcg

SEQ ID NO: 2973104 - RNA, 19 nt, Mycobacterium avium subsp. paratuberculosis
cacccgucgacucggcggu

SEQ ID NO: 2973105 - RNA, 21 nt, Mycobacterium avium subsp. paratuberculosis
cacccgucgacucggcggugc

SEQ ID NO: 2973106 - RNA, 19 nt, Mycobacterium avium subsp. paratuberculosis
cacccgugggccgaccggc

SEQ ID NO: 2973107 - RNA, 20 nt, Mycobacterium avium subsp. paratuberculosis
cacccgugggccgaccggcc

SEQ ID NO: 2973108 - RNA, 23 nt, Mycobacterium avium subsp. paratuberculosis
cacccgugggccgaccggccggu

SEQ ID NO: 2973109 - RNA, 23 nt, Mycobacterium avium subsp. paratuberculosis
cacccguggugggcgaacagcag

SEQ ID NO: 2973110 - RNA, 16 nt, Mycobacterium avium subsp. paratuberculosis
cacccguuccucgacg

SEQ ID NO: 2973111 - RNA, 16 nt, Mycobacterium avium subsp. paratuberculosis
cacccguucggcgucg

SEQ ID NO: 2973112 - RNA, 17 nt, Mycobacterium avium subsp. paratuberculosis
cacccguucggcgucga

SEQ ID NO: 2973113 - RNA, 17 nt, Mycobacterium avium subsp. paratuberculosis
cacccguuggcaggccc

SEQ ID NO: 2973114 - RNA, 17 nt, Mycobacterium avium subsp. paratuberculosis
cacccguuugaggcgag

SEQ ID NO: 2973115 - RNA, 20 nt, Mycobacterium avium subsp. paratuberculosis
cacccucagggagcugcccg

SEQ ID NO: 2973116 - RNA, 13 nt, Mycobacterium avium subsp. paratuberculosis
cacccuccucgcg

SEQ ID NO: 2973117 - RNA, 18 nt, Mycobacterium avium subsp. paratuberculosis
cacccuccucgcggcggu

SEQ ID NO: 2973118 - RNA, 15 nt, Mycobacterium avium subsp. paratuberculosis
cacccucgcgcagga

SEQ ID NO: 2973119 - RNA, 18 nt, Mycobacterium avium subsp. paratuberculosis
cacccucgcgcaggaaca

SEQ ID NO: 2973120 - RNA, 20 nt, Mycobacterium avium subsp. paratuberculosis
cacccucggcccgccacccg

SEQ ID NO: 2973121 - RNA, 15 nt, Mycobacterium avium subsp. paratuberculosis
cacccucggcguccc

SEQ ID NO: 2973122 - RNA, 17 nt, Mycobacterium avium subsp. paratuberculosis
cacccucggcgucccgu

SEQ ID NO: 2973123 - RNA, 15 nt, Mycobacterium avium subsp. paratuberculosis
cacccucggucgggc

SEQ ID NO: 2973124 - RNA, 18 nt, Mycobacterium avium subsp. paratuberculosis
cacccucggucgggcgau

SEQ ID NO: 2973125 - RNA, 22 nt, Mycobacterium avium subsp. paratuberculosis
cacccugccgaccugcgcgacg

SEQ ID NO: 2973126 - RNA, 14 nt, Mycobacterium avium subsp. paratuberculosis
cacccugcgccaca

SEQ ID NO: 2973127 - RNA, 15 nt, Mycobacterium avium subsp. paratuberculosis
cacccugcgccacaa

SEQ ID NO: 2973128 - RNA, 13 nt, Mycobacterium avium subsp. paratuberculosis
cacccuggcgaac

SEQ ID NO: 2973129 - RNA, 18 nt, Mycobacterium avium subsp. paratuberculosis
cacccuugacuaccgcgc

SEQ ID NO: 2973130 - RNA, 21 nt, Mycobacterium avium subsp. paratuberculosis
cacccuugacuaccgcgccca

SEQ ID NO: 2973131 - RNA, 18 nt, Mycobacterium avium subsp. paratuberculosis
cacccuuuuccaucuggg

SEQ ID NO: 2973132 - RNA, 19 nt, Mycobacterium avium subsp. paratuberculosis
cacccuuuuccaucugggc

SEQ ID NO: 2973133 - RNA, 23 nt, Mycobacterium avium subsp. paratuberculosis
cacccuuuuccaucugggcgcgc

SEQ ID NO: 2973134 - RNA, 19 nt, Mycobacterium avium subsp. paratuberculosis
caccgaaaccuugaucggc

SEQ ID NO: 2973135 - RNA, 21 nt, Mycobacterium avium subsp. paratuberculosis
caccgaaaccuugaucggccc

SEQ ID NO: 2973136 - RNA, 22 nt, Mycobacterium avium subsp. paratuberculosis
caccgaaaccuugaucggcccc

SEQ ID NO: 2973137 - RNA, 14 nt, Mycobacterium avium subsp. paratuberculosis
caccgaaagccgua

SEQ ID NO: 2973138 - RNA, 22 nt, Mycobacterium avium subsp. paratuberculosis
caccgaaagccguagcgcaaca

SEQ ID NO: 2973139 - RNA, 15 nt, Mycobacterium avium subsp. paratuberculosis
caccgaacccaccag

SEQ ID NO: 2973140 - RNA, 21 nt, Mycobacterium avium subsp. paratuberculosis
caccgaacccaccagcgccug

SEQ ID NO: 2973141 - RNA, 21 nt, Mycobacterium avium subsp. paratuberculosis
caccgaacccggaucggccau

SEQ ID NO: 2973142 - RNA, 18 nt, Mycobacterium avium subsp. paratuberculosis
caccgaaccgccccgcgc

SEQ ID NO: 2973143 - RNA, 18 nt, Mycobacterium avium subsp. paratuberculosis
caccgaaccggcgggguc

SEQ ID NO: 2973144 - RNA, 15 nt, Mycobacterium avium subsp. paratuberculosis
caccgaacgccagca

SEQ ID NO: 2973145 - RNA, 13 nt, Mycobacterium avium subsp. paratuberculosis
caccgaacgccga

SEQ ID NO: 2973146 - RNA, 16 nt, Mycobacterium avium subsp. paratuberculosis
caccgaacgccgaggu

SEQ ID NO: 2973147 - RNA, 17 nt, Mycobacterium avium subsp. paratuberculosis
caccgaagaaccccgag

SEQ ID NO: 2973148 - RNA, 18 nt, Mycobacterium avium subsp. paratuberculosis
caccgaagaaccccgaga

SEQ ID NO: 2973149 - RNA, 16 nt, Mycobacterium avium subsp. paratuberculosis
caccgaagccgacguc

SEQ ID NO: 2973150 - RNA, 15 nt, Mycobacterium avium subsp. paratuberculosis
caccgaaguccgcca

SEQ ID NO: 2973151 - RNA, 19 nt, Mycobacterium avium subsp. paratuberculosis
caccgaaguccgccagggu

SEQ ID NO: 2973152 - RNA, 20 nt, Mycobacterium avium subsp. paratuberculosis
caccgaaucacccacggcca

SEQ ID NO: 2973153 - RNA, 15 nt, Mycobacterium avium subsp. paratuberculosis
caccgaaucgccgag

SEQ ID NO: 2973154 - RNA, 16 nt, Mycobacterium avium subsp. paratuberculosis
caccgaaucgccgagc

SEQ ID NO: 2973155 - RNA, 20 nt, Mycobacterium avium subsp. paratuberculosis
caccgaaucgccgagcucga

SEQ ID NO: 2973156 - RNA, 19 nt, Mycobacterium avium subsp. paratuberculosis
caccgaauuguccagcagu

SEQ ID NO: 2973157 - RNA, 19 nt, Mycobacterium avium subsp. paratuberculosis
caccgacaagggccgggcg

SEQ ID NO: 2973158 - RNA, 21 nt, Mycobacterium avium subsp. paratuberculosis
caccgacaagggccgggcgcu

SEQ ID NO: 2973159 - RNA, 14 nt, Mycobacterium avium subsp. paratuberculosis
caccgacaccaccg

SEQ ID NO: 2973160 - RNA, 18 nt, Mycobacterium avium subsp. paratuberculosis
caccgacaccaccggccg

SEQ ID NO: 2973161 - RNA, 19 nt, Mycobacterium avium subsp. paratuberculosis
caccgacaccaccggccgc

SEQ ID NO: 2973162 - RNA, 15 nt, Mycobacterium avium subsp. paratuberculosis
caccgacaccggccg

SEQ ID NO: 2973163 - RNA, 11 nt, Mycobacterium avium subsp. paratuberculosis
caccgacagca

SEQ ID NO: 2973164 - RNA, 17 nt, Mycobacterium avium subsp. paratuberculosis
caccgacagcacccggc

SEQ ID NO: 2973165 - RNA, 19 nt, Mycobacterium avium subsp. paratuberculosis
caccgacagcacccggccc

SEQ ID NO: 2973166 - RNA, 12 nt, Mycobacterium avium subsp. paratuberculosis
caccgacagccg

SEQ ID NO: 2973167 - RNA, 14 nt, Mycobacterium avium subsp. paratuberculosis
caccgacagcgcgu

SEQ ID NO: 2973168 - RNA, 20 nt, Mycobacterium avium subsp. paratuberculosis
caccgacaucagaucgccga

SEQ ID NO: 2973169 - RNA, 21 nt, Mycobacterium avium subsp. paratuberculosis
caccgacaucagaucgccgac

SEQ ID NO: 2973170 - RNA, 22 nt, Mycobacterium avium subsp. paratuberculosis
caccgacaucagaucgccgacg

SEQ ID NO: 2973171 - RNA, 24 nt, Mycobacterium avium subsp. paratuberculosis
caccgacaucagaucgccgacgac

SEQ ID NO: 2973172 - RNA, 17 nt, Mycobacterium avium subsp. paratuberculosis
caccgacaucgaaugca

SEQ ID NO: 2973173 - RNA, 18 nt, Mycobacterium avium subsp. paratuberculosis
caccgacaugucgccggg

SEQ ID NO: 2973174 - RNA, 19 nt, Mycobacterium avium subsp. paratuberculosis
caccgacaugucgccgggc

SEQ ID NO: 2973175 - RNA, 20 nt, Mycobacterium avium subsp. paratuberculosis
caccgacaugucgccgggcg

SEQ ID NO: 2973176 - RNA, 13 nt, Mycobacterium avium subsp. paratuberculosis
caccgaccagcug

SEQ ID NO: 2973177 - RNA, 22 nt, Mycobacterium avium subsp. paratuberculosis
cacuggacauucacgaggccgg

SEQ ID NO: 2973178 - RNA, 14 nt, Mycobacterium avium subsp. paratuberculosis
cacuggagugcugc

SEQ ID NO: 2973179 - RNA, 22 nt, Mycobacterium avium subsp. paratuberculosis
cacuggagugcugcagaccgaa

SEQ ID NO: 2973180 - RNA, 20 nt, Mycobacterium avium subsp. paratuberculosis
cacuggcggccggccgcgcc

SEQ ID NO: 2973181 - RNA, 22 nt, Mycobacterium avium subsp. paratuberculosis
cacuggcggccggccgcgccca

SEQ ID NO: 2973182 - RNA, 17 nt, Mycobacterium avium subsp. paratuberculosis
cacuggcgugacgcucg

SEQ ID NO: 2973183 - RNA, 20 nt, Mycobacterium avium subsp. paratuberculosis
cacuggcgugacgcucggcc

SEQ ID NO: 2973184 - RNA, 21 nt, Mycobacterium avium subsp. paratuberculosis
cacuggcuggucacccacugg

SEQ ID NO: 2973185 - RNA, 14 nt, Mycobacterium avium subsp. paratuberculosis
cacugggcgucggc

SEQ ID NO: 2973186 - RNA, 18 nt, Mycobacterium avium subsp. paratuberculosis
cacugggcgucggcgccc

SEQ ID NO: 2973187 - RNA, 19 nt, Mycobacterium avium subsp. paratuberculosis
cacugggcgucggcgcccc

SEQ ID NO: 2973188 - RNA, 15 nt, Mycobacterium avium subsp. paratuberculosis
cacuggucgugcugg

SEQ ID NO: 2973189 - RNA, 18 nt, Mycobacterium avium subsp. paratuberculosis
cacuggucguugcacacc

SEQ ID NO: 2973190 - RNA, 14 nt, Mycobacterium avium subsp. paratuberculosis
cacugucggcgcgg

SEQ ID NO: 2973191 - RNA, 15 nt, Mycobacterium avium subsp. paratuberculosis
cacugucggcgcgga

SEQ ID NO: 2973192 - RNA, 17 nt, Mycobacterium avium subsp. paratuberculosis
cacuuaacaccucgccu

SEQ ID NO: 2973193 - RNA, 18 nt, Mycobacterium avium subsp. paratuberculosis
cacuuaacaccucgccuc

SEQ ID NO: 2973194 - RNA, 14 nt, Mycobacterium avium subsp. paratuberculosis
cacuucgacgguga

SEQ ID NO: 2973195 - RNA, 16 nt, Mycobacterium avium subsp. paratuberculosis
cacuucgacggugaug

SEQ ID NO: 2973196 - RNA, 19 nt, Mycobacterium avium subsp. paratuberculosis
cacuucgccgggcuggccg

SEQ ID NO: 2973197 - RNA, 20 nt, Mycobacterium avium subsp. paratuberculosis
cacuucggguguggugccgg

SEQ ID NO: 2973198 - RNA, 18 nt, Mycobacterium avium subsp. paratuberculosis
cacuucuccacgccgacg

SEQ ID NO: 2973199 - RNA, 19 nt, Mycobacterium avium subsp. paratuberculosis
cacuucuggcgcugcucgg

SEQ ID NO: 2973200 - RNA, 16 nt, Mycobacterium avium subsp. paratuberculosis
cacuugaagccgguga

SEQ ID NO: 2973201 - RNA, 20 nt, Mycobacterium avium subsp. paratuberculosis
cacuuggccucgggcgacga

SEQ ID NO: 2973202 - RNA, 22 nt, Mycobacterium avium subsp. paratuberculosis
cacuuguccaccauggcuuccg

SEQ ID NO: 2973203 - RNA, 14 nt, Mycobacterium avium subsp. paratuberculosis
cagaaaaaggccgc

SEQ ID NO: 2973204 - RNA, 20 nt, Mycobacterium avium subsp. paratuberculosis
cagaaaagagaucgccccgc

SEQ ID NO: 2973205 - RNA, 15 nt, Mycobacterium avium subsp. paratuberculosis
cagaaaucgccggga

SEQ ID NO: 2973206 - RNA, 18 nt, Mycobacterium avium subsp. paratuberculosis
cagaaaugcaggcccugc

SEQ ID NO: 2973207 - RNA, 12 nt, Mycobacterium avium subsp. paratuberculosis
cagaacaccacc

SEQ ID NO: 2973208 - RNA, 13 nt, Mycobacterium avium subsp. paratuberculosis
cagaacaccagcg

SEQ ID NO: 2973209 - RNA, 21 nt, Mycobacterium avium subsp. paratuberculosis
cagaacacguuucggcccucc

SEQ ID NO: 2973210 - RNA, 15 nt, Mycobacterium avium subsp. paratuberculosis
cagaacagcacgaga

SEQ ID NO: 2973211 - RNA, 13 nt, Mycobacterium avium subsp. paratuberculosis
cagaacagccagu

SEQ ID NO: 2973212 - RNA, 16 nt, Mycobacterium avium subsp. paratuberculosis
cagaacagccagucga

SEQ ID NO: 2973213 - RNA, 15 nt, Mycobacterium avium subsp. paratuberculosis
cagaacagccggucc

SEQ ID NO: 2973214 - RNA, 20 nt, Mycobacterium avium subsp. paratuberculosis
cagaacagccgguccgaccg

SEQ ID NO: 2973215 - RNA, 23 nt, Mycobacterium avium subsp. paratuberculosis
cagaacagccgguccgaccgcca

SEQ ID NO: 2973216 - RNA, 15 nt, Mycobacterium avium subsp. paratuberculosis
cagaacaggugcggc

SEQ ID NO: 2973217 - RNA, 17 nt, Mycobacterium avium subsp. paratuberculosis
cagaaccaccugggcgu

SEQ ID NO: 2973218 - RNA, 22 nt, Mycobacterium avium subsp. paratuberculosis
cagaaccaccugggcgucgucg

SEQ ID NO: 2973219 - RNA, 14 nt, Mycobacterium avium subsp. paratuberculosis
cagaaccagcaccg

SEQ ID NO: 2973220 - RNA, 16 nt, Mycobacterium avium subsp. paratuberculosis
cagaaccagcaccgcc

SEQ ID NO: 2973221 - RNA, 16 nt, Mycobacterium avium subsp. paratuberculosis
cagaaccgcaccccgu

SEQ ID NO: 2973222 - RNA, 20 nt, Mycobacterium avium subsp. paratuberculosis
cagaaccgcaccccgucgcg

SEQ ID NO: 2973223 - RNA, 16 nt, Mycobacterium avium subsp. paratuberculosis
cagaaccgcucggcgg

SEQ ID NO: 2973224 - RNA, 19 nt, Mycobacterium avium subsp. paratuberculosis
cagaaccggggccagcacg

SEQ ID NO: 2973225 - RNA, 20 nt, Mycobacterium avium subsp. paratuberculosis
cagaaccggggccagcacgc

SEQ ID NO: 2973226 - RNA, 22 nt, Mycobacterium avium subsp. paratuberculosis
cagaaccggggccagcacgccc

SEQ ID NO: 2973227 - RNA, 18 nt, Mycobacterium avium subsp. paratuberculosis
cagaaccguugagcagca

SEQ ID NO: 2973228 - RNA, 21 nt, Mycobacterium avium subsp. paratuberculosis
cagaacgacgcgcucagcccc

SEQ ID NO: 2973229 - RNA, 19 nt, Mycobacterium avium subsp. paratuberculosis
cagaacgaguuucccgucg

SEQ ID NO: 2973230 - RNA, 19 nt, Mycobacterium avium subsp. paratuberculosis
cagaacgccaucaccagcg

SEQ ID NO: 2973231 - RNA, 20 nt, Mycobacterium avium subsp. paratuberculosis
cagaacgccaucaccagcgc

SEQ ID NO: 2973232 - RNA, 23 nt, Mycobacterium avium subsp. paratuberculosis
cagaacgcgcggaugcccaggcc

SEQ ID NO: 2973233 - RNA, 19 nt, Mycobacterium avium subsp. paratuberculosis
cagaacggaauucagugag

SEQ ID NO: 2973234 - RNA, 16 nt, Mycobacterium avium subsp. paratuberculosis
cagaacucggcggcgg

SEQ ID NO: 2973235 - RNA, 21 nt, Mycobacterium avium subsp. paratuberculosis
cagaacugcugccguccaaca

SEQ ID NO: 2973236 - RNA, 16 nt, Mycobacterium avium subsp. paratuberculosis
cagaacugggccgccg

SEQ ID NO: 2973237 - RNA, 19 nt, Mycobacterium avium subsp. paratuberculosis
cagaacugggccgccgucg

SEQ ID NO: 2973238 - RNA, 19 nt, Mycobacterium avium subsp. paratuberculosis
cagaacuucuccgccggca

SEQ ID NO: 2973239 - RNA, 16 nt, Mycobacterium avium subsp. paratuberculosis
cagaagcuaacgccag

SEQ ID NO: 2973240 - RNA, 12 nt, Mycobacterium avium subsp. paratuberculosis
cagaagcuccac

SEQ ID NO: 2973241 - RNA, 17 nt, Mycobacterium avium subsp. paratuberculosis
cagaagcuccacgccgc

SEQ ID NO: 2973242 - RNA, 19 nt, Mycobacterium avium subsp. paratuberculosis
cagaagcuccacgccgccg

SEQ ID NO: 2973243 - RNA, 14 nt, Mycobacterium avium subsp. paratuberculosis
cagaauucgccggg

SEQ ID NO: 2973244 - RNA, 18 nt, Mycobacterium avium subsp. paratuberculosis
cagaauucgccggggcac

SEQ ID NO: 2973245 - RNA, 18 nt, Mycobacterium avium subsp. paratuberculosis
cagacacaaaagcaccca

SEQ ID NO: 2973246 - RNA, 17 nt, Mycobacterium avium subsp. paratuberculosis
cagacacaaaagcgccc

SEQ ID NO: 2973247 - RNA, 13 nt, Mycobacterium avium subsp. paratuberculosis
cagacacagcacg

SEQ ID NO: 2973248 - RNA, 16 nt, Mycobacterium avium subsp. paratuberculosis
cagacacagcacgccc

SEQ ID NO: 2973249 - RNA, 18 nt, Mycobacterium avium subsp. paratuberculosis
cagacaggccggccgcua

SEQ ID NO: 2973250 - RNA, 19 nt, Mycobacterium avium subsp. paratuberculosis
cagaccacaagggccaccg

SEQ ID NO: 2973251 - RNA, 21 nt, Mycobacterium avium subsp. paratuberculosis
cagaccacaagggccaccggg

SEQ ID NO: 2973252 - RNA, 23 nt, Mycobacterium avium subsp. paratuberculosis
cagaccacaagggccaccgggcc

SEQ ID NO: 2973253 - RNA, 15 nt, Mycobacterium avium subsp. paratuberculosis
cagaccagcccgucg

SEQ ID NO: 2973254 - RNA, 16 nt, Mycobacterium avium subsp. paratuberculosis
cagaccagcccgucgu

SEQ ID NO: 2973255 - RNA, 18 nt, Mycobacterium avium subsp. paratuberculosis
cagaccaggaccagguug

SEQ ID NO: 2973256 - RNA, 17 nt, Mycobacterium avium subsp. paratuberculosis
cagaccauggcgcggcg

SEQ ID NO: 2973257 - RNA, 21 nt, Mycobacterium avium subsp. paratuberculosis
cagaccauggcgcggcggccg

SEQ ID NO: 2973258 - RNA, 22 nt, Mycobacterium avium subsp. paratuberculosis
cagaccauggcgcggcggccgg

SEQ ID NO: 2973259 - RNA, 14 nt, Mycobacterium avium subsp. paratuberculosis
cagacccagcagcg

SEQ ID NO: 2973260 - RNA, 16 nt, Mycobacterium avium subsp. paratuberculosis
cagacccagcagcggc

SEQ ID NO: 2973261 - RNA, 23 nt, Mycobacterium avium subsp. paratuberculosis
cagacccagcagcggccggcgca

SEQ ID NO: 2973262 - RNA, 21 nt, Mycobacterium avium subsp. paratuberculosis
cagacccagcaucgccgcggu

SEQ ID NO: 2973263 - RNA, 16 nt, Mycobacterium avium subsp. paratuberculosis
cagaccccacaccuuc

SEQ ID NO: 2973264 - RNA, 18 nt, Mycobacterium avium subsp. paratuberculosis
cagacccccagcagcggg

SEQ ID NO: 2973265 - RNA, 15 nt, Mycobacterium avium subsp. paratuberculosis
cagaccccggcgucc

SEQ ID NO: 2973266 - RNA, 20 nt, Mycobacterium avium subsp. paratuberculosis
cagaccccguaccagcgcuc

SEQ ID NO: 2973267 - RNA, 13 nt, Mycobacterium avium subsp. paratuberculosis
cagacccgccgcg

SEQ ID NO: 2973268 - RNA, 15 nt, Mycobacterium avium subsp. paratuberculosis
cagacccgccgcggc

SEQ ID NO: 2973269 - RNA, 13 nt, Mycobacterium avium subsp. paratuberculosis
cagacccgcgucg

SEQ ID NO: 2973270 - RNA, 12 nt, Mycobacterium avium subsp. paratuberculosis
cagacccucguu

SEQ ID NO: 2973271 - RNA, 15 nt, Mycobacterium avium subsp. paratuberculosis
cagaccgaacccggg

SEQ ID NO: 2973272 - RNA, 20 nt, Mycobacterium avium subsp. paratuberculosis
cagaccgaacccgggcgcgc

SEQ ID NO: 2973273 - RNA, 23 nt, Mycobacterium avium subsp. paratuberculosis
cagaccgaacgucacggcgagga

SEQ ID NO: 2973274 - RNA, 19 nt, Mycobacterium avium subsp. paratuberculosis
cagaccgaagaucaccgcg

SEQ ID NO: 2973275 - RNA, 20 nt, Mycobacterium avium subsp. paratuberculosis
cagaccgaagaucaccgcga

SEQ ID NO: 2973276 - RNA, 17 nt, Mycobacterium avium subsp. paratuberculosis
cagaccgccggugcgca

SEQ ID NO: 2973277 - RNA, 18 nt, Mycobacterium avium subsp. paratuberculosis
cagaccgcgaucagcccc

SEQ ID NO: 2973278 - RNA, 12 nt, Mycobacterium avium subsp. paratuberculosis
cagaccgcggcg

SEQ ID NO: 2973279 - RNA, 21 nt, Mycobacterium avium subsp. paratuberculosis
cagaccgcggcggucgccacu

SEQ ID NO: 2973280 - RNA, 14 nt, Mycobacterium avium subsp. paratuberculosis
cagaccggacagcu

SEQ ID NO: 2973281 - RNA, 16 nt, Mycobacterium avium subsp. paratuberculosis
cagaccggacagcugg

SEQ ID NO: 2973282 - RNA, 18 nt, Mycobacterium avium subsp. paratuberculosis
cagaccggcggcgaucgg

SEQ ID NO: 2973283 - RNA, 21 nt, Mycobacterium avium subsp. paratuberculosis
cagaccggcggcgaucggcgc

SEQ ID NO: 2973284 - RNA, 21 nt, Mycobacterium avium subsp. paratuberculosis
cagaccggguuugaggcccac

SEQ ID NO: 2973285 - RNA, 20 nt, Mycobacterium avium subsp. paratuberculosis
cagaccggugagcaccggga

SEQ ID NO: 2973286 - RNA, 17 nt, Mycobacterium avium subsp. paratuberculosis
cagaccgguugcggcga

SEQ ID NO: 2973287 - RNA, 20 nt, Mycobacterium avium subsp. paratuberculosis
cagaccguccgguucggcgg

SEQ ID NO: 2973288 - RNA, 22 nt, Mycobacterium avium subsp. paratuberculosis
cagaccgugugccagcccguug

SEQ ID NO: 2973289 - RNA, 21 nt, Mycobacterium avium subsp. paratuberculosis
cagaccguucuccgaggcguc

SEQ ID NO: 2973290 - RNA, 23 nt, Mycobacterium avium subsp. paratuberculosis
cagaccguucuccgaggcguccu

SEQ ID NO: 2973291 - RNA, 15 nt, Mycobacterium avium subsp. paratuberculosis
cagaccucgccgacg

SEQ ID NO: 2973292 - RNA, 15 nt, Mycobacterium avium subsp. paratuberculosis
cagaccuucgcgauc

SEQ ID NO: 2973293 - RNA, 19 nt, Mycobacterium avium subsp. paratuberculosis
cagacgaacgcggccgcca

SEQ ID NO: 2973294 - RNA, 22 nt, Mycobacterium avium subsp. paratuberculosis
cagacgaacgcggccgccagcg

SEQ ID NO: 2973295 - RNA, 18 nt, Mycobacterium avium subsp. paratuberculosis
cagacgaauucggagacc

SEQ ID NO: 2973296 - RNA, 23 nt, Mycobacterium avium subsp. paratuberculosis
cagacgaauucggagaccagguc

SEQ ID NO: 2973297 - RNA, 21 nt, Mycobacterium avium subsp. paratuberculosis
cagacgaucacgacgcgaccg

SEQ ID NO: 2973298 - RNA, 16 nt, Mycobacterium avium subsp. paratuberculosis
cagacgaugggccgcc

SEQ ID NO: 2973299 - RNA, 18 nt, Mycobacterium avium subsp. paratuberculosis
cagacgaugggccgcccg

SEQ ID NO: 2973300 - RNA, 20 nt, Mycobacterium avium subsp. paratuberculosis
cagacgaugucgucgccggu

SEQ ID NO: 2973301 - RNA, 22 nt, Mycobacterium avium subsp. paratuberculosis
cagacgcaaaagccccgcgaca

SEQ ID NO: 2973302 - RNA, 15 nt, Mycobacterium avium subsp. paratuberculosis
cagacgcgcaccgcc

SEQ ID NO: 2973303 - RNA, 16 nt, Mycobacterium avium subsp. paratuberculosis
cagacgcgggcgccca

SEQ ID NO: 2973304 - RNA, 21 nt, Mycobacterium avium subsp. paratuberculosis
cagacgcgggcgcccagcaaa

SEQ ID NO: 2973305 - RNA, 17 nt, Mycobacterium avium subsp. paratuberculosis
cagacggacacccgcgc

SEQ ID NO: 2973306 - RNA, 18 nt, Mycobacterium avium subsp. paratuberculosis
cagacggacacccgcgcg

SEQ ID NO: 2973307 - RNA, 20 nt, Mycobacterium avium subsp. paratuberculosis
cagacggacacccgcgcggu

SEQ ID NO: 2973308 - RNA, 22 nt, Mycobacterium avium subsp. paratuberculosis
cagacggacacccgcgcggugc

SEQ ID NO: 2973309 - RNA, 18 nt, Mycobacterium avium subsp. paratuberculosis
cagacgguaugcccgccg

SEQ ID NO: 2973310 - RNA, 19 nt, Mycobacterium avium subsp. paratuberculosis
cagacgguaugcccgccgc

SEQ ID NO: 2973311 - RNA, 13 nt, Mycobacterium avium subsp. paratuberculosis
cagacgguggggc

SEQ ID NO: 2973312 - RNA, 17 nt, Mycobacterium avium subsp. paratuberculosis
cagacgguggggcuggc

SEQ ID NO: 2973313 - RNA, 13 nt, Mycobacterium avium subsp. paratuberculosis
cagacgguuccac

SEQ ID NO: 2973314 - RNA, 18 nt, Mycobacterium avium subsp. paratuberculosis
cagacgguuccaccgguc

SEQ ID NO: 2973315 - RNA, 21 nt, Mycobacterium avium subsp. paratuberculosis
cagacgguuccaccggucgga

SEQ ID NO: 2973316 - RNA, 18 nt, Mycobacterium avium subsp. paratuberculosis
cagacguagcaccagucg

SEQ ID NO: 2973317 - RNA, 20 nt, Mycobacterium avium subsp. paratuberculosis
cagacguagcaccagucggc

SEQ ID NO: 2973318 - RNA, 15 nt, Mycobacterium avium subsp. paratuberculosis
cagacguccagcgcc

SEQ ID NO: 2973319 - RNA, 18 nt, Mycobacterium avium subsp. paratuberculosis
cagacguccagcgccgcc

SEQ ID NO: 2973320 - RNA, 20 nt, Mycobacterium avium subsp. paratuberculosis
cagacguccagcgccgccau

SEQ ID NO: 2973321 - RNA, 13 nt, Mycobacterium avium subsp. paratuberculosis
cagacgucggcgu

SEQ ID NO: 2973322 - RNA, 21 nt, Mycobacterium avium subsp. paratuberculosis
cagacgugacgugccccucga

SEQ ID NO: 2973323 - RNA, 19 nt, Mycobacterium avium subsp. paratuberculosis
cagacguguggcacccggg

SEQ ID NO: 2973324 - RNA, 21 nt, Mycobacterium avium subsp. paratuberculosis
cagacguguggcacccgggug

SEQ ID NO: 2973325 - RNA, 22 nt, Mycobacterium avium subsp. paratuberculosis
cagacguuuccguccggcgaca

SEQ ID NO: 2973326 - RNA, 14 nt, Mycobacterium avium subsp. paratuberculosis
cagacucacggcgg

SEQ ID NO: 2973327 - RNA, 19 nt, Mycobacterium avium subsp. paratuberculosis
cagacucacggcggcagcg

SEQ ID NO: 2973328 - RNA, 20 nt, Mycobacterium avium subsp. paratuberculosis
cagacucacggcggcagcgc

SEQ ID NO: 2973329 - RNA, 15 nt, Mycobacterium avium subsp. paratuberculosis
cagacucagcccggc

SEQ ID NO: 2973330 - RNA, 17 nt, Mycobacterium avium subsp. paratuberculosis
cagacucagcccggccc

SEQ ID NO: 2973331 - RNA, 22 nt, Mycobacterium avium subsp. paratuberculosis
cagacucagcccggcccagccg

SEQ ID NO: 2973332 - RNA, 20 nt, Mycobacterium avium subsp. paratuberculosis
cagacugaugaagccgccga

SEQ ID NO: 2973333 - RNA, 19 nt, Mycobacterium avium subsp. paratuberculosis
cagacugaugcccucgccg

SEQ ID NO: 2973334 - RNA, 21 nt, Mycobacterium avium subsp. paratuberculosis
cagacugcgcaccgccagcac

SEQ ID NO: 2973335 - RNA, 15 nt, Mycobacterium avium subsp. paratuberculosis
cagagcccgaacacg

SEQ ID NO: 2973336 - RNA, 18 nt, Mycobacterium avium subsp. paratuberculosis
cagagcccgaacacgggc

SEQ ID NO: 2973337 - RNA, 20 nt, Mycobacterium avium subsp. paratuberculosis
cagagcgcgaaaaccagcac

SEQ ID NO: 2973338 - RNA, 23 nt, Mycobacterium avium subsp. paratuberculosis
cagagcgcgaaaaccagcaccgg

SEQ ID NO: 2973339 - RNA, 13 nt, Mycobacterium avium subsp. paratuberculosis
cagagcgggccga

SEQ ID NO: 2973340 - RNA, 15 nt, Mycobacterium avium subsp. paratuberculosis
cagagcgggccgacc

SEQ ID NO: 2973341 - RNA, 19 nt, Mycobacterium avium subsp. paratuberculosis
cagagcgggccgaccguca

SEQ ID NO: 2973342 - RNA, 21 nt, Mycobacterium avium subsp. paratuberculosis
cagagcggugacaucgccacc

SEQ ID NO: 2973343 - RNA, 22 nt, Mycobacterium avium subsp. paratuberculosis
cagagcggugacaucgccaccu

SEQ ID NO: 2973344 - RNA, 23 nt, Mycobacterium avium subsp. paratuberculosis
cagagcugcugaugcggacacca

SEQ ID NO: 2973345 - RNA, 14 nt, Mycobacterium avium subsp. paratuberculosis
cacgaccaugucgg

SEQ ID NO: 2973346 - RNA, 19 nt, Mycobacterium avium subsp. paratuberculosis
cacgaccaugucggcgacc

SEQ ID NO: 2973347 - RNA, 22 nt, Mycobacterium avium subsp. paratuberculosis
cacgaccaugucggcgacccgc

SEQ ID NO: 2973348 - RNA, 13 nt, Mycobacterium avium subsp. paratuberculosis
cacgaccccgccc

SEQ ID NO: 2973349 - RNA, 16 nt, Mycobacterium avium subsp. paratuberculosis
cacgaccccgcccacg

SEQ ID NO: 2973350 - RNA, 14 nt, Mycobacterium avium subsp. paratuberculosis
cacgaccccggcgg

SEQ ID NO: 2973351 - RNA, 16 nt, Mycobacterium avium subsp. paratuberculosis
cacgaccccggcggca

SEQ ID NO: 2973352 - RNA, 18 nt, Mycobacterium avium subsp. paratuberculosis
cacgaccccggcggcacc

SEQ ID NO: 2973353 - RNA, 14 nt, Mycobacterium avium subsp. paratuberculosis
cacgaccgccagca

SEQ ID NO: 2973354 - RNA, 20 nt, Mycobacterium avium subsp. paratuberculosis
cacgaccgccagcagcagcc

SEQ ID NO: 2973355 - RNA, 13 nt, Mycobacterium avium subsp. paratuberculosis
cacgaccggcagc

SEQ ID NO: 2973356 - RNA, 19 nt, Mycobacterium avium subsp. paratuberculosis
cacgaccggcagcaccggc

SEQ ID NO: 2973357 - RNA, 21 nt, Mycobacterium avium subsp. paratuberculosis
cacgaccgggucugccacgcc

SEQ ID NO: 2973358 - RNA, 16 nt, Mycobacterium avium subsp. paratuberculosis
cacgaccuccgugccg

SEQ ID NO: 2973359 - RNA, 16 nt, Mycobacterium avium subsp. paratuberculosis
cacgaccucggggucg

SEQ ID NO: 2973360 - RNA, 19 nt, Mycobacterium avium subsp. paratuberculosis
cacgaccucggggucggcc

SEQ ID NO: 2973361 - RNA, 20 nt, Mycobacterium avium subsp. paratuberculosis
cacgaccucggggucggccg

SEQ ID NO: 2973362 - RNA, 15 nt, Mycobacterium avium subsp. paratuberculosis
cacgaccuggcgggc

SEQ ID NO: 2973363 - RNA, 14 nt, Mycobacterium avium subsp. paratuberculosis
cacgacgaacacca

SEQ ID NO: 2973364 - RNA, 15 nt, Mycobacterium avium subsp. paratuberculosis
cacgacgaacaccac

SEQ ID NO: 2973365 - RNA, 17 nt, Mycobacterium avium subsp. paratuberculosis
cacgacgaacaccaccg

SEQ ID NO: 2973366 - RNA, 19 nt, Mycobacterium avium subsp. paratuberculosis
cacgacgaacaccaccggc

SEQ ID NO: 2973367 - RNA, 20 nt, Mycobacterium avium subsp. paratuberculosis
cacgacgaacaccaccggca

SEQ ID NO: 2973368 - RNA, 22 nt, Mycobacterium avium subsp. paratuberculosis
cacgacgacugggugcgcgggc

SEQ ID NO: 2973369 - RNA, 23 nt, Mycobacterium avium subsp. paratuberculosis
cacgacgacugggugcgcgggcg

SEQ ID NO: 2973370 - RNA, 14 nt, Mycobacterium avium subsp. paratuberculosis
cacgacgccgccga

SEQ ID NO: 2973371 - RNA, 15 nt, Mycobacterium avium subsp. paratuberculosis
cacgacgccgccgag

SEQ ID NO: 2973372 - RNA, 18 nt, Mycobacterium avium subsp. paratuberculosis
cacgacgccgccgagggg

SEQ ID NO: 2973373 - RNA, 18 nt, Mycobacterium avium subsp. paratuberculosis
cacgacgccgcugggcgu

SEQ ID NO: 2973374 - RNA, 14 nt, Mycobacterium avium subsp. paratuberculosis
cacgacgcgaccga

SEQ ID NO: 2973375 - RNA, 18 nt, Mycobacterium avium subsp. paratuberculosis
cacgacgcgaccgagguc

SEQ ID NO: 2973376 - RNA, 12 nt, Mycobacterium avium subsp. paratuberculosis
cacgacgcggcg

SEQ ID NO: 2973377 - RNA, 14 nt, Mycobacterium avium subsp. paratuberculosis
cacgacgcggcgcg

SEQ ID NO: 2973378 - RNA, 15 nt, Mycobacterium avium subsp. paratuberculosis
cacgacgcggcgcgc

SEQ ID NO: 2973379 - RNA, 17 nt, Mycobacterium avium subsp. paratuberculosis
cacgacgcggucugcgg

SEQ ID NO: 2973380 - RNA, 21 nt, Mycobacterium avium subsp. paratuberculosis
cacgacggcgcuggccgcggc

SEQ ID NO: 2973381 - RNA, 20 nt, Mycobacterium avium subsp. paratuberculosis
cacgacggucacggccgcca

SEQ ID NO: 2973382 - RNA, 16 nt, Mycobacterium avium subsp. paratuberculosis
cacgacguacccccgc

SEQ ID NO: 2973383 - RNA, 18 nt, Mycobacterium avium subsp. paratuberculosis
cacgacguccucgacgau

SEQ ID NO: 2973384 - RNA, 14 nt, Mycobacterium avium subsp. paratuberculosis
cacgacgucgagcc

SEQ ID NO: 2973385 - RNA, 23 nt, Mycobacterium avium subsp. paratuberculosis
cacgacgucgagccagcgggccg

SEQ ID NO: 2973386 - RNA, 17 nt, Mycobacterium avium subsp. paratuberculosis
cacgacgucugggccgc

SEQ ID NO: 2973387 - RNA, 18 nt, Mycobacterium avium subsp. paratuberculosis
cacgacgucugggccgcc

SEQ ID NO: 2973388 - RNA, 18 nt, Mycobacterium avium subsp. paratuberculosis
cacgacuccuggccgaac

SEQ ID NO: 2973389 - RNA, 18 nt, Mycobacterium avium subsp. paratuberculosis
cacgacugcgcggccggc

SEQ ID NO: 2973390 - RNA, 19 nt, Mycobacterium avium subsp. paratuberculosis
cacgacuucacaggccgcc

SEQ ID NO: 2973391 - RNA, 20 nt, Mycobacterium avium subsp. paratuberculosis
cacgacuucacaggccgccu

SEQ ID NO: 2973392 - RNA, 18 nt, Mycobacterium avium subsp. paratuberculosis
cacgagcacccagaaaca

SEQ ID NO: 2973393 - RNA, 14 nt, Mycobacterium avium subsp. paratuberculosis
cacgagcagacccg

SEQ ID NO: 2973394 - RNA, 18 nt, Mycobacterium avium subsp. paratuberculosis
cacgagcagacccgccgc

SEQ ID NO: 2973395 - RNA, 19 nt, Mycobacterium avium subsp. paratuberculosis
cacgagcagacccgccgcg

SEQ ID NO: 2973396 - RNA, 16 nt, Mycobacterium avium subsp. paratuberculosis
cacgagcagccgaucu

SEQ ID NO: 2973397 - RNA, 14 nt, Mycobacterium avium subsp. paratuberculosis
cacgagcgaacacg

SEQ ID NO: 2973398 - RNA, 21 nt, Mycobacterium avium subsp. paratuberculosis
cacgagcgaacacgugcagcu

SEQ ID NO: 2973399 - RNA, 15 nt, Mycobacterium avium subsp. paratuberculosis
cacgagcuccagcua

SEQ ID NO: 2973400 - RNA, 17 nt, Mycobacterium avium subsp. paratuberculosis
cacgaggccgggcuggc

SEQ ID NO: 2973401 - RNA, 18 nt, Mycobacterium avium subsp. paratuberculosis
cacgaggccgggcuggcg

SEQ ID NO: 2973402 - RNA, 20 nt, Mycobacterium avium subsp. paratuberculosis
cacgaggcugugggccagca

SEQ ID NO: 2973403 - RNA, 22 nt, Mycobacterium avium subsp. paratuberculosis
cacgaguaaccggugcgcucca

SEQ ID NO: 2973404 - RNA, 14 nt, Mycobacterium avium subsp. paratuberculosis
cacgaucaccacca

SEQ ID NO: 2973405 - RNA, 15 nt, Mycobacterium avium subsp. paratuberculosis
cacgaucaccaccac

SEQ ID NO: 2973406 - RNA, 22 nt, Mycobacterium avium subsp. paratuberculosis
cacgaucaccaccaccgccguc

SEQ ID NO: 2973407 - RNA, 13 nt, Mycobacterium avium subsp. paratuberculosis
cacgaucaccaga

SEQ ID NO: 2973408 - RNA, 20 nt, Mycobacterium avium subsp. paratuberculosis
cacgaucacgucggugacgc

SEQ ID NO: 2973409 - RNA, 16 nt, Mycobacterium avium subsp. paratuberculosis
cacgaucagcgcgucg

SEQ ID NO: 2973410 - RNA, 20 nt, Mycobacterium avium subsp. paratuberculosis
cacgaucagggugucgaaca

SEQ ID NO: 2973411 - RNA, 17 nt, Mycobacterium avium subsp. paratuberculosis
cacgauccaaccgaguc

SEQ ID NO: 2973412 - RNA, 13 nt, Mycobacterium avium subsp. paratuberculosis
cacgaucccgccg

SEQ ID NO: 2973413 - RNA, 15 nt, Mycobacterium avium subsp. paratuberculosis
cacgaucccgccgcc

SEQ ID NO: 2973414 - RNA, 13 nt, Mycobacterium avium subsp. paratuberculosis
cacgauccgcgcg

SEQ ID NO: 2973415 - RNA, 18 nt, Mycobacterium avium subsp. paratuberculosis
cacgauccgcgcggccac

SEQ ID NO: 2973416 - RNA, 12 nt, Mycobacterium avium subsp. paratuberculosis
cacgaucgagcc

SEQ ID NO: 2973417 - RNA, 20 nt, Mycobacterium avium subsp. paratuberculosis
cacgaucgcgaucgccgauc

SEQ ID NO: 2973418 - RNA, 21 nt, Mycobacterium avium subsp. paratuberculosis
cacgaucgcgaucgccgaucc

SEQ ID NO: 2973419 - RNA, 17 nt, Mycobacterium avium subsp. paratuberculosis
cacgaucgcggugacgc

SEQ ID NO: 2973420 - RNA, 22 nt, Mycobacterium avium subsp. paratuberculosis
cacgaucgcggugacgcgccgg

SEQ ID NO: 2973421 - RNA, 23 nt, Mycobacterium avium subsp. paratuberculosis
cacgaucgcgucggaauacagca

SEQ ID NO: 2973422 - RNA, 16 nt, Mycobacterium avium subsp. paratuberculosis
cacgaucggcagcgcc

SEQ ID NO: 2973423 - RNA, 16 nt, Mycobacterium avium subsp. paratuberculosis
cacgaucgggcgcaga

SEQ ID NO: 2973424 - RNA, 20 nt, Mycobacterium avium subsp. paratuberculosis
cacgaucggguagacgucgg

SEQ ID NO: 2973425 - RNA, 22 nt, Mycobacterium avium subsp. paratuberculosis
cacgaucggguagacgucgggc

SEQ ID NO: 2973426 - RNA, 21 nt, Mycobacterium avium subsp. paratuberculosis
cacgaucgucaccgugccguc

SEQ ID NO: 2973427 - RNA, 23 nt, Mycobacterium avium subsp. paratuberculosis
cacgaucgucaccgugccgucgc

SEQ ID NO: 2973428 - RNA, 17 nt, Mycobacterium avium subsp. paratuberculosis
cacgaucgucgccgcca

SEQ ID NO: 2973429 - RNA, 22 nt, Mycobacterium avium subsp. paratuberculosis
cacgaucgucgccgccaacgcg

SEQ ID NO: 2973430 - RNA, 17 nt, Mycobacterium avium subsp. paratuberculosis
cacgaucgucuggccgu

SEQ ID NO: 2973431 - RNA, 19 nt, Mycobacterium avium subsp. paratuberculosis
cacgaucucgaccaggccg

SEQ ID NO: 2973432 - RNA, 19 nt, Mycobacterium avium subsp. paratuberculosis
cacgaucucggucgccagc

SEQ ID NO: 2973433 - RNA, 20 nt, Mycobacterium avium subsp. paratuberculosis
cacgaucucggucgccagca

SEQ ID NO: 2973434 - RNA, 21 nt, Mycobacterium avium subsp. paratuberculosis
cacgaucucggucgccagcac

SEQ ID NO: 2973435 - RNA, 16 nt, Mycobacterium avium subsp. paratuberculosis
cacgaucugcaggccg

SEQ ID NO: 2973436 - RNA, 23 nt, Mycobacterium avium subsp. paratuberculosis
cacgaugaacuccucgaucgucc

SEQ ID NO: 2973437 - RNA, 15 nt, Mycobacterium avium subsp. paratuberculosis
cacgaugaagccgug

SEQ ID NO: 2973438 - RNA, 17 nt, Mycobacterium avium subsp. paratuberculosis
cacgaugaagccgugcc

SEQ ID NO: 2973439 - RNA, 15 nt, Mycobacterium avium subsp. paratuberculosis
cacgaugacgaccgg

SEQ ID NO: 2973440 - RNA, 13 nt, Mycobacterium avium subsp. paratuberculosis
cacgaugacggug

SEQ ID NO: 2973441 - RNA, 14 nt, Mycobacterium avium subsp. paratuberculosis
cacgaugacggugg

SEQ ID NO: 2973442 - RNA, 14 nt, Mycobacterium avium subsp. paratuberculosis
cacgaugaucccga

SEQ ID NO: 2973443 - RNA, 15 nt, Mycobacterium avium subsp. paratuberculosis
cacgaugaucgucgg

SEQ ID NO: 2973444 - RNA, 23 nt, Mycobacterium avium subsp. paratuberculosis
cacgaugaucgucggcagcgacg

SEQ ID NO: 2973445 - RNA, 20 nt, Mycobacterium avium subsp. paratuberculosis
cacgaugcccuuggccagca

SEQ ID NO: 2973446 - RNA, 23 nt, Mycobacterium avium subsp. paratuberculosis
cacgaugcccuuggccagcagug

SEQ ID NO: 2973447 - RNA, 24 nt, Mycobacterium avium subsp. paratuberculosis
cacgaugcccuuggccagcagugc

SEQ ID NO: 2973448 - RNA, 13 nt, Mycobacterium avium subsp. paratuberculosis
cacgaugcgcugu

SEQ ID NO: 2973449 - RNA, 13 nt, Mycobacterium avium subsp. paratuberculosis
cacgaugcggugc

SEQ ID NO: 2973450 - RNA, 22 nt, Mycobacterium avium subsp. paratuberculosis
cacgaugcguugguguagccga

SEQ ID NO: 2973451 - RNA, 20 nt, Mycobacterium avium subsp. paratuberculosis
cacgaugcugauacccgcgc

SEQ ID NO: 2973452 - RNA, 15 nt, Mycobacterium avium subsp. paratuberculosis
cacgauggcgcggcg

SEQ ID NO: 2973453 - RNA, 17 nt, Mycobacterium avium subsp. paratuberculosis
cacgauggcgcggcgca

SEQ ID NO: 2973454 - RNA, 19 nt, Mycobacterium avium subsp. paratuberculosis
cacgauggcgcggcgcacc

SEQ ID NO: 2973455 - RNA, 20 nt, Mycobacterium avium subsp. paratuberculosis
cacgauggcgcggcgcaccg

SEQ ID NO: 2973456 - RNA, 20 nt, Mycobacterium avium subsp. paratuberculosis
cacgauggcggcccagaucg

SEQ ID NO: 2973457 - RNA, 14 nt, Mycobacterium avium subsp. paratuberculosis
cacgaugggucagg

SEQ ID NO: 2973458 - RNA, 18 nt, Mycobacterium avium subsp. paratuberculosis
cacgauuccucggaccgg

SEQ ID NO: 2973459 - RNA, 14 nt, Mycobacterium avium subsp. paratuberculosis
cacgcacaccaccg

SEQ ID NO: 2973460 - RNA, 15 nt, Mycobacterium avium subsp. paratuberculosis
cacgcacaccaccga

SEQ ID NO: 2973461 - RNA, 18 nt, Mycobacterium avium subsp. paratuberculosis
cacgcaccguccuuggga

SEQ ID NO: 2973462 - RNA, 16 nt, Mycobacterium avium subsp. paratuberculosis
cacgcacggcgaacgg

SEQ ID NO: 2973463 - RNA, 20 nt, Mycobacterium avium subsp. paratuberculosis
cacgcacggcgaacggccgc

SEQ ID NO: 2973464 - RNA, 21 nt, Mycobacterium avium subsp. paratuberculosis
cacgcacggcgaacggccgcg

SEQ ID NO: 2973465 - RNA, 18 nt, Mycobacterium avium subsp. paratuberculosis
cacgcagcggugcagccc

SEQ ID NO: 2973466 - RNA, 14 nt, Mycobacterium avium subsp. paratuberculosis
cacgcaggcgucca

SEQ ID NO: 2973467 - RNA, 22 nt, Mycobacterium avium subsp. paratuberculosis
cacgcaggcguccagggccacc

SEQ ID NO: 2973468 - RNA, 17 nt, Mycobacterium avium subsp. paratuberculosis
cacgcagguccaggauc

SEQ ID NO: 2973469 - RNA, 14 nt, Mycobacterium avium subsp. paratuberculosis
cacgcagucgucga

SEQ ID NO: 2973470 - RNA, 15 nt, Mycobacterium avium subsp. paratuberculosis
cacgcagugccgcac

SEQ ID NO: 2973471 - RNA, 23 nt, Mycobacterium avium subsp. paratuberculosis
cacgcagugccgcaccagcaccc

SEQ ID NO: 2973472 - RNA, 16 nt, Mycobacterium avium subsp. paratuberculosis
cacgcaguguccgauc

SEQ ID NO: 2973473 - RNA, 18 nt, Mycobacterium avium subsp. paratuberculosis
cacgccaacugguccugc

SEQ ID NO: 2973474 - RNA, 21 nt, Mycobacterium avium subsp. paratuberculosis
cacgccaacugguccugcggc

SEQ ID NO: 2973475 - RNA, 14 nt, Mycobacterium avium subsp. paratuberculosis
cacgccacucgucg

SEQ ID NO: 2973476 - RNA, 22 nt, Mycobacterium avium subsp. paratuberculosis
cacgccacucgucgacguucga

SEQ ID NO: 2973477 - RNA, 18 nt, Mycobacterium avium subsp. paratuberculosis
cacgccagcgugacgccc

SEQ ID NO: 2973478 - RNA, 21 nt, Mycobacterium avium subsp. paratuberculosis
cacgccagcgugacgccgggc

SEQ ID NO: 2973479 - RNA, 23 nt, Mycobacterium avium subsp. paratuberculosis
cacgccagcgugacgccgggccg

SEQ ID NO: 2973480 - RNA, 21 nt, Mycobacterium avium subsp. paratuberculosis
cacgccagcgugacgcucggg

SEQ ID NO: 2973481 - RNA, 23 nt, Mycobacterium avium subsp. paratuberculosis
cacgccaguguggccgcggcggc

SEQ ID NO: 2973482 - RNA, 20 nt, Mycobacterium avium subsp. paratuberculosis
cacgccaugugccggcgcuc

SEQ ID NO: 2973483 - RNA, 15 nt, Mycobacterium avium subsp. paratuberculosis
cacgcccacgccgag

SEQ ID NO: 2973484 - RNA, 16 nt, Mycobacterium avium subsp. paratuberculosis
cacgcccacgccgagg

SEQ ID NO: 2973485 - RNA, 15 nt, Mycobacterium avium subsp. paratuberculosis
cacgcccagaccgug

SEQ ID NO: 2973486 - RNA, 19 nt, Mycobacterium avium subsp. paratuberculosis
cacgcccagaucgacgccg

SEQ ID NO: 2973487 - RNA, 20 nt, Mycobacterium avium subsp. paratuberculosis
cacgcccagaucgacgccga

SEQ ID NO: 2973488 - RNA, 22 nt, Mycobacterium avium subsp. paratuberculosis
cacgcccagaucgacgccgacc

SEQ ID NO: 2973489 - RNA, 17 nt, Mycobacterium avium subsp. paratuberculosis
cacgcccagaucgccga

SEQ ID NO: 2973490 - RNA, 19 nt, Mycobacterium avium subsp. paratuberculosis
cacgcccagaucgccgacc

SEQ ID NO: 2973491 - RNA, 18 nt, Mycobacterium avium subsp. paratuberculosis
cacgcccagaugcaggcu

SEQ ID NO: 2973492 - RNA, 18 nt, Mycobacterium avium subsp. paratuberculosis
cacgcccagcccgcgggc

SEQ ID NO: 2973493 - RNA, 14 nt, Mycobacterium avium subsp. paratuberculosis
cacgcccagcgccc

SEQ ID NO: 2973494 - RNA, 16 nt, Mycobacterium avium subsp. paratuberculosis
cacgcccagcgccgcg

SEQ ID NO: 2973495 - RNA, 16 nt, Mycobacterium avium subsp. paratuberculosis
cacgcccagggcgcca

SEQ ID NO: 2973496 - RNA, 15 nt, Mycobacterium avium subsp. paratuberculosis
cacgccccagguucc

SEQ ID NO: 2973497 - RNA, 16 nt, Mycobacterium avium subsp. paratuberculosis
cacgccccagguuccg

SEQ ID NO: 2973498 - RNA, 23 nt, Mycobacterium avium subsp. paratuberculosis
cacgccccagguuccggugucga

SEQ ID NO: 2973499 - RNA, 19 nt, Mycobacterium avium subsp. paratuberculosis
cacgccccauugccgcgcc

SEQ ID NO: 2973500 - RNA, 22 nt, Mycobacterium avium subsp. paratuberculosis
cacgccccauugccgcgccggg

SEQ ID NO: 2973501 - RNA, 23 nt, Mycobacterium avium subsp. paratuberculosis
cacgccccauugccgcgccgggg

SEQ ID NO: 2973502 - RNA, 13 nt, Mycobacterium avium subsp. paratuberculosis
cacgccccgaugg

SEQ ID NO: 2973503 - RNA, 14 nt, Mycobacterium avium subsp. paratuberculosis
cacgccccggcgcc

SEQ ID NO: 2973504 - RNA, 13 nt, Mycobacterium avium subsp. paratuberculosis
cacgccccggcgg

SEQ ID NO: 2973505 - RNA, 15 nt, Mycobacterium avium subsp. paratuberculosis
cacgcccgcagcgca

SEQ ID NO: 2973506 - RNA, 20 nt, Mycobacterium avium subsp. paratuberculosis
cacgcccgcgaucggcgcca

SEQ ID NO: 2973507 - RNA, 23 nt, Mycobacterium avium subsp. paratuberculosis
cacgcccgcgaucggcgccacga

SEQ ID NO: 2973508 - RNA, 13 nt, Mycobacterium avium subsp. paratuberculosis
cacgcccgggcau

SEQ ID NO: 2973509 - RNA, 19 nt, Mycobacterium avium subsp. paratuberculosis
cacgcccggggugaugccg

SEQ ID NO: 2973510 - RNA, 19 nt, Mycobacterium avium subsp. paratuberculosis
cacgcccguucgagcgccg

SEQ ID NO: 2973511 - RNA, 17 nt, Mycobacterium avium subsp. paratuberculosis
cacgcccuagcgggcca

SEQ ID NO: 2973512 - RNA, 20 nt, Mycobacterium avium subsp. paratuberculosis
cacgcccuagcgggccagga

SEQ ID NO: 2973513 - RNA, 16 nt, Mycobacterium avium subsp. paratuberculosis
cacgcccuggccgccg

SEQ ID NO: 2973514 - RNA, 17 nt, Mycobacterium avium subsp. paratuberculosis
cacgcccuggccgccgg

SEQ ID NO: 2973515 - RNA, 19 nt, Mycobacterium avium subsp. paratuberculosis
cacgcccuggccgccggcc

SEQ ID NO: 2973516 - RNA, 13 nt, Mycobacterium avium subsp. paratuberculosis
cacgccgacaccg

SEQ ID NO: 2973517 - RNA, 16 nt, Mycobacterium avium subsp. paratuberculosis
cacgccgacaccgucg

SEQ ID NO: 2973518 - RNA, 13 nt, Mycobacterium avium subsp. paratuberculosis
cacgccgaccacc

SEQ ID NO: 2973519 - RNA, 14 nt, Mycobacterium avium subsp. paratuberculosis
cacgccgaccaccc

SEQ ID NO: 2973520 - RNA, 15 nt, Mycobacterium avium subsp. paratuberculosis
cacgccgaccagguc

SEQ ID NO: 2973521 - RNA, 17 nt, Mycobacterium avium subsp. paratuberculosis
cacgccgaccagguccg

SEQ ID NO: 2973522 - RNA, 14 nt, Mycobacterium avium subsp. paratuberculosis
cacgccgacgaucc

SEQ ID NO: 2973523 - RNA, 20 nt, Mycobacterium avium subsp. paratuberculosis
cacgccgacgauccgcgccg

SEQ ID NO: 2973524 - RNA, 22 nt, Mycobacterium avium subsp. paratuberculosis
cacgccgacgauccgcgccgcg

SEQ ID NO: 2973525 - RNA, 17 nt, Mycobacterium avium subsp. paratuberculosis
cacgccgacuagcgcgg

SEQ ID NO: 2973526 - RNA, 14 nt, Mycobacterium avium subsp. paratuberculosis
cacgccgagcaccu

SEQ ID NO: 2973527 - RNA, 14 nt, Mycobacterium avium subsp. paratuberculosis
cacgccgagcagca

SEQ ID NO: 2973528 - RNA, 17 nt, Mycobacterium avium subsp. paratuberculosis
cacgccgagcagcaccg

SEQ ID NO: 2973529 - RNA, 19 nt, Mycobacterium avium subsp. paratuberculosis
cacgccgagcagcaccggc

SEQ ID NO: 2973530 - RNA, 17 nt, Mycobacterium avium subsp. paratuberculosis
cacgccgaggcgugccg

SEQ ID NO: 2973531 - RNA, 18 nt, Mycobacterium avium subsp. paratuberculosis
cacgccgagggcggcggc

SEQ ID NO: 2973532 - RNA, 19 nt, Mycobacterium avium subsp. paratuberculosis
cacgccgagggcggcggcu

SEQ ID NO: 2973533 - RNA, 14 nt, Mycobacterium avium subsp. paratuberculosis
cacgccgagggugc

SEQ ID NO: 2973534 - RNA, 17 nt, Mycobacterium avium subsp. paratuberculosis
cacgccgagggugccgg

SEQ ID NO: 2973535 - RNA, 22 nt, Mycobacterium avium subsp. paratuberculosis
cacgccgagggugccggccacc

SEQ ID NO: 2973536 - RNA, 22 nt, Mycobacterium avium subsp. paratuberculosis
cacgccgauggccugguggccc

SEQ ID NO: 2973537 - RNA, 21 nt, Mycobacterium avium subsp. paratuberculosis
cacgccgauguuuugggugcu

SEQ ID NO: 2973538 - RNA, 14 nt, Mycobacterium avium subsp. paratuberculosis
cacgccgcccaggc

SEQ ID NO: 2973539 - RNA, 16 nt, Mycobacterium avium subsp. paratuberculosis
cacgccgcccaggccc

SEQ ID NO: 2973540 - RNA, 19 nt, Mycobacterium avium subsp. paratuberculosis
cacgccgcccaggccccgg

SEQ ID NO: 2973541 - RNA, 21 nt, Mycobacterium avium subsp. paratuberculosis
cacgccgcccaggccccggcc

SEQ ID NO: 2973542 - RNA, 15 nt, Mycobacterium avium subsp. paratuberculosis
cacgccgcccccgcc

SEQ ID NO: 2973543 - RNA, 22 nt, Mycobacterium avium subsp. paratuberculosis
cacgccgcccccgccgcgagca

SEQ ID NO: 2973544 - RNA, 13 nt, Mycobacterium avium subsp. paratuberculosis
cacgccgccgcga

SEQ ID NO: 2973545 - RNA, 15 nt, Mycobacterium avium subsp. paratuberculosis
cacgccgccgggaac

SEQ ID NO: 2973546 - RNA, 13 nt, Mycobacterium avium subsp. paratuberculosis
cacgccgccgggg

SEQ ID NO: 2973547 - RNA, 15 nt, Mycobacterium avium subsp. paratuberculosis
cacgccgccggggcg

SEQ ID NO: 2973548 - RNA, 13 nt, Mycobacterium avium subsp. paratuberculosis
cacgccgcgcauc

SEQ ID NO: 2973549 - RNA, 14 nt, Mycobacterium avium subsp. paratuberculosis
cacgccgcgcauca

SEQ ID NO: 2973550 - RNA, 15 nt, Mycobacterium avium subsp. paratuberculosis
cacgccgcgggaggc

SEQ ID NO: 2973551 - RNA, 24 nt, Mycobacterium avium subsp. paratuberculosis
cacgccgcggucgcugacccgccg

SEQ ID NO: 2973552 - RNA, 17 nt, Mycobacterium avium subsp. paratuberculosis
cacgccgcucgucgggc

SEQ ID NO: 2973553 - RNA, 18 nt, Mycobacterium avium subsp. paratuberculosis
cacgccgcucgucgggca

SEQ ID NO: 2973554 - RNA, 15 nt, Mycobacterium avium subsp. paratuberculosis
cacgccggcacaccg

SEQ ID NO: 2973555 - RNA, 14 nt, Mycobacterium avium subsp. paratuberculosis
cacgccggccggcg

SEQ ID NO: 2973556 - RNA, 15 nt, Mycobacterium avium subsp. paratuberculosis
cacgccggccggcgu

SEQ ID NO: 2973557 - RNA, 16 nt, Mycobacterium avium subsp. paratuberculosis
cacgccggccggcgug

SEQ ID NO: 2973558 - RNA, 12 nt, Mycobacterium avium subsp. paratuberculosis
cacgccggccgu

SEQ ID NO: 2973559 - RNA, 13 nt, Mycobacterium avium subsp. paratuberculosis
cacgccggcgauc

SEQ ID NO: 2973560 - RNA, 13 nt, Mycobacterium avium subsp. paratuberculosis
cacgccggcggcc

SEQ ID NO: 2973561 - RNA, 14 nt, Mycobacterium avium subsp. paratuberculosis
cacgccggcggcca

SEQ ID NO: 2973562 - RNA, 12 nt, Mycobacterium avium subsp. paratuberculosis
cacgccggcggg

SEQ ID NO: 2973563 - RNA, 13 nt, Mycobacterium avium subsp. paratuberculosis
cacgccggcgggg

SEQ ID NO: 2973564 - RNA, 19 nt, Mycobacterium avium subsp. paratuberculosis
cacgccggcggggguucga

SEQ ID NO: 2973565 - RNA, 12 nt, Mycobacterium avium subsp. paratuberculosis
cacgccgggcau

SEQ ID NO: 2973566 - RNA, 20 nt, Mycobacterium avium subsp. paratuberculosis
cacgccgggcauccgcccgu

SEQ ID NO: 2973567 - RNA, 20 nt, Mycobacterium avium subsp. paratuberculosis
cacgccgggcaugccguuca

SEQ ID NO: 2973568 - RNA, 13 nt, Mycobacterium avium subsp. paratuberculosis
cacgccggggccc

SEQ ID NO: 2973569 - RNA, 22 nt, Mycobacterium avium subsp. paratuberculosis
cacgccggguugggcggcggcc

SEQ ID NO: 2973570 - RNA, 22 nt, Mycobacterium avium subsp. paratuberculosis
cacgccggguuuguccggccag

SEQ ID NO: 2973571 - RNA, 18 nt, Mycobacterium avium subsp. paratuberculosis
cacgccgguagccgcucg

SEQ ID NO: 2973572 - RNA, 16 nt, Mycobacterium avium subsp. paratuberculosis
cacgccggugagcacg

SEQ ID NO: 2973573 - RNA, 20 nt, Mycobacterium avium subsp. paratuberculosis
cacgccggugagcacgaccg

SEQ ID NO: 2973574 - RNA, 23 nt, Mycobacterium avium subsp. paratuberculosis
cacgccggugagcacgaccgcca

SEQ ID NO: 2973575 - RNA, 19 nt, Mycobacterium avium subsp. paratuberculosis
cacgccgguggacaggugc

SEQ ID NO: 2973576 - RNA, 19 nt, Mycobacterium avium subsp. paratuberculosis
cacgccguauucgccgacg

SEQ ID NO: 2973577 - RNA, 22 nt, Mycobacterium avium subsp. paratuberculosis
cacgccguauucgccgacgguc

SEQ ID NO: 2973578 - RNA, 13 nt, Mycobacterium avium subsp. paratuberculosis
cacgccgucgacg

SEQ ID NO: 2973579 - RNA, 14 nt, Mycobacterium avium subsp. paratuberculosis
cacgccgucgucgu

SEQ ID NO: 2973580 - RNA, 23 nt, Mycobacterium avium subsp. paratuberculosis
cacgccgucgucguuguuggcgg

SEQ ID NO: 2973581 - RNA, 17 nt, Mycobacterium avium subsp. paratuberculosis
cacgccgucgugcucgg

SEQ ID NO: 2973582 - RNA, 20 nt, Mycobacterium avium subsp. paratuberculosis
cacgccgucgugcucggcga

SEQ ID NO: 2973583 - RNA, 22 nt, Mycobacterium avium subsp. paratuberculosis
cacgccgucgugcucggcgagc

SEQ ID NO: 2973584 - RNA, 23 nt, Mycobacterium avium subsp. paratuberculosis
cacgccgucgugcucggcgagca

SEQ ID NO: 2973585 - RNA, 17 nt, Mycobacterium avium subsp. paratuberculosis
cacgccgugcccggcgc

SEQ ID NO: 2973586 - RNA, 17 nt, Mycobacterium avium subsp. paratuberculosis
cacgccguggcccgccc

SEQ ID NO: 2973587 - RNA, 21 nt, Mycobacterium avium subsp. paratuberculosis
cacgccguggcccgcccagcg

SEQ ID NO: 2973588 - RNA, 22 nt, Mycobacterium avium subsp. paratuberculosis
cacgccguggcccgcccagcgc

SEQ ID NO: 2973589 - RNA, 16 nt, Mycobacterium avium subsp. paratuberculosis
cacgccguggcggcgg

SEQ ID NO: 2973590 - RNA, 18 nt, Mycobacterium avium subsp. paratuberculosis
cacgccguggcggcgggc

SEQ ID NO: 2973591 - RNA, 20 nt, Mycobacterium avium subsp. paratuberculosis
cacgccguggcggcgggcca

SEQ ID NO: 2973592 - RNA, 18 nt, Mycobacterium avium subsp. paratuberculosis
cacgccguugaccccgac

SEQ ID NO: 2973593 - RNA, 23 nt, Mycobacterium avium subsp. paratuberculosis
cacgccguugaccccgacggcgc

SEQ ID NO: 2973594 - RNA, 13 nt, Mycobacterium avium subsp. paratuberculosis
cacgccguugggc

SEQ ID NO: 2973595 - RNA, 14 nt, Mycobacterium avium subsp. paratuberculosis
cacgccucgucgag

SEQ ID NO: 2973596 - RNA, 21 nt, Mycobacterium avium subsp. paratuberculosis
cacgccuggcggaaggccgcg

SEQ ID NO: 2973597 - RNA, 16 nt, Mycobacterium avium subsp. paratuberculosis
cacgccuuccacgacc

SEQ ID NO: 2973598 - RNA, 12 nt, Mycobacterium avium subsp. paratuberculosis
cacgcgaacacc

SEQ ID NO: 2973599 - RNA, 14 nt, Mycobacterium avium subsp. paratuberculosis
cacgcgagacgagc

SEQ ID NO: 2973600 - RNA, 15 nt, Mycobacterium avium subsp. paratuberculosis
cacgcgaucaggucc

SEQ ID NO: 2973601 - RNA, 20 nt, Mycobacterium avium subsp. paratuberculosis
cacgcgaugaucagcucgcg

SEQ ID NO: 2973602 - RNA, 24 nt, Mycobacterium avium subsp. paratuberculosis
cacgcgaugaucagcucgcgcauc

SEQ ID NO: 2973603 - RNA, 18 nt, Mycobacterium avium subsp. paratuberculosis
cacgcgcagggcgaacgg

SEQ ID NO: 2973604 - RNA, 11 nt, Mycobacterium avium subsp. paratuberculosis
cacgcgccggc

SEQ ID NO: 2973605 - RNA, 13 nt, Mycobacterium avium subsp. paratuberculosis
cacgcgccggcgc

SEQ ID NO: 2973606 - RNA, 17 nt, Mycobacterium avium subsp. paratuberculosis
cacgcgccggcgcgggc

SEQ ID NO: 2973607 - RNA, 14 nt, Mycobacterium avium subsp. paratuberculosis
cacgcgcgcccggc

SEQ ID NO: 2973608 - RNA, 13 nt, Mycobacterium avium subsp. paratuberculosis
cacgcgcucagcg

SEQ ID NO: 2973609 - RNA, 16 nt, Mycobacterium avium subsp. paratuberculosis
cacgcgcucagcgcgg

SEQ ID NO: 2973610 - RNA, 19 nt, Mycobacterium avium subsp. paratuberculosis
cacgcgcucagcgcggcca

SEQ ID NO: 2973611 - RNA, 13 nt, Mycobacterium avium subsp. paratuberculosis
cacgcggacacga

SEQ ID NO: 2973612 - RNA, 16 nt, Mycobacterium avium subsp. paratuberculosis
cacgcggacacgaacg

SEQ ID NO: 2973613 - RNA, 19 nt, Mycobacterium avium subsp. paratuberculosis
cacgcggacacgaacgacg

SEQ ID NO: 2973614 - RNA, 23 nt, Mycobacterium avium subsp. paratuberculosis
cacgcggacacgaacgacgcggc

SEQ ID NO: 2973615 - RNA, 14 nt, Mycobacterium avium subsp. paratuberculosis
cacgcggacagggc

SEQ ID NO: 2973616 - RNA, 19 nt, Mycobacterium avium subsp. paratuberculosis
cacgcggacagggcggcga

SEQ ID NO: 2973617 - RNA, 21 nt, Mycobacterium avium subsp. paratuberculosis
cacgcggacagggcggcgacc

SEQ ID NO: 2973618 - RNA, 22 nt, Mycobacterium avium subsp. paratuberculosis
cacgcggacagggcggcgaccu

SEQ ID NO: 2973619 - RNA, 22 nt, Mycobacterium avium subsp. paratuberculosis
cacgcggacccguacuccacca

SEQ ID NO: 2973620 - RNA, 22 nt, Mycobacterium avium subsp. paratuberculosis
cacgcggaccuuggugucggcg

SEQ ID NO: 2973621 - RNA, 18 nt, Mycobacterium avium subsp. paratuberculosis
cacgcggauagcccagcg

SEQ ID NO: 2973622 - RNA, 14 nt, Mycobacterium avium subsp. paratuberculosis
cacgcggccgcgcc

SEQ ID NO: 2973623 - RNA, 16 nt, Mycobacterium avium subsp. paratuberculosis
cacgcggccgcgccgg

SEQ ID NO: 2973624 - RNA, 12 nt, Mycobacterium avium subsp. paratuberculosis
cacgcggcgcgc

SEQ ID NO: 2973625 - RNA, 13 nt, Mycobacterium avium subsp. paratuberculosis
cacgcggcggcgg

SEQ ID NO: 2973626 - RNA, 16 nt, Mycobacterium avium subsp. paratuberculosis
cacgcggcggcggugc

SEQ ID NO: 2973627 - RNA, 16 nt, Mycobacterium avium subsp. paratuberculosis
cacgcggcuggcccgg

SEQ ID NO: 2973628 - RNA, 19 nt, Mycobacterium avium subsp. paratuberculosis
cacgcggcuggcccggcgc

SEQ ID NO: 2973629 - RNA, 20 nt, Mycobacterium avium subsp. paratuberculosis
cacgcggcuggcccggcgcg

SEQ ID NO: 2973630 - RNA, 23 nt, Mycobacterium avium subsp. paratuberculosis
cacgcgguccacuuccgcgcagg

SEQ ID NO: 2973631 - RNA, 23 nt, Mycobacterium avium subsp. paratuberculosis
cacgcggugauccagagcaucag

SEQ ID NO: 2973632 - RNA, 14 nt, Mycobacterium avium subsp. paratuberculosis
cacgcguagccgac

SEQ ID NO: 2973633 - RNA, 16 nt, Mycobacterium avium subsp. paratuberculosis
cacgcguagccgacca

SEQ ID NO: 2973634 - RNA, 20 nt, Mycobacterium avium subsp. paratuberculosis
cacgcguagccgaccaacgg

SEQ ID NO: 2973635 - RNA, 14 nt, Mycobacterium avium subsp. paratuberculosis
cacgcgucaccgga

SEQ ID NO: 2973636 - RNA, 22 nt, Mycobacterium avium subsp. paratuberculosis
cacgcguucggacaccucggcc

SEQ ID NO: 2973637 - RNA, 20 nt, Mycobacterium avium subsp. paratuberculosis
cacgcuagcgugacagucga

SEQ ID NO: 2973638 - RNA, 19 nt, Mycobacterium avium subsp. paratuberculosis
cacgcuagcgugacgcucg

SEQ ID NO: 2973639 - RNA, 14 nt, Mycobacterium avium subsp. paratuberculosis
cacgcucacgcucg

SEQ ID NO: 2973640 - RNA, 17 nt, Mycobacterium avium subsp. paratuberculosis
cacgcucaugcccgcca

SEQ ID NO: 2973641 - RNA, 22 nt, Mycobacterium avium subsp. paratuberculosis
cacgcucaugcccgccacggcc

SEQ ID NO: 2973642 - RNA, 15 nt, Mycobacterium avium subsp. paratuberculosis
cacgcucgcaggcga

SEQ ID NO: 2973643 - RNA, 15 nt, Mycobacterium avium subsp. paratuberculosis
cacgcucgccagacc

SEQ ID NO: 2973644 - RNA, 11 nt, Mycobacterium avium subsp. paratuberculosis
cacgcucggcg

SEQ ID NO: 2973645 - RNA, 12 nt, Mycobacterium avium subsp. paratuberculosis
cacgcucggcga

SEQ ID NO: 2973646 - RNA, 19 nt, Mycobacterium avium subsp. paratuberculosis
cacgcucggcgagcugcgg

SEQ ID NO: 2973647 - RNA, 17 nt, Mycobacterium avium subsp. paratuberculosis
cacgcucggcgagugcg

SEQ ID NO: 2973648 - RNA, 12 nt, Mycobacterium avium subsp. paratuberculosis
cacgcucggcgc

SEQ ID NO: 2973649 - RNA, 13 nt, Mycobacterium avium subsp. paratuberculosis
cacgcucggcgcc

SEQ ID NO: 2973650 - RNA, 14 nt, Mycobacterium avium subsp. paratuberculosis
cacgcucggcgcga

SEQ ID NO: 2973651 - RNA, 15 nt, Mycobacterium avium subsp. paratuberculosis
cacgcucggcgcgcg

SEQ ID NO: 2973652 - RNA, 15 nt, Mycobacterium avium subsp. paratuberculosis
cacgcucggcggcgc

SEQ ID NO: 2973653 - RNA, 14 nt, Mycobacterium avium subsp. paratuberculosis
cacgcucggcgggu

SEQ ID NO: 2973654 - RNA, 14 nt, Mycobacterium avium subsp. paratuberculosis
cacgcucgggccgg

SEQ ID NO: 2973655 - RNA, 17 nt, Mycobacterium avium subsp. paratuberculosis
cacgcucgggccggcgc

SEQ ID NO: 2973656 - RNA, 21 nt, Mycobacterium avium subsp. paratuberculosis
cacgcucgggccggcgccgac

SEQ ID NO: 2973657 - RNA, 17 nt, Mycobacterium avium subsp. paratuberculosis
cacgcucucgccgguca

SEQ ID NO: 2973658 - RNA, 20 nt, Mycobacterium avium subsp. paratuberculosis
cacgcucucgccggucagca

SEQ ID NO: 2973659 - RNA, 20 nt, Mycobacterium avium subsp. paratuberculosis
cacgcugaacggugccguca

SEQ ID NO: 2973660 - RNA, 17 nt, Mycobacterium avium subsp. paratuberculosis
cacgcugaagcccaccg

SEQ ID NO: 2973661 - RNA, 20 nt, Mycobacterium avium subsp. paratuberculosis
cacgcugaagcccaccgccg

SEQ ID NO: 2973662 - RNA, 15 nt, Mycobacterium avium subsp. paratuberculosis
cacgcugaucaccac

SEQ ID NO: 2973663 - RNA, 19 nt, Mycobacterium avium subsp. paratuberculosis
cacgcugaucgaccgguuc

SEQ ID NO: 2973664 - RNA, 14 nt, Mycobacterium avium subsp. paratuberculosis
cacgcugcgcaccc

SEQ ID NO: 2973665 - RNA, 17 nt, Mycobacterium avium subsp. paratuberculosis
cacgcugcgcacccggu

SEQ ID NO: 2973666 - RNA, 20 nt, Mycobacterium avium subsp. paratuberculosis
cacgcugcgcacccgguccg

SEQ ID NO: 2973667 - RNA, 16 nt, Mycobacterium avium subsp. paratuberculosis
cacgcugcgccagccg

SEQ ID NO: 2973668 - RNA, 17 nt, Mycobacterium avium subsp. paratuberculosis
cacgcugcgccagccgu

SEQ ID NO: 2973669 - RNA, 14 nt, Mycobacterium avium subsp. paratuberculosis
cacgcugcgcgccg

SEQ ID NO: 2973670 - RNA, 17 nt, Mycobacterium avium subsp. paratuberculosis
cacgcuggccggcagcg

SEQ ID NO: 2973671 - RNA, 18 nt, Mycobacterium avium subsp. paratuberculosis
cacgcuggccggcagcgu

SEQ ID NO: 2973672 - RNA, 14 nt, Mycobacterium avium subsp. paratuberculosis
cacgcuggcggugu

SEQ ID NO: 2973673 - RNA, 19 nt, Mycobacterium avium subsp. paratuberculosis
cacgcuggcgugacacucg

SEQ ID NO: 2973674 - RNA, 20 nt, Mycobacterium avium subsp. paratuberculosis
cacgcuggcgugacgcucga

SEQ ID NO: 2973675 - RNA, 21 nt, Mycobacterium avium subsp. paratuberculosis
cacgcuggcgugacgcucgcc

SEQ ID NO: 2973676 - RNA, 20 nt, Mycobacterium avium subsp. paratuberculosis
cacgcuggcgugacgcucgg

SEQ ID NO: 2973677 - RNA, 21 nt, Mycobacterium avium subsp. paratuberculosis
cacgcuggcgugacgcucggg

SEQ ID NO: 2973678 - RNA, 23 nt, Mycobacterium avium subsp. paratuberculosis
cacgcuggcgugacgcucggggc

SEQ ID NO: 2973679 - RNA, 19 nt, Mycobacterium avium subsp. paratuberculosis
cacgcuggcgugacggucg

SEQ ID NO: 2973680 - RNA, 20 nt, Mycobacterium avium subsp. paratuberculosis
cacgcuggcgugacggucga

SEQ ID NO: 2973681 - RNA, 22 nt, Mycobacterium avium subsp. paratuberculosis
cacgcuggcgugacggucgacc

SEQ ID NO: 2973682 - RNA, 19 nt, Mycobacterium avium subsp. paratuberculosis
cacgcuggcgugacguucg

SEQ ID NO: 2973683 - RNA, 19 nt, Mycobacterium avium subsp. paratuberculosis
cacgcuggcguggcgccgg

SEQ ID NO: 2973684 - RNA, 22 nt, Mycobacterium avium subsp. paratuberculosis
cacgcuggcguggcgccggcgc

SEQ ID NO: 2973685 - RNA, 23 nt, Mycobacterium avium subsp. paratuberculosis
cacgcuggcguggcgccggcgcg

SEQ ID NO: 2973686 - RNA, 17 nt, Mycobacterium avium subsp. paratuberculosis
cacgcugggcuccgacc

SEQ ID NO: 2973687 - RNA, 23 nt, Mycobacterium avium subsp. paratuberculosis
cacgcuggugacgugcaccugca

SEQ ID NO: 2973688 - RNA, 18 nt, Mycobacterium avium subsp. paratuberculosis
cacgcuguagggccacca

SEQ ID NO: 2973689 - RNA, 19 nt, Mycobacterium avium subsp. paratuberculosis
cacgcuguagggccaccac

SEQ ID NO: 2973690 - RNA, 22 nt, Mycobacterium avium subsp. paratuberculosis
cacgcuguagggccaccacgcc

SEQ ID NO: 2973691 - RNA, 13 nt, Mycobacterium avium subsp. paratuberculosis
cacgcuguccgcg

SEQ ID NO: 2973692 - RNA, 20 nt, Mycobacterium avium subsp. paratuberculosis
cacgcugucggggucgcggc

SEQ ID NO: 2973693 - RNA, 23 nt, Mycobacterium avium subsp. paratuberculosis
cacgcugucggggucgcggcccg

SEQ ID NO: 2973694 - RNA, 16 nt, Mycobacterium avium subsp. paratuberculosis
cacgcuguuggaaccg

SEQ ID NO: 2973695 - RNA, 19 nt, Mycobacterium avium subsp. paratuberculosis
cacgcuguuggaaccggcc

SEQ ID NO: 2973696 - RNA, 20 nt, Mycobacterium avium subsp. paratuberculosis
cacgcuguuggaaccggcca

SEQ ID NO: 2973697 - RNA, 22 nt, Mycobacterium avium subsp. paratuberculosis
cacgcuguuggaaccggccacc

SEQ ID NO: 2973698 - RNA, 15 nt, Mycobacterium avium subsp. paratuberculosis
cacgcuuccgugcuu

SEQ ID NO: 2973699 - RNA, 20 nt, Mycobacterium avium subsp. paratuberculosis
cacgcuuccgugcuugcccg

SEQ ID NO: 2973700 - RNA, 19 nt, Mycobacterium avium subsp. paratuberculosis
cacggacagcucaccgggc

SEQ ID NO: 2973701 - RNA, 13 nt, Mycobacterium avium subsp. paratuberculosis
cacggagcgcccg

SEQ ID NO: 2973702 - RNA, 22 nt, Mycobacterium avium subsp. paratuberculosis
cacggagcgcccggccagccgg

SEQ ID NO: 2973703 - RNA, 17 nt, Mycobacterium avium subsp. paratuberculosis
cacggauacccgcggcc

SEQ ID NO: 2973704 - RNA, 18 nt, Mycobacterium avium subsp. paratuberculosis
cacggauacccgcggccu

SEQ ID NO: 2973705 - RNA, 15 nt, Mycobacterium avium subsp. paratuberculosis
cacggaucgcccacc

SEQ ID NO: 2973706 - RNA, 23 nt, Mycobacterium avium subsp. paratuberculosis
cacggaucgcccacccgcacgcc

SEQ ID NO: 2973707 - RNA, 18 nt, Mycobacterium avium subsp. paratuberculosis
cacggcaaugguugcggc

SEQ ID NO: 2973708 - RNA, 22 nt, Mycobacterium avium subsp. paratuberculosis
cacggcaaugguugcggcgggc

SEQ ID NO: 2973709 - RNA, 16 nt, Mycobacterium avium subsp. paratuberculosis
cacggcaccgccgcgc

SEQ ID NO: 2973710 - RNA, 13 nt, Mycobacterium avium subsp. paratuberculosis
cacggcaccgcga

SEQ ID NO: 2973711 - RNA, 16 nt, Mycobacterium avium subsp. paratuberculosis
cacggcaccgcgagca

SEQ ID NO: 2973712 - RNA, 15 nt, Mycobacterium avium subsp. paratuberculosis
cacggcacgucgagg

SEQ ID NO: 2973713 - RNA, 20 nt, Mycobacterium avium subsp. paratuberculosis
cacggcagcaacugaccgau

SEQ ID NO: 2973714 - RNA, 21 nt, Mycobacterium avium subsp. paratuberculosis
cacggcagcaacugaccgauc

SEQ ID NO: 2973715 - RNA, 12 nt, Mycobacterium avium subsp. paratuberculosis
cacggcagcccg

SEQ ID NO: 2973716 - RNA, 13 nt, Mycobacterium avium subsp. paratuberculosis
cacggcagcccga

SEQ ID NO: 2973717 - RNA, 16 nt, Mycobacterium avium subsp. paratuberculosis
cacggcagcugcagcg

SEQ ID NO: 2973718 - RNA, 17 nt, Mycobacterium avium subsp. paratuberculosis
cacggcaggcggcccgc

SEQ ID NO: 2973719 - RNA, 20 nt, Mycobacterium avium subsp. paratuberculosis
cacggcauagauaccggcca

SEQ ID NO: 2973720 - RNA, 15 nt, Mycobacterium avium subsp. paratuberculosis
cacggcaucgauggc

SEQ ID NO: 2973721 - RNA, 16 nt, Mycobacterium avium subsp. paratuberculosis
cacggcaucgauggcg

SEQ ID NO: 2973722 - RNA, 17 nt, Mycobacterium avium subsp. paratuberculosis
cacggcaucgauggcgg

SEQ ID NO: 2973723 - RNA, 22 nt, Mycobacterium avium subsp. paratuberculosis
cacggcaucgauggcgggcgcg

SEQ ID NO: 2973724 - RNA, 23 nt, Mycobacterium avium subsp. paratuberculosis
cacggcaucgauggcgggcgcgc

SEQ ID NO: 2973725 - RNA, 22 nt, Mycobacterium avium subsp. paratuberculosis
cacggcauggcgaacacgucgg

SEQ ID NO: 2973726 - RNA, 19 nt, Mycobacterium avium subsp. paratuberculosis
cacggccaacugcaucgcc

SEQ ID NO: 2973727 - RNA, 13 nt, Mycobacterium avium subsp. paratuberculosis
cacggccacaacg

SEQ ID NO: 2973728 - RNA, 22 nt, Mycobacterium avium subsp. paratuberculosis
cacggccaccacggcaccgccg

SEQ ID NO: 2973729 - RNA, 16 nt, Mycobacterium avium subsp. paratuberculosis
cacggccaccagcagc

SEQ ID NO: 2973730 - RNA, 14 nt, Mycobacterium avium subsp. paratuberculosis
cacggccaccgccg

SEQ ID NO: 2973731 - RNA, 16 nt, Mycobacterium avium subsp. paratuberculosis
cacggccacugccccg

SEQ ID NO: 2973732 - RNA, 19 nt, Mycobacterium avium subsp. paratuberculosis
cacggccacugccccggcg

SEQ ID NO: 2973733 - RNA, 16 nt, Mycobacterium avium subsp. paratuberculosis
cacggccagcaccgcc

SEQ ID NO: 2973734 - RNA, 17 nt, Mycobacterium avium subsp. paratuberculosis
cacggccagcaccgcca

SEQ ID NO: 2973735 - RNA, 19 nt, Mycobacterium avium subsp. paratuberculosis
cacggccagcaccgccagc

SEQ ID NO: 2973736 - RNA, 21 nt, Mycobacterium avium subsp. paratuberculosis
cacggccagcaccgccagcgc

SEQ ID NO: 2973737 - RNA, 22 nt, Mycobacterium avium subsp. paratuberculosis
cacggccagcaccgccagcgcc

SEQ ID NO: 2973738 - RNA, 13 nt, Mycobacterium avium subsp. paratuberculosis
cacggccagcgcc

SEQ ID NO: 2973739 - RNA, 14 nt, Mycobacterium avium subsp. paratuberculosis
cacggccagcgccg

SEQ ID NO: 2973740 - RNA, 17 nt, Mycobacterium avium subsp. paratuberculosis
cacggccagcgccguca

SEQ ID NO: 2973741 - RNA, 11 nt, Mycobacterium avium subsp. paratuberculosis
cacggccagga

SEQ ID NO: 2973742 - RNA, 20 nt, Mycobacterium avium subsp. paratuberculosis
cacggccaggaagccggcga

SEQ ID NO: 2973743 - RNA, 21 nt, Mycobacterium avium subsp. paratuberculosis
cacggccaggaagccggcgac

SEQ ID NO: 2973744 - RNA, 23 nt, Mycobacterium avium subsp. paratuberculosis
cacggccaucacggugccgaguu

SEQ ID NO: 2973745 - RNA, 17 nt, Mycobacterium avium subsp. paratuberculosis
cacggccaugcagacca

SEQ ID NO: 2973746 - RNA, 22 nt, Mycobacterium avium subsp. paratuberculosis
cacggccaugcagaccagcccg

SEQ ID NO: 2973747 - RNA, 15 nt, Mycobacterium avium subsp. paratuberculosis
cacggcccaucacca

SEQ ID NO: 2973748 - RNA, 15 nt, Mycobacterium avium subsp. paratuberculosis
cacggccccagccgc

SEQ ID NO: 2973749 - RNA, 21 nt, Mycobacterium avium subsp. paratuberculosis
cacggcccgcgccccggcggc

SEQ ID NO: 2973750 - RNA, 14 nt, Mycobacterium avium subsp. paratuberculosis
cacggcccgcggca

SEQ ID NO: 2973751 - RNA, 16 nt, Mycobacterium avium subsp. paratuberculosis
cacggcccgcggcacg

SEQ ID NO: 2973752 - RNA, 19 nt, Mycobacterium avium subsp. paratuberculosis
cacggcccgcucgggccau

SEQ ID NO: 2973753 - RNA, 13 nt, Mycobacterium avium subsp. paratuberculosis
cacggccgcagcg

SEQ ID NO: 2973754 - RNA, 15 nt, Mycobacterium avium subsp. paratuberculosis
cacggccgcagcggc

SEQ ID NO: 2973755 - RNA, 15 nt, Mycobacterium avium subsp. paratuberculosis
cacggccgccagcag

SEQ ID NO: 2973756 - RNA, 20 nt, Mycobacterium avium subsp. paratuberculosis
cacggccgccagcagcacgg

SEQ ID NO: 2973757 - RNA, 22 nt, Mycobacterium avium subsp. paratuberculosis
cacggccgccagcagcacggca

SEQ ID NO: 2973758 - RNA, 20 nt, Mycobacterium avium subsp. paratuberculosis
cacggccgccuccagcacgu

SEQ ID NO: 2973759 - RNA, 22 nt, Mycobacterium avium subsp. paratuberculosis
cacggccgccuccagcacgucg

SEQ ID NO: 2973760 - RNA, 12 nt, Mycobacterium avium subsp. paratuberculosis
cacggccgcggc

SEQ ID NO: 2973761 - RNA, 14 nt, Mycobacterium avium subsp. paratuberculosis
cacggccgcggcca

SEQ ID NO: 2973762 - RNA, 17 nt, Mycobacterium avium subsp. paratuberculosis
cacggccgcggccagcg

SEQ ID NO: 2973763 - RNA, 18 nt, Mycobacterium avium subsp. paratuberculosis
cacggccgcggccagcga

SEQ ID NO: 2973764 - RNA, 19 nt, Mycobacterium avium subsp. paratuberculosis
cacggccgcggccagcgag

SEQ ID NO: 2973765 - RNA, 14 nt, Mycobacterium avium subsp. paratuberculosis
cacggccggcagca

SEQ ID NO: 2973766 - RNA, 17 nt, Mycobacterium avium subsp. paratuberculosis
cacggccggcagcaucg

SEQ ID NO: 2973767 - RNA, 17 nt, Mycobacterium avium subsp. paratuberculosis
cacggccggccggccga

SEQ ID NO: 2973768 - RNA, 19 nt, Mycobacterium avium subsp. paratuberculosis
cacggccggccggccgagc

SEQ ID NO: 2973769 - RNA, 22 nt, Mycobacterium avium subsp. paratuberculosis
cacggccggccggccgagccga

SEQ ID NO: 2973770 - RNA, 16 nt, Mycobacterium avium subsp. paratuberculosis
cacggccguccaggcg

SEQ ID NO: 2973771 - RNA, 19 nt, Mycobacterium avium subsp. paratuberculosis
cacggccucgaucaucacc

SEQ ID NO: 2973772 - RNA, 23 nt, Mycobacterium avium subsp. paratuberculosis
cacggccucgaucaucaccaccg

SEQ ID NO: 2973773 - RNA, 14 nt, Mycobacterium avium subsp. paratuberculosis
cacggccucgccca

SEQ ID NO: 2973774 - RNA, 21 nt, Mycobacterium avium subsp. paratuberculosis
cacggccucgcccagcgccgc

SEQ ID NO: 2973775 - RNA, 19 nt, Mycobacterium avium subsp. paratuberculosis
cacggccuugccgaucagc

SEQ ID NO: 2973776 - RNA, 19 nt, Mycobacterium avium subsp. paratuberculosis
cacggcgaacggccgcgau

SEQ ID NO: 2973777 - RNA, 16 nt, Mycobacterium avium subsp. paratuberculosis
cacggcgaauauuucg

SEQ ID NO: 2973778 - RNA, 21 nt, Mycobacterium avium subsp. paratuberculosis
cacggcgaauauuucgccgau

SEQ ID NO: 2973779 - RNA, 18 nt, Mycobacterium avium subsp. paratuberculosis
cacggcgaccagcgagcc

SEQ ID NO: 2973780 - RNA, 13 nt, Mycobacterium avium subsp. paratuberculosis
cacggcgaccccg

SEQ ID NO: 2973781 - RNA, 23 nt, Mycobacterium avium subsp. paratuberculosis
cacggcgaccccguucgccgaca

SEQ ID NO: 2973782 - RNA, 18 nt, Mycobacterium avium subsp. paratuberculosis
cacggcgacgaccaccag

SEQ ID NO: 2973783 - RNA, 19 nt, Mycobacterium avium subsp. paratuberculosis
cacggcgacgaccaccagg

SEQ ID NO: 2973784 - RNA, 20 nt, Mycobacterium avium subsp. paratuberculosis
cacggcgacgaccaccagga

SEQ ID NO: 2973785 - RNA, 13 nt, Mycobacterium avium subsp. paratuberculosis
cacggcgauguag

SEQ ID NO: 2973786 - RNA, 20 nt, Mycobacterium avium subsp. paratuberculosis
cacggcgauguaggacgccg

SEQ ID NO: 2973787 - RNA, 13 nt, Mycobacterium avium subsp. paratuberculosis
cacggcgccacca

SEQ ID NO: 2973788 - RNA, 20 nt, Mycobacterium avium subsp. paratuberculosis
cacggcgccaccagccacac

SEQ ID NO: 2973789 - RNA, 21 nt, Mycobacterium avium subsp. paratuberculosis
cacggcgccaccagccacacc

SEQ ID NO: 2973790 - RNA, 22 nt, Mycobacterium avium subsp. paratuberculosis
cacggcgccaccagccacaccg

SEQ ID NO: 2973791 - RNA, 11 nt, Mycobacterium avium subsp. paratuberculosis
cacggcgccgu

SEQ ID NO: 2973792 - RNA, 13 nt, Mycobacterium avium subsp. paratuberculosis
cacggcgccgugc

SEQ ID NO: 2973793 - RNA, 14 nt, Mycobacterium avium subsp. paratuberculosis
cacggcgccgugcg

SEQ ID NO: 2973794 - RNA, 14 nt, Mycobacterium avium subsp. paratuberculosis
cacggcgcgcaccg

SEQ ID NO: 2973795 - RNA, 16 nt, Mycobacterium avium subsp. paratuberculosis
cacggcgcugagcgac

SEQ ID NO: 2973796 - RNA, 17 nt, Mycobacterium avium subsp. paratuberculosis
cacggcgcugagcgaca

SEQ ID NO: 2973797 - RNA, 14 nt, Mycobacterium avium subsp. paratuberculosis
cacggcgcuggcga

SEQ ID NO: 2973798 - RNA, 16 nt, Mycobacterium avium subsp. paratuberculosis
cacggcgcuggcgacc

SEQ ID NO: 2973799 - RNA, 23 nt, Mycobacterium avium subsp. paratuberculosis
cacggcgcuggcgaccaucagcc

SEQ ID NO: 2973800 - RNA, 14 nt, Mycobacterium avium subsp. paratuberculosis
cacggcggcagcgc

SEQ ID NO: 2973801 - RNA, 18 nt, Mycobacterium avium subsp. paratuberculosis
cacggcggcagcgcggcg

SEQ ID NO: 2973802 - RNA, 19 nt, Mycobacterium avium subsp. paratuberculosis
cacggcggcagcgcggcgu

SEQ ID NO: 2973803 - RNA, 12 nt, Mycobacterium avium subsp. paratuberculosis
cacggcggccga

SEQ ID NO: 2973804 - RNA, 14 nt, Mycobacterium avium subsp. paratuberculosis
cacggcggcgaacg

SEQ ID NO: 2973805 - RNA, 19 nt, Mycobacterium avium subsp. paratuberculosis
cacggcggcgaacgccgcc

SEQ ID NO: 2973806 - RNA, 20 nt, Mycobacterium avium subsp. paratuberculosis
cacggcggcgaacgccgccg

SEQ ID NO: 2973807 - RNA, 21 nt, Mycobacterium avium subsp. paratuberculosis
cacggcggcgaacgccgccgu

SEQ ID NO: 2973808 - RNA, 15 nt, Mycobacterium avium subsp. paratuberculosis
cacggcggcgcgcac

SEQ ID NO: 2973809 - RNA, 13 nt, Mycobacterium avium subsp. paratuberculosis
cacggcggcgcgg

SEQ ID NO: 2973810 - RNA, 15 nt, Mycobacterium avium subsp. paratuberculosis
cacggcggcgcgggc

SEQ ID NO: 2973811 - RNA, 20 nt, Mycobacterium avium subsp. paratuberculosis
cacggcggcgcgggcggcgu

SEQ ID NO: 2973812 - RNA, 14 nt, Mycobacterium avium subsp. paratuberculosis
cacggcggcgugca

SEQ ID NO: 2973813 - RNA, 19 nt, Mycobacterium avium subsp. paratuberculosis
cacggcggcgugcaccgcc

SEQ ID NO: 2973814 - RNA, 20 nt, Mycobacterium avium subsp. paratuberculosis
cacggcggggucaagcggca

SEQ ID NO: 2973815 - RNA, 18 nt, Mycobacterium avium subsp. paratuberculosis
cacggcggggucucaauc

SEQ ID NO: 2973816 - RNA, 13 nt, Mycobacterium avium subsp. paratuberculosis
cacggcgggucgg

SEQ ID NO: 2973817 - RNA, 22 nt, Mycobacterium avium subsp. paratuberculosis
cacggcgguagcguggguucga

SEQ ID NO: 2973818 - RNA, 18 nt, Mycobacterium avium subsp. paratuberculosis
cacggcggugucggcggc

SEQ ID NO: 2973819 - RNA, 14 nt, Mycobacterium avium subsp. paratuberculosis
cacggcgucggcgu

SEQ ID NO: 2973820 - RNA, 22 nt, Mycobacterium avium subsp. paratuberculosis
cacggcguugaccaacgccgcc

SEQ ID NO: 2973821 - RNA, 19 nt, Mycobacterium avium subsp. paratuberculosis
cacggcguugaccgggccg

SEQ ID NO: 2973822 - RNA, 20 nt, Mycobacterium avium subsp. paratuberculosis
cacggcuaccuaggcgucgu

SEQ ID NO: 2973823 - RNA, 14 nt, Mycobacterium avium subsp. paratuberculosis
cacggcucgggggc

SEQ ID NO: 2973824 - RNA, 18 nt, Mycobacterium avium subsp. paratuberculosis
cacggcucgggggccgcu

SEQ ID NO: 2973825 - RNA, 20 nt, Mycobacterium avium subsp. paratuberculosis
cacggcucgggggccgcucc

SEQ ID NO: 2973826 - RNA, 14 nt, Mycobacterium avium subsp. paratuberculosis
cacggcugcacccu

SEQ ID NO: 2973827 - RNA, 13 nt, Mycobacterium avium subsp. paratuberculosis
cacggcugccgac

SEQ ID NO: 2973828 - RNA, 14 nt, Mycobacterium avium subsp. paratuberculosis
cacggcugccgacc

SEQ ID NO: 2973829 - RNA, 18 nt, Mycobacterium avium subsp. paratuberculosis
cacggcugccgaccucga

SEQ ID NO: 2973830 - RNA, 15 nt, Mycobacterium avium subsp. paratuberculosis
cacgggaugaucggc

SEQ ID NO: 2973831 - RNA, 16 nt, Mycobacterium avium subsp. paratuberculosis
cacgggaugaucggcg

SEQ ID NO: 2973832 - RNA, 13 nt, Mycobacterium avium subsp. paratuberculosis
cacgggaugcggc

SEQ ID NO: 2973833 - RNA, 16 nt, Mycobacterium avium subsp. paratuberculosis
cacgggaugcggcacg

SEQ ID NO: 2973834 - RNA, 14 nt, Mycobacterium avium subsp. paratuberculosis
cacgggcacaccgu

SEQ ID NO: 2973835 - RNA, 22 nt, Mycobacterium avium subsp. paratuberculosis
cacgggcacaccgucguccacg

SEQ ID NO: 2973836 - RNA, 16 nt, Mycobacterium avium subsp. paratuberculosis
cacgggcaccgacgag

SEQ ID NO: 2973837 - RNA, 16 nt, Mycobacterium avium subsp. paratuberculosis
cacgggccaggcgcgc

SEQ ID NO: 2973838 - RNA, 15 nt, Mycobacterium avium subsp. paratuberculosis
cacgggccgcgccga

SEQ ID NO: 2973839 - RNA, 17 nt, Mycobacterium avium subsp. paratuberculosis
cacgggccgcgccgagg

SEQ ID NO: 2973840 - RNA, 22 nt, Mycobacterium avium subsp. paratuberculosis
cacgggcggcagggccagcacc

SEQ ID NO: 2973841 - RNA, 23 nt, Mycobacterium avium subsp. paratuberculosis
cacgggcggcagggccagcacca

SEQ ID NO: 2973842 - RNA, 14 nt, Mycobacterium avium subsp. paratuberculosis
cacgggcggcgggg

SEQ ID NO: 2973843 - RNA, 18 nt, Mycobacterium avium subsp. paratuberculosis
cacgggcggucggacgcg

SEQ ID NO: 2973844 - RNA, 20 nt, Mycobacterium avium subsp. paratuberculosis
cacgggcguguaguccaggu

SEQ ID NO: 2973845 - RNA, 22 nt, Mycobacterium avium subsp. paratuberculosis
cacgggcguguaguccaggucg

SEQ ID NO: 2973846 - RNA, 16 nt, Mycobacterium avium subsp. paratuberculosis
cacgggcugaccgcca

SEQ ID NO: 2973847 - RNA, 17 nt, Mycobacterium avium subsp. paratuberculosis
cacgggcugaccgccag

SEQ ID NO: 2973848 - RNA, 18 nt, Mycobacterium avium subsp. paratuberculosis
cacgggcugaccgccagg

SEQ ID NO: 2973849 - RNA, 19 nt, Mycobacterium avium subsp. paratuberculosis
cacgggcugaccgccagga

SEQ ID NO: 2973850 - RNA, 22 nt, Mycobacterium avium subsp. paratuberculosis
cacggggacgcugaacagcccg

SEQ ID NO: 2973851 - RNA, 15 nt, Mycobacterium avium subsp. paratuberculosis
cacggggcgccgcug

SEQ ID NO: 2973852 - RNA, 22 nt, Mycobacterium avium subsp. paratuberculosis
cacggggcgccgcugcgggcca

SEQ ID NO: 2973853 - RNA, 19 nt, Mycobacterium avium subsp. paratuberculosis
cacggggugcgugacgggc

SEQ ID NO: 2973854 - RNA, 13 nt, Mycobacterium avium subsp. paratuberculosis
cacgggucgccgu

SEQ ID NO: 2973855 - RNA, 15 nt, Mycobacterium avium subsp. paratuberculosis
cacgggucgccgugg

SEQ ID NO: 2973856 - RNA, 18 nt, Mycobacterium avium subsp. paratuberculosis
cacgggucgcugugcagc

SEQ ID NO: 2973857 - RNA, 21 nt, Mycobacterium avium subsp. paratuberculosis
cacgggugugacauccccggu

SEQ ID NO: 2973858 - RNA, 18 nt, Mycobacterium avium subsp. paratuberculosis
cacggguugagccagacg

SEQ ID NO: 2973859 - RNA, 21 nt, Mycobacterium avium subsp. paratuberculosis
cacggucacagccgcgauagc

SEQ ID NO: 2973860 - RNA, 15 nt, Mycobacterium avium subsp. paratuberculosis
cacggucaccccgag

SEQ ID NO: 2973861 - RNA, 23 nt, Mycobacterium avium subsp. paratuberculosis
cacggucaccccgaguucggcca

SEQ ID NO: 2973862 - RNA, 14 nt, Mycobacterium avium subsp. paratuberculosis
cacggucagcgcgu

SEQ ID NO: 2973863 - RNA, 19 nt, Mycobacterium avium subsp. paratuberculosis
cacggucagcgcgucggcg

SEQ ID NO: 2973864 - RNA, 14 nt, Mycobacterium avium subsp. paratuberculosis
cacggucagcggcc

SEQ ID NO: 2973865 - RNA, 15 nt, Mycobacterium avium subsp. paratuberculosis
cacggucagcggcca

SEQ ID NO: 2973866 - RNA, 19 nt, Mycobacterium avium subsp. paratuberculosis
cacggucagcucgcgcccg

SEQ ID NO: 2973867 - RNA, 21 nt, Mycobacterium avium subsp. paratuberculosis
cacggucagcucgcgcccggc

SEQ ID NO: 2973868 - RNA, 18 nt, Mycobacterium avium subsp. paratuberculosis
cacggucaggcgcagcca

SEQ ID NO: 2973869 - RNA, 16 nt, Mycobacterium avium subsp. paratuberculosis
cacgguccccgcgccc

SEQ ID NO: 2973870 - RNA, 20 nt, Mycobacterium avium subsp. paratuberculosis
cacgguccccgcgcccgccg

SEQ ID NO: 2973871 - RNA, 13 nt, Mycobacterium avium subsp. paratuberculosis
cacggucgccgcg

SEQ ID NO: 2973872 - RNA, 16 nt, Mycobacterium avium subsp. paratuberculosis
cacggucgccgcgccg

SEQ ID NO: 2973873 - RNA, 17 nt, Mycobacterium avium subsp. paratuberculosis
cacggucgccgcgccgc

SEQ ID NO: 2973874 - RNA, 18 nt, Mycobacterium avium subsp. paratuberculosis
cacggucgccgcgccgcc

SEQ ID NO: 2973875 - RNA, 12 nt, Mycobacterium avium subsp. paratuberculosis
cacggucgccgg

SEQ ID NO: 2973876 - RNA, 18 nt, Mycobacterium avium subsp. paratuberculosis
cacggucggagcccagcg

SEQ ID NO: 2973877 - RNA, 13 nt, Mycobacterium avium subsp. paratuberculosis
cacggucggcccc

SEQ ID NO: 2973878 - RNA, 14 nt, Mycobacterium avium subsp. paratuberculosis
cacggucggcgggu

SEQ ID NO: 2973879 - RNA, 18 nt, Mycobacterium avium subsp. paratuberculosis
cacggucuggcuggugac

SEQ ID NO: 2973880 - RNA, 18 nt, Mycobacterium avium subsp. paratuberculosis
cacggucugguggcagcg

SEQ ID NO: 2973881 - RNA, 15 nt, Mycobacterium avium subsp. paratuberculosis
cacggugaacgggcc

SEQ ID NO: 2973882 - RNA, 17 nt, Mycobacterium avium subsp. paratuberculosis
cacggugaacgggccgc

SEQ ID NO: 2973883 - RNA, 18 nt, Mycobacterium avium subsp. paratuberculosis
cacggugaacgggccgca

SEQ ID NO: 2973884 - RNA, 16 nt, Mycobacterium avium subsp. paratuberculosis
cacggugaacgucgau

SEQ ID NO: 2973885 - RNA, 17 nt, Mycobacterium avium subsp. paratuberculosis
cacggugaucagcagca

SEQ ID NO: 2973886 - RNA, 20 nt, Mycobacterium avium subsp. paratuberculosis
cacggugaucagcagcaggu

SEQ ID NO: 2973887 - RNA, 23 nt, Mycobacterium avium subsp. paratuberculosis
cacggugaucagcagcagguccu

SEQ ID NO: 2973888 - RNA, 17 nt, Mycobacterium avium subsp. paratuberculosis
cacggugcacacgccga

SEQ ID NO: 2973889 - RNA, 18 nt, Mycobacterium avium subsp. paratuberculosis
cacggugcacacgccgag

SEQ ID NO: 2973890 - RNA, 19 nt, Mycobacterium avium subsp. paratuberculosis
cacggugcacacgccgagg

SEQ ID NO: 2973891 - RNA, 17 nt, Mycobacterium avium subsp. paratuberculosis
cacggugcagcagcgcc

SEQ ID NO: 2973892 - RNA, 20 nt, Mycobacterium avium subsp. paratuberculosis
cacggugcccgucggcaacg

SEQ ID NO: 2973893 - RNA, 14 nt, Mycobacterium avium subsp. paratuberculosis
cacggugccgccgu

SEQ ID NO: 2973894 - RNA, 14 nt, Mycobacterium avium subsp. paratuberculosis
cacggugcgcaccg

SEQ ID NO: 2973895 - RNA, 15 nt, Mycobacterium avium subsp. paratuberculosis
cacggugcgcaccga

SEQ ID NO: 2973896 - RNA, 17 nt, Mycobacterium avium subsp. paratuberculosis
cacggugcgcaccgaca

SEQ ID NO: 2973897 - RNA, 15 nt, Mycobacterium avium subsp. paratuberculosis
cacggugcgccggca

SEQ ID NO: 2973898 - RNA, 16 nt, Mycobacterium avium subsp. paratuberculosis
cacggugcgccggcag

SEQ ID NO: 2973899 - RNA, 17 nt, Mycobacterium avium subsp. paratuberculosis
cacggugcgggugccga

SEQ ID NO: 2973900 - RNA, 20 nt, Mycobacterium avium subsp. paratuberculosis
cacggugcgggugccgaaca

SEQ ID NO: 2973901 - RNA, 22 nt, Mycobacterium avium subsp. paratuberculosis
cacggugcgggugccgaacacg

SEQ ID NO: 2973902 - RNA, 23 nt, Mycobacterium avium subsp. paratuberculosis
cacggugcgggugccgaacacgu

SEQ ID NO: 2973903 - RNA, 15 nt, Mycobacterium avium subsp. paratuberculosis
cacgguggccgccac

SEQ ID NO: 2973904 - RNA, 14 nt, Mycobacterium avium subsp. paratuberculosis
cacgguggccgcga

SEQ ID NO: 2973905 - RNA, 14 nt, Mycobacterium avium subsp. paratuberculosis
cacgguggcgccga

SEQ ID NO: 2973906 - RNA, 21 nt, Mycobacterium avium subsp. paratuberculosis
cacgguggcgccgcgcagcca

SEQ ID NO: 2973907 - RNA, 12 nt, Mycobacterium avium subsp. paratuberculosis
cacgguggcggu

SEQ ID NO: 2973908 - RNA, 16 nt, Mycobacterium avium subsp. paratuberculosis
cacggugggacggcgg

SEQ ID NO: 2973909 - RNA, 15 nt, Mycobacterium avium subsp. paratuberculosis
cacggugggcgccgg

SEQ ID NO: 2973910 - RNA, 21 nt, Mycobacterium avium subsp. paratuberculosis
cacgguguagacgcgggccgg

SEQ ID NO: 2973911 - RNA, 19 nt, Mycobacterium avium subsp. paratuberculosis
cacgguguagcggcggcug

SEQ ID NO: 2973912 - RNA, 13 nt, Mycobacterium avium subsp. paratuberculosis
cacggugucggcg

SEQ ID NO: 2973913 - RNA, 17 nt, Mycobacterium avium subsp. paratuberculosis
cacgguguugcgcaccc

SEQ ID NO: 2973914 - RNA, 18 nt, Mycobacterium avium subsp. paratuberculosis
cacgguuggccggcccgc

SEQ ID NO: 2973915 - RNA, 14 nt, Mycobacterium avium subsp. paratuberculosis
cacgguuucgccgu

SEQ ID NO: 2973916 - RNA, 15 nt, Mycobacterium avium subsp. paratuberculosis
cacgguuucgccgua

SEQ ID NO: 2973917 - RNA, 13 nt, Mycobacterium avium subsp. paratuberculosis
cacguacaccggg

SEQ ID NO: 2973918 - RNA, 14 nt, Mycobacterium avium subsp. paratuberculosis
cacguacaccggga

SEQ ID NO: 2973919 - RNA, 18 nt, Mycobacterium avium subsp. paratuberculosis
cacguacagcggcggcca

SEQ ID NO: 2973920 - RNA, 14 nt, Mycobacterium avium subsp. paratuberculosis
cacguacuccugcg

SEQ ID NO: 2973921 - RNA, 16 nt, Mycobacterium avium subsp. paratuberculosis
cacguagaaggcgccg

SEQ ID NO: 2973922 - RNA, 17 nt, Mycobacterium avium subsp. paratuberculosis
cacguagaaggcgccgu

SEQ ID NO: 2973923 - RNA, 14 nt, Mycobacterium avium subsp. paratuberculosis
cacguagcccagcg

SEQ ID NO: 2973924 - RNA, 15 nt, Mycobacterium avium subsp. paratuberculosis
cacguagcgcggccg

SEQ ID NO: 2973925 - RNA, 17 nt, Mycobacterium avium subsp. paratuberculosis
cacguagcgcggccgcc

SEQ ID NO: 2973926 - RNA, 19 nt, Mycobacterium avium subsp. paratuberculosis
cacguaggcgaucagcgcg

SEQ ID NO: 2973927 - RNA, 15 nt, Mycobacterium avium subsp. paratuberculosis
cacguaggcggcgag

SEQ ID NO: 2973928 - RNA, 16 nt, Mycobacterium avium subsp. paratuberculosis
cacguaggcggcgagc

SEQ ID NO: 2973929 - RNA, 18 nt, Mycobacterium avium subsp. paratuberculosis
cacguagucgaccgggau

SEQ ID NO: 2973930 - RNA, 23 nt, Mycobacterium avium subsp. paratuberculosis
cacguaucgcgccugcaccggcg

SEQ ID NO: 2973931 - RNA, 13 nt, Mycobacterium avium subsp. paratuberculosis
cacgucaccgcgc

SEQ ID NO: 2973932 - RNA, 14 nt, Mycobacterium avium subsp. paratuberculosis
cacgucaccgcuga

SEQ ID NO: 2973933 - RNA, 14 nt, Mycobacterium avium subsp. paratuberculosis
cacgucacgggcca

SEQ ID NO: 2973934 - RNA, 17 nt, Mycobacterium avium subsp. paratuberculosis
cacgucacgggccaggc

SEQ ID NO: 2973935 - RNA, 18 nt, Mycobacterium avium subsp. paratuberculosis
cacgucacgggccaggcg

SEQ ID NO: 2973936 - RNA, 20 nt, Mycobacterium avium subsp. paratuberculosis
cacgucacgggccaggcgcg

SEQ ID NO: 2973937 - RNA, 19 nt, Mycobacterium avium subsp. paratuberculosis
cacgucauuucggucggca

SEQ ID NO: 2973938 - RNA, 21 nt, Mycobacterium avium subsp. paratuberculosis
cacguccaccagcaccaggcg

SEQ ID NO: 2973939 - RNA, 15 nt, Mycobacterium avium subsp. paratuberculosis
cacguccacgccgcg

SEQ ID NO: 2973940 - RNA, 17 nt, Mycobacterium avium subsp. paratuberculosis
cacguccacgccgcggg

SEQ ID NO: 2973941 - RNA, 13 nt, Mycobacterium avium subsp. paratuberculosis
cacguccagcccg

SEQ ID NO: 2973942 - RNA, 16 nt, Mycobacterium avium subsp. paratuberculosis
cacguccagcccgcgc

SEQ ID NO: 2973943 - RNA, 23 nt, Mycobacterium avium subsp. paratuberculosis
cacguccagcccgcgccagcucg

SEQ ID NO: 2973944 - RNA, 20 nt, Mycobacterium avium subsp. paratuberculosis
cacguccagcucucgagcac

SEQ ID NO: 2973945 - RNA, 17 nt, Mycobacterium avium subsp. paratuberculosis
cacguccagcugggcug

SEQ ID NO: 2973946 - RNA, 17 nt, Mycobacterium avium subsp. paratuberculosis
cacguccccgggcgugc

SEQ ID NO: 2973947 - RNA, 20 nt, Mycobacterium avium subsp. paratuberculosis
cacguccccgugcagccggg

SEQ ID NO: 2973948 - RNA, 21 nt, Mycobacterium avium subsp. paratuberculosis
cacguccccgugcagccgggc

SEQ ID NO: 2973949 - RNA, 23 nt, Mycobacterium avium subsp. paratuberculosis
cacguccccgugcagccgggccu

SEQ ID NO: 2973950 - RNA, 15 nt, Mycobacterium avium subsp. paratuberculosis
cacgucccgcccggc

SEQ ID NO: 2973951 - RNA, 19 nt, Mycobacterium avium subsp. paratuberculosis
cacgucccgcccggcgccg

SEQ ID NO: 2973952 - RNA, 21 nt, Mycobacterium avium subsp. paratuberculosis
cacgucccgcccggcgccggc

SEQ ID NO: 2973953 - RNA, 14 nt, Mycobacterium avium subsp. paratuberculosis
cacgucccgcucga

SEQ ID NO: 2973954 - RNA, 17 nt, Mycobacterium avium subsp. paratuberculosis
cacguccgccuccgacc

SEQ ID NO: 2973955 - RNA, 22 nt, Mycobacterium avium subsp. paratuberculosis
cacguccgccuccgaccagccg

SEQ ID NO: 2973956 - RNA, 23 nt, Mycobacterium avium subsp. paratuberculosis
cacguccgccuccgaccagccgg

SEQ ID NO: 2973957 - RNA, 14 nt, Mycobacterium avium subsp. paratuberculosis
cacguccgcgguga

SEQ ID NO: 2973958 - RNA, 16 nt, Mycobacterium avium subsp. paratuberculosis
cacguccgcggugagc

SEQ ID NO: 2973959 - RNA, 17 nt, Mycobacterium avium subsp. paratuberculosis
cacguccgcggugagca

SEQ ID NO: 2973960 - RNA, 19 nt, Mycobacterium avium subsp. paratuberculosis
cacguccgcggugagcacc

SEQ ID NO: 2973961 - RNA, 18 nt, Mycobacterium avium subsp. paratuberculosis
cacguccggaugcggcgc

SEQ ID NO: 2973962 - RNA, 19 nt, Mycobacterium avium subsp. paratuberculosis
cacguccggaugcggcgcc

SEQ ID NO: 2973963 - RNA, 21 nt, Mycobacterium avium subsp. paratuberculosis
cacguccggaugcggcgccca

SEQ ID NO: 2973964 - RNA, 21 nt, Mycobacterium avium subsp. paratuberculosis
cacguccuagacacgaauacc

SEQ ID NO: 2973965 - RNA, 12 nt, Mycobacterium avium subsp. paratuberculosis
cacguccucguc

SEQ ID NO: 2973966 - RNA, 14 nt, Mycobacterium avium subsp. paratuberculosis
cacguccucgucgg

SEQ ID NO: 2973967 - RNA, 18 nt, Mycobacterium avium subsp. paratuberculosis
cacguccucgucggucca

SEQ ID NO: 2973968 - RNA, 21 nt, Mycobacterium avium subsp. paratuberculosis
cacguccuggacgucgucgcu

SEQ ID NO: 2973969 - RNA, 14 nt, Mycobacterium avium subsp. paratuberculosis
cacguccuggcgcc

SEQ ID NO: 2973970 - RNA, 15 nt, Mycobacterium avium subsp. paratuberculosis
cacguccuggcgcca

SEQ ID NO: 2973971 - RNA, 22 nt, Mycobacterium avium subsp. paratuberculosis
cacguccuugggcuccucgacc

SEQ ID NO: 2973972 - RNA, 21 nt, Mycobacterium avium subsp. paratuberculosis
cacguccuuggugacggccuc

SEQ ID NO: 2973973 - RNA, 16 nt, Mycobacterium avium subsp. paratuberculosis
cacgucgaacccgacc

SEQ ID NO: 2973974 - RNA, 15 nt, Mycobacterium avium subsp. paratuberculosis
cacgucgacacgccg

SEQ ID NO: 2973975 - RNA, 16 nt, Mycobacterium avium subsp. paratuberculosis
cacgucgacacgccgg

SEQ ID NO: 2973976 - RNA, 12 nt, Mycobacterium avium subsp. paratuberculosis
cacgucgacgcc

SEQ ID NO: 2973977 - RNA, 16 nt, Mycobacterium avium subsp. paratuberculosis
cacgucgacgccgguc

SEQ ID NO: 2973978 - RNA, 15 nt, Mycobacterium avium subsp. paratuberculosis
cacgucgacggccgc

SEQ ID NO: 2973979 - RNA, 23 nt, Mycobacterium avium subsp. paratuberculosis
cacgucgacggccgccgcgacgc

SEQ ID NO: 2973980 - RNA, 13 nt, Mycobacterium avium subsp. paratuberculosis
cacgucgagcacc

SEQ ID NO: 2973981 - RNA, 14 nt, Mycobacterium avium subsp. paratuberculosis
cacgucgagcaccg

SEQ ID NO: 2973982 - RNA, 13 nt, Mycobacterium avium subsp. paratuberculosis
cacgucgagcggc

SEQ ID NO: 2973983 - RNA, 22 nt, Mycobacterium avium subsp. paratuberculosis
cacgucgagcggcccgucgccg

SEQ ID NO: 2973984 - RNA, 23 nt, Mycobacterium avium subsp. paratuberculosis
cacgucgagcggcccgucgccga

SEQ ID NO: 2973985 - RNA, 13 nt, Mycobacterium avium subsp. paratuberculosis
cacgucgaguucc

SEQ ID NO: 2973986 - RNA, 19 nt, Mycobacterium avium subsp. paratuberculosis
cacgucgaucacgccgccg

SEQ ID NO: 2973987 - RNA, 20 nt, Mycobacterium avium subsp. paratuberculosis
cacgucgaucacgccgccgg

SEQ ID NO: 2973988 - RNA, 21 nt, Mycobacterium avium subsp. paratuberculosis
cacgucgaucacgccgccggg

SEQ ID NO: 2973989 - RNA, 13 nt, Mycobacterium avium subsp. paratuberculosis
cacgucgaugccg

SEQ ID NO: 2973990 - RNA, 13 nt, Mycobacterium avium subsp. paratuberculosis
cacgucgcccagc

SEQ ID NO: 2973991 - RNA, 14 nt, Mycobacterium avium subsp. paratuberculosis
cacgucgcccagcg

SEQ ID NO: 2973992 - RNA, 15 nt, Mycobacterium avium subsp. paratuberculosis
cacgucgcccagcgu

SEQ ID NO: 2973993 - RNA, 20 nt, Mycobacterium avium subsp. paratuberculosis
cacgucgccguucuugucga

SEQ ID NO: 2973994 - RNA, 15 nt, Mycobacterium avium subsp. paratuberculosis
cacgucgcgccgaug

SEQ ID NO: 2973995 - RNA, 21 nt, Mycobacterium avium subsp. paratuberculosis
cacgucgcgggugaccggcgc

SEQ ID NO: 2973996 - RNA, 22 nt, Mycobacterium avium subsp. paratuberculosis
cacgucgcgggugaccggcgcc

SEQ ID NO: 2973997 - RNA, 23 nt, Mycobacterium avium subsp. paratuberculosis
cacgucgcgggugaccggcgccg

SEQ ID NO: 2973998 - RNA, 17 nt, Mycobacterium avium subsp. paratuberculosis
cacgucggccacgccgg

SEQ ID NO: 2973999 - RNA, 19 nt, Mycobacterium avium subsp. paratuberculosis
cacgucggccacgccgggc

SEQ ID NO: 2974000 - RNA, 20 nt, Mycobacterium avium subsp. paratuberculosis
cacgucggccacgccgggca

SEQ ID NO: 2974001 - RNA, 15 nt, Mycobacterium avium subsp. paratuberculosis
cacgucggccagcgc

SEQ ID NO: 2974002 - RNA, 17 nt, Mycobacterium avium subsp. paratuberculosis
cacgucggccagcgcgu

SEQ ID NO: 2974003 - RNA, 19 nt, Mycobacterium avium subsp. paratuberculosis
cacgucggccagcgcguga

SEQ ID NO: 2974004 - RNA, 14 nt, Mycobacterium avium subsp. paratuberculosis
cacgucggccgcca

SEQ ID NO: 2974005 - RNA, 17 nt, Mycobacterium avium subsp. paratuberculosis
cacgucggccgccaggg

SEQ ID NO: 2974006 - RNA, 11 nt, Mycobacterium avium subsp. paratuberculosis
cacgucggccu

SEQ ID NO: 2974007 - RNA, 15 nt, Mycobacterium avium subsp. paratuberculosis
cacgucggccugcac

SEQ ID NO: 2974008 - RNA, 12 nt, Mycobacterium avium subsp. paratuberculosis
cacgucggcgag

SEQ ID NO: 2974009 - RNA, 13 nt, Mycobacterium avium subsp. paratuberculosis
cacgucggcgagc

SEQ ID NO: 2974010 - RNA, 14 nt, Mycobacterium avium subsp. paratuberculosis
cacgucggcgaugg

SEQ ID NO: 2974011 - RNA, 19 nt, Mycobacterium avium subsp. paratuberculosis
cacgucggcgauggcggcg

SEQ ID NO: 2974012 - RNA, 20 nt, Mycobacterium avium subsp. paratuberculosis
cacgucggcgauggcggcgu

SEQ ID NO: 2974013 - RNA, 21 nt, Mycobacterium avium subsp. paratuberculosis
cacgucggcgauggcggcgug

SEQ ID NO: 2974014 - RNA, 22 nt, Mycobacterium avium subsp. paratuberculosis
cacgucggcgauggcggcgugc

SEQ ID NO: 2974015 - RNA, 23 nt, Mycobacterium avium subsp. paratuberculosis
cacgucggcgauggcggcgugca

SEQ ID NO: 2974016 - RNA, 12 nt, Mycobacterium avium subsp. paratuberculosis
cacgucggcgcg

SEQ ID NO: 2974017 - RNA, 21 nt, Mycobacterium avium subsp. paratuberculosis
cacgucggcgcgcaggcuggc

SEQ ID NO: 2974018 - RNA, 12 nt, Mycobacterium avium subsp. paratuberculosis
cacgucggcggc

SEQ ID NO: 2974019 - RNA, 15 nt, Mycobacterium avium subsp. paratuberculosis
cacgucggcggccgc

SEQ ID NO: 2974020 - RNA, 17 nt, Mycobacterium avium subsp. paratuberculosis
cacgucggcggccgcga

SEQ ID NO: 2974021 - RNA, 13 nt, Mycobacterium avium subsp. paratuberculosis
cacgucggcguag

SEQ ID NO: 2974022 - RNA, 22 nt, Mycobacterium avium subsp. paratuberculosis
cacgucggggaugucgucgggc

SEQ ID NO: 2974023 - RNA, 18 nt, Mycobacterium avium subsp. paratuberculosis
cacgucgggguggccggc

SEQ ID NO: 2974024 - RNA, 19 nt, Mycobacterium avium subsp. paratuberculosis
cacgucggguucgccggug

SEQ ID NO: 2974025 - RNA, 20 nt, Mycobacterium avium subsp. paratuberculosis
cacgucggguucgccgguga

SEQ ID NO: 2974026 - RNA, 22 nt, Mycobacterium avium subsp. paratuberculosis
cacgucggguucgccggugacc

SEQ ID NO: 2974027 - RNA, 15 nt, Mycobacterium avium subsp. paratuberculosis
cacgucggugacgcc

SEQ ID NO: 2974028 - RNA, 16 nt, Mycobacterium avium subsp. paratuberculosis
cacgucggugccgcgu

SEQ ID NO: 2974029 - RNA, 16 nt, Mycobacterium avium subsp. paratuberculosis
cacgucguccggcgcg

SEQ ID NO: 2974030 - RNA, 14 nt, Mycobacterium avium subsp. paratuberculosis
cacgucgucggaca

SEQ ID NO: 2974031 - RNA, 17 nt, Mycobacterium avium subsp. paratuberculosis
cacgucgucggacagca

SEQ ID NO: 2974032 - RNA, 18 nt, Mycobacterium avium subsp. paratuberculosis
cacgucgucgugcgcggg

SEQ ID NO: 2974033 - RNA, 13 nt, Mycobacterium avium subsp. paratuberculosis
cacgucugcucgg

SEQ ID NO: 2974034 - RNA, 16 nt, Mycobacterium avium subsp. paratuberculosis
cacgucugcucggcgg

SEQ ID NO: 2974035 - RNA, 17 nt, Mycobacterium avium subsp. paratuberculosis
cacgucugcucggcggg

SEQ ID NO: 2974036 - RNA, 20 nt, Mycobacterium avium subsp. paratuberculosis
cacgucugcucggcggguca

SEQ ID NO: 2974037 - RNA, 15 nt, Mycobacterium avium subsp. paratuberculosis
cacgugauccaggua

SEQ ID NO: 2974038 - RNA, 16 nt, Mycobacterium avium subsp. paratuberculosis
cacgugcacccacgcc

SEQ ID NO: 2974039 - RNA, 20 nt, Mycobacterium avium subsp. paratuberculosis
cacgugcaccgcggccaacc

SEQ ID NO: 2974040 - RNA, 12 nt, Mycobacterium avium subsp. paratuberculosis
cacgugcacggc

SEQ ID NO: 2974041 - RNA, 13 nt, Mycobacterium avium subsp. paratuberculosis
cacgugcacggcg

SEQ ID NO: 2974042 - RNA, 14 nt, Mycobacterium avium subsp. paratuberculosis
cacgugcacggcgc

SEQ ID NO: 2974043 - RNA, 15 nt, Mycobacterium avium subsp. paratuberculosis
cacgugcacggcgcc

SEQ ID NO: 2974044 - RNA, 16 nt, Mycobacterium avium subsp. paratuberculosis
cacgugcacggcgccg

SEQ ID NO: 2974045 - RNA, 17 nt, Mycobacterium avium subsp. paratuberculosis
cacgugcacggcgccgu

SEQ ID NO: 2974046 - RNA, 22 nt, Mycobacterium avium subsp. paratuberculosis
cacgugcacggcgccgugccgc

SEQ ID NO: 2974047 - RNA, 14 nt, Mycobacterium avium subsp. paratuberculosis
cacgugcagcucgg

SEQ ID NO: 2974048 - RNA, 18 nt, Mycobacterium avium subsp. paratuberculosis
cacgugcaggugcggcac

SEQ ID NO: 2974049 - RNA, 23 nt, Mycobacterium avium subsp. paratuberculosis
cacgugcaggugcggcaccucca

SEQ ID NO: 2974050 - RNA, 13 nt, Mycobacterium avium subsp. paratuberculosis
cacgugccacugg

SEQ ID NO: 2974051 - RNA, 18 nt, Mycobacterium avium subsp. paratuberculosis
cacgugccacuggcgcca

SEQ ID NO: 2974052 - RNA, 20 nt, Mycobacterium avium subsp. paratuberculosis
cacgugccacuggcgccacc

SEQ ID NO: 2974053 - RNA, 16 nt, Mycobacterium avium subsp. paratuberculosis
cacgugcccagcccgc

SEQ ID NO: 2974054 - RNA, 14 nt, Mycobacterium avium subsp. paratuberculosis
cacgugcgcgaagc

SEQ ID NO: 2974055 - RNA, 12 nt, Mycobacterium avium subsp. paratuberculosis
cacgugcgcgcc

SEQ ID NO: 2974056 - RNA, 13 nt, Mycobacterium avium subsp. paratuberculosis
cacgugcgcgccg

SEQ ID NO: 2974057 - RNA, 14 nt, Mycobacterium avium subsp. paratuberculosis
cacgugcgcgccga

SEQ ID NO: 2974058 - RNA, 16 nt, Mycobacterium avium subsp. paratuberculosis
cacgugcgcgccgacc

SEQ ID NO: 2974059 - RNA, 17 nt, Mycobacterium avium subsp. paratuberculosis
cacgugcgcgccgaccg

SEQ ID NO: 2974060 - RNA, 16 nt, Mycobacterium avium subsp. paratuberculosis
cacgugcgcggcgucc

SEQ ID NO: 2974061 - RNA, 22 nt, Mycobacterium avium subsp. paratuberculosis
cacgugcgcggcguccaccagc

SEQ ID NO: 2974062 - RNA, 22 nt, Mycobacterium avium subsp. paratuberculosis
cacgugcgcgggaacgaucggc

SEQ ID NO: 2974063 - RNA, 13 nt, Mycobacterium avium subsp. paratuberculosis
cacgugcggaugg

SEQ ID NO: 2974064 - RNA, 19 nt, Mycobacterium avium subsp. paratuberculosis
cacgugcggauggccccgg

SEQ ID NO: 2974065 - RNA, 12 nt, Mycobacterium avium subsp. paratuberculosis
cacgugcggcgc

SEQ ID NO: 2974066 - RNA, 13 nt, Mycobacterium avium subsp. paratuberculosis
cacgugcggcgcc

SEQ ID NO: 2974067 - RNA, 15 nt, Mycobacterium avium subsp. paratuberculosis
cacgugcggcgcccu

SEQ ID NO: 2974068 - RNA, 18 nt, Mycobacterium avium subsp. paratuberculosis
cacgugcggguuggcgcc

SEQ ID NO: 2974069 - RNA, 13 nt, Mycobacterium avium subsp. paratuberculosis
cacgugcuggcgc

SEQ ID NO: 2974070 - RNA, 19 nt, Mycobacterium avium subsp. paratuberculosis
cacgugcuggcgcuugcgu

SEQ ID NO: 2974071 - RNA, 15 nt, Mycobacterium avium subsp. paratuberculosis
cacguggaccgagcg

SEQ ID NO: 2974072 - RNA, 16 nt, Mycobacterium avium subsp. paratuberculosis
cacguggaccgagcgc

SEQ ID NO: 2974073 - RNA, 18 nt, Mycobacterium avium subsp. paratuberculosis
cacguggaccgagcgcgc

SEQ ID NO: 2974074 - RNA, 13 nt, Mycobacterium avium subsp. paratuberculosis
cacguggccgggc

SEQ ID NO: 2974075 - RNA, 19 nt, Mycobacterium avium subsp. paratuberculosis
cacguggccgggcucgagu

SEQ ID NO: 2974076 - RNA, 21 nt, Mycobacterium avium subsp. paratuberculosis
cacguggcugaccgacggcga

SEQ ID NO: 2974077 - RNA, 14 nt, Mycobacterium avium subsp. paratuberculosis
cacguggucgagca

SEQ ID NO: 2974078 - RNA, 20 nt, Mycobacterium avium subsp. paratuberculosis
cacguggucgcugaccuucu

SEQ ID NO: 2974079 - RNA, 23 nt, Mycobacterium avium subsp. paratuberculosis
cacguggucgcugaccuucuugg

SEQ ID NO: 2974080 - RNA, 13 nt, Mycobacterium avium subsp. paratuberculosis
cacguggugaccg

SEQ ID NO: 2974081 - RNA, 17 nt, Mycobacterium avium subsp. paratuberculosis
cacguguccgacgccgu

SEQ ID NO: 2974082 - RNA, 20 nt, Mycobacterium avium subsp. paratuberculosis
cacguguccgacgccgucga

SEQ ID NO: 2974083 - RNA, 23 nt, Mycobacterium avium subsp. paratuberculosis
cacguguccgacgccgucgagcc

SEQ ID NO: 2974084 - RNA, 23 nt, Mycobacterium avium subsp. paratuberculosis
cacguguccgucgccggaggcga

SEQ ID NO: 2974085 - RNA, 14 nt, Mycobacterium avium subsp. paratuberculosis
cacgugucggcguc

SEQ ID NO: 2974086 - RNA, 23 nt, Mycobacterium avium subsp. paratuberculosis
cacguguucgggaucggcgccca

SEQ ID NO: 2974087 - RNA, 13 nt, Mycobacterium avium subsp. paratuberculosis
cacguguucucac

SEQ ID NO: 2974088 - RNA, 18 nt, Mycobacterium avium subsp. paratuberculosis
cacguguucucacggcga

SEQ ID NO: 2974089 - RNA, 14 nt, Mycobacterium avium subsp. paratuberculosis
cacguucgcggucg

SEQ ID NO: 2974090 - RNA, 14 nt, Mycobacterium avium subsp. paratuberculosis
cacguucggcgggc

SEQ ID NO: 2974091 - RNA, 17 nt, Mycobacterium avium subsp. paratuberculosis
cacguucggcgggcgcg

SEQ ID NO: 2974092 - RNA, 18 nt, Mycobacterium avium subsp. paratuberculosis
cacguucggcgggcgcgc

SEQ ID NO: 2974093 - RNA, 20 nt, Mycobacterium avium subsp. paratuberculosis
cacguucggcgggcgcgcgc

SEQ ID NO: 2974094 - RNA, 15 nt, Mycobacterium avium subsp. paratuberculosis
cacguugagcacgcc

SEQ ID NO: 2974095 - RNA, 17 nt, Mycobacterium avium subsp. paratuberculosis
cacguugagcacgcccg

SEQ ID NO: 2974096 - RNA, 20 nt, Mycobacterium avium subsp. paratuberculosis
cacguugagcacgcccgcga

SEQ ID NO: 2974097 - RNA, 20 nt, Mycobacterium avium subsp. paratuberculosis
cacguugagucccucggcga

SEQ ID NO: 2974098 - RNA, 22 nt, Mycobacterium avium subsp. paratuberculosis
cacguugauccgaugcagggcc

SEQ ID NO: 2974099 - RNA, 18 nt, Mycobacterium avium subsp. paratuberculosis
cacguugaugaucgccga

SEQ ID NO: 2974100 - RNA, 19 nt, Mycobacterium avium subsp. paratuberculosis
cacguugaugaucgccgau

SEQ ID NO: 2974101 - RNA, 13 nt, Mycobacterium avium subsp. paratuberculosis
cacguugaugccg

SEQ ID NO: 2974102 - RNA, 19 nt, Mycobacterium avium subsp. paratuberculosis
cacguugaugccgcccagc

SEQ ID NO: 2974103 - RNA, 16 nt, Mycobacterium avium subsp. paratuberculosis
cacguugcacggcagc

SEQ ID NO: 2974104 - RNA, 14 nt, Mycobacterium avium subsp. paratuberculosis
cacguugcccagga

SEQ ID NO: 2974105 - RNA, 19 nt, Mycobacterium avium subsp. paratuberculosis
cacguugcgcaucagcgcc

SEQ ID NO: 2974106 - RNA, 17 nt, Mycobacterium avium subsp. paratuberculosis
cacguugcgcggccgca

SEQ ID NO: 2974107 - RNA, 14 nt, Mycobacterium avium subsp. paratuberculosis
cacguuggcggcca

SEQ ID NO: 2974108 - RNA, 17 nt, Mycobacterium avium subsp. paratuberculosis
cacguuggcggccagcg

SEQ ID NO: 2974109 - RNA, 21 nt, Mycobacterium avium subsp. paratuberculosis
cacguuggcggccagcgcgcc

SEQ ID NO: 2974110 - RNA, 15 nt, Mycobacterium avium subsp. paratuberculosis
cacguugucgcggcc

SEQ ID NO: 2974111 - RNA, 17 nt, Mycobacterium avium subsp. paratuberculosis
cacguugucgcggccca

SEQ ID NO: 2974112 - RNA, 17 nt, Mycobacterium avium subsp. paratuberculosis
cacguugugcucgucga

SEQ ID NO: 2974113 - RNA, 13 nt, Mycobacterium avium subsp. paratuberculosis
cacuacccgcgau

SEQ ID NO: 2974114 - RNA, 14 nt, Mycobacterium avium subsp. paratuberculosis
cacuacccgcgaug

SEQ ID NO: 2974115 - RNA, 14 nt, Mycobacterium avium subsp. paratuberculosis
cacuaccgccucgc

SEQ ID NO: 2974116 - RNA, 16 nt, Mycobacterium avium subsp. paratuberculosis
cacuaccgccucgcca

SEQ ID NO: 2974117 - RNA, 21 nt, Mycobacterium avium subsp. paratuberculosis
cacuaccgccucgccagcccc

SEQ ID NO: 2974118 - RNA, 15 nt, Mycobacterium avium subsp. paratuberculosis
cacuagguccggcgc

SEQ ID NO: 2974119 - RNA, 17 nt, Mycobacterium avium subsp. paratuberculosis
cacuagguccggcgcga

SEQ ID NO: 2974120 - RNA, 20 nt, Mycobacterium avium subsp. paratuberculosis
cacuagguccggcgcgacca

SEQ ID NO: 2974121 - RNA, 16 nt, Mycobacterium avium subsp. paratuberculosis
cacucagagcagcgcc

SEQ ID NO: 2974122 - RNA, 14 nt, Mycobacterium avium subsp. paratuberculosis
cacucauguucagg

SEQ ID NO: 2974123 - RNA, 16 nt, Mycobacterium avium subsp. paratuberculosis
cacuccaccaccggcc

SEQ ID NO: 2974124 - RNA, 17 nt, Mycobacterium avium subsp. paratuberculosis
cacuccagcggcggccc

SEQ ID NO: 2974125 - RNA, 20 nt, Mycobacterium avium subsp. paratuberculosis
cacuccaggguucucgcggc

SEQ ID NO: 2974126 - RNA, 23 nt, Mycobacterium avium subsp. paratuberculosis
cacuccaggguucucgcggcggc

SEQ ID NO: 2974127 - RNA, 15 nt, Mycobacterium avium subsp. paratuberculosis
cacucccagccgccg

SEQ ID NO: 2974128 - RNA, 13 nt, Mycobacterium avium subsp. paratuberculosis
cacucccgcgcgc

SEQ ID NO: 2974129 - RNA, 23 nt, Mycobacterium avium subsp. paratuberculosis
cacucccgcgcgcuguccucguc

SEQ ID NO: 2974130 - RNA, 17 nt, Mycobacterium avium subsp. paratuberculosis
cacuccucgaucugggc

SEQ ID NO: 2974131 - RNA, 16 nt, Mycobacterium avium subsp. paratuberculosis
cacucgaacggcccgg

SEQ ID NO: 2974132 - RNA, 23 nt, Mycobacterium avium subsp. paratuberculosis
cacucgaacggcccggacggagc

SEQ ID NO: 2974133 - RNA, 14 nt, Mycobacterium avium subsp. paratuberculosis
cacucgagcgcgcu

SEQ ID NO: 2974134 - RNA, 14 nt, Mycobacterium avium subsp. paratuberculosis
cacucgaucagcac

SEQ ID NO: 2974135 - RNA, 17 nt, Mycobacterium avium subsp. paratuberculosis
cacucgaucagcaccgc

SEQ ID NO: 2974136 - RNA, 19 nt, Mycobacterium avium subsp. paratuberculosis
cacucgaucagcaccgcca

SEQ ID NO: 2974137 - RNA, 21 nt, Mycobacterium avium subsp. paratuberculosis
cacucgaucagcaccgccacg

SEQ ID NO: 2974138 - RNA, 18 nt, Mycobacterium avium subsp. paratuberculosis
cacucgauggcggcgaug

SEQ ID NO: 2974139 - RNA, 15 nt, Mycobacterium avium subsp. paratuberculosis
cacucgcccagggcg

SEQ ID NO: 2974140 - RNA, 17 nt, Mycobacterium avium subsp. paratuberculosis
cacucgccgcgaacgac

SEQ ID NO: 2974141 - RNA, 17 nt, Mycobacterium avium subsp. paratuberculosis
cacucgccucggaggcc

SEQ ID NO: 2974142 - RNA, 16 nt, Mycobacterium avium subsp. paratuberculosis
cacucgcgggacggcg

SEQ ID NO: 2974143 - RNA, 17 nt, Mycobacterium avium subsp. paratuberculosis
cacucgcgggacggcgg

SEQ ID NO: 2974144 - RNA, 18 nt, Mycobacterium avium subsp. paratuberculosis
cacucgcgggacggcggc

SEQ ID NO: 2974145 - RNA, 19 nt, Mycobacterium avium subsp. paratuberculosis
cacucgcgggacggcggcg

SEQ ID NO: 2974146 - RNA, 20 nt, Mycobacterium avium subsp. paratuberculosis
cacucgcgggacggcggcga

SEQ ID NO: 2974147 - RNA, 18 nt, Mycobacterium avium subsp. paratuberculosis
cacucgcguccccgcgcc

SEQ ID NO: 2974148 - RNA, 20 nt, Mycobacterium avium subsp. paratuberculosis
cacucgcguccccgcgccgg

SEQ ID NO: 2974149 - RNA, 22 nt, Mycobacterium avium subsp. paratuberculosis
cacucggacagguggccgauca

SEQ ID NO: 2974150 - RNA, 13 nt, Mycobacterium avium subsp. paratuberculosis
cacucggcgaugc

SEQ ID NO: 2974151 - RNA, 14 nt, Mycobacterium avium subsp. paratuberculosis
cacucggcgaugcg

SEQ ID NO: 2974152 - RNA, 18 nt, Mycobacterium avium subsp. paratuberculosis
cacucggcgaugcgccgu

SEQ ID NO: 2974153 - RNA, 23 nt, Mycobacterium avium subsp. paratuberculosis
cacucgggaaaugcgucggcagu

SEQ ID NO: 2974154 - RNA, 15 nt, Mycobacterium avium subsp. paratuberculosis
cacucgggccagccc

SEQ ID NO: 2974155 - RNA, 16 nt, Mycobacterium avium subsp. paratuberculosis
cacucgggccagccca

SEQ ID NO: 2974156 - RNA, 12 nt, Mycobacterium avium subsp. paratuberculosis
cacucgucgacg

SEQ ID NO: 2974157 - RNA, 12 nt, Mycobacterium avium subsp. paratuberculosis
cacucgucgauc

SEQ ID NO: 2974158 - RNA, 16 nt, Mycobacterium avium subsp. paratuberculosis
cacucgucgaucgacg

SEQ ID NO: 2974159 - RNA, 19 nt, Mycobacterium avium subsp. paratuberculosis
cacucgucgaucgacgccg

SEQ ID NO: 2974160 - RNA, 22 nt, Mycobacterium avium subsp. paratuberculosis
cacucgucgaucgacgccgaca

SEQ ID NO: 2974161 - RNA, 19 nt, Mycobacterium avium subsp. paratuberculosis
cacucgucgaugucgaucu

SEQ ID NO: 2974162 - RNA, 19 nt, Mycobacterium avium subsp. paratuberculosis
cacucucgcggcaaggcgc

SEQ ID NO: 2974163 - RNA, 15 nt, Mycobacterium avium subsp. paratuberculosis
cacucuggcgugacg

SEQ ID NO: 2974164 - RNA, 17 nt, Mycobacterium avium subsp. paratuberculosis
cacucuggcgugacgcu

SEQ ID NO: 2974165 - RNA, 23 nt, Mycobacterium avium subsp. paratuberculosis
cacucuggcgugacgcucggcgc

SEQ ID NO: 2974166 - RNA, 19 nt, Mycobacterium avium subsp. paratuberculosis
cacucuggcgugacguucg

SEQ ID NO: 2974167 - RNA, 16 nt, Mycobacterium avium subsp. paratuberculosis
cacugagcgcaggccg

SEQ ID NO: 2974168 - RNA, 16 nt, Mycobacterium avium subsp. paratuberculosis
cacugaucccuccguc

SEQ ID NO: 2974169 - RNA, 15 nt, Mycobacterium avium subsp. paratuberculosis
cacugauccgucauc

SEQ ID NO: 2974170 - RNA, 20 nt, Mycobacterium avium subsp. paratuberculosis
cacugcaacuacgcacccga

SEQ ID NO: 2974171 - RNA, 22 nt, Mycobacterium avium subsp. paratuberculosis
cacugcaacuacgcacccgaca

SEQ ID NO: 2974172 - RNA, 13 nt, Mycobacterium avium subsp. paratuberculosis
cacugcacgcacg

SEQ ID NO: 2974173 - RNA, 15 nt, Mycobacterium avium subsp. paratuberculosis
cacugcacgcacggc

SEQ ID NO: 2974174 - RNA, 17 nt, Mycobacterium avium subsp. paratuberculosis
cacugcacgcacggcga

SEQ ID NO: 2974175 - RNA, 20 nt, Mycobacterium avium subsp. paratuberculosis
cacugcacgcacggcgaacg

SEQ ID NO: 2974176 - RNA, 21 nt, Mycobacterium avium subsp. paratuberculosis
cacugcaucucgaccuggguc

SEQ ID NO: 2974177 - RNA, 23 nt, Mycobacterium avium subsp. paratuberculosis
cacugccaagacguccgcgucgg

SEQ ID NO: 2974178 - RNA, 24 nt, Mycobacterium avium subsp. paratuberculosis
cacugccaagacguccgcgucggc

SEQ ID NO: 2974179 - RNA, 19 nt, Mycobacterium avium subsp. paratuberculosis
cacugccccggcgaacgcc

SEQ ID NO: 2974180 - RNA, 23 nt, Mycobacterium avium subsp. paratuberculosis
cacugccccggcgaacgccucgg

SEQ ID NO: 2974181 - RNA, 14 nt, Mycobacterium avium subsp. paratuberculosis
cacugcccgcaucg

SEQ ID NO: 2974182 - RNA, 18 nt, Mycobacterium avium subsp. paratuberculosis
cacugcccgcaucgcaca

SEQ ID NO: 2974183 - RNA, 15 nt, Mycobacterium avium subsp. paratuberculosis
cacugcccguagucg

SEQ ID NO: 2974184 - RNA, 14 nt, Mycobacterium avium subsp. paratuberculosis
cacugccgccgccc

SEQ ID NO: 2974185 - RNA, 16 nt, Mycobacterium avium subsp. paratuberculosis
cacugccgccgcccag

SEQ ID NO: 2974186 - RNA, 21 nt, Mycobacterium avium subsp. paratuberculosis
cacugccugacccggccgugc

SEQ ID NO: 2974187 - RNA, 22 nt, Mycobacterium avium subsp. paratuberculosis
cacugcgccgucaucgacaccg

SEQ ID NO: 2974188 - RNA, 13 nt, Mycobacterium avium subsp. paratuberculosis
cacugcgcgcccg

SEQ ID NO: 2974189 - RNA, 21 nt, Mycobacterium avium subsp. paratuberculosis
cacugcgguagaggcgggcgu

SEQ ID NO: 2974190 - RNA, 17 nt, Mycobacterium avium subsp. paratuberculosis
cacugcugcccgcgacg

SEQ ID NO: 2974191 - RNA, 21 nt, Mycobacterium avium subsp. paratuberculosis
cacugcugcccgcgacggcga

SEQ ID NO: 2974192 - RNA, 16 nt, Mycobacterium avium subsp. paratuberculosis
cacugcuucgggucgc

SEQ ID NO: 2974193 - RNA, 17 nt, Mycobacterium avium subsp. paratuberculosis
caccuguacgugucccu

SEQ ID NO: 2974194 - RNA, 16 nt, Mycobacterium avium subsp. paratuberculosis
caccuucaccgcgccg

SEQ ID NO: 2974195 - RNA, 14 nt, Mycobacterium avium subsp. paratuberculosis
caccuucaucgccg

SEQ ID NO: 2974196 - RNA, 16 nt, Mycobacterium avium subsp. paratuberculosis
caccuucaucgccguc

SEQ ID NO: 2974197 - RNA, 17 nt, Mycobacterium avium subsp. paratuberculosis
caccuucaucgccgucg

SEQ ID NO: 2974198 - RNA, 18 nt, Mycobacterium avium subsp. paratuberculosis
caccuuccaccaccgcgg

SEQ ID NO: 2974199 - RNA, 21 nt, Mycobacterium avium subsp. paratuberculosis
caccuuccaccaccgcggcgc

SEQ ID NO: 2974200 - RNA, 18 nt, Mycobacterium avium subsp. paratuberculosis
caccuuccaucgacgcug

SEQ ID NO: 2974201 - RNA, 19 nt, Mycobacterium avium subsp. paratuberculosis
caccuucgcggucggcaac

SEQ ID NO: 2974202 - RNA, 12 nt, Mycobacterium avium subsp. paratuberculosis
caccuucugcgc

SEQ ID NO: 2974203 - RNA, 16 nt, Mycobacterium avium subsp. paratuberculosis
caccuucugcgcgccg

SEQ ID NO: 2974204 - RNA, 18 nt, Mycobacterium avium subsp. paratuberculosis
caccuucugcgcgccguc

SEQ ID NO: 2974205 - RNA, 22 nt, Mycobacterium avium subsp. paratuberculosis
caccuucugcgcgccgucggcg

SEQ ID NO: 2974206 - RNA, 22 nt, Mycobacterium avium subsp. paratuberculosis
caccuugaccaugaguugcggg

SEQ ID NO: 2974207 - RNA, 23 nt, Mycobacterium avium subsp. paratuberculosis
caccuugcccugcgugcagacaa

SEQ ID NO: 2974208 - RNA, 17 nt, Mycobacterium avium subsp. paratuberculosis
caccuugcgcagcagca

SEQ ID NO: 2974209 - RNA, 22 nt, Mycobacterium avium subsp. paratuberculosis
caccuugcgcccguagcggcgg

SEQ ID NO: 2974210 - RNA, 16 nt, Mycobacterium avium subsp. paratuberculosis
caccuugcggccggcg

SEQ ID NO: 2974211 - RNA, 20 nt, Mycobacterium avium subsp. paratuberculosis
caccuuggacaggcccagcg

SEQ ID NO: 2974212 - RNA, 22 nt, Mycobacterium avium subsp. paratuberculosis
caccuuggacaggcccagcggc

SEQ ID NO: 2974213 - RNA, 23 nt, Mycobacterium avium subsp. paratuberculosis
caccuuggacaggcccagcggcu

SEQ ID NO: 2974214 - RNA, 19 nt, Mycobacterium avium subsp. paratuberculosis
caccuuggcggccaccauc

SEQ ID NO: 2974215 - RNA, 20 nt, Mycobacterium avium subsp. paratuberculosis
caccuuggugagcaccgcga

SEQ ID NO: 2974216 - RNA, 18 nt, Mycobacterium avium subsp. paratuberculosis
caccuugguggccgcggc

SEQ ID NO: 2974217 - RNA, 15 nt, Mycobacterium avium subsp. paratuberculosis
caccuugucaccgaa

SEQ ID NO: 2974218 - RNA, 14 nt, Mycobacterium avium subsp. paratuberculosis
caccuugucgcuga

SEQ ID NO: 2974219 - RNA, 14 nt, Mycobacterium avium subsp. paratuberculosis
caccuugucggcgc

SEQ ID NO: 2974220 - RNA, 14 nt, Mycobacterium avium subsp. paratuberculosis
caccuuguugcggg

SEQ ID NO: 2974221 - RNA, 21 nt, Mycobacterium avium subsp. paratuberculosis
cacgaaaccgcguggcgcaca

SEQ ID NO: 2974222 - RNA, 22 nt, Mycobacterium avium subsp. paratuberculosis
cacgaaacugaccuucucccgc

SEQ ID NO: 2974223 - RNA, 23 nt, Mycobacterium avium subsp. paratuberculosis
cacgaaacugaccuucucccgcg

SEQ ID NO: 2974224 - RNA, 17 nt, Mycobacterium avium subsp. paratuberculosis
cacgaaauaaccgcgcg

SEQ ID NO: 2974225 - RNA, 20 nt, Mycobacterium avium subsp. paratuberculosis
cacgaaauaaccgcgcggcg

SEQ ID NO: 2974226 - RNA, 23 nt, Mycobacterium avium subsp. paratuberculosis
cacgaacaccacguagccgaccu

SEQ ID NO: 2974227 - RNA, 14 nt, Mycobacterium avium subsp. paratuberculosis
cacgaacaccggcg

SEQ ID NO: 2974228 - RNA, 17 nt, Mycobacterium avium subsp. paratuberculosis
cacgaacaccggcgcga

SEQ ID NO: 2974229 - RNA, 16 nt, Mycobacterium avium subsp. paratuberculosis
cacgaaccaggcgccg

SEQ ID NO: 2974230 - RNA, 17 nt, Mycobacterium avium subsp. paratuberculosis
cacgaaccaggcgccgg

SEQ ID NO: 2974231 - RNA, 23 nt, Mycobacterium avium subsp. paratuberculosis
cacgaaccaggcgccggccagca

SEQ ID NO: 2974232 - RNA, 15 nt, Mycobacterium avium subsp. paratuberculosis
cacgaacccggcggc

SEQ ID NO: 2974233 - RNA, 16 nt, Mycobacterium avium subsp. paratuberculosis
cacgaacccggcggcc

SEQ ID NO: 2974234 - RNA, 14 nt, Mycobacterium avium subsp. paratuberculosis
cacgaaccgcucga

SEQ ID NO: 2974235 - RNA, 13 nt, Mycobacterium avium subsp. paratuberculosis
cacgaacgacgcg

SEQ ID NO: 2974236 - RNA, 15 nt, Mycobacterium avium subsp. paratuberculosis
cacgaacgacgcggc

SEQ ID NO: 2974237 - RNA, 16 nt, Mycobacterium avium subsp. paratuberculosis
cacgaacgacgcggca

SEQ ID NO: 2974238 - RNA, 22 nt, Mycobacterium avium subsp. paratuberculosis
cacgaacgacgcggcacgccgc

SEQ ID NO: 2974239 - RNA, 16 nt, Mycobacterium avium subsp. paratuberculosis
cacgaacgcgccgccg

SEQ ID NO: 2974240 - RNA, 17 nt, Mycobacterium avium subsp. paratuberculosis
cacgaacgcgccgccga

SEQ ID NO: 2974241 - RNA, 14 nt, Mycobacterium avium subsp. paratuberculosis
cacgaacgcggcca

SEQ ID NO: 2974242 - RNA, 18 nt, Mycobacterium avium subsp. paratuberculosis
cacgaacgcggccagcgg

SEQ ID NO: 2974243 - RNA, 14 nt, Mycobacterium avium subsp. paratuberculosis
cacgaacgcggccg

SEQ ID NO: 2974244 - RNA, 15 nt, Mycobacterium avium subsp. paratuberculosis
cacgaacgcggccgc

SEQ ID NO: 2974245 - RNA, 17 nt, Mycobacterium avium subsp. paratuberculosis
cacgaacgcggccgcca

SEQ ID NO: 2974246 - RNA, 19 nt, Mycobacterium avium subsp. paratuberculosis
cacgaacgcggccgccauc

SEQ ID NO: 2974247 - RNA, 23 nt, Mycobacterium avium subsp. paratuberculosis
cacgaacgcguucgucggcgcgu

SEQ ID NO: 2974248 - RNA, 19 nt, Mycobacterium avium subsp. paratuberculosis
cacgaacgcugccaggcgg

SEQ ID NO: 2974249 - RNA, 12 nt, Mycobacterium avium subsp. paratuberculosis
cacgaacggcgc

SEQ ID NO: 2974250 - RNA, 14 nt, Mycobacterium avium subsp. paratuberculosis
cacgaacggcgccu

SEQ ID NO: 2974251 - RNA, 14 nt, Mycobacterium avium subsp. paratuberculosis
cacgaacggcgcga

SEQ ID NO: 2974252 - RNA, 20 nt, Mycobacterium avium subsp. paratuberculosis
cacgaacuccuugacccggc

SEQ ID NO: 2974253 - RNA, 22 nt, Mycobacterium avium subsp. paratuberculosis
cacgaacuccuugacccggccc

SEQ ID NO: 2974254 - RNA, 21 nt, Mycobacterium avium subsp. paratuberculosis
cacgaagaugaucagcgcgcc

SEQ ID NO: 2974255 - RNA, 12 nt, Mycobacterium avium subsp. paratuberculosis
cacgaagccgaa

SEQ ID NO: 2974256 - RNA, 22 nt, Mycobacterium avium subsp. paratuberculosis
cacgaagccgaacgacagcagg

SEQ ID NO: 2974257 - RNA, 14 nt, Mycobacterium avium subsp. paratuberculosis
cacgaagcgggcgg

SEQ ID NO: 2974258 - RNA, 15 nt, Mycobacterium avium subsp. paratuberculosis
cacgaaggccgccgg

SEQ ID NO: 2974259 - RNA, 13 nt, Mycobacterium avium subsp. paratuberculosis
cacgaagggcgcc

SEQ ID NO: 2974260 - RNA, 14 nt, Mycobacterium avium subsp. paratuberculosis
cacgaagggcgcca

SEQ ID NO: 2974261 - RNA, 17 nt, Mycobacterium avium subsp. paratuberculosis
cacgaagggcgccagca

SEQ ID NO: 2974262 - RNA, 18 nt, Mycobacterium avium subsp. paratuberculosis
cacgaagucgaccgcggc

SEQ ID NO: 2974263 - RNA, 19 nt, Mycobacterium avium subsp. paratuberculosis
cacgaagugcccggcgccg

SEQ ID NO: 2974264 - RNA, 14 nt, Mycobacterium avium subsp. paratuberculosis
cacgaaguugaucg

SEQ ID NO: 2974265 - RNA, 22 nt, Mycobacterium avium subsp. paratuberculosis
cacgaaguugguguccacccgc

SEQ ID NO: 2974266 - RNA, 19 nt, Mycobacterium avium subsp. paratuberculosis
cacgaauguucccuuuggu

SEQ ID NO: 2974267 - RNA, 17 nt, Mycobacterium avium subsp. paratuberculosis
cacgaauucgguggcga

SEQ ID NO: 2974268 - RNA, 13 nt, Mycobacterium avium subsp. paratuberculosis
cacgacaccagcg

SEQ ID NO: 2974269 - RNA, 13 nt, Mycobacterium avium subsp. paratuberculosis
cacgacaccgacg

SEQ ID NO: 2974270 - RNA, 14 nt, Mycobacterium avium subsp. paratuberculosis
cacgacaccgacga

SEQ ID NO: 2974271 - RNA, 16 nt, Mycobacterium avium subsp. paratuberculosis
cacgacaccgacgacc

SEQ ID NO: 2974272 - RNA, 13 nt, Mycobacterium avium subsp. paratuberculosis
cacgaccacaccc

SEQ ID NO: 2974273 - RNA, 14 nt, Mycobacterium avium subsp. paratuberculosis
cacgaccacacccg

SEQ ID NO: 2974274 - RNA, 16 nt, Mycobacterium avium subsp. paratuberculosis
cacgaccacacccgca

SEQ ID NO: 2974275 - RNA, 18 nt, Mycobacterium avium subsp. paratuberculosis
cacgaccacacccgcacg

SEQ ID NO: 2974276 - RNA, 13 nt, Mycobacterium avium subsp. paratuberculosis
cacgaccagcggc

SEQ ID NO: 2974277 - RNA, 20 nt, Mycobacterium avium subsp. paratuberculosis
cacgaccagugcccggccaa

SEQ ID NO: 2974278 - RNA, 14 nt, Mycobacterium avium subsp. paratuberculosis
caccgaccagcugu

SEQ ID NO: 2974279 - RNA, 20 nt, Mycobacterium avium subsp. paratuberculosis
caccgaccccucggcggccg

SEQ ID NO: 2974280 - RNA, 15 nt, Mycobacterium avium subsp. paratuberculosis
caccgaccccugcac

SEQ ID NO: 2974281 - RNA, 22 nt, Mycobacterium avium subsp. paratuberculosis
caccgacgaccaucagcgcccg

SEQ ID NO: 2974282 - RNA, 21 nt, Mycobacterium avium subsp. paratuberculosis
caccgacgaccucggugucga

SEQ ID NO: 2974283 - RNA, 13 nt, Mycobacterium avium subsp. paratuberculosis
caccgacgcaucc

SEQ ID NO: 2974284 - RNA, 15 nt, Mycobacterium avium subsp. paratuberculosis
caccgacgccagcgg

SEQ ID NO: 2974285 - RNA, 13 nt, Mycobacterium avium subsp. paratuberculosis
caccgacgcggcg

SEQ ID NO: 2974286 - RNA, 15 nt, Mycobacterium avium subsp. paratuberculosis
caccgacgcggcgac

SEQ ID NO: 2974287 - RNA, 15 nt, Mycobacterium avium subsp. paratuberculosis
caccgacgcgucgcg

SEQ ID NO: 2974288 - RNA, 16 nt, Mycobacterium avium subsp. paratuberculosis
caccgacgcgucgcgg

SEQ ID NO: 2974289 - RNA, 17 nt, Mycobacterium avium subsp. paratuberculosis
caccgacgcgucgcggc

SEQ ID NO: 2974290 - RNA, 19 nt, Mycobacterium avium subsp. paratuberculosis
caccgacgcgucgcggcgg

SEQ ID NO: 2974291 - RNA, 22 nt, Mycobacterium avium subsp. paratuberculosis
caccgacgcgucgcggcggggg

SEQ ID NO: 2974292 - RNA, 22 nt, Mycobacterium avium subsp. paratuberculosis
caccgacggagccgagcaccag

SEQ ID NO: 2974293 - RNA, 15 nt, Mycobacterium avium subsp. paratuberculosis
caccgacuccuccgg

SEQ ID NO: 2974294 - RNA, 16 nt, Mycobacterium avium subsp. paratuberculosis
caccgacuccuccggc

SEQ ID NO: 2974295 - RNA, 19 nt, Mycobacterium avium subsp. paratuberculosis
caccgacuccuccggcccg

SEQ ID NO: 2974296 - RNA, 21 nt, Mycobacterium avium subsp. paratuberculosis
caccgacuccuccggcccgau

SEQ ID NO: 2974297 - RNA, 14 nt, Mycobacterium avium subsp. paratuberculosis
caccgacuccuugg

SEQ ID NO: 2974298 - RNA, 14 nt, Mycobacterium avium subsp. paratuberculosis
caccgacugcgacg

SEQ ID NO: 2974299 - RNA, 14 nt, Mycobacterium avium subsp. paratuberculosis
caccgacugcggcg

SEQ ID NO: 2974300 - RNA, 15 nt, Mycobacterium avium subsp. paratuberculosis
caccgacugcggcgc

SEQ ID NO: 2974301 - RNA, 13 nt, Mycobacterium avium subsp. paratuberculosis
caccgagaccaug

SEQ ID NO: 2974302 - RNA, 19 nt, Mycobacterium avium subsp. paratuberculosis
caccgagaccaugccgccg

SEQ ID NO: 2974303 - RNA, 17 nt, Mycobacterium avium subsp. paratuberculosis
caccgagauggccacca

SEQ ID NO: 2974304 - RNA, 13 nt, Mycobacterium avium subsp. paratuberculosis
caccgagccggcg

SEQ ID NO: 2974305 - RNA, 16 nt, Mycobacterium avium subsp. paratuberculosis
caccgagccggcggcg

SEQ ID NO: 2974306 - RNA, 15 nt, Mycobacterium avium subsp. paratuberculosis
caccgagccggcguc

SEQ ID NO: 2974307 - RNA, 16 nt, Mycobacterium avium subsp. paratuberculosis
caccgagccggcgucg

SEQ ID NO: 2974308 - RNA, 20 nt, Mycobacterium avium subsp. paratuberculosis
caccgagccggcgucgccgc

SEQ ID NO: 2974309 - RNA, 22 nt, Mycobacterium avium subsp. paratuberculosis
caccgagccggcgucgccgcug

SEQ ID NO: 2974310 - RNA, 14 nt, Mycobacterium avium subsp. paratuberculosis
caccgagccgggca

SEQ ID NO: 2974311 - RNA, 16 nt, Mycobacterium avium subsp. paratuberculosis
caccgagccgggcagc

SEQ ID NO: 2974312 - RNA, 22 nt, Mycobacterium avium subsp. paratuberculosis
caccgagccgggcagcgcgaca

SEQ ID NO: 2974313 - RNA, 17 nt, Mycobacterium avium subsp. paratuberculosis
caccgagccggugccgc

SEQ ID NO: 2974314 - RNA, 18 nt, Mycobacterium avium subsp. paratuberculosis
caccgagcgagcgcacca

SEQ ID NO: 2974315 - RNA, 14 nt, Mycobacterium avium subsp. paratuberculosis
caccgagcggggug

SEQ ID NO: 2974316 - RNA, 13 nt, Mycobacterium avium subsp. paratuberculosis
caccgagcugggc

SEQ ID NO: 2974317 - RNA, 14 nt, Mycobacterium avium subsp. paratuberculosis
caccgagcugggcc

SEQ ID NO: 2974318 - RNA, 17 nt, Mycobacterium avium subsp. paratuberculosis
caccgagcugggccggc

SEQ ID NO: 2974319 - RNA, 20 nt, Mycobacterium avium subsp. paratuberculosis
caccgagcugggccggcgcc

SEQ ID NO: 2974320 - RNA, 23 nt, Mycobacterium avium subsp. paratuberculosis
caccgagcugggccggcgccgaa

SEQ ID NO: 2974321 - RNA, 13 nt, Mycobacterium avium subsp. paratuberculosis
caccgaggugacg

SEQ ID NO: 2974322 - RNA, 23 nt, Mycobacterium avium subsp. paratuberculosis
caccgaggugacgucgcgccgcu

SEQ ID NO: 2974323 - RNA, 17 nt, Mycobacterium avium subsp. paratuberculosis
caccgagguggcccagc

SEQ ID NO: 2974324 - RNA, 23 nt, Mycobacterium avium subsp. paratuberculosis
caccgagguggcccagccgcuga

SEQ ID NO: 2974325 - RNA, 24 nt, Mycobacterium avium subsp. paratuberculosis
caccgagguggcccagccgcugac

SEQ ID NO: 2974326 - RNA, 16 nt, Mycobacterium avium subsp. paratuberculosis
caccgagucgcgcgac

SEQ ID NO: 2974327 - RNA, 17 nt, Mycobacterium avium subsp. paratuberculosis
caccgagucgcgcgacc

SEQ ID NO: 2974328 - RNA, 16 nt, Mycobacterium avium subsp. paratuberculosis
caccgagugcggcgcg

SEQ ID NO: 2974329 - RNA, 21 nt, Mycobacterium avium subsp. paratuberculosis
caccgaucaggaucggcgggc

SEQ ID NO: 2974330 - RNA, 16 nt, Mycobacterium avium subsp. paratuberculosis
caccgaucgcgagggc

SEQ ID NO: 2974331 - RNA, 12 nt, Mycobacterium avium subsp. paratuberculosis
caccgaucggca

SEQ ID NO: 2974332 - RNA, 14 nt, Mycobacterium avium subsp. paratuberculosis
caccgaucggcacg

SEQ ID NO: 2974333 - RNA, 18 nt, Mycobacterium avium subsp. paratuberculosis
caccgaugcgggccagga

SEQ ID NO: 2974334 - RNA, 19 nt, Mycobacterium avium subsp. paratuberculosis
caccgauggguuggccguc

SEQ ID NO: 2974335 - RNA, 20 nt, Mycobacterium avium subsp. paratuberculosis
caccgauggguuggccgucg

SEQ ID NO: 2974336 - RNA, 22 nt, Mycobacterium avium subsp. paratuberculosis
caccgauggguuggccgucgcg

SEQ ID NO: 2974337 - RNA, 17 nt, Mycobacterium avium subsp. paratuberculosis
caccgcaaagcaccgcg

SEQ ID NO: 2974338 - RNA, 18 nt, Mycobacterium avium subsp. paratuberculosis
caccgcaaagcaccgcga

SEQ ID NO: 2974339 - RNA, 21 nt, Mycobacterium avium subsp. paratuberculosis
caccgcaaagcaccgcgaaca

SEQ ID NO: 2974340 - RNA, 14 nt, Mycobacterium avium subsp. paratuberculosis
caccgcaccgacga

SEQ ID NO: 2974341 - RNA, 17 nt, Mycobacterium avium subsp. paratuberculosis
caccgcacggcccauca

SEQ ID NO: 2974342 - RNA, 22 nt, Mycobacterium avium subsp. paratuberculosis
caccgcacggcccaucaccagc

SEQ ID NO: 2974343 - RNA, 19 nt, Mycobacterium avium subsp. paratuberculosis
caccgcauaggaccggaug

SEQ ID NO: 2974344 - RNA, 19 nt, Mycobacterium avium subsp. paratuberculosis
caccgcaucgaaccgccgc

SEQ ID NO: 2974345 - RNA, 20 nt, Mycobacterium avium subsp. paratuberculosis
caccgcaucgaaccgccgcg

SEQ ID NO: 2974346 - RNA, 21 nt, Mycobacterium avium subsp. paratuberculosis
caccgcaucgaaccgccgcgc

SEQ ID NO: 2974347 - RNA, 22 nt, Mycobacterium avium subsp. paratuberculosis
caccgcaucgaaccgccgcgcu

SEQ ID NO: 2974348 - RNA, 15 nt, Mycobacterium avium subsp. paratuberculosis
caccgcaucgccgag

SEQ ID NO: 2974349 - RNA, 16 nt, Mycobacterium avium subsp. paratuberculosis
caccgcaucgccgagg

SEQ ID NO: 2974350 - RNA, 22 nt, Mycobacterium avium subsp. paratuberculosis
caccgcaucgccgagggcgacg

SEQ ID NO: 2974351 - RNA, 23 nt, Mycobacterium avium subsp. paratuberculosis
caccgcauggggcaguagcgacg

SEQ ID NO: 2974352 - RNA, 17 nt, Mycobacterium avium subsp. paratuberculosis
caccgcauuugccgaca

SEQ ID NO: 2974353 - RNA, 20 nt, Mycobacterium avium subsp. paratuberculosis
caccgcauuugccgacaugc

SEQ ID NO: 2974354 - RNA, 14 nt, Mycobacterium avium subsp. paratuberculosis
caccgccaccagca

SEQ ID NO: 2974355 - RNA, 15 nt, Mycobacterium avium subsp. paratuberculosis
caccgccaccagcag

SEQ ID NO: 2974356 - RNA, 18 nt, Mycobacterium avium subsp. paratuberculosis
caccgccaccagcaggcc

SEQ ID NO: 2974357 - RNA, 20 nt, Mycobacterium avium subsp. paratuberculosis
caccgccaccagcaggccca

SEQ ID NO: 2974358 - RNA, 16 nt, Mycobacterium avium subsp. paratuberculosis
caccgccaccagcgca

SEQ ID NO: 2974359 - RNA, 18 nt, Mycobacterium avium subsp. paratuberculosis
caccgccaccagcgcaca

SEQ ID NO: 2974360 - RNA, 16 nt, Mycobacterium avium subsp. paratuberculosis
caccgccaccaggccg

SEQ ID NO: 2974361 - RNA, 15 nt, Mycobacterium avium subsp. paratuberculosis
caccgccaccgcccg

SEQ ID NO: 2974362 - RNA, 16 nt, Mycobacterium avium subsp. paratuberculosis
caccgccaccgcccgc

SEQ ID NO: 2974363 - RNA, 21 nt, Mycobacterium avium subsp. paratuberculosis
caacuggucgugcagcaccgc

SEQ ID NO: 2974364 - RNA, 19 nt, Mycobacterium avium subsp. paratuberculosis
caacuggucgugcucgucg

SEQ ID NO: 2974365 - RNA, 20 nt, Mycobacterium avium subsp. paratuberculosis
caacuggucgugcucgucgg

SEQ ID NO: 2974366 - RNA, 21 nt, Mycobacterium avium subsp. paratuberculosis
caacuggucgugcucgucggc

SEQ ID NO: 2974367 - RNA, 23 nt, Mycobacterium avium subsp. paratuberculosis
caacuggucgugcucgucggcgg

SEQ ID NO: 2974368 - RNA, 18 nt, Mycobacterium avium subsp. paratuberculosis
caacuguucgcggcuggc

SEQ ID NO: 2974369 - RNA, 17 nt, Mycobacterium avium subsp. paratuberculosis
caagaagugggccauca

SEQ ID NO: 2974370 - RNA, 20 nt, Mycobacterium avium subsp. paratuberculosis
caagaaguuuccccaccagg

SEQ ID NO: 2974371 - RNA, 21 nt, Mycobacterium avium subsp. paratuberculosis
caagaaguuuccccaccaggc

SEQ ID NO: 2974372 - RNA, 18 nt, Mycobacterium avium subsp. paratuberculosis
caagacaauucgcugccc

SEQ ID NO: 2974373 - RNA, 14 nt, Mycobacterium avium subsp. paratuberculosis
caagacccgcguca

SEQ ID NO: 2974374 - RNA, 13 nt, Mycobacterium avium subsp. paratuberculosis
caagaccgcgguc

SEQ ID NO: 2974375 - RNA, 16 nt, Mycobacterium avium subsp. paratuberculosis
caagaccgcggucacc

SEQ ID NO: 2974376 - RNA, 17 nt, Mycobacterium avium subsp. paratuberculosis
caagaccgcggucaccg

SEQ ID NO: 2974377 - RNA, 21 nt, Mycobacterium avium subsp. paratuberculosis
caagaccgcggucaccggucg

SEQ ID NO: 2974378 - RNA, 17 nt, Mycobacterium avium subsp. paratuberculosis
caagacggugggcccgc

SEQ ID NO: 2974379 - RNA, 20 nt, Mycobacterium avium subsp. paratuberculosis
caagacggugggcccgccgu

SEQ ID NO: 2974380 - RNA, 22 nt, Mycobacterium avium subsp. paratuberculosis
caagacggugggcccgccgucg

SEQ ID NO: 2974381 - RNA, 15 nt, Mycobacterium avium subsp. paratuberculosis
caagacguccgcguc

SEQ ID NO: 2974382 - RNA, 21 nt, Mycobacterium avium subsp. paratuberculosis
caagagcaggcuucgcagcag

SEQ ID NO: 2974383 - RNA, 19 nt, Mycobacterium avium subsp. paratuberculosis
caagauaggagacagccga

SEQ ID NO: 2974384 - RNA, 14 nt, Mycobacterium avium subsp. paratuberculosis
caagcaccggcugg

SEQ ID NO: 2974385 - RNA, 15 nt, Mycobacterium avium subsp. paratuberculosis
caagcaccggcuggc

SEQ ID NO: 2974386 - RNA, 12 nt, Mycobacterium avium subsp. paratuberculosis
caagcagagcag

SEQ ID NO: 2974387 - RNA, 22 nt, Mycobacterium avium subsp. paratuberculosis
caagcagauucgaggucaucga

SEQ ID NO: 2974388 - RNA, 20 nt, Mycobacterium avium subsp. paratuberculosis
caagcagcggcagccacggc

SEQ ID NO: 2974389 - RNA, 16 nt, Mycobacterium avium subsp. paratuberculosis
caagcaguaugcccgc

SEQ ID NO: 2974390 - RNA, 19 nt, Mycobacterium avium subsp. paratuberculosis
caagcaguaugcccgccgc

SEQ ID NO: 2974391 - RNA, 18 nt, Mycobacterium avium subsp. paratuberculosis
caagccauuucagcagcg

SEQ ID NO: 2974392 - RNA, 21 nt, Mycobacterium avium subsp. paratuberculosis
caagccauuucagcagcgcgg

SEQ ID NO: 2974393 - RNA, 18 nt, Mycobacterium avium subsp. paratuberculosis
caagcccuuuggcggcca

SEQ ID NO: 2974394 - RNA, 14 nt, Mycobacterium avium subsp. paratuberculosis
caagccgccgaucu

SEQ ID NO: 2974395 - RNA, 16 nt, Mycobacterium avium subsp. paratuberculosis
caagccggagaaggcg

SEQ ID NO: 2974396 - RNA, 13 nt, Mycobacterium avium subsp. paratuberculosis
caagccggccagc

SEQ ID NO: 2974397 - RNA, 16 nt, Mycobacterium avium subsp. paratuberculosis
caagccggcgucgaug

SEQ ID NO: 2974398 - RNA, 22 nt, Mycobacterium avium subsp. paratuberculosis
caagccggcgucgaugaugccg

SEQ ID NO: 2974399 - RNA, 19 nt, Mycobacterium avium subsp. paratuberculosis
caagccgggcggcagcagc

SEQ ID NO: 2974400 - RNA, 20 nt, Mycobacterium avium subsp. paratuberculosis
caagccgggcggcagcagcu

SEQ ID NO: 2974401 - RNA, 18 nt, Mycobacterium avium subsp. paratuberculosis
caagcgauuaggugggcu

SEQ ID NO: 2974402 - RNA, 19 nt, Mycobacterium avium subsp. paratuberculosis
caagcgauuaggugggcuu

SEQ ID NO: 2974403 - RNA, 17 nt, Mycobacterium avium subsp. paratuberculosis
caagcgcuuucgccgaa

SEQ ID NO: 2974404 - RNA, 15 nt, Mycobacterium avium subsp. paratuberculosis
caagcgguuccagac

SEQ ID NO: 2974405 - RNA, 18 nt, Mycobacterium avium subsp. paratuberculosis
caagcgguuccagaccgg

SEQ ID NO: 2974406 - RNA, 17 nt, Mycobacterium avium subsp. paratuberculosis
caagcguauccggccag

SEQ ID NO: 2974407 - RNA, 18 nt, Mycobacterium avium subsp. paratuberculosis
caagcguauccggccagc

SEQ ID NO: 2974408 - RNA, 21 nt, Mycobacterium avium subsp. paratuberculosis
caagcguauccggccagccgg

SEQ ID NO: 2974409 - RNA, 22 nt, Mycobacterium avium subsp. paratuberculosis
caagcguauccggccagccggg

SEQ ID NO: 2974410 - RNA, 17 nt, Mycobacterium avium subsp. paratuberculosis
caagcucgccaggaugu

SEQ ID NO: 2974411 - RNA, 22 nt, Mycobacterium avium subsp. paratuberculosis
caagcugauucgggaucagccg

SEQ ID NO: 2974412 - RNA, 22 nt, Mycobacterium avium subsp. paratuberculosis
caagcuggucgccaaacugcgc

SEQ ID NO: 2974413 - RNA, 13 nt, Mycobacterium avium subsp. paratuberculosis
caaggacaagcug

SEQ ID NO: 2974414 - RNA, 17 nt, Mycobacterium avium subsp. paratuberculosis
caaggagaaggccgcgc

SEQ ID NO: 2974415 - RNA, 16 nt, Mycobacterium avium subsp. paratuberculosis
caaggcaacucagucc

SEQ ID NO: 2974416 - RNA, 23 nt, Mycobacterium avium subsp. paratuberculosis
caaggcaagucgucggugggccg

SEQ ID NO: 2974417 - RNA, 14 nt, Mycobacterium avium subsp. paratuberculosis
caaggccagcaacc

SEQ ID NO: 2974418 - RNA, 15 nt, Mycobacterium avium subsp. paratuberculosis
caaggccagcaaccg

SEQ ID NO: 2974419 - RNA, 17 nt, Mycobacterium avium subsp. paratuberculosis
caaggccagcaaccgga

SEQ ID NO: 2974420 - RNA, 22 nt, Mycobacterium avium subsp. paratuberculosis
caaggcccccgccucgccgguc

SEQ ID NO: 2974421 - RNA, 11 nt, Mycobacterium avium subsp. paratuberculosis
caaggcgagca

SEQ ID NO: 2974422 - RNA, 13 nt, Mycobacterium avium subsp. paratuberculosis
caagggccaccgg

SEQ ID NO: 2974423 - RNA, 21 nt, Mycobacterium avium subsp. paratuberculosis
caagggcggguaggcgccgau

SEQ ID NO: 2974424 - RNA, 15 nt, Mycobacterium avium subsp. paratuberculosis
caagggcuugggcgc

SEQ ID NO: 2974425 - RNA, 14 nt, Mycobacterium avium subsp. paratuberculosis
caaggggccgggcu

SEQ ID NO: 2974426 - RNA, 14 nt, Mycobacterium avium subsp. paratuberculosis
caaggggcuguccu

SEQ ID NO: 2974427 - RNA, 20 nt, Mycobacterium avium subsp. paratuberculosis
caaggggcuguccucccagc

SEQ ID NO: 2974428 - RNA, 15 nt, Mycobacterium avium subsp. paratuberculosis
caaggucgucgcggc

SEQ ID NO: 2974429 - RNA, 19 nt, Mycobacterium avium subsp. paratuberculosis
caaggugauucgcgcggcg

SEQ ID NO: 2974430 - RNA, 15 nt, Mycobacterium avium subsp. paratuberculosis
caagguggacgagca

SEQ ID NO: 2974431 - RNA, 18 nt, Mycobacterium avium subsp. paratuberculosis
caagguggacgagcagcc

SEQ ID NO: 2974432 - RNA, 19 nt, Mycobacterium avium subsp. paratuberculosis
caaguagacucagcgucga

SEQ ID NO: 2974433 - RNA, 21 nt, Mycobacterium avium subsp. paratuberculosis
caaguagacucagcgucgaug

SEQ ID NO: 2974434 - RNA, 18 nt, Mycobacterium avium subsp. paratuberculosis
caaguccucgguggccac

SEQ ID NO: 2974435 - RNA, 21 nt, Mycobacterium avium subsp. paratuberculosis
caagucgucggugggccgccg

SEQ ID NO: 2974436 - RNA, 22 nt, Mycobacterium avium subsp. paratuberculosis
caagucgucggugggccgccgc

SEQ ID NO: 2974437 - RNA, 15 nt, Mycobacterium avium subsp. paratuberculosis
caagugaugaccugg

SEQ ID NO: 2974438 - RNA, 18 nt, Mycobacterium avium subsp. paratuberculosis
caagugaugaccuggaua

SEQ ID NO: 2974439 - RNA, 17 nt, Mycobacterium avium subsp. paratuberculosis
caagugcaagggcgaca

SEQ ID NO: 2974440 - RNA, 21 nt, Mycobacterium avium subsp. paratuberculosis
caauacccgaccagcaccgcg

SEQ ID NO: 2974441 - RNA, 19 nt, Mycobacterium avium subsp. paratuberculosis
caauaccguuccgccccug

SEQ ID NO: 2974442 - RNA, 15 nt, Mycobacterium avium subsp. paratuberculosis
caauacggcccggcg

SEQ ID NO: 2974443 - RNA, 16 nt, Mycobacterium avium subsp. paratuberculosis
caauacggcccggcga

SEQ ID NO: 2974444 - RNA, 16 nt, Mycobacterium avium subsp. paratuberculosis
caauacggggcauccc

SEQ ID NO: 2974445 - RNA, 18 nt, Mycobacterium avium subsp. paratuberculosis
caauacggugcccgccgc

SEQ ID NO: 2974446 - RNA, 19 nt, Mycobacterium avium subsp. paratuberculosis
caauacggugcccgccgcg

SEQ ID NO: 2974447 - RNA, 14 nt, Mycobacterium avium subsp. paratuberculosis
caaucaccgcggug

SEQ ID NO: 2974448 - RNA, 23 nt, Mycobacterium avium subsp. paratuberculosis
caauccggccccgcugccguccg

SEQ ID NO: 2974449 - RNA, 20 nt, Mycobacterium avium subsp. paratuberculosis
caauccggcgggccucgccg

SEQ ID NO: 2974450 - RNA, 23 nt, Mycobacterium avium subsp. paratuberculosis
caauccggcgggccucgccgcuu

SEQ ID NO: 2974451 - RNA, 21 nt, Mycobacterium avium subsp. paratuberculosis
caauccuguuccccggcgggc

SEQ ID NO: 2974452 - RNA, 13 nt, Mycobacterium avium subsp. paratuberculosis
caaucggcgccgg

SEQ ID NO: 2974453 - RNA, 15 nt, Mycobacterium avium subsp. paratuberculosis
caaucggcgccggcu

SEQ ID NO: 2974454 - RNA, 20 nt, Mycobacterium avium subsp. paratuberculosis
caaucgggacgccacggcga

SEQ ID NO: 2974455 - RNA, 18 nt, Mycobacterium avium subsp. paratuberculosis
caaucucgggcaccccug

SEQ ID NO: 2974456 - RNA, 21 nt, Mycobacterium avium subsp. paratuberculosis
caaucucgggcaccccugccg

SEQ ID NO: 2974457 - RNA, 12 nt, Mycobacterium avium subsp. paratuberculosis
caaucucgucgg

SEQ ID NO: 2974458 - RNA, 17 nt, Mycobacterium avium subsp. paratuberculosis
caaucucgucggggcgc

SEQ ID NO: 2974459 - RNA, 18 nt, Mycobacterium avium subsp. paratuberculosis
caaucuucuccgcggccg

SEQ ID NO: 2974460 - RNA, 16 nt, Mycobacterium avium subsp. paratuberculosis
caaugauggucagccg

SEQ ID NO: 2974461 - RNA, 16 nt, Mycobacterium avium subsp. paratuberculosis
caaugaugucggcggg

SEQ ID NO: 2974462 - RNA, 17 nt, Mycobacterium avium subsp. paratuberculosis
caaugaugucggcgggc

SEQ ID NO: 2974463 - RNA, 20 nt, Mycobacterium avium subsp. paratuberculosis
caaugcccucguagcggccg

SEQ ID NO: 2974464 - RNA, 15 nt, Mycobacterium avium subsp. paratuberculosis
caaugccgcagccga

SEQ ID NO: 2974465 - RNA, 14 nt, Mycobacterium avium subsp. paratuberculosis
caaugccggaucgg

SEQ ID NO: 2974466 - RNA, 23 nt, Mycobacterium avium subsp. paratuberculosis
caaugccuuugccguggcggcgg

SEQ ID NO: 2974467 - RNA, 21 nt, Mycobacterium avium subsp. paratuberculosis
caaugcgaucauuccgccgaa

SEQ ID NO: 2974468 - RNA, 15 nt, Mycobacterium avium subsp. paratuberculosis
caaugcgccggcggc

SEQ ID NO: 2974469 - RNA, 16 nt, Mycobacterium avium subsp. paratuberculosis
caaugcgccggcggcc

SEQ ID NO: 2974470 - RNA, 17 nt, Mycobacterium avium subsp. paratuberculosis
caaugcgccggcggccg

SEQ ID NO: 2974471 - RNA, 18 nt, Mycobacterium avium subsp. paratuberculosis
caaugcgucgcggcggcg

SEQ ID NO: 2974472 - RNA, 19 nt, Mycobacterium avium subsp. paratuberculosis
caaugcgucgcggcggcgc

SEQ ID NO: 2974473 - RNA, 21 nt, Mycobacterium avium subsp. paratuberculosis
caaugcuuuuugcggacccag

SEQ ID NO: 2974474 - RNA, 14 nt, Mycobacterium avium subsp. paratuberculosis
caauggccccggcg

SEQ ID NO: 2974475 - RNA, 15 nt, Mycobacterium avium subsp. paratuberculosis
caauggccccggcgu

SEQ ID NO: 2974476 - RNA, 16 nt, Mycobacterium avium subsp. paratuberculosis
caaugucacggcgggu

SEQ ID NO: 2974477 - RNA, 14 nt, Mycobacterium avium subsp. paratuberculosis
caauuccucagccc

SEQ ID NO: 2974478 - RNA, 13 nt, Mycobacterium avium subsp. paratuberculosis
caauucgacugcg

SEQ ID NO: 2974479 - RNA, 13 nt, Mycobacterium avium subsp. paratuberculosis
caauucgcgcugc

SEQ ID NO: 2974480 - RNA, 15 nt, Mycobacterium avium subsp. paratuberculosis
caauucggucagcgc

SEQ ID NO: 2974481 - RNA, 17 nt, Mycobacterium avium subsp. paratuberculosis
caauucggugacggcgu

SEQ ID NO: 2974482 - RNA, 14 nt, Mycobacterium avium subsp. paratuberculosis
caauucuucggcgu

SEQ ID NO: 2974483 - RNA, 18 nt, Mycobacterium avium subsp. paratuberculosis
caauugccaacugcagca

SEQ ID NO: 2974484 - RNA, 19 nt, Mycobacterium avium subsp. paratuberculosis
caauugccgggccagauag

SEQ ID NO: 2974485 - RNA, 17 nt, Mycobacterium avium subsp. paratuberculosis
caauugcgccagcagca

SEQ ID NO: 2974486 - RNA, 21 nt, Mycobacterium avium subsp. paratuberculosis
cacaaaagcgcccgauucccc

SEQ ID NO: 2974487 - RNA, 15 nt, Mycobacterium avium subsp. paratuberculosis
cacaaacagcgcggc

SEQ ID NO: 2974488 - RNA, 15 nt, Mycobacterium avium subsp. paratuberculosis
cacaacccggacagc

SEQ ID NO: 2974489 - RNA, 17 nt, Mycobacterium avium subsp. paratuberculosis
cacaacccggacagcgc

SEQ ID NO: 2974490 - RNA, 18 nt, Mycobacterium avium subsp. paratuberculosis
cacaacccggacagcgcg

SEQ ID NO: 2974491 - RNA, 23 nt, Mycobacterium avium subsp. paratuberculosis
cacaaccgauguggacgaugcgg

SEQ ID NO: 2974492 - RNA, 16 nt, Mycobacterium avium subsp. paratuberculosis
cacaacgccuccgaau

SEQ ID NO: 2974493 - RNA, 18 nt, Mycobacterium avium subsp. paratuberculosis
cacaagggacaguagcca

SEQ ID NO: 2974494 - RNA, 21 nt, Mycobacterium avium subsp. paratuberculosis
cacaauccggucagcguggcg

SEQ ID NO: 2974495 - RNA, 20 nt, Mycobacterium avium subsp. paratuberculosis
cacaauggauccgaucagca

SEQ ID NO: 2974496 - RNA, 22 nt, Mycobacterium avium subsp. paratuberculosis
cacaauggauccgaucagcagc

SEQ ID NO: 2974497 - RNA, 23 nt, Mycobacterium avium subsp. paratuberculosis
cacaauggauccgaucagcagca

SEQ ID NO: 2974498 - RNA, 13 nt, Mycobacterium avium subsp. paratuberculosis
cacacacaggucg

SEQ ID NO: 2974499 - RNA, 22 nt, Mycobacterium avium subsp. paratuberculosis
cacacacugcugcgcagacccg

SEQ ID NO: 2974500 - RNA, 14 nt, Mycobacterium avium subsp. paratuberculosis
cacaccaccacgcg

SEQ ID NO: 2974501 - RNA, 13 nt, Mycobacterium avium subsp. paratuberculosis
cacaccagcacgg

SEQ ID NO: 2974502 - RNA, 19 nt, Mycobacterium avium subsp. paratuberculosis
cacaccagcacggcggcgc

SEQ ID NO: 2974503 - RNA, 22 nt, Mycobacterium avium subsp. paratuberculosis
cacaccagcacggcggcgcuga

SEQ ID NO: 2974504 - RNA, 13 nt, Mycobacterium avium subsp. paratuberculosis
cacaccagcgguc

SEQ ID NO: 2974505 - RNA, 17 nt, Mycobacterium avium subsp. paratuberculosis
cacacccagcgagccga

SEQ ID NO: 2974506 - RNA, 13 nt, Mycobacterium avium subsp. paratuberculosis
cacacccagcgcc

SEQ ID NO: 2974507 - RNA, 14 nt, Mycobacterium avium subsp. paratuberculosis
cacacccagcgcca

SEQ ID NO: 2974508 - RNA, 12 nt, Mycobacterium avium subsp. paratuberculosis
cacaccccggcc

SEQ ID NO: 2974509 - RNA, 14 nt, Mycobacterium avium subsp. paratuberculosis
cacacccgcagcga

SEQ ID NO: 2974510 - RNA, 13 nt, Mycobacterium avium subsp. paratuberculosis
cacacccgcggcc

SEQ ID NO: 2974511 - RNA, 20 nt, Mycobacterium avium subsp. paratuberculosis
cacacccgucgacucggcgg

SEQ ID NO: 2974512 - RNA, 13 nt, Mycobacterium avium subsp. paratuberculosis
cacacccucggcc

SEQ ID NO: 2974513 - RNA, 14 nt, Mycobacterium avium subsp. paratuberculosis
cacacccucggccc

SEQ ID NO: 2974514 - RNA, 17 nt, Mycobacterium avium subsp. paratuberculosis
cacacccuugucgguga

SEQ ID NO: 2974515 - RNA, 22 nt, Mycobacterium avium subsp. paratuberculosis
cacaccgaagaaccccgagauc

SEQ ID NO: 2974516 - RNA, 16 nt, Mycobacterium avium subsp. paratuberculosis
cacaccgacaccggcc

SEQ ID NO: 2974517 - RNA, 21 nt, Mycobacterium avium subsp. paratuberculosis
cacaccgccgcggcgguggcc

SEQ ID NO: 2974518 - RNA, 14 nt, Mycobacterium avium subsp. paratuberculosis
cacaccgccggcca

SEQ ID NO: 2974519 - RNA, 15 nt, Mycobacterium avium subsp. paratuberculosis
cacaccgccggcgcg

SEQ ID NO: 2974520 - RNA, 18 nt, Mycobacterium avium subsp. paratuberculosis
cacaccgcgcgcaggccc

SEQ ID NO: 2974521 - RNA, 18 nt, Mycobacterium avium subsp. paratuberculosis
cacaccgcggccagcgcg

SEQ ID NO: 2974522 - RNA, 23 nt, Mycobacterium avium subsp. paratuberculosis
cacaccgcggccagcgcgcgggc

SEQ ID NO: 2974523 - RNA, 13 nt, Mycobacterium avium subsp. paratuberculosis
cacaccgcugagg

SEQ ID NO: 2974524 - RNA, 21 nt, Mycobacterium avium subsp. paratuberculosis
cacaccgcugucggugugagc

SEQ ID NO: 2974525 - RNA, 15 nt, Mycobacterium avium subsp. paratuberculosis
cacaccggaucggcu

SEQ ID NO: 2974526 - RNA, 13 nt, Mycobacterium avium subsp. paratuberculosis
cacaccggccuuc

SEQ ID NO: 2974527 - RNA, 16 nt, Mycobacterium avium subsp. paratuberculosis
cacaccggccuucacc

SEQ ID NO: 2974528 - RNA, 17 nt, Mycobacterium avium subsp. paratuberculosis
cacaccggccuucacca

SEQ ID NO: 2974529 - RNA, 16 nt, Mycobacterium avium subsp. paratuberculosis
cacaccggggccaggu

SEQ ID NO: 2974530 - RNA, 20 nt, Mycobacterium avium subsp. paratuberculosis
cacaccggugcucuccugcu

SEQ ID NO: 2974531 - RNA, 16 nt, Mycobacterium avium subsp. paratuberculosis
cacaccguaccgagga

SEQ ID NO: 2974532 - RNA, 13 nt, Mycobacterium avium subsp. paratuberculosis
caccgccaccgcg

SEQ ID NO: 2974533 - RNA, 23 nt, Mycobacterium avium subsp. paratuberculosis
caccgccaccgcgcaaccgggcc

SEQ ID NO: 2974534 - RNA, 17 nt, Mycobacterium avium subsp. paratuberculosis
caccgccaccggcccgg

SEQ ID NO: 2974535 - RNA, 13 nt, Mycobacterium avium subsp. paratuberculosis
caccgccacgccg

SEQ ID NO: 2974536 - RNA, 16 nt, Mycobacterium avium subsp. paratuberculosis
caccgccacgccguug

SEQ ID NO: 2974537 - RNA, 17 nt, Mycobacterium avium subsp. paratuberculosis
caccgccacggcgacga

SEQ ID NO: 2974538 - RNA, 14 nt, Mycobacterium avium subsp. paratuberculosis
caccgccacgucga

SEQ ID NO: 2974539 - RNA, 13 nt, Mycobacterium avium subsp. paratuberculosis
caccgccagcacc

SEQ ID NO: 2974540 - RNA, 14 nt, Mycobacterium avium subsp. paratuberculosis
caccgccagcaccg

SEQ ID NO: 2974541 - RNA, 17 nt, Mycobacterium avium subsp. paratuberculosis
caccgccagcaccgacg

SEQ ID NO: 2974542 - RNA, 19 nt, Mycobacterium avium subsp. paratuberculosis
caccgccagcaccgacgcg

SEQ ID NO: 2974543 - RNA, 20 nt, Mycobacterium avium subsp. paratuberculosis
caccgccagcaccgacgcgc

SEQ ID NO: 2974544 - RNA, 16 nt, Mycobacterium avium subsp. paratuberculosis
caccgccagcaccgcc

SEQ ID NO: 2974545 - RNA, 12 nt, Mycobacterium avium subsp. paratuberculosis
caccgccagcag

SEQ ID NO: 2974546 - RNA, 17 nt, Mycobacterium avium subsp. paratuberculosis
caccgccagcagcgccg

SEQ ID NO: 2974547 - RNA, 15 nt, Mycobacterium avium subsp. paratuberculosis
caccgccagcauccg

SEQ ID NO: 2974548 - RNA, 17 nt, Mycobacterium avium subsp. paratuberculosis
caccgccagccaccaca

SEQ ID NO: 2974549 - RNA, 13 nt, Mycobacterium avium subsp. paratuberculosis
caccgccagcgcg

SEQ ID NO: 2974550 - RNA, 17 nt, Mycobacterium avium subsp. paratuberculosis
caccgccagcgcgccga

SEQ ID NO: 2974551 - RNA, 18 nt, Mycobacterium avium subsp. paratuberculosis
caccgccagcgcgccgau

SEQ ID NO: 2974552 - RNA, 20 nt, Mycobacterium avium subsp. paratuberculosis
caccgccagcgcgccgaucg

SEQ ID NO: 2974553 - RNA, 14 nt, Mycobacterium avium subsp. paratuberculosis
caccgccagcgcgg

SEQ ID NO: 2974554 - RNA, 18 nt, Mycobacterium avium subsp. paratuberculosis
caccgccagcgcggcggc

SEQ ID NO: 2974555 - RNA, 20 nt, Mycobacterium avium subsp. paratuberculosis
caccgccagcgcggcggcgc

SEQ ID NO: 2974556 - RNA, 20 nt, Mycobacterium avium subsp. paratuberculosis
caccgccagucugagcccgg

SEQ ID NO: 2974557 - RNA, 14 nt, Mycobacterium avium subsp. paratuberculosis
caccgccaucggca

SEQ ID NO: 2974558 - RNA, 14 nt, Mycobacterium avium subsp. paratuberculosis
caccgccaucucgg

SEQ ID NO: 2974559 - RNA, 20 nt, Mycobacterium avium subsp. paratuberculosis
caccgcccacagcaacgaca

SEQ ID NO: 2974560 - RNA, 13 nt, Mycobacterium avium subsp. paratuberculosis
caccgccccagcc

SEQ ID NO: 2974561 - RNA, 18 nt, Mycobacterium avium subsp. paratuberculosis
caccgccccagccgacca

SEQ ID NO: 2974562 - RNA, 21 nt, Mycobacterium avium subsp. paratuberculosis
caccgccccagccgaccaguu

SEQ ID NO: 2974563 - RNA, 15 nt, Mycobacterium avium subsp. paratuberculosis
caccgcccccgcggc

SEQ ID NO: 2974564 - RNA, 18 nt, Mycobacterium avium subsp. paratuberculosis
caccgcccccgcggcggc

SEQ ID NO: 2974565 - RNA, 13 nt, Mycobacterium avium subsp. paratuberculosis
caccgccccgccc

SEQ ID NO: 2974566 - RNA, 14 nt, Mycobacterium avium subsp. paratuberculosis
caccgccccgccgc

SEQ ID NO: 2974567 - RNA, 15 nt, Mycobacterium avium subsp. paratuberculosis
caccgccccgccgcg

SEQ ID NO: 2974568 - RNA, 16 nt, Mycobacterium avium subsp. paratuberculosis
caccgccccgccgcgc

SEQ ID NO: 2974569 - RNA, 20 nt, Mycobacterium avium subsp. paratuberculosis
caccgccccggucaccccgg

SEQ ID NO: 2974570 - RNA, 13 nt, Mycobacterium avium subsp. paratuberculosis
caccgcccgcgcg

SEQ ID NO: 2974571 - RNA, 15 nt, Mycobacterium avium subsp. paratuberculosis
caccgcccgcgcgau

SEQ ID NO: 2974572 - RNA, 16 nt, Mycobacterium avium subsp. paratuberculosis
caccgcccgcgcgaug

SEQ ID NO: 2974573 - RNA, 15 nt, Mycobacterium avium subsp. paratuberculosis
caccgcccgcggugu

SEQ ID NO: 2974574 - RNA, 16 nt, Mycobacterium avium subsp. paratuberculosis
caccgcccgcggugug

SEQ ID NO: 2974575 - RNA, 13 nt, Mycobacterium avium subsp. paratuberculosis
caccgcccggacc

SEQ ID NO: 2974576 - RNA, 14 nt, Mycobacterium avium subsp. paratuberculosis
caccgcccggaccg

SEQ ID NO: 2974577 - RNA, 18 nt, Mycobacterium avium subsp. paratuberculosis
caccgcccggaccggcuc

SEQ ID NO: 2974578 - RNA, 20 nt, Mycobacterium avium subsp. paratuberculosis
caccgcccggaugccggcgc

SEQ ID NO: 2974579 - RNA, 23 nt, Mycobacterium avium subsp. paratuberculosis
caccgcccggaugccggcgccca

SEQ ID NO: 2974580 - RNA, 15 nt, Mycobacterium avium subsp. paratuberculosis
caccgccgacaucgc

SEQ ID NO: 2974581 - RNA, 12 nt, Mycobacterium avium subsp. paratuberculosis
caccgccgagcc

SEQ ID NO: 2974582 - RNA, 17 nt, Mycobacterium avium subsp. paratuberculosis
caccgccgagccgcucc

SEQ ID NO: 2974583 - RNA, 13 nt, Mycobacterium avium subsp. paratuberculosis
caccgccgagggc

SEQ ID NO: 2974584 - RNA, 17 nt, Mycobacterium avium subsp. paratuberculosis
caccgccgagggcccgg

SEQ ID NO: 2974585 - RNA, 14 nt, Mycobacterium avium subsp. paratuberculosis
caccgccgauggcg

SEQ ID NO: 2974586 - RNA, 17 nt, Mycobacterium avium subsp. paratuberculosis
caccgccgauggcgacg

SEQ ID NO: 2974587 - RNA, 20 nt, Mycobacterium avium subsp. paratuberculosis
caccgccgauggcgacgguc

SEQ ID NO: 2974588 - RNA, 14 nt, Mycobacterium avium subsp. paratuberculosis
caccgccgccagca

SEQ ID NO: 2974589 - RNA, 16 nt, Mycobacterium avium subsp. paratuberculosis
caccgccgccgacucc

SEQ ID NO: 2974590 - RNA, 16 nt, Mycobacterium avium subsp. paratuberculosis
caccgccgcgccgagg

SEQ ID NO: 2974591 - RNA, 14 nt, Mycobacterium avium subsp. paratuberculosis
caccgccgcgcggc

SEQ ID NO: 2974592 - RNA, 20 nt, Mycobacterium avium subsp. paratuberculosis
caccgccgcgcggccgggcu

SEQ ID NO: 2974593 - RNA, 11 nt, Mycobacterium avium subsp. paratuberculosis
caccgccgcgg

SEQ ID NO: 2974594 - RNA, 15 nt, Mycobacterium avium subsp. paratuberculosis
caccgccgcggccgc

SEQ ID NO: 2974595 - RNA, 15 nt, Mycobacterium avium subsp. paratuberculosis
caccgccgcggcgac

SEQ ID NO: 2974596 - RNA, 21 nt, Mycobacterium avium subsp. paratuberculosis
caccgccgcggcgaccacgaa

SEQ ID NO: 2974597 - RNA, 13 nt, Mycobacterium avium subsp. paratuberculosis
caccgccgcggga

SEQ ID NO: 2974598 - RNA, 14 nt, Mycobacterium avium subsp. paratuberculosis
caccgccgcgggau

SEQ ID NO: 2974599 - RNA, 15 nt, Mycobacterium avium subsp. paratuberculosis
caccgccgcgggcuc

SEQ ID NO: 2974600 - RNA, 20 nt, Mycobacterium avium subsp. paratuberculosis
caccgccgcugcgcgcgcga

SEQ ID NO: 2974601 - RNA, 13 nt, Mycobacterium avium subsp. paratuberculosis
caccgccggccac

SEQ ID NO: 2974602 - RNA, 14 nt, Mycobacterium avium subsp. paratuberculosis
caccgccggcccgg

SEQ ID NO: 2974603 - RNA, 15 nt, Mycobacterium avium subsp. paratuberculosis
caccgccggcccggc

SEQ ID NO: 2974604 - RNA, 17 nt, Mycobacterium avium subsp. paratuberculosis
caccgccggcccggcgu

SEQ ID NO: 2974605 - RNA, 13 nt, Mycobacterium avium subsp. paratuberculosis
caccgccggcgcc

SEQ ID NO: 2974606 - RNA, 17 nt, Mycobacterium avium subsp. paratuberculosis
caccgccggcgccgucg

SEQ ID NO: 2974607 - RNA, 15 nt, Mycobacterium avium subsp. paratuberculosis
caccgccggcgcgga

SEQ ID NO: 2974608 - RNA, 12 nt, Mycobacterium avium subsp. paratuberculosis
caccgccggcgg

SEQ ID NO: 2974609 - RNA, 13 nt, Mycobacterium avium subsp. paratuberculosis
caccgccggcggc

SEQ ID NO: 2974610 - RNA, 21 nt, Mycobacterium avium subsp. paratuberculosis
caccgccggcggccuccgcca

SEQ ID NO: 2974611 - RNA, 16 nt, Mycobacterium avium subsp. paratuberculosis
caccgccgggcauccg

SEQ ID NO: 2974612 - RNA, 16 nt, Mycobacterium avium subsp. paratuberculosis
caccgccggggugugc

SEQ ID NO: 2974613 - RNA, 13 nt, Mycobacterium avium subsp. paratuberculosis
caccgccgucccg

SEQ ID NO: 2974614 - RNA, 15 nt, Mycobacterium avium subsp. paratuberculosis
caccgccgucccguc

SEQ ID NO: 2974615 - RNA, 17 nt, Mycobacterium avium subsp. paratuberculosis
caccgccgucccgucac

SEQ ID NO: 2974616 - RNA, 19 nt, Mycobacterium avium subsp. paratuberculosis
caccgccgucggggcgucg

SEQ ID NO: 2974617 - RNA, 22 nt, Mycobacterium avium subsp. paratuberculosis
caccgccguuccgaugaagaac

SEQ ID NO: 2974618 - RNA, 14 nt, Mycobacterium avium subsp. paratuberculosis
caccgccucgacgg

SEQ ID NO: 2974619 - RNA, 17 nt, Mycobacterium avium subsp. paratuberculosis
caccgccucgacgguga

SEQ ID NO: 2974620 - RNA, 21 nt, Mycobacterium avium subsp. paratuberculosis
caccgccugcgcgaucgccgg

SEQ ID NO: 2974621 - RNA, 16 nt, Mycobacterium avium subsp. paratuberculosis
caccgccugugcgacg

SEQ ID NO: 2974622 - RNA, 15 nt, Mycobacterium avium subsp. paratuberculosis
caccgccuucgacgg

SEQ ID NO: 2974623 - RNA, 19 nt, Mycobacterium avium subsp. paratuberculosis
caccgccuucgacggccgg

SEQ ID NO: 2974624 - RNA, 20 nt, Mycobacterium avium subsp. paratuberculosis
caccgccuucgacggccggc

SEQ ID NO: 2974625 - RNA, 22 nt, Mycobacterium avium subsp. paratuberculosis
caccgccuucgacggccggccc

SEQ ID NO: 2974626 - RNA, 23 nt, Mycobacterium avium subsp. paratuberculosis
caccgccuucgacggccggcccu

SEQ ID NO: 2974627 - RNA, 15 nt, Mycobacterium avium subsp. paratuberculosis
caccgccuugcccgg

SEQ ID NO: 2974628 - RNA, 16 nt, Mycobacterium avium subsp. paratuberculosis
caccgccuugcccggc

SEQ ID NO: 2974629 - RNA, 20 nt, Mycobacterium avium subsp. paratuberculosis
caccgccuugcccggcucgg

SEQ ID NO: 2974630 - RNA, 17 nt, Mycobacterium avium subsp. paratuberculosis
caccgcgaaagcgucgg

SEQ ID NO: 2974631 - RNA, 23 nt, Mycobacterium avium subsp. paratuberculosis
caccgcgaacagcacguaggucc

SEQ ID NO: 2974632 - RNA, 18 nt, Mycobacterium avium subsp. paratuberculosis
caccgcgaacaucgccag

SEQ ID NO: 2974633 - RNA, 19 nt, Mycobacterium avium subsp. paratuberculosis
caccgcgaacaucgccagc

SEQ ID NO: 2974634 - RNA, 20 nt, Mycobacterium avium subsp. paratuberculosis
caccgcgaacaucgccagca

SEQ ID NO: 2974635 - RNA, 16 nt, Mycobacterium avium subsp. paratuberculosis
caccgcgaagaacggu

SEQ ID NO: 2974636 - RNA, 20 nt, Mycobacterium avium subsp. paratuberculosis
caccgcgaagaacgguguca

SEQ ID NO: 2974637 - RNA, 19 nt, Mycobacterium avium subsp. paratuberculosis
caccgcgacacgucgacac

SEQ ID NO: 2974638 - RNA, 16 nt, Mycobacterium avium subsp. paratuberculosis
caccgcgaccacgccg

SEQ ID NO: 2974639 - RNA, 17 nt, Mycobacterium avium subsp. paratuberculosis
caccgcgaccacgccgc

SEQ ID NO: 2974640 - RNA, 19 nt, Mycobacterium avium subsp. paratuberculosis
caccgcgaccacgccgcgg

SEQ ID NO: 2974641 - RNA, 15 nt, Mycobacterium avium subsp. paratuberculosis
caccgcgaccaugcc

SEQ ID NO: 2974642 - RNA, 17 nt, Mycobacterium avium subsp. paratuberculosis
caccgcgaccaugcccg

SEQ ID NO: 2974643 - RNA, 19 nt, Mycobacterium avium subsp. paratuberculosis
caccgcgaccaugcccggc

SEQ ID NO: 2974644 - RNA, 21 nt, Mycobacterium avium subsp. paratuberculosis
caccgcgaccaugcccggcgc

SEQ ID NO: 2974645 - RNA, 16 nt, Mycobacterium avium subsp. paratuberculosis
caccgcgacccaggcc

SEQ ID NO: 2974646 - RNA, 18 nt, Mycobacterium avium subsp. paratuberculosis
caccgcgacccaggccgc

SEQ ID NO: 2974647 - RNA, 21 nt, Mycobacterium avium subsp. paratuberculosis
caccgcgacccaggccgccgc

SEQ ID NO: 2974648 - RNA, 23 nt, Mycobacterium avium subsp. paratuberculosis
caccgcgacccaggccgccgcca

SEQ ID NO: 2974649 - RNA, 13 nt, Mycobacterium avium subsp. paratuberculosis
caccgcgacccgg

SEQ ID NO: 2974650 - RNA, 15 nt, Mycobacterium avium subsp. paratuberculosis
caccgcgacccggcc

SEQ ID NO: 2974651 - RNA, 17 nt, Mycobacterium avium subsp. paratuberculosis
caccgcgacccggccga

SEQ ID NO: 2974652 - RNA, 19 nt, Mycobacterium avium subsp. paratuberculosis
caccgcgacccggccgagc

SEQ ID NO: 2974653 - RNA, 16 nt, Mycobacterium avium subsp. paratuberculosis
caccgcgacgagaucg

SEQ ID NO: 2974654 - RNA, 15 nt, Mycobacterium avium subsp. paratuberculosis
caccgcgacgaucgc

SEQ ID NO: 2974655 - RNA, 16 nt, Mycobacterium avium subsp. paratuberculosis
caccgcgacgaucgcg

SEQ ID NO: 2974656 - RNA, 18 nt, Mycobacterium avium subsp. paratuberculosis
caccgcgacgaucgcgac

SEQ ID NO: 2974657 - RNA, 20 nt, Mycobacterium avium subsp. paratuberculosis
caccgcgacgaucgcgacgg

SEQ ID NO: 2974658 - RNA, 22 nt, Mycobacterium avium subsp. paratuberculosis
caccgcgacgaucgcgacggcc

SEQ ID NO: 2974659 - RNA, 23 nt, Mycobacterium avium subsp. paratuberculosis
caccgcgacgaucgcgacggccg

SEQ ID NO: 2974660 - RNA, 12 nt, Mycobacterium avium subsp. paratuberculosis
caccgcgacgcc

SEQ ID NO: 2974661 - RNA, 16 nt, Mycobacterium avium subsp. paratuberculosis
caccgcgacgcccagg

SEQ ID NO: 2974662 - RNA, 19 nt, Mycobacterium avium subsp. paratuberculosis
caccgcgacgcccaggugc

SEQ ID NO: 2974663 - RNA, 15 nt, Mycobacterium avium subsp. paratuberculosis
caccgcgacgcugcc

SEQ ID NO: 2974664 - RNA, 17 nt, Mycobacterium avium subsp. paratuberculosis
caccgcgacgcugccgg

SEQ ID NO: 2974665 - RNA, 23 nt, Mycobacterium avium subsp. paratuberculosis
caccgcgacgcugccggggcgca

SEQ ID NO: 2974666 - RNA, 14 nt, Mycobacterium avium subsp. paratuberculosis
caccgcgacgguga

SEQ ID NO: 2974667 - RNA, 15 nt, Mycobacterium avium subsp. paratuberculosis
caccgcgacggugag

SEQ ID NO: 2974668 - RNA, 17 nt, Mycobacterium avium subsp. paratuberculosis
caccgcgacggugagca

SEQ ID NO: 2974669 - RNA, 14 nt, Mycobacterium avium subsp. paratuberculosis
caccgcgaguucgc

SEQ ID NO: 2974670 - RNA, 18 nt, Mycobacterium avium subsp. paratuberculosis
caccgcgaguucgcgcac

SEQ ID NO: 2974671 - RNA, 21 nt, Mycobacterium avium subsp. paratuberculosis
caccgcgaguucgcgcacgcu

SEQ ID NO: 2974672 - RNA, 24 nt, Mycobacterium avium subsp. paratuberculosis
caccgcgaguucgcgcacgcuggc

SEQ ID NO: 2974673 - RNA, 15 nt, Mycobacterium avium subsp. paratuberculosis
caccgcgaucaccac

SEQ ID NO: 2974674 - RNA, 19 nt, Mycobacterium avium subsp. paratuberculosis
caccgcgaucaccaccccg

SEQ ID NO: 2974675 - RNA, 23 nt, Mycobacterium avium subsp. paratuberculosis
caccgcgaucaccaccccggugc

SEQ ID NO: 2974676 - RNA, 20 nt, Mycobacterium avium subsp. paratuberculosis
caccgcgaucaccgagaugg

SEQ ID NO: 2974677 - RNA, 13 nt, Mycobacterium avium subsp. paratuberculosis
caccgcgaucgcc

SEQ ID NO: 2974678 - RNA, 20 nt, Mycobacterium avium subsp. paratuberculosis
caccgcgaucgccgacgucg

SEQ ID NO: 2974679 - RNA, 19 nt, Mycobacterium avium subsp. paratuberculosis
caccgcgaugauggcgucg

SEQ ID NO: 2974680 - RNA, 20 nt, Mycobacterium avium subsp. paratuberculosis
caccgcgaugauggcgucga

SEQ ID NO: 2974681 - RNA, 16 nt, Mycobacterium avium subsp. paratuberculosis
caccgcgauggcccgc

SEQ ID NO: 2974682 - RNA, 23 nt, Mycobacterium avium subsp. paratuberculosis
caccgcgcaaccgggccgcaccc

SEQ ID NO: 2974683 - RNA, 16 nt, Mycobacterium avium subsp. paratuberculosis
caccgcgcccagcccc

SEQ ID NO: 2974684 - RNA, 15 nt, Mycobacterium avium subsp. paratuberculosis
caccgcgccccggcg

SEQ ID NO: 2974685 - RNA, 16 nt, Mycobacterium avium subsp. paratuberculosis
caccgcgccccggcgc

SEQ ID NO: 2974686 - RNA, 18 nt, Mycobacterium avium subsp. paratuberculosis
caccgcgccccggcgcag

SEQ ID NO: 2974687 - RNA, 14 nt, Mycobacterium avium subsp. paratuberculosis
caccgcgccgggca

SEQ ID NO: 2974688 - RNA, 13 nt, Mycobacterium avium subsp. paratuberculosis
caccgcgccgguc

SEQ ID NO: 2974689 - RNA, 22 nt, Mycobacterium avium subsp. paratuberculosis
caccgcgccgguccggcccugg

SEQ ID NO: 2974690 - RNA, 14 nt, Mycobacterium avium subsp. paratuberculosis
caccgcgccgucgu

SEQ ID NO: 2974691 - RNA, 20 nt, Mycobacterium avium subsp. paratuberculosis
caccgcgccgucuuccgggc

SEQ ID NO: 2974692 - RNA, 22 nt, Mycobacterium avium subsp. paratuberculosis
caccgcgccgucuuccgggcca

SEQ ID NO: 2974693 - RNA, 13 nt, Mycobacterium avium subsp. paratuberculosis
caccgcgccguga

SEQ ID NO: 2974694 - RNA, 22 nt, Mycobacterium avium subsp. paratuberculosis
caccgcgccuuugacguucgcg

SEQ ID NO: 2974695 - RNA, 19 nt, Mycobacterium avium subsp. paratuberculosis
caccgcgcgaacgcaacag

SEQ ID NO: 2974696 - RNA, 14 nt, Mycobacterium avium subsp. paratuberculosis
caccgcgcgcacca

SEQ ID NO: 2974697 - RNA, 15 nt, Mycobacterium avium subsp. paratuberculosis
caccgcgcgcaccac

SEQ ID NO: 2974698 - RNA, 20 nt, Mycobacterium avium subsp. paratuberculosis
caccgcgcgcaggccccggc

SEQ ID NO: 2974699 - RNA, 21 nt, Mycobacterium avium subsp. paratuberculosis
caccgcgcgcaggccccggcg

SEQ ID NO: 2974700 - RNA, 23 nt, Mycobacterium avium subsp. paratuberculosis
caccgcgcgcaggccccggcgcg

SEQ ID NO: 2974701 - RNA, 13 nt, Mycobacterium avium subsp. paratuberculosis
caccgcgcgccag

SEQ ID NO: 2974702 - RNA, 13 nt, Mycobacterium avium subsp. paratuberculosis
caccgcgcgcggg

SEQ ID NO: 2974703 - RNA, 15 nt, Mycobacterium avium subsp. paratuberculosis
caccgcgcgcgggua

SEQ ID NO: 2974704 - RNA, 15 nt, Mycobacterium avium subsp. paratuberculosis
caccgcgcgcugcag

SEQ ID NO: 2974705 - RNA, 16 nt, Mycobacterium avium subsp. paratuberculosis
caccgcgcgcugcagc

SEQ ID NO: 2974706 - RNA, 23 nt, Mycobacterium avium subsp. paratuberculosis
caccgcgcggccagcggcgccga

SEQ ID NO: 2974707 - RNA, 13 nt, Mycobacterium avium subsp. paratuberculosis
caccgcgcggcgg

SEQ ID NO: 2974708 - RNA, 15 nt, Mycobacterium avium subsp. paratuberculosis
caccgcgcggcgguc

SEQ ID NO: 2974709 - RNA, 22 nt, Mycobacterium avium subsp. paratuberculosis
caccgcgcggcgguccagcgag

SEQ ID NO: 2974710 - RNA, 16 nt, Mycobacterium avium subsp. paratuberculosis
caccgcgcggcggugc

SEQ ID NO: 2974711 - RNA, 23 nt, Mycobacterium avium subsp. paratuberculosis
caccgcgcggcggugcucgcgcc

SEQ ID NO: 2974712 - RNA, 13 nt, Mycobacterium avium subsp. paratuberculosis
caccgcgcggugc

SEQ ID NO: 2974713 - RNA, 19 nt, Mycobacterium avium subsp. paratuberculosis
caccgcgcuccugccagcg

SEQ ID NO: 2974714 - RNA, 20 nt, Mycobacterium avium subsp. paratuberculosis
caccgcgcuccugccagcgg

SEQ ID NO: 2974715 - RNA, 12 nt, Mycobacterium avium subsp. paratuberculosis
caccgcgcucgg

SEQ ID NO: 2974716 - RNA, 17 nt, Mycobacterium avium subsp. paratuberculosis
caccgcgcucggcgacg

SEQ ID NO: 2974717 - RNA, 16 nt, Mycobacterium avium subsp. paratuberculosis
caccgcgcuugccgcg

SEQ ID NO: 2974718 - RNA, 18 nt, Mycobacterium avium subsp. paratuberculosis
caccgcgcuugccgcgac

SEQ ID NO: 2974719 - RNA, 20 nt, Mycobacterium avium subsp. paratuberculosis
caccgcgcuuuggaccaggg

SEQ ID NO: 2974720 - RNA, 15 nt, Mycobacterium avium subsp. paratuberculosis
caccgcggaccaccg

SEQ ID NO: 2974721 - RNA, 17 nt, Mycobacterium avium subsp. paratuberculosis
caccgcggaccaccgcg

SEQ ID NO: 2974722 - RNA, 14 nt, Mycobacterium avium subsp. paratuberculosis
caccgcggagcgca

SEQ ID NO: 2974723 - RNA, 18 nt, Mycobacterium avium subsp. paratuberculosis
caccgcggagcgcaacgu

SEQ ID NO: 2974724 - RNA, 22 nt, Mycobacterium avium subsp. paratuberculosis
caccgcggaggaauucgccgac

SEQ ID NO: 2974725 - RNA, 23 nt, Mycobacterium avium subsp. paratuberculosis
caccgcggaggaauucgccgacg

SEQ ID NO: 2974726 - RNA, 17 nt, Mycobacterium avium subsp. paratuberculosis
caccgcggauuccagcg

SEQ ID NO: 2974727 - RNA, 12 nt, Mycobacterium avium subsp. paratuberculosis
caccgcggccaa

SEQ ID NO: 2974728 - RNA, 16 nt, Mycobacterium avium subsp. paratuberculosis
caccgcggccaacccg

SEQ ID NO: 2974729 - RNA, 19 nt, Mycobacterium avium subsp. paratuberculosis
caccgcggccaacccgggc

SEQ ID NO: 2974730 - RNA, 20 nt, Mycobacterium avium subsp. paratuberculosis
caccgcggccaacccgggcg

SEQ ID NO: 2974731 - RNA, 23 nt, Mycobacterium avium subsp. paratuberculosis
caccgcggccaacccgggcgcca

SEQ ID NO: 2974732 - RNA, 15 nt, Mycobacterium avium subsp. paratuberculosis
caccgcggccaccac

SEQ ID NO: 2974733 - RNA, 22 nt, Mycobacterium avium subsp. paratuberculosis
caccgcggccaccaccgccacg

SEQ ID NO: 2974734 - RNA, 14 nt, Mycobacterium avium subsp. paratuberculosis
caccgcggccaccu

SEQ ID NO: 2974735 - RNA, 15 nt, Mycobacterium avium subsp. paratuberculosis
caccgcggccaccug

SEQ ID NO: 2974736 - RNA, 15 nt, Mycobacterium avium subsp. paratuberculosis
caccgcggccgucgc

SEQ ID NO: 2974737 - RNA, 16 nt, Mycobacterium avium subsp. paratuberculosis
caccgcggccgucgcg

SEQ ID NO: 2974738 - RNA, 22 nt, Mycobacterium avium subsp. paratuberculosis
caccgcggccgucgcggcgauc

SEQ ID NO: 2974739 - RNA, 23 nt, Mycobacterium avium subsp. paratuberculosis
caccgcggccgucgcggcgaucg

SEQ ID NO: 2974740 - RNA, 16 nt, Mycobacterium avium subsp. paratuberculosis
caccgcggccucggcg

SEQ ID NO: 2974741 - RNA, 19 nt, Mycobacterium avium subsp. paratuberculosis
caccgcggccucggcgucg

SEQ ID NO: 2974742 - RNA, 13 nt, Mycobacterium avium subsp. paratuberculosis
caccgcggcgacg

SEQ ID NO: 2974743 - RNA, 16 nt, Mycobacterium avium subsp. paratuberculosis
caccgcggcgacgucg

SEQ ID NO: 2974744 - RNA, 23 nt, Mycobacterium avium subsp. paratuberculosis
caccgcggcgacgucgugcacgc

SEQ ID NO: 2974745 - RNA, 12 nt, Mycobacterium avium subsp. paratuberculosis
caccgcggcgag

SEQ ID NO: 2974746 - RNA, 16 nt, Mycobacterium avium subsp. paratuberculosis
caccgcggcgaucgcc

SEQ ID NO: 2974747 - RNA, 13 nt, Mycobacterium avium subsp. paratuberculosis
caccgcggcgccg

SEQ ID NO: 2974748 - RNA, 14 nt, Mycobacterium avium subsp. paratuberculosis
caccgcggcgccgu

SEQ ID NO: 2974749 - RNA, 16 nt, Mycobacterium avium subsp. paratuberculosis
caccgcggcgccgucg

SEQ ID NO: 2974750 - RNA, 20 nt, Mycobacterium avium subsp. paratuberculosis
caccgcggcgccgucgaaca

SEQ ID NO: 2974751 - RNA, 12 nt, Mycobacterium avium subsp. paratuberculosis
caccgcggcgcg

SEQ ID NO: 2974752 - RNA, 14 nt, Mycobacterium avium subsp. paratuberculosis
caccgcggcgcgca

SEQ ID NO: 2974753 - RNA, 22 nt, Mycobacterium avium subsp. paratuberculosis
caccgcggcgcgcaucgccguc

SEQ ID NO: 2974754 - RNA, 16 nt, Mycobacterium avium subsp. paratuberculosis
caccgcggcgcgcggc

SEQ ID NO: 2974755 - RNA, 17 nt, Mycobacterium avium subsp. paratuberculosis
caccgcggcgcgcggcc

SEQ ID NO: 2974756 - RNA, 22 nt, Mycobacterium avium subsp. paratuberculosis
caccgcggcgcgcggccgcgac

SEQ ID NO: 2974757 - RNA, 14 nt, Mycobacterium avium subsp. paratuberculosis
caccgcggcggcca

SEQ ID NO: 2974758 - RNA, 16 nt, Mycobacterium avium subsp. paratuberculosis
caccgcggcggcgucg

SEQ ID NO: 2974759 - RNA, 19 nt, Mycobacterium avium subsp. paratuberculosis
caccgcggcggcgucggcg

SEQ ID NO: 2974760 - RNA, 13 nt, Mycobacterium avium subsp. paratuberculosis
caccgcggcgggg

SEQ ID NO: 2974761 - RNA, 15 nt, Mycobacterium avium subsp. paratuberculosis
caccgcggcgggguc

SEQ ID NO: 2974762 - RNA, 14 nt, Mycobacterium avium subsp. paratuberculosis
caccgcggcggugu

SEQ ID NO: 2974763 - RNA, 17 nt, Mycobacterium avium subsp. paratuberculosis
caccgcggcggugucgg

SEQ ID NO: 2974764 - RNA, 21 nt, Mycobacterium avium subsp. paratuberculosis
caccgcggcggugucggcgcc

SEQ ID NO: 2974765 - RNA, 15 nt, Mycobacterium avium subsp. paratuberculosis
caccgcggcguagcg

SEQ ID NO: 2974766 - RNA, 17 nt, Mycobacterium avium subsp. paratuberculosis
caccgcggcguagcgcc

SEQ ID NO: 2974767 - RNA, 22 nt, Mycobacterium avium subsp. paratuberculosis
caccgcggcguagcgccagucg

SEQ ID NO: 2974768 - RNA, 13 nt, Mycobacterium avium subsp. paratuberculosis
caccgcggcgugg

SEQ ID NO: 2974769 - RNA, 16 nt, Mycobacterium avium subsp. paratuberculosis
caccgcggcucggucg

SEQ ID NO: 2974770 - RNA, 18 nt, Mycobacterium avium subsp. paratuberculosis
caccgcggcucggucgcg

SEQ ID NO: 2974771 - RNA, 22 nt, Mycobacterium avium subsp. paratuberculosis
caccgcgggaauggccgcgccg

SEQ ID NO: 2974772 - RNA, 14 nt, Mycobacterium avium subsp. paratuberculosis
caccgcgggcagca

SEQ ID NO: 2974773 - RNA, 16 nt, Mycobacterium avium subsp. paratuberculosis
caccgcgggccaggcc

SEQ ID NO: 2974774 - RNA, 17 nt, Mycobacterium avium subsp. paratuberculosis
caccgcgggccaggccc

SEQ ID NO: 2974775 - RNA, 15 nt, Mycobacterium avium subsp. paratuberculosis
caccgcgggcgcgcc

SEQ ID NO: 2974776 - RNA, 20 nt, Mycobacterium avium subsp. paratuberculosis
caccgcgggcgcgccguccc

SEQ ID NO: 2974777 - RNA, 22 nt, Mycobacterium avium subsp. paratuberculosis
caccgcgggcgcgccgucccag

SEQ ID NO: 2974778 - RNA, 12 nt, Mycobacterium avium subsp. paratuberculosis
caccgcgggcuc

SEQ ID NO: 2974779 - RNA, 20 nt, Mycobacterium avium subsp. paratuberculosis
caccgcggggcugggcgcca

SEQ ID NO: 2974780 - RNA, 16 nt, Mycobacterium avium subsp. paratuberculosis
caccgcgggggcggcc

SEQ ID NO: 2974781 - RNA, 23 nt, Mycobacterium avium subsp. paratuberculosis
caccgcgggggcggccgggccgc

SEQ ID NO: 2974782 - RNA, 13 nt, Mycobacterium avium subsp. paratuberculosis
caccgcggggugc

SEQ ID NO: 2974783 - RNA, 21 nt, Mycobacterium avium subsp. paratuberculosis
caccgcggggugcccggcgag

SEQ ID NO: 2974784 - RNA, 15 nt, Mycobacterium avium subsp. paratuberculosis
caccgcggucgacgg

SEQ ID NO: 2974785 - RNA, 17 nt, Mycobacterium avium subsp. paratuberculosis
caccgcggucgacggga

SEQ ID NO: 2974786 - RNA, 17 nt, Mycobacterium avium subsp. paratuberculosis
caccgcggucugcgcca

SEQ ID NO: 2974787 - RNA, 17 nt, Mycobacterium avium subsp. paratuberculosis
caccgcggugaccgccc

SEQ ID NO: 2974788 - RNA, 18 nt, Mycobacterium avium subsp. paratuberculosis
caccgcggugaccgcccg

SEQ ID NO: 2974789 - RNA, 20 nt, Mycobacterium avium subsp. paratuberculosis
caccgcggugaccgcccgcu

SEQ ID NO: 2974790 - RNA, 23 nt, Mycobacterium avium subsp. paratuberculosis
caccgcggugaccgcccgcucga

SEQ ID NO: 2974791 - RNA, 18 nt, Mycobacterium avium subsp. paratuberculosis
caccgcggugagcggccg

SEQ ID NO: 2974792 - RNA, 18 nt, Mycobacterium avium subsp. paratuberculosis
caccgcgguguugagcgc

SEQ ID NO: 2974793 - RNA, 19 nt, Mycobacterium avium subsp. paratuberculosis
caccgcgguguugagcgcg

SEQ ID NO: 2974794 - RNA, 21 nt, Mycobacterium avium subsp. paratuberculosis
caccgcgguugcccucgguca

SEQ ID NO: 2974795 - RNA, 23 nt, Mycobacterium avium subsp. paratuberculosis
caccgcguagaacuucaucugga

SEQ ID NO: 2974796 - RNA, 17 nt, Mycobacterium avium subsp. paratuberculosis
caccgcguagcgccgcc

SEQ ID NO: 2974797 - RNA, 18 nt, Mycobacterium avium subsp. paratuberculosis
caccgcguagcgccgccc

SEQ ID NO: 2974798 - RNA, 21 nt, Mycobacterium avium subsp. paratuberculosis
caccgcguagcgccgcccguc

SEQ ID NO: 2974799 - RNA, 22 nt, Mycobacterium avium subsp. paratuberculosis
caccgcguagcgccgcccgucc

SEQ ID NO: 2974800 - RNA, 14 nt, Mycobacterium avium subsp. paratuberculosis
caccgcguccugca

SEQ ID NO: 2974801 - RNA, 23 nt, Mycobacterium avium subsp. paratuberculosis
caccgcguccugcaggcaggccg

SEQ ID NO: 2974802 - RNA, 23 nt, Mycobacterium avium subsp. paratuberculosis
caccgcguccuucuccgccgggc

SEQ ID NO: 2974803 - RNA, 15 nt, Mycobacterium avium subsp. paratuberculosis
caccgcgucgaccac

SEQ ID NO: 2974804 - RNA, 17 nt, Mycobacterium avium subsp. paratuberculosis
caccgcgucgaccaccg

SEQ ID NO: 2974805 - RNA, 22 nt, Mycobacterium avium subsp. paratuberculosis
caccgcgucgaugcgggcccgc

SEQ ID NO: 2974806 - RNA, 15 nt, Mycobacterium avium subsp. paratuberculosis
caccgcgucgcagug

SEQ ID NO: 2974807 - RNA, 13 nt, Mycobacterium avium subsp. paratuberculosis
caccgcgucggcc

SEQ ID NO: 2974808 - RNA, 15 nt, Mycobacterium avium subsp. paratuberculosis
caccgcgucggcgcu

SEQ ID NO: 2974809 - RNA, 20 nt, Mycobacterium avium subsp. paratuberculosis
caccgcgucggcgcuggcca

SEQ ID NO: 2974810 - RNA, 15 nt, Mycobacterium avium subsp. paratuberculosis
caccgcgugcgagcc

SEQ ID NO: 2974811 - RNA, 22 nt, Mycobacterium avium subsp. paratuberculosis
caccgcgugcgagccgagcacg

SEQ ID NO: 2974812 - RNA, 17 nt, Mycobacterium avium subsp. paratuberculosis
caccgcguugaucagcg

SEQ ID NO: 2974813 - RNA, 16 nt, Mycobacterium avium subsp. paratuberculosis
caccgcguuggccgcc

SEQ ID NO: 2974814 - RNA, 17 nt, Mycobacterium avium subsp. paratuberculosis
caccgcguuggccgcca

SEQ ID NO: 2974815 - RNA, 18 nt, Mycobacterium avium subsp. paratuberculosis
caccgcguuggccgccac

SEQ ID NO: 2974816 - RNA, 20 nt, Mycobacterium avium subsp. paratuberculosis
caccgcguuggccgccacga

SEQ ID NO: 2974817 - RNA, 19 nt, Mycobacterium avium subsp. paratuberculosis
caccgcguugucggcgacg

SEQ ID NO: 2974818 - RNA, 23 nt, Mycobacterium avium subsp. paratuberculosis
caccgcguugucggcgacggcgg

SEQ ID NO: 2974819 - RNA, 22 nt, Mycobacterium avium subsp. paratuberculosis
caccgcugagguagucccgcgc

SEQ ID NO: 2974820 - RNA, 14 nt, Mycobacterium avium subsp. paratuberculosis
caccgcugaugccg

SEQ ID NO: 2974821 - RNA, 16 nt, Mycobacterium avium subsp. paratuberculosis
caccgcugaugccgcc

SEQ ID NO: 2974822 - RNA, 19 nt, Mycobacterium avium subsp. paratuberculosis
caccgcugaugccgccgaa

SEQ ID NO: 2974823 - RNA, 13 nt, Mycobacterium avium subsp. paratuberculosis
caccgcugccggc

SEQ ID NO: 2974824 - RNA, 15 nt, Mycobacterium avium subsp. paratuberculosis
caccgcuggccgagg

SEQ ID NO: 2974825 - RNA, 17 nt, Mycobacterium avium subsp. paratuberculosis
caccgcuggccgaggcc

SEQ ID NO: 2974826 - RNA, 16 nt, Mycobacterium avium subsp. paratuberculosis
caccgcugggcggcgc

SEQ ID NO: 2974827 - RNA, 20 nt, Mycobacterium avium subsp. paratuberculosis
caccgcuguggacaggucga

SEQ ID NO: 2974828 - RNA, 19 nt, Mycobacterium avium subsp. paratuberculosis
caccggaagcgcgcaucgc

SEQ ID NO: 2974829 - RNA, 20 nt, Mycobacterium avium subsp. paratuberculosis
caccggaagcgcgcaucgcg

SEQ ID NO: 2974830 - RNA, 13 nt, Mycobacterium avium subsp. paratuberculosis
caccggaccgccg

SEQ ID NO: 2974831 - RNA, 13 nt, Mycobacterium avium subsp. paratuberculosis
caccggaccggcc

SEQ ID NO: 2974832 - RNA, 15 nt, Mycobacterium avium subsp. paratuberculosis
caccggaccggccag

SEQ ID NO: 2974833 - RNA, 16 nt, Mycobacterium avium subsp. paratuberculosis
caccggaccggccagc

SEQ ID NO: 2974834 - RNA, 17 nt, Mycobacterium avium subsp. paratuberculosis
caccggaccggccagca

SEQ ID NO: 2974835 - RNA, 13 nt, Mycobacterium avium subsp. paratuberculosis
caccggacgcagc

SEQ ID NO: 2974836 - RNA, 19 nt, Mycobacterium avium subsp. paratuberculosis
caccggacgcagcgaucgg

SEQ ID NO: 2974837 - RNA, 20 nt, Mycobacterium avium subsp. paratuberculosis
caccggacugcuugggcgcc

SEQ ID NO: 2974838 - RNA, 16 nt, Mycobacterium avium subsp. paratuberculosis
caccggaucgaccaac

SEQ ID NO: 2974839 - RNA, 20 nt, Mycobacterium avium subsp. paratuberculosis
caccggaugcaccggcagcc

SEQ ID NO: 2974840 - RNA, 20 nt, Mycobacterium avium subsp. paratuberculosis
caccggaugcucaccgguca

SEQ ID NO: 2974841 - RNA, 18 nt, Mycobacterium avium subsp. paratuberculosis
caccggauggcgcccggc

SEQ ID NO: 2974842 - RNA, 21 nt, Mycobacterium avium subsp. paratuberculosis
caccggauggcgcccggcagc

SEQ ID NO: 2974843 - RNA, 18 nt, Mycobacterium avium subsp. paratuberculosis
caccggauucggcuccug

SEQ ID NO: 2974844 - RNA, 13 nt, Mycobacterium avium subsp. paratuberculosis
caccggcaaccgc

SEQ ID NO: 2974845 - RNA, 18 nt, Mycobacterium avium subsp. paratuberculosis
caccggcaaccgccacga

SEQ ID NO: 2974846 - RNA, 20 nt, Mycobacterium avium subsp. paratuberculosis
caccggcaaggugccguccg

SEQ ID NO: 2974847 - RNA, 20 nt, Mycobacterium avium subsp. paratuberculosis
caccggcaaucgggacgcca

SEQ ID NO: 2974848 - RNA, 13 nt, Mycobacterium avium subsp. paratuberculosis
caccggcaccacg

SEQ ID NO: 2974849 - RNA, 15 nt, Mycobacterium avium subsp. paratuberculosis
caccggcacccccaa

SEQ ID NO: 2974850 - RNA, 16 nt, Mycobacterium avium subsp. paratuberculosis
caccggcacccccaau

SEQ ID NO: 2974851 - RNA, 15 nt, Mycobacterium avium subsp. paratuberculosis
caccggcaccgcccc

SEQ ID NO: 2974852 - RNA, 18 nt, Mycobacterium avium subsp. paratuberculosis
caccggcaccgcccccgc

SEQ ID NO: 2974853 - RNA, 23 nt, Mycobacterium avium subsp. paratuberculosis
caccggcaccgcccccgcggcgg

SEQ ID NO: 2974854 - RNA, 18 nt, Mycobacterium avium subsp. paratuberculosis
caccggcacgaucgucgc

SEQ ID NO: 2974855 - RNA, 23 nt, Mycobacterium avium subsp. paratuberculosis
caccggcacgaucgucgccgcca

SEQ ID NO: 2974856 - RNA, 17 nt, Mycobacterium avium subsp. paratuberculosis
caccggcacggcaccgc

SEQ ID NO: 2974857 - RNA, 22 nt, Mycobacterium avium subsp. paratuberculosis
caccggcacggcaccgcgagca

SEQ ID NO: 2974858 - RNA, 23 nt, Mycobacterium avium subsp. paratuberculosis
caccggcacgucgagcuccucgg

SEQ ID NO: 2974859 - RNA, 14 nt, Mycobacterium avium subsp. paratuberculosis
caccggcacgucgg

SEQ ID NO: 2974860 - RNA, 16 nt, Mycobacterium avium subsp. paratuberculosis
caccggcacgucggcc

SEQ ID NO: 2974861 - RNA, 21 nt, Mycobacterium avium subsp. paratuberculosis
caccggcacgucggccacgcc

SEQ ID NO: 2974862 - RNA, 19 nt, Mycobacterium avium subsp. paratuberculosis
caccggcacgugcggguug

SEQ ID NO: 2974863 - RNA, 15 nt, Mycobacterium avium subsp. paratuberculosis
caccggcagcaccgc

SEQ ID NO: 2974864 - RNA, 20 nt, Mycobacterium avium subsp. paratuberculosis
caccggcagcaccgccgagc

SEQ ID NO: 2974865 - RNA, 14 nt, Mycobacterium avium subsp. paratuberculosis
caccggcagcagcg

SEQ ID NO: 2974866 - RNA, 16 nt, Mycobacterium avium subsp. paratuberculosis
caccggcagccgcagc

SEQ ID NO: 2974867 - RNA, 19 nt, Mycobacterium avium subsp. paratuberculosis
caccggcagccgcagcgac

SEQ ID NO: 2974868 - RNA, 21 nt, Mycobacterium avium subsp. paratuberculosis
caccggcagccgcagcgacag

SEQ ID NO: 2974869 - RNA, 13 nt, Mycobacterium avium subsp. paratuberculosis
caccggcagcgcc

SEQ ID NO: 2974870 - RNA, 16 nt, Mycobacterium avium subsp. paratuberculosis
caccggcagcgccacc

SEQ ID NO: 2974871 - RNA, 17 nt, Mycobacterium avium subsp. paratuberculosis
caccggcagcgccacca

SEQ ID NO: 2974872 - RNA, 12 nt, Mycobacterium avium subsp. paratuberculosis
caccggcaggcg

SEQ ID NO: 2974873 - RNA, 23 nt, Mycobacterium avium subsp. paratuberculosis
caccggcaggcgguagcggcaga

SEQ ID NO: 2974874 - RNA, 13 nt, Mycobacterium avium subsp. paratuberculosis
caccggcagugau

SEQ ID NO: 2974875 - RNA, 19 nt, Mycobacterium avium subsp. paratuberculosis
caccggcagugaucggcgg

SEQ ID NO: 2974876 - RNA, 20 nt, Mycobacterium avium subsp. paratuberculosis
caccggcagugaucggcgga

SEQ ID NO: 2974877 - RNA, 16 nt, Mycobacterium avium subsp. paratuberculosis
caccggcaucgguggc

SEQ ID NO: 2974878 - RNA, 18 nt, Mycobacterium avium subsp. paratuberculosis
caccggcaugugccacag

SEQ ID NO: 2974879 - RNA, 23 nt, Mycobacterium avium subsp. paratuberculosis
caccggcaugugccacagguaca

SEQ ID NO: 2974880 - RNA, 13 nt, Mycobacterium avium subsp. paratuberculosis
caccggccacucg

SEQ ID NO: 2974881 - RNA, 18 nt, Mycobacterium avium subsp. paratuberculosis
caccggccacucgcgucc

SEQ ID NO: 2974882 - RNA, 17 nt, Mycobacterium avium subsp. paratuberculosis
caccggccagggccgcc

SEQ ID NO: 2974883 - RNA, 20 nt, Mycobacterium avium subsp. paratuberculosis
caccggccagggccgccgca

SEQ ID NO: 2974884 - RNA, 22 nt, Mycobacterium avium subsp. paratuberculosis
caccggccagggccgccgcaua

SEQ ID NO: 2974885 - RNA, 19 nt, Mycobacterium avium subsp. paratuberculosis
caccggcccagccggcggu

SEQ ID NO: 2974886 - RNA, 17 nt, Mycobacterium avium subsp. paratuberculosis
caccggcccggccggcg

SEQ ID NO: 2974887 - RNA, 16 nt, Mycobacterium avium subsp. paratuberculosis
caccggcccggcgggc

SEQ ID NO: 2974888 - RNA, 17 nt, Mycobacterium avium subsp. paratuberculosis
caccggcccggcgggca

SEQ ID NO: 2974889 - RNA, 15 nt, Mycobacterium avium subsp. paratuberculosis
caccggccgaccggu

SEQ ID NO: 2974890 - RNA, 20 nt, Mycobacterium avium subsp. paratuberculosis
caccggccgaccggucucga

SEQ ID NO: 2974891 - RNA, 22 nt, Mycobacterium avium subsp. paratuberculosis
caccggccgagccgaugcccag

SEQ ID NO: 2974892 - RNA, 13 nt, Mycobacterium avium subsp. paratuberculosis
caccggccgcccg

SEQ ID NO: 2974893 - RNA, 15 nt, Mycobacterium avium subsp. paratuberculosis
caccggccgcccggc

SEQ ID NO: 2974894 - RNA, 18 nt, Mycobacterium avium subsp. paratuberculosis
caccggccgcccggcgag

SEQ ID NO: 2974895 - RNA, 19 nt, Mycobacterium avium subsp. paratuberculosis
caccggccgcccggcgagc

SEQ ID NO: 2974896 - RNA, 20 nt, Mycobacterium avium subsp. paratuberculosis
caccggccgcccggcgagca

SEQ ID NO: 2974897 - RNA, 14 nt, Mycobacterium avium subsp. paratuberculosis
caccggccgcgcgu

SEQ ID NO: 2974898 - RNA, 14 nt, Mycobacterium avium subsp. paratuberculosis
caccggccggaugu

SEQ ID NO: 2974899 - RNA, 14 nt, Mycobacterium avium subsp. paratuberculosis
caccggccggcccc

SEQ ID NO: 2974900 - RNA, 20 nt, Mycobacterium avium subsp. paratuberculosis
caccggccggccccggggga

SEQ ID NO: 2974901 - RNA, 14 nt, Mycobacterium avium subsp. paratuberculosis
caccggccgggacg

SEQ ID NO: 2974902 - RNA, 15 nt, Mycobacterium avium subsp. paratuberculosis
caccggccgggacgg

SEQ ID NO: 2974903 - RNA, 15 nt, Mycobacterium avium subsp. paratuberculosis
caccggccgguccgc

SEQ ID NO: 2974904 - RNA, 21 nt, Mycobacterium avium subsp. paratuberculosis
caccggccgguccgcccagac

SEQ ID NO: 2974905 - RNA, 23 nt, Mycobacterium avium subsp. paratuberculosis
caccggccgguccgcccagacgc

SEQ ID NO: 2974906 - RNA, 19 nt, Mycobacterium avium subsp. paratuberculosis
caccggccuucaccagggu

SEQ ID NO: 2974907 - RNA, 20 nt, Mycobacterium avium subsp. paratuberculosis
caccggcgaggugaaccgcg

SEQ ID NO: 2974908 - RNA, 23 nt, Mycobacterium avium subsp. paratuberculosis
caccggcgaguccgcggaggcga

SEQ ID NO: 2974909 - RNA, 15 nt, Mycobacterium avium subsp. paratuberculosis
caccggcgaugcaga

SEQ ID NO: 2974910 - RNA, 16 nt, Mycobacterium avium subsp. paratuberculosis
caccggcgcagcgcgu

SEQ ID NO: 2974911 - RNA, 22 nt, Mycobacterium avium subsp. paratuberculosis
caccggcgcagcgcgucgcgcc

SEQ ID NO: 2974912 - RNA, 14 nt, Mycobacterium avium subsp. paratuberculosis
caccggcgccaggu

SEQ ID NO: 2974913 - RNA, 15 nt, Mycobacterium avium subsp. paratuberculosis
caccggcgccccggg

SEQ ID NO: 2974914 - RNA, 16 nt, Mycobacterium avium subsp. paratuberculosis
caccggcgccccgggc

SEQ ID NO: 2974915 - RNA, 12 nt, Mycobacterium avium subsp. paratuberculosis
caccggcgccuc

SEQ ID NO: 2974916 - RNA, 13 nt, Mycobacterium avium subsp. paratuberculosis
caccggcgcgacg

SEQ ID NO: 2974917 - RNA, 15 nt, Mycobacterium avium subsp. paratuberculosis
caccggcgcgacggc

SEQ ID NO: 2974918 - RNA, 16 nt, Mycobacterium avium subsp. paratuberculosis
caccggcgcgacggcg

SEQ ID NO: 2974919 - RNA, 13 nt, Mycobacterium avium subsp. paratuberculosis
caccggcgcgccg

SEQ ID NO: 2974920 - RNA, 16 nt, Mycobacterium avium subsp. paratuberculosis
caccggcgcgccgcgu

SEQ ID NO: 2974921 - RNA, 22 nt, Mycobacterium avium subsp. paratuberculosis
caccggcgcgccgcguucggcg

SEQ ID NO: 2974922 - RNA, 14 nt, Mycobacterium avium subsp. paratuberculosis
caccggcgcgccgu

SEQ ID NO: 2974923 - RNA, 18 nt, Mycobacterium avium subsp. paratuberculosis
caccggcgcgccguccuu

SEQ ID NO: 2974924 - RNA, 18 nt, Mycobacterium avium subsp. paratuberculosis
caccggcgcguuggcccg

SEQ ID NO: 2974925 - RNA, 16 nt, Mycobacterium avium subsp. paratuberculosis
caccggcgcugcccgc

SEQ ID NO: 2974926 - RNA, 13 nt, Mycobacterium avium subsp. paratuberculosis
caccggcggaucc

SEQ ID NO: 2974927 - RNA, 20 nt, Mycobacterium avium subsp. paratuberculosis
caccggcggauccucagucc

SEQ ID NO: 2974928 - RNA, 22 nt, Mycobacterium avium subsp. paratuberculosis
caccggcggauucucgcucugc

SEQ ID NO: 2974929 - RNA, 14 nt, Mycobacterium avium subsp. paratuberculosis
caccggcggcgacg

SEQ ID NO: 2974930 - RNA, 14 nt, Mycobacterium avium subsp. paratuberculosis
caccggcggcggcc

SEQ ID NO: 2974931 - RNA, 23 nt, Mycobacterium avium subsp. paratuberculosis
caccggcggcggccuucuucugc

SEQ ID NO: 2974932 - RNA, 22 nt, Mycobacterium avium subsp. paratuberculosis
caccggcgucauggugcgcggg

SEQ ID NO: 2974933 - RNA, 14 nt, Mycobacterium avium subsp. paratuberculosis
caccggcgucgaca

SEQ ID NO: 2974934 - RNA, 17 nt, Mycobacterium avium subsp. paratuberculosis
caccggcgucgacagcc

SEQ ID NO: 2974935 - RNA, 20 nt, Mycobacterium avium subsp. paratuberculosis
caccggcgugaugacggcgg

SEQ ID NO: 2974936 - RNA, 21 nt, Mycobacterium avium subsp. paratuberculosis
caccggcgugaugacggcggc

SEQ ID NO: 2974937 - RNA, 16 nt, Mycobacterium avium subsp. paratuberculosis
caccggcguggggacc

SEQ ID NO: 2974938 - RNA, 23 nt, Mycobacterium avium subsp. paratuberculosis
caccggcguggugggcagaugcc

SEQ ID NO: 2974939 - RNA, 21 nt, Mycobacterium avium subsp. paratuberculosis
caccggcuccuugcgccgcaa

SEQ ID NO: 2974940 - RNA, 21 nt, Mycobacterium avium subsp. paratuberculosis
caccggcucgcggggugucgu

SEQ ID NO: 2974941 - RNA, 20 nt, Mycobacterium avium subsp. paratuberculosis
caccggcucgcugaucugcg

SEQ ID NO: 2974942 - RNA, 13 nt, Mycobacterium avium subsp. paratuberculosis
caccggcugcccc

SEQ ID NO: 2974943 - RNA, 14 nt, Mycobacterium avium subsp. paratuberculosis
caccggcugcccca

SEQ ID NO: 2974944 - RNA, 15 nt, Mycobacterium avium subsp. paratuberculosis
caccggcugcccgac

SEQ ID NO: 2974945 - RNA, 16 nt, Mycobacterium avium subsp. paratuberculosis
caccggcugcccgacc

SEQ ID NO: 2974946 - RNA, 19 nt, Mycobacterium avium subsp. paratuberculosis
caccggcugcccgacccgc

SEQ ID NO: 2974947 - RNA, 21 nt, Mycobacterium avium subsp. paratuberculosis
caccggcugcccgacccgcac

SEQ ID NO: 2974948 - RNA, 13 nt, Mycobacterium avium subsp. paratuberculosis
caccggcuggccg

SEQ ID NO: 2974949 - RNA, 22 nt, Mycobacterium avium subsp. paratuberculosis
caccggcuggccgagcggcugc

SEQ ID NO: 2974950 - RNA, 23 nt, Mycobacterium avium subsp. paratuberculosis
caccggcuggccgagcggcugcu

SEQ ID NO: 2974951 - RNA, 14 nt, Mycobacterium avium subsp. paratuberculosis
caccggcuggccgg

SEQ ID NO: 2974952 - RNA, 15 nt, Mycobacterium avium subsp. paratuberculosis
caccggcuggccgga

SEQ ID NO: 2974953 - RNA, 16 nt, Mycobacterium avium subsp. paratuberculosis
caccggcuggugcagc

SEQ ID NO: 2974954 - RNA, 17 nt, Mycobacterium avium subsp. paratuberculosis
caccggcuggugcagca

SEQ ID NO: 2974955 - RNA, 23 nt, Mycobacterium avium subsp. paratuberculosis
caccggcuggugcagcagcugga

SEQ ID NO: 2974956 - RNA, 17 nt, Mycobacterium avium subsp. paratuberculosis
caccggcuucuccucgg

SEQ ID NO: 2974957 - RNA, 18 nt, Mycobacterium avium subsp. paratuberculosis
caccggcuucuccucggu

SEQ ID NO: 2974958 - RNA, 16 nt, Mycobacterium avium subsp. paratuberculosis
caccggcuugccgauc

SEQ ID NO: 2974959 - RNA, 16 nt, Mycobacterium avium subsp. paratuberculosis
caccggcuuggccacg

SEQ ID NO: 2974960 - RNA, 15 nt, Mycobacterium avium subsp. paratuberculosis
caccggcuuggcggu

SEQ ID NO: 2974961 - RNA, 15 nt, Mycobacterium avium subsp. paratuberculosis
caccgggaacagcca

SEQ ID NO: 2974962 - RNA, 17 nt, Mycobacterium avium subsp. paratuberculosis
caccgggaacagccagg

SEQ ID NO: 2974963 - RNA, 20 nt, Mycobacterium avium subsp. paratuberculosis
caccgggaccagcgcggugc

SEQ ID NO: 2974964 - RNA, 16 nt, Mycobacterium avium subsp. paratuberculosis
caccgggaccgucggg

SEQ ID NO: 2974965 - RNA, 13 nt, Mycobacterium avium subsp. paratuberculosis
caccgggaccugc

SEQ ID NO: 2974966 - RNA, 17 nt, Mycobacterium avium subsp. paratuberculosis
caccgggaccugcugcu

SEQ ID NO: 2974967 - RNA, 23 nt, Mycobacterium avium subsp. paratuberculosis
caccgggaccugcugcucgucgc

SEQ ID NO: 2974968 - RNA, 23 nt, Mycobacterium avium subsp. paratuberculosis
caccgggaccugggucugcggcc

SEQ ID NO: 2974969 - RNA, 24 nt, Mycobacterium avium subsp. paratuberculosis
caccgggaccugggucugcggccg

SEQ ID NO: 2974970 - RNA, 13 nt, Mycobacterium avium subsp. paratuberculosis
caccgggacgggg

SEQ ID NO: 2974971 - RNA, 15 nt, Mycobacterium avium subsp. paratuberculosis
caccgggacgggggu

SEQ ID NO: 2974972 - RNA, 16 nt, Mycobacterium avium subsp. paratuberculosis
caccgggacgggggug

SEQ ID NO: 2974973 - RNA, 20 nt, Mycobacterium avium subsp. paratuberculosis
caccgggacgggggugccga

SEQ ID NO: 2974974 - RNA, 15 nt, Mycobacterium avium subsp. paratuberculosis
caccgggauccggcg

SEQ ID NO: 2974975 - RNA, 22 nt, Mycobacterium avium subsp. paratuberculosis
caccgggauccggcgcgccgcg

SEQ ID NO: 2974976 - RNA, 15 nt, Mycobacterium avium subsp. paratuberculosis
caccgggaucggcgg

SEQ ID NO: 2974977 - RNA, 19 nt, Mycobacterium avium subsp. paratuberculosis
caccgggaucggcggcggg

SEQ ID NO: 2974978 - RNA, 22 nt, Mycobacterium avium subsp. paratuberculosis
caccgggaucggggugccgccg

SEQ ID NO: 2974979 - RNA, 23 nt, Mycobacterium avium subsp. paratuberculosis
caccgggauggcguucugcaccg

SEQ ID NO: 2974980 - RNA, 20 nt, Mycobacterium avium subsp. paratuberculosis
caccgggauggugaccagcg

SEQ ID NO: 2974981 - RNA, 22 nt, Mycobacterium avium subsp. paratuberculosis
caccgggauggugaccagcgcc

SEQ ID NO: 2974982 - RNA, 15 nt, Mycobacterium avium subsp. paratuberculosis
caccgggcaccgaca

SEQ ID NO: 2974983 - RNA, 16 nt, Mycobacterium avium subsp. paratuberculosis
caccgggcagccgcac

SEQ ID NO: 2974984 - RNA, 17 nt, Mycobacterium avium subsp. paratuberculosis
caccgggcagccgcaca

SEQ ID NO: 2974985 - RNA, 19 nt, Mycobacterium avium subsp. paratuberculosis
caccgggcagccgcacacc

SEQ ID NO: 2974986 - RNA, 24 nt, Mycobacterium avium subsp. paratuberculosis
caccgggcagccgcacaccgcggc

SEQ ID NO: 2974987 - RNA, 20 nt, Mycobacterium avium subsp. paratuberculosis
caccgggcaguagaacggcc

SEQ ID NO: 2974988 - RNA, 14 nt, Mycobacterium avium subsp. paratuberculosis
caccgggcccgccc

SEQ ID NO: 2974989 - RNA, 16 nt, Mycobacterium avium subsp. paratuberculosis
caccgggcccgcccgc

SEQ ID NO: 2974990 - RNA, 21 nt, Mycobacterium avium subsp. paratuberculosis
caccgggccgaaggcggcgcc

SEQ ID NO: 2974991 - RNA, 22 nt, Mycobacterium avium subsp. paratuberculosis
caccgggccgaaggcggcgccg

SEQ ID NO: 2974992 - RNA, 13 nt, Mycobacterium avium subsp. paratuberculosis
caccgggccgcca

SEQ ID NO: 2974993 - RNA, 14 nt, Mycobacterium avium subsp. paratuberculosis
caccgggccgccau

SEQ ID NO: 2974994 - RNA, 21 nt, Mycobacterium avium subsp. paratuberculosis
caccgggcgacaccccgcgag

SEQ ID NO: 2974995 - RNA, 17 nt, Mycobacterium avium subsp. paratuberculosis
caccgggcggccguggu

SEQ ID NO: 2974996 - RNA, 13 nt, Mycobacterium avium subsp. paratuberculosis
caccgggcgucgg

SEQ ID NO: 2974997 - RNA, 14 nt, Mycobacterium avium subsp. paratuberculosis
caccgggcgucggc

SEQ ID NO: 2974998 - RNA, 15 nt, Mycobacterium avium subsp. paratuberculosis
caccgggcgucggcg

SEQ ID NO: 2974999 - RNA, 17 nt, Mycobacterium avium subsp. paratuberculosis
caccgggcgucggggcc

SEQ ID NO: 2975000 - RNA, 16 nt, Mycobacterium avium subsp. paratuberculosis
caccgggcucggucac

SEQ ID NO: 2975001 - RNA, 17 nt, Mycobacterium avium subsp. paratuberculosis
caccgggcucggucacc

SEQ ID NO: 2975002 - RNA, 19 nt, Mycobacterium avium subsp. paratuberculosis
caccgggcucggucacccc

SEQ ID NO: 2975003 - RNA, 19 nt, Mycobacterium avium subsp. paratuberculosis
caccgggcugucgggcagg

SEQ ID NO: 2975004 - RNA, 21 nt, Mycobacterium avium subsp. paratuberculosis
caccggggccaacuccggcgg

SEQ ID NO: 2975005 - RNA, 23 nt, Mycobacterium avium subsp. paratuberculosis
caccggggccaacuccggcggca

SEQ ID NO: 2975006 - RNA, 23 nt, Mycobacterium avium subsp. paratuberculosis
caccggggccagguacuccucga

SEQ ID NO: 2975007 - RNA, 14 nt, Mycobacterium avium subsp. paratuberculosis
caccggggccggcg

SEQ ID NO: 2975008 - RNA, 15 nt, Mycobacterium avium subsp. paratuberculosis
caccggggccggcgg

SEQ ID NO: 2975009 - RNA, 17 nt, Mycobacterium avium subsp. paratuberculosis
caccggggccggcgggg

SEQ ID NO: 2975010 - RNA, 20 nt, Mycobacterium avium subsp. paratuberculosis
caccggggccggcgggggcg

SEQ ID NO: 2975011 - RNA, 20 nt, Mycobacterium avium subsp. paratuberculosis
caccggggucaccuuggccg

SEQ ID NO: 2975012 - RNA, 22 nt, Mycobacterium avium subsp. paratuberculosis
caccggggucaccuuggccgga

SEQ ID NO: 2975013 - RNA, 17 nt, Mycobacterium avium subsp. paratuberculosis
caccggggucugcacga

SEQ ID NO: 2975014 - RNA, 15 nt, Mycobacterium avium subsp. paratuberculosis
caccggggugccgcc

SEQ ID NO: 2975015 - RNA, 16 nt, Mycobacterium avium subsp. paratuberculosis
caccggggugccgccc

SEQ ID NO: 2975016 - RNA, 17 nt, Mycobacterium avium subsp. paratuberculosis
caccggggugccgccca

SEQ ID NO: 2975017 - RNA, 17 nt, Mycobacterium avium subsp. paratuberculosis
caccggguacaccggcu

SEQ ID NO: 2975018 - RNA, 20 nt, Mycobacterium avium subsp. paratuberculosis
caccggguacaccggcucgc

SEQ ID NO: 2975019 - RNA, 23 nt, Mycobacterium avium subsp. paratuberculosis
caccggguacaccggcucgcuga

SEQ ID NO: 2975020 - RNA, 20 nt, Mycobacterium avium subsp. paratuberculosis
caccgggucccccgccgacc

SEQ ID NO: 2975021 - RNA, 18 nt, Mycobacterium avium subsp. paratuberculosis
caccgggucguccgcgac

SEQ ID NO: 2975022 - RNA, 19 nt, Mycobacterium avium subsp. paratuberculosis
caccgggucguccgcgacg

SEQ ID NO: 2975023 - RNA, 18 nt, Mycobacterium avium subsp. paratuberculosis
caccgggugauaccggcc

SEQ ID NO: 2975024 - RNA, 23 nt, Mycobacterium avium subsp. paratuberculosis
caccgggugauaccggcccagcg

SEQ ID NO: 2975025 - RNA, 22 nt, Mycobacterium avium subsp. paratuberculosis
caccgggugaugucgccgacca

SEQ ID NO: 2975026 - RNA, 15 nt, Mycobacterium avium subsp. paratuberculosis
caccgggugcgucca

SEQ ID NO: 2975027 - RNA, 21 nt, Mycobacterium avium subsp. paratuberculosis
caccggucagcgcuacugccg

SEQ ID NO: 2975028 - RNA, 14 nt, Mycobacterium avium subsp. paratuberculosis
caccgguccggccg

SEQ ID NO: 2975029 - RNA, 15 nt, Mycobacterium avium subsp. paratuberculosis
caccgguccggccgu

SEQ ID NO: 2975030 - RNA, 17 nt, Mycobacterium avium subsp. paratuberculosis
caccgguccggccgugc

SEQ ID NO: 2975031 - RNA, 20 nt, Mycobacterium avium subsp. paratuberculosis
caccgguccggucacgcccg

SEQ ID NO: 2975032 - RNA, 18 nt, Mycobacterium avium subsp. paratuberculosis
caccggucgacgacgaac

SEQ ID NO: 2975033 - RNA, 23 nt, Mycobacterium avium subsp. paratuberculosis
caccggucgcguugaaagccgcg

SEQ ID NO: 2975034 - RNA, 20 nt, Mycobacterium avium subsp. paratuberculosis
caccggucggugcccagcac

SEQ ID NO: 2975035 - RNA, 14 nt, Mycobacterium avium subsp. paratuberculosis
caccggugacgacc

SEQ ID NO: 2975036 - RNA, 20 nt, Mycobacterium avium subsp. paratuberculosis
caccggugacgaccggcagc

SEQ ID NO: 2975037 - RNA, 16 nt, Mycobacterium avium subsp. paratuberculosis
caccggugcaccgcgc

SEQ ID NO: 2975038 - RNA, 14 nt, Mycobacterium avium subsp. paratuberculosis
caccggugcggcgg

SEQ ID NO: 2975039 - RNA, 15 nt, Mycobacterium avium subsp. paratuberculosis
caccggugcucuccu

SEQ ID NO: 2975040 - RNA, 18 nt, Mycobacterium avium subsp. paratuberculosis
caccggugcucuccugcu

SEQ ID NO: 2975041 - RNA, 20 nt, Mycobacterium avium subsp. paratuberculosis
caccgguggccgcgucgacc

SEQ ID NO: 2975042 - RNA, 18 nt, Mycobacterium avium subsp. paratuberculosis
caccgguggcguugcggg

SEQ ID NO: 2975043 - RNA, 21 nt, Mycobacterium avium subsp. paratuberculosis
caccgguggcguugcgggcga

SEQ ID NO: 2975044 - RNA, 19 nt, Mycobacterium avium subsp. paratuberculosis
caccggugucacgcuggcg

SEQ ID NO: 2975045 - RNA, 14 nt, Mycobacterium avium subsp. paratuberculosis
caccgguugcgccg

SEQ ID NO: 2975046 - RNA, 16 nt, Mycobacterium avium subsp. paratuberculosis
caccgguugcgccgag

SEQ ID NO: 2975047 - RNA, 17 nt, Mycobacterium avium subsp. paratuberculosis
caccgguugcgccgagg

SEQ ID NO: 2975048 - RNA, 19 nt, Mycobacterium avium subsp. paratuberculosis
caccgguuugucggcgccc

SEQ ID NO: 2975049 - RNA, 15 nt, Mycobacterium avium subsp. paratuberculosis
caccgucaccgacgg

SEQ ID NO: 2975050 - RNA, 13 nt, Mycobacterium avium subsp. paratuberculosis
caccgucaccgcc

SEQ ID NO: 2975051 - RNA, 14 nt, Mycobacterium avium subsp. paratuberculosis
caccgucaccgccg

SEQ ID NO: 2975052 - RNA, 15 nt, Mycobacterium avium subsp. paratuberculosis
caccgucaccgccgc

SEQ ID NO: 2975053 - RNA, 18 nt, Mycobacterium avium subsp. paratuberculosis
caccgucaccgccgcacc

SEQ ID NO: 2975054 - RNA, 14 nt, Mycobacterium avium subsp. paratuberculosis
caccgucaccgccu

SEQ ID NO: 2975055 - RNA, 14 nt, Mycobacterium avium subsp. paratuberculosis
caccgucaggguga

SEQ ID NO: 2975056 - RNA, 21 nt, Mycobacterium avium subsp. paratuberculosis
caccgucagggugacguggcg

SEQ ID NO: 2975057 - RNA, 22 nt, Mycobacterium avium subsp. paratuberculosis
caccgucagggugacguggcgg

SEQ ID NO: 2975058 - RNA, 14 nt, Mycobacterium avium subsp. paratuberculosis
caccgucagggugg

SEQ ID NO: 2975059 - RNA, 13 nt, Mycobacterium avium subsp. paratuberculosis
caccgucaucgcg

SEQ ID NO: 2975060 - RNA, 17 nt, Mycobacterium avium subsp. paratuberculosis
caccgucaucgcggcga

SEQ ID NO: 2975061 - RNA, 13 nt, Mycobacterium avium subsp. paratuberculosis
caccguccagcuc

SEQ ID NO: 2975062 - RNA, 16 nt, Mycobacterium avium subsp. paratuberculosis
caccgucccggugucg

SEQ ID NO: 2975063 - RNA, 21 nt, Mycobacterium avium subsp. paratuberculosis
caccgucccggugucgccguc

SEQ ID NO: 2975064 - RNA, 22 nt, Mycobacterium avium subsp. paratuberculosis
caccgucccggugucgccgucg

SEQ ID NO: 2975065 - RNA, 22 nt, Mycobacterium avium subsp. paratuberculosis
caccguccuugggaagcaucaa

SEQ ID NO: 2975066 - RNA, 19 nt, Mycobacterium avium subsp. paratuberculosis
caccguccuuguaggugau

SEQ ID NO: 2975067 - RNA, 22 nt, Mycobacterium avium subsp. paratuberculosis
caccguccuuguaggugaucgu

SEQ ID NO: 2975068 - RNA, 13 nt, Mycobacterium avium subsp. paratuberculosis
caccgucgacgac

SEQ ID NO: 2975069 - RNA, 18 nt, Mycobacterium avium subsp. paratuberculosis
caccgucgauggacaggg

SEQ ID NO: 2975070 - RNA, 22 nt, Mycobacterium avium subsp. paratuberculosis
caccgucgauggacagggcgac

SEQ ID NO: 2975071 - RNA, 13 nt, Mycobacterium avium subsp. paratuberculosis
caccgucgccacg

SEQ ID NO: 2975072 - RNA, 16 nt, Mycobacterium avium subsp. paratuberculosis
caccgucgcccgccca

SEQ ID NO: 2975073 - RNA, 18 nt, Mycobacterium avium subsp. paratuberculosis
caccgucgcccgcccagg

SEQ ID NO: 2975074 - RNA, 19 nt, Mycobacterium avium subsp. paratuberculosis
caccgucgcccgcccaggc

SEQ ID NO: 2975075 - RNA, 22 nt, Mycobacterium avium subsp. paratuberculosis
caccgucgcccgcccaggccgc

SEQ ID NO: 2975076 - RNA, 14 nt, Mycobacterium avium subsp. paratuberculosis
caccgucgccggcg

SEQ ID NO: 2975077 - RNA, 15 nt, Mycobacterium avium subsp. paratuberculosis
caccgucgccggcgg

SEQ ID NO: 2975078 - RNA, 22 nt, Mycobacterium avium subsp. paratuberculosis
caccgucgccggcggggcgucg

SEQ ID NO: 2975079 - RNA, 17 nt, Mycobacterium avium subsp. paratuberculosis
caccgucgccggcugac

SEQ ID NO: 2975080 - RNA, 20 nt, Mycobacterium avium subsp. paratuberculosis
caccgucgccggcugacugc

SEQ ID NO: 2975081 - RNA, 20 nt, Mycobacterium avium subsp. paratuberculosis
caccgucgccgugaucuggu

SEQ ID NO: 2975082 - RNA, 20 nt, Mycobacterium avium subsp. paratuberculosis
caccgucgcggucagcucga

SEQ ID NO: 2975083 - RNA, 13 nt, Mycobacterium avium subsp. paratuberculosis
caccgucggcgau

SEQ ID NO: 2975084 - RNA, 14 nt, Mycobacterium avium subsp. paratuberculosis
caccgucggcgauc

SEQ ID NO: 2975085 - RNA, 20 nt, Mycobacterium avium subsp. paratuberculosis
caccgucggcgaucgccggg

SEQ ID NO: 2975086 - RNA, 17 nt, Mycobacterium avium subsp. paratuberculosis
caccgucguacucgacc

SEQ ID NO: 2975087 - RNA, 21 nt, Mycobacterium avium subsp. paratuberculosis
caccgucguccacgcccagcg

SEQ ID NO: 2975088 - RNA, 19 nt, Mycobacterium avium subsp. paratuberculosis
caccgucgucgcaccggca

SEQ ID NO: 2975089 - RNA, 13 nt, Mycobacterium avium subsp. paratuberculosis
caccgucugcugg

SEQ ID NO: 2975090 - RNA, 20 nt, Mycobacterium avium subsp. paratuberculosis
caccgucuucggggccgccg

SEQ ID NO: 2975091 - RNA, 22 nt, Mycobacterium avium subsp. paratuberculosis
caccgucuucggggccgccguc

SEQ ID NO: 2975092 - RNA, 21 nt, Mycobacterium avium subsp. paratuberculosis
caccgucuuggucucgccgau

SEQ ID NO: 2975093 - RNA, 23 nt, Mycobacterium avium subsp. paratuberculosis
caccgugaguucgcugaccgcca

SEQ ID NO: 2975094 - RNA, 16 nt, Mycobacterium avium subsp. paratuberculosis
caccgugaucgccacc

SEQ ID NO: 2975095 - RNA, 18 nt, Mycobacterium avium subsp. paratuberculosis
caccgugaucgccaccac

SEQ ID NO: 2975096 - RNA, 19 nt, Mycobacterium avium subsp. paratuberculosis
caccgugaucgccaccacc

SEQ ID NO: 2975097 - RNA, 12 nt, Mycobacterium avium subsp. paratuberculosis
caccgugccgcc

SEQ ID NO: 2975098 - RNA, 16 nt, Mycobacterium avium subsp. paratuberculosis
caccgugccgcccguc

SEQ ID NO: 2975099 - RNA, 21 nt, Mycobacterium avium subsp. paratuberculosis
caccgugccgcccgucgccuc

SEQ ID NO: 2975100 - RNA, 13 nt, Mycobacterium avium subsp. paratuberculosis
caccgugccgcgc

SEQ ID NO: 2975101 - RNA, 14 nt, Mycobacterium avium subsp. paratuberculosis
caccgugccgcgcg

SEQ ID NO: 2975102 - RNA, 15 nt, Mycobacterium avium subsp. paratuberculosis
caccgugccgcgcgg

SEQ ID NO: 2975103 - RNA, 17 nt, Mycobacterium avium subsp. paratuberculosis
caccgugccgcgcggcg

SEQ ID NO: 2975104 - RNA, 14 nt, Mycobacterium avium subsp. paratuberculosis
caccgugccgucac

SEQ ID NO: 2975105 - RNA, 16 nt, Mycobacterium avium subsp. paratuberculosis
caccgugccgucggcg

SEQ ID NO: 2975106 - RNA, 20 nt, Mycobacterium avium subsp. paratuberculosis
caccgugccgucggcgucga

SEQ ID NO: 2975107 - RNA, 15 nt, Mycobacterium avium subsp. paratuberculosis
caccgugcgcgcgca

SEQ ID NO: 2975108 - RNA, 15 nt, Mycobacterium avium subsp. paratuberculosis
caccgugcgggucgc

SEQ ID NO: 2975109 - RNA, 19 nt, Mycobacterium avium subsp. paratuberculosis
caccgugcgggucgcgcug

SEQ ID NO: 2975110 - RNA, 20 nt, Mycobacterium avium subsp. paratuberculosis
caccgugcgggucgcgcugc

SEQ ID NO: 2975111 - RNA, 18 nt, Mycobacterium avium subsp. paratuberculosis
caccgugcuggccaccac

SEQ ID NO: 2975112 - RNA, 16 nt, Mycobacterium avium subsp. paratuberculosis
caccgugcugugcugc

SEQ ID NO: 2975113 - RNA, 23 nt, Mycobacterium avium subsp. paratuberculosis
caccgugcugugcugccugccgu

SEQ ID NO: 2975114 - RNA, 19 nt, Mycobacterium avium subsp. paratuberculosis
caccguggagacguccgag

SEQ ID NO: 2975115 - RNA, 20 nt, Mycobacterium avium subsp. paratuberculosis
caccguggagacguccgagg

SEQ ID NO: 2975116 - RNA, 17 nt, Mycobacterium avium subsp. paratuberculosis
caccguggccccacggg

SEQ ID NO: 2975117 - RNA, 19 nt, Mycobacterium avium subsp. paratuberculosis
caccguggccccacgggcc

SEQ ID NO: 2975118 - RNA, 20 nt, Mycobacterium avium subsp. paratuberculosis
caccguggccccacgggcca

SEQ ID NO: 2975119 - RNA, 23 nt, Mycobacterium avium subsp. paratuberculosis
caccguggccccacgggccaugu

SEQ ID NO: 2975120 - RNA, 15 nt, Mycobacterium avium subsp. paratuberculosis
caccguggccccagc

SEQ ID NO: 2975121 - RNA, 21 nt, Mycobacterium avium subsp. paratuberculosis
caccguggccccagccaccgu

SEQ ID NO: 2975122 - RNA, 16 nt, Mycobacterium avium subsp. paratuberculosis
caccguggcgaugggc

SEQ ID NO: 2975123 - RNA, 21 nt, Mycobacterium avium subsp. paratuberculosis
caccguggcgggggagccgug

SEQ ID NO: 2975124 - RNA, 16 nt, Mycobacterium avium subsp. paratuberculosis
caccgugggcggcgcg

SEQ ID NO: 2975125 - RNA, 17 nt, Mycobacterium avium subsp. paratuberculosis
caccgugggcggcgcga

SEQ ID NO: 2975126 - RNA, 13 nt, Mycobacterium avium subsp. paratuberculosis
caccguggucggc

SEQ ID NO: 2975127 - RNA, 15 nt, Mycobacterium avium subsp. paratuberculosis
caccguggucggcag

SEQ ID NO: 2975128 - RNA, 17 nt, Mycobacterium avium subsp. paratuberculosis
caccguggucggcagca

SEQ ID NO: 2975129 - RNA, 19 nt, Mycobacterium avium subsp. paratuberculosis
caccguggucggcagcacc

SEQ ID NO: 2975130 - RNA, 20 nt, Mycobacterium avium subsp. paratuberculosis
caccguggucggcagcaccg

SEQ ID NO: 2975131 - RNA, 23 nt, Mycobacterium avium subsp. paratuberculosis
caccguggucggcagcaccggca

SEQ ID NO: 2975132 - RNA, 16 nt, Mycobacterium avium subsp. paratuberculosis
caccguggugacccgg

SEQ ID NO: 2975133 - RNA, 22 nt, Mycobacterium avium subsp. paratuberculosis
caccguggugacccggaccggg

SEQ ID NO: 2975134 - RNA, 17 nt, Mycobacterium avium subsp. paratuberculosis
caccgugguggacaacu

SEQ ID NO: 2975135 - RNA, 19 nt, Mycobacterium avium subsp. paratuberculosis
caccguguagccgaccgac

SEQ ID NO: 2975136 - RNA, 20 nt, Mycobacterium avium subsp. paratuberculosis
caccguguagccgaccgacc

SEQ ID NO: 2975137 - RNA, 14 nt, Mycobacterium avium subsp. paratuberculosis
caccgugucggcgg

SEQ ID NO: 2975138 - RNA, 16 nt, Mycobacterium avium subsp. paratuberculosis
caccgugucggcgggc

SEQ ID NO: 2975139 - RNA, 17 nt, Mycobacterium avium subsp. paratuberculosis
caccgugucgucgcuga

SEQ ID NO: 2975140 - RNA, 22 nt, Mycobacterium avium subsp. paratuberculosis
caccgugucgucgcugacgccg

SEQ ID NO: 2975141 - RNA, 17 nt, Mycobacterium avium subsp. paratuberculosis
caccguguucaccagcg

SEQ ID NO: 2975142 - RNA, 18 nt, Mycobacterium avium subsp. paratuberculosis
caccguguucaccagcgg

SEQ ID NO: 2975143 - RNA, 20 nt, Mycobacterium avium subsp. paratuberculosis
caccguguucaccagcgggg

SEQ ID NO: 2975144 - RNA, 15 nt, Mycobacterium avium subsp. paratuberculosis
caccguucccaccgg

SEQ ID NO: 2975145 - RNA, 18 nt, Mycobacterium avium subsp. paratuberculosis
caccguucccaccggcuu

SEQ ID NO: 2975146 - RNA, 19 nt, Mycobacterium avium subsp. paratuberculosis
caccguucccaccggcuuc

SEQ ID NO: 2975147 - RNA, 18 nt, Mycobacterium avium subsp. paratuberculosis
caccguucggggggcacg

SEQ ID NO: 2975148 - RNA, 19 nt, Mycobacterium avium subsp. paratuberculosis
caccguugucucggcgccg

SEQ ID NO: 2975149 - RNA, 21 nt, Mycobacterium avium subsp. paratuberculosis
caccguugucucggcgccguc

SEQ ID NO: 2975150 - RNA, 18 nt, Mycobacterium avium subsp. paratuberculosis
caccguugugacccgcuc

SEQ ID NO: 2975151 - RNA, 22 nt, Mycobacterium avium subsp. paratuberculosis
caccucaccugcguugcggcac

SEQ ID NO: 2975152 - RNA, 20 nt, Mycobacterium avium subsp. paratuberculosis
caccucaucgcccagccggc

SEQ ID NO: 2975153 - RNA, 14 nt, Mycobacterium avium subsp. paratuberculosis
caccuccagcccgg

SEQ ID NO: 2975154 - RNA, 22 nt, Mycobacterium avium subsp. paratuberculosis
caccuccaguugcgaccccgcc

SEQ ID NO: 2975155 - RNA, 16 nt, Mycobacterium avium subsp. paratuberculosis
caccuccccgcggugc

SEQ ID NO: 2975156 - RNA, 18 nt, Mycobacterium avium subsp. paratuberculosis
caccuccccgcggugccg

SEQ ID NO: 2975157 - RNA, 22 nt, Mycobacterium avium subsp. paratuberculosis
caccuccccgcggugccgcagc

SEQ ID NO: 2975158 - RNA, 23 nt, Mycobacterium avium subsp. paratuberculosis
caccuccccgcggugccgcagcu

SEQ ID NO: 2975159 - RNA, 15 nt, Mycobacterium avium subsp. paratuberculosis
caccuccgacagccc

SEQ ID NO: 2975160 - RNA, 18 nt, Mycobacterium avium subsp. paratuberculosis
caccuccgacagcccccg

SEQ ID NO: 2975161 - RNA, 22 nt, Mycobacterium avium subsp. paratuberculosis
caccuccgacagcccccgcagc

SEQ ID NO: 2975162 - RNA, 22 nt, Mycobacterium avium subsp. paratuberculosis
caccuccgacaucaggcccuug

SEQ ID NO: 2975163 - RNA, 15 nt, Mycobacterium avium subsp. paratuberculosis
caccuccuccaaagc

SEQ ID NO: 2975164 - RNA, 13 nt, Mycobacterium avium subsp. paratuberculosis
caccuccuccggu

SEQ ID NO: 2975165 - RNA, 15 nt, Mycobacterium avium subsp. paratuberculosis
caccuccucgcgggc

SEQ ID NO: 2975166 - RNA, 19 nt, Mycobacterium avium subsp. paratuberculosis
caccuccucgcgggcgauc

SEQ ID NO: 2975167 - RNA, 13 nt, Mycobacterium avium subsp. paratuberculosis
caccuccugcacc

SEQ ID NO: 2975168 - RNA, 14 nt, Mycobacterium avium subsp. paratuberculosis
caccuccugcaccc

SEQ ID NO: 2975169 - RNA, 15 nt, Mycobacterium avium subsp. paratuberculosis
caccuccugcacccg

SEQ ID NO: 2975170 - RNA, 18 nt, Mycobacterium avium subsp. paratuberculosis
caccuccugcacccgucc

SEQ ID NO: 2975171 - RNA, 22 nt, Mycobacterium avium subsp. paratuberculosis
caccuccugggugagcggcgcg

SEQ ID NO: 2975172 - RNA, 21 nt, Mycobacterium avium subsp. paratuberculosis
caccuccuuggccaggcgggc

SEQ ID NO: 2975173 - RNA, 23 nt, Mycobacterium avium subsp. paratuberculosis
caccuccuuggccaggcgggcca

SEQ ID NO: 2975174 - RNA, 21 nt, Mycobacterium avium subsp. paratuberculosis
caccuccuuggguucggcggc

SEQ ID NO: 2975175 - RNA, 13 nt, Mycobacterium avium subsp. paratuberculosis
caccucgaacgcc

SEQ ID NO: 2975176 - RNA, 16 nt, Mycobacterium avium subsp. paratuberculosis
caccucgaagccgacg

SEQ ID NO: 2975177 - RNA, 23 nt, Mycobacterium avium subsp. paratuberculosis
caccucgaagccgaucgcggcga

SEQ ID NO: 2975178 - RNA, 19 nt, Mycobacterium avium subsp. paratuberculosis
caccucgaagggcgccagc

SEQ ID NO: 2975179 - RNA, 20 nt, Mycobacterium avium subsp. paratuberculosis
caccucgaagggcgccagcc

SEQ ID NO: 2975180 - RNA, 21 nt, Mycobacterium avium subsp. paratuberculosis
caccucgaagggcgccagccg

SEQ ID NO: 2975181 - RNA, 22 nt, Mycobacterium avium subsp. paratuberculosis
caccucgaagggcgccagccgu

SEQ ID NO: 2975182 - RNA, 17 nt, Mycobacterium avium subsp. paratuberculosis
caccucgaccagauccu

SEQ ID NO: 2975183 - RNA, 12 nt, Mycobacterium avium subsp. paratuberculosis
caccucgacgaa

SEQ ID NO: 2975184 - RNA, 13 nt, Mycobacterium avium subsp. paratuberculosis
caccucgagcacg

SEQ ID NO: 2975185 - RNA, 23 nt, Mycobacterium avium subsp. paratuberculosis
caccucgagcacgcccugcggcu

SEQ ID NO: 2975186 - RNA, 22 nt, Mycobacterium avium subsp. paratuberculosis
caccucgagcacucgcgggacg

SEQ ID NO: 2975187 - RNA, 18 nt, Mycobacterium avium subsp. paratuberculosis
caccucgagcucaccgac

SEQ ID NO: 2975188 - RNA, 19 nt, Mycobacterium avium subsp. paratuberculosis
caccucgagcucaccgaca

SEQ ID NO: 2975189 - RNA, 14 nt, Mycobacterium avium subsp. paratuberculosis
caccucgaucaccg

SEQ ID NO: 2975190 - RNA, 18 nt, Mycobacterium avium subsp. paratuberculosis
caccucgaucaccgggcg

SEQ ID NO: 2975191 - RNA, 21 nt, Mycobacterium avium subsp. paratuberculosis
caccucgaucaccgggcggcc

SEQ ID NO: 2975192 - RNA, 16 nt, Mycobacterium avium subsp. paratuberculosis
caccucgaucagcggc

SEQ ID NO: 2975193 - RNA, 13 nt, Mycobacterium avium subsp. paratuberculosis
caccucgcccggc

SEQ ID NO: 2975194 - RNA, 16 nt, Mycobacterium avium subsp. paratuberculosis
caccucgcccggcucg

SEQ ID NO: 2975195 - RNA, 14 nt, Mycobacterium avium subsp. paratuberculosis
caccucgcccugca

SEQ ID NO: 2975196 - RNA, 17 nt, Mycobacterium avium subsp. paratuberculosis
caccucgccgcaggcgu

SEQ ID NO: 2975197 - RNA, 15 nt, Mycobacterium avium subsp. paratuberculosis
caccucgccggccgc

SEQ ID NO: 2975198 - RNA, 15 nt, Mycobacterium avium subsp. paratuberculosis
caccucgccuccagc

SEQ ID NO: 2975199 - RNA, 16 nt, Mycobacterium avium subsp. paratuberculosis
caccucgccuccagca

SEQ ID NO: 2975200 - RNA, 17 nt, Mycobacterium avium subsp. paratuberculosis
caccucgccuccagcag

SEQ ID NO: 2975201 - RNA, 17 nt, Mycobacterium avium subsp. paratuberculosis
caccucgcgcagcaccg

SEQ ID NO: 2975202 - RNA, 20 nt, Mycobacterium avium subsp. paratuberculosis
caccucgcgcggggcggccg

SEQ ID NO: 2975203 - RNA, 23 nt, Mycobacterium avium subsp. paratuberculosis
caccucgcgcucuugggcggccg

SEQ ID NO: 2975204 - RNA, 19 nt, Mycobacterium avium subsp. paratuberculosis
caccucgcgggcgaccugg

SEQ ID NO: 2975205 - RNA, 19 nt, Mycobacterium avium subsp. paratuberculosis
caccucgcuacgcgagcug

SEQ ID NO: 2975206 - RNA, 22 nt, Mycobacterium avium subsp. paratuberculosis
caccucgcuacgcgagcugcuu

SEQ ID NO: 2975207 - RNA, 19 nt, Mycobacterium avium subsp. paratuberculosis
caccucgcugacgucgaug

SEQ ID NO: 2975208 - RNA, 22 nt, Mycobacterium avium subsp. paratuberculosis
caccucgcuggaaaccucuugc

SEQ ID NO: 2975209 - RNA, 18 nt, Mycobacterium avium subsp. paratuberculosis
caccucgcuggcggcgcg

SEQ ID NO: 2975210 - RNA, 14 nt, Mycobacterium avium subsp. paratuberculosis
caccucggccagcg

SEQ ID NO: 2975211 - RNA, 16 nt, Mycobacterium avium subsp. paratuberculosis
caccucggccagcgcc

SEQ ID NO: 2975212 - RNA, 17 nt, Mycobacterium avium subsp. paratuberculosis
caccucggccagcgccg

SEQ ID NO: 2975213 - RNA, 14 nt, Mycobacterium avium subsp. paratuberculosis
caccucggccgggu

SEQ ID NO: 2975214 - RNA, 16 nt, Mycobacterium avium subsp. paratuberculosis
caccucggccgggucc

SEQ ID NO: 2975215 - RNA, 23 nt, Mycobacterium avium subsp. paratuberculosis
caccucggccuugaccacggugc

SEQ ID NO: 2975216 - RNA, 16 nt, Mycobacterium avium subsp. paratuberculosis
caccucggccuugccg

SEQ ID NO: 2975217 - RNA, 13 nt, Mycobacterium avium subsp. paratuberculosis
caccucggcgacc

SEQ ID NO: 2975218 - RNA, 19 nt, Mycobacterium avium subsp. paratuberculosis
caccucggcgaccacgucc

SEQ ID NO: 2975219 - RNA, 16 nt, Mycobacterium avium subsp. paratuberculosis
caccucggcgaccucg

SEQ ID NO: 2975220 - RNA, 16 nt, Mycobacterium avium subsp. paratuberculosis
caccucggcgacgaug

SEQ ID NO: 2975221 - RNA, 18 nt, Mycobacterium avium subsp. paratuberculosis
caccucggcgaucugcuc

SEQ ID NO: 2975222 - RNA, 13 nt, Mycobacterium avium subsp. paratuberculosis
caccucggcgaug

SEQ ID NO: 2975223 - RNA, 21 nt, Mycobacterium avium subsp. paratuberculosis
caccucggcggcaccgcccgg

SEQ ID NO: 2975224 - RNA, 22 nt, Mycobacterium avium subsp. paratuberculosis
caccucggcggcaccgcccggg

SEQ ID NO: 2975225 - RNA, 13 nt, Mycobacterium avium subsp. paratuberculosis
caccucggcgucg

SEQ ID NO: 2975226 - RNA, 17 nt, Mycobacterium avium subsp. paratuberculosis
caccucggcgucggcgc

SEQ ID NO: 2975227 - RNA, 20 nt, Mycobacterium avium subsp. paratuberculosis
caccucgggauagccgagcg

SEQ ID NO: 2975228 - RNA, 12 nt, Mycobacterium avium subsp. paratuberculosis
caccucgggauc

SEQ ID NO: 2975229 - RNA, 17 nt, Mycobacterium avium subsp. paratuberculosis
caccucgggaugggcau

SEQ ID NO: 2975230 - RNA, 20 nt, Mycobacterium avium subsp. paratuberculosis
caccucgggcacguccagcc

SEQ ID NO: 2975231 - RNA, 19 nt, Mycobacterium avium subsp. paratuberculosis
caccucgggccgggcgggc

SEQ ID NO: 2975232 - RNA, 23 nt, Mycobacterium avium subsp. paratuberculosis
caccucgggccgggcgggcaccc

SEQ ID NO: 2975233 - RNA, 14 nt, Mycobacterium avium subsp. paratuberculosis
caccucggucgggg

SEQ ID NO: 2975234 - RNA, 16 nt, Mycobacterium avium subsp. paratuberculosis
caccucggucggggau

SEQ ID NO: 2975235 - RNA, 14 nt, Mycobacterium avium subsp. paratuberculosis
caccucggugaucu

SEQ ID NO: 2975236 - RNA, 22 nt, Mycobacterium avium subsp. paratuberculosis
caccucggugaucucaccggcg

SEQ ID NO: 2975237 - RNA, 20 nt, Mycobacterium avium subsp. paratuberculosis
caccucgguggacgccgcgc

SEQ ID NO: 2975238 - RNA, 21 nt, Mycobacterium avium subsp. paratuberculosis
caccucgguggacgccgcgca

SEQ ID NO: 2975239 - RNA, 15 nt, Mycobacterium avium subsp. paratuberculosis
caccucgucccagcg

SEQ ID NO: 2975240 - RNA, 17 nt, Mycobacterium avium subsp. paratuberculosis
caccucgucccagcgca

SEQ ID NO: 2975241 - RNA, 23 nt, Mycobacterium avium subsp. paratuberculosis
caccucgucgaucuucgcggcgu

SEQ ID NO: 2975242 - RNA, 17 nt, Mycobacterium avium subsp. paratuberculosis
caccucgucgcccggcg

SEQ ID NO: 2975243 - RNA, 20 nt, Mycobacterium avium subsp. paratuberculosis
caccucgucgcccggcgucc

SEQ ID NO: 2975244 - RNA, 15 nt, Mycobacterium avium subsp. paratuberculosis
caccucgucgccguc

SEQ ID NO: 2975245 - RNA, 19 nt, Mycobacterium avium subsp. paratuberculosis
caccucgucgccgucgggg

SEQ ID NO: 2975246 - RNA, 22 nt, Mycobacterium avium subsp. paratuberculosis
caccucgucggcggucaacacg

SEQ ID NO: 2975247 - RNA, 21 nt, Mycobacterium avium subsp. paratuberculosis
caccucucgggaaacgcgucg

SEQ ID NO: 2975248 - RNA, 16 nt, Mycobacterium avium subsp. paratuberculosis
caccucuucgcggucc

SEQ ID NO: 2975249 - RNA, 20 nt, Mycobacterium avium subsp. paratuberculosis
caccucuucgggcagcgcgu

SEQ ID NO: 2975250 - RNA, 21 nt, Mycobacterium avium subsp. paratuberculosis
caccugaccgcgggcccgccg

SEQ ID NO: 2975251 - RNA, 22 nt, Mycobacterium avium subsp. paratuberculosis
caccugaccgucggccagauag

SEQ ID NO: 2975252 - RNA, 20 nt, Mycobacterium avium subsp. paratuberculosis
caccugauaggggucggcga

SEQ ID NO: 2975253 - RNA, 21 nt, Mycobacterium avium subsp. paratuberculosis
caccugauaggggucggcgaa

SEQ ID NO: 2975254 - RNA, 16 nt, Mycobacterium avium subsp. paratuberculosis
caccugaucgcggcga

SEQ ID NO: 2975255 - RNA, 19 nt, Mycobacterium avium subsp. paratuberculosis
caccugaucgcggcgagca

SEQ ID NO: 2975256 - RNA, 16 nt, Mycobacterium avium subsp. paratuberculosis
caccugcacggggacg

SEQ ID NO: 2975257 - RNA, 21 nt, Mycobacterium avium subsp. paratuberculosis
caccugcacggggacgucguc

SEQ ID NO: 2975258 - RNA, 11 nt, Mycobacterium avium subsp. paratuberculosis
caccugcagcc

SEQ ID NO: 2975259 - RNA, 20 nt, Mycobacterium avium subsp. paratuberculosis
caccugcaucacgauggugc

SEQ ID NO: 2975260 - RNA, 20 nt, Mycobacterium avium subsp. paratuberculosis
caccugccgcaacgggccgc

SEQ ID NO: 2975261 - RNA, 22 nt, Mycobacterium avium subsp. paratuberculosis
caccugccgcaacgggccgcag

SEQ ID NO: 2975262 - RNA, 23 nt, Mycobacterium avium subsp. paratuberculosis
caccugccgcacaccgucuccca

SEQ ID NO: 2975263 - RNA, 15 nt, Mycobacterium avium subsp. paratuberculosis
caccugccgucgacg

SEQ ID NO: 2975264 - RNA, 22 nt, Mycobacterium avium subsp. paratuberculosis
caccugcggcaggucggccagc

SEQ ID NO: 2975265 - RNA, 12 nt, Mycobacterium avium subsp. paratuberculosis
caccugcggccc

SEQ ID NO: 2975266 - RNA, 13 nt, Mycobacterium avium subsp. paratuberculosis
caccugcggcccc

SEQ ID NO: 2975267 - RNA, 19 nt, Mycobacterium avium subsp. paratuberculosis
caccugcggcccgucgccg

SEQ ID NO: 2975268 - RNA, 13 nt, Mycobacterium avium subsp. paratuberculosis
caccugcggcggc

SEQ ID NO: 2975269 - RNA, 14 nt, Mycobacterium avium subsp. paratuberculosis
caccugcggcggca

SEQ ID NO: 2975270 - RNA, 15 nt, Mycobacterium avium subsp. paratuberculosis
caccugcggcggcag

SEQ ID NO: 2975271 - RNA, 16 nt, Mycobacterium avium subsp. paratuberculosis
caccugcgugccuugc

SEQ ID NO: 2975272 - RNA, 20 nt, Mycobacterium avium subsp. paratuberculosis
caccugcucaccgagcuggg

SEQ ID NO: 2975273 - RNA, 20 nt, Mycobacterium avium subsp. paratuberculosis
caccugcucgaugcgcgcca

SEQ ID NO: 2975274 - RNA, 21 nt, Mycobacterium avium subsp. paratuberculosis
caccugcucgaugcgcgccag

SEQ ID NO: 2975275 - RNA, 21 nt, Mycobacterium avium subsp. paratuberculosis
caccuggaggccaacgagcgc

SEQ ID NO: 2975276 - RNA, 14 nt, Mycobacterium avium subsp. paratuberculosis
caccuggccggcca

SEQ ID NO: 2975277 - RNA, 19 nt, Mycobacterium avium subsp. paratuberculosis
caccuggccguucaggucg

SEQ ID NO: 2975278 - RNA, 22 nt, Mycobacterium avium subsp. paratuberculosis
caccuggccguucaggucgauc

SEQ ID NO: 2975279 - RNA, 19 nt, Mycobacterium avium subsp. paratuberculosis
caccuggcgcaccgccgcg

SEQ ID NO: 2975280 - RNA, 22 nt, Mycobacterium avium subsp. paratuberculosis
caccuggcgcaccgccgcggga

SEQ ID NO: 2975281 - RNA, 14 nt, Mycobacterium avium subsp. paratuberculosis
caccuggcgcagca

SEQ ID NO: 2975282 - RNA, 16 nt, Mycobacterium avium subsp. paratuberculosis
caccuggcugugcacg

SEQ ID NO: 2975283 - RNA, 23 nt, Mycobacterium avium subsp. paratuberculosis
caccuggcugugcacgauggaca

SEQ ID NO: 2975284 - RNA, 19 nt, Mycobacterium avium subsp. paratuberculosis
caccugggagaacucgauc

SEQ ID NO: 2975285 - RNA, 16 nt, Mycobacterium avium subsp. paratuberculosis
caccugguccugcccc

SEQ ID NO: 2975286 - RNA, 14 nt, Mycobacterium avium subsp. paratuberculosis
caccuggugcucgc

SEQ ID NO: 2975287 - RNA, 16 nt, Mycobacterium avium subsp. paratuberculosis
caccuggugcucgcgc

SEQ ID NO: 2975288 - RNA, 20 nt, Mycobacterium avium subsp. paratuberculosis
caccugguugaacggcaccc

SEQ ID NO: 2975289 - RNA, 22 nt, Mycobacterium avium subsp. paratuberculosis
caccugguugaacggcaccccg

SEQ ID NO: 2975290 - RNA, 18 nt, Mycobacterium avium subsp. paratuberculosis
caccugguuggcccgcac

SEQ ID NO: 2975291 - RNA, 19 nt, Mycobacterium avium subsp. paratuberculosis
caccugguuggcccgcacc

SEQ ID NO: 2975292 - RNA, 22 nt, Mycobacterium avium subsp. paratuberculosis
caccugguuggcccgcaccacc

SEQ ID NO: 2975293 - RNA, 17 nt, Mycobacterium avium subsp. paratuberculosis
agguagucggcccaggc

SEQ ID NO: 2975294 - RNA, 23 nt, Mycobacterium avium subsp. paratuberculosis
agguagugcgcgauggcgugccg

SEQ ID NO: 2975295 - RNA, 20 nt, Mycobacterium avium subsp. paratuberculosis
aggucacccuccucgcggcg

SEQ ID NO: 2975296 - RNA, 14 nt, Mycobacterium avium subsp. paratuberculosis
aggucaccgcgcga

SEQ ID NO: 2975297 - RNA, 22 nt, Mycobacterium avium subsp. paratuberculosis
aggucaccggaugcacgugcac

SEQ ID NO: 2975298 - RNA, 20 nt, Mycobacterium avium subsp. paratuberculosis
aggucaccggauucggcucc

SEQ ID NO: 2975299 - RNA, 12 nt, Mycobacterium avium subsp. paratuberculosis
aggucagcggcc

SEQ ID NO: 2975300 - RNA, 18 nt, Mycobacterium avium subsp. paratuberculosis
aggucaucagcgacguca

SEQ ID NO: 2975301 - RNA, 19 nt, Mycobacterium avium subsp. paratuberculosis
aggucaucagcgacgucag

SEQ ID NO: 2975302 - RNA, 16 nt, Mycobacterium avium subsp. paratuberculosis
aggucauggcgaccgc

SEQ ID NO: 2975303 - RNA, 23 nt, Mycobacterium avium subsp. paratuberculosis
aggucauggcgaccgcgacggug

SEQ ID NO: 2975304 - RNA, 19 nt, Mycobacterium avium subsp. paratuberculosis
aggucaugguggcggcgcc

SEQ ID NO: 2975305 - RNA, 21 nt, Mycobacterium avium subsp. paratuberculosis
agguccacaccguggagacgu

SEQ ID NO: 2975306 - RNA, 16 nt, Mycobacterium avium subsp. paratuberculosis
agguccaccaggugac

SEQ ID NO: 2975307 - RNA, 17 nt, Mycobacterium avium subsp. paratuberculosis
agguccacccgccccgc

SEQ ID NO: 2975308 - RNA, 13 nt, Mycobacterium avium subsp. paratuberculosis
agguccaggauca

SEQ ID NO: 2975309 - RNA, 20 nt, Mycobacterium avium subsp. paratuberculosis
agguccaggaucacgcggcg

SEQ ID NO: 2975310 - RNA, 16 nt, Mycobacterium avium subsp. paratuberculosis
aggucccaggccagga

SEQ ID NO: 2975311 - RNA, 18 nt, Mycobacterium avium subsp. paratuberculosis
aggucccaggcguggucg

SEQ ID NO: 2975312 - RNA, 21 nt, Mycobacterium avium subsp. paratuberculosis
agguccgcgaacucgucgacg

SEQ ID NO: 2975313 - RNA, 13 nt, Mycobacterium avium subsp. paratuberculosis
agguccgcggugg

SEQ ID NO: 2975314 - RNA, 16 nt, Mycobacterium avium subsp. paratuberculosis
agguccggcagcgcgc

SEQ ID NO: 2975315 - RNA, 14 nt, Mycobacterium avium subsp. paratuberculosis
agguccgguaggcg

SEQ ID NO: 2975316 - RNA, 18 nt, Mycobacterium avium subsp. paratuberculosis
agguccgguucgaccggc

SEQ ID NO: 2975317 - RNA, 22 nt, Mycobacterium avium subsp. paratuberculosis
agguccguggugaucgccgcgg

SEQ ID NO: 2975318 - RNA, 16 nt, Mycobacterium avium subsp. paratuberculosis
agguccucgaccucuu

SEQ ID NO: 2975319 - RNA, 22 nt, Mycobacterium avium subsp. paratuberculosis
agguccucgcuggcgaucaccu

SEQ ID NO: 2975320 - RNA, 15 nt, Mycobacterium avium subsp. paratuberculosis
agguccuugaucggg

SEQ ID NO: 2975321 - RNA, 15 nt, Mycobacterium avium subsp. paratuberculosis
agguccuugcccagc

SEQ ID NO: 2975322 - RNA, 22 nt, Mycobacterium avium subsp. paratuberculosis
agguccuugcccagcaguuugu

SEQ ID NO: 2975323 - RNA, 14 nt, Mycobacterium avium subsp. paratuberculosis
agguccuugcgcgc

SEQ ID NO: 2975324 - RNA, 15 nt, Mycobacterium avium subsp. paratuberculosis
agguccuugcgcgcc

SEQ ID NO: 2975325 - RNA, 23 nt, Mycobacterium avium subsp. paratuberculosis
agguccuugcggaaccgcugcau

SEQ ID NO: 2975326 - RNA, 20 nt, Mycobacterium avium subsp. paratuberculosis
aggucgaacagcucgaccag

SEQ ID NO: 2975327 - RNA, 14 nt, Mycobacterium avium subsp. paratuberculosis
aggucgaaccacgc

SEQ ID NO: 2975328 - RNA, 18 nt, Mycobacterium avium subsp. paratuberculosis
aggucgaaccacgcggcg

SEQ ID NO: 2975329 - RNA, 20 nt, Mycobacterium avium subsp. paratuberculosis
aggucgaaccacgcggcggc

SEQ ID NO: 2975330 - RNA, 16 nt, Mycobacterium avium subsp. paratuberculosis
aggucgaaggcggccg

SEQ ID NO: 2975331 - RNA, 16 nt, Mycobacterium avium subsp. paratuberculosis
aggucgaagggcaucg

SEQ ID NO: 2975332 - RNA, 19 nt, Mycobacterium avium subsp. paratuberculosis
aggucgaccaucugccggc

SEQ ID NO: 2975333 - RNA, 17 nt, Mycobacterium avium subsp. paratuberculosis
aggucgaccggcucgcc

SEQ ID NO: 2975334 - RNA, 18 nt, Mycobacterium avium subsp. paratuberculosis
aggucgaccggcucgccg

SEQ ID NO: 2975335 - RNA, 19 nt, Mycobacterium avium subsp. paratuberculosis
aggucgaccggcucgccgu

SEQ ID NO: 2975336 - RNA, 14 nt, Mycobacterium avium subsp. paratuberculosis
aggucgacgggguc

SEQ ID NO: 2975337 - RNA, 16 nt, Mycobacterium avium subsp. paratuberculosis
aggucgagcaccaggu

SEQ ID NO: 2975338 - RNA, 17 nt, Mycobacterium avium subsp. paratuberculosis
aggucgaggccggccag

SEQ ID NO: 2975339 - RNA, 22 nt, Mycobacterium avium subsp. paratuberculosis
aggucgaggccggccagcgggu

SEQ ID NO: 2975340 - RNA, 20 nt, Mycobacterium avium subsp. paratuberculosis
aggucgaucagcgguccacc

SEQ ID NO: 2975341 - RNA, 16 nt, Mycobacterium avium subsp. paratuberculosis
aggucgaucugcggca

SEQ ID NO: 2975342 - RNA, 17 nt, Mycobacterium avium subsp. paratuberculosis
aggucgaucugcggcac

SEQ ID NO: 2975343 - RNA, 23 nt, Mycobacterium avium subsp. paratuberculosis
aggucgaucugcggcacggugcg

SEQ ID NO: 2975344 - RNA, 22 nt, Mycobacterium avium subsp. paratuberculosis
aggucgcacaccagcacggcgg

SEQ ID NO: 2975345 - RNA, 18 nt, Mycobacterium avium subsp. paratuberculosis
aggucgcccggcucgccg

SEQ ID NO: 2975346 - RNA, 19 nt, Mycobacterium avium subsp. paratuberculosis
aggucgcccggcucgccgg

SEQ ID NO: 2975347 - RNA, 19 nt, Mycobacterium avium subsp. paratuberculosis
aggucgccgacgccgucga

SEQ ID NO: 2975348 - RNA, 11 nt, Mycobacterium avium subsp. paratuberculosis
aggucgccgau

SEQ ID NO: 2975349 - RNA, 20 nt, Mycobacterium avium subsp. paratuberculosis
aggucgccgcgcagcaccgc

SEQ ID NO: 2975350 - RNA, 13 nt, Mycobacterium avium subsp. paratuberculosis
aggucgccggcgg

SEQ ID NO: 2975351 - RNA, 16 nt, Mycobacterium avium subsp. paratuberculosis
aggucgccggcggccg

SEQ ID NO: 2975352 - RNA, 13 nt, Mycobacterium avium subsp. paratuberculosis
aggucgcgaccgc

SEQ ID NO: 2975353 - RNA, 15 nt, Mycobacterium avium subsp. paratuberculosis
aggucgcgaccgccg

SEQ ID NO: 2975354 - RNA, 18 nt, Mycobacterium avium subsp. paratuberculosis
aggucgcgccggagccgg

SEQ ID NO: 2975355 - RNA, 12 nt, Mycobacterium avium subsp. paratuberculosis
aggucgcggacu

SEQ ID NO: 2975356 - RNA, 23 nt, Mycobacterium avium subsp. paratuberculosis
aggucgcggacuggugggcgucg

SEQ ID NO: 2975357 - RNA, 21 nt, Mycobacterium avium subsp. paratuberculosis
aggucgcggauacgcccggcc

SEQ ID NO: 2975358 - RNA, 22 nt, Mycobacterium avium subsp. paratuberculosis
aggucgcggauacgcccggcca

SEQ ID NO: 2975359 - RNA, 17 nt, Mycobacterium avium subsp. paratuberculosis
aggucgcggcgcugcgc

SEQ ID NO: 2975360 - RNA, 15 nt, Mycobacterium avium subsp. paratuberculosis
aggucgcgguagucg

SEQ ID NO: 2975361 - RNA, 17 nt, Mycobacterium avium subsp. paratuberculosis
aggucgcgguagucggg

SEQ ID NO: 2975362 - RNA, 16 nt, Mycobacterium avium subsp. paratuberculosis
aggucgcugcccggcg

SEQ ID NO: 2975363 - RNA, 18 nt, Mycobacterium avium subsp. paratuberculosis
aggucgcugcccggcgug

SEQ ID NO: 2975364 - RNA, 16 nt, Mycobacterium avium subsp. paratuberculosis
aggucgcugcgcucgc

SEQ ID NO: 2975365 - RNA, 18 nt, Mycobacterium avium subsp. paratuberculosis
aggucgcugcgcucgccg

SEQ ID NO: 2975366 - RNA, 15 nt, Mycobacterium avium subsp. paratuberculosis
aggucggccagcgcc

SEQ ID NO: 2975367 - RNA, 13 nt, Mycobacterium avium subsp. paratuberculosis
aggucggccgcgg

SEQ ID NO: 2975368 - RNA, 15 nt, Mycobacterium avium subsp. paratuberculosis
aggucggccgcggcc

SEQ ID NO: 2975369 - RNA, 16 nt, Mycobacterium avium subsp. paratuberculosis
aggucggccgcggccg

SEQ ID NO: 2975370 - RNA, 12 nt, Mycobacterium avium subsp. paratuberculosis
aggucggcgaug

SEQ ID NO: 2975371 - RNA, 21 nt, Mycobacterium avium subsp. paratuberculosis
aggucggcgauggugaugcgg

SEQ ID NO: 2975372 - RNA, 20 nt, Mycobacterium avium subsp. paratuberculosis
aggucggcgggagccggcgg

SEQ ID NO: 2975373 - RNA, 15 nt, Mycobacterium avium subsp. paratuberculosis
aggucggcggucgcg

SEQ ID NO: 2975374 - RNA, 12 nt, Mycobacterium avium subsp. paratuberculosis
aggucggcgugc

SEQ ID NO: 2975375 - RNA, 15 nt, Mycobacterium avium subsp. paratuberculosis
aggucgggacguccg

SEQ ID NO: 2975376 - RNA, 14 nt, Mycobacterium avium subsp. paratuberculosis
aggucgggccggcc

SEQ ID NO: 2975377 - RNA, 15 nt, Mycobacterium avium subsp. paratuberculosis
aggucgggccggccg

SEQ ID NO: 2975378 - RNA, 16 nt, Mycobacterium avium subsp. paratuberculosis
aggucgggccggccga

SEQ ID NO: 2975379 - RNA, 14 nt, Mycobacterium avium subsp. paratuberculosis
aggucgggcucgcg

SEQ ID NO: 2975380 - RNA, 17 nt, Mycobacterium avium subsp. paratuberculosis
aggucgggguccaggcc

SEQ ID NO: 2975381 - RNA, 19 nt, Mycobacterium avium subsp. paratuberculosis
aggucggucaccgagcuca

SEQ ID NO: 2975382 - RNA, 15 nt, Mycobacterium avium subsp. paratuberculosis
aggucggucgcggca

SEQ ID NO: 2975383 - RNA, 17 nt, Mycobacterium avium subsp. paratuberculosis
aggucggugccgcggcg

SEQ ID NO: 2975384 - RNA, 18 nt, Mycobacterium avium subsp. paratuberculosis
aggucggugccgcggcgc

SEQ ID NO: 2975385 - RNA, 16 nt, Mycobacterium avium subsp. paratuberculosis
aggucggugcgcgggg

SEQ ID NO: 2975386 - RNA, 19 nt, Mycobacterium avium subsp. paratuberculosis
aggucgguggccaccaccg

SEQ ID NO: 2975387 - RNA, 20 nt, Mycobacterium avium subsp. paratuberculosis
aggucgguggccaccaccga

SEQ ID NO: 2975388 - RNA, 22 nt, Mycobacterium avium subsp. paratuberculosis
aggucgguggccaccaccgagg

SEQ ID NO: 2975389 - RNA, 15 nt, Mycobacterium avium subsp. paratuberculosis
aggucguaguaggcg

SEQ ID NO: 2975390 - RNA, 22 nt, Mycobacterium avium subsp. paratuberculosis
aggucguccgacaggaugcugg

SEQ ID NO: 2975391 - RNA, 15 nt, Mycobacterium avium subsp. paratuberculosis
aggucgucgacgucg

SEQ ID NO: 2975392 - RNA, 18 nt, Mycobacterium avium subsp. paratuberculosis
aggucgucgagggccacc

SEQ ID NO: 2975393 - RNA, 20 nt, Mycobacterium avium subsp. paratuberculosis
aggucgucgagggccaccgg

SEQ ID NO: 2975394 - RNA, 13 nt, Mycobacterium avium subsp. paratuberculosis
aggucgucggcca

SEQ ID NO: 2975395 - RNA, 15 nt, Mycobacterium avium subsp. paratuberculosis
aggucgucgggcgcc

SEQ ID NO: 2975396 - RNA, 16 nt, Mycobacterium avium subsp. paratuberculosis
aggucgucgggcgccg

SEQ ID NO: 2975397 - RNA, 18 nt, Mycobacterium avium subsp. paratuberculosis
aggucgucgucgccgcgc

SEQ ID NO: 2975398 - RNA, 15 nt, Mycobacterium avium subsp. paratuberculosis
aggucguugccggug

SEQ ID NO: 2975399 - RNA, 21 nt, Mycobacterium avium subsp. paratuberculosis
aggucguugccggugccgacg

SEQ ID NO: 2975400 - RNA, 18 nt, Mycobacterium avium subsp. paratuberculosis
aggucucccgguccacgg

SEQ ID NO: 2975401 - RNA, 22 nt, Mycobacterium avium subsp. paratuberculosis
aggucuuccggaugccggcuug

SEQ ID NO: 2975402 - RNA, 19 nt, Mycobacterium avium subsp. paratuberculosis
aggucuucggucccggcgg

SEQ ID NO: 2975403 - RNA, 13 nt, Mycobacterium avium subsp. paratuberculosis
aggugaacagcag

SEQ ID NO: 2975404 - RNA, 17 nt, Mycobacterium avium subsp. paratuberculosis
aggugaaccgcgacgcg

SEQ ID NO: 2975405 - RNA, 18 nt, Mycobacterium avium subsp. paratuberculosis
aggugaagccguugucga

SEQ ID NO: 2975406 - RNA, 22 nt, Mycobacterium avium subsp. paratuberculosis
aggugaauaccacugcgcgccc

SEQ ID NO: 2975407 - RNA, 20 nt, Mycobacterium avium subsp. paratuberculosis
aggugaccaucgggucgucg

SEQ ID NO: 2975408 - RNA, 21 nt, Mycobacterium avium subsp. paratuberculosis
aggugaccaucgggucgucgg

SEQ ID NO: 2975409 - RNA, 15 nt, Mycobacterium avium subsp. paratuberculosis
aggugaccucgagca

SEQ ID NO: 2975410 - RNA, 17 nt, Mycobacterium avium subsp. paratuberculosis
aggugaccucgagcagc

SEQ ID NO: 2975411 - RNA, 19 nt, Mycobacterium avium subsp. paratuberculosis
aggugaccucgagcagcgc

SEQ ID NO: 2975412 - RNA, 16 nt, Mycobacterium avium subsp. paratuberculosis
aggugacgaggcccac

SEQ ID NO: 2975413 - RNA, 16 nt, Mycobacterium avium subsp. paratuberculosis
aggugacgucgcgccg

SEQ ID NO: 2975414 - RNA, 14 nt, Mycobacterium avium subsp. paratuberculosis
aggugagcaacgcc

SEQ ID NO: 2975415 - RNA, 21 nt, Mycobacterium avium subsp. paratuberculosis
aggugaucaaagccgguggca

SEQ ID NO: 2975416 - RNA, 17 nt, Mycobacterium avium subsp. paratuberculosis
aggugaucgccagcccg

SEQ ID NO: 2975417 - RNA, 18 nt, Mycobacterium avium subsp. paratuberculosis
aggugaucgccucgacca

SEQ ID NO: 2975418 - RNA, 21 nt, Mycobacterium avium subsp. paratuberculosis
aggugaucgccucgaccaggc

SEQ ID NO: 2975419 - RNA, 15 nt, Mycobacterium avium subsp. paratuberculosis
aggugaucguguugu

SEQ ID NO: 2975420 - RNA, 16 nt, Mycobacterium avium subsp. paratuberculosis
aggugaucuuguuguu

SEQ ID NO: 2975421 - RNA, 21 nt, Mycobacterium avium subsp. paratuberculosis
aggugaugccguccagcaacg

SEQ ID NO: 2975422 - RNA, 23 nt, Mycobacterium avium subsp. paratuberculosis
aggugaugccguccagcaacgcc

SEQ ID NO: 2975423 - RNA, 22 nt, Mycobacterium avium subsp. paratuberculosis
aggugcaccacccaggccaccc

SEQ ID NO: 2975424 - RNA, 17 nt, Mycobacterium avium subsp. paratuberculosis
aggugcacccgcggcgc

SEQ ID NO: 2975425 - RNA, 18 nt, Mycobacterium avium subsp. paratuberculosis
aggugcacccgcggcgcg

SEQ ID NO: 2975426 - RNA, 15 nt, Mycobacterium avium subsp. paratuberculosis
aggugcacgccgagc

SEQ ID NO: 2975427 - RNA, 18 nt, Mycobacterium avium subsp. paratuberculosis
aggugcacgccgagcagc

SEQ ID NO: 2975428 - RNA, 19 nt, Mycobacterium avium subsp. paratuberculosis
aggugcagcagcagccacg

SEQ ID NO: 2975429 - RNA, 23 nt, Mycobacterium avium subsp. paratuberculosis
aggugcagcgggcuggcguagga

SEQ ID NO: 2975430 - RNA, 14 nt, Mycobacterium avium subsp. paratuberculosis
aggugcagcuccuu

SEQ ID NO: 2975431 - RNA, 18 nt, Mycobacterium avium subsp. paratuberculosis
aggugcagcugcaucucc

SEQ ID NO: 2975432 - RNA, 20 nt, Mycobacterium avium subsp. paratuberculosis
aggugcauccagucggcgcc

SEQ ID NO: 2975433 - RNA, 18 nt, Mycobacterium avium subsp. paratuberculosis
aggugcaucgaccggcgg

SEQ ID NO: 2975434 - RNA, 20 nt, Mycobacterium avium subsp. paratuberculosis
aggugcaucgccaccgucgu

SEQ ID NO: 2975435 - RNA, 14 nt, Mycobacterium avium subsp. paratuberculosis
aggugccccacgcc

SEQ ID NO: 2975436 - RNA, 21 nt, Mycobacterium avium subsp. paratuberculosis
aggugcccgagcugaucgcgg

SEQ ID NO: 2975437 - RNA, 15 nt, Mycobacterium avium subsp. paratuberculosis
aggugcccuccucgc

SEQ ID NO: 2975438 - RNA, 15 nt, Mycobacterium avium subsp. paratuberculosis
aggugccggcggcgc

SEQ ID NO: 2975439 - RNA, 16 nt, Mycobacterium avium subsp. paratuberculosis
aggugccggcggcgcg

SEQ ID NO: 2975440 - RNA, 15 nt, Mycobacterium avium subsp. paratuberculosis
aggugcgccagaucg

SEQ ID NO: 2975441 - RNA, 20 nt, Mycobacterium avium subsp. paratuberculosis
aggugcgccgccgcgucgcc

SEQ ID NO: 2975442 - RNA, 20 nt, Mycobacterium avium subsp. paratuberculosis
aggugcgccgcucgucggcc

SEQ ID NO: 2975443 - RNA, 13 nt, Mycobacterium avium subsp. paratuberculosis
aggugcgcgagga

SEQ ID NO: 2975444 - RNA, 13 nt, Mycobacterium avium subsp. paratuberculosis
aggugcggcaccu

SEQ ID NO: 2975445 - RNA, 20 nt, Mycobacterium avium subsp. paratuberculosis
aggugcgggcggggcccggg

SEQ ID NO: 2975446 - RNA, 15 nt, Mycobacterium avium subsp. paratuberculosis
aggugcgggucucga

SEQ ID NO: 2975447 - RNA, 14 nt, Mycobacterium avium subsp. paratuberculosis
aggugcucgccggc

SEQ ID NO: 2975448 - RNA, 15 nt, Mycobacterium avium subsp. paratuberculosis
aggugcucgccggcg

SEQ ID NO: 2975449 - RNA, 19 nt, Mycobacterium avium subsp. paratuberculosis
aggugcucgccggcgcgga

SEQ ID NO: 2975450 - RNA, 15 nt, Mycobacterium avium subsp. paratuberculosis
aggugcucgcgcagg

SEQ ID NO: 2975451 - RNA, 20 nt, Mycobacterium avium subsp. paratuberculosis
aggugcugaacaaccccacc

SEQ ID NO: 2975452 - RNA, 16 nt, Mycobacterium avium subsp. paratuberculosis
aggugcugucgucgcc

SEQ ID NO: 2975453 - RNA, 21 nt, Mycobacterium avium subsp. paratuberculosis
aggugcuuggucagcgcggcc

SEQ ID NO: 2975454 - RNA, 17 nt, Mycobacterium avium subsp. paratuberculosis
agguggacagaugccag

SEQ ID NO: 2975455 - RNA, 18 nt, Mycobacterium avium subsp. paratuberculosis
agguggacgagcagccgc

SEQ ID NO: 2975456 - RNA, 23 nt, Mycobacterium avium subsp. paratuberculosis
agguggacgagcagccgcaacca

SEQ ID NO: 2975457 - RNA, 18 nt, Mycobacterium avium subsp. paratuberculosis
agguggauugucggccgc

SEQ ID NO: 2975458 - RNA, 21 nt, Mycobacterium avium subsp. paratuberculosis
agguggauugucggccgcccg

SEQ ID NO: 2975459 - RNA, 22 nt, Mycobacterium avium subsp. paratuberculosis
agguggauugucggccgcccgu

SEQ ID NO: 2975460 - RNA, 16 nt, Mycobacterium avium subsp. paratuberculosis
agguggccagccgggc

SEQ ID NO: 2975461 - RNA, 12 nt, Mycobacterium avium subsp. paratuberculosis
agguggccauga

SEQ ID NO: 2975462 - RNA, 14 nt, Mycobacterium avium subsp. paratuberculosis
agguggccaugggg

SEQ ID NO: 2975463 - RNA, 14 nt, Mycobacterium avium subsp. paratuberculosis
agguggcccacacg

SEQ ID NO: 2975464 - RNA, 17 nt, Mycobacterium avium subsp. paratuberculosis
agguggcccagccgcug

SEQ ID NO: 2975465 - RNA, 22 nt, Mycobacterium avium subsp. paratuberculosis
agguggccgaucagcggcgggc

SEQ ID NO: 2975466 - RNA, 13 nt, Mycobacterium avium subsp. paratuberculosis
agguggccgucgc

SEQ ID NO: 2975467 - RNA, 14 nt, Mycobacterium avium subsp. paratuberculosis
agguggccgucgcc

SEQ ID NO: 2975468 - RNA, 18 nt, Mycobacterium avium subsp. paratuberculosis
agguggccgucgccucgc

SEQ ID NO: 2975469 - RNA, 17 nt, Mycobacterium avium subsp. paratuberculosis
agguggcgaccaccgac

SEQ ID NO: 2975470 - RNA, 18 nt, Mycobacterium avium subsp. paratuberculosis
agguggcgcccggagcug

SEQ ID NO: 2975471 - RNA, 13 nt, Mycobacterium avium subsp. paratuberculosis
agguggcgccggu

SEQ ID NO: 2975472 - RNA, 15 nt, Mycobacterium avium subsp. paratuberculosis
agguggcgccuccgc

SEQ ID NO: 2975473 - RNA, 20 nt, Mycobacterium avium subsp. paratuberculosis
agguggcgccuccgcccggg

SEQ ID NO: 2975474 - RNA, 13 nt, Mycobacterium avium subsp. paratuberculosis
agguggcgucggc

SEQ ID NO: 2975475 - RNA, 17 nt, Mycobacterium avium subsp. paratuberculosis
agguggcgucggcgucg

SEQ ID NO: 2975476 - RNA, 23 nt, Mycobacterium avium subsp. paratuberculosis
agguggcugggcgcuagcugcgc

SEQ ID NO: 2975477 - RNA, 14 nt, Mycobacterium avium subsp. paratuberculosis
aggugggcgcgcag

SEQ ID NO: 2975478 - RNA, 15 nt, Mycobacterium avium subsp. paratuberculosis
aggugggcggccacc

SEQ ID NO: 2975479 - RNA, 12 nt, Mycobacterium avium subsp. paratuberculosis
aggugggcggga

SEQ ID NO: 2975480 - RNA, 13 nt, Mycobacterium avium subsp. paratuberculosis
agguggggcacca

SEQ ID NO: 2975481 - RNA, 15 nt, Mycobacterium avium subsp. paratuberculosis
aggugggguggugga

SEQ ID NO: 2975482 - RNA, 19 nt, Mycobacterium avium subsp. paratuberculosis
aggugggguugaagcuggc

SEQ ID NO: 2975483 - RNA, 22 nt, Mycobacterium avium subsp. paratuberculosis
aggugggguugaagcuggccac

SEQ ID NO: 2975484 - RNA, 22 nt, Mycobacterium avium subsp. paratuberculosis
agguggugaacucuucgcagcg

SEQ ID NO: 2975485 - RNA, 22 nt, Mycobacterium avium subsp. paratuberculosis
aggugguuucggggucgccguc

SEQ ID NO: 2975486 - RNA, 23 nt, Mycobacterium avium subsp. paratuberculosis
aggugguuucggggucgccgucg

SEQ ID NO: 2975487 - RNA, 15 nt, Mycobacterium avium subsp. paratuberculosis
agguguagccggugg

SEQ ID NO: 2975488 - RNA, 24 nt, Mycobacterium avium subsp. paratuberculosis
agguguccucgagcugcacgggcg

SEQ ID NO: 2975489 - RNA, 15 nt, Mycobacterium avium subsp. paratuberculosis
aggugucggccggga

SEQ ID NO: 2975490 - RNA, 15 nt, Mycobacterium avium subsp. paratuberculosis
aggugugaggagucg

SEQ ID NO: 2975491 - RNA, 15 nt, Mycobacterium avium subsp. paratuberculosis
aggugugcccgcccu

SEQ ID NO: 2975492 - RNA, 15 nt, Mycobacterium avium subsp. paratuberculosis
aggugugcggcacga

SEQ ID NO: 2975493 - RNA, 17 nt, Mycobacterium avium subsp. paratuberculosis
agguguuggugcggggu

SEQ ID NO: 2975494 - RNA, 23 nt, Mycobacterium avium subsp. paratuberculosis
agguguuguaggagcugccggcg

SEQ ID NO: 2975495 - RNA, 12 nt, Mycobacterium avium subsp. paratuberculosis
agguucacgucg

SEQ ID NO: 2975496 - RNA, 16 nt, Mycobacterium avium subsp. paratuberculosis
agguucagcccggcgc

SEQ ID NO: 2975497 - RNA, 22 nt, Mycobacterium avium subsp. paratuberculosis
agguucaggcugaucuggaugc

SEQ ID NO: 2975498 - RNA, 22 nt, Mycobacterium avium subsp. paratuberculosis
agguucauccccgcggccaccc

SEQ ID NO: 2975499 - RNA, 23 nt, Mycobacterium avium subsp. paratuberculosis
agguucauguggaagccgcgauc

SEQ ID NO: 2975500 - RNA, 22 nt, Mycobacterium avium subsp. paratuberculosis
agguuccaccgggcgucggcgg

SEQ ID NO: 2975501 - RNA, 12 nt, Mycobacterium avium subsp. paratuberculosis
agguucgccgga

SEQ ID NO: 2975502 - RNA, 16 nt, Mycobacterium avium subsp. paratuberculosis
agguucuccggcccgc

SEQ ID NO: 2975503 - RNA, 19 nt, Mycobacterium avium subsp. paratuberculosis
agguucuccucccagcccu

SEQ ID NO: 2975504 - RNA, 14 nt, Mycobacterium avium subsp. paratuberculosis
agguugaccaccag

SEQ ID NO: 2975505 - RNA, 17 nt, Mycobacterium avium subsp. paratuberculosis
agguugaccaccagcgu

SEQ ID NO: 2975506 - RNA, 14 nt, Mycobacterium avium subsp. paratuberculosis
agguugaugccgac

SEQ ID NO: 2975507 - RNA, 16 nt, Mycobacterium avium subsp. paratuberculosis
agguugaugccgacgu

SEQ ID NO: 2975508 - RNA, 18 nt, Mycobacterium avium subsp. paratuberculosis
agguugaugccgacgucg

SEQ ID NO: 2975509 - RNA, 20 nt, Mycobacterium avium subsp. paratuberculosis
agguuggucagcagcagcgc

SEQ ID NO: 2975510 - RNA, 15 nt, Mycobacterium avium subsp. paratuberculosis
agguuguagaccggg

SEQ ID NO: 2975511 - RNA, 16 nt, Mycobacterium avium subsp. paratuberculosis
agguuguagucggcgc

SEQ ID NO: 2975512 - RNA, 19 nt, Mycobacterium avium subsp. paratuberculosis
agguugucgucgggcacca

SEQ ID NO: 2975513 - RNA, 18 nt, Mycobacterium avium subsp. paratuberculosis
agguuucgcucgucggcg

SEQ ID NO: 2975514 - RNA, 20 nt, Mycobacterium avium subsp. paratuberculosis
agguuugagcgugccgccgg

SEQ ID NO: 2975515 - RNA, 22 nt, Mycobacterium avium subsp. paratuberculosis
agguuuggccagcaccgcggcg

SEQ ID NO: 2975516 - RNA, 14 nt, Mycobacterium avium subsp. paratuberculosis
aguaacgcgagaug

SEQ ID NO: 2975517 - RNA, 14 nt, Mycobacterium avium subsp. paratuberculosis
aguacaccaccgcg

SEQ ID NO: 2975518 - RNA, 18 nt, Mycobacterium avium subsp. paratuberculosis
aguacaccucgagcuugc

SEQ ID NO: 2975519 - RNA, 23 nt, Mycobacterium avium subsp. paratuberculosis
aguacaccucgagcuugccgucg

SEQ ID NO: 2975520 - RNA, 17 nt, Mycobacterium avium subsp. paratuberculosis
aguacagcuaggccagc

SEQ ID NO: 2975521 - RNA, 22 nt, Mycobacterium avium subsp. paratuberculosis
aguacagcuaggccagcagcgc

SEQ ID NO: 2975522 - RNA, 17 nt, Mycobacterium avium subsp. paratuberculosis
aguaccagcggccgucg

SEQ ID NO: 2975523 - RNA, 20 nt, Mycobacterium avium subsp. paratuberculosis
aguacccgcgcauguuggug

SEQ ID NO: 2975524 - RNA, 22 nt, Mycobacterium avium subsp. paratuberculosis
aguaccgacgagaucagcacca

SEQ ID NO: 2975525 - RNA, 17 nt, Mycobacterium avium subsp. paratuberculosis
aguacgaccgcgacgug

SEQ ID NO: 2975526 - RNA, 22 nt, Mycobacterium avium subsp. paratuberculosis
aguacucgguguagagcaccuc

SEQ ID NO: 2975527 - RNA, 16 nt, Mycobacterium avium subsp. paratuberculosis
aguagacgagcucacc

SEQ ID NO: 2975528 - RNA, 15 nt, Mycobacterium avium subsp. paratuberculosis
aguagacgccgccgu

SEQ ID NO: 2975529 - RNA, 14 nt, Mycobacterium avium subsp. paratuberculosis
aguagacucagcgu

SEQ ID NO: 2975530 - RNA, 13 nt, Mycobacterium avium subsp. paratuberculosis
aguagagccgcug

SEQ ID NO: 2975531 - RNA, 16 nt, Mycobacterium avium subsp. paratuberculosis
aguagagccgcugcac

SEQ ID NO: 2975532 - RNA, 20 nt, Mycobacterium avium subsp. paratuberculosis
aguagcagcgucugcgcccc

SEQ ID NO: 2975533 - RNA, 16 nt, Mycobacterium avium subsp. paratuberculosis
aguagccgaucuccac

SEQ ID NO: 2975534 - RNA, 15 nt, Mycobacterium avium subsp. paratuberculosis
aguagccgccgggcg

SEQ ID NO: 2975535 - RNA, 14 nt, Mycobacterium avium subsp. paratuberculosis
aguagccggccagc

SEQ ID NO: 2975536 - RNA, 15 nt, Mycobacterium avium subsp. paratuberculosis
aguagccggccagcu

SEQ ID NO: 2975537 - RNA, 11 nt, Mycobacterium avium subsp. paratuberculosis
aguagccggcg

SEQ ID NO: 2975538 - RNA, 21 nt, Mycobacterium avium subsp. paratuberculosis
aguagccgguucgucccgcgc

SEQ ID NO: 2975539 - RNA, 23 nt, Mycobacterium avium subsp. paratuberculosis
aguagcgacgcgacgcgcucggc

SEQ ID NO: 2975540 - RNA, 14 nt, Mycobacterium avium subsp. paratuberculosis
aguagcgcaccggu

SEQ ID NO: 2975541 - RNA, 20 nt, Mycobacterium avium subsp. paratuberculosis
aguagcgcauaggccgcgag

SEQ ID NO: 2975542 - RNA, 18 nt, Mycobacterium avium subsp. paratuberculosis
aguagcuguuggccagcu

SEQ ID NO: 2975543 - RNA, 22 nt, Mycobacterium avium subsp. paratuberculosis
aguaggccagcaucucggcgaa

SEQ ID NO: 2975544 - RNA, 20 nt, Mycobacterium avium subsp. paratuberculosis
aguaggcgaccacaccgccg

SEQ ID NO: 2975545 - RNA, 21 nt, Mycobacterium avium subsp. paratuberculosis
aguaggcgaccacaccgccgg

SEQ ID NO: 2975546 - RNA, 13 nt, Mycobacterium avium subsp. paratuberculosis
aguaggcgccgcc

SEQ ID NO: 2975547 - RNA, 15 nt, Mycobacterium avium subsp. paratuberculosis
aguagggccgcagcg

SEQ ID NO: 2975548 - RNA, 23 nt, Mycobacterium avium subsp. paratuberculosis
aguaguccagcaccgccacgucg

SEQ ID NO: 2975549 - RNA, 19 nt, Mycobacterium avium subsp. paratuberculosis
aguaguccagggugucguc

SEQ ID NO: 2975550 - RNA, 16 nt, Mycobacterium avium subsp. paratuberculosis
aguagugcaucggcag

SEQ ID NO: 2975551 - RNA, 15 nt, Mycobacterium avium subsp. paratuberculosis
aguaguuccggcggu

SEQ ID NO: 2975552 - RNA, 22 nt, Mycobacterium avium subsp. paratuberculosis
aguauauuugccugacuucuga

SEQ ID NO: 2975553 - RNA, 18 nt, Mycobacterium avium subsp. paratuberculosis
aguaucuuguucgccgac

SEQ ID NO: 2975554 - RNA, 23 nt, Mycobacterium avium subsp. paratuberculosis
aguaugcccgccgcugacgcggc

SEQ ID NO: 2975555 - RNA, 23 nt, Mycobacterium avium subsp. paratuberculosis
aguauggagaaaauccagaacag

SEQ ID NO: 2975556 - RNA, 16 nt, Mycobacterium avium subsp. paratuberculosis
agucacccggcccccg

SEQ ID NO: 2975557 - RNA, 18 nt, Mycobacterium avium subsp. paratuberculosis
agucacccggcccccgag

SEQ ID NO: 2975558 - RNA, 13 nt, Mycobacterium avium subsp. paratuberculosis
agucacccggcug

SEQ ID NO: 2975559 - RNA, 19 nt, Mycobacterium avium subsp. paratuberculosis
agucaccggcucgcggggu

SEQ ID NO: 2975560 - RNA, 17 nt, Mycobacterium avium subsp. paratuberculosis
agucaucaccggggauc

SEQ ID NO: 2975561 - RNA, 19 nt, Mycobacterium avium subsp. paratuberculosis
agucaucgagaugccggga

SEQ ID NO: 2975562 - RNA, 15 nt, Mycobacterium avium subsp. paratuberculosis
agucaucgccacccg

SEQ ID NO: 2975563 - RNA, 21 nt, Mycobacterium avium subsp. paratuberculosis
agucauucugaauucggccac

SEQ ID NO: 2975564 - RNA, 12 nt, Mycobacterium avium subsp. paratuberculosis
aguccaccggcg

SEQ ID NO: 2975565 - RNA, 16 nt, Mycobacterium avium subsp. paratuberculosis
aguccagcacagcauc

SEQ ID NO: 2975566 - RNA, 22 nt, Mycobacterium avium subsp. paratuberculosis
aguccagcaccugaccgucggc

SEQ ID NO: 2975567 - RNA, 14 nt, Mycobacterium avium subsp. paratuberculosis
aguccagccagccg

SEQ ID NO: 2975568 - RNA, 17 nt, Mycobacterium avium subsp. paratuberculosis
aguccagccagccgcgc

SEQ ID NO: 2975569 - RNA, 23 nt, Mycobacterium avium subsp. paratuberculosis
aguccagccagccgcgccgcgcc

SEQ ID NO: 2975570 - RNA, 13 nt, Mycobacterium avium subsp. paratuberculosis
aguccagcccaaa

SEQ ID NO: 2975571 - RNA, 23 nt, Mycobacterium avium subsp. paratuberculosis
aguccagcucccaggacgcggug

SEQ ID NO: 2975572 - RNA, 16 nt, Mycobacterium avium subsp. paratuberculosis
aguccaggccgccgug

SEQ ID NO: 2975573 - RNA, 16 nt, Mycobacterium avium subsp. paratuberculosis
aguccagggugguggu

SEQ ID NO: 2975574 - RNA, 17 nt, Mycobacterium avium subsp. paratuberculosis
aguccagggugguggug

SEQ ID NO: 2975575 - RNA, 17 nt, Mycobacterium avium subsp. paratuberculosis
aguccagggugucgucg

SEQ ID NO: 2975576 - RNA, 15 nt, Mycobacterium avium subsp. paratuberculosis
aguccaggucgaucu

SEQ ID NO: 2975577 - RNA, 22 nt, Mycobacterium avium subsp. paratuberculosis
aguccaggucgaucucggccag

SEQ ID NO: 2975578 - RNA, 23 nt, Mycobacterium avium subsp. paratuberculosis
aguccaggucgaucucggccagc

SEQ ID NO: 2975579 - RNA, 18 nt, Mycobacterium avium subsp. paratuberculosis
aguccagucgcgccgagg

SEQ ID NO: 2975580 - RNA, 14 nt, Mycobacterium avium subsp. paratuberculosis
aguccaugaacggc

SEQ ID NO: 2975581 - RNA, 22 nt, Mycobacterium avium subsp. paratuberculosis
aguccaugaacggcagcucguc

SEQ ID NO: 2975582 - RNA, 21 nt, Mycobacterium avium subsp. paratuberculosis
agucccagaucguagggcucg

SEQ ID NO: 2975583 - RNA, 15 nt, Mycobacterium avium subsp. paratuberculosis
agucccagcacagcc

SEQ ID NO: 2975584 - RNA, 22 nt, Mycobacterium avium subsp. paratuberculosis
agucccaguuguuuccccagcc

SEQ ID NO: 2975585 - RNA, 23 nt, Mycobacterium avium subsp. paratuberculosis
agucccaguuguuuccccagccc

SEQ ID NO: 2975586 - RNA, 14 nt, Mycobacterium avium subsp. paratuberculosis
agucccaugggcug

SEQ ID NO: 2975587 - RNA, 22 nt, Mycobacterium avium subsp. paratuberculosis
aguccccgccuucgaugcccuc

SEQ ID NO: 2975588 - RNA, 21 nt, Mycobacterium avium subsp. paratuberculosis
aguccccgggugggugcucac

SEQ ID NO: 2975589 - RNA, 15 nt, Mycobacterium avium subsp. paratuberculosis
agucccggcgcacca

SEQ ID NO: 2975590 - RNA, 17 nt, Mycobacterium avium subsp. paratuberculosis
agucccggcgcaccagg

SEQ ID NO: 2975591 - RNA, 13 nt, Mycobacterium avium subsp. paratuberculosis
agucccucggcga

SEQ ID NO: 2975592 - RNA, 13 nt, Mycobacterium avium subsp. paratuberculosis
aguccgccgccgu

SEQ ID NO: 2975593 - RNA, 16 nt, Mycobacterium avium subsp. paratuberculosis
aguccgccgccguccc

SEQ ID NO: 2975594 - RNA, 22 nt, Mycobacterium avium subsp. paratuberculosis
aguccgccggagaccagcagcu

SEQ ID NO: 2975595 - RNA, 15 nt, Mycobacterium avium subsp. paratuberculosis
aguccgcggaggcga

SEQ ID NO: 2975596 - RNA, 22 nt, Mycobacterium avium subsp. paratuberculosis
aguccgcggaggcgagcagccg

SEQ ID NO: 2975597 - RNA, 13 nt, Mycobacterium avium subsp. paratuberculosis
aguccgcgugaca

SEQ ID NO: 2975598 - RNA, 18 nt, Mycobacterium avium subsp. paratuberculosis
aguccggacacggccagc

SEQ ID NO: 2975599 - RNA, 16 nt, Mycobacterium avium subsp. paratuberculosis
aguccggcagcagcga

SEQ ID NO: 2975600 - RNA, 22 nt, Mycobacterium avium subsp. paratuberculosis
aguccggccgugaugcgccggc

SEQ ID NO: 2975601 - RNA, 17 nt, Mycobacterium avium subsp. paratuberculosis
aguccggcgcccggcuc

SEQ ID NO: 2975602 - RNA, 17 nt, Mycobacterium avium subsp. paratuberculosis
aguccggcgcgcccgga

SEQ ID NO: 2975603 - RNA, 15 nt, Mycobacterium avium subsp. paratuberculosis
aguccggcggucagc

SEQ ID NO: 2975604 - RNA, 22 nt, Mycobacterium avium subsp. paratuberculosis
aguccggcgugccaccgcuggg

SEQ ID NO: 2975605 - RNA, 19 nt, Mycobacterium avium subsp. paratuberculosis
aguccgggaugacaccgcg

SEQ ID NO: 2975606 - RNA, 14 nt, Mycobacterium avium subsp. paratuberculosis
aguccgggccgccg

SEQ ID NO: 2975607 - RNA, 18 nt, Mycobacterium avium subsp. paratuberculosis
aguccgggccgccggccg

SEQ ID NO: 2975608 - RNA, 19 nt, Mycobacterium avium subsp. paratuberculosis
aguccggguccuaucagga

SEQ ID NO: 2975609 - RNA, 23 nt, Mycobacterium avium subsp. paratuberculosis
aguccggguccuaucaggacugg

SEQ ID NO: 2975610 - RNA, 19 nt, Mycobacterium avium subsp. paratuberculosis
aguccggguugggcgccug

SEQ ID NO: 2975611 - RNA, 21 nt, Mycobacterium avium subsp. paratuberculosis
aguccguugggggcgccgcgg

SEQ ID NO: 2975612 - RNA, 22 nt, Mycobacterium avium subsp. paratuberculosis
aguccguugggggcgccgcggc

SEQ ID NO: 2975613 - RNA, 17 nt, Mycobacterium avium subsp. paratuberculosis
aguccucgguggccacc

SEQ ID NO: 2975614 - RNA, 15 nt, Mycobacterium avium subsp. paratuberculosis
aguccugcagcucgc

SEQ ID NO: 2975615 - RNA, 16 nt, Mycobacterium avium subsp. paratuberculosis
aguccugcagcucgcc

SEQ ID NO: 2975616 - RNA, 20 nt, Mycobacterium avium subsp. paratuberculosis
aguccugcagcucgccggcg

SEQ ID NO: 2975617 - RNA, 13 nt, Mycobacterium avium subsp. paratuberculosis
aguccugcgccgc

SEQ ID NO: 2975618 - RNA, 14 nt, Mycobacterium avium subsp. paratuberculosis
aguccugcgccgcg

SEQ ID NO: 2975619 - RNA, 17 nt, Mycobacterium avium subsp. paratuberculosis
aguccugcgccgcggug

SEQ ID NO: 2975620 - RNA, 19 nt, Mycobacterium avium subsp. paratuberculosis
aguccugguaccccagcaa

SEQ ID NO: 2975621 - RNA, 16 nt, Mycobacterium avium subsp. paratuberculosis
aguccuuguggcccag

SEQ ID NO: 2975622 - RNA, 18 nt, Mycobacterium avium subsp. paratuberculosis
aguccuuguggcccaggc

SEQ ID NO: 2975623 - RNA, 12 nt, Mycobacterium avium subsp. paratuberculosis
agucgaagccgu

SEQ ID NO: 2975624 - RNA, 15 nt, Mycobacterium avium subsp. paratuberculosis
agucgaagccgucca

SEQ ID NO: 2975625 - RNA, 16 nt, Mycobacterium avium subsp. paratuberculosis
agucgaagccguggca

SEQ ID NO: 2975626 - RNA, 20 nt, Mycobacterium avium subsp. paratuberculosis
agucgaagccguggcaggca

SEQ ID NO: 2975627 - RNA, 22 nt, Mycobacterium avium subsp. paratuberculosis
agucgaagcggugcaccaccgu

SEQ ID NO: 2975628 - RNA, 18 nt, Mycobacterium avium subsp. paratuberculosis
agucgaauuccuugcgga

SEQ ID NO: 2975629 - RNA, 12 nt, Mycobacterium avium subsp. paratuberculosis
agucgaccaccc

SEQ ID NO: 2975630 - RNA, 13 nt, Mycobacterium avium subsp. paratuberculosis
agucgaccacccg

SEQ ID NO: 2975631 - RNA, 16 nt, Mycobacterium avium subsp. paratuberculosis
agucgaccacccgcag

SEQ ID NO: 2975632 - RNA, 22 nt, Mycobacterium avium subsp. paratuberculosis
agucgaccacccgcagcucgcc

SEQ ID NO: 2975633 - RNA, 20 nt, Mycobacterium avium subsp. paratuberculosis
agucgaccgcggcuccggcc

SEQ ID NO: 2975634 - RNA, 14 nt, Mycobacterium avium subsp. paratuberculosis
agucgaccggggcg

SEQ ID NO: 2975635 - RNA, 18 nt, Mycobacterium avium subsp. paratuberculosis
agucgacgcugugcgccu

SEQ ID NO: 2975636 - RNA, 20 nt, Mycobacterium avium subsp. paratuberculosis
agucgacgugcucggcggcc

SEQ ID NO: 2975637 - RNA, 13 nt, Mycobacterium avium subsp. paratuberculosis
agucgacuuccca

SEQ ID NO: 2975638 - RNA, 12 nt, Mycobacterium avium subsp. paratuberculosis
agucgagcaccg

SEQ ID NO: 2975639 - RNA, 21 nt, Mycobacterium avium subsp. paratuberculosis
agucgagggcuaaccaccggu

SEQ ID NO: 2975640 - RNA, 19 nt, Mycobacterium avium subsp. paratuberculosis
agucgagguugaugccgac

SEQ ID NO: 2975641 - RNA, 18 nt, Mycobacterium avium subsp. paratuberculosis
agucgaucagcgacggcc

SEQ ID NO: 2975642 - RNA, 13 nt, Mycobacterium avium subsp. paratuberculosis
agucgaucgccag

SEQ ID NO: 2975643 - RNA, 21 nt, Mycobacterium avium subsp. paratuberculosis
agucgaugccgccccugcugg

SEQ ID NO: 2975644 - RNA, 13 nt, Mycobacterium avium subsp. paratuberculosis
agucgcagcagca

SEQ ID NO: 2975645 - RNA, 14 nt, Mycobacterium avium subsp. paratuberculosis
agucgcagcagcag

SEQ ID NO: 2975646 - RNA, 19 nt, Mycobacterium avium subsp. paratuberculosis
agucgcagcagcagcccga

SEQ ID NO: 2975647 - RNA, 17 nt, Mycobacterium avium subsp. paratuberculosis
agucgcauaugcguggg

SEQ ID NO: 2975648 - RNA, 22 nt, Mycobacterium avium subsp. paratuberculosis
agucgcauaugcgugggcccuc

SEQ ID NO: 2975649 - RNA, 20 nt, Mycobacterium avium subsp. paratuberculosis
agucgccgacgccgaagauc

SEQ ID NO: 2975650 - RNA, 18 nt, Mycobacterium avium subsp. paratuberculosis
agucgccgauggagaccu

SEQ ID NO: 2975651 - RNA, 20 nt, Mycobacterium avium subsp. paratuberculosis
agucgccgccgcgcaccgcg

SEQ ID NO: 2975652 - RNA, 15 nt, Mycobacterium avium subsp. paratuberculosis
agucgccggccagga

SEQ ID NO: 2975653 - RNA, 13 nt, Mycobacterium avium subsp. paratuberculosis
agucgccggccuc

SEQ ID NO: 2975654 - RNA, 17 nt, Mycobacterium avium subsp. paratuberculosis
agucgccguccggggcc

SEQ ID NO: 2975655 - RNA, 18 nt, Mycobacterium avium subsp. paratuberculosis
agucgcgcaccauccgcg

SEQ ID NO: 2975656 - RNA, 12 nt, Mycobacterium avium subsp. paratuberculosis
agucgcgcagcu

SEQ ID NO: 2975657 - RNA, 12 nt, Mycobacterium avium subsp. paratuberculosis
agucgcgccgcc

SEQ ID NO: 2975658 - RNA, 14 nt, Mycobacterium avium subsp. paratuberculosis
agucgcgccgccag

SEQ ID NO: 2975659 - RNA, 13 nt, Mycobacterium avium subsp. paratuberculosis
agucgcgccgcgu

SEQ ID NO: 2975660 - RNA, 18 nt, Mycobacterium avium subsp. paratuberculosis
agucgcggcgaaccagca

SEQ ID NO: 2975661 - RNA, 16 nt, Mycobacterium avium subsp. paratuberculosis
agucgcgggcagccgg

SEQ ID NO: 2975662 - RNA, 20 nt, Mycobacterium avium subsp. paratuberculosis
agucgcgggcgagccgacag

SEQ ID NO: 2975663 - RNA, 23 nt, Mycobacterium avium subsp. paratuberculosis
agucgcgggcggggcgccgacag

SEQ ID NO: 2975664 - RNA, 13 nt, Mycobacterium avium subsp. paratuberculosis
agucgcucagcgu

SEQ ID NO: 2975665 - RNA, 15 nt, Mycobacterium avium subsp. paratuberculosis
agucgcucggcggcg

SEQ ID NO: 2975666 - RNA, 20 nt, Mycobacterium avium subsp. paratuberculosis
agucgcuggguguaaccggc

SEQ ID NO: 2975667 - RNA, 20 nt, Mycobacterium avium subsp. paratuberculosis
agucgcuguuggcgacggug

SEQ ID NO: 2975668 - RNA, 21 nt, Mycobacterium avium subsp. paratuberculosis
agucgcuguuggcgacggugc

SEQ ID NO: 2975669 - RNA, 11 nt, Mycobacterium avium subsp. paratuberculosis
agucggccacc

SEQ ID NO: 2975670 - RNA, 15 nt, Mycobacterium avium subsp. paratuberculosis
agucggccacguugc

SEQ ID NO: 2975671 - RNA, 12 nt, Mycobacterium avium subsp. paratuberculosis
agucggcccagg

SEQ ID NO: 2975672 - RNA, 13 nt, Mycobacterium avium subsp. paratuberculosis
agucggcccaggc

SEQ ID NO: 2975673 - RNA, 16 nt, Mycobacterium avium subsp. paratuberculosis
agucggcccgaucgcg

SEQ ID NO: 2975674 - RNA, 21 nt, Mycobacterium avium subsp. paratuberculosis
agucggcccgaucgcgucgac

SEQ ID NO: 2975675 - RNA, 15 nt, Mycobacterium avium subsp. paratuberculosis
agucggcccgccggg

SEQ ID NO: 2975676 - RNA, 17 nt, Mycobacterium avium subsp. paratuberculosis
agucggcccgccgggcc

SEQ ID NO: 2975677 - RNA, 14 nt, Mycobacterium avium subsp. paratuberculosis
agucggccggcguu

SEQ ID NO: 2975678 - RNA, 22 nt, Mycobacterium avium subsp. paratuberculosis
agucggccggcguuguccaggu

SEQ ID NO: 2975679 - RNA, 14 nt, Mycobacterium avium subsp. paratuberculosis
agucggccugcagc

SEQ ID NO: 2975680 - RNA, 15 nt, Mycobacterium avium subsp. paratuberculosis
agucggccugcagcu

SEQ ID NO: 2975681 - RNA, 19 nt, Mycobacterium avium subsp. paratuberculosis
agucggcgaucagcuccuc

SEQ ID NO: 2975682 - RNA, 13 nt, Mycobacterium avium subsp. paratuberculosis
agucggcgaucgg

SEQ ID NO: 2975683 - RNA, 16 nt, Mycobacterium avium subsp. paratuberculosis
agucggcgcagcgcac

SEQ ID NO: 2975684 - RNA, 17 nt, Mycobacterium avium subsp. paratuberculosis
agucggcgccgacggcc

SEQ ID NO: 2975685 - RNA, 23 nt, Mycobacterium avium subsp. paratuberculosis
agucggcggugaugcgcgccgac

SEQ ID NO: 2975686 - RNA, 17 nt, Mycobacterium avium subsp. paratuberculosis
agucggcgucggagaug

SEQ ID NO: 2975687 - RNA, 22 nt, Mycobacterium avium subsp. paratuberculosis
agucggcgucggagaugcgggc

SEQ ID NO: 2975688 - RNA, 14 nt, Mycobacterium avium subsp. paratuberculosis
agucggcgucggcc

SEQ ID NO: 2975689 - RNA, 17 nt, Mycobacterium avium subsp. paratuberculosis
agucggcgucggccacc

SEQ ID NO: 2975690 - RNA, 19 nt, Mycobacterium avium subsp. paratuberculosis
agucggcgucggccaccgc

SEQ ID NO: 2975691 - RNA, 17 nt, Mycobacterium avium subsp. paratuberculosis
agucgggaaaucggacc

SEQ ID NO: 2975692 - RNA, 20 nt, Mycobacterium avium subsp. paratuberculosis
agucgggaaaucggacccag

SEQ ID NO: 2975693 - RNA, 23 nt, Mycobacterium avium subsp. paratuberculosis
agucgggaaaucggacccagccc

SEQ ID NO: 2975694 - RNA, 20 nt, Mycobacterium avium subsp. paratuberculosis
agucgggauagggcgcgucg

SEQ ID NO: 2975695 - RNA, 22 nt, Mycobacterium avium subsp. paratuberculosis
agucgggauagggcgcgucgau

SEQ ID NO: 2975696 - RNA, 15 nt, Mycobacterium avium subsp. paratuberculosis
agucgggcccgcccc

SEQ ID NO: 2975697 - RNA, 19 nt, Mycobacterium avium subsp. paratuberculosis
agucggggugcucgaucgg

SEQ ID NO: 2975698 - RNA, 16 nt, Mycobacterium avium subsp. paratuberculosis
agucggucagcgucgc

SEQ ID NO: 2975699 - RNA, 20 nt, Mycobacterium avium subsp. paratuberculosis
agucggucagcgucgccgcc

SEQ ID NO: 2975700 - RNA, 15 nt, Mycobacterium avium subsp. paratuberculosis
agucggucggucagc

SEQ ID NO: 2975701 - RNA, 22 nt, Mycobacterium avium subsp. paratuberculosis
agucgguuucgaccugcgggug

SEQ ID NO: 2975702 - RNA, 22 nt, Mycobacterium avium subsp. paratuberculosis
agucguagucgaugcccgcguc

SEQ ID NO: 2975703 - RNA, 16 nt, Mycobacterium avium subsp. paratuberculosis
agucguccagcgucga

SEQ ID NO: 2975704 - RNA, 18 nt, Mycobacterium avium subsp. paratuberculosis
agucgucgaccgccacca

SEQ ID NO: 2975705 - RNA, 14 nt, Mycobacterium avium subsp. paratuberculosis
agucgucgaucucg

SEQ ID NO: 2975706 - RNA, 20 nt, Mycobacterium avium subsp. paratuberculosis
agucgucgaucucggugagc

SEQ ID NO: 2975707 - RNA, 16 nt, Mycobacterium avium subsp. paratuberculosis
agucgucgcgcaccag

SEQ ID NO: 2975708 - RNA, 17 nt, Mycobacterium avium subsp. paratuberculosis
agucgucgcgcaccagc

SEQ ID NO: 2975709 - RNA, 20 nt, Mycobacterium avium subsp. paratuberculosis
agucgucggugggccgccgc

SEQ ID NO: 2975710 - RNA, 22 nt, Mycobacterium avium subsp. paratuberculosis
agucgucggugggccgccgcgg

SEQ ID NO: 2975711 - RNA, 14 nt, Mycobacterium avium subsp. paratuberculosis
agucgugacgcggc

SEQ ID NO: 2975712 - RNA, 18 nt, Mycobacterium avium subsp. paratuberculosis
agucgugacgcggcgucg

SEQ ID NO: 2975713 - RNA, 16 nt, Mycobacterium avium subsp. paratuberculosis
agucguucagcugcag

SEQ ID NO: 2975714 - RNA, 16 nt, Mycobacterium avium subsp. paratuberculosis
agucguucggccagca

SEQ ID NO: 2975715 - RNA, 18 nt, Mycobacterium avium subsp. paratuberculosis
agucguuggugcgcacca

SEQ ID NO: 2975716 - RNA, 18 nt, Mycobacterium avium subsp. paratuberculosis
agucugagcccgggcagg

SEQ ID NO: 2975717 - RNA, 16 nt, Mycobacterium avium subsp. paratuberculosis
auacccgcggccuccg

SEQ ID NO: 2975718 - RNA, 13 nt, Mycobacterium avium subsp. paratuberculosis
auaccgcccgcgc

SEQ ID NO: 2975719 - RNA, 23 nt, Mycobacterium avium subsp. paratuberculosis
auaccgcccgcgcuggugcugcu

SEQ ID NO: 2975720 - RNA, 15 nt, Mycobacterium avium subsp. paratuberculosis
auaccgccggccgcg

SEQ ID NO: 2975721 - RNA, 16 nt, Mycobacterium avium subsp. paratuberculosis
auaccgccggccgcgc

SEQ ID NO: 2975722 - RNA, 14 nt, Mycobacterium avium subsp. paratuberculosis
auaccggcagcagg

SEQ ID NO: 2975723 - RNA, 18 nt, Mycobacterium avium subsp. paratuberculosis
auaccggcagcaggugca

SEQ ID NO: 2975724 - RNA, 23 nt, Mycobacterium avium subsp. paratuberculosis
auaccggcagcaggugcaccacc

SEQ ID NO: 2975725 - RNA, 15 nt, Mycobacterium avium subsp. paratuberculosis
auaccggccggcgcg

SEQ ID NO: 2975726 - RNA, 14 nt, Mycobacterium avium subsp. paratuberculosis
auaccguccgcgcc

SEQ ID NO: 2975727 - RNA, 17 nt, Mycobacterium avium subsp. paratuberculosis
auaccuugccggagugc

SEQ ID NO: 2975728 - RNA, 16 nt, Mycobacterium avium subsp. paratuberculosis
auaccuugucggcguc

SEQ ID NO: 2975729 - RNA, 15 nt, Mycobacterium avium subsp. paratuberculosis
auacgacguccgggc

SEQ ID NO: 2975730 - RNA, 16 nt, Mycobacterium avium subsp. paratuberculosis
auacgcccggccaccu

SEQ ID NO: 2975731 - RNA, 16 nt, Mycobacterium avium subsp. paratuberculosis
auacgccgacgcaugu

SEQ ID NO: 2975732 - RNA, 15 nt, Mycobacterium avium subsp. paratuberculosis
auacgccgcgacgau

SEQ ID NO: 2975733 - RNA, 10 nt, Mycobacterium avium subsp. paratuberculosis
auacgcggcg

SEQ ID NO: 2975734 - RNA, 19 nt, Mycobacterium avium subsp. paratuberculosis
auacggugcccgccgcgac

SEQ ID NO: 2975735 - RNA, 14 nt, Mycobacterium avium subsp. paratuberculosis
auagaucaucccgg

SEQ ID NO: 2975736 - RNA, 13 nt, Mycobacterium avium subsp. paratuberculosis
auagaugcuuugg

SEQ ID NO: 2975737 - RNA, 22 nt, Mycobacterium avium subsp. paratuberculosis
auagcccagccaguccgccgcc

SEQ ID NO: 2975738 - RNA, 16 nt, Mycobacterium avium subsp. paratuberculosis
auagccccgccaggcg

SEQ ID NO: 2975739 - RNA, 21 nt, Mycobacterium avium subsp. paratuberculosis
auagcccgccgcggcgaccgg

SEQ ID NO: 2975740 - RNA, 20 nt, Mycobacterium avium subsp. paratuberculosis
auagccgacgggauccggau

SEQ ID NO: 2975741 - RNA, 10 nt, Mycobacterium avium subsp. paratuberculosis
auagccgcgc

SEQ ID NO: 2975742 - RNA, 12 nt, Mycobacterium avium subsp. paratuberculosis
auagccggccgc

SEQ ID NO: 2975743 - RNA, 15 nt, Mycobacterium avium subsp. paratuberculosis
auagccggccgcguc

SEQ ID NO: 2975744 - RNA, 20 nt, Mycobacterium avium subsp. paratuberculosis
auagccggccgcgucgccga

SEQ ID NO: 2975745 - RNA, 20 nt, Mycobacterium avium subsp. paratuberculosis
auagccggugaucgcggcgc

SEQ ID NO: 2975746 - RNA, 15 nt, Mycobacterium avium subsp. paratuberculosis
auagccgucggcggc

SEQ ID NO: 2975747 - RNA, 16 nt, Mycobacterium avium subsp. paratuberculosis
auagcgccgcucggcc

SEQ ID NO: 2975748 - RNA, 18 nt, Mycobacterium avium subsp. paratuberculosis
auagcggcguaccgcggc

SEQ ID NO: 2975749 - RNA, 22 nt, Mycobacterium avium subsp. paratuberculosis
auagcgggagccggccagguug

SEQ ID NO: 2975750 - RNA, 20 nt, Mycobacterium avium subsp. paratuberculosis
auagcgggcuaggcucggca

SEQ ID NO: 2975751 - RNA, 13 nt, Mycobacterium avium subsp. paratuberculosis
auagcucaggugc

SEQ ID NO: 2975752 - RNA, 14 nt, Mycobacterium avium subsp. paratuberculosis
auagcuggcgccga

SEQ ID NO: 2975753 - RNA, 17 nt, Mycobacterium avium subsp. paratuberculosis
auagcuggcgccgaaca

SEQ ID NO: 2975754 - RNA, 22 nt, Mycobacterium avium subsp. paratuberculosis
auaggagacagccgagauggca

SEQ ID NO: 2975755 - RNA, 13 nt, Mycobacterium avium subsp. paratuberculosis
auaggccagcacc

SEQ ID NO: 2975756 - RNA, 20 nt, Mycobacterium avium subsp. paratuberculosis
auaggccagcaccagcgugu

SEQ ID NO: 2975757 - RNA, 11 nt, Mycobacterium avium subsp. paratuberculosis
auaggccgcgu

SEQ ID NO: 2975758 - RNA, 22 nt, Mycobacterium avium subsp. paratuberculosis
auaggccgggcagugcgcggcg

SEQ ID NO: 2975759 - RNA, 14 nt, Mycobacterium avium subsp. paratuberculosis
auaggcguacacca

SEQ ID NO: 2975760 - RNA, 16 nt, Mycobacterium avium subsp. paratuberculosis
auaggucacgccgggg

SEQ ID NO: 2975761 - RNA, 22 nt, Mycobacterium avium subsp. paratuberculosis
auagugaacgccucgggccggc

SEQ ID NO: 2975762 - RNA, 15 nt, Mycobacterium avium subsp. paratuberculosis
auaguucgccgccgc

SEQ ID NO: 2975763 - RNA, 21 nt, Mycobacterium avium subsp. paratuberculosis
auaguucgccgccgccagcac

SEQ ID NO: 2975764 - RNA, 16 nt, Mycobacterium avium subsp. paratuberculosis
auauaggugagaaaag

SEQ ID NO: 2975765 - RNA, 22 nt, Mycobacterium avium subsp. paratuberculosis
auaucgacggccccccgggcac

SEQ ID NO: 2975766 - RNA, 18 nt, Mycobacterium avium subsp. paratuberculosis
auaucgcaccggcgccuc

SEQ ID NO: 2975767 - RNA, 15 nt, Mycobacterium avium subsp. paratuberculosis
auaugacgccggccu

SEQ ID NO: 2975768 - RNA, 13 nt, Mycobacterium avium subsp. paratuberculosis
auauggcccucca

SEQ ID NO: 2975769 - RNA, 17 nt, Mycobacterium avium subsp. paratuberculosis
auauugguucgcucguc

SEQ ID NO: 2975770 - RNA, 16 nt, Mycobacterium avium subsp. paratuberculosis
auauuucguguucuca

SEQ ID NO: 2975771 - RNA, 20 nt, Mycobacterium avium subsp. paratuberculosis
aucaaaucccgcagcucgca

SEQ ID NO: 2975772 - RNA, 13 nt, Mycobacterium avium subsp. paratuberculosis
aucaacaccgcgc

SEQ ID NO: 2975773 - RNA, 14 nt, Mycobacterium avium subsp. paratuberculosis
aucaacagccgccc

SEQ ID NO: 2975774 - RNA, 14 nt, Mycobacterium avium subsp. paratuberculosis
aucaacaggcccag

SEQ ID NO: 2975775 - RNA, 19 nt, Mycobacterium avium subsp. paratuberculosis
aucaacaggcccagcagcg

SEQ ID NO: 2975776 - RNA, 20 nt, Mycobacterium avium subsp. paratuberculosis
aucaacauugugcuguugga

SEQ ID NO: 2975777 - RNA, 22 nt, Mycobacterium avium subsp. paratuberculosis
aucaacccgagcaccgggccga

SEQ ID NO: 2975778 - RNA, 16 nt, Mycobacterium avium subsp. paratuberculosis
aucaacgcgccgaaca

SEQ ID NO: 2975779 - RNA, 22 nt, Mycobacterium avium subsp. paratuberculosis
aucaacgcgccgaacaacggcg

SEQ ID NO: 2975780 - RNA, 16 nt, Mycobacterium avium subsp. paratuberculosis
aucaacgggucgagca

SEQ ID NO: 2975781 - RNA, 14 nt, Mycobacterium avium subsp. paratuberculosis
aucaacugcaccag

SEQ ID NO: 2975782 - RNA, 17 nt, Mycobacterium avium subsp. paratuberculosis
aucacaccaccacgcga

SEQ ID NO: 2975783 - RNA, 21 nt, Mycobacterium avium subsp. paratuberculosis
aucacacgcgcgccccggucc

SEQ ID NO: 2975784 - RNA, 20 nt, Mycobacterium avium subsp. paratuberculosis
aucacaucggacaucggcag

SEQ ID NO: 2975785 - RNA, 19 nt, Mycobacterium avium subsp. paratuberculosis
aucaccaagcgcgacaagc

SEQ ID NO: 2975786 - RNA, 14 nt, Mycobacterium avium subsp. paratuberculosis
aucaccaccaccgc

SEQ ID NO: 2975787 - RNA, 17 nt, Mycobacterium avium subsp. paratuberculosis
aucaccaccgccgccga

SEQ ID NO: 2975788 - RNA, 14 nt, Mycobacterium avium subsp. paratuberculosis
aucaccaccgccgg

SEQ ID NO: 2975789 - RNA, 23 nt, Mycobacterium avium subsp. paratuberculosis
aucaccacgcuguagggccacca

SEQ ID NO: 2975790 - RNA, 13 nt, Mycobacterium avium subsp. paratuberculosis
aucaccagcggcu

SEQ ID NO: 2975791 - RNA, 17 nt, Mycobacterium avium subsp. paratuberculosis
aucaccagcggcugcag

SEQ ID NO: 2975792 - RNA, 18 nt, Mycobacterium avium subsp. paratuberculosis
aucaccaugaucagcgcc

SEQ ID NO: 2975793 - RNA, 20 nt, Mycobacterium avium subsp. paratuberculosis
aucaccaugaucagcgccgu

SEQ ID NO: 2975794 - RNA, 23 nt, Mycobacterium avium subsp. paratuberculosis
aucaccaugaucagcgccguggc

SEQ ID NO: 2975795 - RNA, 13 nt, Mycobacterium avium subsp. paratuberculosis
aucacccagccgu

SEQ ID NO: 2975796 - RNA, 18 nt, Mycobacterium avium subsp. paratuberculosis
aucacccccgacaccgug

SEQ ID NO: 2975797 - RNA, 22 nt, Mycobacterium avium subsp. paratuberculosis
aucaccccgaagcucaucaccg

SEQ ID NO: 2975798 - RNA, 14 nt, Mycobacterium avium subsp. paratuberculosis
aucacccgccgggu

SEQ ID NO: 2975799 - RNA, 15 nt, Mycobacterium avium subsp. paratuberculosis
aucacccggcgcgcg

SEQ ID NO: 2975800 - RNA, 21 nt, Mycobacterium avium subsp. paratuberculosis
aucacccggcggcaccgcggc

SEQ ID NO: 2975801 - RNA, 22 nt, Mycobacterium avium subsp. paratuberculosis
aucacccggcggcaccgcggcu

SEQ ID NO: 2975802 - RNA, 22 nt, Mycobacterium avium subsp. paratuberculosis
aucacccgggucgagcggcccg

SEQ ID NO: 2975803 - RNA, 16 nt, Mycobacterium avium subsp. paratuberculosis
aucaccgacagcgcgu

SEQ ID NO: 2975804 - RNA, 16 nt, Mycobacterium avium subsp. paratuberculosis
aucaccgcaccgacga

SEQ ID NO: 2975805 - RNA, 16 nt, Mycobacterium avium subsp. paratuberculosis
aucaccgccagcgcgc

SEQ ID NO: 2975806 - RNA, 21 nt, Mycobacterium avium subsp. paratuberculosis
aucaccgccagcgcgccgauc

SEQ ID NO: 2975807 - RNA, 14 nt, Mycobacterium avium subsp. paratuberculosis
aucaccgccgcggc

SEQ ID NO: 2975808 - RNA, 20 nt, Mycobacterium avium subsp. paratuberculosis
aucaccgcgggcgcgccguc

SEQ ID NO: 2975809 - RNA, 22 nt, Mycobacterium avium subsp. paratuberculosis
aucaccgcgguguugagcgcgu

SEQ ID NO: 2975810 - RNA, 19 nt, Mycobacterium avium subsp. paratuberculosis
aucaccgcguagcgccgcc

SEQ ID NO: 2975811 - RNA, 19 nt, Mycobacterium avium subsp. paratuberculosis
aucaccggaccggccagca

SEQ ID NO: 2975812 - RNA, 20 nt, Mycobacterium avium subsp. paratuberculosis
aucaccggcacgugcggguu

SEQ ID NO: 2975813 - RNA, 16 nt, Mycobacterium avium subsp. paratuberculosis
aucaccggcgcgccgu

SEQ ID NO: 2975814 - RNA, 17 nt, Mycobacterium avium subsp. paratuberculosis
aucaccggcgcgccguc

SEQ ID NO: 2975815 - RNA, 18 nt, Mycobacterium avium subsp. paratuberculosis
aucaccggcuugccgauc

SEQ ID NO: 2975816 - RNA, 22 nt, Mycobacterium avium subsp. paratuberculosis
aucaccgggacgggggugccga

SEQ ID NO: 2975817 - RNA, 20 nt, Mycobacterium avium subsp. paratuberculosis
aucaccuccuuggccaggcg

SEQ ID NO: 2975818 - RNA, 13 nt, Mycobacterium avium subsp. paratuberculosis
aucaccucgaacu

SEQ ID NO: 2975819 - RNA, 19 nt, Mycobacterium avium subsp. paratuberculosis
aucaccucgccggccgggc

SEQ ID NO: 2975820 - RNA, 22 nt, Mycobacterium avium subsp. paratuberculosis
aucaccucggugaugucgacgu

SEQ ID NO: 2975821 - RNA, 19 nt, Mycobacterium avium subsp. paratuberculosis
aucaccuggugcucgcgcu

SEQ ID NO: 2975822 - RNA, 23 nt, Mycobacterium avium subsp. paratuberculosis
aucaccuggugcucgcgcucguc

SEQ ID NO: 2975823 - RNA, 20 nt, Mycobacterium avium subsp. paratuberculosis
aucaccuucugcgcgccguc

SEQ ID NO: 2975824 - RNA, 20 nt, Mycobacterium avium subsp. paratuberculosis
aucaccuugcggccggcggc

SEQ ID NO: 2975825 - RNA, 22 nt, Mycobacterium avium subsp. paratuberculosis
aucaccuugcggccggcggcgu

SEQ ID NO: 2975826 - RNA, 16 nt, Mycobacterium avium subsp. paratuberculosis
aucaccuugucgcuga

SEQ ID NO: 2975827 - RNA, 23 nt, Mycobacterium avium subsp. paratuberculosis
aucaccuugucgcugaccaccga

SEQ ID NO: 2975828 - RNA, 22 nt, Mycobacterium avium subsp. paratuberculosis
aucacgaagaacuugucgucgu

SEQ ID NO: 2975829 - RNA, 16 nt, Mycobacterium avium subsp. paratuberculosis
aucacgacgcgaccga

SEQ ID NO: 2975830 - RNA, 19 nt, Mycobacterium avium subsp. paratuberculosis
aucacgcagaacucgucgc

SEQ ID NO: 2975831 - RNA, 22 nt, Mycobacterium avium subsp. paratuberculosis
aucacgccccaggcgcccugca

SEQ ID NO: 2975832 - RNA, 20 nt, Mycobacterium avium subsp. paratuberculosis
aucacggcguugaccgggcc

SEQ ID NO: 2975833 - RNA, 18 nt, Mycobacterium avium subsp. paratuberculosis
aucacgggcacaccgucg

SEQ ID NO: 2975834 - RNA, 22 nt, Mycobacterium avium subsp. paratuberculosis
aucacggugccgaguucgaccu

SEQ ID NO: 2975835 - RNA, 22 nt, Mycobacterium avium subsp. paratuberculosis
aucacgguggccgccaccaaca

SEQ ID NO: 2975836 - RNA, 16 nt, Mycobacterium avium subsp. paratuberculosis
aucacgucccgcucga

SEQ ID NO: 2975837 - RNA, 14 nt, Mycobacterium avium subsp. paratuberculosis
aucacgucggcgag

SEQ ID NO: 2975838 - RNA, 13 nt, Mycobacterium avium subsp. paratuberculosis
aucacgugcuggc

SEQ ID NO: 2975839 - RNA, 21 nt, Mycobacterium avium subsp. paratuberculosis
aucacguugauccgaugcagg

SEQ ID NO: 2975840 - RNA, 16 nt, Mycobacterium avium subsp. paratuberculosis
aucagaacgcccgcaa

SEQ ID NO: 2975841 - RNA, 16 nt, Mycobacterium avium subsp. paratuberculosis
aucagacccagcguca

SEQ ID NO: 2975842 - RNA, 12 nt, Mycobacterium avium subsp. paratuberculosis
aucagagcgggc

SEQ ID NO: 2975843 - RNA, 13 nt, Mycobacterium avium subsp. paratuberculosis
aucagagcgggcc

SEQ ID NO: 2975844 - RNA, 23 nt, Mycobacterium avium subsp. paratuberculosis
aucagcaccacguugcgcccggc

SEQ ID NO: 2975845 - RNA, 23 nt, Mycobacterium avium subsp. paratuberculosis
aucagcaccagguugucgccgcg

SEQ ID NO: 2975846 - RNA, 15 nt, Mycobacterium avium subsp. paratuberculosis
aucagcaccggguga

SEQ ID NO: 2975847 - RNA, 17 nt, Mycobacterium avium subsp. paratuberculosis
aucagcaccgggugaua

SEQ ID NO: 2975848 - RNA, 18 nt, Mycobacterium avium subsp. paratuberculosis
aucagcaccguccacagc

SEQ ID NO: 2975849 - RNA, 14 nt, Mycobacterium avium subsp. paratuberculosis
aucagcagcacccg

SEQ ID NO: 2975850 - RNA, 16 nt, Mycobacterium avium subsp. paratuberculosis
aucagcagcaccggcg

SEQ ID NO: 2975851 - RNA, 20 nt, Mycobacterium avium subsp. paratuberculosis
aucagcagcagguccugucc

SEQ ID NO: 2975852 - RNA, 19 nt, Mycobacterium avium subsp. paratuberculosis
aucagcagccgggccugcg

SEQ ID NO: 2975853 - RNA, 21 nt, Mycobacterium avium subsp. paratuberculosis
aucagcagcgccucgccgggc

SEQ ID NO: 2975854 - RNA, 14 nt, Mycobacterium avium subsp. paratuberculosis
aucagcaggaccag

SEQ ID NO: 2975855 - RNA, 16 nt, Mycobacterium avium subsp. paratuberculosis
aucagcaggaccaggc

SEQ ID NO: 2975856 - RNA, 18 nt, Mycobacterium avium subsp. paratuberculosis
aucagcaggaccgggauc

SEQ ID NO: 2975857 - RNA, 20 nt, Mycobacterium avium subsp. paratuberculosis
aucagcaggcccucggccag

SEQ ID NO: 2975858 - RNA, 16 nt, Mycobacterium avium subsp. paratuberculosis
aucagcaggcuggcgg

SEQ ID NO: 2975859 - RNA, 19 nt, Mycobacterium avium subsp. paratuberculosis
aucagcaggcuggcggcga

SEQ ID NO: 2975860 - RNA, 20 nt, Mycobacterium avium subsp. paratuberculosis
aucagcagguugauccgcgc

SEQ ID NO: 2975861 - RNA, 14 nt, Mycobacterium avium subsp. paratuberculosis
aucagcagugcccc

SEQ ID NO: 2975862 - RNA, 16 nt, Mycobacterium avium subsp. paratuberculosis
aucagcaugccgguca

SEQ ID NO: 2975863 - RNA, 15 nt, Mycobacterium avium subsp. paratuberculosis
aucagccacaccgcc

SEQ ID NO: 2975864 - RNA, 16 nt, Mycobacterium avium subsp. paratuberculosis
aucagccacaccgccg

SEQ ID NO: 2975865 - RNA, 17 nt, Mycobacterium avium subsp. paratuberculosis
aucagccacaccgccgg

SEQ ID NO: 2975866 - RNA, 18 nt, Mycobacterium avium subsp. paratuberculosis
aucagccacaccgccggc

SEQ ID NO: 2975867 - RNA, 23 nt, Mycobacterium avium subsp. paratuberculosis
aucagccacaccgccggcgcgga

SEQ ID NO: 2975868 - RNA, 14 nt, Mycobacterium avium subsp. paratuberculosis
aucagccaguugau

SEQ ID NO: 2975869 - RNA, 18 nt, Mycobacterium avium subsp. paratuberculosis
aucagccaguugaucagc

SEQ ID NO: 2975870 - RNA, 18 nt, Mycobacterium avium subsp. paratuberculosis
aucagcccgacccggcuc

SEQ ID NO: 2975871 - RNA, 17 nt, Mycobacterium avium subsp. paratuberculosis
aucagcccgcccaccac

SEQ ID NO: 2975872 - RNA, 19 nt, Mycobacterium avium subsp. paratuberculosis
aucagcccgcccaccacga

SEQ ID NO: 2975873 - RNA, 16 nt, Mycobacterium avium subsp. paratuberculosis
aucagcccggcccgca

SEQ ID NO: 2975874 - RNA, 21 nt, Mycobacterium avium subsp. paratuberculosis
aucagccgauacaugugccga

SEQ ID NO: 2975875 - RNA, 14 nt, Mycobacterium avium subsp. paratuberculosis
aucagccgccgucg

SEQ ID NO: 2975876 - RNA, 15 nt, Mycobacterium avium subsp. paratuberculosis
aucagccgcgacagc

SEQ ID NO: 2975877 - RNA, 18 nt, Mycobacterium avium subsp. paratuberculosis
aucagccgcgacagccgc

SEQ ID NO: 2975878 - RNA, 20 nt, Mycobacterium avium subsp. paratuberculosis
aucagccggguagcgccgcc

SEQ ID NO: 2975879 - RNA, 24 nt, Mycobacterium avium subsp. paratuberculosis
aucagcgaaggcaugggcgugccg

SEQ ID NO: 2975880 - RNA, 17 nt, Mycobacterium avium subsp. paratuberculosis
aucagcgacgucagguc

SEQ ID NO: 2975881 - RNA, 20 nt, Mycobacterium avium subsp. paratuberculosis
aucagcgacgucaggucgac

SEQ ID NO: 2975882 - RNA, 20 nt, Mycobacterium avium subsp. paratuberculosis
aucagcgacucgaccccgcc

SEQ ID NO: 2975883 - RNA, 18 nt, Mycobacterium avium subsp. paratuberculosis
aucagcgagacgaccagg

SEQ ID NO: 2975884 - RNA, 15 nt, Mycobacterium avium subsp. paratuberculosis
aucagcgccaccagc

SEQ ID NO: 2975885 - RNA, 16 nt, Mycobacterium avium subsp. paratuberculosis
aucagcgccaugcugc

SEQ ID NO: 2975886 - RNA, 10 nt, Mycobacterium avium subsp. paratuberculosis
aucagcgccc

SEQ ID NO: 2975887 - RNA, 12 nt, Mycobacterium avium subsp. paratuberculosis
aucagcgcccgc

SEQ ID NO: 2975888 - RNA, 20 nt, Mycobacterium avium subsp. paratuberculosis
aucagcgcccgcgcgggcug

SEQ ID NO: 2975889 - RNA, 13 nt, Mycobacterium avium subsp. paratuberculosis
aucagcgccgucu

SEQ ID NO: 2975890 - RNA, 18 nt, Mycobacterium avium subsp. paratuberculosis
aucagcgcgcacagcgcc

SEQ ID NO: 2975891 - RNA, 14 nt, Mycobacterium avium subsp. paratuberculosis
aucagcgcgcccag

SEQ ID NO: 2975892 - RNA, 18 nt, Mycobacterium avium subsp. paratuberculosis
aucagcgcgcccaggccc

SEQ ID NO: 2975893 - RNA, 22 nt, Mycobacterium avium subsp. paratuberculosis
aucagcgcgccgcccagcggug

SEQ ID NO: 2975894 - RNA, 17 nt, Mycobacterium avium subsp. paratuberculosis
aucagcgcguccaaccg

SEQ ID NO: 2975895 - RNA, 20 nt, Mycobacterium avium subsp. paratuberculosis
aucagcgcguccaaccgcgg

SEQ ID NO: 2975896 - RNA, 22 nt, Mycobacterium avium subsp. paratuberculosis
aucagcggagugaccgccagca

SEQ ID NO: 2975897 - RNA, 22 nt, Mycobacterium avium subsp. paratuberculosis
aucagcggauagaggcggcgca

SEQ ID NO: 2975898 - RNA, 17 nt, Mycobacterium avium subsp. paratuberculosis
aucagcggcgggcccag

SEQ ID NO: 2975899 - RNA, 19 nt, Mycobacterium avium subsp. paratuberculosis
aucagcggcgggcccagca

SEQ ID NO: 2975900 - RNA, 21 nt, Mycobacterium avium subsp. paratuberculosis
aucagcggcgggcccagcaga

SEQ ID NO: 2975901 - RNA, 22 nt, Mycobacterium avium subsp. paratuberculosis
aucagcggcgggcccagcagau

SEQ ID NO: 2975902 - RNA, 18 nt, Mycobacterium avium subsp. paratuberculosis
aucagcgucagcaccgcg

SEQ ID NO: 2975903 - RNA, 19 nt, Mycobacterium avium subsp. paratuberculosis
aucagcguggucagcgucu

SEQ ID NO: 2975904 - RNA, 19 nt, Mycobacterium avium subsp. paratuberculosis
aucagcguguuggacgccc

SEQ ID NO: 2975905 - RNA, 23 nt, Mycobacterium avium subsp. paratuberculosis
aucagcucgcggauccgggccgg

SEQ ID NO: 2975906 - RNA, 18 nt, Mycobacterium avium subsp. paratuberculosis
aucagcucggcagccccg

SEQ ID NO: 2975907 - RNA, 14 nt, Mycobacterium avium subsp. paratuberculosis
aucagcucggcggc

SEQ ID NO: 2975908 - RNA, 16 nt, Mycobacterium avium subsp. paratuberculosis
aucagcucggcggccu

SEQ ID NO: 2975909 - RNA, 17 nt, Mycobacterium avium subsp. paratuberculosis
aucagcucgucagcgcg

SEQ ID NO: 2975910 - RNA, 23 nt, Mycobacterium avium subsp. paratuberculosis
aucagcucgucagcgcgggccag

SEQ ID NO: 2975911 - RNA, 14 nt, Mycobacterium avium subsp. paratuberculosis
aucagcugcccgga

SEQ ID NO: 2975912 - RNA, 23 nt, Mycobacterium avium subsp. paratuberculosis
aucagcugcccggaguccggcuc

SEQ ID NO: 2975913 - RNA, 16 nt, Mycobacterium avium subsp. paratuberculosis
aucagcugccguccgg

SEQ ID NO: 2975914 - RNA, 15 nt, Mycobacterium avium subsp. paratuberculosis
aucagcugcucggcc

SEQ ID NO: 2975915 - RNA, 16 nt, Mycobacterium avium subsp. paratuberculosis
aucagcugcucggcca

SEQ ID NO: 2975916 - RNA, 13 nt, Mycobacterium avium subsp. paratuberculosis
aucagcugcucgu

SEQ ID NO: 2975917 - RNA, 16 nt, Mycobacterium avium subsp. paratuberculosis
aucaggaucugcgcaa

SEQ ID NO: 2975918 - RNA, 22 nt, Mycobacterium avium subsp. paratuberculosis
aucaggaucugcgcaagaaggg

SEQ ID NO: 2975919 - RNA, 19 nt, Mycobacterium avium subsp. paratuberculosis
aucaggaugacgccgcggu

SEQ ID NO: 2975920 - RNA, 15 nt, Mycobacterium avium subsp. paratuberculosis
aucaggccccacccg

SEQ ID NO: 2975921 - RNA, 21 nt, Mycobacterium avium subsp. paratuberculosis
aucaggcccucgucggcgagc

SEQ ID NO: 2975922 - RNA, 13 nt, Mycobacterium avium subsp. paratuberculosis
aucaggccggcca

SEQ ID NO: 2975923 - RNA, 14 nt, Mycobacterium avium subsp. paratuberculosis
aucaggccggccac

SEQ ID NO: 2975924 - RNA, 20 nt, Mycobacterium avium subsp. paratuberculosis
aucaggcggccggcccggcc

SEQ ID NO: 2975925 - RNA, 19 nt, Mycobacterium avium subsp. paratuberculosis
aucaggcggucgaacgcgg

SEQ ID NO: 2975926 - RNA, 22 nt, Mycobacterium avium subsp. paratuberculosis
aucaggcggucgaacgcggcgc

SEQ ID NO: 2975927 - RNA, 15 nt, Mycobacterium avium subsp. paratuberculosis
aucaggcugccgcug

SEQ ID NO: 2975928 - RNA, 19 nt, Mycobacterium avium subsp. paratuberculosis
aucaggcugccgcugcgcc

SEQ ID NO: 2975929 - RNA, 23 nt, Mycobacterium avium subsp. paratuberculosis
aucaggcugccgcugcgccggcg

SEQ ID NO: 2975930 - RNA, 23 nt, Mycobacterium avium subsp. paratuberculosis
aucagggcccacagcagccgcac

SEQ ID NO: 2975931 - RNA, 18 nt, Mycobacterium avium subsp. paratuberculosis
aucagggccgcggccgcc

SEQ ID NO: 2975932 - RNA, 13 nt, Mycobacterium avium subsp. paratuberculosis
aucagggcggcgc

SEQ ID NO: 2975933 - RNA, 14 nt, Mycobacterium avium subsp. paratuberculosis
aucagggcggcgcc

SEQ ID NO: 2975934 - RNA, 16 nt, Mycobacterium avium subsp. paratuberculosis
aucagggcggcgccgc

SEQ ID NO: 2975935 - RNA, 19 nt, Mycobacterium avium subsp. paratuberculosis
aucagggcggcgccgcggc

SEQ ID NO: 2975936 - RNA, 14 nt, Mycobacterium avium subsp. paratuberculosis
aucaggucggugcc

SEQ ID NO: 2975937 - RNA, 19 nt, Mycobacterium avium subsp. paratuberculosis
aucagguugaccagguggg

SEQ ID NO: 2975938 - RNA, 22 nt, Mycobacterium avium subsp. paratuberculosis
aucaguauggagaaaauccaga

SEQ ID NO: 2975939 - RNA, 23 nt, Mycobacterium avium subsp. paratuberculosis
aucagucgaagaugucgcggcgc

SEQ ID NO: 2975940 - RNA, 13 nt, Mycobacterium avium subsp. paratuberculosis
aucagugcggccc

SEQ ID NO: 2975941 - RNA, 19 nt, Mycobacterium avium subsp. paratuberculosis
aucaguuccuugauccggc

SEQ ID NO: 2975942 - RNA, 22 nt, Mycobacterium avium subsp. paratuberculosis
aucaguuccuugauccggccgc

SEQ ID NO: 2975943 - RNA, 23 nt, Mycobacterium avium subsp. paratuberculosis
aucauccaggugaacagcagcca

SEQ ID NO: 2975944 - RNA, 13 nt, Mycobacterium avium subsp. paratuberculosis
aucaucccggcca

SEQ ID NO: 2975945 - RNA, 14 nt, Mycobacterium avium subsp. paratuberculosis
aucaucccggccac

SEQ ID NO: 2975946 - RNA, 16 nt, Mycobacterium avium subsp. paratuberculosis
aucaucccggccaccc

SEQ ID NO: 2975947 - RNA, 14 nt, Mycobacterium avium subsp. paratuberculosis
aucauccggcgggg

SEQ ID NO: 2975948 - RNA, 16 nt, Mycobacterium avium subsp. paratuberculosis
aucaucgcccagcgca

SEQ ID NO: 2975949 - RNA, 23 nt, Mycobacterium avium subsp. paratuberculosis
aucaucgcccagcgcagcgccuc

SEQ ID NO: 2975950 - RNA, 18 nt, Mycobacterium avium subsp. paratuberculosis
aucaucgccccggagaug

SEQ ID NO: 2975951 - RNA, 21 nt, Mycobacterium avium subsp. paratuberculosis
aucaucgcuacaccccaccgg

SEQ ID NO: 2975952 - RNA, 22 nt, Mycobacterium avium subsp. paratuberculosis
aucaucuggcuggugauggcca

SEQ ID NO: 2975953 - RNA, 22 nt, Mycobacterium avium subsp. paratuberculosis
aucaugcccaccaucccgccgc

SEQ ID NO: 2975954 - RNA, 17 nt, Mycobacterium avium subsp. paratuberculosis
aucaugccgcccaucac

SEQ ID NO: 2975955 - RNA, 20 nt, Mycobacterium avium subsp. paratuberculosis
aucaugcgcgucauggccgu

SEQ ID NO: 2975956 - RNA, 22 nt, Mycobacterium avium subsp. paratuberculosis
aucauggucggcgacgccgucg

SEQ ID NO: 2975957 - RNA, 23 nt, Mycobacterium avium subsp. paratuberculosis
aucauggugaaggcgaacaccag

SEQ ID NO: 2975958 - RNA, 13 nt, Mycobacterium avium subsp. paratuberculosis
aucauguagcgcu

SEQ ID NO: 2975959 - RNA, 22 nt, Mycobacterium avium subsp. paratuberculosis
aucaugucgaugccgagccggc

SEQ ID NO: 2975960 - RNA, 12 nt, Mycobacterium avium subsp. paratuberculosis
aucaugucgucc

SEQ ID NO: 2975961 - RNA, 16 nt, Mycobacterium avium subsp. paratuberculosis
auccaaggagaaggcc

SEQ ID NO: 2975962 - RNA, 17 nt, Mycobacterium avium subsp. paratuberculosis
auccaaggagaaggccg

SEQ ID NO: 2975963 - RNA, 23 nt, Mycobacterium avium subsp. paratuberculosis
auccacagcgguucggcgacgcu

SEQ ID NO: 2975964 - RNA, 11 nt, Mycobacterium avium subsp. paratuberculosis
auccacagcgu

SEQ ID NO: 2975965 - RNA, 15 nt, Mycobacterium avium subsp. paratuberculosis
auccacccaccggca

SEQ ID NO: 2975966 - RNA, 16 nt, Mycobacterium avium subsp. paratuberculosis
auccaccgcgcggcca

SEQ ID NO: 2975967 - RNA, 17 nt, Mycobacterium avium subsp. paratuberculosis
auccacgaugccgggca

SEQ ID NO: 2975968 - RNA, 17 nt, Mycobacterium avium subsp. paratuberculosis
auccacgccuccggcag

SEQ ID NO: 2975969 - RNA, 13 nt, Mycobacterium avium subsp. paratuberculosis
auccacggccggu

SEQ ID NO: 2975970 - RNA, 15 nt, Mycobacterium avium subsp. paratuberculosis
auccacuccagcacc

SEQ ID NO: 2975971 - RNA, 16 nt, Mycobacterium avium subsp. paratuberculosis
auccacuccagcaccg

SEQ ID NO: 2975972 - RNA, 17 nt, Mycobacterium avium subsp. paratuberculosis
auccacuccgaggucag

SEQ ID NO: 2975973 - RNA, 22 nt, Mycobacterium avium subsp. paratuberculosis
auccacuccgaggucagcgcgu

SEQ ID NO: 2975974 - RNA, 24 nt, Mycobacterium avium subsp. paratuberculosis
auccacuccgaggucagcgcguac

SEQ ID NO: 2975975 - RNA, 15 nt, Mycobacterium avium subsp. paratuberculosis
auccacucggccacc

SEQ ID NO: 2975976 - RNA, 16 nt, Mycobacterium avium subsp. paratuberculosis
auccagaacagccagu

SEQ ID NO: 2975977 - RNA, 18 nt, Mycobacterium avium subsp. paratuberculosis
auccagacggucuuggcg

SEQ ID NO: 2975978 - RNA, 18 nt, Mycobacterium avium subsp. paratuberculosis
auccagagcaucagggcg

SEQ ID NO: 2975979 - RNA, 16 nt, Mycobacterium avium subsp. paratuberculosis
auccagaugcccagca

SEQ ID NO: 2975980 - RNA, 17 nt, Mycobacterium avium subsp. paratuberculosis
auccagaugcccagcag

SEQ ID NO: 2975981 - RNA, 14 nt, Mycobacterium avium subsp. paratuberculosis
auccagaugccggg

SEQ ID NO: 2975982 - RNA, 24 nt, Mycobacterium avium subsp. paratuberculosis
auccagcagcgccucggcgaucgg

SEQ ID NO: 2975983 - RNA, 13 nt, Mycobacterium avium subsp. paratuberculosis
auccagcagcgcg

SEQ ID NO: 2975984 - RNA, 17 nt, Mycobacterium avium subsp. paratuberculosis
auccagcccugcucggc

SEQ ID NO: 2975985 - RNA, 19 nt, Mycobacterium avium subsp. paratuberculosis
auccagcccugcuugaccg

SEQ ID NO: 2975986 - RNA, 23 nt, Mycobacterium avium subsp. paratuberculosis
auccagcccugcuugaccgcgac

SEQ ID NO: 2975987 - RNA, 23 nt, Mycobacterium avium subsp. paratuberculosis
auccagccgucguugcgggcggc

SEQ ID NO: 2975988 - RNA, 22 nt, Mycobacterium avium subsp. paratuberculosis
auccagccgugcggcuugcccg

SEQ ID NO: 2975989 - RNA, 16 nt, Mycobacterium avium subsp. paratuberculosis
auccagccgugggugu

SEQ ID NO: 2975990 - RNA, 19 nt, Mycobacterium avium subsp. paratuberculosis
auccagccuugcagccgcu

SEQ ID NO: 2975991 - RNA, 13 nt, Mycobacterium avium subsp. paratuberculosis
auccagcgccgcc

SEQ ID NO: 2975992 - RNA, 14 nt, Mycobacterium avium subsp. paratuberculosis
auccagcgcgccgc

SEQ ID NO: 2975993 - RNA, 17 nt, Mycobacterium avium subsp. paratuberculosis
auccagcgcuggccggc

SEQ ID NO: 2975994 - RNA, 19 nt, Mycobacterium avium subsp. paratuberculosis
auccagcgcuggccggcca

SEQ ID NO: 2975995 - RNA, 11 nt, Mycobacterium avium subsp. paratuberculosis
auccagcggcg

SEQ ID NO: 2975996 - RNA, 12 nt, Mycobacterium avium subsp. paratuberculosis
auccagcggcgc

SEQ ID NO: 2975997 - RNA, 13 nt, Mycobacterium avium subsp. paratuberculosis
auccagcggcgca

SEQ ID NO: 2975998 - RNA, 15 nt, Mycobacterium avium subsp. paratuberculosis
auccagcggcggccu

SEQ ID NO: 2975999 - RNA, 15 nt, Mycobacterium avium subsp. paratuberculosis
auccaggaacggcac

SEQ ID NO: 2976000 - RNA, 18 nt, Mycobacterium avium subsp. paratuberculosis
auccaggaacggcacccg

SEQ ID NO: 2976001 - RNA, 17 nt, Mycobacterium avium subsp. paratuberculosis
auccaggaccgcgcgcc

SEQ ID NO: 2976002 - RNA, 22 nt, Mycobacterium avium subsp. paratuberculosis
auccaggaccgcgcgccggcca

SEQ ID NO: 2976003 - RNA, 17 nt, Mycobacterium avium subsp. paratuberculosis
auccagguacugggcgu

SEQ ID NO: 2976004 - RNA, 18 nt, Mycobacterium avium subsp. paratuberculosis
auccaggugaacagcagc

SEQ ID NO: 2976005 - RNA, 15 nt, Mycobacterium avium subsp. paratuberculosis
auccagucggcgccg

SEQ ID NO: 2976006 - RNA, 16 nt, Mycobacterium avium subsp. paratuberculosis
auccagucggcgccga

SEQ ID NO: 2976007 - RNA, 20 nt, Mycobacterium avium subsp. paratuberculosis
auccagucggcgccgaugca

SEQ ID NO: 2976008 - RNA, 23 nt, Mycobacterium avium subsp. paratuberculosis
auccagugcaguucgaugccgau

SEQ ID NO: 2976009 - RNA, 18 nt, Mycobacterium avium subsp. paratuberculosis
auccauugggccgcggcg

SEQ ID NO: 2976010 - RNA, 20 nt, Mycobacterium avium subsp. paratuberculosis
auccauugggccgcggcguc

SEQ ID NO: 2976011 - RNA, 20 nt, Mycobacterium avium subsp. paratuberculosis
aucccagaauucgccggggc

SEQ ID NO: 2976012 - RNA, 23 nt, Mycobacterium avium subsp. paratuberculosis
aucccagccauacugacgccggu

SEQ ID NO: 2976013 - RNA, 16 nt, Mycobacterium avium subsp. paratuberculosis
aucccagcgggacagc

SEQ ID NO: 2976014 - RNA, 18 nt, Mycobacterium avium subsp. paratuberculosis
aucccagcgggacagcac

SEQ ID NO: 2976015 - RNA, 23 nt, Mycobacterium avium subsp. paratuberculosis
aucccagcgggacagcaccacca

SEQ ID NO: 2976016 - RNA, 16 nt, Mycobacterium avium subsp. paratuberculosis
aucccaggaacgcgcc

SEQ ID NO: 2976017 - RNA, 20 nt, Mycobacterium avium subsp. paratuberculosis
aucccaucagugcggcccgc

SEQ ID NO: 2976018 - RNA, 15 nt, Mycobacterium avium subsp. paratuberculosis
aucccaucggggcua

SEQ ID NO: 2976019 - RNA, 16 nt, Mycobacterium avium subsp. paratuberculosis
auccccacgucgccgu

SEQ ID NO: 2976020 - RNA, 23 nt, Mycobacterium avium subsp. paratuberculosis
auccccagcacggugaugcgggu

SEQ ID NO: 2976021 - RNA, 16 nt, Mycobacterium avium subsp. paratuberculosis
auccccagcugggccg

SEQ ID NO: 2976022 - RNA, 13 nt, Mycobacterium avium subsp. paratuberculosis
auccccccgcgcc

SEQ ID NO: 2976023 - RNA, 13 nt, Mycobacterium avium subsp. paratuberculosis
auccccgcgcugg

SEQ ID NO: 2976024 - RNA, 21 nt, Mycobacterium avium subsp. paratuberculosis
auccccgcgcugggcuggccg

SEQ ID NO: 2976025 - RNA, 17 nt, Mycobacterium avium subsp. paratuberculosis
auccccgcuucggcucg

SEQ ID NO: 2976026 - RNA, 18 nt, Mycobacterium avium subsp. paratuberculosis
aucccgaacugccgcgca

SEQ ID NO: 2976027 - RNA, 16 nt, Mycobacterium avium subsp. paratuberculosis
aucccgaccagcugau

SEQ ID NO: 2976028 - RNA, 15 nt, Mycobacterium avium subsp. paratuberculosis
aucccgauccgcgcc

SEQ ID NO: 2976029 - RNA, 16 nt, Mycobacterium avium subsp. paratuberculosis
aucccgauccgcgccg

SEQ ID NO: 2976030 - RNA, 22 nt, Mycobacterium avium subsp. paratuberculosis
aucccgauccgcgccgccgcca

SEQ ID NO: 2976031 - RNA, 14 nt, Mycobacterium avium subsp. paratuberculosis
aucccgaucgacgu

SEQ ID NO: 2976032 - RNA, 22 nt, Mycobacterium avium subsp. paratuberculosis
aucccgaucgacgucagcuccc

SEQ ID NO: 2976033 - RNA, 15 nt, Mycobacterium avium subsp. paratuberculosis
aucccgaugccgcgc

SEQ ID NO: 2976034 - RNA, 16 nt, Mycobacterium avium subsp. paratuberculosis
aucccgaugucggcga

SEQ ID NO: 2976035 - RNA, 20 nt, Mycobacterium avium subsp. paratuberculosis
aucccgcaauugcgccagca

SEQ ID NO: 2976036 - RNA, 14 nt, Mycobacterium avium subsp. paratuberculosis
aucccgcagccgcg

SEQ ID NO: 2976037 - RNA, 15 nt, Mycobacterium avium subsp. paratuberculosis
aucccgcagcuucug

SEQ ID NO: 2976038 - RNA, 18 nt, Mycobacterium avium subsp. paratuberculosis
aucccgcagcuucugguc

SEQ ID NO: 2976039 - RNA, 17 nt, Mycobacterium avium subsp. paratuberculosis
aucccgccgaacccgcc

SEQ ID NO: 2976040 - RNA, 23 nt, Mycobacterium avium subsp. paratuberculosis
aucccgccgaacccgcccucgcc

SEQ ID NO: 2976041 - RNA, 23 nt, Mycobacterium avium subsp. paratuberculosis
aucccgccggcgaucgacgucac

SEQ ID NO: 2976042 - RNA, 16 nt, Mycobacterium avium subsp. paratuberculosis
aucccgccggcggcca

SEQ ID NO: 2976043 - RNA, 18 nt, Mycobacterium avium subsp. paratuberculosis
aucccgccggcggccacg

SEQ ID NO: 2976044 - RNA, 14 nt, Mycobacterium avium subsp. paratuberculosis
aucccgccgggcau

SEQ ID NO: 2976045 - RNA, 16 nt, Mycobacterium avium subsp. paratuberculosis
aucccgccgggcaucu

SEQ ID NO: 2976046 - RNA, 19 nt, Mycobacterium avium subsp. paratuberculosis
aucccgccucggcggaguc

SEQ ID NO: 2976047 - RNA, 21 nt, Mycobacterium avium subsp. paratuberculosis
aucccgccucggugagcagcu

SEQ ID NO: 2976048 - RNA, 22 nt, Mycobacterium avium subsp. paratuberculosis
aucccgcgggucgcggcccacc

SEQ ID NO: 2976049 - RNA, 23 nt, Mycobacterium avium subsp. paratuberculosis
aucccgcgggucgcggcccaccg

SEQ ID NO: 2976050 - RNA, 17 nt, Mycobacterium avium subsp. paratuberculosis
aucccggagaacaucag

SEQ ID NO: 2976051 - RNA, 14 nt, Mycobacterium avium subsp. paratuberculosis
aucccggagccguc

SEQ ID NO: 2976052 - RNA, 16 nt, Mycobacterium avium subsp. paratuberculosis
aucccggccaccccgc

SEQ ID NO: 2976053 - RNA, 17 nt, Mycobacterium avium subsp. paratuberculosis
aucccggccaccccgca

SEQ ID NO: 2976054 - RNA, 12 nt, Mycobacterium avium subsp. paratuberculosis
aucccggccacg

SEQ ID NO: 2976055 - RNA, 19 nt, Mycobacterium avium subsp. paratuberculosis
aucccggccagcacccgcu

SEQ ID NO: 2976056 - RNA, 17 nt, Mycobacterium avium subsp. paratuberculosis
aucccggggcgcgcugg

SEQ ID NO: 2976057 - RNA, 17 nt, Mycobacterium avium subsp. paratuberculosis
aucccggugaugccggc

SEQ ID NO: 2976058 - RNA, 20 nt, Mycobacterium avium subsp. paratuberculosis
aucccggugaugccggcauc

SEQ ID NO: 2976059 - RNA, 23 nt, Mycobacterium avium subsp. paratuberculosis
aucccgguucccgugcuggccau

SEQ ID NO: 2976060 - RNA, 19 nt, Mycobacterium avium subsp. paratuberculosis
aucccguacucgaugccgu

SEQ ID NO: 2976061 - RNA, 19 nt, Mycobacterium avium subsp. paratuberculosis
aucccguaggucgccucca

SEQ ID NO: 2976062 - RNA, 13 nt, Mycobacterium avium subsp. paratuberculosis
aucccgucgacca

SEQ ID NO: 2976063 - RNA, 13 nt, Mycobacterium avium subsp. paratuberculosis
aucccgucggcca

SEQ ID NO: 2976064 - RNA, 14 nt, Mycobacterium avium subsp. paratuberculosis
aucccgucggccau

SEQ ID NO: 2976065 - RNA, 21 nt, Mycobacterium avium subsp. paratuberculosis
aucccgucggccaucagccgc

SEQ ID NO: 2976066 - RNA, 23 nt, Mycobacterium avium subsp. paratuberculosis
aucccgucggccaucagccgccg

SEQ ID NO: 2976067 - RNA, 16 nt, Mycobacterium avium subsp. paratuberculosis
aucccgugcggagauc

SEQ ID NO: 2976068 - RNA, 21 nt, Mycobacterium avium subsp. paratuberculosis
aucccuccggcaggccgcggc

SEQ ID NO: 2976069 - RNA, 20 nt, Mycobacterium avium subsp. paratuberculosis
aucccugacacgaccgccug

SEQ ID NO: 2976070 - RNA, 16 nt, Mycobacterium avium subsp. paratuberculosis
aucccuugccgccgaa

SEQ ID NO: 2976071 - RNA, 14 nt, Mycobacterium avium subsp. paratuberculosis
aucccuuggcggcg

SEQ ID NO: 2976072 - RNA, 15 nt, Mycobacterium avium subsp. paratuberculosis
auccgacaccgccuu

SEQ ID NO: 2976073 - RNA, 21 nt, Mycobacterium avium subsp. paratuberculosis
auccgaccggcucagcccggc

SEQ ID NO: 2976074 - RNA, 15 nt, Mycobacterium avium subsp. paratuberculosis
auccgagcgcugccc

SEQ ID NO: 2976075 - RNA, 19 nt, Mycobacterium avium subsp. paratuberculosis
auccgaggguucgguggcc

SEQ ID NO: 2976076 - RNA, 22 nt, Mycobacterium avium subsp. paratuberculosis
auccgaucagcagcaccuggau

SEQ ID NO: 2976077 - RNA, 17 nt, Mycobacterium avium subsp. paratuberculosis
auccgaucaucagggca

SEQ ID NO: 2976078 - RNA, 21 nt, Mycobacterium avium subsp. paratuberculosis
auccgaugacgcugccgcgcc

SEQ ID NO: 2976079 - RNA, 15 nt, Mycobacterium avium subsp. paratuberculosis
auccgaugcagggcc

SEQ ID NO: 2976080 - RNA, 19 nt, Mycobacterium avium subsp. paratuberculosis
auccgcaacgugcgccggc

SEQ ID NO: 2976081 - RNA, 21 nt, Mycobacterium avium subsp. paratuberculosis
auccgcaacgugcgccggccu

SEQ ID NO: 2976082 - RNA, 15 nt, Mycobacterium avium subsp. paratuberculosis
auccgcagcaccagg

SEQ ID NO: 2976083 - RNA, 16 nt, Mycobacterium avium subsp. paratuberculosis
auccgcagcaccaggg

SEQ ID NO: 2976084 - RNA, 16 nt, Mycobacterium avium subsp. paratuberculosis
auccgcagccgcugcc

SEQ ID NO: 2976085 - RNA, 19 nt, Mycobacterium avium subsp. paratuberculosis
auccgcaggccgucgccgg

SEQ ID NO: 2976086 - RNA, 20 nt, Mycobacterium avium subsp. paratuberculosis
auccgcaggccgucgccggu

SEQ ID NO: 2976087 - RNA, 18 nt, Mycobacterium avium subsp. paratuberculosis
auccgccacccgcugcuc

SEQ ID NO: 2976088 - RNA, 20 nt, Mycobacterium avium subsp. paratuberculosis
auccgccacccgcugcucga

SEQ ID NO: 2976089 - RNA, 17 nt, Mycobacterium avium subsp. paratuberculosis
auccgccagaucgccug

SEQ ID NO: 2976090 - RNA, 13 nt, Mycobacterium avium subsp. paratuberculosis
auccgcccgccgg

SEQ ID NO: 2976091 - RNA, 21 nt, Mycobacterium avium subsp. paratuberculosis
auccgcccggcccgcaugcac

SEQ ID NO: 2976092 - RNA, 21 nt, Mycobacterium avium subsp. paratuberculosis
auccgcccguagaugcggccc

SEQ ID NO: 2976093 - RNA, 22 nt, Mycobacterium avium subsp. paratuberculosis
auccgccgacgauacgugcucc

SEQ ID NO: 2976094 - RNA, 14 nt, Mycobacterium avium subsp. paratuberculosis
auccgccgggcggc

SEQ ID NO: 2976095 - RNA, 17 nt, Mycobacterium avium subsp. paratuberculosis
auccgccguugcggccc

SEQ ID NO: 2976096 - RNA, 15 nt, Mycobacterium avium subsp. paratuberculosis
auccgccugcgcggg

SEQ ID NO: 2976097 - RNA, 19 nt, Mycobacterium avium subsp. paratuberculosis
auccgccugcgcgggcgcg

SEQ ID NO: 2976098 - RNA, 14 nt, Mycobacterium avium subsp. paratuberculosis
auccgcgacgccag

SEQ ID NO: 2976099 - RNA, 16 nt, Mycobacterium avium subsp. paratuberculosis
auccgcgacgccagca

SEQ ID NO: 2976100 - RNA, 16 nt, Mycobacterium avium subsp. paratuberculosis
auccgcgagccgagcc

SEQ ID NO: 2976101 - RNA, 15 nt, Mycobacterium avium subsp. paratuberculosis
auccgcgcagcagcg

SEQ ID NO: 2976102 - RNA, 20 nt, Mycobacterium avium subsp. paratuberculosis
auccgcgcagcgucuugccc

SEQ ID NO: 2976103 - RNA, 17 nt, Mycobacterium avium subsp. paratuberculosis
auccgcgccgccgccag

SEQ ID NO: 2976104 - RNA, 20 nt, Mycobacterium avium subsp. paratuberculosis
auccgcgccgccgccagcca

SEQ ID NO: 2976105 - RNA, 21 nt, Mycobacterium avium subsp. paratuberculosis
auccgcgccgccgccagccag

SEQ ID NO: 2976106 - RNA, 14 nt, Mycobacterium avium subsp. paratuberculosis
auccgcgccgcgau

SEQ ID NO: 2976107 - RNA, 17 nt, Mycobacterium avium subsp. paratuberculosis
auccgcgcgagcgcgcu

SEQ ID NO: 2976108 - RNA, 18 nt, Mycobacterium avium subsp. paratuberculosis
auccgcgcgagcgcgcug

SEQ ID NO: 2976109 - RNA, 18 nt, Mycobacterium avium subsp. paratuberculosis
auccgcgcggccaccagc

SEQ ID NO: 2976110 - RNA, 21 nt, Mycobacterium avium subsp. paratuberculosis
auccgcgcggccaccagcgcg

SEQ ID NO: 2976111 - RNA, 12 nt, Mycobacterium avium subsp. paratuberculosis
auccgcgcggcg

SEQ ID NO: 2976112 - RNA, 14 nt, Mycobacterium avium subsp. paratuberculosis
auccgcgcggcgac

SEQ ID NO: 2976113 - RNA, 16 nt, Mycobacterium avium subsp. paratuberculosis
auccgcgcgucgggcu

SEQ ID NO: 2976114 - RNA, 20 nt, Mycobacterium avium subsp. paratuberculosis
auccgcgcgucgggcucgcg

SEQ ID NO: 2976115 - RNA, 15 nt, Mycobacterium avium subsp. paratuberculosis
auccgcggccaccgg

SEQ ID NO: 2976116 - RNA, 12 nt, Mycobacterium avium subsp. paratuberculosis
auccgcggcgcc

SEQ ID NO: 2976117 - RNA, 13 nt, Mycobacterium avium subsp. paratuberculosis
auccgcucgccgc

SEQ ID NO: 2976118 - RNA, 18 nt, Mycobacterium avium subsp. paratuberculosis
auccgcucgccgcgggug

SEQ ID NO: 2976119 - RNA, 16 nt, Mycobacterium avium subsp. paratuberculosis
auccgcuggugcgcgc

SEQ ID NO: 2976120 - RNA, 17 nt, Mycobacterium avium subsp. paratuberculosis
auccgcuggugcgcgcc

SEQ ID NO: 2976121 - RNA, 15 nt, Mycobacterium avium subsp. paratuberculosis
auccggaacacguga

SEQ ID NO: 2976122 - RNA, 15 nt, Mycobacterium avium subsp. paratuberculosis
auccggaagccgucg

SEQ ID NO: 2976123 - RNA, 17 nt, Mycobacterium avium subsp. paratuberculosis
auccggaaugcggugcu

SEQ ID NO: 2976124 - RNA, 18 nt, Mycobacterium avium subsp. paratuberculosis
auccggacgaccugggcg

SEQ ID NO: 2976125 - RNA, 20 nt, Mycobacterium avium subsp. paratuberculosis
auccggacgaccugggcgcc

SEQ ID NO: 2976126 - RNA, 17 nt, Mycobacterium avium subsp. paratuberculosis
auccggauugccgggca

SEQ ID NO: 2976127 - RNA, 13 nt, Mycobacterium avium subsp. paratuberculosis
auccggcagcgcu

SEQ ID NO: 2976128 - RNA, 18 nt, Mycobacterium avium subsp. paratuberculosis
auccggcagcgcucgucg

SEQ ID NO: 2976129 - RNA, 16 nt, Mycobacterium avium subsp. paratuberculosis
auccggccagccgggg

SEQ ID NO: 2976130 - RNA, 15 nt, Mycobacterium avium subsp. paratuberculosis
auccggccgcuggug

SEQ ID NO: 2976131 - RNA, 19 nt, Mycobacterium avium subsp. paratuberculosis
auccggccggcgaggaacu

SEQ ID NO: 2976132 - RNA, 15 nt, Mycobacterium avium subsp. paratuberculosis
auccggccggcggcg

SEQ ID NO: 2976133 - RNA, 15 nt, Mycobacterium avium subsp. paratuberculosis
auccggcgcacggcg

SEQ ID NO: 2976134 - RNA, 18 nt, Mycobacterium avium subsp. paratuberculosis
auccggcgcccgaugaag

SEQ ID NO: 2976135 - RNA, 13 nt, Mycobacterium avium subsp. paratuberculosis
auccggcggcgcu

SEQ ID NO: 2976136 - RNA, 18 nt, Mycobacterium avium subsp. paratuberculosis
auccggcggcgcucagcg

SEQ ID NO: 2976137 - RNA, 16 nt, Mycobacterium avium subsp. paratuberculosis
auccggcgggccucgc

SEQ ID NO: 2976138 - RNA, 22 nt, Mycobacterium avium subsp. paratuberculosis
auccggcgucucagucggccac

SEQ ID NO: 2976139 - RNA, 16 nt, Mycobacterium avium subsp. paratuberculosis
auccggcucagaaggc

SEQ ID NO: 2976140 - RNA, 16 nt, Mycobacterium avium subsp. paratuberculosis
auccggcuccacagca

SEQ ID NO: 2976141 - RNA, 19 nt, Mycobacterium avium subsp. paratuberculosis
auccggcugagcagcucgc

SEQ ID NO: 2976142 - RNA, 16 nt, Mycobacterium avium subsp. paratuberculosis
auccgggaggccagca

SEQ ID NO: 2976143 - RNA, 17 nt, Mycobacterium avium subsp. paratuberculosis
auccgggcacgcagcgg

SEQ ID NO: 2976144 - RNA, 18 nt, Mycobacterium avium subsp. paratuberculosis
auccgggccgccgcggac

SEQ ID NO: 2976145 - RNA, 13 nt, Mycobacterium avium subsp. paratuberculosis
auccgggcgccau

SEQ ID NO: 2976146 - RNA, 17 nt, Mycobacterium avium subsp. paratuberculosis
auccgggcgccauccgc

SEQ ID NO: 2976147 - RNA, 13 nt, Mycobacterium avium subsp. paratuberculosis
auccgggcgccgg

SEQ ID NO: 2976148 - RNA, 14 nt, Mycobacterium avium subsp. paratuberculosis
auccgggcgccggc

SEQ ID NO: 2976149 - RNA, 18 nt, Mycobacterium avium subsp. paratuberculosis
auccgggcgccggccggc

SEQ ID NO: 2976150 - RNA, 19 nt, Mycobacterium avium subsp. paratuberculosis
auccgggcgccggccggcg

SEQ ID NO: 2976151 - RNA, 14 nt, Mycobacterium avium subsp. paratuberculosis
auccgggcgccggu

SEQ ID NO: 2976152 - RNA, 14 nt, Mycobacterium avium subsp. paratuberculosis
auccgggcggcauc

SEQ ID NO: 2976153 - RNA, 18 nt, Mycobacterium avium subsp. paratuberculosis
auccgggcggcaucgcgc

SEQ ID NO: 2976154 - RNA, 12 nt, Mycobacterium avium subsp. paratuberculosis
auccgggcggcc

SEQ ID NO: 2976155 - RNA, 16 nt, Mycobacterium avium subsp. paratuberculosis
auccgggcggccagcc

SEQ ID NO: 2976156 - RNA, 16 nt, Mycobacterium avium subsp. paratuberculosis
auccggggcagcagca

SEQ ID NO: 2976157 - RNA, 15 nt, Mycobacterium avium subsp. paratuberculosis
auccggggucagggc

SEQ ID NO: 2976158 - RNA, 17 nt, Mycobacterium avium subsp. paratuberculosis
auccggggucagggcgc

SEQ ID NO: 2976159 - RNA, 16 nt, Mycobacterium avium subsp. paratuberculosis
auccgggugucgacgc

SEQ ID NO: 2976160 - RNA, 22 nt, Mycobacterium avium subsp. paratuberculosis
auccgguaccagaucgagcugg

SEQ ID NO: 2976161 - RNA, 15 nt, Mycobacterium avium subsp. paratuberculosis
auccgguagaagacc

SEQ ID NO: 2976162 - RNA, 17 nt, Mycobacterium avium subsp. paratuberculosis
auccggucaacgccgcg

SEQ ID NO: 2976163 - RNA, 18 nt, Mycobacterium avium subsp. paratuberculosis
auccggucaacgccgcgc

SEQ ID NO: 2976164 - RNA, 20 nt, Mycobacterium avium subsp. paratuberculosis
auccggucagcgccagcaug

SEQ ID NO: 2976165 - RNA, 21 nt, Mycobacterium avium subsp. paratuberculosis
auccggucagcgccagcaugc

SEQ ID NO: 2976166 - RNA, 23 nt, Mycobacterium avium subsp. paratuberculosis
auccggucagcguggcgucggcg

SEQ ID NO: 2976167 - RNA, 20 nt, Mycobacterium avium subsp. paratuberculosis
auccggucauccucgccgcg

SEQ ID NO: 2976168 - RNA, 21 nt, Mycobacterium avium subsp. paratuberculosis
auccggucauccucgccgcgc

SEQ ID NO: 2976169 - RNA, 16 nt, Mycobacterium avium subsp. paratuberculosis
auccgguccacucguc

SEQ ID NO: 2976170 - RNA, 18 nt, Mycobacterium avium subsp. paratuberculosis
auccgguccagaucggcg

SEQ ID NO: 2976171 - RNA, 15 nt, Mycobacterium avium subsp. paratuberculosis
auccgguccagcccg

SEQ ID NO: 2976172 - RNA, 18 nt, Mycobacterium avium subsp. paratuberculosis
auccgguccagcccggug

SEQ ID NO: 2976173 - RNA, 20 nt, Mycobacterium avium subsp. paratuberculosis
auccggucgaucaccucguc

SEQ ID NO: 2976174 - RNA, 18 nt, Mycobacterium avium subsp. paratuberculosis
auccggugccgagcgcgc

SEQ ID NO: 2976175 - RNA, 19 nt, Mycobacterium avium subsp. paratuberculosis
auccggugccgagcgcgcu

SEQ ID NO: 2976176 - RNA, 19 nt, Mycobacterium avium subsp. paratuberculosis
auccggugggguuagggcg

SEQ ID NO: 2976177 - RNA, 15 nt, Mycobacterium avium subsp. paratuberculosis
auccgguugcaccgc

SEQ ID NO: 2976178 - RNA, 22 nt, Mycobacterium avium subsp. paratuberculosis
auccgguugcaccgcgauggcc

SEQ ID NO: 2976179 - RNA, 16 nt, Mycobacterium avium subsp. paratuberculosis
auccgucacgcccguc

SEQ ID NO: 2976180 - RNA, 21 nt, Mycobacterium avium subsp. paratuberculosis
auccguccuuggugauuucgc

SEQ ID NO: 2976181 - RNA, 19 nt, Mycobacterium avium subsp. paratuberculosis
auccgucugcucccaggac

SEQ ID NO: 2976182 - RNA, 15 nt, Mycobacterium avium subsp. paratuberculosis
auccgugagggaccu

SEQ ID NO: 2976183 - RNA, 22 nt, Mycobacterium avium subsp. paratuberculosis
auccucagcacggccgcggcca

SEQ ID NO: 2976184 - RNA, 18 nt, Mycobacterium avium subsp. paratuberculosis
auccucauagccggccgc

SEQ ID NO: 2976185 - RNA, 18 nt, Mycobacterium avium subsp. paratuberculosis
auccucgaauccgcgggc

SEQ ID NO: 2976186 - RNA, 14 nt, Mycobacterium avium subsp. paratuberculosis
auccucgccgagca

SEQ ID NO: 2976187 - RNA, 19 nt, Mycobacterium avium subsp. paratuberculosis
auccucgccgcgccagcac

SEQ ID NO: 2976188 - RNA, 15 nt, Mycobacterium avium subsp. paratuberculosis
auccugcagcuggcg

SEQ ID NO: 2976189 - RNA, 12 nt, Mycobacterium avium subsp. paratuberculosis
auccugcccggu

SEQ ID NO: 2976190 - RNA, 21 nt, Mycobacterium avium subsp. paratuberculosis
auccugcccggucugcggccg

SEQ ID NO: 2976191 - RNA, 16 nt, Mycobacterium avium subsp. paratuberculosis
auccugcgcaucgagc

SEQ ID NO: 2976192 - RNA, 16 nt, Mycobacterium avium subsp. paratuberculosis
auccugcuggccgggc

SEQ ID NO: 2976193 - RNA, 20 nt, Mycobacterium avium subsp. paratuberculosis
auccuggccuggucggccgg

SEQ ID NO: 2976194 - RNA, 21 nt, Mycobacterium avium subsp. paratuberculosis
auccuggccuggucggccggc

SEQ ID NO: 2976195 - RNA, 15 nt, Mycobacterium avium subsp. paratuberculosis
auccugggcgucgag

SEQ ID NO: 2976196 - RNA, 17 nt, Mycobacterium avium subsp. paratuberculosis
auccugguuucaggugg

SEQ ID NO: 2976197 - RNA, 18 nt, Mycobacterium avium subsp. paratuberculosis
auccugguuucagguggc

SEQ ID NO: 2976198 - RNA, 21 nt, Mycobacterium avium subsp. paratuberculosis
auccugucauccgucgcccgc

SEQ ID NO: 2976199 - RNA, 17 nt, Mycobacterium avium subsp. paratuberculosis
auccugugcaccgugcu

SEQ ID NO: 2976200 - RNA, 16 nt, Mycobacterium avium subsp. paratuberculosis
auccuuccucgcagaa

SEQ ID NO: 2976201 - RNA, 17 nt, Mycobacterium avium subsp. paratuberculosis
aucgaaaugaccgcgcc

SEQ ID NO: 2976202 - RNA, 13 nt, Mycobacterium avium subsp. paratuberculosis
aucgaacagggcg

SEQ ID NO: 2976203 - RNA, 22 nt, Mycobacterium avium subsp. paratuberculosis
aucgaacagggcggcgggcccg

SEQ ID NO: 2976204 - RNA, 16 nt, Mycobacterium avium subsp. paratuberculosis
aucgaacggcaccucg

SEQ ID NO: 2976205 - RNA, 13 nt, Mycobacterium avium subsp. paratuberculosis
aucgaacggcgga

SEQ ID NO: 2976206 - RNA, 23 nt, Mycobacterium avium subsp. paratuberculosis
aucgaacggcggaaccgggccgc

SEQ ID NO: 2976207 - RNA, 19 nt, Mycobacterium avium subsp. paratuberculosis
aucgaacuugaucaccgcg

SEQ ID NO: 2976208 - RNA, 14 nt, Mycobacterium avium subsp. paratuberculosis
aucgaaggccaggu

SEQ ID NO: 2976209 - RNA, 20 nt, Mycobacterium avium subsp. paratuberculosis
aucgaauacaccugccgcac

SEQ ID NO: 2976210 - RNA, 15 nt, Mycobacterium avium subsp. paratuberculosis
aucgaauccggcggc

SEQ ID NO: 2976211 - RNA, 17 nt, Mycobacterium avium subsp. paratuberculosis
aucgacaacgcgugaug

SEQ ID NO: 2976212 - RNA, 15 nt, Mycobacterium avium subsp. paratuberculosis
aucgacaccagcgug

SEQ ID NO: 2976213 - RNA, 13 nt, Mycobacterium avium subsp. paratuberculosis
aucgacaccgcac

SEQ ID NO: 2976214 - RNA, 18 nt, Mycobacterium avium subsp. paratuberculosis
aucgacaccgcacggccc

SEQ ID NO: 2976215 - RNA, 13 nt, Mycobacterium avium subsp. paratuberculosis
aucgacagcucca

SEQ ID NO: 2976216 - RNA, 12 nt, Mycobacterium avium subsp. paratuberculosis
aucgacagggcg

SEQ ID NO: 2976217 - RNA, 18 nt, Mycobacterium avium subsp. paratuberculosis
aucgacagguucuuggcg

SEQ ID NO: 2976218 - RNA, 23 nt, Mycobacterium avium subsp. paratuberculosis
aucgacagguucuuggcggccug

SEQ ID NO: 2976219 - RNA, 13 nt, Mycobacterium avium subsp. paratuberculosis
aucgacagucccg

SEQ ID NO: 2976220 - RNA, 15 nt, Mycobacterium avium subsp. paratuberculosis
aucgacaugcccggc

SEQ ID NO: 2976221 - RNA, 23 nt, Mycobacterium avium subsp. paratuberculosis
aucgacaugcccggcgacggcgc

SEQ ID NO: 2976222 - RNA, 20 nt, Mycobacterium avium subsp. paratuberculosis
aucgaccaacuccaccgccc

SEQ ID NO: 2976223 - RNA, 16 nt, Mycobacterium avium subsp. paratuberculosis
aucgacccccaccgcg

SEQ ID NO: 2976224 - RNA, 17 nt, Mycobacterium avium subsp. paratuberculosis
aucgacccccaccgcga

SEQ ID NO: 2976225 - RNA, 17 nt, Mycobacterium avium subsp. paratuberculosis
aucgaccgcccgcugaa

SEQ ID NO: 2976226 - RNA, 19 nt, Mycobacterium avium subsp. paratuberculosis
aucgaccggaugaugccgg

SEQ ID NO: 2976227 - RNA, 20 nt, Mycobacterium avium subsp. paratuberculosis
aucgaccggaugaugccggu

SEQ ID NO: 2976228 - RNA, 18 nt, Mycobacterium avium subsp. paratuberculosis
aucgaccggguuggcgcg

SEQ ID NO: 2976229 - RNA, 22 nt, Mycobacterium avium subsp. paratuberculosis
aucgaccggguuggcgcgcacc

SEQ ID NO: 2976230 - RNA, 14 nt, Mycobacterium avium subsp. paratuberculosis
aucgaccgguucgu

SEQ ID NO: 2976231 - RNA, 15 nt, Mycobacterium avium subsp. paratuberculosis
aucgacgacgccagc

SEQ ID NO: 2976232 - RNA, 16 nt, Mycobacterium avium subsp. paratuberculosis
aucgacgagccgggcc

SEQ ID NO: 2976233 - RNA, 13 nt, Mycobacterium avium subsp. paratuberculosis
aucgacgccgaca

SEQ ID NO: 2976234 - RNA, 21 nt, Mycobacterium avium subsp. paratuberculosis
aucgacgccgacaucgcggcg

SEQ ID NO: 2976235 - RNA, 17 nt, Mycobacterium avium subsp. paratuberculosis
aucgacgucaccaccgg

SEQ ID NO: 2976236 - RNA, 19 nt, Mycobacterium avium subsp. paratuberculosis
aucgacgucaccaccgggu

SEQ ID NO: 2976237 - RNA, 20 nt, Mycobacterium avium subsp. paratuberculosis
aucgacgucaccaccggguc

SEQ ID NO: 2976238 - RNA, 13 nt, Mycobacterium avium subsp. paratuberculosis
aucgacuccagca

SEQ ID NO: 2976239 - RNA, 14 nt, Mycobacterium avium subsp. paratuberculosis
aucgacuccagcac

SEQ ID NO: 2976240 - RNA, 15 nt, Mycobacterium avium subsp. paratuberculosis
aucgacuccagcacc

SEQ ID NO: 2976241 - RNA, 18 nt, Mycobacterium avium subsp. paratuberculosis
aucgacuccagcaccggc

SEQ ID NO: 2976242 - RNA, 20 nt, Mycobacterium avium subsp. paratuberculosis
aucgacuccagcaccggcgc

SEQ ID NO: 2976243 - RNA, 22 nt, Mycobacterium avium subsp. paratuberculosis
aucgacuccagcaccggcgcca

SEQ ID NO: 2976244 - RNA, 13 nt, Mycobacterium avium subsp. paratuberculosis
aucgacuccgggu

SEQ ID NO: 2976245 - RNA, 14 nt, Mycobacterium avium subsp. paratuberculosis
aucgacugcgacac

SEQ ID NO: 2976246 - RNA, 17 nt, Mycobacterium avium subsp. paratuberculosis
aucgacugcgacacccg

SEQ ID NO: 2976247 - RNA, 14 nt, Mycobacterium avium subsp. paratuberculosis
aucgacuugccgcc

SEQ ID NO: 2976248 - RNA, 16 nt, Mycobacterium avium subsp. paratuberculosis
aucgacuugccgccgc

SEQ ID NO: 2976249 - RNA, 21 nt, Mycobacterium avium subsp. paratuberculosis
aucgacuugccgccgcacacu

SEQ ID NO: 2976250 - RNA, 16 nt, Mycobacterium avium subsp. paratuberculosis
aucgagaccaugucgg

SEQ ID NO: 2976251 - RNA, 15 nt, Mycobacterium avium subsp. paratuberculosis
aucgagaucagggcg

SEQ ID NO: 2976252 - RNA, 11 nt, Mycobacterium avium subsp. paratuberculosis
aucgagcacca

SEQ ID NO: 2976253 - RNA, 17 nt, Mycobacterium avium subsp. paratuberculosis
aucgagcaccagcgucg

SEQ ID NO: 2976254 - RNA, 11 nt, Mycobacterium avium subsp. paratuberculosis
aucgagcaccc

SEQ ID NO: 2976255 - RNA, 18 nt, Mycobacterium avium subsp. paratuberculosis
aucgagcacccggcgggg

SEQ ID NO: 2976256 - RNA, 16 nt, Mycobacterium avium subsp. paratuberculosis
aucgagcaccgggcgu

SEQ ID NO: 2976257 - RNA, 23 nt, Mycobacterium avium subsp. paratuberculosis
aucgagcacgggaugaucggcgc

SEQ ID NO: 2976258 - RNA, 21 nt, Mycobacterium avium subsp. paratuberculosis
aucgagcccaccgcgcccagc

SEQ ID NO: 2976259 - RNA, 22 nt, Mycobacterium avium subsp. paratuberculosis
aucgagcccaccgcgcccagcc

SEQ ID NO: 2976260 - RNA, 14 nt, Mycobacterium avium subsp. paratuberculosis
aucgagccgagcac

SEQ ID NO: 2976261 - RNA, 18 nt, Mycobacterium avium subsp. paratuberculosis
aucgagccgccugcgcgc

SEQ ID NO: 2976262 - RNA, 19 nt, Mycobacterium avium subsp. paratuberculosis
aucgagccgccugcgcgcc

SEQ ID NO: 2976263 - RNA, 20 nt, Mycobacterium avium subsp. paratuberculosis
aucgagccgccugcgcgccg

SEQ ID NO: 2976264 - RNA, 22 nt, Mycobacterium avium subsp. paratuberculosis
aucgagccgccugcgcgccguc

SEQ ID NO: 2976265 - RNA, 15 nt, Mycobacterium avium subsp. paratuberculosis
aucgagccgcggccc

SEQ ID NO: 2976266 - RNA, 15 nt, Mycobacterium avium subsp. paratuberculosis
aucgagcgcaccgcc

SEQ ID NO: 2976267 - RNA, 16 nt, Mycobacterium avium subsp. paratuberculosis
aucgagcgcaccgccc

SEQ ID NO: 2976268 - RNA, 16 nt, Mycobacterium avium subsp. paratuberculosis
aucgagcgggcgggcu

SEQ ID NO: 2976269 - RNA, 20 nt, Mycobacterium avium subsp. paratuberculosis
aucgagcucgcagucgauca

SEQ ID NO: 2976270 - RNA, 23 nt, Mycobacterium avium subsp. paratuberculosis
aucgagcugcaacgcgucggcgc

SEQ ID NO: 2976271 - RNA, 19 nt, Mycobacterium avium subsp. paratuberculosis
aucgagcugggcccgcgca

SEQ ID NO: 2976272 - RNA, 18 nt, Mycobacterium avium subsp. paratuberculosis
aucgaggaccggcgccgg

SEQ ID NO: 2976273 - RNA, 23 nt, Mycobacterium avium subsp. paratuberculosis
aucgaggccagcgcgaucgccgg

SEQ ID NO: 2976274 - RNA, 14 nt, Mycobacterium avium subsp. paratuberculosis
aucgagggcgcgca

SEQ ID NO: 2976275 - RNA, 17 nt, Mycobacterium avium subsp. paratuberculosis
aucgagggcgcgcagcg

SEQ ID NO: 2976276 - RNA, 17 nt, Mycobacterium avium subsp. paratuberculosis
aucgagggggucaucag

SEQ ID NO: 2976277 - RNA, 18 nt, Mycobacterium avium subsp. paratuberculosis
aucgagguagcgugcgcc

SEQ ID NO: 2976278 - RNA, 22 nt, Mycobacterium avium subsp. paratuberculosis
aucgaggucgaaccacgcggcg

SEQ ID NO: 2976279 - RNA, 13 nt, Mycobacterium avium subsp. paratuberculosis
aucgaguuccgcg

SEQ ID NO: 2976280 - RNA, 20 nt, Mycobacterium avium subsp. paratuberculosis
aucgauaacgcgcgcgccgu

SEQ ID NO: 2976281 - RNA, 21 nt, Mycobacterium avium subsp. paratuberculosis
aucgauaacgcgcgcgccguc

SEQ ID NO: 2976282 - RNA, 16 nt, Mycobacterium avium subsp. paratuberculosis
aucgaucagccgcgac

SEQ ID NO: 2976283 - RNA, 17 nt, Mycobacterium avium subsp. paratuberculosis
aucgaucagccgcgaca

SEQ ID NO: 2976284 - RNA, 20 nt, Mycobacterium avium subsp. paratuberculosis
aucgaucccuuggcggcggc

SEQ ID NO: 2976285 - RNA, 19 nt, Mycobacterium avium subsp. paratuberculosis
aucgaugaauccgcgcagc

SEQ ID NO: 2976286 - RNA, 14 nt, Mycobacterium avium subsp. paratuberculosis
aucgaugcccagcg

SEQ ID NO: 2976287 - RNA, 16 nt, Mycobacterium avium subsp. paratuberculosis
aucgaugcccagcgcg

SEQ ID NO: 2976288 - RNA, 12 nt, Mycobacterium avium subsp. paratuberculosis
aucgaugccggc

SEQ ID NO: 2976289 - RNA, 14 nt, Mycobacterium avium subsp. paratuberculosis
aucgauggcggugu

SEQ ID NO: 2976290 - RNA, 13 nt, Mycobacterium avium subsp. paratuberculosis
aucgcaaaccgcg

SEQ ID NO: 2976291 - RNA, 15 nt, Mycobacterium avium subsp. paratuberculosis
aucgcaccggcgccu

SEQ ID NO: 2976292 - RNA, 13 nt, Mycobacterium avium subsp. paratuberculosis
aucgcagcgcgcg

SEQ ID NO: 2976293 - RNA, 18 nt, Mycobacterium avium subsp. paratuberculosis
aucgcagcgcgcggcgca

SEQ ID NO: 2976294 - RNA, 21 nt, Mycobacterium avium subsp. paratuberculosis
aucgcagcgcgcggcgcagau

SEQ ID NO: 2976295 - RNA, 19 nt, Mycobacterium avium subsp. paratuberculosis
aucgcaggauggccugcac

SEQ ID NO: 2976296 - RNA, 22 nt, Mycobacterium avium subsp. paratuberculosis
aucgcaucgggcgacaucucgg

SEQ ID NO: 2976297 - RNA, 13 nt, Mycobacterium avium subsp. paratuberculosis
aucgccaccacca

SEQ ID NO: 2976298 - RNA, 13 nt, Mycobacterium avium subsp. paratuberculosis
aucgccacccgca

SEQ ID NO: 2976299 - RNA, 15 nt, Mycobacterium avium subsp. paratuberculosis
aucgccaccgagauc

SEQ ID NO: 2976300 - RNA, 17 nt, Mycobacterium avium subsp. paratuberculosis
aucgccaccgucgucga

SEQ ID NO: 2976301 - RNA, 12 nt, Mycobacterium avium subsp. paratuberculosis
aucgccaccugg

SEQ ID NO: 2976302 - RNA, 14 nt, Mycobacterium avium subsp. paratuberculosis
aucgccacgccgac

SEQ ID NO: 2976303 - RNA, 19 nt, Mycobacterium avium subsp. paratuberculosis
aucgccacgccgaccaggu

SEQ ID NO: 2976304 - RNA, 16 nt, Mycobacterium avium subsp. paratuberculosis
aucgccacgccguggc

SEQ ID NO: 2976305 - RNA, 13 nt, Mycobacterium avium subsp. paratuberculosis
aucgccacggcgg

SEQ ID NO: 2976306 - RNA, 21 nt, Mycobacterium avium subsp. paratuberculosis
aucgccagcaacgacccggcc

SEQ ID NO: 2976307 - RNA, 22 nt, Mycobacterium avium subsp. paratuberculosis
aucgccagcaacgacccggcca

SEQ ID NO: 2976308 - RNA, 16 nt, Mycobacterium avium subsp. paratuberculosis
aucgccagcaccggcg

SEQ ID NO: 2976309 - RNA, 18 nt, Mycobacterium avium subsp. paratuberculosis
aucgccagcaccggcgcg

SEQ ID NO: 2976310 - RNA, 19 nt, Mycobacterium avium subsp. paratuberculosis
aucgccagcaccggcgcgc

SEQ ID NO: 2976311 - RNA, 14 nt, Mycobacterium avium subsp. paratuberculosis
aucgccagcacggu

SEQ ID NO: 2976312 - RNA, 14 nt, Mycobacterium avium subsp. paratuberculosis
aucgccagcccggc

SEQ ID NO: 2976313 - RNA, 12 nt, Mycobacterium avium subsp. paratuberculosis
aucgccagcgcc

SEQ ID NO: 2976314 - RNA, 13 nt, Mycobacterium avium subsp. paratuberculosis
aucgccagcgccc

SEQ ID NO: 2976315 - RNA, 16 nt, Mycobacterium avium subsp. paratuberculosis
aucgccagcgcgcaga

SEQ ID NO: 2976316 - RNA, 21 nt, Mycobacterium avium subsp. paratuberculosis
aucgccaggcguugcaccgcg

SEQ ID NO: 2976317 - RNA, 20 nt, Mycobacterium avium subsp. paratuberculosis
aucgccaguccggcgccgac

SEQ ID NO: 2976318 - RNA, 17 nt, Mycobacterium avium subsp. paratuberculosis
aucgccaucagcagcgc

SEQ ID NO: 2976319 - RNA, 18 nt, Mycobacterium avium subsp. paratuberculosis
aucgccaucagcagcgcc

SEQ ID NO: 2976320 - RNA, 20 nt, Mycobacterium avium subsp. paratuberculosis
aucgcccaacaacucgacgu

SEQ ID NO: 2976321 - RNA, 14 nt, Mycobacterium avium subsp. paratuberculosis
aucgcccacccgca

SEQ ID NO: 2976322 - RNA, 13 nt, Mycobacterium avium subsp. paratuberculosis
aucgcccaccugg

SEQ ID NO: 2976323 - RNA, 13 nt, Mycobacterium avium subsp. paratuberculosis
aucgcccagcacc

SEQ ID NO: 2976324 - RNA, 12 nt, Mycobacterium avium subsp. paratuberculosis
aucgcccagccg

SEQ ID NO: 2976325 - RNA, 15 nt, Mycobacterium avium subsp. paratuberculosis
aucgcccagccggcg

SEQ ID NO: 2976326 - RNA, 18 nt, Mycobacterium avium subsp. paratuberculosis
aucgcccagcgcagcgcc

SEQ ID NO: 2976327 - RNA, 14 nt, Mycobacterium avium subsp. paratuberculosis
aucgcccagucccg

SEQ ID NO: 2976328 - RNA, 23 nt, Mycobacterium avium subsp. paratuberculosis
aucgcccagucccguugcgggac

SEQ ID NO: 2976329 - RNA, 19 nt, Mycobacterium avium subsp. paratuberculosis
aucgcccagugcgcgccgu

SEQ ID NO: 2976330 - RNA, 22 nt, Mycobacterium avium subsp. paratuberculosis
aucgcccagugcgcgccguguu

SEQ ID NO: 2976331 - RNA, 16 nt, Mycobacterium avium subsp. paratuberculosis
aucgcccaucaccgca

SEQ ID NO: 2976332 - RNA, 17 nt, Mycobacterium avium subsp. paratuberculosis
aucgcccauuugccggu

SEQ ID NO: 2976333 - RNA, 20 nt, Mycobacterium avium subsp. paratuberculosis
aucgccccgcuggaacgccg

SEQ ID NO: 2976334 - RNA, 13 nt, Mycobacterium avium subsp. paratuberculosis
aucgccccggcga

SEQ ID NO: 2976335 - RNA, 16 nt, Mycobacterium avium subsp. paratuberculosis
aucgccccggcgacgu

SEQ ID NO: 2976336 - RNA, 22 nt, Mycobacterium avium subsp. paratuberculosis
aucgccccggcgacgucgccgg

SEQ ID NO: 2976337 - RNA, 14 nt, Mycobacterium avium subsp. paratuberculosis
aucgcccgccgcga

SEQ ID NO: 2976338 - RNA, 22 nt, Mycobacterium avium subsp. paratuberculosis
aucgcccgcgaaaucuucgccg

SEQ ID NO: 2976339 - RNA, 21 nt, Mycobacterium avium subsp. paratuberculosis
aucgcccggcgcccggccggc

SEQ ID NO: 2976340 - RNA, 15 nt, Mycobacterium avium subsp. paratuberculosis
aucgcccgguaggcc

SEQ ID NO: 2976341 - RNA, 19 nt, Mycobacterium avium subsp. paratuberculosis
aucgccgaaccgggcgcgc

SEQ ID NO: 2976342 - RNA, 18 nt, Mycobacterium avium subsp. paratuberculosis
aucgccgaaccgucccac

SEQ ID NO: 2976343 - RNA, 23 nt, Mycobacterium avium subsp. paratuberculosis
aucgccgacgacgaagacguacg

SEQ ID NO: 2976344 - RNA, 15 nt, Mycobacterium avium subsp. paratuberculosis
aucgccgacgccagc

SEQ ID NO: 2976345 - RNA, 16 nt, Mycobacterium avium subsp. paratuberculosis
aucgccgacgccagca

SEQ ID NO: 2976346 - RNA, 16 nt, Mycobacterium avium subsp. paratuberculosis
aucgccgacggugagc

SEQ ID NO: 2976347 - RNA, 18 nt, Mycobacterium avium subsp. paratuberculosis
aucgccgacggugagcac

SEQ ID NO: 2976348 - RNA, 22 nt, Mycobacterium avium subsp. paratuberculosis
aucgccgacggugagcaccgcc

SEQ ID NO: 2976349 - RNA, 13 nt, Mycobacterium avium subsp. paratuberculosis
aucgccgacgucg

SEQ ID NO: 2976350 - RNA, 14 nt, Mycobacterium avium subsp. paratuberculosis
aucgccgagcucga

SEQ ID NO: 2976351 - RNA, 18 nt, Mycobacterium avium subsp. paratuberculosis
aucgccgagggcgacgau

SEQ ID NO: 2976352 - RNA, 19 nt, Mycobacterium avium subsp. paratuberculosis
aucgccgagggcgacgaug

SEQ ID NO: 2976353 - RNA, 17 nt, Mycobacterium avium subsp. paratuberculosis
aucgccgagucgaucgc

SEQ ID NO: 2976354 - RNA, 19 nt, Mycobacterium avium subsp. paratuberculosis
aucgccgauccggcgccgc

SEQ ID NO: 2976355 - RNA, 22 nt, Mycobacterium avium subsp. paratuberculosis
aucgccgauccggcgccgcggg

SEQ ID NO: 2976356 - RNA, 20 nt, Mycobacterium avium subsp. paratuberculosis
aucgccgcaacuugcccgac

SEQ ID NO: 2976357 - RNA, 23 nt, Mycobacterium avium subsp. paratuberculosis
aucgccgcaacuugcccgacggc

SEQ ID NO: 2976358 - RNA, 13 nt, Mycobacterium avium subsp. paratuberculosis
aucgccgcccauc

SEQ ID NO: 2976359 - RNA, 17 nt, Mycobacterium avium subsp. paratuberculosis
aucgccgcccaucggca

SEQ ID NO: 2976360 - RNA, 19 nt, Mycobacterium avium subsp. paratuberculosis
aucgccgcccaucggcagc

SEQ ID NO: 2976361 - RNA, 22 nt, Mycobacterium avium subsp. paratuberculosis
aucgccgccgccaucuccuccg

SEQ ID NO: 2976362 - RNA, 15 nt, Mycobacterium avium subsp. paratuberculosis
aucgccgcgaacaau

SEQ ID NO: 2976363 - RNA, 12 nt, Mycobacterium avium subsp. paratuberculosis
aucgccgcgcac

SEQ ID NO: 2976364 - RNA, 21 nt, Mycobacterium avium subsp. paratuberculosis
aucgccgcgcauucaccagcu

SEQ ID NO: 2976365 - RNA, 12 nt, Mycobacterium avium subsp. paratuberculosis
aucgccgcgccc

SEQ ID NO: 2976366 - RNA, 15 nt, Mycobacterium avium subsp. paratuberculosis
aucgccgcgcccagc

SEQ ID NO: 2976367 - RNA, 18 nt, Mycobacterium avium subsp. paratuberculosis
aucgccgcgcccagcacg

SEQ ID NO: 2976368 - RNA, 13 nt, Mycobacterium avium subsp. paratuberculosis
aucgccgcggacc

SEQ ID NO: 2976369 - RNA, 15 nt, Mycobacterium avium subsp. paratuberculosis
aucgccgcggccgga

SEQ ID NO: 2976370 - RNA, 14 nt, Mycobacterium avium subsp. paratuberculosis
aucgccgcggcgau

SEQ ID NO: 2976371 - RNA, 13 nt, Mycobacterium avium subsp. paratuberculosis
aucgccgcggugg

SEQ ID NO: 2976372 - RNA, 14 nt, Mycobacterium avium subsp. paratuberculosis
aucgccgcgguggc

SEQ ID NO: 2976373 - RNA, 17 nt, Mycobacterium avium subsp. paratuberculosis
aucgccgcgguggcgcc

SEQ ID NO: 2976374 - RNA, 23 nt, Mycobacterium avium subsp. paratuberculosis
aucgccgcgguggcgccgcgggc

SEQ ID NO: 2976375 - RNA, 18 nt, Mycobacterium avium subsp. paratuberculosis
aucgccggaucgccgagg

SEQ ID NO: 2976376 - RNA, 18 nt, Mycobacterium avium subsp. paratuberculosis
aucgccggcgaccgugcc

SEQ ID NO: 2976377 - RNA, 21 nt, Mycobacterium avium subsp. paratuberculosis
aucgccggcgaccgugcccac

SEQ ID NO: 2976378 - RNA, 13 nt, Mycobacterium avium subsp. paratuberculosis
aucgccggcgccg

SEQ ID NO: 2976379 - RNA, 14 nt, Mycobacterium avium subsp. paratuberculosis
aucgccggcgccgg

SEQ ID NO: 2976380 - RNA, 14 nt, Mycobacterium avium subsp. paratuberculosis
aucgccggcgcgcu

SEQ ID NO: 2976381 - RNA, 15 nt, Mycobacterium avium subsp. paratuberculosis
aucgccggcgcgcug

SEQ ID NO: 2976382 - RNA, 20 nt, Mycobacterium avium subsp. paratuberculosis
aucgccgggauggugagccc

SEQ ID NO: 2976383 - RNA, 14 nt, Mycobacterium avium subsp. paratuberculosis
aucgccggggcgcu

SEQ ID NO: 2976384 - RNA, 17 nt, Mycobacterium avium subsp. paratuberculosis
aucgccgggucgcacgc

SEQ ID NO: 2976385 - RNA, 12 nt, Mycobacterium avium subsp. paratuberculosis
aucgccggucgu

SEQ ID NO: 2976386 - RNA, 21 nt, Mycobacterium avium subsp. paratuberculosis
aucgccggugcggccgcgauc

SEQ ID NO: 2976387 - RNA, 16 nt, Mycobacterium avium subsp. paratuberculosis
aucgccggugcgggcu

SEQ ID NO: 2976388 - RNA, 13 nt, Mycobacterium avium subsp. paratuberculosis
aucgccgucacgu

SEQ ID NO: 2976389 - RNA, 17 nt, Mycobacterium avium subsp. paratuberculosis
aucgccgucgccaccga

SEQ ID NO: 2976390 - RNA, 20 nt, Mycobacterium avium subsp. paratuberculosis
aucgccgucgccaccgaguc

SEQ ID NO: 2976391 - RNA, 15 nt, Mycobacterium avium subsp. paratuberculosis
aucgccgucgucagc

SEQ ID NO: 2976392 - RNA, 18 nt, Mycobacterium avium subsp. paratuberculosis
aucgccuacugcgccaau

SEQ ID NO: 2976393 - RNA, 15 nt, Mycobacterium avium subsp. paratuberculosis
aucgccuccgucagc

SEQ ID NO: 2976394 - RNA, 21 nt, Mycobacterium avium subsp. paratuberculosis
aucgccuccgucagcgccgcc

SEQ ID NO: 2976395 - RNA, 14 nt, Mycobacterium avium subsp. paratuberculosis
aucgccucgaccag

SEQ ID NO: 2976396 - RNA, 18 nt, Mycobacterium avium subsp. paratuberculosis
aucgccucgaccagcacc

SEQ ID NO: 2976397 - RNA, 19 nt, Mycobacterium avium subsp. paratuberculosis
aucgccucgaccagcaccg

SEQ ID NO: 2976398 - RNA, 21 nt, Mycobacterium avium subsp. paratuberculosis
aucgccucgaccagcaccgca

SEQ ID NO: 2976399 - RNA, 14 nt, Mycobacterium avium subsp. paratuberculosis
aucgccucggccac

SEQ ID NO: 2976400 - RNA, 15 nt, Mycobacterium avium subsp. paratuberculosis
aucgccucggccacc

SEQ ID NO: 2976401 - RNA, 17 nt, Mycobacterium avium subsp. paratuberculosis
aucgccucggccaccag

SEQ ID NO: 2976402 - RNA, 16 nt, Mycobacterium avium subsp. paratuberculosis
aucgccucggccgcgg

SEQ ID NO: 2976403 - RNA, 14 nt, Mycobacterium avium subsp. paratuberculosis
aucgccucggcggc

SEQ ID NO: 2976404 - RNA, 16 nt, Mycobacterium avium subsp. paratuberculosis
aucgccucggcggccg

SEQ ID NO: 2976405 - RNA, 20 nt, Mycobacterium avium subsp. paratuberculosis
aucgccucggcggccgcccg

SEQ ID NO: 2976406 - RNA, 16 nt, Mycobacterium avium subsp. paratuberculosis
aucgccucggucgcgu

SEQ ID NO: 2976407 - RNA, 18 nt, Mycobacterium avium subsp. paratuberculosis
aucgccucggucgcguga

SEQ ID NO: 2976408 - RNA, 15 nt, Mycobacterium avium subsp. paratuberculosis
aucgccucgucccuc

SEQ ID NO: 2976409 - RNA, 17 nt, Mycobacterium avium subsp. paratuberculosis
aucgcgaagaccagcgu

SEQ ID NO: 2976410 - RNA, 15 nt, Mycobacterium avium subsp. paratuberculosis
aucgcgaccaccggc

SEQ ID NO: 2976411 - RNA, 18 nt, Mycobacterium avium subsp. paratuberculosis
aucgcgaccaccggccga

SEQ ID NO: 2976412 - RNA, 22 nt, Mycobacterium avium subsp. paratuberculosis
aucgcgaccaccggccgaccgg

SEQ ID NO: 2976413 - RNA, 22 nt, Mycobacterium avium subsp. paratuberculosis
aucgcgacggccggggccagca

SEQ ID NO: 2976414 - RNA, 15 nt, Mycobacterium avium subsp. paratuberculosis
aucgcgagcagggcg

SEQ ID NO: 2976415 - RNA, 18 nt, Mycobacterium avium subsp. paratuberculosis
aucgcgagcagggcgggc

SEQ ID NO: 2976416 - RNA, 21 nt, Mycobacterium avium subsp. paratuberculosis
aucgcgagcagggcgggcagg

SEQ ID NO: 2976417 - RNA, 22 nt, Mycobacterium avium subsp. paratuberculosis
aucgcgagcagggcgggcaggc

SEQ ID NO: 2976418 - RNA, 17 nt, Mycobacterium avium subsp. paratuberculosis
aucgcgaucaccgcggc

SEQ ID NO: 2976419 - RNA, 20 nt, Mycobacterium avium subsp. paratuberculosis
aucgcgaucaccgcggccac

SEQ ID NO: 2976420 - RNA, 17 nt, Mycobacterium avium subsp. paratuberculosis
aucgcgauccgggcgcc

SEQ ID NO: 2976421 - RNA, 20 nt, Mycobacterium avium subsp. paratuberculosis
aucgcgauccgggcgccggc

SEQ ID NO: 2976422 - RNA, 16 nt, Mycobacterium avium subsp. paratuberculosis
aucgcgaucgacagcu

SEQ ID NO: 2976423 - RNA, 17 nt, Mycobacterium avium subsp. paratuberculosis
aucgcgaucgacagcuc

SEQ ID NO: 2976424 - RNA, 15 nt, Mycobacterium avium subsp. paratuberculosis
aucgcgaucgccgau

SEQ ID NO: 2976425 - RNA, 16 nt, Mycobacterium avium subsp. paratuberculosis
aucgcgaugucgacgg

SEQ ID NO: 2976426 - RNA, 13 nt, Mycobacterium avium subsp. paratuberculosis
aucgcgcagccgc

SEQ ID NO: 2976427 - RNA, 16 nt, Mycobacterium avium subsp. paratuberculosis
aucgcgcagccgcggu

SEQ ID NO: 2976428 - RNA, 14 nt, Mycobacterium avium subsp. paratuberculosis
aucgcgcaggugau

SEQ ID NO: 2976429 - RNA, 13 nt, Mycobacterium avium subsp. paratuberculosis
aucgcgcaucacc

SEQ ID NO: 2976430 - RNA, 13 nt, Mycobacterium avium subsp. paratuberculosis
aucgcgccgcaug

SEQ ID NO: 2976431 - RNA, 19 nt, Mycobacterium avium subsp. paratuberculosis
aucgcgccgcaugaugcgg

SEQ ID NO: 2976432 - RNA, 15 nt, Mycobacterium avium subsp. paratuberculosis
aucgcgccggccgcc

SEQ ID NO: 2976433 - RNA, 13 nt, Mycobacterium avium subsp. paratuberculosis
aucgcgcgcagga

SEQ ID NO: 2976434 - RNA, 17 nt, Mycobacterium avium subsp. paratuberculosis
aucgcgcgcggcgacgg

SEQ ID NO: 2976435 - RNA, 21 nt, Mycobacterium avium subsp. paratuberculosis
aucgcgcgcggcggccaccgc

SEQ ID NO: 2976436 - RNA, 19 nt, Mycobacterium avium subsp. paratuberculosis
aucgcgcugaccaggccgu

SEQ ID NO: 2976437 - RNA, 22 nt, Mycobacterium avium subsp. paratuberculosis
aucgcgcugaccaggccgucca

SEQ ID NO: 2976438 - RNA, 16 nt, Mycobacterium avium subsp. paratuberculosis
aucgcggccaccacga

SEQ ID NO: 2976439 - RNA, 14 nt, Mycobacterium avium subsp. paratuberculosis
aucgcggccagcgu

SEQ ID NO: 2976440 - RNA, 21 nt, Mycobacterium avium subsp. paratuberculosis
aucgcggccagcgugaacacc

SEQ ID NO: 2976441 - RNA, 17 nt, Mycobacterium avium subsp. paratuberculosis
aucgcggcccacccgca

SEQ ID NO: 2976442 - RNA, 18 nt, Mycobacterium avium subsp. paratuberculosis
aucgcggcccacccgcag

SEQ ID NO: 2976443 - RNA, 15 nt, Mycobacterium avium subsp. paratuberculosis
aucgcggcccgccgc

SEQ ID NO: 2976444 - RNA, 17 nt, Mycobacterium avium subsp. paratuberculosis
aucgcggcccgccgcuc

SEQ ID NO: 2976445 - RNA, 19 nt, Mycobacterium avium subsp. paratuberculosis
aucgcggcccgccgcucac

SEQ ID NO: 2976446 - RNA, 22 nt, Mycobacterium avium subsp. paratuberculosis
aucgcggcccgccgcucaccgc

SEQ ID NO: 2976447 - RNA, 17 nt, Mycobacterium avium subsp. paratuberculosis
aucgcggccgcccgguc

SEQ ID NO: 2976448 - RNA, 14 nt, Mycobacterium avium subsp. paratuberculosis
aucgcggccggcga

SEQ ID NO: 2976449 - RNA, 22 nt, Mycobacterium avium subsp. paratuberculosis
aucgcggccggcgagucgcgga

SEQ ID NO: 2976450 - RNA, 16 nt, Mycobacterium avium subsp. paratuberculosis
aucgcggcgacccgcu

SEQ ID NO: 2976451 - RNA, 13 nt, Mycobacterium avium subsp. paratuberculosis
aucgcggcgagca

SEQ ID NO: 2976452 - RNA, 18 nt, Mycobacterium avium subsp. paratuberculosis
aucgcggcgaucagcccg

SEQ ID NO: 2976453 - RNA, 18 nt, Mycobacterium avium subsp. paratuberculosis
aucgcgggaucggccggc

SEQ ID NO: 2976454 - RNA, 20 nt, Mycobacterium avium subsp. paratuberculosis
aucgcgggaucggccggcga

SEQ ID NO: 2976455 - RNA, 19 nt, Mycobacterium avium subsp. paratuberculosis
aucgcgggccaccggcgcc

SEQ ID NO: 2976456 - RNA, 20 nt, Mycobacterium avium subsp. paratuberculosis
aucgcgggccaccggcgcca

SEQ ID NO: 2976457 - RNA, 14 nt, Mycobacterium avium subsp. paratuberculosis
aucgcgggcgaccc

SEQ ID NO: 2976458 - RNA, 23 nt, Mycobacterium avium subsp. paratuberculosis
aucgcgguagcgcucggucaggc

SEQ ID NO: 2976459 - RNA, 17 nt, Mycobacterium avium subsp. paratuberculosis
aucgcggugaccgccgc

SEQ ID NO: 2976460 - RNA, 21 nt, Mycobacterium avium subsp. paratuberculosis
aucgcggugaccgccgccauc

SEQ ID NO: 2976461 - RNA, 16 nt, Mycobacterium avium subsp. paratuberculosis
aucgcggugacgcgcc

SEQ ID NO: 2976462 - RNA, 14 nt, Mycobacterium avium subsp. paratuberculosis
aucgcggugcugca

SEQ ID NO: 2976463 - RNA, 14 nt, Mycobacterium avium subsp. paratuberculosis
aucgcgguggcgcc

SEQ ID NO: 2976464 - RNA, 22 nt, Mycobacterium avium subsp. paratuberculosis
aucgcgguggcuuccagcccgu

SEQ ID NO: 2976465 - RNA, 17 nt, Mycobacterium avium subsp. paratuberculosis
aucgcguaguccagcac

SEQ ID NO: 2976466 - RNA, 18 nt, Mycobacterium avium subsp. paratuberculosis
aucgcguaguccagcacg

SEQ ID NO: 2976467 - RNA, 18 nt, Mycobacterium avium subsp. paratuberculosis
aucgcgucaaccaccggc

SEQ ID NO: 2976468 - RNA, 13 nt, Mycobacterium avium subsp. paratuberculosis
aucgcgucgacga

SEQ ID NO: 2976469 - RNA, 16 nt, Mycobacterium avium subsp. paratuberculosis
aucgcgucgacggcgc

SEQ ID NO: 2976470 - RNA, 20 nt, Mycobacterium avium subsp. paratuberculosis
aucgcgucgacggcgccgga

SEQ ID NO: 2976471 - RNA, 17 nt, Mycobacterium avium subsp. paratuberculosis
aucgcgucgaugccggc

SEQ ID NO: 2976472 - RNA, 19 nt, Mycobacterium avium subsp. paratuberculosis
aucgcgucgaugccggcga

SEQ ID NO: 2976473 - RNA, 21 nt, Mycobacterium avium subsp. paratuberculosis
aucgcgucgaugccggcgauc

SEQ ID NO: 2976474 - RNA, 21 nt, Mycobacterium avium subsp. paratuberculosis
aucgcgucggaauacagcagc

SEQ ID NO: 2976475 - RNA, 12 nt, Mycobacterium avium subsp. paratuberculosis
aucgcgugccga

SEQ ID NO: 2976476 - RNA, 13 nt, Mycobacterium avium subsp. paratuberculosis
aucgcgugccgac

SEQ ID NO: 2976477 - RNA, 15 nt, Mycobacterium avium subsp. paratuberculosis
aucgcgugccgacca

SEQ ID NO: 2976478 - RNA, 16 nt, Mycobacterium avium subsp. paratuberculosis
aucgcgugccgaccag

SEQ ID NO: 2976479 - RNA, 14 nt, Mycobacterium avium subsp. paratuberculosis
aucgcgugcgucac

SEQ ID NO: 2976480 - RNA, 16 nt, Mycobacterium avium subsp. paratuberculosis
aucgcgugcgucacgc

SEQ ID NO: 2976481 - RNA, 23 nt, Mycobacterium avium subsp. paratuberculosis
aucgcgugcgucacgcuggugac

SEQ ID NO: 2976482 - RNA, 16 nt, Mycobacterium avium subsp. paratuberculosis
aucgcuacaccccacc

SEQ ID NO: 2976483 - RNA, 17 nt, Mycobacterium avium subsp. paratuberculosis
aucgcuacaccccaccg

SEQ ID NO: 2976484 - RNA, 18 nt, Mycobacterium avium subsp. paratuberculosis
aucgcugccguccacccg

SEQ ID NO: 2976485 - RNA, 18 nt, Mycobacterium avium subsp. paratuberculosis
aucgcugcgagcccggcc

SEQ ID NO: 2976486 - RNA, 21 nt, Mycobacterium avium subsp. paratuberculosis
aucgcugcgagcccggccagu

SEQ ID NO: 2976487 - RNA, 15 nt, Mycobacterium avium subsp. paratuberculosis
aucgcugcgcccgcc

SEQ ID NO: 2976488 - RNA, 17 nt, Mycobacterium avium subsp. paratuberculosis
aucgcuggggugcccac

SEQ ID NO: 2976489 - RNA, 21 nt, Mycobacterium avium subsp. paratuberculosis
aucgcuggggugcccaccagc

SEQ ID NO: 2976490 - RNA, 23 nt, Mycobacterium avium subsp. paratuberculosis
aucgcuggggugcccaccagcau

SEQ ID NO: 2976491 - RNA, 18 nt, Mycobacterium avium subsp. paratuberculosis
aucgcugguggccgacgu

SEQ ID NO: 2976492 - RNA, 19 nt, Mycobacterium avium subsp. paratuberculosis
aucgcuucggccagcgcgu

SEQ ID NO: 2976493 - RNA, 15 nt, Mycobacterium avium subsp. paratuberculosis
aucgcuugcgccgca

SEQ ID NO: 2976494 - RNA, 23 nt, Mycobacterium avium subsp. paratuberculosis
aucgcuugcgccgcagcggugau

SEQ ID NO: 2976495 - RNA, 17 nt, Mycobacterium avium subsp. paratuberculosis
aucgcuuuccggucagg

SEQ ID NO: 2976496 - RNA, 16 nt, Mycobacterium avium subsp. paratuberculosis
aucggacaucggcagc

SEQ ID NO: 2976497 - RNA, 13 nt, Mycobacterium avium subsp. paratuberculosis
aucggacccagcc

SEQ ID NO: 2976498 - RNA, 15 nt, Mycobacterium avium subsp. paratuberculosis
aucggacccagcccg

SEQ ID NO: 2976499 - RNA, 17 nt, Mycobacterium avium subsp. paratuberculosis
aucggagguugauggcc

SEQ ID NO: 2976500 - RNA, 20 nt, Mycobacterium avium subsp. paratuberculosis
aucggagguugauggccaga

SEQ ID NO: 2976501 - RNA, 20 nt, Mycobacterium avium subsp. paratuberculosis
aucggauuucccgcuuggcg

SEQ ID NO: 2976502 - RNA, 15 nt, Mycobacterium avium subsp. paratuberculosis
aucggcagacccagc

SEQ ID NO: 2976503 - RNA, 19 nt, Mycobacterium avium subsp. paratuberculosis
aucggcagacccagcagcg

SEQ ID NO: 2976504 - RNA, 20 nt, Mycobacterium avium subsp. paratuberculosis
aucggcagacccagcagcgg

SEQ ID NO: 2976505 - RNA, 21 nt, Mycobacterium avium subsp. paratuberculosis
aucggcagaccggugagcacc

SEQ ID NO: 2976506 - RNA, 22 nt, Mycobacterium avium subsp. paratuberculosis
aucggcagcagggugccgccgc

SEQ ID NO: 2976507 - RNA, 18 nt, Mycobacterium avium subsp. paratuberculosis
aucggcagcccggaggcg

SEQ ID NO: 2976508 - RNA, 19 nt, Mycobacterium avium subsp. paratuberculosis
aucggcagcccggaggcga

SEQ ID NO: 2976509 - RNA, 14 nt, Mycobacterium avium subsp. paratuberculosis
aucggcagcgcgcc

SEQ ID NO: 2976510 - RNA, 22 nt, Mycobacterium avium subsp. paratuberculosis
aucggcaggauccggucgauca

SEQ ID NO: 2976511 - RNA, 17 nt, Mycobacterium avium subsp. paratuberculosis
aucggcaguccgcgccg

SEQ ID NO: 2976512 - RNA, 20 nt, Mycobacterium avium subsp. paratuberculosis
aucggcaguccgcgccgguc

SEQ ID NO: 2976513 - RNA, 18 nt, Mycobacterium avium subsp. paratuberculosis
aucggcaucgcgcgcggc

SEQ ID NO: 2976514 - RNA, 19 nt, Mycobacterium avium subsp. paratuberculosis
aucggcaucgcgcgcggcg

SEQ ID NO: 2976515 - RNA, 18 nt, Mycobacterium avium subsp. paratuberculosis
aucggcaugacgcccagc

SEQ ID NO: 2976516 - RNA, 20 nt, Mycobacterium avium subsp. paratuberculosis
aucggccagccacgccgaca

SEQ ID NO: 2976517 - RNA, 14 nt, Mycobacterium avium subsp. paratuberculosis
aucggccagcgcgg

SEQ ID NO: 2976518 - RNA, 20 nt, Mycobacterium avium subsp. paratuberculosis
aucggccagcgcggccgggc

SEQ ID NO: 2976519 - RNA, 18 nt, Mycobacterium avium subsp. paratuberculosis
aucggccaggaaccaccg

SEQ ID NO: 2976520 - RNA, 19 nt, Mycobacterium avium subsp. paratuberculosis
aucggccaggaaccaccgg

SEQ ID NO: 2976521 - RNA, 13 nt, Mycobacterium avium subsp. paratuberculosis
aucggccaggcgc

SEQ ID NO: 2976522 - RNA, 11 nt, Mycobacterium avium subsp. paratuberculosis
aucggccaggu

SEQ ID NO: 2976523 - RNA, 22 nt, Mycobacterium avium subsp. paratuberculosis
aucggccagguugucgucgggc

SEQ ID NO: 2976524 - RNA, 18 nt, Mycobacterium avium subsp. paratuberculosis
aucggccccggccgagcc

SEQ ID NO: 2976525 - RNA, 20 nt, Mycobacterium avium subsp. paratuberculosis
aucggcccgacggguucgcg

SEQ ID NO: 2976526 - RNA, 15 nt, Mycobacterium avium subsp. paratuberculosis
aucggccgcggggcc

SEQ ID NO: 2976527 - RNA, 21 nt, Mycobacterium avium subsp. paratuberculosis
aucggccgcugcgggcgggcc

SEQ ID NO: 2976528 - RNA, 22 nt, Mycobacterium avium subsp. paratuberculosis
aucggccgggagauacggucgc

SEQ ID NO: 2976529 - RNA, 21 nt, Mycobacterium avium subsp. paratuberculosis
aucggccgggucgcaggcagc

SEQ ID NO: 2976530 - RNA, 18 nt, Mycobacterium avium subsp. paratuberculosis
aucggcgacggcgacggc

SEQ ID NO: 2976531 - RNA, 15 nt, Mycobacterium avium subsp. paratuberculosis
aucggcgagccggga

SEQ ID NO: 2976532 - RNA, 14 nt, Mycobacterium avium subsp. paratuberculosis
aucggcgccacgac

SEQ ID NO: 2976533 - RNA, 19 nt, Mycobacterium avium subsp. paratuberculosis
aucggcgccacgaccagcg

SEQ ID NO: 2976534 - RNA, 13 nt, Mycobacterium avium subsp. paratuberculosis
aucggcgcccacc

SEQ ID NO: 2976535 - RNA, 17 nt, Mycobacterium avium subsp. paratuberculosis
aucggcgcccaccgcgg

SEQ ID NO: 2976536 - RNA, 18 nt, Mycobacterium avium subsp. paratuberculosis
aucggcgcccaccgcggc

SEQ ID NO: 2976537 - RNA, 22 nt, Mycobacterium avium subsp. paratuberculosis
aucggcgcccaccgcggcgcgc

SEQ ID NO: 2976538 - RNA, 17 nt, Mycobacterium avium subsp. paratuberculosis
aucggcgcccucgccga

SEQ ID NO: 2976539 - RNA, 18 nt, Mycobacterium avium subsp. paratuberculosis
aucggcgcccucgccgac

SEQ ID NO: 2976540 - RNA, 18 nt, Mycobacterium avium subsp. paratuberculosis
aucggcgccggcuccgca

SEQ ID NO: 2976541 - RNA, 22 nt, Mycobacterium avium subsp. paratuberculosis
aucggcgcgaagucgagcaggu

SEQ ID NO: 2976542 - RNA, 13 nt, Mycobacterium avium subsp. paratuberculosis
aucggcgcggcga

SEQ ID NO: 2976543 - RNA, 16 nt, Mycobacterium avium subsp. paratuberculosis
aucggcggccaccagc

SEQ ID NO: 2976544 - RNA, 13 nt, Mycobacterium avium subsp. paratuberculosis
aucggcggcgacg

SEQ ID NO: 2976545 - RNA, 13 nt, Mycobacterium avium subsp. paratuberculosis
aucggcggcgggg

SEQ ID NO: 2976546 - RNA, 15 nt, Mycobacterium avium subsp. paratuberculosis
aucggcggcggggug

SEQ ID NO: 2976547 - RNA, 17 nt, Mycobacterium avium subsp. paratuberculosis
aucggcgggacccgcga

SEQ ID NO: 2976548 - RNA, 19 nt, Mycobacterium avium subsp. paratuberculosis
aucggcgggacccgcgacc

SEQ ID NO: 2976549 - RNA, 13 nt, Mycobacterium avium subsp. paratuberculosis
aucggcggggcgc

SEQ ID NO: 2976550 - RNA, 18 nt, Mycobacterium avium subsp. paratuberculosis
aucggcggggcgcguucg

SEQ ID NO: 2976551 - RNA, 23 nt, Mycobacterium avium subsp. paratuberculosis
aucggcgggugcgggcgcugcaa

SEQ ID NO: 2976552 - RNA, 12 nt, Mycobacterium avium subsp. paratuberculosis
aucggcgguggu

SEQ ID NO: 2976553 - RNA, 22 nt, Mycobacterium avium subsp. paratuberculosis
aucggcgucacugcccagccau

SEQ ID NO: 2976554 - RNA, 18 nt, Mycobacterium avium subsp. paratuberculosis
aucggcguucaucgugcc

SEQ ID NO: 2976555 - RNA, 18 nt, Mycobacterium avium subsp. paratuberculosis
aucggcguuggcggcguc

SEQ ID NO: 2976556 - RNA, 21 nt, Mycobacterium avium subsp. paratuberculosis
aucggcucgccucaacgguug

SEQ ID NO: 2976557 - RNA, 14 nt, Mycobacterium avium subsp. paratuberculosis
aucggcucggcgcc

SEQ ID NO: 2976558 - RNA, 16 nt, Mycobacterium avium subsp. paratuberculosis
aucggcucggucgaca

SEQ ID NO: 2976559 - RNA, 22 nt, Mycobacterium avium subsp. paratuberculosis
aucggcucguggaacgacgcca

SEQ ID NO: 2976560 - RNA, 18 nt, Mycobacterium avium subsp. paratuberculosis
aucggcuggucggcggcc

SEQ ID NO: 2976561 - RNA, 21 nt, Mycobacterium avium subsp. paratuberculosis
aucggcuuggugggcgccggc

SEQ ID NO: 2976562 - RNA, 22 nt, Mycobacterium avium subsp. paratuberculosis
aucggcuuggugggcgccggcg

SEQ ID NO: 2976563 - RNA, 16 nt, Mycobacterium avium subsp. paratuberculosis
aucgggaacagcccgc

SEQ ID NO: 2976564 - RNA, 18 nt, Mycobacterium avium subsp. paratuberculosis
aucgggaccgcgggcgca

SEQ ID NO: 2976565 - RNA, 16 nt, Mycobacterium avium subsp. paratuberculosis
aucgggaccgggaagc

SEQ ID NO: 2976566 - RNA, 15 nt, Mycobacterium avium subsp. paratuberculosis
aucgggacgccugcc

SEQ ID NO: 2976567 - RNA, 22 nt, Mycobacterium avium subsp. paratuberculosis
aucgggaugucgugggcgugcc

SEQ ID NO: 2976568 - RNA, 17 nt, Mycobacterium avium subsp. paratuberculosis
aucgggauuggcggcca

SEQ ID NO: 2976569 - RNA, 13 nt, Mycobacterium avium subsp. paratuberculosis
aucgggcccagca

SEQ ID NO: 2976570 - RNA, 22 nt, Mycobacterium avium subsp. paratuberculosis
aucgggcgcagguccacccgcc

SEQ ID NO: 2976571 - RNA, 14 nt, Mycobacterium avium subsp. paratuberculosis
aucgggcgcucggc

SEQ ID NO: 2976572 - RNA, 18 nt, Mycobacterium avium subsp. paratuberculosis
aucgggcgcucggccagc

SEQ ID NO: 2976573 - RNA, 18 nt, Mycobacterium avium subsp. paratuberculosis
aucgggcgguccaccgac

SEQ ID NO: 2976574 - RNA, 20 nt, Mycobacterium avium subsp. paratuberculosis
aucgggcgguccaccgacgc

SEQ ID NO: 2976575 - RNA, 21 nt, Mycobacterium avium subsp. paratuberculosis
aucgggcguugcgccgcgagc

SEQ ID NO: 2976576 - RNA, 16 nt, Mycobacterium avium subsp. paratuberculosis
aucgggcuggguccga

SEQ ID NO: 2976577 - RNA, 20 nt, Mycobacterium avium subsp. paratuberculosis
aucggggaauccuggccgau

SEQ ID NO: 2976578 - RNA, 18 nt, Mycobacterium avium subsp. paratuberculosis
aucggggauguaugcggu

SEQ ID NO: 2976579 - RNA, 13 nt, Mycobacterium avium subsp. paratuberculosis
aucggggccagga

SEQ ID NO: 2976580 - RNA, 18 nt, Mycobacterium avium subsp. paratuberculosis
aucggggcgcagcccggc

SEQ ID NO: 2976581 - RNA, 14 nt, Mycobacterium avium subsp. paratuberculosis
aucggggugaccgu

SEQ ID NO: 2976582 - RNA, 18 nt, Mycobacterium avium subsp. paratuberculosis
aucggggugccgccgggg

SEQ ID NO: 2976583 - RNA, 21 nt, Mycobacterium avium subsp. paratuberculosis
aucgggguuccaccguucggg

SEQ ID NO: 2976584 - RNA, 18 nt, Mycobacterium avium subsp. paratuberculosis
aucggguaacccuccggc

SEQ ID NO: 2976585 - RNA, 12 nt, Mycobacterium avium subsp. paratuberculosis
aucgggucaccg

SEQ ID NO: 2976586 - RNA, 16 nt, Mycobacterium avium subsp. paratuberculosis
aucgggucaccggccg

SEQ ID NO: 2976587 - RNA, 18 nt, Mycobacterium avium subsp. paratuberculosis
aucggguccagcgccgag

SEQ ID NO: 2976588 - RNA, 14 nt, Mycobacterium avium subsp. paratuberculosis
aucgggucccagau

SEQ ID NO: 2976589 - RNA, 19 nt, Mycobacterium avium subsp. paratuberculosis
aucgggugagacggccagc

SEQ ID NO: 2976590 - RNA, 20 nt, Mycobacterium avium subsp. paratuberculosis
aucgguaaauugaacgccgc

SEQ ID NO: 2976591 - RNA, 21 nt, Mycobacterium avium subsp. paratuberculosis
aucgguaaauugaacgccgcc

SEQ ID NO: 2976592 - RNA, 23 nt, Mycobacterium avium subsp. paratuberculosis
aucgguccggcgaauccgaccgg

SEQ ID NO: 2976593 - RNA, 14 nt, Mycobacterium avium subsp. paratuberculosis
aucggugaacccgc

SEQ ID NO: 2976594 - RNA, 14 nt, Mycobacterium avium subsp. paratuberculosis
aucggugaagccga

SEQ ID NO: 2976595 - RNA, 17 nt, Mycobacterium avium subsp. paratuberculosis
aucggugaagcggcgcg

SEQ ID NO: 2976596 - RNA, 18 nt, Mycobacterium avium subsp. paratuberculosis
aucggugaccgucgccga

SEQ ID NO: 2976597 - RNA, 14 nt, Mycobacterium avium subsp. paratuberculosis
aucggugaucacga

SEQ ID NO: 2976598 - RNA, 18 nt, Mycobacterium avium subsp. paratuberculosis
aucggugcaggccgcgac

SEQ ID NO: 2976599 - RNA, 14 nt, Mycobacterium avium subsp. paratuberculosis
aucggugccgacgg

SEQ ID NO: 2976600 - RNA, 18 nt, Mycobacterium avium subsp. paratuberculosis
aucggugccgacggugcg

SEQ ID NO: 2976601 - RNA, 23 nt, Mycobacterium avium subsp. paratuberculosis
aucggugccucuucgucggccgg

SEQ ID NO: 2976602 - RNA, 19 nt, Mycobacterium avium subsp. paratuberculosis
aucgguggacgcggucgcc

SEQ ID NO: 2976603 - RNA, 17 nt, Mycobacterium avium subsp. paratuberculosis
aucgguguccagccgca

SEQ ID NO: 2976604 - RNA, 18 nt, Mycobacterium avium subsp. paratuberculosis
aucgguguccagccgcac

SEQ ID NO: 2976605 - RNA, 14 nt, Mycobacterium avium subsp. paratuberculosis
aucgguucggccag

SEQ ID NO: 2976606 - RNA, 22 nt, Mycobacterium avium subsp. paratuberculosis
aucgucaaagccguucgcgccg

SEQ ID NO: 2976607 - RNA, 19 nt, Mycobacterium avium subsp. paratuberculosis
aucgucaggucuucggucg

SEQ ID NO: 2976608 - RNA, 21 nt, Mycobacterium avium subsp. paratuberculosis
aucgucaggucuucggucgcg

SEQ ID NO: 2976609 - RNA, 18 nt, Mycobacterium avium subsp. paratuberculosis
aucguccacaccgggaag

SEQ ID NO: 2976610 - RNA, 22 nt, Mycobacterium avium subsp. paratuberculosis
aucguccacaccgggaaggugg

SEQ ID NO: 2976611 - RNA, 15 nt, Mycobacterium avium subsp. paratuberculosis
aucgucccgucgacc

SEQ ID NO: 2976612 - RNA, 17 nt, Mycobacterium avium subsp. paratuberculosis
aucguccgaggccccgc

SEQ ID NO: 2976613 - RNA, 14 nt, Mycobacterium avium subsp. paratuberculosis
aucguccggcgcca

SEQ ID NO: 2976614 - RNA, 19 nt, Mycobacterium avium subsp. paratuberculosis
aucgucgaacucgggcccg

SEQ ID NO: 2976615 - RNA, 12 nt, Mycobacterium avium subsp. paratuberculosis
aucgucgaccac

SEQ ID NO: 2976616 - RNA, 15 nt, Mycobacterium avium subsp. paratuberculosis
aucgucgaccaccac

SEQ ID NO: 2976617 - RNA, 17 nt, Mycobacterium avium subsp. paratuberculosis
aucgucgacccggccgc

SEQ ID NO: 2976618 - RNA, 17 nt, Mycobacterium avium subsp. paratuberculosis
aucgucgaccugcucgu

SEQ ID NO: 2976619 - RNA, 17 nt, Mycobacterium avium subsp. paratuberculosis
aucgucgccgccaacgc

SEQ ID NO: 2976620 - RNA, 11 nt, Mycobacterium avium subsp. paratuberculosis
aucgucgccgg

SEQ ID NO: 2976621 - RNA, 12 nt, Mycobacterium avium subsp. paratuberculosis
aucgucgccggg

SEQ ID NO: 2976622 - RNA, 14 nt, Mycobacterium avium subsp. paratuberculosis
aucgucgcggcggu

SEQ ID NO: 2976623 - RNA, 19 nt, Mycobacterium avium subsp. paratuberculosis
aucgucgcggcggucacgc

SEQ ID NO: 2976624 - RNA, 16 nt, Mycobacterium avium subsp. paratuberculosis
aucgucggcagcgacg

SEQ ID NO: 2976625 - RNA, 16 nt, Mycobacterium avium subsp. paratuberculosis
aucgucggcgauggag

SEQ ID NO: 2976626 - RNA, 17 nt, Mycobacterium avium subsp. paratuberculosis
aucgucggcgccggcgc

SEQ ID NO: 2976627 - RNA, 18 nt, Mycobacterium avium subsp. paratuberculosis
aucgucgggcaccuccag

SEQ ID NO: 2976628 - RNA, 16 nt, Mycobacterium avium subsp. paratuberculosis
aucgucgggccggauc

SEQ ID NO: 2976629 - RNA, 17 nt, Mycobacterium avium subsp. paratuberculosis
aucgucucggccagccg

SEQ ID NO: 2976630 - RNA, 21 nt, Mycobacterium avium subsp. paratuberculosis
aucgugacgccguccgacgug

SEQ ID NO: 2976631 - RNA, 15 nt, Mycobacterium avium subsp. paratuberculosis
aucgugaucgcccac

SEQ ID NO: 2976632 - RNA, 14 nt, Mycobacterium avium subsp. paratuberculosis
aucgugaugcgggu

SEQ ID NO: 2976633 - RNA, 21 nt, Mycobacterium avium subsp. paratuberculosis
aucgugcgcccauccggcgcc

SEQ ID NO: 2976634 - RNA, 22 nt, Mycobacterium avium subsp. paratuberculosis
aucgugcgcccauccggcgccg

SEQ ID NO: 2976635 - RNA, 15 nt, Mycobacterium avium subsp. paratuberculosis
aucgugcuugagcaa

SEQ ID NO: 2976636 - RNA, 19 nt, Mycobacterium avium subsp. paratuberculosis
aucguggacaggaggacaa

SEQ ID NO: 2976637 - RNA, 16 nt, Mycobacterium avium subsp. paratuberculosis
aucguggcgacgacgc

SEQ ID NO: 2976638 - RNA, 19 nt, Mycobacterium avium subsp. paratuberculosis
aucguggcgacgacgccga

SEQ ID NO: 2976639 - RNA, 17 nt, Mycobacterium avium subsp. paratuberculosis
aucgugggcgccgucgc

SEQ ID NO: 2976640 - RNA, 19 nt, Mycobacterium avium subsp. paratuberculosis
aucguguccgcgccggcgc

SEQ ID NO: 2976641 - RNA, 20 nt, Mycobacterium avium subsp. paratuberculosis
aucguguccgcgccggcgca

SEQ ID NO: 2976642 - RNA, 15 nt, Mycobacterium avium subsp. paratuberculosis
aucgugucuggcccc

SEQ ID NO: 2976643 - RNA, 18 nt, Mycobacterium avium subsp. paratuberculosis
aucgugucuggccccguc

SEQ ID NO: 2976644 - RNA, 23 nt, Mycobacterium avium subsp. paratuberculosis
aucgugugggcgcccgcggcgcg

SEQ ID NO: 2976645 - RNA, 14 nt, Mycobacterium avium subsp. paratuberculosis
aucguugagcacca

SEQ ID NO: 2976646 - RNA, 15 nt, Mycobacterium avium subsp. paratuberculosis
aucguugccggcggc

SEQ ID NO: 2976647 - RNA, 17 nt, Mycobacterium avium subsp. paratuberculosis
aucuacgucgucgccgg

SEQ ID NO: 2976648 - RNA, 14 nt, Mycobacterium avium subsp. paratuberculosis
aucucaccggcggc

SEQ ID NO: 2976649 - RNA, 21 nt, Mycobacterium avium subsp. paratuberculosis
aucuccaccgagugcggcgcg

SEQ ID NO: 2976650 - RNA, 11 nt, Mycobacterium avium subsp. paratuberculosis
aucuccagcag

SEQ ID NO: 2976651 - RNA, 16 nt, Mycobacterium avium subsp. paratuberculosis
aucuccagcagcuuca

SEQ ID NO: 2976652 - RNA, 20 nt, Mycobacterium avium subsp. paratuberculosis
aucuccagcagcuucaugcc

SEQ ID NO: 2976653 - RNA, 15 nt, Mycobacterium avium subsp. paratuberculosis
aucuccagccggcga

SEQ ID NO: 2976654 - RNA, 13 nt, Mycobacterium avium subsp. paratuberculosis
aucuccagcggcc

SEQ ID NO: 2976655 - RNA, 19 nt, Mycobacterium avium subsp. paratuberculosis
aucuccagcggccgggcga

SEQ ID NO: 2976656 - RNA, 14 nt, Mycobacterium avium subsp. paratuberculosis
aucuccaucccgcu

SEQ ID NO: 2976657 - RNA, 20 nt, Mycobacterium avium subsp. paratuberculosis
aucucccaacgcagcgcauc

SEQ ID NO: 2976658 - RNA, 13 nt, Mycobacterium avium subsp. paratuberculosis
aucuccgggaacg

SEQ ID NO: 2976659 - RNA, 18 nt, Mycobacterium avium subsp. paratuberculosis
aucuccgggaacgcggcg

SEQ ID NO: 2976660 - RNA, 19 nt, Mycobacterium avium subsp. paratuberculosis
aucuccgggaacgcggcga

SEQ ID NO: 2976661 - RNA, 16 nt, Mycobacterium avium subsp. paratuberculosis
aucuccucggacccga

SEQ ID NO: 2976662 - RNA, 13 nt, Mycobacterium avium subsp. paratuberculosis
aucuccucggcgu

SEQ ID NO: 2976663 - RNA, 22 nt, Mycobacterium avium subsp. paratuberculosis
aucucgaccucgucggcggcga

SEQ ID NO: 2976664 - RNA, 14 nt, Mycobacterium avium subsp. paratuberculosis
aucucgaccuucuu

SEQ ID NO: 2976665 - RNA, 16 nt, Mycobacterium avium subsp. paratuberculosis
aucucgauggccacgc

SEQ ID NO: 2976666 - RNA, 15 nt, Mycobacterium avium subsp. paratuberculosis
aucucgccgagcaca

SEQ ID NO: 2976667 - RNA, 13 nt, Mycobacterium avium subsp. paratuberculosis
aucucgccgcggu

SEQ ID NO: 2976668 - RNA, 13 nt, Mycobacterium avium subsp. paratuberculosis
aucucgcgccgcg

SEQ ID NO: 2976669 - RNA, 14 nt, Mycobacterium avium subsp. paratuberculosis
aucucggccaccgu

SEQ ID NO: 2976670 - RNA, 17 nt, Mycobacterium avium subsp. paratuberculosis
aucucggccaccgucag

SEQ ID NO: 2976671 - RNA, 22 nt, Mycobacterium avium subsp. paratuberculosis
aucucggccagcgggcggcccc

SEQ ID NO: 2976672 - RNA, 15 nt, Mycobacterium avium subsp. paratuberculosis
aucucggcgcaggug

SEQ ID NO: 2976673 - RNA, 11 nt, Mycobacterium avium subsp. paratuberculosis
aucucggcggc

SEQ ID NO: 2976674 - RNA, 21 nt, Mycobacterium avium subsp. paratuberculosis
aucucggcggucugucgcgcg

SEQ ID NO: 2976675 - RNA, 22 nt, Mycobacterium avium subsp. paratuberculosis
aucucggcggucugucgcgcga

SEQ ID NO: 2976676 - RNA, 18 nt, Mycobacterium avium subsp. paratuberculosis
aucucgggcaccccugcc

SEQ ID NO: 2976677 - RNA, 15 nt, Mycobacterium avium subsp. paratuberculosis
aucucggucgccagc

SEQ ID NO: 2976678 - RNA, 16 nt, Mycobacterium avium subsp. paratuberculosis
aucucggucgccagca

SEQ ID NO: 2976679 - RNA, 18 nt, Mycobacterium avium subsp. paratuberculosis
aucucggucgccagcacc

SEQ ID NO: 2976680 - RNA, 16 nt, Mycobacterium avium subsp. paratuberculosis
aucucggugagccgcu

SEQ ID NO: 2976681 - RNA, 13 nt, Mycobacterium avium subsp. paratuberculosis
aucucggugccgg

SEQ ID NO: 2976682 - RNA, 16 nt, Mycobacterium avium subsp. paratuberculosis
aucucggugccgucga

SEQ ID NO: 2976683 - RNA, 16 nt, Mycobacterium avium subsp. paratuberculosis
aucucggugguggcca

SEQ ID NO: 2976684 - RNA, 17 nt, Mycobacterium avium subsp. paratuberculosis
aucucggugguggccau

SEQ ID NO: 2976685 - RNA, 23 nt, Mycobacterium avium subsp. paratuberculosis
aucucguagcccaccucgagcac

SEQ ID NO: 2976686 - RNA, 16 nt, Mycobacterium avium subsp. paratuberculosis
aucucguagccgugca

SEQ ID NO: 2976687 - RNA, 17 nt, Mycobacterium avium subsp. paratuberculosis
aucucguagguggccag

SEQ ID NO: 2976688 - RNA, 21 nt, Mycobacterium avium subsp. paratuberculosis
aucucguagguggccagcacg

SEQ ID NO: 2976689 - RNA, 17 nt, Mycobacterium avium subsp. paratuberculosis
aucucgucgaugacgau

SEQ ID NO: 2976690 - RNA, 22 nt, Mycobacterium avium subsp. paratuberculosis
aucucgucgcacaaccgggcca

SEQ ID NO: 2976691 - RNA, 18 nt, Mycobacterium avium subsp. paratuberculosis
aucucgucgcggcugccg

SEQ ID NO: 2976692 - RNA, 13 nt, Mycobacterium avium subsp. paratuberculosis
aucucgucggcgg

SEQ ID NO: 2976693 - RNA, 16 nt, Mycobacterium avium subsp. paratuberculosis
aucucgucggcggcgg

SEQ ID NO: 2976694 - RNA, 18 nt, Mycobacterium avium subsp. paratuberculosis
aucucgucggcggcggcc

SEQ ID NO: 2976695 - RNA, 14 nt, Mycobacterium avium subsp. paratuberculosis
aucucgugccgcac

SEQ ID NO: 2976696 - RNA, 18 nt, Mycobacterium avium subsp. paratuberculosis
aucucgugccgcacccga

SEQ ID NO: 2976697 - RNA, 19 nt, Mycobacterium avium subsp. paratuberculosis
aucucgugguaccggcgcc

SEQ ID NO: 2976698 - RNA, 23 nt, Mycobacterium avium subsp. paratuberculosis
aucucgugguaccggcgccaggc

SEQ ID NO: 2976699 - RNA, 14 nt, Mycobacterium avium subsp. paratuberculosis
aucucguugcggcg

SEQ ID NO: 2976700 - RNA, 22 nt, Mycobacterium avium subsp. paratuberculosis
aucucugauuugaaauucaccu

SEQ ID NO: 2976701 - RNA, 21 nt, Mycobacterium avium subsp. paratuberculosis
aucucuuucgauuucgccugc

SEQ ID NO: 2976702 - RNA, 20 nt, Mycobacterium avium subsp. paratuberculosis
aucugcacagcuucggcgcc

SEQ ID NO: 2976703 - RNA, 12 nt, Mycobacterium avium subsp. paratuberculosis
aucugcaccagc

SEQ ID NO: 2976704 - RNA, 14 nt, Mycobacterium avium subsp. paratuberculosis
aucugcaccagcgc

SEQ ID NO: 2976705 - RNA, 23 nt, Mycobacterium avium subsp. paratuberculosis
aucugcaccagcgcggacaccag

SEQ ID NO: 2976706 - RNA, 22 nt, Mycobacterium avium subsp. paratuberculosis
aucugcaggccgaggcugucgg

SEQ ID NO: 2976707 - RNA, 15 nt, Mycobacterium avium subsp. paratuberculosis
aucugccggcagauc

SEQ ID NO: 2976708 - RNA, 12 nt, Mycobacterium avium subsp. paratuberculosis
aucugccgggcg

SEQ ID NO: 2976709 - RNA, 14 nt, Mycobacterium avium subsp. paratuberculosis
aucugccgggcggc

SEQ ID NO: 2976710 - RNA, 22 nt, Mycobacterium avium subsp. paratuberculosis
aucugccggucgaugucggcga

SEQ ID NO: 2976711 - RNA, 17 nt, Mycobacterium avium subsp. paratuberculosis
aucugccggugccgccg

SEQ ID NO: 2976712 - RNA, 19 nt, Mycobacterium avium subsp. paratuberculosis
aucugccggugccgccggc

SEQ ID NO: 2976713 - RNA, 23 nt, Mycobacterium avium subsp. paratuberculosis
aucugcgccgccuccgggcugcc

SEQ ID NO: 2976714 - RNA, 13 nt, Mycobacterium avium subsp. paratuberculosis
aucugcggcacca

SEQ ID NO: 2976715 - RNA, 21 nt, Mycobacterium avium subsp. paratuberculosis
aucugcgucauggagaucacc

SEQ ID NO: 2976716 - RNA, 18 nt, Mycobacterium avium subsp. paratuberculosis
aucugcuccucggucagc

SEQ ID NO: 2976717 - RNA, 18 nt, Mycobacterium avium subsp. paratuberculosis
aucugcucgaugcggccc

SEQ ID NO: 2976718 - RNA, 19 nt, Mycobacterium avium subsp. paratuberculosis
aucugcucgaugcggcccu

SEQ ID NO: 2976719 - RNA, 10 nt, Mycobacterium avium subsp. paratuberculosis
aucugcucgg

SEQ ID NO: 2976720 - RNA, 20 nt, Mycobacterium avium subsp. paratuberculosis
aucugcuuggucaccugacg

SEQ ID NO: 2976721 - RNA, 19 nt, Mycobacterium avium subsp. paratuberculosis
aucuggcggauggcgcccu

SEQ ID NO: 2976722 - RNA, 13 nt, Mycobacterium avium subsp. paratuberculosis
aucugggcggcgg

SEQ ID NO: 2976723 - RNA, 13 nt, Mycobacterium avium subsp. paratuberculosis
aucuggucggcca

SEQ ID NO: 2976724 - RNA, 15 nt, Mycobacterium avium subsp. paratuberculosis
aucuggucggccagc

SEQ ID NO: 2976725 - RNA, 20 nt, Mycobacterium avium subsp. paratuberculosis
aucuggucggccagcgcgcg

SEQ ID NO: 2976726 - RNA, 16 nt, Mycobacterium avium subsp. paratuberculosis
aucugguucaccgcca

SEQ ID NO: 2976727 - RNA, 23 nt, Mycobacterium avium subsp. paratuberculosis
aucugguucaccgccaccagcag

SEQ ID NO: 2976728 - RNA, 22 nt, Mycobacterium avium subsp. paratuberculosis
aucugguuccacagcugcaggc

SEQ ID NO: 2976729 - RNA, 20 nt, Mycobacterium avium subsp. paratuberculosis
aucugucgcgcucagugcac

SEQ ID NO: 2976730 - RNA, 23 nt, Mycobacterium avium subsp. paratuberculosis
aucuucacgaagugcccggcgcc

SEQ ID NO: 2976731 - RNA, 18 nt, Mycobacterium avium subsp. paratuberculosis
aucuucacgugcgcggcg

SEQ ID NO: 2976732 - RNA, 16 nt, Mycobacterium avium subsp. paratuberculosis
aucuucaguucggccg

SEQ ID NO: 2976733 - RNA, 19 nt, Mycobacterium avium subsp. paratuberculosis
aucuucaguucggccggcu

SEQ ID NO: 2976734 - RNA, 23 nt, Mycobacterium avium subsp. paratuberculosis
aucuucaugugguugggccaggc

SEQ ID NO: 2976735 - RNA, 20 nt, Mycobacterium avium subsp. paratuberculosis
aucuuccauauuggcuagcg

SEQ ID NO: 2976736 - RNA, 16 nt, Mycobacterium avium subsp. paratuberculosis
aucuuccaucacgccc

SEQ ID NO: 2976737 - RNA, 16 nt, Mycobacterium avium subsp. paratuberculosis
aucuuccuucuugaac

SEQ ID NO: 2976738 - RNA, 22 nt, Mycobacterium avium subsp. paratuberculosis
aucuuccuucuugaacagcgcc

SEQ ID NO: 2976739 - RNA, 15 nt, Mycobacterium avium subsp. paratuberculosis
aucuucuccgcggcc

SEQ ID NO: 2976740 - RNA, 19 nt, Mycobacterium avium subsp. paratuberculosis
aucuucucggugucgucga

SEQ ID NO: 2976741 - RNA, 21 nt, Mycobacterium avium subsp. paratuberculosis
aucuucucggugucgucgacc

SEQ ID NO: 2976742 - RNA, 11 nt, Mycobacterium avium subsp. paratuberculosis
aucuugaccgu

SEQ ID NO: 2976743 - RNA, 15 nt, Mycobacterium avium subsp. paratuberculosis
aucuugacggcgacg

SEQ ID NO: 2976744 - RNA, 16 nt, Mycobacterium avium subsp. paratuberculosis
aucuugacggcgacgg

SEQ ID NO: 2976745 - RNA, 13 nt, Mycobacterium avium subsp. paratuberculosis
aucuugaucucgc

SEQ ID NO: 2976746 - RNA, 17 nt, Mycobacterium avium subsp. paratuberculosis
aucuugcccagccacgc

SEQ ID NO: 2976747 - RNA, 17 nt, Mycobacterium avium subsp. paratuberculosis
aucuugccgucggccgc

SEQ ID NO: 2976748 - RNA, 21 nt, Mycobacterium avium subsp. paratuberculosis
aucuugccgucggccgccgac

SEQ ID NO: 2976749 - RNA, 23 nt, Mycobacterium avium subsp. paratuberculosis
aucuugcgccagaucccgcagcu

SEQ ID NO: 2976750 - RNA, 23 nt, Mycobacterium avium subsp. paratuberculosis
aucuugcuggucuucggugucgc

SEQ ID NO: 2976751 - RNA, 14 nt, Mycobacterium avium subsp. paratuberculosis
aucuuggccagcag

SEQ ID NO: 2976752 - RNA, 15 nt, Mycobacterium avium subsp. paratuberculosis
aucuuggccagcagc

SEQ ID NO: 2976753 - RNA, 13 nt, Mycobacterium avium subsp. paratuberculosis
aucuuggccucca

SEQ ID NO: 2976754 - RNA, 17 nt, Mycobacterium avium subsp. paratuberculosis
aucuugguguccagcgg

SEQ ID NO: 2976755 - RNA, 19 nt, Mycobacterium avium subsp. paratuberculosis
aucuugucggccuugacca

SEQ ID NO: 2976756 - RNA, 14 nt, Mycobacterium avium subsp. paratuberculosis
augaaaccggccag

SEQ ID NO: 2976757 - RNA, 19 nt, Mycobacterium avium subsp. paratuberculosis
augaaaccggccagcagca

SEQ ID NO: 2976758 - RNA, 20 nt, Mycobacterium avium subsp. paratuberculosis
augaaauucaggccacgcag

SEQ ID NO: 2976759 - RNA, 17 nt, Mycobacterium avium subsp. paratuberculosis
augaacacggucgccgg

SEQ ID NO: 2976760 - RNA, 18 nt, Mycobacterium avium subsp. paratuberculosis
augaaccacugcggcaga

SEQ ID NO: 2976761 - RNA, 19 nt, Mycobacterium avium subsp. paratuberculosis
augaaccaggccgcgcugg

SEQ ID NO: 2976762 - RNA, 17 nt, Mycobacterium avium subsp. paratuberculosis
augaaccgcugcugcuc

SEQ ID NO: 2976763 - RNA, 22 nt, Mycobacterium avium subsp. paratuberculosis
augaaccgcugcugcucggccg

SEQ ID NO: 2976764 - RNA, 23 nt, Mycobacterium avium subsp. paratuberculosis
augaacgccucgagcgcccgggc

SEQ ID NO: 2976765 - RNA, 16 nt, Mycobacterium avium subsp. paratuberculosis
augaacgcggccaggg

SEQ ID NO: 2976766 - RNA, 20 nt, Mycobacterium avium subsp. paratuberculosis
augaacuccgacuccagcag

SEQ ID NO: 2976767 - RNA, 22 nt, Mycobacterium avium subsp. paratuberculosis
augaacuccgacuccagcagcg

SEQ ID NO: 2976768 - RNA, 11 nt, Mycobacterium avium subsp. paratuberculosis
augaacuccuc

SEQ ID NO: 2976769 - RNA, 21 nt, Mycobacterium avium subsp. paratuberculosis
augaacucgcgggcgagcagc

SEQ ID NO: 2976770 - RNA, 19 nt, Mycobacterium avium subsp. paratuberculosis
augaacucguccaccgaca

SEQ ID NO: 2976771 - RNA, 14 nt, Mycobacterium avium subsp. paratuberculosis
augaacugccgcgg

SEQ ID NO: 2976772 - RNA, 16 nt, Mycobacterium avium subsp. paratuberculosis
augaacugccgcggca

SEQ ID NO: 2976773 - RNA, 19 nt, Mycobacterium avium subsp. paratuberculosis
augaagaugaucucgccga

SEQ ID NO: 2976774 - RNA, 18 nt, Mycobacterium avium subsp. paratuberculosis
augaagccgugcccgcgg

SEQ ID NO: 2976775 - RNA, 22 nt, Mycobacterium avium subsp. paratuberculosis
augaagucggugagcaccguug

SEQ ID NO: 2976776 - RNA, 17 nt, Mycobacterium avium subsp. paratuberculosis
augaauccgcgcagcag

SEQ ID NO: 2976777 - RNA, 19 nt, Mycobacterium avium subsp. paratuberculosis
augaauccgcgcagcagcg

SEQ ID NO: 2976778 - RNA, 15 nt, Mycobacterium avium subsp. paratuberculosis
augaauucggcgauc

SEQ ID NO: 2976779 - RNA, 14 nt, Mycobacterium avium subsp. paratuberculosis
augacaaccaucga

SEQ ID NO: 2976780 - RNA, 13 nt, Mycobacterium avium subsp. paratuberculosis
augaccagcgcga

SEQ ID NO: 2976781 - RNA, 18 nt, Mycobacterium avium subsp. paratuberculosis
augaccaggguggucagc

SEQ ID NO: 2976782 - RNA, 14 nt, Mycobacterium avium subsp. paratuberculosis
augaccaggucgcc

SEQ ID NO: 2976783 - RNA, 16 nt, Mycobacterium avium subsp. paratuberculosis
augaccaggucgccgg

SEQ ID NO: 2976784 - RNA, 16 nt, Mycobacterium avium subsp. paratuberculosis
augaccaugucgacgc

SEQ ID NO: 2976785 - RNA, 13 nt, Mycobacterium avium subsp. paratuberculosis
augacccagccca

SEQ ID NO: 2976786 - RNA, 19 nt, Mycobacterium avium subsp. paratuberculosis
augaccgacauggccagca

SEQ ID NO: 2976787 - RNA, 15 nt, Mycobacterium avium subsp. paratuberculosis
augaccgcggcgggc

SEQ ID NO: 2976788 - RNA, 23 nt, Mycobacterium avium subsp. paratuberculosis
augaccggcccggcggccggccg

SEQ ID NO: 2976789 - RNA, 19 nt, Mycobacterium avium subsp. paratuberculosis
augaccuccuugcccagcg

SEQ ID NO: 2976790 - RNA, 15 nt, Mycobacterium avium subsp. paratuberculosis
augaccucgcgcagc

SEQ ID NO: 2976791 - RNA, 13 nt, Mycobacterium avium subsp. paratuberculosis
augacgaacaugc

SEQ ID NO: 2976792 - RNA, 17 nt, Mycobacterium avium subsp. paratuberculosis
augacgagcagcgugcu

SEQ ID NO: 2976793 - RNA, 18 nt, Mycobacterium avium subsp. paratuberculosis
augacgcccagcugcaug

SEQ ID NO: 2976794 - RNA, 14 nt, Mycobacterium avium subsp. paratuberculosis
augacgccgcgguu

SEQ ID NO: 2976795 - RNA, 17 nt, Mycobacterium avium subsp. paratuberculosis
augacgccgcgguuggu

SEQ ID NO: 2976796 - RNA, 18 nt, Mycobacterium avium subsp. paratuberculosis
augacgccggacagcugg

SEQ ID NO: 2976797 - RNA, 19 nt, Mycobacterium avium subsp. paratuberculosis
augacgccggacagcuggc

SEQ ID NO: 2976798 - RNA, 22 nt, Mycobacterium avium subsp. paratuberculosis
augacgcgcuuguacaggucga

SEQ ID NO: 2976799 - RNA, 13 nt, Mycobacterium avium subsp. paratuberculosis
augacggcggcgc

SEQ ID NO: 2976800 - RNA, 14 nt, Mycobacterium avium subsp. paratuberculosis
augacggcggcgcc

SEQ ID NO: 2976801 - RNA, 19 nt, Mycobacterium avium subsp. paratuberculosis
augacggucugcaccggga

SEQ ID NO: 2976802 - RNA, 18 nt, Mycobacterium avium subsp. paratuberculosis
augacguagucgcugagc

SEQ ID NO: 2976803 - RNA, 19 nt, Mycobacterium avium subsp. paratuberculosis
augacguccuugacccggc

SEQ ID NO: 2976804 - RNA, 22 nt, Mycobacterium avium subsp. paratuberculosis
augacgucgcccacccggggcc

SEQ ID NO: 2976805 - RNA, 13 nt, Mycobacterium avium subsp. paratuberculosis
augacgucgcgcu

SEQ ID NO: 2976806 - RNA, 14 nt, Mycobacterium avium subsp. paratuberculosis
augacgucgcgcug

SEQ ID NO: 2976807 - RNA, 17 nt, Mycobacterium avium subsp. paratuberculosis
augacgugcaccaccgc

SEQ ID NO: 2976808 - RNA, 18 nt, Mycobacterium avium subsp. paratuberculosis
augacgugcaccaccgcg

SEQ ID NO: 2976809 - RNA, 22 nt, Mycobacterium avium subsp. paratuberculosis
augacguggcaacgugccacag

SEQ ID NO: 2976810 - RNA, 24 nt, Mycobacterium avium subsp. paratuberculosis
augacgugguugcguucgccggcg

SEQ ID NO: 2976811 - RNA, 14 nt, Mycobacterium avium subsp. paratuberculosis
augacguugcgcgc

SEQ ID NO: 2976812 - RNA, 16 nt, Mycobacterium avium subsp. paratuberculosis
augacguuggugaucg

SEQ ID NO: 2976813 - RNA, 23 nt, Mycobacterium avium subsp. paratuberculosis
augagccgcagccgggugggcgg

SEQ ID NO: 2976814 - RNA, 23 nt, Mycobacterium avium subsp. paratuberculosis
augagccuaugaggcgacccccg

SEQ ID NO: 2976815 - RNA, 18 nt, Mycobacterium avium subsp. paratuberculosis
augagcgagaugaucagc

SEQ ID NO: 2976816 - RNA, 19 nt, Mycobacterium avium subsp. paratuberculosis
augagcgaggacgucgagc

SEQ ID NO: 2976817 - RNA, 16 nt, Mycobacterium avium subsp. paratuberculosis
augagcugggcggcgc

SEQ ID NO: 2976818 - RNA, 21 nt, Mycobacterium avium subsp. paratuberculosis
augaguugcggguccaucgcc

SEQ ID NO: 2976819 - RNA, 20 nt, Mycobacterium avium subsp. paratuberculosis
augaucaccgccagcgcgcc

SEQ ID NO: 2976820 - RNA, 15 nt, Mycobacterium avium subsp. paratuberculosis
augaucagccgcccg

SEQ ID NO: 2976821 - RNA, 14 nt, Mycobacterium avium subsp. paratuberculosis
augaucagcgcgcc

SEQ ID NO: 2976822 - RNA, 16 nt, Mycobacterium avium subsp. paratuberculosis
augaucaggccccacc

SEQ ID NO: 2976823 - RNA, 15 nt, Mycobacterium avium subsp. paratuberculosis
augauccgcggcgcc

SEQ ID NO: 2976824 - RNA, 13 nt, Mycobacterium avium subsp. paratuberculosis
augauccuggccu

SEQ ID NO: 2976825 - RNA, 14 nt, Mycobacterium avium subsp. paratuberculosis
augaucgcccgcuc

SEQ ID NO: 2976826 - RNA, 17 nt, Mycobacterium avium subsp. paratuberculosis
augaucgucucggccgc

SEQ ID NO: 2976827 - RNA, 22 nt, Mycobacterium avium subsp. paratuberculosis
augaucucgccgagcgggucgu

SEQ ID NO: 2976828 - RNA, 14 nt, Mycobacterium avium subsp. paratuberculosis
augaucuuggugaa

SEQ ID NO: 2976829 - RNA, 18 nt, Mycobacterium avium subsp. paratuberculosis
augaugaaaccggccagc

SEQ ID NO: 2976830 - RNA, 19 nt, Mycobacterium avium subsp. paratuberculosis
augaugaaaccggccagca

SEQ ID NO: 2976831 - RNA, 15 nt, Mycobacterium avium subsp. paratuberculosis
augaugggcgaucga

SEQ ID NO: 2976832 - RNA, 16 nt, Mycobacterium avium subsp. paratuberculosis
augauggucaccgucg

SEQ ID NO: 2976833 - RNA, 22 nt, Mycobacterium avium subsp. paratuberculosis
augauguagcggcggucggcgc

SEQ ID NO: 2976834 - RNA, 13 nt, Mycobacterium avium subsp. paratuberculosis
augaugucggccg

SEQ ID NO: 2976835 - RNA, 16 nt, Mycobacterium avium subsp. paratuberculosis
augauguucaccccgu

SEQ ID NO: 2976836 - RNA, 20 nt, Mycobacterium avium subsp. paratuberculosis
augauguucuccggcccggc

SEQ ID NO: 2976837 - RNA, 16 nt, Mycobacterium avium subsp. paratuberculosis
augauuccgccgggcg

SEQ ID NO: 2976838 - RNA, 17 nt, Mycobacterium avium subsp. paratuberculosis
augcacaaccgcugcug

SEQ ID NO: 2976839 - RNA, 18 nt, Mycobacterium avium subsp. paratuberculosis
augcaccggugcaccgcg

SEQ ID NO: 2976840 - RNA, 14 nt, Mycobacterium avium subsp. paratuberculosis
augcacggcgcugg

SEQ ID NO: 2976841 - RNA, 16 nt, Mycobacterium avium subsp. paratuberculosis
augcacggcgcuggcg

SEQ ID NO: 2976842 - RNA, 14 nt, Mycobacterium avium subsp. paratuberculosis
augcagaacagccg

SEQ ID NO: 2976843 - RNA, 15 nt, Mycobacterium avium subsp. paratuberculosis
augcagaccagcccg

SEQ ID NO: 2976844 - RNA, 13 nt, Mycobacterium avium subsp. paratuberculosis
augcagccgccgc

SEQ ID NO: 2976845 - RNA, 23 nt, Mycobacterium avium subsp. paratuberculosis
augcagccgccgcggagcggcgg

SEQ ID NO: 2976846 - RNA, 15 nt, Mycobacterium avium subsp. paratuberculosis
augcagcgccucggu

SEQ ID NO: 2976847 - RNA, 13 nt, Mycobacterium avium subsp. paratuberculosis
augcagcggcucc

SEQ ID NO: 2976848 - RNA, 22 nt, Mycobacterium avium subsp. paratuberculosis
augcaggcccugcccgaagcug

SEQ ID NO: 2976849 - RNA, 13 nt, Mycobacterium avium subsp. paratuberculosis
augcagugguuga

SEQ ID NO: 2976850 - RNA, 22 nt, Mycobacterium avium subsp. paratuberculosis
augcauucguccauccgcuugc

SEQ ID NO: 2976851 - RNA, 17 nt, Mycobacterium avium subsp. paratuberculosis
augccagacgaacgcgg

SEQ ID NO: 2976852 - RNA, 21 nt, Mycobacterium avium subsp. paratuberculosis
augccagacgaacgcggccgc

SEQ ID NO: 2976853 - RNA, 22 nt, Mycobacterium avium subsp. paratuberculosis
augccagacgaacgcggccgcc

SEQ ID NO: 2976854 - RNA, 19 nt, Mycobacterium avium subsp. paratuberculosis
augccagcagguccgccgg

SEQ ID NO: 2976855 - RNA, 18 nt, Mycobacterium avium subsp. paratuberculosis
augccagcgcaccgggcc

SEQ ID NO: 2976856 - RNA, 20 nt, Mycobacterium avium subsp. paratuberculosis
augcccaagccggccaggcc

SEQ ID NO: 2976857 - RNA, 14 nt, Mycobacterium avium subsp. paratuberculosis
augcccacccgcuc

SEQ ID NO: 2976858 - RNA, 16 nt, Mycobacterium avium subsp. paratuberculosis
augcccacgccgucga

SEQ ID NO: 2976859 - RNA, 14 nt, Mycobacterium avium subsp. paratuberculosis
augcccagcagcgg

SEQ ID NO: 2976860 - RNA, 13 nt, Mycobacterium avium subsp. paratuberculosis
augcccagcagga

SEQ ID NO: 2976861 - RNA, 23 nt, Mycobacterium avium subsp. paratuberculosis
augcccagcaguccggcggucag

SEQ ID NO: 2976862 - RNA, 20 nt, Mycobacterium avium subsp. paratuberculosis
augcccagcggguaguucuu

SEQ ID NO: 2976863 - RNA, 17 nt, Mycobacterium avium subsp. paratuberculosis
augcccaggaugaucuu

SEQ ID NO: 2976864 - RNA, 16 nt, Mycobacterium avium subsp. paratuberculosis
augcccaggcccacca

SEQ ID NO: 2976865 - RNA, 19 nt, Mycobacterium avium subsp. paratuberculosis
augcccaggcccaccagcu

SEQ ID NO: 2976866 - RNA, 17 nt, Mycobacterium avium subsp. paratuberculosis
augcccaggccggcgag

SEQ ID NO: 2976867 - RNA, 17 nt, Mycobacterium avium subsp. paratuberculosis
augcccgccacggccag

SEQ ID NO: 2976868 - RNA, 19 nt, Mycobacterium avium subsp. paratuberculosis
augcccgccacggccagca

SEQ ID NO: 2976869 - RNA, 22 nt, Mycobacterium avium subsp. paratuberculosis
augcccgcccacgggucgccga

SEQ ID NO: 2976870 - RNA, 22 nt, Mycobacterium avium subsp. paratuberculosis
augcccgccccgcccggcggcc

SEQ ID NO: 2976871 - RNA, 13 nt, Mycobacterium avium subsp. paratuberculosis
augcccgccgcgu

SEQ ID NO: 2976872 - RNA, 16 nt, Mycobacterium avium subsp. paratuberculosis
augcccgccggcgucu

SEQ ID NO: 2976873 - RNA, 22 nt, Mycobacterium avium subsp. paratuberculosis
augcccgcgaacgccucguugg

SEQ ID NO: 2976874 - RNA, 13 nt, Mycobacterium avium subsp. paratuberculosis
augcccgcgccga

SEQ ID NO: 2976875 - RNA, 16 nt, Mycobacterium avium subsp. paratuberculosis
augcccgcgccgacca

SEQ ID NO: 2976876 - RNA, 13 nt, Mycobacterium avium subsp. paratuberculosis
augcccgggccgu

SEQ ID NO: 2976877 - RNA, 17 nt, Mycobacterium avium subsp. paratuberculosis
augcccgggccgucauc

SEQ ID NO: 2976878 - RNA, 22 nt, Mycobacterium avium subsp. paratuberculosis
augcccgggccgucaucgccga

SEQ ID NO: 2976879 - RNA, 17 nt, Mycobacterium avium subsp. paratuberculosis
augcccggggugcuggc

SEQ ID NO: 2976880 - RNA, 15 nt, Mycobacterium avium subsp. paratuberculosis
augcccgugaucgcc

SEQ ID NO: 2976881 - RNA, 17 nt, Mycobacterium avium subsp. paratuberculosis
augcccucgccggucag

SEQ ID NO: 2976882 - RNA, 14 nt, Mycobacterium avium subsp. paratuberculosis
augcccuuggccag

SEQ ID NO: 2976883 - RNA, 16 nt, Mycobacterium avium subsp. paratuberculosis
augcccuuggccagca

SEQ ID NO: 2976884 - RNA, 23 nt, Mycobacterium avium subsp. paratuberculosis
augcccuuggcggccacgacggc

SEQ ID NO: 2976885 - RNA, 22 nt, Mycobacterium avium subsp. paratuberculosis
augccgaacaacagggccgcgc

SEQ ID NO: 2976886 - RNA, 22 nt, Mycobacterium avium subsp. paratuberculosis
augccgaaccgcuccccgagca

SEQ ID NO: 2976887 - RNA, 19 nt, Mycobacterium avium subsp. paratuberculosis
augccgaaccgcugcggau

SEQ ID NO: 2976888 - RNA, 20 nt, Mycobacterium avium subsp. paratuberculosis
augccgaacgucaccaacau

SEQ ID NO: 2976889 - RNA, 18 nt, Mycobacterium avium subsp. paratuberculosis
augccgaacuccgccgaa

SEQ ID NO: 2976890 - RNA, 13 nt, Mycobacterium avium subsp. paratuberculosis
augccgaccgaca

SEQ ID NO: 2976891 - RNA, 21 nt, Mycobacterium avium subsp. paratuberculosis
augccgaccgacagccgcacc

SEQ ID NO: 2976892 - RNA, 14 nt, Mycobacterium avium subsp. paratuberculosis
augccgacgucggu

SEQ ID NO: 2976893 - RNA, 19 nt, Mycobacterium avium subsp. paratuberculosis
augccgagcagcucggcgg

SEQ ID NO: 2976894 - RNA, 22 nt, Mycobacterium avium subsp. paratuberculosis
augccgagcagcucggcggccu

SEQ ID NO: 2976895 - RNA, 19 nt, Mycobacterium avium subsp. paratuberculosis
augccgagcgccgcguuca

SEQ ID NO: 2976896 - RNA, 18 nt, Mycobacterium avium subsp. paratuberculosis
augccgaggcacagcagc

SEQ ID NO: 2976897 - RNA, 19 nt, Mycobacterium avium subsp. paratuberculosis
augccgagguagucggccu

SEQ ID NO: 2976898 - RNA, 21 nt, Mycobacterium avium subsp. paratuberculosis
augccgagguagucggccucc

SEQ ID NO: 2976899 - RNA, 15 nt, Mycobacterium avium subsp. paratuberculosis
augccgaucaggcug

SEQ ID NO: 2976900 - RNA, 15 nt, Mycobacterium avium subsp. paratuberculosis
augccgaucggggcg

SEQ ID NO: 2976901 - RNA, 21 nt, Mycobacterium avium subsp. paratuberculosis
augccgaucggggcgcagccc

SEQ ID NO: 2976902 - RNA, 12 nt, Mycobacterium avium subsp. paratuberculosis
augccgcagccg

SEQ ID NO: 2976903 - RNA, 14 nt, Mycobacterium avium subsp. paratuberculosis
augccgcagccgau

SEQ ID NO: 2976904 - RNA, 15 nt, Mycobacterium avium subsp. paratuberculosis
augccgcagccgauc

SEQ ID NO: 2976905 - RNA, 16 nt, Mycobacterium avium subsp. paratuberculosis
augccgcagccgaucu

SEQ ID NO: 2976906 - RNA, 17 nt, Mycobacterium avium subsp. paratuberculosis
augccgcccaccaccgg

SEQ ID NO: 2976907 - RNA, 18 nt, Mycobacterium avium subsp. paratuberculosis
augccgcccaccaccggc

SEQ ID NO: 2976908 - RNA, 19 nt, Mycobacterium avium subsp. paratuberculosis
augccgcccaccaccggcu

SEQ ID NO: 2976909 - RNA, 14 nt, Mycobacterium avium subsp. paratuberculosis
augccgcccagcag

SEQ ID NO: 2976910 - RNA, 17 nt, Mycobacterium avium subsp. paratuberculosis
augccgcccagcagcgg

SEQ ID NO: 2976911 - RNA, 16 nt, Mycobacterium avium subsp. paratuberculosis
augccgcccaggugca

SEQ ID NO: 2976912 - RNA, 18 nt, Mycobacterium avium subsp. paratuberculosis
augccgccgaagcccgac

SEQ ID NO: 2976913 - RNA, 14 nt, Mycobacterium avium subsp. paratuberculosis
augccgccgaccgc

SEQ ID NO: 2976914 - RNA, 20 nt, Mycobacterium avium subsp. paratuberculosis
augccgccgaccgccgagcg

SEQ ID NO: 2976915 - RNA, 17 nt, Mycobacterium avium subsp. paratuberculosis
augccgccgacgauguc

SEQ ID NO: 2976916 - RNA, 18 nt, Mycobacterium avium subsp. paratuberculosis
augccgccgagggccagc

SEQ ID NO: 2976917 - RNA, 21 nt, Mycobacterium avium subsp. paratuberculosis
augccgccgagggccagcagc

SEQ ID NO: 2976918 - RNA, 13 nt, Mycobacterium avium subsp. paratuberculosis
augccgccgccag

SEQ ID NO: 2976919 - RNA, 15 nt, Mycobacterium avium subsp. paratuberculosis
augccgcgcggcgcc

SEQ ID NO: 2976920 - RNA, 14 nt, Mycobacterium avium subsp. paratuberculosis
augccgcgcucguc

SEQ ID NO: 2976921 - RNA, 14 nt, Mycobacterium avium subsp. paratuberculosis
augccgcgggccag

SEQ ID NO: 2976922 - RNA, 17 nt, Mycobacterium avium subsp. paratuberculosis
augccgcgggccagcag

SEQ ID NO: 2976923 - RNA, 21 nt, Mycobacterium avium subsp. paratuberculosis
augccgcgggccagcagccgg

SEQ ID NO: 2976924 - RNA, 22 nt, Mycobacterium avium subsp. paratuberculosis
augccgcgggccagcagccggg

SEQ ID NO: 2976925 - RNA, 14 nt, Mycobacterium avium subsp. paratuberculosis
augccgcucggcgc

SEQ ID NO: 2976926 - RNA, 15 nt, Mycobacterium avium subsp. paratuberculosis
augccgcucggcgcu

SEQ ID NO: 2976927 - RNA, 16 nt, Mycobacterium avium subsp. paratuberculosis
augccggaggcgccgu

SEQ ID NO: 2976928 - RNA, 20 nt, Mycobacterium avium subsp. paratuberculosis
augccggaucgggaccggga

SEQ ID NO: 2976929 - RNA, 13 nt, Mycobacterium avium subsp. paratuberculosis
augccggcaaccg

SEQ ID NO: 2976930 - RNA, 19 nt, Mycobacterium avium subsp. paratuberculosis
augccggcauccucggcgc

SEQ ID NO: 2976931 - RNA, 20 nt, Mycobacterium avium subsp. paratuberculosis
augccggcauccucggcgcg

SEQ ID NO: 2976932 - RNA, 21 nt, Mycobacterium avium subsp. paratuberculosis
augccggcauccucggcgcgu

SEQ ID NO: 2976933 - RNA, 14 nt, Mycobacterium avium subsp. paratuberculosis
augccggccagcgg

SEQ ID NO: 2976934 - RNA, 16 nt, Mycobacterium avium subsp. paratuberculosis
augccggccagcggcc

SEQ ID NO: 2976935 - RNA, 13 nt, Mycobacterium avium subsp. paratuberculosis
augccggccaggc

SEQ ID NO: 2976936 - RNA, 14 nt, Mycobacterium avium subsp. paratuberculosis
augccggccaggca

SEQ ID NO: 2976937 - RNA, 19 nt, Mycobacterium avium subsp. paratuberculosis
augccggccaggcacagca

SEQ ID NO: 2976938 - RNA, 16 nt, Mycobacterium avium subsp. paratuberculosis
augccggccggcacga

SEQ ID NO: 2976939 - RNA, 14 nt, Mycobacterium avium subsp. paratuberculosis
augccggccgggac

SEQ ID NO: 2976940 - RNA, 23 nt, Mycobacterium avium subsp. paratuberculosis
augccggccuggcccagccgcgu

SEQ ID NO: 2976941 - RNA, 20 nt, Mycobacterium avium subsp. paratuberculosis
augccggcgauccgcgcggc

SEQ ID NO: 2976942 - RNA, 23 nt, Mycobacterium avium subsp. paratuberculosis
augccggcgauccgcgcggcgac

SEQ ID NO: 2976943 - RNA, 19 nt, Mycobacterium avium subsp. paratuberculosis
augccggcgcccagcggcg

SEQ ID NO: 2976944 - RNA, 21 nt, Mycobacterium avium subsp. paratuberculosis
augccggcgcccagcggcgau

SEQ ID NO: 2976945 - RNA, 20 nt, Mycobacterium avium subsp. paratuberculosis
augccggcgguaccgccgau

SEQ ID NO: 2976946 - RNA, 14 nt, Mycobacterium avium subsp. paratuberculosis
augccggcgucguc

SEQ ID NO: 2976947 - RNA, 19 nt, Mycobacterium avium subsp. paratuberculosis
augccgggcaaccacagcg

SEQ ID NO: 2976948 - RNA, 22 nt, Mycobacterium avium subsp. paratuberculosis
augccgggcaaccacagcggcg

SEQ ID NO: 2976949 - RNA, 15 nt, Mycobacterium avium subsp. paratuberculosis
augccgggccagccg

SEQ ID NO: 2976950 - RNA, 21 nt, Mycobacterium avium subsp. paratuberculosis
augccgggcuccgcguucgac

SEQ ID NO: 2976951 - RNA, 17 nt, Mycobacterium avium subsp. paratuberculosis
augccggggcagcaccc

SEQ ID NO: 2976952 - RNA, 18 nt, Mycobacterium avium subsp. paratuberculosis
augccggggcagcacccg

SEQ ID NO: 2976953 - RNA, 20 nt, Mycobacterium avium subsp. paratuberculosis
augccggggcagcacccgca

SEQ ID NO: 2976954 - RNA, 22 nt, Mycobacterium avium subsp. paratuberculosis
augccggggcagcacccgcacc

SEQ ID NO: 2976955 - RNA, 22 nt, Mycobacterium avium subsp. paratuberculosis
augccgggugggcagccccagc

SEQ ID NO: 2976956 - RNA, 22 nt, Mycobacterium avium subsp. paratuberculosis
augccguaaguggcgccgcggu

SEQ ID NO: 2976957 - RNA, 23 nt, Mycobacterium avium subsp. paratuberculosis
augccguaaguggcgccgcgguc

SEQ ID NO: 2976958 - RNA, 16 nt, Mycobacterium avium subsp. paratuberculosis
augccguagaccagca

SEQ ID NO: 2976959 - RNA, 17 nt, Mycobacterium avium subsp. paratuberculosis
augccguagcgcaugau

SEQ ID NO: 2976960 - RNA, 19 nt, Mycobacterium avium subsp. paratuberculosis
augccgucacugucggcgc

SEQ ID NO: 2976961 - RNA, 24 nt, Mycobacterium avium subsp. paratuberculosis
augccguccagcaacgccgacauc

SEQ ID NO: 2976962 - RNA, 12 nt, Mycobacterium avium subsp. paratuberculosis
augccgucgacg

SEQ ID NO: 2976963 - RNA, 13 nt, Mycobacterium avium subsp. paratuberculosis
augccgucgacga

SEQ ID NO: 2976964 - RNA, 21 nt, Mycobacterium avium subsp. paratuberculosis
augccgucgaucuugucgucc

SEQ ID NO: 2976965 - RNA, 22 nt, Mycobacterium avium subsp. paratuberculosis
augccgucggugguccagucga

SEQ ID NO: 2976966 - RNA, 17 nt, Mycobacterium avium subsp. paratuberculosis
augccgugccagccggc

SEQ ID NO: 2976967 - RNA, 13 nt, Mycobacterium avium subsp. paratuberculosis
augccgugccggu

SEQ ID NO: 2976968 - RNA, 21 nt, Mycobacterium avium subsp. paratuberculosis
augccguuccagggugucgac

SEQ ID NO: 2976969 - RNA, 15 nt, Mycobacterium avium subsp. paratuberculosis
augccguugccaggc

SEQ ID NO: 2976970 - RNA, 16 nt, Mycobacterium avium subsp. paratuberculosis
augccguugccaggcc

SEQ ID NO: 2976971 - RNA, 18 nt, Mycobacterium avium subsp. paratuberculosis
augccguugccaggccgc

SEQ ID NO: 2976972 - RNA, 21 nt, Mycobacterium avium subsp. paratuberculosis
augccguugccaggccgcgag

SEQ ID NO: 2976973 - RNA, 22 nt, Mycobacterium avium subsp. paratuberculosis
augccguuggugacgcucaccc

SEQ ID NO: 2976974 - RNA, 11 nt, Mycobacterium avium subsp. paratuberculosis
augccuccucg

SEQ ID NO: 2976975 - RNA, 13 nt, Mycobacterium avium subsp. paratuberculosis
augccugcccagc

SEQ ID NO: 2976976 - RNA, 17 nt, Mycobacterium avium subsp. paratuberculosis
augccuuccucggcgcu

SEQ ID NO: 2976977 - RNA, 16 nt, Mycobacterium avium subsp. paratuberculosis
augccuuggcccgcgc

SEQ ID NO: 2976978 - RNA, 15 nt, Mycobacterium avium subsp. paratuberculosis
augccuuggcggcgu

SEQ ID NO: 2976979 - RNA, 16 nt, Mycobacterium avium subsp. paratuberculosis
augccuuucagcucga

SEQ ID NO: 2976980 - RNA, 21 nt, Mycobacterium avium subsp. paratuberculosis
augccuuucagcucgauggug

SEQ ID NO: 2976981 - RNA, 16 nt, Mycobacterium avium subsp. paratuberculosis
augcgaccacgaccgg

SEQ ID NO: 2976982 - RNA, 24 nt, Mycobacterium avium subsp. paratuberculosis
augcgacgacgucgucguccucgu

SEQ ID NO: 2976983 - RNA, 17 nt, Mycobacterium avium subsp. paratuberculosis
augcgacgcaccucggc

SEQ ID NO: 2976984 - RNA, 16 nt, Mycobacterium avium subsp. paratuberculosis
augcgagccagcugcg

SEQ ID NO: 2976985 - RNA, 17 nt, Mycobacterium avium subsp. paratuberculosis
augcgagccagcugcgc

SEQ ID NO: 2976986 - RNA, 18 nt, Mycobacterium avium subsp. paratuberculosis
augcgaucauuccgccga

SEQ ID NO: 2976987 - RNA, 19 nt, Mycobacterium avium subsp. paratuberculosis
augcgaucauuccgccgaa

SEQ ID NO: 2976988 - RNA, 15 nt, Mycobacterium avium subsp. paratuberculosis
augcgaugaccaccc

SEQ ID NO: 2976989 - RNA, 14 nt, Mycobacterium avium subsp. paratuberculosis
augcgaugagcucg

SEQ ID NO: 2976990 - RNA, 19 nt, Mycobacterium avium subsp. paratuberculosis
augcgaugggugaucgcgg

SEQ ID NO: 2976991 - RNA, 21 nt, Mycobacterium avium subsp. paratuberculosis
augcgcaagcaccggcuggcc

SEQ ID NO: 2976992 - RNA, 13 nt, Mycobacterium avium subsp. paratuberculosis
augcgcaccacgc

SEQ ID NO: 2976993 - RNA, 16 nt, Mycobacterium avium subsp. paratuberculosis
augcgcaccacgcccg

SEQ ID NO: 2976994 - RNA, 12 nt, Mycobacterium avium subsp. paratuberculosis
augcgcaccccc

SEQ ID NO: 2976995 - RNA, 14 nt, Mycobacterium avium subsp. paratuberculosis
augcgcaccgcggc

SEQ ID NO: 2976996 - RNA, 17 nt, Mycobacterium avium subsp. paratuberculosis
augcgcacgucggccgc

SEQ ID NO: 2976997 - RNA, 13 nt, Mycobacterium avium subsp. paratuberculosis
augcgcaucaugu

SEQ ID NO: 2976998 - RNA, 14 nt, Mycobacterium avium subsp. paratuberculosis
augcgccaccgaca

SEQ ID NO: 2976999 - RNA, 18 nt, Mycobacterium avium subsp. paratuberculosis
augcgccaccgacaccac

SEQ ID NO: 2977000 - RNA, 19 nt, Mycobacterium avium subsp. paratuberculosis
augcgccaccgacaccacc

SEQ ID NO: 2977001 - RNA, 22 nt, Mycobacterium avium subsp. paratuberculosis
augcgccaccgacaccaccggc

SEQ ID NO: 2977002 - RNA, 16 nt, Mycobacterium avium subsp. paratuberculosis
augcgccagagcgcga

SEQ ID NO: 2977003 - RNA, 15 nt, Mycobacterium avium subsp. paratuberculosis
augcgcccgcgccac

SEQ ID NO: 2977004 - RNA, 18 nt, Mycobacterium avium subsp. paratuberculosis
augcgcccgcugcggcgc

SEQ ID NO: 2977005 - RNA, 19 nt, Mycobacterium avium subsp. paratuberculosis
augcgcccgcugcggcgca

SEQ ID NO: 2977006 - RNA, 13 nt, Mycobacterium avium subsp. paratuberculosis
augcgcccgguca

SEQ ID NO: 2977007 - RNA, 20 nt, Mycobacterium avium subsp. paratuberculosis
augcgccggguccagccgcg

SEQ ID NO: 2977008 - RNA, 18 nt, Mycobacterium avium subsp. paratuberculosis
augcgcgacggccucgcc

SEQ ID NO: 2977009 - RNA, 20 nt, Mycobacterium avium subsp. paratuberculosis
augcgcgacggccucgccgu

SEQ ID NO: 2977010 - RNA, 13 nt, Mycobacterium avium subsp. paratuberculosis
augcgcgccagca

SEQ ID NO: 2977011 - RNA, 13 nt, Mycobacterium avium subsp. paratuberculosis
augcgcgccgacg

SEQ ID NO: 2977012 - RNA, 14 nt, Mycobacterium avium subsp. paratuberculosis
augcgcgccgacga

SEQ ID NO: 2977013 - RNA, 17 nt, Mycobacterium avium subsp. paratuberculosis
augcgcgccuccgacga

SEQ ID NO: 2977014 - RNA, 13 nt, Mycobacterium avium subsp. paratuberculosis
augcgcggcccgu

SEQ ID NO: 2977015 - RNA, 13 nt, Mycobacterium avium subsp. paratuberculosis
augcgcggcgacg

SEQ ID NO: 2977016 - RNA, 20 nt, Mycobacterium avium subsp. paratuberculosis
augcgcgguaacagagcggg

SEQ ID NO: 2977017 - RNA, 17 nt, Mycobacterium avium subsp. paratuberculosis
augcgcgucauggccgu

SEQ ID NO: 2977018 - RNA, 20 nt, Mycobacterium avium subsp. paratuberculosis
augcgcgucauggccgucgg

SEQ ID NO: 2977019 - RNA, 22 nt, Mycobacterium avium subsp. paratuberculosis
augcgcgucauggccgucgggu

SEQ ID NO: 2977020 - RNA, 17 nt, Mycobacterium avium subsp. paratuberculosis
augcgcgucgcggcgcg

SEQ ID NO: 2977021 - RNA, 23 nt, Mycobacterium avium subsp. paratuberculosis
augcgcguuuugaaauccgggcg

SEQ ID NO: 2977022 - RNA, 21 nt, Mycobacterium avium subsp. paratuberculosis
augcgcucaucguguccagca

SEQ ID NO: 2977023 - RNA, 13 nt, Mycobacterium avium subsp. paratuberculosis
augcgcuccagca

SEQ ID NO: 2977024 - RNA, 15 nt, Mycobacterium avium subsp. paratuberculosis
augcgcucgccgauc

SEQ ID NO: 2977025 - RNA, 11 nt, Mycobacterium avium subsp. paratuberculosis
augcgcucggc

SEQ ID NO: 2977026 - RNA, 11 nt, Mycobacterium avium subsp. paratuberculosis
augcgcugcaa

SEQ ID NO: 2977027 - RNA, 17 nt, Mycobacterium avium subsp. paratuberculosis
augcggaucucggugcc

SEQ ID NO: 2977028 - RNA, 19 nt, Mycobacterium avium subsp. paratuberculosis
augcggaucucggugccgg

SEQ ID NO: 2977029 - RNA, 15 nt, Mycobacterium avium subsp. paratuberculosis
augcggcacgcguca

SEQ ID NO: 2977030 - RNA, 23 nt, Mycobacterium avium subsp. paratuberculosis
augcggccauguccccgccggug

SEQ ID NO: 2977031 - RNA, 14 nt, Mycobacterium avium subsp. paratuberculosis
augcggcccagccc

SEQ ID NO: 2977032 - RNA, 16 nt, Mycobacterium avium subsp. paratuberculosis
augcggcccagcccgg

SEQ ID NO: 2977033 - RNA, 14 nt, Mycobacterium avium subsp. paratuberculosis
augcggcccgaccc

SEQ ID NO: 2977034 - RNA, 16 nt, Mycobacterium avium subsp. paratuberculosis
augcggcccggccacu

SEQ ID NO: 2977035 - RNA, 22 nt, Mycobacterium avium subsp. paratuberculosis
augcggcccugguugagcaccg

SEQ ID NO: 2977036 - RNA, 15 nt, Mycobacterium avium subsp. paratuberculosis
augcggccggcgggc

SEQ ID NO: 2977037 - RNA, 15 nt, Mycobacterium avium subsp. paratuberculosis
augcggccgucggga

SEQ ID NO: 2977038 - RNA, 14 nt, Mycobacterium avium subsp. paratuberculosis
augcggcgcccaca

SEQ ID NO: 2977039 - RNA, 17 nt, Mycobacterium avium subsp. paratuberculosis
augcggcgcccacagca

SEQ ID NO: 2977040 - RNA, 13 nt, Mycobacterium avium subsp. paratuberculosis
augcggcucccac

SEQ ID NO: 2977041 - RNA, 16 nt, Mycobacterium avium subsp. paratuberculosis
augcgggauucgcgca

SEQ ID NO: 2977042 - RNA, 13 nt, Mycobacterium avium subsp. paratuberculosis
augcgggcgccga

SEQ ID NO: 2977043 - RNA, 14 nt, Mycobacterium avium subsp. paratuberculosis
augcgggcgccgaa

SEQ ID NO: 2977044 - RNA, 19 nt, Mycobacterium avium subsp. paratuberculosis
augcgggcgcugccguccu

SEQ ID NO: 2977045 - RNA, 17 nt, Mycobacterium avium subsp. paratuberculosis
augcggggccggcggcg

SEQ ID NO: 2977046 - RNA, 22 nt, Mycobacterium avium subsp. paratuberculosis
augcggguguugcgcagcgucu

SEQ ID NO: 2977047 - RNA, 20 nt, Mycobacterium avium subsp. paratuberculosis
augcggucgaugagcuggug

SEQ ID NO: 2977048 - RNA, 15 nt, Mycobacterium avium subsp. paratuberculosis
augcggucggcgcgg

SEQ ID NO: 2977049 - RNA, 19 nt, Mycobacterium avium subsp. paratuberculosis
augcggugccgggccaggu

SEQ ID NO: 2977050 - RNA, 14 nt, Mycobacterium avium subsp. paratuberculosis
augcggugccgggu

SEQ ID NO: 2977051 - RNA, 18 nt, Mycobacterium avium subsp. paratuberculosis
augcggugccgggugcug

SEQ ID NO: 2977052 - RNA, 19 nt, Mycobacterium avium subsp. paratuberculosis
augcggugcugccgugccg

SEQ ID NO: 2977053 - RNA, 23 nt, Mycobacterium avium subsp. paratuberculosis
augcgguggucgaacacggcgcu

SEQ ID NO: 2977054 - RNA, 13 nt, Mycobacterium avium subsp. paratuberculosis
augcgucaacccg

SEQ ID NO: 2977055 - RNA, 21 nt, Mycobacterium avium subsp. paratuberculosis
augcgucaacccguuccacau

SEQ ID NO: 2977056 - RNA, 15 nt, Mycobacterium avium subsp. paratuberculosis
augcgucaugccgga

SEQ ID NO: 2977057 - RNA, 15 nt, Mycobacterium avium subsp. paratuberculosis
augcguuccgcgaca

SEQ ID NO: 2977058 - RNA, 15 nt, Mycobacterium avium subsp. paratuberculosis
augcguucggccagu

SEQ ID NO: 2977059 - RNA, 15 nt, Mycobacterium avium subsp. paratuberculosis
augcguuggccgagc

SEQ ID NO: 2977060 - RNA, 20 nt, Mycobacterium avium subsp. paratuberculosis
augcguugguguagccgaac

SEQ ID NO: 2977061 - RNA, 17 nt, Mycobacterium avium subsp. paratuberculosis
augcuauucgggccagc

SEQ ID NO: 2977062 - RNA, 20 nt, Mycobacterium avium subsp. paratuberculosis
augcucagcgggaagccgag

SEQ ID NO: 2977063 - RNA, 22 nt, Mycobacterium avium subsp. paratuberculosis
augcucgaugcgcaccugcggc

SEQ ID NO: 2977064 - RNA, 14 nt, Mycobacterium avium subsp. paratuberculosis
augcucgucgguca

SEQ ID NO: 2977065 - RNA, 16 nt, Mycobacterium avium subsp. paratuberculosis
augcucgucggucagg

SEQ ID NO: 2977066 - RNA, 16 nt, Mycobacterium avium subsp. paratuberculosis
augcucuugcgggcgg

SEQ ID NO: 2977067 - RNA, 20 nt, Mycobacterium avium subsp. paratuberculosis
augcugagcgggucggccgg

SEQ ID NO: 2977068 - RNA, 21 nt, Mycobacterium avium subsp. paratuberculosis
augcugagcgggucggccggc

SEQ ID NO: 2977069 - RNA, 19 nt, Mycobacterium avium subsp. paratuberculosis
augcugauacccgcgcggc

SEQ ID NO: 2977070 - RNA, 20 nt, Mycobacterium avium subsp. paratuberculosis
augcugauacccgcgcggcg

SEQ ID NO: 2977071 - RNA, 22 nt, Mycobacterium avium subsp. paratuberculosis
augcugauccgcaggaugccga

SEQ ID NO: 2977072 - RNA, 20 nt, Mycobacterium avium subsp. paratuberculosis
augcugcaacggcuggcgca

SEQ ID NO: 2977073 - RNA, 19 nt, Mycobacterium avium subsp. paratuberculosis
augcugcacccaccggcgc

SEQ ID NO: 2977074 - RNA, 20 nt, Mycobacterium avium subsp. paratuberculosis
augcugcacccaccggcgca

SEQ ID NO: 2977075 - RNA, 14 nt, Mycobacterium avium subsp. paratuberculosis
augcugcacggggu

SEQ ID NO: 2977076 - RNA, 14 nt, Mycobacterium avium subsp. paratuberculosis
augcugcccggcgc

SEQ ID NO: 2977077 - RNA, 15 nt, Mycobacterium avium subsp. paratuberculosis
augcugcccggcgcc

SEQ ID NO: 2977078 - RNA, 14 nt, Mycobacterium avium subsp. paratuberculosis
augcugccgccggc

SEQ ID NO: 2977079 - RNA, 17 nt, Mycobacterium avium subsp. paratuberculosis
augcugcgggucagcag

SEQ ID NO: 2977080 - RNA, 17 nt, Mycobacterium avium subsp. paratuberculosis
augcuggggucggccag

SEQ ID NO: 2977081 - RNA, 16 nt, Mycobacterium avium subsp. paratuberculosis
augcuggugacgccgc

SEQ ID NO: 2977082 - RNA, 17 nt, Mycobacterium avium subsp. paratuberculosis
augcuggugacgccgcu

SEQ ID NO: 2977083 - RNA, 21 nt, Mycobacterium avium subsp. paratuberculosis
augcuguggaagggccccggc

SEQ ID NO: 2977084 - RNA, 23 nt, Mycobacterium avium subsp. paratuberculosis
augcuguggaagggccccggcau

SEQ ID NO: 2977085 - RNA, 22 nt, Mycobacterium avium subsp. paratuberculosis
augcuguuccagacgucggcgu

SEQ ID NO: 2977086 - RNA, 16 nt, Mycobacterium avium subsp. paratuberculosis
augcuuccgaucaacg

SEQ ID NO: 2977087 - RNA, 23 nt, Mycobacterium avium subsp. paratuberculosis
augcuuccgaucaacggcagcga

SEQ ID NO: 2977088 - RNA, 21 nt, Mycobacterium avium subsp. paratuberculosis
auggaaugugccugcgggccc

SEQ ID NO: 2977089 - RNA, 18 nt, Mycobacterium avium subsp. paratuberculosis
auggacagcaccuugccc

SEQ ID NO: 2977090 - RNA, 13 nt, Mycobacterium avium subsp. paratuberculosis
auggacagcagcc

SEQ ID NO: 2977091 - RNA, 18 nt, Mycobacterium avium subsp. paratuberculosis
auggacagcagccagguc

SEQ ID NO: 2977092 - RNA, 18 nt, Mycobacterium avium subsp. paratuberculosis
auggacagccaccgugcc

SEQ ID NO: 2977093 - RNA, 18 nt, Mycobacterium avium subsp. paratuberculosis
auggacaugugagguggc

SEQ ID NO: 2977094 - RNA, 20 nt, Mycobacterium avium subsp. paratuberculosis
auggaccggguggugggcga

SEQ ID NO: 2977095 - RNA, 23 nt, Mycobacterium avium subsp. paratuberculosis
auggacgcccaacuacccgccga

SEQ ID NO: 2977096 - RNA, 17 nt, Mycobacterium avium subsp. paratuberculosis
auggacgcgguggugcu

SEQ ID NO: 2977097 - RNA, 17 nt, Mycobacterium avium subsp. paratuberculosis
auggacguccagcggcc

SEQ ID NO: 2977098 - RNA, 19 nt, Mycobacterium avium subsp. paratuberculosis
auggacguccagcggcccu

SEQ ID NO: 2977099 - RNA, 24 nt, Mycobacterium avium subsp. paratuberculosis
auggagaaaauccagaacagccag

SEQ ID NO: 2977100 - RNA, 17 nt, Mycobacterium avium subsp. paratuberculosis
auggagcugaccuggcu

SEQ ID NO: 2977101 - RNA, 16 nt, Mycobacterium avium subsp. paratuberculosis
auggaggugccgcgca

SEQ ID NO: 2977102 - RNA, 18 nt, Mycobacterium avium subsp. paratuberculosis
auggaggugccgcgcagc

SEQ ID NO: 2977103 - RNA, 19 nt, Mycobacterium avium subsp. paratuberculosis
auggaggugccgcgcagca

SEQ ID NO: 2977104 - RNA, 23 nt, Mycobacterium avium subsp. paratuberculosis
auggaggugccgcgcagcaccgu

SEQ ID NO: 2977105 - RNA, 15 nt, Mycobacterium avium subsp. paratuberculosis
auggaguagcugacc

SEQ ID NO: 2977106 - RNA, 21 nt, Mycobacterium avium subsp. paratuberculosis
auggaucagacccagcgucag

SEQ ID NO: 2977107 - RNA, 19 nt, Mycobacterium avium subsp. paratuberculosis
auggauccgaucagcagca

SEQ ID NO: 2977108 - RNA, 22 nt, Mycobacterium avium subsp. paratuberculosis
auggauccgaucagcagcaccu

SEQ ID NO: 2977109 - RNA, 16 nt, Mycobacterium avium subsp. paratuberculosis
auggcaaggccagcaa

SEQ ID NO: 2977110 - RNA, 18 nt, Mycobacterium avium subsp. paratuberculosis
auggcacacagcgugacc

SEQ ID NO: 2977111 - RNA, 20 nt, Mycobacterium avium subsp. paratuberculosis
auggcaucgccaaggcgcug

SEQ ID NO: 2977112 - RNA, 15 nt, Mycobacterium avium subsp. paratuberculosis
auggccaccgggcgu

SEQ ID NO: 2977113 - RNA, 16 nt, Mycobacterium avium subsp. paratuberculosis
auggccagcaccaccg

SEQ ID NO: 2977114 - RNA, 17 nt, Mycobacterium avium subsp. paratuberculosis
auggccagcaccaccgc

SEQ ID NO: 2977115 - RNA, 19 nt, Mycobacterium avium subsp. paratuberculosis
auggccagcaccaccgcga

SEQ ID NO: 2977116 - RNA, 21 nt, Mycobacterium avium subsp. paratuberculosis
auggccagcaccaccgcgagc

SEQ ID NO: 2977117 - RNA, 23 nt, Mycobacterium avium subsp. paratuberculosis
auggccagcaccaccgcgagcgg

SEQ ID NO: 2977118 - RNA, 14 nt, Mycobacterium avium subsp. paratuberculosis
auggccagcaccau

SEQ ID NO: 2977119 - RNA, 14 nt, Mycobacterium avium subsp. paratuberculosis
auggccagcgcggc

SEQ ID NO: 2977120 - RNA, 15 nt, Mycobacterium avium subsp. paratuberculosis
auggccagcgcggcg

SEQ ID NO: 2977121 - RNA, 21 nt, Mycobacterium avium subsp. paratuberculosis
auggccagcgcgucgcacagc

SEQ ID NO: 2977122 - RNA, 13 nt, Mycobacterium avium subsp. paratuberculosis
auggccagcucgu

SEQ ID NO: 2977123 - RNA, 21 nt, Mycobacterium avium subsp. paratuberculosis
auggccagcucgucgcggaac

SEQ ID NO: 2977124 - RNA, 17 nt, Mycobacterium avium subsp. paratuberculosis
auggccaggaacggcgc

SEQ ID NO: 2977125 - RNA, 18 nt, Mycobacterium avium subsp. paratuberculosis
auggccaggaacggcgcc

SEQ ID NO: 2977126 - RNA, 13 nt, Mycobacterium avium subsp. paratuberculosis
auggccaucuggc

SEQ ID NO: 2977127 - RNA, 17 nt, Mycobacterium avium subsp. paratuberculosis
auggccaucuggccgcg

SEQ ID NO: 2977128 - RNA, 18 nt, Mycobacterium avium subsp. paratuberculosis
auggccaucuggccgcgg

SEQ ID NO: 2977129 - RNA, 19 nt, Mycobacterium avium subsp. paratuberculosis
auggccaucuggccgcggg

SEQ ID NO: 2977130 - RNA, 21 nt, Mycobacterium avium subsp. paratuberculosis
auggcccaggccgcggucgcc

SEQ ID NO: 2977131 - RNA, 15 nt, Mycobacterium avium subsp. paratuberculosis
auggcccgcgcgaug

SEQ ID NO: 2977132 - RNA, 14 nt, Mycobacterium avium subsp. paratuberculosis
auggcccgcucggu

SEQ ID NO: 2977133 - RNA, 17 nt, Mycobacterium avium subsp. paratuberculosis
auggcccgcugcgccga

SEQ ID NO: 2977134 - RNA, 18 nt, Mycobacterium avium subsp. paratuberculosis
auggcccgcugcgccgac

SEQ ID NO: 2977135 - RNA, 20 nt, Mycobacterium avium subsp. paratuberculosis
auggccgacaacauccgcga

SEQ ID NO: 2977136 - RNA, 12 nt, Mycobacterium avium subsp. paratuberculosis
auggccgcgccg

SEQ ID NO: 2977137 - RNA, 21 nt, Mycobacterium avium subsp. paratuberculosis
auggccgcgccgccgcccugg

SEQ ID NO: 2977138 - RNA, 11 nt, Mycobacterium avium subsp. paratuberculosis
auggccggccg

SEQ ID NO: 2977139 - RNA, 13 nt, Mycobacterium avium subsp. paratuberculosis
auggccgggaagu

SEQ ID NO: 2977140 - RNA, 14 nt, Mycobacterium avium subsp. paratuberculosis
auggccgggaaguu

SEQ ID NO: 2977141 - RNA, 22 nt, Mycobacterium avium subsp. paratuberculosis
auggccgucgggucggcgagca

SEQ ID NO: 2977142 - RNA, 20 nt, Mycobacterium avium subsp. paratuberculosis
auggccucgucgaugucggc

SEQ ID NO: 2977143 - RNA, 19 nt, Mycobacterium avium subsp. paratuberculosis
auggccugguggcccaggc

SEQ ID NO: 2977144 - RNA, 21 nt, Mycobacterium avium subsp. paratuberculosis
auggcgaacacgucggccagc

SEQ ID NO: 2977145 - RNA, 16 nt, Mycobacterium avium subsp. paratuberculosis
auggcgaaccagcgcc

SEQ ID NO: 2977146 - RNA, 17 nt, Mycobacterium avium subsp. paratuberculosis
auggcgaaccagcgccc

SEQ ID NO: 2977147 - RNA, 19 nt, Mycobacterium avium subsp. paratuberculosis
auggcgaaccagcgcccgc

SEQ ID NO: 2977148 - RNA, 18 nt, Mycobacterium avium subsp. paratuberculosis
auggcgaaguucggcauc

SEQ ID NO: 2977149 - RNA, 14 nt, Mycobacterium avium subsp. paratuberculosis
auggcgaccgcgac

SEQ ID NO: 2977150 - RNA, 12 nt, Mycobacterium avium subsp. paratuberculosis
auggcgacggcg

SEQ ID NO: 2977151 - RNA, 23 nt, Mycobacterium avium subsp. paratuberculosis
auggcgacggucugccgggacag

SEQ ID NO: 2977152 - RNA, 12 nt, Mycobacterium avium subsp. paratuberculosis
auggcgaucauc

SEQ ID NO: 2977153 - RNA, 18 nt, Mycobacterium avium subsp. paratuberculosis
auggcgaugaccagcgcg

SEQ ID NO: 2977154 - RNA, 18 nt, Mycobacterium avium subsp. paratuberculosis
auggcgaugacgucgucg

SEQ ID NO: 2977155 - RNA, 15 nt, Mycobacterium avium subsp. paratuberculosis
auggcgcccagcccg

SEQ ID NO: 2977156 - RNA, 23 nt, Mycobacterium avium subsp. paratuberculosis
auggcgcccagcccgagcaccag

SEQ ID NO: 2977157 - RNA, 22 nt, Mycobacterium avium subsp. paratuberculosis
auggcgcccagcgucucggcgg

SEQ ID NO: 2977158 - RNA, 21 nt, Mycobacterium avium subsp. paratuberculosis
cccgccggguggccgccacgu

SEQ ID NO: 2977159 - RNA, 23 nt, Mycobacterium avium subsp. paratuberculosis
cccgccggugaucucccgugcgg

SEQ ID NO: 2977160 - RNA, 17 nt, Mycobacterium avium subsp. paratuberculosis
cccgccgguggccgcga

SEQ ID NO: 2977161 - RNA, 17 nt, Mycobacterium avium subsp. paratuberculosis
cccgccgguggccgcgc

SEQ ID NO: 2977162 - RNA, 17 nt, Mycobacterium avium subsp. paratuberculosis
cccgccgguggcggcga

SEQ ID NO: 2977163 - RNA, 20 nt, Mycobacterium avium subsp. paratuberculosis
cccgccgguggcggcgagga

SEQ ID NO: 2977164 - RNA, 20 nt, Mycobacterium avium subsp. paratuberculosis
cccgccguagcgccggcaac

SEQ ID NO: 2977165 - RNA, 16 nt, Mycobacterium avium subsp. paratuberculosis
cccgccgucacgccgu

SEQ ID NO: 2977166 - RNA, 13 nt, Mycobacterium avium subsp. paratuberculosis
cccgccgucgacc

SEQ ID NO: 2977167 - RNA, 15 nt, Mycobacterium avium subsp. paratuberculosis
cccgccgucgaccac

SEQ ID NO: 2977168 - RNA, 16 nt, Mycobacterium avium subsp. paratuberculosis
cccgccgugaccggcg

SEQ ID NO: 2977169 - RNA, 16 nt, Mycobacterium avium subsp. paratuberculosis
cccgccgugcgccccg

SEQ ID NO: 2977170 - RNA, 17 nt, Mycobacterium avium subsp. paratuberculosis
cccgccgugcgccccgc

SEQ ID NO: 2977171 - RNA, 16 nt, Mycobacterium avium subsp. paratuberculosis
cccgccguuguugagc

SEQ ID NO: 2977172 - RNA, 20 nt, Mycobacterium avium subsp. paratuberculosis
cccgccguuucagcagcgcg

SEQ ID NO: 2977173 - RNA, 21 nt, Mycobacterium avium subsp. paratuberculosis
cccgccuacuugaccagcgug

SEQ ID NO: 2977174 - RNA, 17 nt, Mycobacterium avium subsp. paratuberculosis
cccgccucacagcgaca

SEQ ID NO: 2977175 - RNA, 14 nt, Mycobacterium avium subsp. paratuberculosis
cccgccucgcagcg

SEQ ID NO: 2977176 - RNA, 17 nt, Mycobacterium avium subsp. paratuberculosis
cccgccucgcagcgaca

SEQ ID NO: 2977177 - RNA, 13 nt, Mycobacterium avium subsp. paratuberculosis
cccgccucgccgg

SEQ ID NO: 2977178 - RNA, 15 nt, Mycobacterium avium subsp. paratuberculosis
cccgccucggugagc

SEQ ID NO: 2977179 - RNA, 19 nt, Mycobacterium avium subsp. paratuberculosis
cccgccucggugagcagcu

SEQ ID NO: 2977180 - RNA, 22 nt, Mycobacterium avium subsp. paratuberculosis
cccgccucggugagcagcucgg

SEQ ID NO: 2977181 - RNA, 22 nt, Mycobacterium avium subsp. paratuberculosis
cccgccuggccaccucgacggc

SEQ ID NO: 2977182 - RNA, 12 nt, Mycobacterium avium subsp. paratuberculosis
cccgccuucucc

SEQ ID NO: 2977183 - RNA, 17 nt, Mycobacterium avium subsp. paratuberculosis
cccgcgaaaucuucgcc

SEQ ID NO: 2977184 - RNA, 20 nt, Mycobacterium avium subsp. paratuberculosis
cccgcgaaaucuucgccguc

SEQ ID NO: 2977185 - RNA, 15 nt, Mycobacterium avium subsp. paratuberculosis
cccgcgaacacgcga

SEQ ID NO: 2977186 - RNA, 17 nt, Mycobacterium avium subsp. paratuberculosis
cccgcgaacacgcgaug

SEQ ID NO: 2977187 - RNA, 23 nt, Mycobacterium avium subsp. paratuberculosis
cccgcgaacacgcgaugaucagc

SEQ ID NO: 2977188 - RNA, 14 nt, Mycobacterium avium subsp. paratuberculosis
cccgcgaacgccuc

SEQ ID NO: 2977189 - RNA, 19 nt, Mycobacterium avium subsp. paratuberculosis
cccgcgaccccuccaacgg

SEQ ID NO: 2977190 - RNA, 15 nt, Mycobacterium avium subsp. paratuberculosis
cccgcgaccgcagca

SEQ ID NO: 2977191 - RNA, 12 nt, Mycobacterium avium subsp. paratuberculosis
cccgcgacgucg

SEQ ID NO: 2977192 - RNA, 13 nt, Mycobacterium avium subsp. paratuberculosis
cccgcgacgucgg

SEQ ID NO: 2977193 - RNA, 13 nt, Mycobacterium avium subsp. paratuberculosis
cccgcgacugucg

SEQ ID NO: 2977194 - RNA, 17 nt, Mycobacterium avium subsp. paratuberculosis
cccgcgacugucggcgc

SEQ ID NO: 2977195 - RNA, 22 nt, Mycobacterium avium subsp. paratuberculosis
cccgcgacugucggcgccccgc

SEQ ID NO: 2977196 - RNA, 23 nt, Mycobacterium avium subsp. paratuberculosis
cccgcgacugucggcgccccgcc

SEQ ID NO: 2977197 - RNA, 20 nt, Mycobacterium avium subsp. paratuberculosis
cccgcgacugucggcucgcc

SEQ ID NO: 2977198 - RNA, 14 nt, Mycobacterium avium subsp. paratuberculosis
cccgcgagcugccc

SEQ ID NO: 2977199 - RNA, 18 nt, Mycobacterium avium subsp. paratuberculosis
cccgcgagcugccccuuc

SEQ ID NO: 2977200 - RNA, 15 nt, Mycobacterium avium subsp. paratuberculosis
cccgcgagucaccgg

SEQ ID NO: 2977201 - RNA, 16 nt, Mycobacterium avium subsp. paratuberculosis
cccgcgagucaccggc

SEQ ID NO: 2977202 - RNA, 16 nt, Mycobacterium avium subsp. paratuberculosis
cccgcgaucaacaccg

SEQ ID NO: 2977203 - RNA, 20 nt, Mycobacterium avium subsp. paratuberculosis
cccgcgauggcacacagcgu

SEQ ID NO: 2977204 - RNA, 13 nt, Mycobacterium avium subsp. paratuberculosis
cccgcgcaccguc

SEQ ID NO: 2977205 - RNA, 21 nt, Mycobacterium avium subsp. paratuberculosis
cccgcgcaccgucaucgcggc

SEQ ID NO: 2977206 - RNA, 13 nt, Mycobacterium avium subsp. paratuberculosis
cccgcgccacccc

SEQ ID NO: 2977207 - RNA, 17 nt, Mycobacterium avium subsp. paratuberculosis
cccgcgccacgccgccc

SEQ ID NO: 2977208 - RNA, 18 nt, Mycobacterium avium subsp. paratuberculosis
cccgcgccacgccgcccc

SEQ ID NO: 2977209 - RNA, 20 nt, Mycobacterium avium subsp. paratuberculosis
cccgcgccagcucggcggcc

SEQ ID NO: 2977210 - RNA, 17 nt, Mycobacterium avium subsp. paratuberculosis
cccgcgcccaccuggag

SEQ ID NO: 2977211 - RNA, 20 nt, Mycobacterium avium subsp. paratuberculosis
cccgcgcccaugaacgcguc

SEQ ID NO: 2977212 - RNA, 13 nt, Mycobacterium avium subsp. paratuberculosis
cccgcgccccggc

SEQ ID NO: 2977213 - RNA, 14 nt, Mycobacterium avium subsp. paratuberculosis
cccgcgccccggcc

SEQ ID NO: 2977214 - RNA, 15 nt, Mycobacterium avium subsp. paratuberculosis
cccgcgccccggcgg

SEQ ID NO: 2977215 - RNA, 17 nt, Mycobacterium avium subsp. paratuberculosis
cccgcgccccggcggcc

SEQ ID NO: 2977216 - RNA, 13 nt, Mycobacterium avium subsp. paratuberculosis
cccgcgcccgcga

SEQ ID NO: 2977217 - RNA, 13 nt, Mycobacterium avium subsp. paratuberculosis
cccgcgcccgcuc

SEQ ID NO: 2977218 - RNA, 15 nt, Mycobacterium avium subsp. paratuberculosis
cccgcgcccgcucga

SEQ ID NO: 2977219 - RNA, 19 nt, Mycobacterium avium subsp. paratuberculosis
cccgcgccgaccagcgcgu

SEQ ID NO: 2977220 - RNA, 14 nt, Mycobacterium avium subsp. paratuberculosis
cccgcgccgacggc

SEQ ID NO: 2977221 - RNA, 20 nt, Mycobacterium avium subsp. paratuberculosis
cccgcgccgcauuggcaccg

SEQ ID NO: 2977222 - RNA, 13 nt, Mycobacterium avium subsp. paratuberculosis
cccgcgccgcccg

SEQ ID NO: 2977223 - RNA, 13 nt, Mycobacterium avium subsp. paratuberculosis
cccgcgccgcggc

SEQ ID NO: 2977224 - RNA, 14 nt, Mycobacterium avium subsp. paratuberculosis
cccgcgccgcggcc

SEQ ID NO: 2977225 - RNA, 14 nt, Mycobacterium avium subsp. paratuberculosis
cccgcgccgcgucg

SEQ ID NO: 2977226 - RNA, 21 nt, Mycobacterium avium subsp. paratuberculosis
cccgcgccgcgucgucgucga

SEQ ID NO: 2977227 - RNA, 14 nt, Mycobacterium avium subsp. paratuberculosis
cccgcgccggcgug

SEQ ID NO: 2977228 - RNA, 13 nt, Mycobacterium avium subsp. paratuberculosis
cccgcgccgggcg

SEQ ID NO: 2977229 - RNA, 12 nt, Mycobacterium avium subsp. paratuberculosis
cccgcgccucgu

SEQ ID NO: 2977230 - RNA, 21 nt, Mycobacterium avium subsp. paratuberculosis
cccgcgccucguugagcacaa

SEQ ID NO: 2977231 - RNA, 18 nt, Mycobacterium avium subsp. paratuberculosis
cccgcgcgacaucaccgc

SEQ ID NO: 2977232 - RNA, 23 nt, Mycobacterium avium subsp. paratuberculosis
cccgcgcgacaucaccgcgggcg

SEQ ID NO: 2977233 - RNA, 17 nt, Mycobacterium avium subsp. paratuberculosis
cccgcgcgagcgcagcg

SEQ ID NO: 2977234 - RNA, 15 nt, Mycobacterium avium subsp. paratuberculosis
cccgcgcgaucggcg

SEQ ID NO: 2977235 - RNA, 17 nt, Mycobacterium avium subsp. paratuberculosis
cccgcgcgaucggcgag

SEQ ID NO: 2977236 - RNA, 14 nt, Mycobacterium avium subsp. paratuberculosis
cccgcgcgcgggcc

SEQ ID NO: 2977237 - RNA, 15 nt, Mycobacterium avium subsp. paratuberculosis
cccgcgcgcgggcca

SEQ ID NO: 2977238 - RNA, 14 nt, Mycobacterium avium subsp. paratuberculosis
cccgcgcgcugacc

SEQ ID NO: 2977239 - RNA, 12 nt, Mycobacterium avium subsp. paratuberculosis
cccgcgcggccg

SEQ ID NO: 2977240 - RNA, 14 nt, Mycobacterium avium subsp. paratuberculosis
cccgcgcggccgcc

SEQ ID NO: 2977241 - RNA, 13 nt, Mycobacterium avium subsp. paratuberculosis
cccgcgcggcggc

SEQ ID NO: 2977242 - RNA, 15 nt, Mycobacterium avium subsp. paratuberculosis
cccgcgcggcggcca

SEQ ID NO: 2977243 - RNA, 21 nt, Mycobacterium avium subsp. paratuberculosis
cccgcgcggcggccaacgcga

SEQ ID NO: 2977244 - RNA, 14 nt, Mycobacterium avium subsp. paratuberculosis
cccgcgcggcggug

SEQ ID NO: 2977245 - RNA, 20 nt, Mycobacterium avium subsp. paratuberculosis
cccgcgcggcgucggccugc

SEQ ID NO: 2977246 - RNA, 13 nt, Mycobacterium avium subsp. paratuberculosis
cccgcgcggcuca

SEQ ID NO: 2977247 - RNA, 15 nt, Mycobacterium avium subsp. paratuberculosis
cccgcgcggcucaca

SEQ ID NO: 2977248 - RNA, 22 nt, Mycobacterium avium subsp. paratuberculosis
cccgcgcggcucacagcgcggc

SEQ ID NO: 2977249 - RNA, 19 nt, Mycobacterium avium subsp. paratuberculosis
cccgcgcggcucgcgggcg

SEQ ID NO: 2977250 - RNA, 12 nt, Mycobacterium avium subsp. paratuberculosis
cccgcgcgggca

SEQ ID NO: 2977251 - RNA, 22 nt, Mycobacterium avium subsp. paratuberculosis
cccgcgcgggggccgccgcgau

SEQ ID NO: 2977252 - RNA, 12 nt, Mycobacterium avium subsp. paratuberculosis
cccgcgcgucgc

SEQ ID NO: 2977253 - RNA, 18 nt, Mycobacterium avium subsp. paratuberculosis
cccgcgcgucgcgcagcg

SEQ ID NO: 2977254 - RNA, 17 nt, Mycobacterium avium subsp. paratuberculosis
cccgcgcguggucccac

SEQ ID NO: 2977255 - RNA, 15 nt, Mycobacterium avium subsp. paratuberculosis
cccgcgcugcccagc

SEQ ID NO: 2977256 - RNA, 13 nt, Mycobacterium avium subsp. paratuberculosis
cccgcgcuggugc

SEQ ID NO: 2977257 - RNA, 22 nt, Mycobacterium avium subsp. paratuberculosis
cccgcggaucgcguaguccagc

SEQ ID NO: 2977258 - RNA, 19 nt, Mycobacterium avium subsp. paratuberculosis
cccgcggcacgcugcgcca

SEQ ID NO: 2977259 - RNA, 23 nt, Mycobacterium avium subsp. paratuberculosis
cccgcggcacgcugcgccagccg

SEQ ID NO: 2977260 - RNA, 14 nt, Mycobacterium avium subsp. paratuberculosis
cccgcggcagccag

SEQ ID NO: 2977261 - RNA, 15 nt, Mycobacterium avium subsp. paratuberculosis
cccgcggcagccagc

SEQ ID NO: 2977262 - RNA, 15 nt, Mycobacterium avium subsp. paratuberculosis
cccgcggccaucgcc

SEQ ID NO: 2977263 - RNA, 16 nt, Mycobacterium avium subsp. paratuberculosis
cccgcggccaucgccu

SEQ ID NO: 2977264 - RNA, 13 nt, Mycobacterium avium subsp. paratuberculosis
cccgcggccgccg

SEQ ID NO: 2977265 - RNA, 16 nt, Mycobacterium avium subsp. paratuberculosis
cccgcggccgccgccg

SEQ ID NO: 2977266 - RNA, 20 nt, Mycobacterium avium subsp. paratuberculosis
cccgcggccgccgccgcggc

SEQ ID NO: 2977267 - RNA, 22 nt, Mycobacterium avium subsp. paratuberculosis
cccgcggccgccgccgcggccg

SEQ ID NO: 2977268 - RNA, 13 nt, Mycobacterium avium subsp. paratuberculosis
cccgcggccgcug

SEQ ID NO: 2977269 - RNA, 14 nt, Mycobacterium avium subsp. paratuberculosis
cccgcggccgcugc

SEQ ID NO: 2977270 - RNA, 13 nt, Mycobacterium avium subsp. paratuberculosis
cccgcggccggcc

SEQ ID NO: 2977271 - RNA, 14 nt, Mycobacterium avium subsp. paratuberculosis
cccgcggccggccc

SEQ ID NO: 2977272 - RNA, 15 nt, Mycobacterium avium subsp. paratuberculosis
cccgcggccggccca

SEQ ID NO: 2977273 - RNA, 11 nt, Mycobacterium avium subsp. paratuberculosis
cccgcggccuc

SEQ ID NO: 2977274 - RNA, 13 nt, Mycobacterium avium subsp. paratuberculosis
cccgcggccuccg

SEQ ID NO: 2977275 - RNA, 14 nt, Mycobacterium avium subsp. paratuberculosis
cccgcggcgccgcg

SEQ ID NO: 2977276 - RNA, 17 nt, Mycobacterium avium subsp. paratuberculosis
cccgcggcgccgcggcg

SEQ ID NO: 2977277 - RNA, 19 nt, Mycobacterium avium subsp. paratuberculosis
cccgcggcgccgcggcggc

SEQ ID NO: 2977278 - RNA, 14 nt, Mycobacterium avium subsp. paratuberculosis
cccgcggcgcgaug

SEQ ID NO: 2977279 - RNA, 22 nt, Mycobacterium avium subsp. paratuberculosis
cccgcggcgcgaugaucgccgg

SEQ ID NO: 2977280 - RNA, 13 nt, Mycobacterium avium subsp. paratuberculosis
cccgcggcgcgca

SEQ ID NO: 2977281 - RNA, 12 nt, Mycobacterium avium subsp. paratuberculosis
cccgcggcggcc

SEQ ID NO: 2977282 - RNA, 18 nt, Mycobacterium avium subsp. paratuberculosis
cccgcggcggccaucucg

SEQ ID NO: 2977283 - RNA, 15 nt, Mycobacterium avium subsp. paratuberculosis
cccgcggcggcgcca

SEQ ID NO: 2977284 - RNA, 22 nt, Mycobacterium avium subsp. paratuberculosis
cccgcggcggcgccaugaacgg

SEQ ID NO: 2977285 - RNA, 21 nt, Mycobacterium avium subsp. paratuberculosis
cccgcgggacacggcggcgcg

SEQ ID NO: 2977286 - RNA, 15 nt, Mycobacterium avium subsp. paratuberculosis
cccgcgggaucagcg

SEQ ID NO: 2977287 - RNA, 18 nt, Mycobacterium avium subsp. paratuberculosis
cccgcgggaucagcgugu

SEQ ID NO: 2977288 - RNA, 13 nt, Mycobacterium avium subsp. paratuberculosis
cccgcgggccaga

SEQ ID NO: 2977289 - RNA, 17 nt, Mycobacterium avium subsp. paratuberculosis
cccgcgggccagacugc

SEQ ID NO: 2977290 - RNA, 21 nt, Mycobacterium avium subsp. paratuberculosis
cccgcgggccagacugcgcac

SEQ ID NO: 2977291 - RNA, 18 nt, Mycobacterium avium subsp. paratuberculosis
cccgcggguagcccgucg

SEQ ID NO: 2977292 - RNA, 12 nt, Mycobacterium avium subsp. paratuberculosis
cccgcgggucgc

SEQ ID NO: 2977293 - RNA, 16 nt, Mycobacterium avium subsp. paratuberculosis
cccgcgggucgcggcc

SEQ ID NO: 2977294 - RNA, 17 nt, Mycobacterium avium subsp. paratuberculosis
cccgcgggucgcggccc

SEQ ID NO: 2977295 - RNA, 18 nt, Mycobacterium avium subsp. paratuberculosis
cccgcgggucgcggccca

SEQ ID NO: 2977296 - RNA, 17 nt, Mycobacterium avium subsp. paratuberculosis
cccgcgggucgucgacg

SEQ ID NO: 2977297 - RNA, 18 nt, Mycobacterium avium subsp. paratuberculosis
cccgcgggucgucgacgu

SEQ ID NO: 2977298 - RNA, 20 nt, Mycobacterium avium subsp. paratuberculosis
cccgcgggucgucgggcggc

SEQ ID NO: 2977299 - RNA, 14 nt, Mycobacterium avium subsp. paratuberculosis
cccgcgggugcagc

SEQ ID NO: 2977300 - RNA, 17 nt, Mycobacterium avium subsp. paratuberculosis
cccgcggucaugcgcgg

SEQ ID NO: 2977301 - RNA, 16 nt, Mycobacterium avium subsp. paratuberculosis
cccgcggucggcggcg

SEQ ID NO: 2977302 - RNA, 15 nt, Mycobacterium avium subsp. paratuberculosis
cccgcggugccgcag

SEQ ID NO: 2977303 - RNA, 20 nt, Mycobacterium avium subsp. paratuberculosis
cccgcggugccgcagcucga

SEQ ID NO: 2977304 - RNA, 22 nt, Mycobacterium avium subsp. paratuberculosis
cccgcggugugcuggccagcac

SEQ ID NO: 2977305 - RNA, 16 nt, Mycobacterium avium subsp. paratuberculosis
cccgcguaaccggcgg

SEQ ID NO: 2977306 - RNA, 17 nt, Mycobacterium avium subsp. paratuberculosis
cccgcguaaccggcggc

SEQ ID NO: 2977307 - RNA, 18 nt, Mycobacterium avium subsp. paratuberculosis
cccgcguaaccggcggcg

SEQ ID NO: 2977308 - RNA, 23 nt, Mycobacterium avium subsp. paratuberculosis
cccgcguaaccggcggcggugag

SEQ ID NO: 2977309 - RNA, 16 nt, Mycobacterium avium subsp. paratuberculosis
cccgcguacagcgggu

SEQ ID NO: 2977310 - RNA, 22 nt, Mycobacterium avium subsp. paratuberculosis
cccgcguauugcacggcggcga

SEQ ID NO: 2977311 - RNA, 18 nt, Mycobacterium avium subsp. paratuberculosis
cccgcgucaucgggcccg

SEQ ID NO: 2977312 - RNA, 18 nt, Mycobacterium avium subsp. paratuberculosis
cccgcguccugcagcgcc

SEQ ID NO: 2977313 - RNA, 19 nt, Mycobacterium avium subsp. paratuberculosis
cccgcguccugcagcgccg

SEQ ID NO: 2977314 - RNA, 21 nt, Mycobacterium avium subsp. paratuberculosis
cccgcguccugcagcgccguc

SEQ ID NO: 2977315 - RNA, 23 nt, Mycobacterium avium subsp. paratuberculosis
cccgcguccugcagcgccguccg

SEQ ID NO: 2977316 - RNA, 14 nt, Mycobacterium avium subsp. paratuberculosis
cccgcgucgcgcag

SEQ ID NO: 2977317 - RNA, 14 nt, Mycobacterium avium subsp. paratuberculosis
cccgcgucguggcc

SEQ ID NO: 2977318 - RNA, 17 nt, Mycobacterium avium subsp. paratuberculosis
cccgcgucguggcccug

SEQ ID NO: 2977319 - RNA, 15 nt, Mycobacterium avium subsp. paratuberculosis
cccgcgugcacaccc

SEQ ID NO: 2977320 - RNA, 20 nt, Mycobacterium avium subsp. paratuberculosis
cccgcguggccgccaggauc

SEQ ID NO: 2977321 - RNA, 16 nt, Mycobacterium avium subsp. paratuberculosis
cccgcgugggcacccc

SEQ ID NO: 2977322 - RNA, 19 nt, Mycobacterium avium subsp. paratuberculosis
cccgcguugcggcgcagcg

SEQ ID NO: 2977323 - RNA, 20 nt, Mycobacterium avium subsp. paratuberculosis
cccgcguuggccagcgccuc

SEQ ID NO: 2977324 - RNA, 13 nt, Mycobacterium avium subsp. paratuberculosis
cccgcuaaagccg

SEQ ID NO: 2977325 - RNA, 15 nt, Mycobacterium avium subsp. paratuberculosis
cccgcuaaagccgac

SEQ ID NO: 2977326 - RNA, 16 nt, Mycobacterium avium subsp. paratuberculosis
cccgcucaccugcggc

SEQ ID NO: 2977327 - RNA, 18 nt, Mycobacterium avium subsp. paratuberculosis
cccgcucaggucggccgc

SEQ ID NO: 2977328 - RNA, 19 nt, Mycobacterium avium subsp. paratuberculosis
cccgcucaguccagcuccc

SEQ ID NO: 2977329 - RNA, 13 nt, Mycobacterium avium subsp. paratuberculosis
cccgcuccagcgg

SEQ ID NO: 2977330 - RNA, 14 nt, Mycobacterium avium subsp. paratuberculosis
cccgcuccagcggc

SEQ ID NO: 2977331 - RNA, 15 nt, Mycobacterium avium subsp. paratuberculosis
cccgcuccagcggcc

SEQ ID NO: 2977332 - RNA, 15 nt, Mycobacterium avium subsp. paratuberculosis
cccgcuccauggcgg

SEQ ID NO: 2977333 - RNA, 18 nt, Mycobacterium avium subsp. paratuberculosis
cccgcuccauggcggcga

SEQ ID NO: 2977334 - RNA, 20 nt, Mycobacterium avium subsp. paratuberculosis
cccgcuccauggcggcgacc

SEQ ID NO: 2977335 - RNA, 12 nt, Mycobacterium avium subsp. paratuberculosis
cccgcuccgacg

SEQ ID NO: 2977336 - RNA, 15 nt, Mycobacterium avium subsp. paratuberculosis
cccgcuccgacgcgg

SEQ ID NO: 2977337 - RNA, 15 nt, Mycobacterium avium subsp. paratuberculosis
cccgcuccgcgggca

SEQ ID NO: 2977338 - RNA, 13 nt, Mycobacterium avium subsp. paratuberculosis
cccgcuccggcgg

SEQ ID NO: 2977339 - RNA, 15 nt, Mycobacterium avium subsp. paratuberculosis
cccgcuccggcggac

SEQ ID NO: 2977340 - RNA, 13 nt, Mycobacterium avium subsp. paratuberculosis
cccgcuccuccuc

SEQ ID NO: 2977341 - RNA, 21 nt, Mycobacterium avium subsp. paratuberculosis
cccgcuccuccucgcgccgcc

SEQ ID NO: 2977342 - RNA, 22 nt, Mycobacterium avium subsp. paratuberculosis
cccgcuccuccucgcgccgcca

SEQ ID NO: 2977343 - RNA, 15 nt, Mycobacterium avium subsp. paratuberculosis
cccgcuccugcaggc

SEQ ID NO: 2977344 - RNA, 23 nt, Mycobacterium avium subsp. paratuberculosis
cccgcucgaggggcuuggcgacg

SEQ ID NO: 2977345 - RNA, 14 nt, Mycobacterium avium subsp. paratuberculosis
cccgcucgaucugg

SEQ ID NO: 2977346 - RNA, 17 nt, Mycobacterium avium subsp. paratuberculosis
cccgcucgaugggugug

SEQ ID NO: 2977347 - RNA, 12 nt, Mycobacterium avium subsp. paratuberculosis
cccgcucgccga

SEQ ID NO: 2977348 - RNA, 21 nt, Mycobacterium avium subsp. paratuberculosis
cccgcucgccgaugacguugc

SEQ ID NO: 2977349 - RNA, 16 nt, Mycobacterium avium subsp. paratuberculosis
cccgcucgcgggcccg

SEQ ID NO: 2977350 - RNA, 17 nt, Mycobacterium avium subsp. paratuberculosis
cccgcucggccagcgcg

SEQ ID NO: 2977351 - RNA, 20 nt, Mycobacterium avium subsp. paratuberculosis
cccgcucggccagcgcgccg

SEQ ID NO: 2977352 - RNA, 22 nt, Mycobacterium avium subsp. paratuberculosis
cccgcucggccagcgcgccgca

SEQ ID NO: 2977353 - RNA, 23 nt, Mycobacterium avium subsp. paratuberculosis
cccgcucggccagcgcgccgcac

SEQ ID NO: 2977354 - RNA, 14 nt, Mycobacterium avium subsp. paratuberculosis
cccgcucggcgauc

SEQ ID NO: 2977355 - RNA, 15 nt, Mycobacterium avium subsp. paratuberculosis
cccgcucggcgaucu

SEQ ID NO: 2977356 - RNA, 16 nt, Mycobacterium avium subsp. paratuberculosis
cccgcucggcgggucg

SEQ ID NO: 2977357 - RNA, 16 nt, Mycobacterium avium subsp. paratuberculosis
cccgcucggucuugau

SEQ ID NO: 2977358 - RNA, 24 nt, Mycobacterium avium subsp. paratuberculosis
cccgcucggucuugaucaggucgc

SEQ ID NO: 2977359 - RNA, 15 nt, Mycobacterium avium subsp. paratuberculosis
cccgcugaaagcucg

SEQ ID NO: 2977360 - RNA, 14 nt, Mycobacterium avium subsp. paratuberculosis
cccgcugaccaggc

SEQ ID NO: 2977361 - RNA, 15 nt, Mycobacterium avium subsp. paratuberculosis
cccgcugaccaggcc

SEQ ID NO: 2977362 - RNA, 15 nt, Mycobacterium avium subsp. paratuberculosis
cccgcugaccgccgc

SEQ ID NO: 2977363 - RNA, 17 nt, Mycobacterium avium subsp. paratuberculosis
cccgcugaccgccgcgc

SEQ ID NO: 2977364 - RNA, 15 nt, Mycobacterium avium subsp. paratuberculosis
cccgcugauccagca

SEQ ID NO: 2977365 - RNA, 12 nt, Mycobacterium avium subsp. paratuberculosis
cccgcugcagcc

SEQ ID NO: 2977366 - RNA, 14 nt, Mycobacterium avium subsp. paratuberculosis
cccgcugcagccgg

SEQ ID NO: 2977367 - RNA, 23 nt, Mycobacterium avium subsp. paratuberculosis
cccgcugcagccgguccggcggc

SEQ ID NO: 2977368 - RNA, 15 nt, Mycobacterium avium subsp. paratuberculosis
cccgcugcagcgccg

SEQ ID NO: 2977369 - RNA, 17 nt, Mycobacterium avium subsp. paratuberculosis
cccgcugcagcgccgag

SEQ ID NO: 2977370 - RNA, 14 nt, Mycobacterium avium subsp. paratuberculosis
cccgcugccggacc

SEQ ID NO: 2977371 - RNA, 15 nt, Mycobacterium avium subsp. paratuberculosis
cccgcugccggaccu

SEQ ID NO: 2977372 - RNA, 16 nt, Mycobacterium avium subsp. paratuberculosis
cccgcugccggaccuc

SEQ ID NO: 2977373 - RNA, 20 nt, Mycobacterium avium subsp. paratuberculosis
cccgcugccggaccucgacc

SEQ ID NO: 2977374 - RNA, 12 nt, Mycobacterium avium subsp. paratuberculosis
cccgcugccguc

SEQ ID NO: 2977375 - RNA, 14 nt, Mycobacterium avium subsp. paratuberculosis
cccgcugcgccgac

SEQ ID NO: 2977376 - RNA, 15 nt, Mycobacterium avium subsp. paratuberculosis
cccgcugcgccgacu

SEQ ID NO: 2977377 - RNA, 13 nt, Mycobacterium avium subsp. paratuberculosis
cccgcugcgcggc

SEQ ID NO: 2977378 - RNA, 15 nt, Mycobacterium avium subsp. paratuberculosis
cccgcugcgcggccg

SEQ ID NO: 2977379 - RNA, 17 nt, Mycobacterium avium subsp. paratuberculosis
cccgcugcgcggccgaa

SEQ ID NO: 2977380 - RNA, 22 nt, Mycobacterium avium subsp. paratuberculosis
cccgcugcgcgggucggcgccg

SEQ ID NO: 2977381 - RNA, 14 nt, Mycobacterium avium subsp. paratuberculosis
cccgcugcggcgca

SEQ ID NO: 2977382 - RNA, 14 nt, Mycobacterium avium subsp. paratuberculosis
cccgcugcucgacc

SEQ ID NO: 2977383 - RNA, 17 nt, Mycobacterium avium subsp. paratuberculosis
cccgcugcucgaccucg

SEQ ID NO: 2977384 - RNA, 18 nt, Mycobacterium avium subsp. paratuberculosis
cccgcugcucgaccucgg

SEQ ID NO: 2977385 - RNA, 14 nt, Mycobacterium avium subsp. paratuberculosis
cccgcugcucuugu

SEQ ID NO: 2977386 - RNA, 20 nt, Mycobacterium avium subsp. paratuberculosis
cccgcuggaacagcgggccg

SEQ ID NO: 2977387 - RNA, 16 nt, Mycobacterium avium subsp. paratuberculosis
cccgcuggaacgccga

SEQ ID NO: 2977388 - RNA, 13 nt, Mycobacterium avium subsp. paratuberculosis
cccgcuggcccgg

SEQ ID NO: 2977389 - RNA, 14 nt, Mycobacterium avium subsp. paratuberculosis
cccgcuggcgccgg

SEQ ID NO: 2977390 - RNA, 16 nt, Mycobacterium avium subsp. paratuberculosis
cccgcuggcgccggcg

SEQ ID NO: 2977391 - RNA, 21 nt, Mycobacterium avium subsp. paratuberculosis
cccgcugucaauccccgcggu

SEQ ID NO: 2977392 - RNA, 20 nt, Mycobacterium avium subsp. paratuberculosis
cccgcugugguccucgucac

SEQ ID NO: 2977393 - RNA, 21 nt, Mycobacterium avium subsp. paratuberculosis
cccgcugugguccucgucacc

SEQ ID NO: 2977394 - RNA, 18 nt, Mycobacterium avium subsp. paratuberculosis
cccgcuucgcccggcugc

SEQ ID NO: 2977395 - RNA, 15 nt, Mycobacterium avium subsp. paratuberculosis
cccgcuucggcucgg

SEQ ID NO: 2977396 - RNA, 16 nt, Mycobacterium avium subsp. paratuberculosis
cccgcuucuggcgggc

SEQ ID NO: 2977397 - RNA, 17 nt, Mycobacterium avium subsp. paratuberculosis
cccgcuucuggcgggcg

SEQ ID NO: 2977398 - RNA, 18 nt, Mycobacterium avium subsp. paratuberculosis
cccgcuucuggcgggcga

SEQ ID NO: 2977399 - RNA, 20 nt, Mycobacterium avium subsp. paratuberculosis
cccgcuugauggcggcgcgg

SEQ ID NO: 2977400 - RNA, 13 nt, Mycobacterium avium subsp. paratuberculosis
cccgcuugccgac

SEQ ID NO: 2977401 - RNA, 14 nt, Mycobacterium avium subsp. paratuberculosis
cccgcuugccggau

SEQ ID NO: 2977402 - RNA, 16 nt, Mycobacterium avium subsp. paratuberculosis
cccgcuuggcggucug

SEQ ID NO: 2977403 - RNA, 16 nt, Mycobacterium avium subsp. paratuberculosis
cccgcuuuugccgucg

SEQ ID NO: 2977404 - RNA, 22 nt, Mycobacterium avium subsp. paratuberculosis
cccgcuuuugccgucggugcgg

SEQ ID NO: 2977405 - RNA, 15 nt, Mycobacterium avium subsp. paratuberculosis
cccggaaagcgcggg

SEQ ID NO: 2977406 - RNA, 22 nt, Mycobacterium avium subsp. paratuberculosis
cccggaaagcgcgggcagccca

SEQ ID NO: 2977407 - RNA, 22 nt, Mycobacterium avium subsp. paratuberculosis
cccggaacagcuuggcgcagcc

SEQ ID NO: 2977408 - RNA, 23 nt, Mycobacterium avium subsp. paratuberculosis
cccggaacagcuuggcgcagccg

SEQ ID NO: 2977409 - RNA, 19 nt, Mycobacterium avium subsp. paratuberculosis
cccggaacccgcguggcag

SEQ ID NO: 2977410 - RNA, 23 nt, Mycobacterium avium subsp. paratuberculosis
cccggaacgcgucgcccacgccg

SEQ ID NO: 2977411 - RNA, 14 nt, Mycobacterium avium subsp. paratuberculosis
cccggaagccgcau

SEQ ID NO: 2977412 - RNA, 13 nt, Mycobacterium avium subsp. paratuberculosis
cccggaaucgucg

SEQ ID NO: 2977413 - RNA, 19 nt, Mycobacterium avium subsp. paratuberculosis
cccggaaucgucggccacg

SEQ ID NO: 2977414 - RNA, 20 nt, Mycobacterium avium subsp. paratuberculosis
cccggaaucgucggccacgc

SEQ ID NO: 2977415 - RNA, 22 nt, Mycobacterium avium subsp. paratuberculosis
cccggaaugugcuugaucagcg

SEQ ID NO: 2977416 - RNA, 21 nt, Mycobacterium avium subsp. paratuberculosis
cccggacaacggaucgagcgc

SEQ ID NO: 2977417 - RNA, 17 nt, Mycobacterium avium subsp. paratuberculosis
cccggacaccccguagg

SEQ ID NO: 2977418 - RNA, 17 nt, Mycobacterium avium subsp. paratuberculosis
cccggacagccacucca

SEQ ID NO: 2977419 - RNA, 14 nt, Mycobacterium avium subsp. paratuberculosis
cccggacagcgcga

SEQ ID NO: 2977420 - RNA, 16 nt, Mycobacterium avium subsp. paratuberculosis
cccggacagcgcgacg

SEQ ID NO: 2977421 - RNA, 22 nt, Mycobacterium avium subsp. paratuberculosis
cccggacagcgcgacgcacgcc

SEQ ID NO: 2977422 - RNA, 14 nt, Mycobacterium avium subsp. paratuberculosis
cccggacaggucgg

SEQ ID NO: 2977423 - RNA, 13 nt, Mycobacterium avium subsp. paratuberculosis
cccggaccacguc

SEQ ID NO: 2977424 - RNA, 14 nt, Mycobacterium avium subsp. paratuberculosis
cccggaccacgucc

SEQ ID NO: 2977425 - RNA, 17 nt, Mycobacterium avium subsp. paratuberculosis
cccggacccgcucgccg

SEQ ID NO: 2977426 - RNA, 13 nt, Mycobacterium avium subsp. paratuberculosis
cccggaccgccgc

SEQ ID NO: 2977427 - RNA, 14 nt, Mycobacterium avium subsp. paratuberculosis
cccggaccgccgcg

SEQ ID NO: 2977428 - RNA, 15 nt, Mycobacterium avium subsp. paratuberculosis
cccggaccggagacg

SEQ ID NO: 2977429 - RNA, 14 nt, Mycobacterium avium subsp. paratuberculosis
cccggaccggccgu

SEQ ID NO: 2977430 - RNA, 15 nt, Mycobacterium avium subsp. paratuberculosis
cccggaccggccgug

SEQ ID NO: 2977431 - RNA, 17 nt, Mycobacterium avium subsp. paratuberculosis
cccggaccggccgugcg

SEQ ID NO: 2977432 - RNA, 19 nt, Mycobacterium avium subsp. paratuberculosis
cccggaccgggugaccggc

SEQ ID NO: 2977433 - RNA, 20 nt, Mycobacterium avium subsp. paratuberculosis
cccggaccgggugaccggcg

SEQ ID NO: 2977434 - RNA, 23 nt, Mycobacterium avium subsp. paratuberculosis
cccggaccgggugaccggcgcgc

SEQ ID NO: 2977435 - RNA, 13 nt, Mycobacterium avium subsp. paratuberculosis
cccggacgaugac

SEQ ID NO: 2977436 - RNA, 15 nt, Mycobacterium avium subsp. paratuberculosis
cccggacgaugccgc

SEQ ID NO: 2977437 - RNA, 16 nt, Mycobacterium avium subsp. paratuberculosis
cccggacgaugccgcg

SEQ ID NO: 2977438 - RNA, 14 nt, Mycobacterium avium subsp. paratuberculosis
cccggacgaugcgc

SEQ ID NO: 2977439 - RNA, 18 nt, Mycobacterium avium subsp. paratuberculosis
cccggacgaugcgcaccc

SEQ ID NO: 2977440 - RNA, 17 nt, Mycobacterium avium subsp. paratuberculosis
cccggacgcgcacacgg

SEQ ID NO: 2977441 - RNA, 13 nt, Mycobacterium avium subsp. paratuberculosis
cccggacgcugcg

SEQ ID NO: 2977442 - RNA, 15 nt, Mycobacterium avium subsp. paratuberculosis
cccggacggagccgu

SEQ ID NO: 2977443 - RNA, 20 nt, Mycobacterium avium subsp. paratuberculosis
cccggacggccgaaacgccc

SEQ ID NO: 2977444 - RNA, 20 nt, Mycobacterium avium subsp. paratuberculosis
cccggacgugaucgcggugg

SEQ ID NO: 2977445 - RNA, 21 nt, Mycobacterium avium subsp. paratuberculosis
cccggacuccucgguggccuc

SEQ ID NO: 2977446 - RNA, 18 nt, Mycobacterium avium subsp. paratuberculosis
cccggagaaaccgucggc

SEQ ID NO: 2977447 - RNA, 22 nt, Mycobacterium avium subsp. paratuberculosis
cccggagaaaccgucggcccgc

SEQ ID NO: 2977448 - RNA, 23 nt, Mycobacterium avium subsp. paratuberculosis
cccggagaaaccgucggcccgcc

SEQ ID NO: 2977449 - RNA, 14 nt, Mycobacterium avium subsp. paratuberculosis
cccggagagccggu

SEQ ID NO: 2977450 - RNA, 18 nt, Mycobacterium avium subsp. paratuberculosis
cccggagauccggccgcu

SEQ ID NO: 2977451 - RNA, 20 nt, Mycobacterium avium subsp. paratuberculosis
cccggagauccggccgcugg

SEQ ID NO: 2977452 - RNA, 14 nt, Mycobacterium avium subsp. paratuberculosis
cccggagcugucgg

SEQ ID NO: 2977453 - RNA, 19 nt, Mycobacterium avium subsp. paratuberculosis
cccggagcugucggugacg

SEQ ID NO: 2977454 - RNA, 15 nt, Mycobacterium avium subsp. paratuberculosis
cccggaucagcugac

SEQ ID NO: 2977455 - RNA, 20 nt, Mycobacterium avium subsp. paratuberculosis
cccggaucagcugaccggcg

SEQ ID NO: 2977456 - RNA, 16 nt, Mycobacterium avium subsp. paratuberculosis
cccggauccgucgccc

SEQ ID NO: 2977457 - RNA, 17 nt, Mycobacterium avium subsp. paratuberculosis
cccggauccgucgcccc

SEQ ID NO: 2977458 - RNA, 21 nt, Mycobacterium avium subsp. paratuberculosis
cccggauccgucgccccgcac

SEQ ID NO: 2977459 - RNA, 14 nt, Mycobacterium avium subsp. paratuberculosis
cccggaucgccgaa

SEQ ID NO: 2977460 - RNA, 21 nt, Mycobacterium avium subsp. paratuberculosis
cccggaucgucuugcggccca

SEQ ID NO: 2977461 - RNA, 22 nt, Mycobacterium avium subsp. paratuberculosis
cccggaucuugccgucggccgc

SEQ ID NO: 2977462 - RNA, 23 nt, Mycobacterium avium subsp. paratuberculosis
cccggaucuugccgucggccgcc

SEQ ID NO: 2977463 - RNA, 17 nt, Mycobacterium avium subsp. paratuberculosis
cccggaugaccagggug

SEQ ID NO: 2977464 - RNA, 22 nt, Mycobacterium avium subsp. paratuberculosis
cccggaugauguucuccggccc

SEQ ID NO: 2977465 - RNA, 16 nt, Mycobacterium avium subsp. paratuberculosis
cccggaugccggcgcc

SEQ ID NO: 2977466 - RNA, 17 nt, Mycobacterium avium subsp. paratuberculosis
cccggaugcugcggguc

SEQ ID NO: 2977467 - RNA, 20 nt, Mycobacterium avium subsp. paratuberculosis
cccggaugcugcgggucagc

SEQ ID NO: 2977468 - RNA, 19 nt, Mycobacterium avium subsp. paratuberculosis
cccggauggagcgcgacgg

SEQ ID NO: 2977469 - RNA, 22 nt, Mycobacterium avium subsp. paratuberculosis
cccggauggagcgcgacgggcu

SEQ ID NO: 2977470 - RNA, 17 nt, Mycobacterium avium subsp. paratuberculosis
cccggauggucugcagc

SEQ ID NO: 2977471 - RNA, 14 nt, Mycobacterium avium subsp. paratuberculosis
cccggaugucgggc

SEQ ID NO: 2977472 - RNA, 17 nt, Mycobacterium avium subsp. paratuberculosis
cccggaugucgggcgag

SEQ ID NO: 2977473 - RNA, 19 nt, Mycobacterium avium subsp. paratuberculosis
cccggaugucgggcgaggu

SEQ ID NO: 2977474 - RNA, 19 nt, Mycobacterium avium subsp. paratuberculosis
cccggaugucguagacgga

SEQ ID NO: 2977475 - RNA, 19 nt, Mycobacterium avium subsp. paratuberculosis
cccggaugucgugcggucg

SEQ ID NO: 2977476 - RNA, 21 nt, Mycobacterium avium subsp. paratuberculosis
cccggaugucgugcggucgca

SEQ ID NO: 2977477 - RNA, 21 nt, Mycobacterium avium subsp. paratuberculosis
cccggauuucgucccagucca

SEQ ID NO: 2977478 - RNA, 17 nt, Mycobacterium avium subsp. paratuberculosis
cccggcaacaccggcgg

SEQ ID NO: 2977479 - RNA, 18 nt, Mycobacterium avium subsp. paratuberculosis
cccggcaacaccggcggc

SEQ ID NO: 2977480 - RNA, 21 nt, Mycobacterium avium subsp. paratuberculosis
cccggcaaccgaaucgagccg

SEQ ID NO: 2977481 - RNA, 12 nt, Mycobacterium avium subsp. paratuberculosis
cccggcaccacc

SEQ ID NO: 2977482 - RNA, 14 nt, Mycobacterium avium subsp. paratuberculosis
cccggcaccaccac

SEQ ID NO: 2977483 - RNA, 20 nt, Mycobacterium avium subsp. paratuberculosis
cccggcaccaccacccccga

SEQ ID NO: 2977484 - RNA, 16 nt, Mycobacterium avium subsp. paratuberculosis
cccggcaccgcggcgg

SEQ ID NO: 2977485 - RNA, 15 nt, Mycobacterium avium subsp. paratuberculosis
cccggcaccggugcg

SEQ ID NO: 2977486 - RNA, 12 nt, Mycobacterium avium subsp. paratuberculosis
cccggcacgaac

SEQ ID NO: 2977487 - RNA, 19 nt, Mycobacterium avium subsp. paratuberculosis
cccggcagaacgacgccag

SEQ ID NO: 2977488 - RNA, 16 nt, Mycobacterium avium subsp. paratuberculosis
cccggcagaucgcggc

SEQ ID NO: 2977489 - RNA, 18 nt, Mycobacterium avium subsp. paratuberculosis
cccggcagaucgcggccc

SEQ ID NO: 2977490 - RNA, 20 nt, Mycobacterium avium subsp. paratuberculosis
cccggcagaucgcggcccgc

SEQ ID NO: 2977491 - RNA, 18 nt, Mycobacterium avium subsp. paratuberculosis
cccggcagccgcuccggc

SEQ ID NO: 2977492 - RNA, 20 nt, Mycobacterium avium subsp. paratuberculosis
cccggcagccgcuccggccc

SEQ ID NO: 2977493 - RNA, 22 nt, Mycobacterium avium subsp. paratuberculosis
cccggcagccgcuccggcccga

SEQ ID NO: 2977494 - RNA, 14 nt, Mycobacterium avium subsp. paratuberculosis
cccggcagccgggg

SEQ ID NO: 2977495 - RNA, 15 nt, Mycobacterium avium subsp. paratuberculosis
cccggcagccggggu

SEQ ID NO: 2977496 - RNA, 23 nt, Mycobacterium avium subsp. paratuberculosis
cccggcagccggggugcccgggc

SEQ ID NO: 2977497 - RNA, 21 nt, Mycobacterium avium subsp. paratuberculosis
cccggcauagagcuggugggc

SEQ ID NO: 2977498 - RNA, 15 nt, Mycobacterium avium subsp. paratuberculosis
cccggcaucccaccc

SEQ ID NO: 2977499 - RNA, 13 nt, Mycobacterium avium subsp. paratuberculosis
cccggcaucgaca

SEQ ID NO: 2977500 - RNA, 20 nt, Mycobacterium avium subsp. paratuberculosis
cccggcaucgacaugcccgg

SEQ ID NO: 2977501 - RNA, 11 nt, Mycobacterium avium subsp. paratuberculosis
cccggccacca

SEQ ID NO: 2977502 - RNA, 17 nt, Mycobacterium avium subsp. paratuberculosis
cccggccaccagggcga

SEQ ID NO: 2977503 - RNA, 22 nt, Mycobacterium avium subsp. paratuberculosis
cccggccaccagggcgaccgcc

SEQ ID NO: 2977504 - RNA, 14 nt, Mycobacterium avium subsp. paratuberculosis
cccggccaccccgc

SEQ ID NO: 2977505 - RNA, 13 nt, Mycobacterium avium subsp. paratuberculosis
cccggccaccgcc

SEQ ID NO: 2977506 - RNA, 14 nt, Mycobacterium avium subsp. paratuberculosis
cccggccaccgccg

SEQ ID NO: 2977507 - RNA, 15 nt, Mycobacterium avium subsp. paratuberculosis
cccggccaccgccgc

SEQ ID NO: 2977508 - RNA, 16 nt, Mycobacterium avium subsp. paratuberculosis
cccggccaccgccgcc

SEQ ID NO: 2977509 - RNA, 14 nt, Mycobacterium avium subsp. paratuberculosis
cccggccacgccgg

SEQ ID NO: 2977510 - RNA, 16 nt, Mycobacterium avium subsp. paratuberculosis
cccggccacgccgggu

SEQ ID NO: 2977511 - RNA, 17 nt, Mycobacterium avium subsp. paratuberculosis
cccggccacgccggguu

SEQ ID NO: 2977512 - RNA, 13 nt, Mycobacterium avium subsp. paratuberculosis
cccggccacgucg

SEQ ID NO: 2977513 - RNA, 15 nt, Mycobacterium avium subsp. paratuberculosis
cccggccacgucgau

SEQ ID NO: 2977514 - RNA, 20 nt, Mycobacterium avium subsp. paratuberculosis
cccggccacucgccgcgaac

SEQ ID NO: 2977515 - RNA, 14 nt, Mycobacterium avium subsp. paratuberculosis
cccggccagcaccc

SEQ ID NO: 2977516 - RNA, 16 nt, Mycobacterium avium subsp. paratuberculosis
cccggccagcacccgc

SEQ ID NO: 2977517 - RNA, 17 nt, Mycobacterium avium subsp. paratuberculosis
cccggccagcacccgcu

SEQ ID NO: 2977518 - RNA, 13 nt, Mycobacterium avium subsp. paratuberculosis
cccggccagcacg

SEQ ID NO: 2977519 - RNA, 18 nt, Mycobacterium avium subsp. paratuberculosis
cccggccagccggccgcu

SEQ ID NO: 2977520 - RNA, 14 nt, Mycobacterium avium subsp. paratuberculosis
cccggccagccggu

SEQ ID NO: 2977521 - RNA, 23 nt, Mycobacterium avium subsp. paratuberculosis
cccggccagcgucuccggcgggc

SEQ ID NO: 2977522 - RNA, 22 nt, Mycobacterium avium subsp. paratuberculosis
cccggccaggaucuugucggcg

SEQ ID NO: 2977523 - RNA, 14 nt, Mycobacterium avium subsp. paratuberculosis
cccggccagguucc

SEQ ID NO: 2977524 - RNA, 21 nt, Mycobacterium avium subsp. paratuberculosis
cccggccagguuccaccgggc

SEQ ID NO: 2977525 - RNA, 22 nt, Mycobacterium avium subsp. paratuberculosis
cccggccagguuccaccgggcg

SEQ ID NO: 2977526 - RNA, 19 nt, Mycobacterium avium subsp. paratuberculosis
cccggccaguccggcagca

SEQ ID NO: 2977527 - RNA, 22 nt, Mycobacterium avium subsp. paratuberculosis
cccggccaguccggcagcagcg

SEQ ID NO: 2977528 - RNA, 23 nt, Mycobacterium avium subsp. paratuberculosis
cccggccaguccggcagcagcga

SEQ ID NO: 2977529 - RNA, 12 nt, Mycobacterium avium subsp. paratuberculosis
cccggccaguug

SEQ ID NO: 2977530 - RNA, 21 nt, Mycobacterium avium subsp. paratuberculosis
cccggccaucaugcccaccau

SEQ ID NO: 2977531 - RNA, 14 nt, Mycobacterium avium subsp. paratuberculosis
cccggcccaccggc

SEQ ID NO: 2977532 - RNA, 16 nt, Mycobacterium avium subsp. paratuberculosis
cccggcccaccggccc

SEQ ID NO: 2977533 - RNA, 17 nt, Mycobacterium avium subsp. paratuberculosis
cccggcccaccggcccg

SEQ ID NO: 2977534 - RNA, 18 nt, Mycobacterium avium subsp. paratuberculosis
cccggcccaccggcccgg

SEQ ID NO: 2977535 - RNA, 21 nt, Mycobacterium avium subsp. paratuberculosis
cccggcccacgccgucgucgu

SEQ ID NO: 2977536 - RNA, 14 nt, Mycobacterium avium subsp. paratuberculosis
cccggcccagccgg

SEQ ID NO: 2977537 - RNA, 17 nt, Mycobacterium avium subsp. paratuberculosis
cccggcccagccggucg

SEQ ID NO: 2977538 - RNA, 22 nt, Mycobacterium avium subsp. paratuberculosis
cccggcccagccggucgccggg

SEQ ID NO: 2977539 - RNA, 15 nt, Mycobacterium avium subsp. paratuberculosis
cccggcccaggcaca

SEQ ID NO: 2977540 - RNA, 18 nt, Mycobacterium avium subsp. paratuberculosis
cccggcccaggcacagcg

SEQ ID NO: 2977541 - RNA, 15 nt, Mycobacterium avium subsp. paratuberculosis
cccggcccaucaccg

SEQ ID NO: 2977542 - RNA, 17 nt, Mycobacterium avium subsp. paratuberculosis
cccggcccaucaccgga

SEQ ID NO: 2977543 - RNA, 15 nt, Mycobacterium avium subsp. paratuberculosis
cccggccccaccgcc

SEQ ID NO: 2977544 - RNA, 20 nt, Mycobacterium avium subsp. paratuberculosis
cccggccccaccgccgcugc

SEQ ID NO: 2977545 - RNA, 18 nt, Mycobacterium avium subsp. paratuberculosis
cccggcccgcaugcaccg

SEQ ID NO: 2977546 - RNA, 12 nt, Mycobacterium avium subsp. paratuberculosis
cccggcccgccg

SEQ ID NO: 2977547 - RNA, 16 nt, Mycobacterium avium subsp. paratuberculosis
cccggcccgccgcugc

SEQ ID NO: 2977548 - RNA, 12 nt, Mycobacterium avium subsp. paratuberculosis
cccggcccgcug

SEQ ID NO: 2977549 - RNA, 22 nt, Mycobacterium avium subsp. paratuberculosis
cccggcccggaacgcgucgccc

SEQ ID NO: 2977550 - RNA, 15 nt, Mycobacterium avium subsp. paratuberculosis
cccggcccggcgaug

SEQ ID NO: 2977551 - RNA, 14 nt, Mycobacterium avium subsp. paratuberculosis
cccggcccggcgcg

SEQ ID NO: 2977552 - RNA, 16 nt, Mycobacterium avium subsp. paratuberculosis
cccggcccggcgcggc

SEQ ID NO: 2977553 - RNA, 18 nt, Mycobacterium avium subsp. paratuberculosis
cccggcccggcgcggccg

SEQ ID NO: 2977554 - RNA, 15 nt, Mycobacterium avium subsp. paratuberculosis
cccggcccguccaga

SEQ ID NO: 2977555 - RNA, 17 nt, Mycobacterium avium subsp. paratuberculosis
cccggcccguccagauc

SEQ ID NO: 2977556 - RNA, 19 nt, Mycobacterium avium subsp. paratuberculosis
cccggcccgucgagcggcu

SEQ ID NO: 2977557 - RNA, 21 nt, Mycobacterium avium subsp. paratuberculosis
cccggcccuauggcaucgcca

SEQ ID NO: 2977558 - RNA, 11 nt, Mycobacterium avium subsp. paratuberculosis
cccggccgacg

SEQ ID NO: 2977559 - RNA, 17 nt, Mycobacterium avium subsp. paratuberculosis
cccggccgacgaugaac

SEQ ID NO: 2977560 - RNA, 12 nt, Mycobacterium avium subsp. paratuberculosis
cccggccgacgg

SEQ ID NO: 2977561 - RNA, 14 nt, Mycobacterium avium subsp. paratuberculosis
cccggccgacgggc

SEQ ID NO: 2977562 - RNA, 15 nt, Mycobacterium avium subsp. paratuberculosis
cccggccgacgggcg

SEQ ID NO: 2977563 - RNA, 17 nt, Mycobacterium avium subsp. paratuberculosis
cccggccgagccggcgu

SEQ ID NO: 2977564 - RNA, 19 nt, Mycobacterium avium subsp. paratuberculosis
cccggccgagccggcguac

SEQ ID NO: 2977565 - RNA, 12 nt, Mycobacterium avium subsp. paratuberculosis
cccggccgagcg

SEQ ID NO: 2977566 - RNA, 13 nt, Mycobacterium avium subsp. paratuberculosis
cccggccgagcgc

SEQ ID NO: 2977567 - RNA, 17 nt, Mycobacterium avium subsp. paratuberculosis
cccggccgagcgcagcg

SEQ ID NO: 2977568 - RNA, 14 nt, Mycobacterium avium subsp. paratuberculosis
cccggccgagcgcg

SEQ ID NO: 2977569 - RNA, 17 nt, Mycobacterium avium subsp. paratuberculosis
cccggccgagcgcgccg

SEQ ID NO: 2977570 - RNA, 18 nt, Mycobacterium avium subsp. paratuberculosis
cccggccgcacaccacca

SEQ ID NO: 2977571 - RNA, 19 nt, Mycobacterium avium subsp. paratuberculosis
cccggccgcacaccaccac

SEQ ID NO: 2977572 - RNA, 22 nt, Mycobacterium avium subsp. paratuberculosis
cccggccgcacaccaccacgug

SEQ ID NO: 2977573 - RNA, 11 nt, Mycobacterium avium subsp. paratuberculosis
cccggccgcca

SEQ ID NO: 2977574 - RNA, 13 nt, Mycobacterium avium subsp. paratuberculosis
cccggccgccgag

SEQ ID NO: 2977575 - RNA, 12 nt, Mycobacterium avium subsp. paratuberculosis
cccggccgccgg

SEQ ID NO: 2977576 - RNA, 15 nt, Mycobacterium avium subsp. paratuberculosis
cccggccgccgggac

SEQ ID NO: 2977577 - RNA, 16 nt, Mycobacterium avium subsp. paratuberculosis
cccggccgccgggacg

SEQ ID NO: 2977578 - RNA, 15 nt, Mycobacterium avium subsp. paratuberculosis
cccggccgcgcaccg

SEQ ID NO: 2977579 - RNA, 18 nt, Mycobacterium avium subsp. paratuberculosis
cccggccgcgcaccgccc

SEQ ID NO: 2977580 - RNA, 16 nt, Mycobacterium avium subsp. paratuberculosis
cccggccgcgccggau

SEQ ID NO: 2977581 - RNA, 16 nt, Mycobacterium avium subsp. paratuberculosis
cccggccggcccgccc

SEQ ID NO: 2977582 - RNA, 23 nt, Mycobacterium avium subsp. paratuberculosis
cccggccggcccgcccggcggcg

SEQ ID NO: 2977583 - RNA, 15 nt, Mycobacterium avium subsp. paratuberculosis
cccggccggcgcgac

SEQ ID NO: 2977584 - RNA, 20 nt, Mycobacterium avium subsp. paratuberculosis
cccggccggcgcgaccagcg

SEQ ID NO: 2977585 - RNA, 10 nt, Mycobacterium avium subsp. paratuberculosis
cccggccggu

SEQ ID NO: 2977586 - RNA, 19 nt, Mycobacterium avium subsp. paratuberculosis
cccggccggucgccgaugg

SEQ ID NO: 2977587 - RNA, 21 nt, Mycobacterium avium subsp. paratuberculosis
cccggccggucgccugcuucu

SEQ ID NO: 2977588 - RNA, 22 nt, Mycobacterium avium subsp. paratuberculosis
cccggccggucgccugcuucug

SEQ ID NO: 2977589 - RNA, 16 nt, Mycobacterium avium subsp. paratuberculosis
cccggccgguggccgg

SEQ ID NO: 2977590 - RNA, 22 nt, Mycobacterium avium subsp. paratuberculosis
cccggccgguggccggugggcg

SEQ ID NO: 2977591 - RNA, 12 nt, Mycobacterium avium subsp. paratuberculosis
cccggccgugga

SEQ ID NO: 2977592 - RNA, 19 nt, Mycobacterium avium subsp. paratuberculosis
cccggccguggacccgccc

SEQ ID NO: 2977593 - RNA, 21 nt, Mycobacterium avium subsp. paratuberculosis
cccggccguggacccgccccg

SEQ ID NO: 2977594 - RNA, 22 nt, Mycobacterium avium subsp. paratuberculosis
cccggccguucuugcgggugau

SEQ ID NO: 2977595 - RNA, 13 nt, Mycobacterium avium subsp. paratuberculosis
cccggcgaaccgg

SEQ ID NO: 2977596 - RNA, 18 nt, Mycobacterium avium subsp. paratuberculosis
cccggcgaacgccucggu

SEQ ID NO: 2977597 - RNA, 18 nt, Mycobacterium avium subsp. paratuberculosis
cccggcgaaucagcagcu

SEQ ID NO: 2977598 - RNA, 13 nt, Mycobacterium avium subsp. paratuberculosis
cccggcgaauucg

SEQ ID NO: 2977599 - RNA, 13 nt, Mycobacterium avium subsp. paratuberculosis
cccggcgaccacc

SEQ ID NO: 2977600 - RNA, 15 nt, Mycobacterium avium subsp. paratuberculosis
cccggcgaccacccu

SEQ ID NO: 2977601 - RNA, 14 nt, Mycobacterium avium subsp. paratuberculosis
cccggcgaccagca

SEQ ID NO: 2977602 - RNA, 18 nt, Mycobacterium avium subsp. paratuberculosis
cccggcgaccagcagguc

SEQ ID NO: 2977603 - RNA, 13 nt, Mycobacterium avium subsp. paratuberculosis
cccggcgacgaag

SEQ ID NO: 2977604 - RNA, 15 nt, Mycobacterium avium subsp. paratuberculosis
cccggcgacgaagca

SEQ ID NO: 2977605 - RNA, 17 nt, Mycobacterium avium subsp. paratuberculosis
cccggcgacgaagcagc

SEQ ID NO: 2977606 - RNA, 19 nt, Mycobacterium avium subsp. paratuberculosis
cccggcgacgcggcgggaa

SEQ ID NO: 2977607 - RNA, 13 nt, Mycobacterium avium subsp. paratuberculosis
cccggcgacggcg

SEQ ID NO: 2977608 - RNA, 17 nt, Mycobacterium avium subsp. paratuberculosis
cccggcgacggcgccug

SEQ ID NO: 2977609 - RNA, 15 nt, Mycobacterium avium subsp. paratuberculosis
cccggcgacggcggc

SEQ ID NO: 2977610 - RNA, 19 nt, Mycobacterium avium subsp. paratuberculosis
cccggcgacggcggugggc

SEQ ID NO: 2977611 - RNA, 14 nt, Mycobacterium avium subsp. paratuberculosis
cccggcgacgucgc

SEQ ID NO: 2977612 - RNA, 12 nt, Mycobacterium avium subsp. paratuberculosis
cccggcgagcac

SEQ ID NO: 2977613 - RNA, 15 nt, Mycobacterium avium subsp. paratuberculosis
cccggcgagcacgcc

SEQ ID NO: 2977614 - RNA, 19 nt, Mycobacterium avium subsp. paratuberculosis
cccggcgagcacgccgccg

SEQ ID NO: 2977615 - RNA, 16 nt, Mycobacterium avium subsp. paratuberculosis
cccggcgagcagcccg

SEQ ID NO: 2977616 - RNA, 17 nt, Mycobacterium avium subsp. paratuberculosis
cccggcgagcgacgcca

SEQ ID NO: 2977617 - RNA, 22 nt, Mycobacterium avium subsp. paratuberculosis
cccggcgagcgcgugcacgaac

SEQ ID NO: 2977618 - RNA, 13 nt, Mycobacterium avium subsp. paratuberculosis
cccggcgagcggc

SEQ ID NO: 2977619 - RNA, 15 nt, Mycobacterium avium subsp. paratuberculosis
cccggcgagcggcac

SEQ ID NO: 2977620 - RNA, 16 nt, Mycobacterium avium subsp. paratuberculosis
cccggcgaggccaggc

SEQ ID NO: 2977621 - RNA, 18 nt, Mycobacterium avium subsp. paratuberculosis
cccggcgaggccaggcgu

SEQ ID NO: 2977622 - RNA, 17 nt, Mycobacterium avium subsp. paratuberculosis
cccggcgaucucggaga

SEQ ID NO: 2977623 - RNA, 13 nt, Mycobacterium avium subsp. paratuberculosis
cccggcgaugauc

SEQ ID NO: 2977624 - RNA, 15 nt, Mycobacterium avium subsp. paratuberculosis
cccggcgaugaucag

SEQ ID NO: 2977625 - RNA, 17 nt, Mycobacterium avium subsp. paratuberculosis
cccggcgaugccgagcc

SEQ ID NO: 2977626 - RNA, 19 nt, Mycobacterium avium subsp. paratuberculosis
cccggcgaugccgagcccu

SEQ ID NO: 2977627 - RNA, 16 nt, Mycobacterium avium subsp. paratuberculosis
cccggcgaugucgggc

SEQ ID NO: 2977628 - RNA, 21 nt, Mycobacterium avium subsp. paratuberculosis
cccggcgaugucgggcaccug

SEQ ID NO: 2977629 - RNA, 20 nt, Mycobacterium avium subsp. paratuberculosis
cccggcgcaccaggcgccac

SEQ ID NO: 2977630 - RNA, 12 nt, Mycobacterium avium subsp. paratuberculosis
cccggcgcagca

SEQ ID NO: 2977631 - RNA, 16 nt, Mycobacterium avium subsp. paratuberculosis
cccggcgcagcaacuc

SEQ ID NO: 2977632 - RNA, 15 nt, Mycobacterium avium subsp. paratuberculosis
cccggcgcagcgccg

SEQ ID NO: 2977633 - RNA, 18 nt, Mycobacterium avium subsp. paratuberculosis
cccggcgcagcgccgcgc

SEQ ID NO: 2977634 - RNA, 12 nt, Mycobacterium avium subsp. paratuberculosis
cccggcgccacg

SEQ ID NO: 2977635 - RNA, 22 nt, Mycobacterium avium subsp. paratuberculosis
cccggcgccacgcacaccgcgc

SEQ ID NO: 2977636 - RNA, 14 nt, Mycobacterium avium subsp. paratuberculosis
cccggcgccacgcc

SEQ ID NO: 2977637 - RNA, 15 nt, Mycobacterium avium subsp. paratuberculosis
cccggcgccacgccg

SEQ ID NO: 2977638 - RNA, 18 nt, Mycobacterium avium subsp. paratuberculosis
cccggcgccacgccgcga

SEQ ID NO: 2977639 - RNA, 15 nt, Mycobacterium avium subsp. paratuberculosis
cccggcgcccggccg

SEQ ID NO: 2977640 - RNA, 15 nt, Mycobacterium avium subsp. paratuberculosis
cccggcgcccggcgc

SEQ ID NO: 2977641 - RNA, 18 nt, Mycobacterium avium subsp. paratuberculosis
cccggcgcccggcgcgcc

SEQ ID NO: 2977642 - RNA, 22 nt, Mycobacterium avium subsp. paratuberculosis
cccggcgcccuucggcgcccgc

SEQ ID NO: 2977643 - RNA, 12 nt, Mycobacterium avium subsp. paratuberculosis
cccggcgccgac

SEQ ID NO: 2977644 - RNA, 12 nt, Mycobacterium avium subsp. paratuberculosis
cccggcgccgau

SEQ ID NO: 2977645 - RNA, 13 nt, Mycobacterium avium subsp. paratuberculosis
cccggcgccgccg

SEQ ID NO: 2977646 - RNA, 19 nt, Mycobacterium avium subsp. paratuberculosis
cccggcgccgccguucgcc

SEQ ID NO: 2977647 - RNA, 14 nt, Mycobacterium avium subsp. paratuberculosis
cccggcgccggccc

SEQ ID NO: 2977648 - RNA, 19 nt, Mycobacterium avium subsp. paratuberculosis
cccggcgccggcccgcggc

SEQ ID NO: 2977649 - RNA, 14 nt, Mycobacterium avium subsp. paratuberculosis
cccggcgccggcgg

SEQ ID NO: 2977650 - RNA, 15 nt, Mycobacterium avium subsp. paratuberculosis
cccggcgccggcggc

SEQ ID NO: 2977651 - RNA, 14 nt, Mycobacterium avium subsp. paratuberculosis
cccggcgccggucg

SEQ ID NO: 2977652 - RNA, 15 nt, Mycobacterium avium subsp. paratuberculosis
cccggcgccucggcg

SEQ ID NO: 2977653 - RNA, 17 nt, Mycobacterium avium subsp. paratuberculosis
cccggcgccucggcgcc

SEQ ID NO: 2977654 - RNA, 13 nt, Mycobacterium avium subsp. paratuberculosis
cccggcgcgacgg

SEQ ID NO: 2977655 - RNA, 14 nt, Mycobacterium avium subsp. paratuberculosis
cccggcgcgacggc

SEQ ID NO: 2977656 - RNA, 15 nt, Mycobacterium avium subsp. paratuberculosis
cccggcgcgcagccc

SEQ ID NO: 2977657 - RNA, 17 nt, Mycobacterium avium subsp. paratuberculosis
cccggcgcgccgcagga

SEQ ID NO: 2977658 - RNA, 18 nt, Mycobacterium avium subsp. paratuberculosis
cccggcgcgccugcgcgg

SEQ ID NO: 2977659 - RNA, 19 nt, Mycobacterium avium subsp. paratuberculosis
cccggcgcgccugcgcggc

SEQ ID NO: 2977660 - RNA, 23 nt, Mycobacterium avium subsp. paratuberculosis
cccggcgcgcguauuccagcgcc

SEQ ID NO: 2977661 - RNA, 21 nt, Mycobacterium avium subsp. paratuberculosis
cccggcgcggaacgcgccggg

SEQ ID NO: 2977662 - RNA, 22 nt, Mycobacterium avium subsp. paratuberculosis
cccggcgcggaacgcgccgggc

SEQ ID NO: 2977663 - RNA, 19 nt, Mycobacterium avium subsp. paratuberculosis
cccggcgcggacagcgcgg

SEQ ID NO: 2977664 - RNA, 21 nt, Mycobacterium avium subsp. paratuberculosis
cccggcgcggcaucggcgacg

SEQ ID NO: 2977665 - RNA, 13 nt, Mycobacterium avium subsp. paratuberculosis
cccggcgcggccg

SEQ ID NO: 2977666 - RNA, 15 nt, Mycobacterium avium subsp. paratuberculosis
cccggcgcggccgcc

SEQ ID NO: 2977667 - RNA, 16 nt, Mycobacterium avium subsp. paratuberculosis
cccggcgcggccgccc

SEQ ID NO: 2977668 - RNA, 18 nt, Mycobacterium avium subsp. paratuberculosis
cccggcgcggccgcccag

SEQ ID NO: 2977669 - RNA, 22 nt, Mycobacterium avium subsp. paratuberculosis
cccggcgcggccgcccagcccg

SEQ ID NO: 2977670 - RNA, 14 nt, Mycobacterium avium subsp. paratuberculosis
cccggcgcggccgg

SEQ ID NO: 2977671 - RNA, 17 nt, Mycobacterium avium subsp. paratuberculosis
cccggcgcggcggcgcc

SEQ ID NO: 2977672 - RNA, 18 nt, Mycobacterium avium subsp. paratuberculosis
cccggcgcuaaagccgac

SEQ ID NO: 2977673 - RNA, 20 nt, Mycobacterium avium subsp. paratuberculosis
cccggcgcuaaagccgaccg

SEQ ID NO: 2977674 - RNA, 22 nt, Mycobacterium avium subsp. paratuberculosis
cccggcgcugaagugcagcgca

SEQ ID NO: 2977675 - RNA, 15 nt, Mycobacterium avium subsp. paratuberculosis
cccggcgcugcgccc

SEQ ID NO: 2977676 - RNA, 15 nt, Mycobacterium avium subsp. paratuberculosis
cccggcggacccgga

SEQ ID NO: 2977677 - RNA, 12 nt, Mycobacterium avium subsp. paratuberculosis
cccggcggacgg

SEQ ID NO: 2977678 - RNA, 20 nt, Mycobacterium avium subsp. paratuberculosis
cccggcggacggucccgacg

SEQ ID NO: 2977679 - RNA, 15 nt, Mycobacterium avium subsp. paratuberculosis
cccggcggcaccgcc

SEQ ID NO: 2977680 - RNA, 16 nt, Mycobacterium avium subsp. paratuberculosis
cccggcggcaccgcgg

SEQ ID NO: 2977681 - RNA, 14 nt, Mycobacterium avium subsp. paratuberculosis
cccggcggccacca

SEQ ID NO: 2977682 - RNA, 16 nt, Mycobacterium avium subsp. paratuberculosis
cccggcggccaccaug

SEQ ID NO: 2977683 - RNA, 15 nt, Mycobacterium avium subsp. paratuberculosis
cccggcggccacgca

SEQ ID NO: 2977684 - RNA, 19 nt, Mycobacterium avium subsp. paratuberculosis
cccggcggccacgcaggcg

SEQ ID NO: 2977685 - RNA, 14 nt, Mycobacterium avium subsp. paratuberculosis
cccggcggccccgg

SEQ ID NO: 2977686 - RNA, 16 nt, Mycobacterium avium subsp. paratuberculosis
cccggcggccgcgucg

SEQ ID NO: 2977687 - RNA, 16 nt, Mycobacterium avium subsp. paratuberculosis
cccggcggccggcccc

SEQ ID NO: 2977688 - RNA, 18 nt, Mycobacterium avium subsp. paratuberculosis
cccggcggccggccccgg

SEQ ID NO: 2977689 - RNA, 19 nt, Mycobacterium avium subsp. paratuberculosis
cccggcggccggccccggc

SEQ ID NO: 2977690 - RNA, 18 nt, Mycobacterium avium subsp. paratuberculosis
cccggcggccggccgcgc

SEQ ID NO: 2977691 - RNA, 19 nt, Mycobacterium avium subsp. paratuberculosis
cccggcggccggccgcgcg

SEQ ID NO: 2977692 - RNA, 12 nt, Mycobacterium avium subsp. paratuberculosis
cccggcggcgcu

SEQ ID NO: 2977693 - RNA, 17 nt, Mycobacterium avium subsp. paratuberculosis
cccggcggcgcugcccc

SEQ ID NO: 2977694 - RNA, 12 nt, Mycobacterium avium subsp. paratuberculosis
cccggcgggcag

SEQ ID NO: 2977695 - RNA, 17 nt, Mycobacterium avium subsp. paratuberculosis
cccggcgggcagguuca

SEQ ID NO: 2977696 - RNA, 23 nt, Mycobacterium avium subsp. paratuberculosis
cccggcgggcagguucaucacca

SEQ ID NO: 2977697 - RNA, 12 nt, Mycobacterium avium subsp. paratuberculosis
cccggcgggcca

SEQ ID NO: 2977698 - RNA, 13 nt, Mycobacterium avium subsp. paratuberculosis
cccggcgggccag

SEQ ID NO: 2977699 - RNA, 15 nt, Mycobacterium avium subsp. paratuberculosis
cccggcgggccagau

SEQ ID NO: 2977700 - RNA, 19 nt, Mycobacterium avium subsp. paratuberculosis
cccggcgggcucgccggcc

SEQ ID NO: 2977701 - RNA, 21 nt, Mycobacterium avium subsp. paratuberculosis
cccggcgggcucgccggcccg

SEQ ID NO: 2977702 - RNA, 16 nt, Mycobacterium avium subsp. paratuberculosis
cccggcggggacccga

SEQ ID NO: 2977703 - RNA, 18 nt, Mycobacterium avium subsp. paratuberculosis
cccggcgggucagcaccg

SEQ ID NO: 2977704 - RNA, 19 nt, Mycobacterium avium subsp. paratuberculosis
cccggcgggucagcaccgc

SEQ ID NO: 2977705 - RNA, 15 nt, Mycobacterium avium subsp. paratuberculosis
cccggcgggucugug

SEQ ID NO: 2977706 - RNA, 15 nt, Mycobacterium avium subsp. paratuberculosis
cccggcggucgccga

SEQ ID NO: 2977707 - RNA, 23 nt, Mycobacterium avium subsp. paratuberculosis
cccggcggucggaucgagcucgc

SEQ ID NO: 2977708 - RNA, 22 nt, Mycobacterium avium subsp. paratuberculosis
cccggcgguugauacucgggca

SEQ ID NO: 2977709 - RNA, 17 nt, Mycobacterium avium subsp. paratuberculosis
cccggcguaguucgucg

SEQ ID NO: 2977710 - RNA, 20 nt, Mycobacterium avium subsp. paratuberculosis
cccggcguaguucgucgaac

SEQ ID NO: 2977711 - RNA, 13 nt, Mycobacterium avium subsp. paratuberculosis
cccggcguccagu

SEQ ID NO: 2977712 - RNA, 21 nt, Mycobacterium avium subsp. paratuberculosis
cccggcguccaguagccgccg

SEQ ID NO: 2977713 - RNA, 22 nt, Mycobacterium avium subsp. paratuberculosis
cccggcguccaguagccgccgg

SEQ ID NO: 2977714 - RNA, 12 nt, Mycobacterium avium subsp. paratuberculosis
cccggcgucgau

SEQ ID NO: 2977715 - RNA, 19 nt, Mycobacterium avium subsp. paratuberculosis
cccggcgucgaugaccucg

SEQ ID NO: 2977716 - RNA, 14 nt, Mycobacterium avium subsp. paratuberculosis
cccggcgucggagu

SEQ ID NO: 2977717 - RNA, 20 nt, Mycobacterium avium subsp. paratuberculosis
cccggcgugagcgagccggc

SEQ ID NO: 2977718 - RNA, 23 nt, Mycobacterium avium subsp. paratuberculosis
cccggcgugcaggauccgcucga

SEQ ID NO: 2977719 - RNA, 23 nt, Mycobacterium avium subsp. paratuberculosis
cccggcgugcuccagcaggcgcg

SEQ ID NO: 2977720 - RNA, 16 nt, Mycobacterium avium subsp. paratuberculosis
cccggcgugggccgca

SEQ ID NO: 2977721 - RNA, 18 nt, Mycobacterium avium subsp. paratuberculosis
cccggcgugggccgcagc

SEQ ID NO: 2977722 - RNA, 19 nt, Mycobacterium avium subsp. paratuberculosis
cccggcgugggccgcagcg

SEQ ID NO: 2977723 - RNA, 14 nt, Mycobacterium avium subsp. paratuberculosis
cccggcgugggugu

SEQ ID NO: 2977724 - RNA, 17 nt, Mycobacterium avium subsp. paratuberculosis
cccggcgugucgcgugc

SEQ ID NO: 2977725 - RNA, 23 nt, Mycobacterium avium subsp. paratuberculosis
cccggcguuacccgaacccagcg

SEQ ID NO: 2977726 - RNA, 16 nt, Mycobacterium avium subsp. paratuberculosis
cccggcguuccagcgc

SEQ ID NO: 2977727 - RNA, 17 nt, Mycobacterium avium subsp. paratuberculosis
cccggcguuccagcgca

SEQ ID NO: 2977728 - RNA, 19 nt, Mycobacterium avium subsp. paratuberculosis
cccggcguuccagcgcaca

SEQ ID NO: 2977729 - RNA, 23 nt, Mycobacterium avium subsp. paratuberculosis
cccggcuacucggacgccggcag

SEQ ID NO: 2977730 - RNA, 24 nt, Mycobacterium avium subsp. paratuberculosis
cccggcucaaaccguugaccacca

SEQ ID NO: 2977731 - RNA, 21 nt, Mycobacterium avium subsp. paratuberculosis
cccggcucagcccgauucagc

SEQ ID NO: 2977732 - RNA, 20 nt, Mycobacterium avium subsp. paratuberculosis
cccggcucagcgcgacgugc

SEQ ID NO: 2977733 - RNA, 15 nt, Mycobacterium avium subsp. paratuberculosis
cccggcuccccgacc

SEQ ID NO: 2977734 - RNA, 21 nt, Mycobacterium avium subsp. paratuberculosis
cccggcuccccgaccacaccg

SEQ ID NO: 2977735 - RNA, 21 nt, Mycobacterium avium subsp. paratuberculosis
cccggcucgaaguggcagcgc

SEQ ID NO: 2977736 - RNA, 15 nt, Mycobacterium avium subsp. paratuberculosis
cccggcucgaucgcg

SEQ ID NO: 2977737 - RNA, 18 nt, Mycobacterium avium subsp. paratuberculosis
cccggcucgaucgcgguc

SEQ ID NO: 2977738 - RNA, 18 nt, Mycobacterium avium subsp. paratuberculosis
cccggcucgccgggcugc

SEQ ID NO: 2977739 - RNA, 14 nt, Mycobacterium avium subsp. paratuberculosis
cccggcucgggcca

SEQ ID NO: 2977740 - RNA, 14 nt, Mycobacterium avium subsp. paratuberculosis
cccggcucggugcg

SEQ ID NO: 2977741 - RNA, 14 nt, Mycobacterium avium subsp. paratuberculosis
cccggcucuccauc

SEQ ID NO: 2977742 - RNA, 20 nt, Mycobacterium avium subsp. paratuberculosis
cccggcugcgcagcgcagca

SEQ ID NO: 2977743 - RNA, 15 nt, Mycobacterium avium subsp. paratuberculosis
cccggcugcgccgcg

SEQ ID NO: 2977744 - RNA, 16 nt, Mycobacterium avium subsp. paratuberculosis
cccggcugcgccgcgc

SEQ ID NO: 2977745 - RNA, 20 nt, Mycobacterium avium subsp. paratuberculosis
cccggcugcugcacgacgac

SEQ ID NO: 2977746 - RNA, 12 nt, Mycobacterium avium subsp. paratuberculosis
cccggcuggccg

SEQ ID NO: 2977747 - RNA, 14 nt, Mycobacterium avium subsp. paratuberculosis
cccggcuucgccgc

SEQ ID NO: 2977748 - RNA, 15 nt, Mycobacterium avium subsp. paratuberculosis
cccggcuucgccgcc

SEQ ID NO: 2977749 - RNA, 21 nt, Mycobacterium avium subsp. paratuberculosis
cccggcuucgccgccgcaccg

SEQ ID NO: 2977750 - RNA, 15 nt, Mycobacterium avium subsp. paratuberculosis
cccggcuucgccgcg

SEQ ID NO: 2977751 - RNA, 16 nt, Mycobacterium avium subsp. paratuberculosis
cccggcuucgccgcgc

SEQ ID NO: 2977752 - RNA, 17 nt, Mycobacterium avium subsp. paratuberculosis
cccggcuucgccgcgcu

SEQ ID NO: 2977753 - RNA, 19 nt, Mycobacterium avium subsp. paratuberculosis
cccggcuucgcugcgccgg

SEQ ID NO: 2977754 - RNA, 17 nt, Mycobacterium avium subsp. paratuberculosis
cccgggaaaugcugcac

SEQ ID NO: 2977755 - RNA, 18 nt, Mycobacterium avium subsp. paratuberculosis
cccgggaagccgcagcag

SEQ ID NO: 2977756 - RNA, 18 nt, Mycobacterium avium subsp. paratuberculosis
cccgggaaguucacgucc

SEQ ID NO: 2977757 - RNA, 16 nt, Mycobacterium avium subsp. paratuberculosis
cccgggaugccugccc

SEQ ID NO: 2977758 - RNA, 22 nt, Mycobacterium avium subsp. paratuberculosis
cccgggaugccugcccgcgcag

SEQ ID NO: 2977759 - RNA, 17 nt, Mycobacterium avium subsp. paratuberculosis
cccgggauggaucgagu

SEQ ID NO: 2977760 - RNA, 15 nt, Mycobacterium avium subsp. paratuberculosis
cccgggcaccccggu

SEQ ID NO: 2977761 - RNA, 19 nt, Mycobacterium avium subsp. paratuberculosis
cccgggcacgacggucagc

SEQ ID NO: 2977762 - RNA, 22 nt, Mycobacterium avium subsp. paratuberculosis
cccgggcacgcgagacgagccg

SEQ ID NO: 2977763 - RNA, 13 nt, Mycobacterium avium subsp. paratuberculosis
cccgggcaggcau

SEQ ID NO: 2977764 - RNA, 18 nt, Mycobacterium avium subsp. paratuberculosis
cccgggcaggcggcgcgc

SEQ ID NO: 2977765 - RNA, 21 nt, Mycobacterium avium subsp. paratuberculosis
cccgggcaggcggcgcgccag

SEQ ID NO: 2977766 - RNA, 18 nt, Mycobacterium avium subsp. paratuberculosis
cccgggcaugcccguaga

SEQ ID NO: 2977767 - RNA, 14 nt, Mycobacterium avium subsp. paratuberculosis
cccgggccacccgc

SEQ ID NO: 2977768 - RNA, 20 nt, Mycobacterium avium subsp. paratuberculosis
cccgggccacccgcgaucgg

SEQ ID NO: 2977769 - RNA, 16 nt, Mycobacterium avium subsp. paratuberculosis
cccgggccaggaccgg

SEQ ID NO: 2977770 - RNA, 13 nt, Mycobacterium avium subsp. paratuberculosis
cccgggccagguc

SEQ ID NO: 2977771 - RNA, 14 nt, Mycobacterium avium subsp. paratuberculosis
cccgggccagguuc

SEQ ID NO: 2977772 - RNA, 20 nt, Mycobacterium avium subsp. paratuberculosis
cccgggccagguucgcgccg

SEQ ID NO: 2977773 - RNA, 14 nt, Mycobacterium avium subsp. paratuberculosis
cccgggcccagcac

SEQ ID NO: 2977774 - RNA, 15 nt, Mycobacterium avium subsp. paratuberculosis
cccgggcccagcacc

SEQ ID NO: 2977775 - RNA, 17 nt, Mycobacterium avium subsp. paratuberculosis
cccgggcccagcaccac

SEQ ID NO: 2977776 - RNA, 16 nt, Mycobacterium avium subsp. paratuberculosis
cccgggcccgauggcg

SEQ ID NO: 2977777 - RNA, 15 nt, Mycobacterium avium subsp. paratuberculosis
cccgggcccgcugca

SEQ ID NO: 2977778 - RNA, 17 nt, Mycobacterium avium subsp. paratuberculosis
cccgggcccgcugcagc

SEQ ID NO: 2977779 - RNA, 23 nt, Mycobacterium avium subsp. paratuberculosis
cccgggcccguagcucgcgccga

SEQ ID NO: 2977780 - RNA, 11 nt, Mycobacterium avium subsp. paratuberculosis
cccgggccgca

SEQ ID NO: 2977781 - RNA, 16 nt, Mycobacterium avium subsp. paratuberculosis
cccgggccgccacggc

SEQ ID NO: 2977782 - RNA, 10 nt, Mycobacterium avium subsp. paratuberculosis
cccgggccgg

SEQ ID NO: 2977783 - RNA, 15 nt, Mycobacterium avium subsp. paratuberculosis
cccgggccggacacg

SEQ ID NO: 2977784 - RNA, 20 nt, Mycobacterium avium subsp. paratuberculosis
cccgggccgucaucgccgac

SEQ ID NO: 2977785 - RNA, 22 nt, Mycobacterium avium subsp. paratuberculosis
cccgggccgucaucgccgacgg

SEQ ID NO: 2977786 - RNA, 13 nt, Mycobacterium avium subsp. paratuberculosis
cccgggccguccg

SEQ ID NO: 2977787 - RNA, 14 nt, Mycobacterium avium subsp. paratuberculosis
cccgggccguccgg

SEQ ID NO: 2977788 - RNA, 19 nt, Mycobacterium avium subsp. paratuberculosis
cccgggccguccgggugcg

SEQ ID NO: 2977789 - RNA, 16 nt, Mycobacterium avium subsp. paratuberculosis
cccgggccugcggcgg

SEQ ID NO: 2977790 - RNA, 22 nt, Mycobacterium avium subsp. paratuberculosis
cccgggccuuguugcggcgcac

SEQ ID NO: 2977791 - RNA, 18 nt, Mycobacterium avium subsp. paratuberculosis
cccgggcgagcgucgccg

SEQ ID NO: 2977792 - RNA, 21 nt, Mycobacterium avium subsp. paratuberculosis
cccgggcgagcgucgccgcgu

SEQ ID NO: 2977793 - RNA, 14 nt, Mycobacterium avium subsp. paratuberculosis
cccgggcgaucagc

SEQ ID NO: 2977794 - RNA, 18 nt, Mycobacterium avium subsp. paratuberculosis
cccgggcgaucagcccgc

SEQ ID NO: 2977795 - RNA, 12 nt, Mycobacterium avium subsp. paratuberculosis
cccgggcgaugg

SEQ ID NO: 2977796 - RNA, 22 nt, Mycobacterium avium subsp. paratuberculosis
cccgggcgauggugccgccggu

SEQ ID NO: 2977797 - RNA, 16 nt, Mycobacterium avium subsp. paratuberculosis
cccgggcgccauccgc

SEQ ID NO: 2977798 - RNA, 21 nt, Mycobacterium avium subsp. paratuberculosis
cccgggcgccauccgcagccc

SEQ ID NO: 2977799 - RNA, 16 nt, Mycobacterium avium subsp. paratuberculosis
cccgggcgccgagaac

SEQ ID NO: 2977800 - RNA, 14 nt, Mycobacterium avium subsp. paratuberculosis
cccgggcgccggcg

SEQ ID NO: 2977801 - RNA, 17 nt, Mycobacterium avium subsp. paratuberculosis
cccgggcgccggcgaug

SEQ ID NO: 2977802 - RNA, 13 nt, Mycobacterium avium subsp. paratuberculosis
cccgggcgcgccc

SEQ ID NO: 2977803 - RNA, 14 nt, Mycobacterium avium subsp. paratuberculosis
cccgggcgcgccca

SEQ ID NO: 2977804 - RNA, 19 nt, Mycobacterium avium subsp. paratuberculosis
cccgggcgcgcccacccgc

SEQ ID NO: 2977805 - RNA, 13 nt, Mycobacterium avium subsp. paratuberculosis
cccgggcgcugag

SEQ ID NO: 2977806 - RNA, 14 nt, Mycobacterium avium subsp. paratuberculosis
cccgggcgcugagc

SEQ ID NO: 2977807 - RNA, 14 nt, Mycobacterium avium subsp. paratuberculosis
cccgggcggcccgg

SEQ ID NO: 2977808 - RNA, 18 nt, Mycobacterium avium subsp. paratuberculosis
cccgggcggccugcugca

SEQ ID NO: 2977809 - RNA, 14 nt, Mycobacterium avium subsp. paratuberculosis
cccgggcggcgccg

SEQ ID NO: 2977810 - RNA, 21 nt, Mycobacterium avium subsp. paratuberculosis
cccgggcggcgccgaacucgg

SEQ ID NO: 2977811 - RNA, 12 nt, Mycobacterium avium subsp. paratuberculosis
cccgggcggcgg

SEQ ID NO: 2977812 - RNA, 16 nt, Mycobacterium avium subsp. paratuberculosis
cccgggcuagacgcgc

SEQ ID NO: 2977813 - RNA, 17 nt, Mycobacterium avium subsp. paratuberculosis
cccgggcuaucgcccgg

SEQ ID NO: 2977814 - RNA, 14 nt, Mycobacterium avium subsp. paratuberculosis
cccgggcugcagca

SEQ ID NO: 2977815 - RNA, 12 nt, Mycobacterium avium subsp. paratuberculosis
cccgggcugccc

SEQ ID NO: 2977816 - RNA, 14 nt, Mycobacterium avium subsp. paratuberculosis
cccggggccguccg

SEQ ID NO: 2977817 - RNA, 15 nt, Mycobacterium avium subsp. paratuberculosis
cccggggccguccgg

SEQ ID NO: 2977818 - RNA, 17 nt, Mycobacterium avium subsp. paratuberculosis
cccggggccuccagcca

SEQ ID NO: 2977819 - RNA, 21 nt, Mycobacterium avium subsp. paratuberculosis
cccggggccuccagccagcgc

SEQ ID NO: 2977820 - RNA, 13 nt, Mycobacterium avium subsp. paratuberculosis
cccggggcgcgcu

SEQ ID NO: 2977821 - RNA, 14 nt, Mycobacterium avium subsp. paratuberculosis
cccggggcgcgcug

SEQ ID NO: 2977822 - RNA, 16 nt, Mycobacterium avium subsp. paratuberculosis
cccggggcgcgcuggg

SEQ ID NO: 2977823 - RNA, 19 nt, Mycobacterium avium subsp. paratuberculosis
cccgggggaagcccagcac

SEQ ID NO: 2977824 - RNA, 21 nt, Mycobacterium avium subsp. paratuberculosis
cccgggggaagcccagcaccc

SEQ ID NO: 2977825 - RNA, 16 nt, Mycobacterium avium subsp. paratuberculosis
cccgggggaccagcgc

SEQ ID NO: 2977826 - RNA, 21 nt, Mycobacterium avium subsp. paratuberculosis
cccgggggaccagcgcaaccg

SEQ ID NO: 2977827 - RNA, 13 nt, Mycobacterium avium subsp. paratuberculosis
cccggggguccag

SEQ ID NO: 2977828 - RNA, 14 nt, Mycobacterium avium subsp. paratuberculosis
cccggggguccagg

SEQ ID NO: 2977829 - RNA, 15 nt, Mycobacterium avium subsp. paratuberculosis
cccggggguccaggg

SEQ ID NO: 2977830 - RNA, 23 nt, Mycobacterium avium subsp. paratuberculosis
cccggggguggcggucccggcgg

SEQ ID NO: 2977831 - RNA, 14 nt, Mycobacterium avium subsp. paratuberculosis
cccggggugaugcc

SEQ ID NO: 2977832 - RNA, 20 nt, Mycobacterium avium subsp. paratuberculosis
cccggggugaugccggcggu

SEQ ID NO: 2977833 - RNA, 12 nt, Mycobacterium avium subsp. paratuberculosis
cccggggugcug

SEQ ID NO: 2977834 - RNA, 14 nt, Mycobacterium avium subsp. paratuberculosis
cccggguagcgcag

SEQ ID NO: 2977835 - RNA, 16 nt, Mycobacterium avium subsp. paratuberculosis
cccggguagggcagcc

SEQ ID NO: 2977836 - RNA, 20 nt, Mycobacterium avium subsp. paratuberculosis
cccggguagggcagccacau

SEQ ID NO: 2977837 - RNA, 21 nt, Mycobacterium avium subsp. paratuberculosis
cccggguagggcagccacauc

SEQ ID NO: 2977838 - RNA, 18 nt, Mycobacterium avium subsp. paratuberculosis
cccggguccuggaucagc

SEQ ID NO: 2977839 - RNA, 15 nt, Mycobacterium avium subsp. paratuberculosis
cccggguccuggccc

SEQ ID NO: 2977840 - RNA, 22 nt, Mycobacterium avium subsp. paratuberculosis
cccggguccuggcccccgcccc

SEQ ID NO: 2977841 - RNA, 15 nt, Mycobacterium avium subsp. paratuberculosis
cccgggucgagcggc

SEQ ID NO: 2977842 - RNA, 19 nt, Mycobacterium avium subsp. paratuberculosis
cccgggucgagcggcccgc

SEQ ID NO: 2977843 - RNA, 22 nt, Mycobacterium avium subsp. paratuberculosis
cccgggugcgauggcaacgccg

SEQ ID NO: 2977844 - RNA, 21 nt, Mycobacterium avium subsp. paratuberculosis
cccgggugcgcgucgcggugg

SEQ ID NO: 2977845 - RNA, 20 nt, Mycobacterium avium subsp. paratuberculosis
cccgggugcgcuugucggcg

SEQ ID NO: 2977846 - RNA, 23 nt, Mycobacterium avium subsp. paratuberculosis
cccgggugcgcuugucggcgugg

SEQ ID NO: 2977847 - RNA, 12 nt, Mycobacterium avium subsp. paratuberculosis
cccggguggccc

SEQ ID NO: 2977848 - RNA, 14 nt, Mycobacterium avium subsp. paratuberculosis
cccggguggcccgc

SEQ ID NO: 2977849 - RNA, 22 nt, Mycobacterium avium subsp. paratuberculosis
cccggguggcgacgaaccuggc

SEQ ID NO: 2977850 - RNA, 24 nt, Mycobacterium avium subsp. paratuberculosis
cccggguggcguccagaugccguu

SEQ ID NO: 2977851 - RNA, 14 nt, Mycobacterium avium subsp. paratuberculosis
cccgggugggcagc

SEQ ID NO: 2977852 - RNA, 15 nt, Mycobacterium avium subsp. paratuberculosis
cccgggugggcagcg

SEQ ID NO: 2977853 - RNA, 17 nt, Mycobacterium avium subsp. paratuberculosis
cccgggugggcgggacg

SEQ ID NO: 2977854 - RNA, 21 nt, Mycobacterium avium subsp. paratuberculosis
cccgggugggcgggacguggc

SEQ ID NO: 2977855 - RNA, 22 nt, Mycobacterium avium subsp. paratuberculosis
cccgggugggcgggacguggcu

SEQ ID NO: 2977856 - RNA, 21 nt, Mycobacterium avium subsp. paratuberculosis
cccgggugggugcucaccccg

SEQ ID NO: 2977857 - RNA, 23 nt, Mycobacterium avium subsp. paratuberculosis
cccgggugggugcucaccccggc

SEQ ID NO: 2977858 - RNA, 19 nt, Mycobacterium avium subsp. paratuberculosis
cccgggugugggcgccguc

SEQ ID NO: 2977859 - RNA, 21 nt, Mycobacterium avium subsp. paratuberculosis
cccggguguuggagccguccg

SEQ ID NO: 2977860 - RNA, 17 nt, Mycobacterium avium subsp. paratuberculosis
cccggguguuggcgcac

SEQ ID NO: 2977861 - RNA, 19 nt, Mycobacterium avium subsp. paratuberculosis
cccggguugcgugcagccg

SEQ ID NO: 2977862 - RNA, 16 nt, Mycobacterium avium subsp. paratuberculosis
cccggguugucgacgu

SEQ ID NO: 2977863 - RNA, 18 nt, Mycobacterium avium subsp. paratuberculosis
cccggguugucgacgugg

SEQ ID NO: 2977864 - RNA, 13 nt, Mycobacterium avium subsp. paratuberculosis
cccgguacagcgc

SEQ ID NO: 2977865 - RNA, 17 nt, Mycobacterium avium subsp. paratuberculosis
cccgguacagcgccgcg

SEQ ID NO: 2977866 - RNA, 18 nt, Mycobacterium avium subsp. paratuberculosis
cccgguacagcgccgcgg

SEQ ID NO: 2977867 - RNA, 19 nt, Mycobacterium avium subsp. paratuberculosis
cccgguacagcgccgcggc

SEQ ID NO: 2977868 - RNA, 23 nt, Mycobacterium avium subsp. paratuberculosis
cccgguacagcgccgcggccagc

SEQ ID NO: 2977869 - RNA, 20 nt, Mycobacterium avium subsp. paratuberculosis
cccgguacaggucgcugccc

SEQ ID NO: 2977870 - RNA, 22 nt, Mycobacterium avium subsp. paratuberculosis
cccgguacaucgacgcgaccgg

SEQ ID NO: 2977871 - RNA, 14 nt, Mycobacterium avium subsp. paratuberculosis
cccgguagagcggc

SEQ ID NO: 2977872 - RNA, 22 nt, Mycobacterium avium subsp. paratuberculosis
cccgguagagcggcaccagguu

SEQ ID NO: 2977873 - RNA, 22 nt, Mycobacterium avium subsp. paratuberculosis
cccgguagauauggcccuccac

SEQ ID NO: 2977874 - RNA, 15 nt, Mycobacterium avium subsp. paratuberculosis
cccgguagaucgccg

SEQ ID NO: 2977875 - RNA, 16 nt, Mycobacterium avium subsp. paratuberculosis
cccgguagaucgccgg

SEQ ID NO: 2977876 - RNA, 16 nt, Mycobacterium avium subsp. paratuberculosis
cccgguagccagcacc

SEQ ID NO: 2977877 - RNA, 18 nt, Mycobacterium avium subsp. paratuberculosis
cccgguagccagcaccgc

SEQ ID NO: 2977878 - RNA, 19 nt, Mycobacterium avium subsp. paratuberculosis
cccgguagccagcaccgcc

SEQ ID NO: 2977879 - RNA, 20 nt, Mycobacterium avium subsp. paratuberculosis
cccgguagccagcaccgccc

SEQ ID NO: 2977880 - RNA, 22 nt, Mycobacterium avium subsp. paratuberculosis
cccgguagccagcaccgccccg

SEQ ID NO: 2977881 - RNA, 23 nt, Mycobacterium avium subsp. paratuberculosis
cccgguagccagcaccgccccgg

SEQ ID NO: 2977882 - RNA, 15 nt, Mycobacterium avium subsp. paratuberculosis
cccgguagccgacau

SEQ ID NO: 2977883 - RNA, 13 nt, Mycobacterium avium subsp. paratuberculosis
cccgguagcgcag

SEQ ID NO: 2977884 - RNA, 15 nt, Mycobacterium avium subsp. paratuberculosis
cccgguagcgcagca

SEQ ID NO: 2977885 - RNA, 18 nt, Mycobacterium avium subsp. paratuberculosis
cccgguagcgcagcacca

SEQ ID NO: 2977886 - RNA, 15 nt, Mycobacterium avium subsp. paratuberculosis
cccgguaggccgccg

SEQ ID NO: 2977887 - RNA, 16 nt, Mycobacterium avium subsp. paratuberculosis
cccgguaggccgccgc

SEQ ID NO: 2977888 - RNA, 13 nt, Mycobacterium avium subsp. paratuberculosis
cccgguaggcggc

SEQ ID NO: 2977889 - RNA, 16 nt, Mycobacterium avium subsp. paratuberculosis
cccgguaggcggcgag

SEQ ID NO: 2977890 - RNA, 18 nt, Mycobacterium avium subsp. paratuberculosis
cccgguaggcggcgagau

SEQ ID NO: 2977891 - RNA, 20 nt, Mycobacterium avium subsp. paratuberculosis
cccggucaccaucagcaccg

SEQ ID NO: 2977892 - RNA, 16 nt, Mycobacterium avium subsp. paratuberculosis
cccggucagcccccac

SEQ ID NO: 2977893 - RNA, 21 nt, Mycobacterium avium subsp. paratuberculosis
cccggucagcccccaccgcgc

SEQ ID NO: 2977894 - RNA, 15 nt, Mycobacterium avium subsp. paratuberculosis
cccggucagcgucca

SEQ ID NO: 2977895 - RNA, 15 nt, Mycobacterium avium subsp. paratuberculosis
cccggucagcucgcc

SEQ ID NO: 2977896 - RNA, 17 nt, Mycobacterium avium subsp. paratuberculosis
cccggucagcucgccgu

SEQ ID NO: 2977897 - RNA, 21 nt, Mycobacterium avium subsp. paratuberculosis
cccggucagguugacgccgau

SEQ ID NO: 2977898 - RNA, 22 nt, Mycobacterium avium subsp. paratuberculosis
cccgguccaccuggcugugcac

SEQ ID NO: 2977899 - RNA, 15 nt, Mycobacterium avium subsp. paratuberculosis
cccgguccacggugu

SEQ ID NO: 2977900 - RNA, 16 nt, Mycobacterium avium subsp. paratuberculosis
cccgguccacgguguc

SEQ ID NO: 2977901 - RNA, 23 nt, Mycobacterium avium subsp. paratuberculosis
cccgguccacggugucgcuguag

SEQ ID NO: 2977902 - RNA, 22 nt, Mycobacterium avium subsp. paratuberculosis
cccgguccaggcgaccggcccc

SEQ ID NO: 2977903 - RNA, 20 nt, Mycobacterium avium subsp. paratuberculosis
cccgguccccggagucgucg

SEQ ID NO: 2977904 - RNA, 13 nt, Mycobacterium avium subsp. paratuberculosis
cccggucccgccg

SEQ ID NO: 2977905 - RNA, 24 nt, Mycobacterium avium subsp. paratuberculosis
cccggucccggggcucgacaggca

SEQ ID NO: 2977906 - RNA, 22 nt, Mycobacterium avium subsp. paratuberculosis
cccgguccgcugugcggcccgg

SEQ ID NO: 2977907 - RNA, 13 nt, Mycobacterium avium subsp. paratuberculosis
cccgguccggccc

SEQ ID NO: 2977908 - RNA, 15 nt, Mycobacterium avium subsp. paratuberculosis
cccgguccggcccgg

SEQ ID NO: 2977909 - RNA, 14 nt, Mycobacterium avium subsp. paratuberculosis
cccgguccggcugg

SEQ ID NO: 2977910 - RNA, 18 nt, Mycobacterium avium subsp. paratuberculosis
cccgguccggcuggucgg

SEQ ID NO: 2977911 - RNA, 18 nt, Mycobacterium avium subsp. paratuberculosis
cccgguccgggucgcuga

SEQ ID NO: 2977912 - RNA, 20 nt, Mycobacterium avium subsp. paratuberculosis
cccgguccgggucgcugagc

SEQ ID NO: 2977913 - RNA, 21 nt, Mycobacterium avium subsp. paratuberculosis
cccgguccuugagguagucgc

SEQ ID NO: 2977914 - RNA, 20 nt, Mycobacterium avium subsp. paratuberculosis
cccggucgacgauggcccgg

SEQ ID NO: 2977915 - RNA, 12 nt, Mycobacterium avium subsp. paratuberculosis
cccggucgccgg

SEQ ID NO: 2977916 - RNA, 14 nt, Mycobacterium avium subsp. paratuberculosis
cccggucgcggccg

SEQ ID NO: 2977917 - RNA, 20 nt, Mycobacterium avium subsp. paratuberculosis
cccggucgcggccguagccg

SEQ ID NO: 2977918 - RNA, 21 nt, Mycobacterium avium subsp. paratuberculosis
cccggucggaguccagcacgc

SEQ ID NO: 2977919 - RNA, 13 nt, Mycobacterium avium subsp. paratuberculosis
cccggucggugag

SEQ ID NO: 2977920 - RNA, 14 nt, Mycobacterium avium subsp. paratuberculosis
cccggucguagucg

SEQ ID NO: 2977921 - RNA, 20 nt, Mycobacterium avium subsp. paratuberculosis
cccggucguagucggcccgc

SEQ ID NO: 2977922 - RNA, 23 nt, Mycobacterium avium subsp. paratuberculosis
cccggucguagucggcccgccgg

SEQ ID NO: 2977923 - RNA, 15 nt, Mycobacterium avium subsp. paratuberculosis
cccggucgucgagca

SEQ ID NO: 2977924 - RNA, 15 nt, Mycobacterium avium subsp. paratuberculosis
cccggucgucgccgg

SEQ ID NO: 2977925 - RNA, 18 nt, Mycobacterium avium subsp. paratuberculosis
cccggucugaucgcccag

SEQ ID NO: 2977926 - RNA, 22 nt, Mycobacterium avium subsp. paratuberculosis
cccggucugaucgcccagcacc

SEQ ID NO: 2977927 - RNA, 23 nt, Mycobacterium avium subsp. paratuberculosis
cccggucugaucgcccagcaccg

SEQ ID NO: 2977928 - RNA, 12 nt, Mycobacterium avium subsp. paratuberculosis
cccggucugcgg

SEQ ID NO: 2977929 - RNA, 23 nt, Mycobacterium avium subsp. paratuberculosis
cccggucugcggccgcgacugca

SEQ ID NO: 2977930 - RNA, 22 nt, Mycobacterium avium subsp. paratuberculosis
cccggucuuguugugcugcacc

SEQ ID NO: 2977931 - RNA, 23 nt, Mycobacterium avium subsp. paratuberculosis
cccggugacgaacaucgacgacg

SEQ ID NO: 2977932 - RNA, 22 nt, Mycobacterium avium subsp. paratuberculosis
cccggugacgauccggucgaug

SEQ ID NO: 2977933 - RNA, 17 nt, Mycobacterium avium subsp. paratuberculosis
cccggugaucgccgccc

SEQ ID NO: 2977934 - RNA, 17 nt, Mycobacterium avium subsp. paratuberculosis
cccggugaugacggggc

SEQ ID NO: 2977935 - RNA, 17 nt, Mycobacterium avium subsp. paratuberculosis
cccggugaugccggcau

SEQ ID NO: 2977936 - RNA, 14 nt, Mycobacterium avium subsp. paratuberculosis
cccggugccacgau

SEQ ID NO: 2977937 - RNA, 16 nt, Mycobacterium avium subsp. paratuberculosis
cccggugcccaccguc

SEQ ID NO: 2977938 - RNA, 15 nt, Mycobacterium avium subsp. paratuberculosis
cccggugccgcugga

SEQ ID NO: 2977939 - RNA, 14 nt, Mycobacterium avium subsp. paratuberculosis
cccggugccggccg

SEQ ID NO: 2977940 - RNA, 15 nt, Mycobacterium avium subsp. paratuberculosis
cccggugccggccgg

SEQ ID NO: 2977941 - RNA, 17 nt, Mycobacterium avium subsp. paratuberculosis
cccggugccggccgggu

SEQ ID NO: 2977942 - RNA, 14 nt, Mycobacterium avium subsp. paratuberculosis
cccggugcgacgcc

SEQ ID NO: 2977943 - RNA, 16 nt, Mycobacterium avium subsp. paratuberculosis
cccggugcgacgccgc

SEQ ID NO: 2977944 - RNA, 20 nt, Mycobacterium avium subsp. paratuberculosis
cccggugcgacgccgcgcag

SEQ ID NO: 2977945 - RNA, 22 nt, Mycobacterium avium subsp. paratuberculosis
cccggugcgacgccgcgcagcg

SEQ ID NO: 2977946 - RNA, 14 nt, Mycobacterium avium subsp. paratuberculosis
cccggugcgccggu

SEQ ID NO: 2977947 - RNA, 18 nt, Mycobacterium avium subsp. paratuberculosis
cccgguggacgcgauggc

SEQ ID NO: 2977948 - RNA, 21 nt, Mycobacterium avium subsp. paratuberculosis
cccgguggccgaggguuccag

SEQ ID NO: 2977949 - RNA, 19 nt, Mycobacterium avium subsp. paratuberculosis
cccggugggacugggcgcc

SEQ ID NO: 2977950 - RNA, 22 nt, Mycobacterium avium subsp. paratuberculosis
cccggugggacugggcgccgcc

SEQ ID NO: 2977951 - RNA, 23 nt, Mycobacterium avium subsp. paratuberculosis
cccggugggacugggcgccgccg

SEQ ID NO: 2977952 - RNA, 24 nt, Mycobacterium avium subsp. paratuberculosis
cccggugggacugggcgccgccgg

SEQ ID NO: 2977953 - RNA, 12 nt, Mycobacterium avium subsp. paratuberculosis
cccgguguccac

SEQ ID NO: 2977954 - RNA, 19 nt, Mycobacterium avium subsp. paratuberculosis
cccgguguccacgucgccc

SEQ ID NO: 2977955 - RNA, 21 nt, Mycobacterium avium subsp. paratuberculosis
cccgguguccacgucgcccag

SEQ ID NO: 2977956 - RNA, 23 nt, Mycobacterium avium subsp. paratuberculosis
cccgguguccacgucgcccagcg

SEQ ID NO: 2977957 - RNA, 14 nt, Mycobacterium avium subsp. paratuberculosis
cccggugucgccgu

SEQ ID NO: 2977958 - RNA, 15 nt, Mycobacterium avium subsp. paratuberculosis
cccggugucgccguc

SEQ ID NO: 2977959 - RNA, 22 nt, Mycobacterium avium subsp. paratuberculosis
cccggugucugaccucgcgccg

SEQ ID NO: 2977960 - RNA, 15 nt, Mycobacterium avium subsp. paratuberculosis
cccgguuccaaccac

SEQ ID NO: 2977961 - RNA, 15 nt, Mycobacterium avium subsp. paratuberculosis
cccgguuccaccggg

SEQ ID NO: 2977962 - RNA, 19 nt, Mycobacterium avium subsp. paratuberculosis
cccgguuccaccgggccgc

SEQ ID NO: 2977963 - RNA, 20 nt, Mycobacterium avium subsp. paratuberculosis
cccgguuccaccgggccgcc

SEQ ID NO: 2977964 - RNA, 23 nt, Mycobacterium avium subsp. paratuberculosis
cccgguuccaccgggccgccauc

SEQ ID NO: 2977965 - RNA, 20 nt, Mycobacterium avium subsp. paratuberculosis
cccgguuccgcgacaucggu

SEQ ID NO: 2977966 - RNA, 15 nt, Mycobacterium avium subsp. paratuberculosis
cccgguucugggcgg

SEQ ID NO: 2977967 - RNA, 18 nt, Mycobacterium avium subsp. paratuberculosis
cccgguucugggcgggcu

SEQ ID NO: 2977968 - RNA, 20 nt, Mycobacterium avium subsp. paratuberculosis
cccgguugaaggccgcgcug

SEQ ID NO: 2977969 - RNA, 16 nt, Mycobacterium avium subsp. paratuberculosis
cccgguugucgcucag

SEQ ID NO: 2977970 - RNA, 21 nt, Mycobacterium avium subsp. paratuberculosis
cccgguuuccaguccggcgcc

SEQ ID NO: 2977971 - RNA, 22 nt, Mycobacterium avium subsp. paratuberculosis
cccgguuuccaguccggcgccc

SEQ ID NO: 2977972 - RNA, 23 nt, Mycobacterium avium subsp. paratuberculosis
cccgguuuccaguccggcgcccg

SEQ ID NO: 2977973 - RNA, 20 nt, Mycobacterium avium subsp. paratuberculosis
cccgguuucguuguccacca

SEQ ID NO: 2977974 - RNA, 20 nt, Mycobacterium avium subsp. paratuberculosis
cccguaacacgaucaccccg

SEQ ID NO: 2977975 - RNA, 17 nt, Mycobacterium avium subsp. paratuberculosis
cccguacggguugccgu

SEQ ID NO: 2977976 - RNA, 19 nt, Mycobacterium avium subsp. paratuberculosis
cccguacuugcuggcgcug

SEQ ID NO: 2977977 - RNA, 20 nt, Mycobacterium avium subsp. paratuberculosis
cccguagaacaguucgacgu

SEQ ID NO: 2977978 - RNA, 15 nt, Mycobacterium avium subsp. paratuberculosis
cccguagacccacag

SEQ ID NO: 2977979 - RNA, 18 nt, Mycobacterium avium subsp. paratuberculosis
cccguagacccacagcug

SEQ ID NO: 2977980 - RNA, 23 nt, Mycobacterium avium subsp. paratuberculosis
cccguagacccacagcugccggc

SEQ ID NO: 2977981 - RNA, 17 nt, Mycobacterium avium subsp. paratuberculosis
cccguagaugccgguac

SEQ ID NO: 2977982 - RNA, 19 nt, Mycobacterium avium subsp. paratuberculosis
cccguagaugcggcccagc

SEQ ID NO: 2977983 - RNA, 23 nt, Mycobacterium avium subsp. paratuberculosis
cccguagccgcgguucggcgucg

SEQ ID NO: 2977984 - RNA, 18 nt, Mycobacterium avium subsp. paratuberculosis
cccguagcucgcgccgac

SEQ ID NO: 2977985 - RNA, 20 nt, Mycobacterium avium subsp. paratuberculosis
cccguagcucgcgccgaccc

SEQ ID NO: 2977986 - RNA, 22 nt, Mycobacterium avium subsp. paratuberculosis
cccguagcucgcgccgacccgc

SEQ ID NO: 2977987 - RNA, 23 nt, Mycobacterium avium subsp. paratuberculosis
cccguagcucgcgccgacccgcc

SEQ ID NO: 2977988 - RNA, 18 nt, Mycobacterium avium subsp. paratuberculosis
cccguaggagcugacggc

SEQ ID NO: 2977989 - RNA, 15 nt, Mycobacterium avium subsp. paratuberculosis
cccguaggucgccuc

SEQ ID NO: 2977990 - RNA, 22 nt, Mycobacterium avium subsp. paratuberculosis
cccguagguugccccacacgau

SEQ ID NO: 2977991 - RNA, 13 nt, Mycobacterium avium subsp. paratuberculosis
cccguagucaccc

SEQ ID NO: 2977992 - RNA, 16 nt, Mycobacterium avium subsp. paratuberculosis
cccguagucacccggc

SEQ ID NO: 2977993 - RNA, 17 nt, Mycobacterium avium subsp. paratuberculosis
cccguagucggcggcga

SEQ ID NO: 2977994 - RNA, 17 nt, Mycobacterium avium subsp. paratuberculosis
cccguauugccgucggc

SEQ ID NO: 2977995 - RNA, 13 nt, Mycobacterium avium subsp. paratuberculosis
cccgucacgcugg

SEQ ID NO: 2977996 - RNA, 14 nt, Mycobacterium avium subsp. paratuberculosis
cccgucacggcugc

SEQ ID NO: 2977997 - RNA, 18 nt, Mycobacterium avium subsp. paratuberculosis
cccgucacggcugccgac

SEQ ID NO: 2977998 - RNA, 20 nt, Mycobacterium avium subsp. paratuberculosis
cccguccagaucggccagcg

SEQ ID NO: 2977999 - RNA, 13 nt, Mycobacterium avium subsp. paratuberculosis
cccguccagccca

SEQ ID NO: 2978000 - RNA, 13 nt, Mycobacterium avium subsp. paratuberculosis
cccguccagcgug

SEQ ID NO: 2978001 - RNA, 21 nt, Mycobacterium avium subsp. paratuberculosis
cccguccaggaugagcugggc

SEQ ID NO: 2978002 - RNA, 23 nt, Mycobacterium avium subsp. paratuberculosis
cccguccccaccaccgacagcac

SEQ ID NO: 2978003 - RNA, 15 nt, Mycobacterium avium subsp. paratuberculosis
cccgucccgccgacg

SEQ ID NO: 2978004 - RNA, 19 nt, Mycobacterium avium subsp. paratuberculosis
cccgucccgccgacggaga

SEQ ID NO: 2978005 - RNA, 12 nt, Mycobacterium avium subsp. paratuberculosis
cccguccgcccc

SEQ ID NO: 2978006 - RNA, 18 nt, Mycobacterium avium subsp. paratuberculosis
cccguccgccccgcugcc

SEQ ID NO: 2978007 - RNA, 22 nt, Mycobacterium avium subsp. paratuberculosis
cccguccgccccgcugccggac

SEQ ID NO: 2978008 - RNA, 13 nt, Mycobacterium avium subsp. paratuberculosis
cccguccgggccg

SEQ ID NO: 2978009 - RNA, 15 nt, Mycobacterium avium subsp. paratuberculosis
cccguccgggccggc

SEQ ID NO: 2978010 - RNA, 21 nt, Mycobacterium avium subsp. paratuberculosis
cccguccuggaugaacagcac

SEQ ID NO: 2978011 - RNA, 13 nt, Mycobacterium avium subsp. paratuberculosis
cccguccugggcc

SEQ ID NO: 2978012 - RNA, 14 nt, Mycobacterium avium subsp. paratuberculosis
cccguccugggccu

SEQ ID NO: 2978013 - RNA, 20 nt, Mycobacterium avium subsp. paratuberculosis
cccguccugggccuggcgcu

SEQ ID NO: 2978014 - RNA, 15 nt, Mycobacterium avium subsp. paratuberculosis
cccgucgaccaggac

SEQ ID NO: 2978015 - RNA, 20 nt, Mycobacterium avium subsp. paratuberculosis
cccgucgacgggccaccagc

SEQ ID NO: 2978016 - RNA, 22 nt, Mycobacterium avium subsp. paratuberculosis
cccgucgacgggccaccagcgc

SEQ ID NO: 2978017 - RNA, 13 nt, Mycobacterium avium subsp. paratuberculosis
cccgucgacgucg

SEQ ID NO: 2978018 - RNA, 13 nt, Mycobacterium avium subsp. paratuberculosis
cccgucgacucgg

SEQ ID NO: 2978019 - RNA, 17 nt, Mycobacterium avium subsp. paratuberculosis
cccgucgacucggcggu

SEQ ID NO: 2978020 - RNA, 22 nt, Mycobacterium avium subsp. paratuberculosis
cccgucgacucggcggugccgu

SEQ ID NO: 2978021 - RNA, 15 nt, Mycobacterium avium subsp. paratuberculosis
cccgucgagcagccg

SEQ ID NO: 2978022 - RNA, 23 nt, Mycobacterium avium subsp. paratuberculosis
cccgucgagcggcuugccgccgc

SEQ ID NO: 2978023 - RNA, 15 nt, Mycobacterium avium subsp. paratuberculosis
cccgucgagcgucac

SEQ ID NO: 2978024 - RNA, 19 nt, Mycobacterium avium subsp. paratuberculosis
cccgucgagcgucacgccg

SEQ ID NO: 2978025 - RNA, 22 nt, Mycobacterium avium subsp. paratuberculosis
cccgucgagcgucacgccgcgc

SEQ ID NO: 2978026 - RNA, 23 nt, Mycobacterium avium subsp. paratuberculosis
cccgucgagcgucacgccgcgcc

SEQ ID NO: 2978027 - RNA, 23 nt, Mycobacterium avium subsp. paratuberculosis
cccgucgagcgucauuccgccgc

SEQ ID NO: 2978028 - RNA, 19 nt, Mycobacterium avium subsp. paratuberculosis
cccgucgccaccacggcgc

SEQ ID NO: 2978029 - RNA, 20 nt, Mycobacterium avium subsp. paratuberculosis
cccgucgccgaucagcacca

SEQ ID NO: 2978030 - RNA, 13 nt, Mycobacterium avium subsp. paratuberculosis
cccgucgccggcg

SEQ ID NO: 2978031 - RNA, 14 nt, Mycobacterium avium subsp. paratuberculosis
cccgucgccggcgc

SEQ ID NO: 2978032 - RNA, 16 nt, Mycobacterium avium subsp. paratuberculosis
cccgucgccggcgcgc

SEQ ID NO: 2978033 - RNA, 17 nt, Mycobacterium avium subsp. paratuberculosis
cccgucgccggcgcgca

SEQ ID NO: 2978034 - RNA, 12 nt, Mycobacterium avium subsp. paratuberculosis
cccgucgcgacg

SEQ ID NO: 2978035 - RNA, 23 nt, Mycobacterium avium subsp. paratuberculosis
cccgucgcggacccuggccagca

SEQ ID NO: 2978036 - RNA, 14 nt, Mycobacterium avium subsp. paratuberculosis
cccgucgcggguca

SEQ ID NO: 2978037 - RNA, 18 nt, Mycobacterium avium subsp. paratuberculosis
cccgucggccaucagccg

SEQ ID NO: 2978038 - RNA, 21 nt, Mycobacterium avium subsp. paratuberculosis
cccgucggccaucagccgccg

SEQ ID NO: 2978039 - RNA, 18 nt, Mycobacterium avium subsp. paratuberculosis
cccgucggccuccagccg

SEQ ID NO: 2978040 - RNA, 12 nt, Mycobacterium avium subsp. paratuberculosis
cccgucggcgcg

SEQ ID NO: 2978041 - RNA, 13 nt, Mycobacterium avium subsp. paratuberculosis
cccgucggcgcga

SEQ ID NO: 2978042 - RNA, 18 nt, Mycobacterium avium subsp. paratuberculosis
cccgucgggccguccgcc

SEQ ID NO: 2978043 - RNA, 15 nt, Mycobacterium avium subsp. paratuberculosis
cccgucgggcgcggc

SEQ ID NO: 2978044 - RNA, 18 nt, Mycobacterium avium subsp. paratuberculosis
cccgucgggcgcggcggc

SEQ ID NO: 2978045 - RNA, 19 nt, Mycobacterium avium subsp. paratuberculosis
cccgucggucccgacgcgg

SEQ ID NO: 2978046 - RNA, 20 nt, Mycobacterium avium subsp. paratuberculosis
cccgucggucccgacgcggc

SEQ ID NO: 2978047 - RNA, 22 nt, Mycobacterium avium subsp. paratuberculosis
cccgucggucccgacgcggcgc

SEQ ID NO: 2978048 - RNA, 14 nt, Mycobacterium avium subsp. paratuberculosis
cccgucggucgggc

SEQ ID NO: 2978049 - RNA, 21 nt, Mycobacterium avium subsp. paratuberculosis
cccgucguccuugagccccca

SEQ ID NO: 2978050 - RNA, 21 nt, Mycobacterium avium subsp. paratuberculosis
cccgucgucgaugcgcagcag

SEQ ID NO: 2978051 - RNA, 22 nt, Mycobacterium avium subsp. paratuberculosis
cccgucgucuagcggccuagga

SEQ ID NO: 2978052 - RNA, 20 nt, Mycobacterium avium subsp. paratuberculosis
cccgucucgagcuuccgccg

SEQ ID NO: 2978053 - RNA, 14 nt, Mycobacterium avium subsp. paratuberculosis
cccgucucggcgug

SEQ ID NO: 2978054 - RNA, 16 nt, Mycobacterium avium subsp. paratuberculosis
cccgucucggcgugcu

SEQ ID NO: 2978055 - RNA, 19 nt, Mycobacterium avium subsp. paratuberculosis
cccgucucggcgugcucgg

SEQ ID NO: 2978056 - RNA, 20 nt, Mycobacterium avium subsp. paratuberculosis
cccgucucggcgugcucggc

SEQ ID NO: 2978057 - RNA, 14 nt, Mycobacterium avium subsp. paratuberculosis
cccgugaucgccac

SEQ ID NO: 2978058 - RNA, 17 nt, Mycobacterium avium subsp. paratuberculosis
cccgugcaggaucggcu

SEQ ID NO: 2978059 - RNA, 20 nt, Mycobacterium avium subsp. paratuberculosis
cccgugcaggaucggcuugg

SEQ ID NO: 2978060 - RNA, 18 nt, Mycobacterium avium subsp. paratuberculosis
cccgugccgaugccggcc

SEQ ID NO: 2978061 - RNA, 19 nt, Mycobacterium avium subsp. paratuberculosis
cccgugccgaugccggccu

SEQ ID NO: 2978062 - RNA, 21 nt, Mycobacterium avium subsp. paratuberculosis
cccgugccgaugccggccugg

SEQ ID NO: 2978063 - RNA, 22 nt, Mycobacterium avium subsp. paratuberculosis
cccgugccgaugccggccuggc

SEQ ID NO: 2978064 - RNA, 13 nt, Mycobacterium avium subsp. paratuberculosis
cccgugcgacggc

SEQ ID NO: 2978065 - RNA, 15 nt, Mycobacterium avium subsp. paratuberculosis
cccgugcgacggcuc

SEQ ID NO: 2978066 - RNA, 14 nt, Mycobacterium avium subsp. paratuberculosis
cccgugcgccgccc

SEQ ID NO: 2978067 - RNA, 15 nt, Mycobacterium avium subsp. paratuberculosis
cccgugcgccgccca

SEQ ID NO: 2978068 - RNA, 20 nt, Mycobacterium avium subsp. paratuberculosis
cccgugcgccgcccacaccg

SEQ ID NO: 2978069 - RNA, 19 nt, Mycobacterium avium subsp. paratuberculosis
cccgugcggggccucgucg

SEQ ID NO: 2978070 - RNA, 13 nt, Mycobacterium avium subsp. paratuberculosis
cccgugcgggugg

SEQ ID NO: 2978071 - RNA, 19 nt, Mycobacterium avium subsp. paratuberculosis
cccguggauggacgcccag

SEQ ID NO: 2978072 - RNA, 16 nt, Mycobacterium avium subsp. paratuberculosis
cccguggcccacggga

SEQ ID NO: 2978073 - RNA, 18 nt, Mycobacterium avium subsp. paratuberculosis
cccguggcccacgggaug

SEQ ID NO: 2978074 - RNA, 22 nt, Mycobacterium avium subsp. paratuberculosis
cccguggcccacgggaugcggc

SEQ ID NO: 2978075 - RNA, 17 nt, Mycobacterium avium subsp. paratuberculosis
cccgugggccgaccggc

SEQ ID NO: 2978076 - RNA, 19 nt, Mycobacterium avium subsp. paratuberculosis
cccgugguagacgccggac

SEQ ID NO: 2978077 - RNA, 19 nt, Mycobacterium avium subsp. paratuberculosis
cccguguuguggucugacc

SEQ ID NO: 2978078 - RNA, 22 nt, Mycobacterium avium subsp. paratuberculosis
cccguguuguggucugaccccc

SEQ ID NO: 2978079 - RNA, 13 nt, Mycobacterium avium subsp. paratuberculosis
cccguuccacauc

SEQ ID NO: 2978080 - RNA, 18 nt, Mycobacterium avium subsp. paratuberculosis
cccguucccgacagcucg

SEQ ID NO: 2978081 - RNA, 14 nt, Mycobacterium avium subsp. paratuberculosis
cccguuccggcgag

SEQ ID NO: 2978082 - RNA, 17 nt, Mycobacterium avium subsp. paratuberculosis
cccguucgaugaugggc

SEQ ID NO: 2978083 - RNA, 23 nt, Mycobacterium avium subsp. paratuberculosis
cccguucgaugaugggcgaucga

SEQ ID NO: 2978084 - RNA, 17 nt, Mycobacterium avium subsp. paratuberculosis
cccguucgccgacagca

SEQ ID NO: 2978085 - RNA, 18 nt, Mycobacterium avium subsp. paratuberculosis
cccguucgccgacagcag

SEQ ID NO: 2978086 - RNA, 12 nt, Mycobacterium avium subsp. paratuberculosis
cccguucggcgu

SEQ ID NO: 2978087 - RNA, 14 nt, Mycobacterium avium subsp. paratuberculosis
cccguucggcgucg

SEQ ID NO: 2978088 - RNA, 16 nt, Mycobacterium avium subsp. paratuberculosis
cccguucgguggccac

SEQ ID NO: 2978089 - RNA, 21 nt, Mycobacterium avium subsp. paratuberculosis
cccguucgguggccaccgcga

SEQ ID NO: 2978090 - RNA, 22 nt, Mycobacterium avium subsp. paratuberculosis
cccguucguuuuucguaccugc

SEQ ID NO: 2978091 - RNA, 21 nt, Mycobacterium avium subsp. paratuberculosis
cccguugaaguuggccaccgg

SEQ ID NO: 2978092 - RNA, 23 nt, Mycobacterium avium subsp. paratuberculosis
cccguugaaguuggccaccgggg

SEQ ID NO: 2978093 - RNA, 20 nt, Mycobacterium avium subsp. paratuberculosis
cccguugaucuugaccgucg

SEQ ID NO: 2978094 - RNA, 22 nt, Mycobacterium avium subsp. paratuberculosis
cccguugcacaggcacacgaac

SEQ ID NO: 2978095 - RNA, 17 nt, Mycobacterium avium subsp. paratuberculosis
cccguugcccgaucagc

SEQ ID NO: 2978096 - RNA, 14 nt, Mycobacterium avium subsp. paratuberculosis
cccguugccgccgg

SEQ ID NO: 2978097 - RNA, 19 nt, Mycobacterium avium subsp. paratuberculosis
cccguugcgccgcaacggc

SEQ ID NO: 2978098 - RNA, 21 nt, Mycobacterium avium subsp. paratuberculosis
cccguugcgccgcaacggcgc

SEQ ID NO: 2978099 - RNA, 20 nt, Mycobacterium avium subsp. paratuberculosis
cccguugcgggacugggcga

SEQ ID NO: 2978100 - RNA, 15 nt, Mycobacterium avium subsp. paratuberculosis
cccguugcggugacg

SEQ ID NO: 2978101 - RNA, 23 nt, Mycobacterium avium subsp. paratuberculosis
cccguugcugcguucggcgauca

SEQ ID NO: 2978102 - RNA, 19 nt, Mycobacterium avium subsp. paratuberculosis
cccguuggcgccggucgac

SEQ ID NO: 2978103 - RNA, 17 nt, Mycobacterium avium subsp. paratuberculosis
cccguugggccagaacg

SEQ ID NO: 2978104 - RNA, 14 nt, Mycobacterium avium subsp. paratuberculosis
cccguuuccucgcg

SEQ ID NO: 2978105 - RNA, 15 nt, Mycobacterium avium subsp. paratuberculosis
cccuacgccguggcc

SEQ ID NO: 2978106 - RNA, 13 nt, Mycobacterium avium subsp. paratuberculosis
cccuacgggcgca

SEQ ID NO: 2978107 - RNA, 17 nt, Mycobacterium avium subsp. paratuberculosis
cccuacgggcgcaccgc

SEQ ID NO: 2978108 - RNA, 21 nt, Mycobacterium avium subsp. paratuberculosis
cccuacgggcgcaccgcgcgc

SEQ ID NO: 2978109 - RNA, 23 nt, Mycobacterium avium subsp. paratuberculosis
cccuagcucggccggggcgacca

SEQ ID NO: 2978110 - RNA, 12 nt, Mycobacterium avium subsp. paratuberculosis
cccucaccccgc

SEQ ID NO: 2978111 - RNA, 15 nt, Mycobacterium avium subsp. paratuberculosis
cccucaccccgccca

SEQ ID NO: 2978112 - RNA, 17 nt, Mycobacterium avium subsp. paratuberculosis
cccucaccccgcccagc

SEQ ID NO: 2978113 - RNA, 15 nt, Mycobacterium avium subsp. paratuberculosis
cccucacuccagcgg

SEQ ID NO: 2978114 - RNA, 19 nt, Mycobacterium avium subsp. paratuberculosis
cccucacuccagcggcggc

SEQ ID NO: 2978115 - RNA, 11 nt, Mycobacterium avium subsp. paratuberculosis
cccucagcagg

SEQ ID NO: 2978116 - RNA, 18 nt, Mycobacterium avium subsp. paratuberculosis
cccucaggcguccagcac

SEQ ID NO: 2978117 - RNA, 13 nt, Mycobacterium avium subsp. paratuberculosis
cccucaucgucga

SEQ ID NO: 2978118 - RNA, 15 nt, Mycobacterium avium subsp. paratuberculosis
cccuccaacggccgc

SEQ ID NO: 2978119 - RNA, 17 nt, Mycobacterium avium subsp. paratuberculosis
cccuccaacggccgcac

SEQ ID NO: 2978120 - RNA, 17 nt, Mycobacterium avium subsp. paratuberculosis
cccuccacacggcaggc

SEQ ID NO: 2978121 - RNA, 19 nt, Mycobacterium avium subsp. paratuberculosis
cccuccacacggcaggcgg

SEQ ID NO: 2978122 - RNA, 20 nt, Mycobacterium avium subsp. paratuberculosis
cccuccacacggcaggcggc

SEQ ID NO: 2978123 - RNA, 17 nt, Mycobacterium avium subsp. paratuberculosis
cccuccacggugcgcac

SEQ ID NO: 2978124 - RNA, 15 nt, Mycobacterium avium subsp. paratuberculosis
cccuccacgucgucg

SEQ ID NO: 2978125 - RNA, 17 nt, Mycobacterium avium subsp. paratuberculosis
cccuccacgucgucgga

SEQ ID NO: 2978126 - RNA, 12 nt, Mycobacterium avium subsp. paratuberculosis
cccuccagccgc

SEQ ID NO: 2978127 - RNA, 23 nt, Mycobacterium avium subsp. paratuberculosis
cccuccagcuggagaggcccggc

SEQ ID NO: 2978128 - RNA, 23 nt, Mycobacterium avium subsp. paratuberculosis
cccucccaccacggccgaugcag

SEQ ID NO: 2978129 - RNA, 14 nt, Mycobacterium avium subsp. paratuberculosis
cccuccccgcuagc

SEQ ID NO: 2978130 - RNA, 15 nt, Mycobacterium avium subsp. paratuberculosis
cccuccggcaggccg

SEQ ID NO: 2978131 - RNA, 18 nt, Mycobacterium avium subsp. paratuberculosis
cccuccggcaggccgcgg

SEQ ID NO: 2978132 - RNA, 13 nt, Mycobacterium avium subsp. paratuberculosis
cccuccgggcggc

SEQ ID NO: 2978133 - RNA, 15 nt, Mycobacterium avium subsp. paratuberculosis
cccuccgggcggcac

SEQ ID NO: 2978134 - RNA, 21 nt, Mycobacterium avium subsp. paratuberculosis
cccuccgggcggcaccgcugc

SEQ ID NO: 2978135 - RNA, 23 nt, Mycobacterium avium subsp. paratuberculosis
cccuccgggcggcaccgcugccg

SEQ ID NO: 2978136 - RNA, 12 nt, Mycobacterium avium subsp. paratuberculosis
cccuccucgccg

SEQ ID NO: 2978137 - RNA, 17 nt, Mycobacterium avium subsp. paratuberculosis
cccuccuggcggguggc

SEQ ID NO: 2978138 - RNA, 22 nt, Mycobacterium avium subsp. paratuberculosis
cccucgaagcagaacuucuccg

SEQ ID NO: 2978139 - RNA, 15 nt, Mycobacterium avium subsp. paratuberculosis
cccucgaaguagagc

SEQ ID NO: 2978140 - RNA, 21 nt, Mycobacterium avium subsp. paratuberculosis
cccucgacaccgguggcguug

SEQ ID NO: 2978141 - RNA, 16 nt, Mycobacterium avium subsp. paratuberculosis
cccucgacccgaagcc

SEQ ID NO: 2978142 - RNA, 19 nt, Mycobacterium avium subsp. paratuberculosis
cccucgacgaacgcggcgg

SEQ ID NO: 2978143 - RNA, 13 nt, Mycobacterium avium subsp. paratuberculosis
cccucgacgccgg

SEQ ID NO: 2978144 - RNA, 16 nt, Mycobacterium avium subsp. paratuberculosis
cccucgacgccgggca

SEQ ID NO: 2978145 - RNA, 15 nt, Mycobacterium avium subsp. paratuberculosis
cccucgacguccagg

SEQ ID NO: 2978146 - RNA, 22 nt, Mycobacterium avium subsp. paratuberculosis
cccucgacguccaggccggcgc

SEQ ID NO: 2978147 - RNA, 18 nt, Mycobacterium avium subsp. paratuberculosis
cccucgauaauggcggcc

SEQ ID NO: 2978148 - RNA, 23 nt, Mycobacterium avium subsp. paratuberculosis
cccucgauaauggcggccgccgc

SEQ ID NO: 2978149 - RNA, 22 nt, Mycobacterium avium subsp. paratuberculosis
cccucgaucagccacaccgccg

SEQ ID NO: 2978150 - RNA, 14 nt, Mycobacterium avium subsp. paratuberculosis
cccucgaucgcgac

SEQ ID NO: 2978151 - RNA, 21 nt, Mycobacterium avium subsp. paratuberculosis
cccucgaucgcgaccaccggc

SEQ ID NO: 2978152 - RNA, 11 nt, Mycobacterium avium subsp. paratuberculosis
cccucgccgaa

SEQ ID NO: 2978153 - RNA, 15 nt, Mycobacterium avium subsp. paratuberculosis
cccucgccgaaccgg

SEQ ID NO: 2978154 - RNA, 15 nt, Mycobacterium avium subsp. paratuberculosis
cccucgccgccgccg

SEQ ID NO: 2978155 - RNA, 15 nt, Mycobacterium avium subsp. paratuberculosis
cccucgccggucagc

SEQ ID NO: 2978156 - RNA, 23 nt, Mycobacterium avium subsp. paratuberculosis
cccucgccggucagcgcauccuc

SEQ ID NO: 2978157 - RNA, 17 nt, Mycobacterium avium subsp. paratuberculosis
cccucgcgcagggccag

SEQ ID NO: 2978158 - RNA, 19 nt, Mycobacterium avium subsp. paratuberculosis
cccucgcucaacccgucgc

SEQ ID NO: 2978159 - RNA, 23 nt, Mycobacterium avium subsp. paratuberculosis
cccucgcugccgcccccgcuggc

SEQ ID NO: 2978160 - RNA, 11 nt, Mycobacterium avium subsp. paratuberculosis
cccucggccag

SEQ ID NO: 2978161 - RNA, 13 nt, Mycobacterium avium subsp. paratuberculosis
cccucggccagcc

SEQ ID NO: 2978162 - RNA, 12 nt, Mycobacterium avium subsp. paratuberculosis
cccucggcccgc

SEQ ID NO: 2978163 - RNA, 15 nt, Mycobacterium avium subsp. paratuberculosis
cccucggcccgccac

SEQ ID NO: 2978164 - RNA, 19 nt, Mycobacterium avium subsp. paratuberculosis
cccucggccgguccgaucg

SEQ ID NO: 2978165 - RNA, 14 nt, Mycobacterium avium subsp. paratuberculosis
cccucggcgagcga

SEQ ID NO: 2978166 - RNA, 22 nt, Mycobacterium avium subsp. paratuberculosis
cccucggcgccgguggugucga

SEQ ID NO: 2978167 - RNA, 16 nt, Mycobacterium avium subsp. paratuberculosis
cccucggcggccgucg

SEQ ID NO: 2978168 - RNA, 18 nt, Mycobacterium avium subsp. paratuberculosis
cccucggcuuccgagccg

SEQ ID NO: 2978169 - RNA, 20 nt, Mycobacterium avium subsp. paratuberculosis
cccucggcuuccgagccggu

SEQ ID NO: 2978170 - RNA, 17 nt, Mycobacterium avium subsp. paratuberculosis
cccucggggcucaccac

SEQ ID NO: 2978171 - RNA, 20 nt, Mycobacterium avium subsp. paratuberculosis
cccucgggguacucggcggc

SEQ ID NO: 2978172 - RNA, 17 nt, Mycobacterium avium subsp. paratuberculosis
cccucggugcucuugac

SEQ ID NO: 2978173 - RNA, 18 nt, Mycobacterium avium subsp. paratuberculosis
cccucggugcucuugacg

SEQ ID NO: 2978174 - RNA, 21 nt, Mycobacterium avium subsp. paratuberculosis
cccucggugcucuugacggcc

SEQ ID NO: 2978175 - RNA, 14 nt, Mycobacterium avium subsp. paratuberculosis
cccucguagcggcc

SEQ ID NO: 2978176 - RNA, 20 nt, Mycobacterium avium subsp. paratuberculosis
cccucguagcggccgcacgc

SEQ ID NO: 2978177 - RNA, 14 nt, Mycobacterium avium subsp. paratuberculosis
cccucguccaggug

SEQ ID NO: 2978178 - RNA, 19 nt, Mycobacterium avium subsp. paratuberculosis
cccucguccaggugcaccc

SEQ ID NO: 2978179 - RNA, 24 nt, Mycobacterium avium subsp. paratuberculosis
cccucguccaggugcacccgcggc

SEQ ID NO: 2978180 - RNA, 13 nt, Mycobacterium avium subsp. paratuberculosis
cccucgucgacca

SEQ ID NO: 2978181 - RNA, 22 nt, Mycobacterium avium subsp. paratuberculosis
cccucgucgaccagggcgauca

SEQ ID NO: 2978182 - RNA, 17 nt, Mycobacterium avium subsp. paratuberculosis
cccucgucgaucgcggc

SEQ ID NO: 2978183 - RNA, 19 nt, Mycobacterium avium subsp. paratuberculosis
cccucgucgaugacgucca

SEQ ID NO: 2978184 - RNA, 13 nt, Mycobacterium avium subsp. paratuberculosis
cccucgucggcga

SEQ ID NO: 2978185 - RNA, 16 nt, Mycobacterium avium subsp. paratuberculosis
cccucgucggcgagca

SEQ ID NO: 2978186 - RNA, 18 nt, Mycobacterium avium subsp. paratuberculosis
cccucgugcguagcggcc

SEQ ID NO: 2978187 - RNA, 21 nt, Mycobacterium avium subsp. paratuberculosis
cccucgugcguagcggcccga

SEQ ID NO: 2978188 - RNA, 16 nt, Mycobacterium avium subsp. paratuberculosis
cccucgugguggacgg

SEQ ID NO: 2978189 - RNA, 20 nt, Mycobacterium avium subsp. paratuberculosis
cccucgugguggacggucag

SEQ ID NO: 2978190 - RNA, 14 nt, Mycobacterium avium subsp. paratuberculosis
cccucucacggcgg

SEQ ID NO: 2978191 - RNA, 14 nt, Mycobacterium avium subsp. paratuberculosis
cccucugccacggc

SEQ ID NO: 2978192 - RNA, 16 nt, Mycobacterium avium subsp. paratuberculosis
cccucuucgaucaggc

SEQ ID NO: 2978193 - RNA, 18 nt, Mycobacterium avium subsp. paratuberculosis
cccugacacagcaccggc

SEQ ID NO: 2978194 - RNA, 18 nt, Mycobacterium avium subsp. paratuberculosis
cccugacacgaccgccug

SEQ ID NO: 2978195 - RNA, 22 nt, Mycobacterium avium subsp. paratuberculosis
cccugagcugguuucgggucga

SEQ ID NO: 2978196 - RNA, 23 nt, Mycobacterium avium subsp. paratuberculosis
cccugagcugguuucgggucgag

SEQ ID NO: 2978197 - RNA, 15 nt, Mycobacterium avium subsp. paratuberculosis
cccugagggugucgg

SEQ ID NO: 2978198 - RNA, 16 nt, Mycobacterium avium subsp. paratuberculosis
cccugagggugucggc

SEQ ID NO: 2978199 - RNA, 20 nt, Mycobacterium avium subsp. paratuberculosis
cccugagggugucggcgauc

SEQ ID NO: 2978200 - RNA, 14 nt, Mycobacterium avium subsp. paratuberculosis
cccugaucggccgc

SEQ ID NO: 2978201 - RNA, 23 nt, Mycobacterium avium subsp. paratuberculosis
cccugcaccacgaagcgggcggc

SEQ ID NO: 2978202 - RNA, 23 nt, Mycobacterium avium subsp. paratuberculosis
cccugcacgaucucggcggucuu

SEQ ID NO: 2978203 - RNA, 19 nt, Mycobacterium avium subsp. paratuberculosis
cccugcacuaccccgucga

SEQ ID NO: 2978204 - RNA, 21 nt, Mycobacterium avium subsp. paratuberculosis
cccugcagccggguggcccgc

SEQ ID NO: 2978205 - RNA, 23 nt, Mycobacterium avium subsp. paratuberculosis
cccugcagccggguggcccgccc

SEQ ID NO: 2978206 - RNA, 22 nt, Mycobacterium avium subsp. paratuberculosis
cccugcagcgccuugaccgcgu

SEQ ID NO: 2978207 - RNA, 18 nt, Mycobacterium avium subsp. paratuberculosis
cccugcaggucgcggugg

SEQ ID NO: 2978208 - RNA, 12 nt, Mycobacterium avium subsp. paratuberculosis
cccugccagggg

SEQ ID NO: 2978209 - RNA, 17 nt, Mycobacterium avium subsp. paratuberculosis
cccugcccgucgggcgc

SEQ ID NO: 2978210 - RNA, 18 nt, Mycobacterium avium subsp. paratuberculosis
cccugcccgucgggcgcg

SEQ ID NO: 2978211 - RNA, 12 nt, Mycobacterium avium subsp. paratuberculosis
cccugccgccac

SEQ ID NO: 2978212 - RNA, 13 nt, Mycobacterium avium subsp. paratuberculosis
cccugcgagcccg

SEQ ID NO: 2978213 - RNA, 12 nt, Mycobacterium avium subsp. paratuberculosis
cccugcgcaccg

SEQ ID NO: 2978214 - RNA, 13 nt, Mycobacterium avium subsp. paratuberculosis
cccugcgcaccgc

SEQ ID NO: 2978215 - RNA, 15 nt, Mycobacterium avium subsp. paratuberculosis
cccugcgcaccgcgg

SEQ ID NO: 2978216 - RNA, 16 nt, Mycobacterium avium subsp. paratuberculosis
cccugcgcgcccugcu

SEQ ID NO: 2978217 - RNA, 22 nt, Mycobacterium avium subsp. paratuberculosis
cccugcgcggaaguggaccgcg

SEQ ID NO: 2978218 - RNA, 13 nt, Mycobacterium avium subsp. paratuberculosis
cccugcgcggccu

SEQ ID NO: 2978219 - RNA, 18 nt, Mycobacterium avium subsp. paratuberculosis
cccugcgcggcgaugcgc

SEQ ID NO: 2978220 - RNA, 20 nt, Mycobacterium avium subsp. paratuberculosis
cccugcgcggcgaugcgcuc

SEQ ID NO: 2978221 - RNA, 20 nt, Mycobacterium avium subsp. paratuberculosis
cccugcgcucagcacgcgga

SEQ ID NO: 2978222 - RNA, 18 nt, Mycobacterium avium subsp. paratuberculosis
cccugcggccagugccgg

SEQ ID NO: 2978223 - RNA, 15 nt, Mycobacterium avium subsp. paratuberculosis
cccugcggcugcauc

SEQ ID NO: 2978224 - RNA, 17 nt, Mycobacterium avium subsp. paratuberculosis
cccugcggcugggucgg

SEQ ID NO: 2978225 - RNA, 19 nt, Mycobacterium avium subsp. paratuberculosis
cccugcgggaacagcggga

SEQ ID NO: 2978226 - RNA, 15 nt, Mycobacterium avium subsp. paratuberculosis
cccugcguccggccc

SEQ ID NO: 2978227 - RNA, 16 nt, Mycobacterium avium subsp. paratuberculosis
cccugcguccggcccg

SEQ ID NO: 2978228 - RNA, 16 nt, Mycobacterium avium subsp. paratuberculosis
cccugcucagcggcca

SEQ ID NO: 2978229 - RNA, 17 nt, Mycobacterium avium subsp. paratuberculosis
cccugcucgcuguggcg

SEQ ID NO: 2978230 - RNA, 15 nt, Mycobacterium avium subsp. paratuberculosis
cccugcucggccagc

SEQ ID NO: 2978231 - RNA, 17 nt, Mycobacterium avium subsp. paratuberculosis
cccugcucggccagcgg

SEQ ID NO: 2978232 - RNA, 13 nt, Mycobacterium avium subsp. paratuberculosis
cccugcucgucgu

SEQ ID NO: 2978233 - RNA, 22 nt, Mycobacterium avium subsp. paratuberculosis
cccugcucgucguugaccugcu

SEQ ID NO: 2978234 - RNA, 20 nt, Mycobacterium avium subsp. paratuberculosis
cccugcucuucgcgcgcggc

SEQ ID NO: 2978235 - RNA, 16 nt, Mycobacterium avium subsp. paratuberculosis
cccugcugcagcgcga

SEQ ID NO: 2978236 - RNA, 17 nt, Mycobacterium avium subsp. paratuberculosis
cccugcugcagcgcgaa

SEQ ID NO: 2978237 - RNA, 16 nt, Mycobacterium avium subsp. paratuberculosis
cccugcugggagcggc

SEQ ID NO: 2978238 - RNA, 15 nt, Mycobacterium avium subsp. paratuberculosis
cccugcuugaacagc

SEQ ID NO: 2978239 - RNA, 16 nt, Mycobacterium avium subsp. paratuberculosis
cccugcuugaacagca

SEQ ID NO: 2978240 - RNA, 18 nt, Mycobacterium avium subsp. paratuberculosis
cccugcuugaccgcgacg

SEQ ID NO: 2978241 - RNA, 21 nt, Mycobacterium avium subsp. paratuberculosis
cccugcuugaccgcgacgggc

SEQ ID NO: 2978242 - RNA, 22 nt, Mycobacterium avium subsp. paratuberculosis
cccuggacgaguggucggccgc

SEQ ID NO: 2978243 - RNA, 16 nt, Mycobacterium avium subsp. paratuberculosis
cccuggauauccagcc

SEQ ID NO: 2978244 - RNA, 18 nt, Mycobacterium avium subsp. paratuberculosis
cccuggaugaucucgaug

SEQ ID NO: 2978245 - RNA, 20 nt, Mycobacterium avium subsp. paratuberculosis
cccuggaugucacgguccag

SEQ ID NO: 2978246 - RNA, 13 nt, Mycobacterium avium subsp. paratuberculosis
cccuggcagguga

SEQ ID NO: 2978247 - RNA, 20 nt, Mycobacterium avium subsp. paratuberculosis
cccuggcaggugagccgggu

SEQ ID NO: 2978248 - RNA, 12 nt, Mycobacterium avium subsp. paratuberculosis
cccuggcauccg

SEQ ID NO: 2978249 - RNA, 12 nt, Mycobacterium avium subsp. paratuberculosis
cccuggccagca

SEQ ID NO: 2978250 - RNA, 12 nt, Mycobacterium avium subsp. paratuberculosis
cccuggccccag

SEQ ID NO: 2978251 - RNA, 12 nt, Mycobacterium avium subsp. paratuberculosis
cccuggccgccg

SEQ ID NO: 2978252 - RNA, 16 nt, Mycobacterium avium subsp. paratuberculosis
cccuggccgccggccg

SEQ ID NO: 2978253 - RNA, 17 nt, Mycobacterium avium subsp. paratuberculosis
cccuggccgccggccgc

SEQ ID NO: 2978254 - RNA, 19 nt, Mycobacterium avium subsp. paratuberculosis
cccuggccgccggccgcgc

SEQ ID NO: 2978255 - RNA, 12 nt, Mycobacterium avium subsp. paratuberculosis
cccuggccgcgu

SEQ ID NO: 2978256 - RNA, 21 nt, Mycobacterium avium subsp. paratuberculosis
cccuggcgaugaucaacagga

SEQ ID NO: 2978257 - RNA, 20 nt, Mycobacterium avium subsp. paratuberculosis
cccuggcgggcggcccgcac

SEQ ID NO: 2978258 - RNA, 12 nt, Mycobacterium avium subsp. paratuberculosis
cccuggcgggua

SEQ ID NO: 2978259 - RNA, 18 nt, Mycobacterium avium subsp. paratuberculosis
cccuggcggguacagccg

SEQ ID NO: 2978260 - RNA, 21 nt, Mycobacterium avium subsp. paratuberculosis
cccuggcggguacagccgcag

SEQ ID NO: 2978261 - RNA, 21 nt, Mycobacterium avium subsp. paratuberculosis
cccugggaggaagugcacgcc

SEQ ID NO: 2978262 - RNA, 15 nt, Mycobacterium avium subsp. paratuberculosis
cccugggcggcgaca

SEQ ID NO: 2978263 - RNA, 23 nt, Mycobacterium avium subsp. paratuberculosis
cccugggcggcgacacgccgacg

SEQ ID NO: 2978264 - RNA, 13 nt, Mycobacterium avium subsp. paratuberculosis
cccugggggucgg

SEQ ID NO: 2978265 - RNA, 19 nt, Mycobacterium avium subsp. paratuberculosis
cccugggggucggugacca

SEQ ID NO: 2978266 - RNA, 16 nt, Mycobacterium avium subsp. paratuberculosis
cccugguacgcgccgu

SEQ ID NO: 2978267 - RNA, 20 nt, Mycobacterium avium subsp. paratuberculosis
cccugguacgcgccgucguc

SEQ ID NO: 2978268 - RNA, 15 nt, Mycobacterium avium subsp. paratuberculosis
cccugguaggccugg

SEQ ID NO: 2978269 - RNA, 16 nt, Mycobacterium avium subsp. paratuberculosis
cccugguaggccugga

SEQ ID NO: 2978270 - RNA, 13 nt, Mycobacterium avium subsp. paratuberculosis
cccuggucggcca

SEQ ID NO: 2978271 - RNA, 15 nt, Mycobacterium avium subsp. paratuberculosis
cccuggucggccagg

SEQ ID NO: 2978272 - RNA, 16 nt, Mycobacterium avium subsp. paratuberculosis
cccuggucggccaggg

SEQ ID NO: 2978273 - RNA, 20 nt, Mycobacterium avium subsp. paratuberculosis
cccuggugcaacaccgaaag

SEQ ID NO: 2978274 - RNA, 17 nt, Mycobacterium avium subsp. paratuberculosis
cccugguugagcaccgc

SEQ ID NO: 2978275 - RNA, 18 nt, Mycobacterium avium subsp. paratuberculosis
cccugguugauccagcgg

SEQ ID NO: 2978276 - RNA, 16 nt, Mycobacterium avium subsp. paratuberculosis
cccuguucgccgucgc

SEQ ID NO: 2978277 - RNA, 14 nt, Mycobacterium avium subsp. paratuberculosis
cccuguucgcgccg

SEQ ID NO: 2978278 - RNA, 15 nt, Mycobacterium avium subsp. paratuberculosis
cccuguucgcgccgg

SEQ ID NO: 2978279 - RNA, 16 nt, Mycobacterium avium subsp. paratuberculosis
cccuguuugcaggcga

SEQ ID NO: 2978280 - RNA, 13 nt, Mycobacterium avium subsp. paratuberculosis
cccuuaccggccg

SEQ ID NO: 2978281 - RNA, 13 nt, Mycobacterium avium subsp. paratuberculosis
cccuucaccucgg

SEQ ID NO: 2978282 - RNA, 15 nt, Mycobacterium avium subsp. paratuberculosis
cccuucaccucggcc

SEQ ID NO: 2978283 - RNA, 16 nt, Mycobacterium avium subsp. paratuberculosis
cccuucaucagcaccg

SEQ ID NO: 2978284 - RNA, 17 nt, Mycobacterium avium subsp. paratuberculosis
cccuucaucagcaccgc

SEQ ID NO: 2978285 - RNA, 19 nt, Mycobacterium avium subsp. paratuberculosis
cccuucaucagcaccgcga

SEQ ID NO: 2978286 - RNA, 14 nt, Mycobacterium avium subsp. paratuberculosis
cccuuccagcaccc

SEQ ID NO: 2978287 - RNA, 19 nt, Mycobacterium avium subsp. paratuberculosis
cccuuccagcaccccgucg

SEQ ID NO: 2978288 - RNA, 14 nt, Mycobacterium avium subsp. paratuberculosis
cccuuccccggcgg

SEQ ID NO: 2978289 - RNA, 15 nt, Mycobacterium avium subsp. paratuberculosis
cccuucggcgcccgc

SEQ ID NO: 2978290 - RNA, 22 nt, Mycobacterium avium subsp. paratuberculosis
cccuucuucgcgggugccuucu

SEQ ID NO: 2978291 - RNA, 19 nt, Mycobacterium avium subsp. paratuberculosis
cccuugaacggcaccagcg

SEQ ID NO: 2978292 - RNA, 13 nt, Mycobacterium avium subsp. paratuberculosis
cccuugacgguga

SEQ ID NO: 2978293 - RNA, 19 nt, Mycobacterium avium subsp. paratuberculosis
cccuugacggugaggucgg

SEQ ID NO: 2978294 - RNA, 19 nt, Mycobacterium avium subsp. paratuberculosis
cccuugagcuucccggcgg

SEQ ID NO: 2978295 - RNA, 15 nt, Mycobacterium avium subsp. paratuberculosis
cccuugccccaccac

SEQ ID NO: 2978296 - RNA, 15 nt, Mycobacterium avium subsp. paratuberculosis
cccuugccgaugccg

SEQ ID NO: 2978297 - RNA, 13 nt, Mycobacterium avium subsp. paratuberculosis
cccuugccgccga

SEQ ID NO: 2978298 - RNA, 16 nt, Mycobacterium avium subsp. paratuberculosis
cccuuggacaccugca

SEQ ID NO: 2978299 - RNA, 17 nt, Mycobacterium avium subsp. paratuberculosis
cccuuggcggccacgac

SEQ ID NO: 2978300 - RNA, 22 nt, Mycobacterium avium subsp. paratuberculosis
cccuuggcggccacgacggcgc

SEQ ID NO: 2978301 - RNA, 20 nt, Mycobacterium avium subsp. paratuberculosis
cccuuggcguauucggcgcg

SEQ ID NO: 2978302 - RNA, 22 nt, Mycobacterium avium subsp. paratuberculosis
cccuuguaggucaucagcgacg

SEQ ID NO: 2978303 - RNA, 22 nt, Mycobacterium avium subsp. paratuberculosis
cccuuguccaggauccccgucc

SEQ ID NO: 2978304 - RNA, 23 nt, Mycobacterium avium subsp. paratuberculosis
cccuuguccaggauccccgucca

SEQ ID NO: 2978305 - RNA, 14 nt, Mycobacterium avium subsp. paratuberculosis
cccuuuacccggac

SEQ ID NO: 2978306 - RNA, 17 nt, Mycobacterium avium subsp. paratuberculosis
ccgaaaaacgcgacggc

SEQ ID NO: 2978307 - RNA, 13 nt, Mycobacterium avium subsp. paratuberculosis
ccgaaacaccggc

SEQ ID NO: 2978308 - RNA, 22 nt, Mycobacterium avium subsp. paratuberculosis
ccgaaacccgcugucaaucccc

SEQ ID NO: 2978309 - RNA, 13 nt, Mycobacterium avium subsp. paratuberculosis
ccgaaaccgucga

SEQ ID NO: 2978310 - RNA, 15 nt, Mycobacterium avium subsp. paratuberculosis
ccgaaaccgucgacc

SEQ ID NO: 2978311 - RNA, 13 nt, Mycobacterium avium subsp. paratuberculosis
ccgaaacggugcc

SEQ ID NO: 2978312 - RNA, 16 nt, Mycobacterium avium subsp. paratuberculosis
ccgaaacggugcccgc

SEQ ID NO: 2978313 - RNA, 19 nt, Mycobacterium avium subsp. paratuberculosis
ccgaaacggugcccgcagc

SEQ ID NO: 2978314 - RNA, 21 nt, Mycobacterium avium subsp. paratuberculosis
ccgaaagccguaccgcaacac

SEQ ID NO: 2978315 - RNA, 21 nt, Mycobacterium avium subsp. paratuberculosis
ccgaaagccuccgcgaucagc

SEQ ID NO: 2978316 - RNA, 23 nt, Mycobacterium avium subsp. paratuberculosis
ccgaaagguuuucccggccgccg

SEQ ID NO: 2978317 - RNA, 16 nt, Mycobacterium avium subsp. paratuberculosis
ccgaaaguccccgggu

SEQ ID NO: 2978318 - RNA, 18 nt, Mycobacterium avium subsp. paratuberculosis
ccgaaaguccccgggugg

SEQ ID NO: 2978319 - RNA, 21 nt, Mycobacterium avium subsp. paratuberculosis
ccgaaaucaacgcgccgaaca

SEQ ID NO: 2978320 - RNA, 15 nt, Mycobacterium avium subsp. paratuberculosis
ccgaacaacagggcc

SEQ ID NO: 2978321 - RNA, 17 nt, Mycobacterium avium subsp. paratuberculosis
ccgaacaacagggccgc

SEQ ID NO: 2978322 - RNA, 23 nt, Mycobacterium avium subsp. paratuberculosis
ccgaacaacagggccgcgcgggc

SEQ ID NO: 2978323 - RNA, 17 nt, Mycobacterium avium subsp. paratuberculosis
ccgaacaacggcggacc

SEQ ID NO: 2978324 - RNA, 23 nt, Mycobacterium avium subsp. paratuberculosis
ccgaacaacugaccgauggccgc

SEQ ID NO: 2978325 - RNA, 15 nt, Mycobacterium avium subsp. paratuberculosis
ccgaacaccacgccg

SEQ ID NO: 2978326 - RNA, 15 nt, Mycobacterium avium subsp. paratuberculosis
ccgaacaccggcagc

SEQ ID NO: 2978327 - RNA, 18 nt, Mycobacterium avium subsp. paratuberculosis
ccgaacaccgugaacagg

SEQ ID NO: 2978328 - RNA, 15 nt, Mycobacterium avium subsp. paratuberculosis
ccgaacaccugcggc

SEQ ID NO: 2978329 - RNA, 15 nt, Mycobacterium avium subsp. paratuberculosis
ccgaacacgggcggc

SEQ ID NO: 2978330 - RNA, 16 nt, Mycobacterium avium subsp. paratuberculosis
ccgaacacgggcggca

SEQ ID NO: 2978331 - RNA, 20 nt, Mycobacterium avium subsp. paratuberculosis
ccgaacagcagcgaacccgc

SEQ ID NO: 2978332 - RNA, 14 nt, Mycobacterium avium subsp. paratuberculosis
ccgaacagccgggc

SEQ ID NO: 2978333 - RNA, 16 nt, Mycobacterium avium subsp. paratuberculosis
ccgaacagccgggcca

SEQ ID NO: 2978334 - RNA, 20 nt, Mycobacterium avium subsp. paratuberculosis
ccgaacagccgggccagcag

SEQ ID NO: 2978335 - RNA, 14 nt, Mycobacterium avium subsp. paratuberculosis
ccgaacagccgggu

SEQ ID NO: 2978336 - RNA, 15 nt, Mycobacterium avium subsp. paratuberculosis
ccgaacagcgccagg

SEQ ID NO: 2978337 - RNA, 18 nt, Mycobacterium avium subsp. paratuberculosis
ccgaacagcgccagggug

SEQ ID NO: 2978338 - RNA, 18 nt, Mycobacterium avium subsp. paratuberculosis
ccgaacagcuugccgauc

SEQ ID NO: 2978339 - RNA, 23 nt, Mycobacterium avium subsp. paratuberculosis
ccgaacagcuugccgaucugguc

SEQ ID NO: 2978340 - RNA, 18 nt, Mycobacterium avium subsp. paratuberculosis
ccgaacaggcgcaacagc

SEQ ID NO: 2978341 - RNA, 12 nt, Mycobacterium avium subsp. paratuberculosis
ccgaacagggcg

SEQ ID NO: 2978342 - RNA, 17 nt, Mycobacterium avium subsp. paratuberculosis
ccgaacagggcgacggc

SEQ ID NO: 2978343 - RNA, 20 nt, Mycobacterium avium subsp. paratuberculosis
ccgaacagggcgacggcggc

SEQ ID NO: 2978344 - RNA, 16 nt, Mycobacterium avium subsp. paratuberculosis
ccgaacaucgccucgg

SEQ ID NO: 2978345 - RNA, 19 nt, Mycobacterium avium subsp. paratuberculosis
ccgaacaucgccucggccg

SEQ ID NO: 2978346 - RNA, 22 nt, Mycobacterium avium subsp. paratuberculosis
ccgaacaucgccucggccgcgg

SEQ ID NO: 2978347 - RNA, 15 nt, Mycobacterium avium subsp. paratuberculosis
ccgaaccagaucggc

SEQ ID NO: 2978348 - RNA, 19 nt, Mycobacterium avium subsp. paratuberculosis
ccgaaccagaucggcgggu

SEQ ID NO: 2978349 - RNA, 17 nt, Mycobacterium avium subsp. paratuberculosis
ccgaaccaguucgccac

SEQ ID NO: 2978350 - RNA, 13 nt, Mycobacterium avium subsp. paratuberculosis
ccgaacccaccag

SEQ ID NO: 2978351 - RNA, 14 nt, Mycobacterium avium subsp. paratuberculosis
ccgaacccaccagc

SEQ ID NO: 2978352 - RNA, 15 nt, Mycobacterium avium subsp. paratuberculosis
ccgaacccaccagcg

SEQ ID NO: 2978353 - RNA, 19 nt, Mycobacterium avium subsp. paratuberculosis
ccgaacccaccagcgccug

SEQ ID NO: 2978354 - RNA, 21 nt, Mycobacterium avium subsp. paratuberculosis
ccgaacccagcgccucgagca

SEQ ID NO: 2978355 - RNA, 14 nt, Mycobacterium avium subsp. paratuberculosis
ccgaacccggaucg

SEQ ID NO: 2978356 - RNA, 14 nt, Mycobacterium avium subsp. paratuberculosis
ccgaacccggccag

SEQ ID NO: 2978357 - RNA, 15 nt, Mycobacterium avium subsp. paratuberculosis
ccgaacccgggcgcg

SEQ ID NO: 2978358 - RNA, 19 nt, Mycobacterium avium subsp. paratuberculosis
ccgaacccgggcgcgccca

SEQ ID NO: 2978359 - RNA, 23 nt, Mycobacterium avium subsp. paratuberculosis
ccgaacccgggcgcgcccacccg

SEQ ID NO: 2978360 - RNA, 12 nt, Mycobacterium avium subsp. paratuberculosis
ccgaacccguuc

SEQ ID NO: 2978361 - RNA, 20 nt, Mycobacterium avium subsp. paratuberculosis
ccgaacccguucccgacagc

SEQ ID NO: 2978362 - RNA, 17 nt, Mycobacterium avium subsp. paratuberculosis
ccgaaccgaucaccggc

SEQ ID NO: 2978363 - RNA, 12 nt, Mycobacterium avium subsp. paratuberculosis
ccgaaccgcagc

SEQ ID NO: 2978364 - RNA, 14 nt, Mycobacterium avium subsp. paratuberculosis
ccgaaccgcagccg

SEQ ID NO: 2978365 - RNA, 18 nt, Mycobacterium avium subsp. paratuberculosis
ccgaaccgcagccggauc

SEQ ID NO: 2978366 - RNA, 15 nt, Mycobacterium avium subsp. paratuberculosis
ccgaaccgccccgcg

SEQ ID NO: 2978367 - RNA, 16 nt, Mycobacterium avium subsp. paratuberculosis
ccgaaccgccccgcgc

SEQ ID NO: 2978368 - RNA, 19 nt, Mycobacterium avium subsp. paratuberculosis
ccgaaccgccccgcgcgau

SEQ ID NO: 2978369 - RNA, 21 nt, Mycobacterium avium subsp. paratuberculosis
ccgaaccgcccgcccggcacg

SEQ ID NO: 2978370 - RNA, 13 nt, Mycobacterium avium subsp. paratuberculosis
ccgaaccgcucgu

SEQ ID NO: 2978371 - RNA, 12 nt, Mycobacterium avium subsp. paratuberculosis
ccgaaccgcugc

SEQ ID NO: 2978372 - RNA, 16 nt, Mycobacterium avium subsp. paratuberculosis
ccgaaccgggcgcgca

SEQ ID NO: 2978373 - RNA, 14 nt, Mycobacterium avium subsp. paratuberculosis
ccgaaccggggccg

SEQ ID NO: 2978374 - RNA, 15 nt, Mycobacterium avium subsp. paratuberculosis
ccgaaccggggccgc

SEQ ID NO: 2978375 - RNA, 12 nt, Mycobacterium avium subsp. paratuberculosis
ccgaaccguccc

SEQ ID NO: 2978376 - RNA, 17 nt, Mycobacterium avium subsp. paratuberculosis
ccgaacgacgagccguc

SEQ ID NO: 2978377 - RNA, 19 nt, Mycobacterium avium subsp. paratuberculosis
ccgaacgacgagccgucga

SEQ ID NO: 2978378 - RNA, 15 nt, Mycobacterium avium subsp. paratuberculosis
ccgaacgauggugug

SEQ ID NO: 2978379 - RNA, 20 nt, Mycobacterium avium subsp. paratuberculosis
ccgaacgauggugugcagca

SEQ ID NO: 2978380 - RNA, 14 nt, Mycobacterium avium subsp. paratuberculosis
ccgaacgcaccacc

SEQ ID NO: 2978381 - RNA, 15 nt, Mycobacterium avium subsp. paratuberculosis
ccgaacgcaccaccg

SEQ ID NO: 2978382 - RNA, 17 nt, Mycobacterium avium subsp. paratuberculosis
ccgaacgcaccaccgcg

SEQ ID NO: 2978383 - RNA, 15 nt, Mycobacterium avium subsp. paratuberculosis
ccgaacgccaccacc

SEQ ID NO: 2978384 - RNA, 13 nt, Mycobacterium avium subsp. paratuberculosis
ccgaacgccagca

SEQ ID NO: 2978385 - RNA, 13 nt, Mycobacterium avium subsp. paratuberculosis
ccgaacgccuccg

SEQ ID NO: 2978386 - RNA, 18 nt, Mycobacterium avium subsp. paratuberculosis
ccgaacgccuccgccgcc

SEQ ID NO: 2978387 - RNA, 19 nt, Mycobacterium avium subsp. paratuberculosis
ccgaacgccuccgccgccc

SEQ ID NO: 2978388 - RNA, 13 nt, Mycobacterium avium subsp. paratuberculosis
ccgaacgccucga

SEQ ID NO: 2978389 - RNA, 20 nt, Mycobacterium avium subsp. paratuberculosis
ccgaacggaccgggcgggcu

SEQ ID NO: 2978390 - RNA, 12 nt, Mycobacterium avium subsp. paratuberculosis
ccgaacggcaug

SEQ ID NO: 2978391 - RNA, 16 nt, Mycobacterium avium subsp. paratuberculosis
ccgaacgggucggcga

SEQ ID NO: 2978392 - RNA, 17 nt, Mycobacterium avium subsp. paratuberculosis
ccgaacgggucggcgac

SEQ ID NO: 2978393 - RNA, 19 nt, Mycobacterium avium subsp. paratuberculosis
ccgaacgggucggcgacca

SEQ ID NO: 2978394 - RNA, 21 nt, Mycobacterium avium subsp. paratuberculosis
ccgaacgggucggcgaccaug

SEQ ID NO: 2978395 - RNA, 15 nt, Mycobacterium avium subsp. paratuberculosis
ccgaacgucacggcg

SEQ ID NO: 2978396 - RNA, 17 nt, Mycobacterium avium subsp. paratuberculosis
ccgaacgugauggcgaa

SEQ ID NO: 2978397 - RNA, 19 nt, Mycobacterium avium subsp. paratuberculosis
ccgaacgugcgcggcgcgc

SEQ ID NO: 2978398 - RNA, 22 nt, Mycobacterium avium subsp. paratuberculosis
ccgaacgugcugugcgggcggu

SEQ ID NO: 2978399 - RNA, 15 nt, Mycobacterium avium subsp. paratuberculosis
ccgaacucauggcgu

SEQ ID NO: 2978400 - RNA, 15 nt, Mycobacterium avium subsp. paratuberculosis
ccgaacucggcgccg

SEQ ID NO: 2978401 - RNA, 16 nt, Mycobacterium avium subsp. paratuberculosis
ccgaacucggcgccgc

SEQ ID NO: 2978402 - RNA, 13 nt, Mycobacterium avium subsp. paratuberculosis
ccgaacugccgcg

SEQ ID NO: 2978403 - RNA, 14 nt, Mycobacterium avium subsp. paratuberculosis
ccgaacugccgcgc

SEQ ID NO: 2978404 - RNA, 16 nt, Mycobacterium avium subsp. paratuberculosis
ccgaacugccgcgcac

SEQ ID NO: 2978405 - RNA, 22 nt, Mycobacterium avium subsp. paratuberculosis
ccgaacugguuguagucgucga

SEQ ID NO: 2978406 - RNA, 16 nt, Mycobacterium avium subsp. paratuberculosis
ccgaacuucagcgcgu

SEQ ID NO: 2978407 - RNA, 21 nt, Mycobacterium avium subsp. paratuberculosis
ccgaacuucagcgcgucgucg

SEQ ID NO: 2978408 - RNA, 22 nt, Mycobacterium avium subsp. paratuberculosis
ccgaacuucagcgcgucgucga

SEQ ID NO: 2978409 - RNA, 21 nt, Mycobacterium avium subsp. paratuberculosis
ccgaagaaccccgagaucgcg

SEQ ID NO: 2978410 - RNA, 21 nt, Mycobacterium avium subsp. paratuberculosis
ccgaagaacgacuggcggcgg

SEQ ID NO: 2978411 - RNA, 23 nt, Mycobacterium avium subsp. paratuberculosis
ccgaagaacgacuggcggcggcg

SEQ ID NO: 2978412 - RNA, 15 nt, Mycobacterium avium subsp. paratuberculosis
ccgaagaucaccgcg

SEQ ID NO: 2978413 - RNA, 18 nt, Mycobacterium avium subsp. paratuberculosis
ccgaagaucaccgcgacg

SEQ ID NO: 2978414 - RNA, 21 nt, Mycobacterium avium subsp. paratuberculosis
ccgaagaucaccgcgucggcc

SEQ ID NO: 2978415 - RNA, 16 nt, Mycobacterium avium subsp. paratuberculosis
ccgaagauggccagcg

SEQ ID NO: 2978416 - RNA, 16 nt, Mycobacterium avium subsp. paratuberculosis
ccgaagauggccagga

SEQ ID NO: 2978417 - RNA, 16 nt, Mycobacterium avium subsp. paratuberculosis
ccgaagaugucggugc

SEQ ID NO: 2978418 - RNA, 21 nt, Mycobacterium avium subsp. paratuberculosis
ccgaagaugucggugccgauc

SEQ ID NO: 2978419 - RNA, 19 nt, Mycobacterium avium subsp. paratuberculosis
ccgaagcccgcagcgaacg

SEQ ID NO: 2978420 - RNA, 13 nt, Mycobacterium avium subsp. paratuberculosis
ccgaagccgacac

SEQ ID NO: 2978421 - RNA, 16 nt, Mycobacterium avium subsp. paratuberculosis
ccgaagccgacgucga

SEQ ID NO: 2978422 - RNA, 18 nt, Mycobacterium avium subsp. paratuberculosis
ccgaagccgacgucgacc

SEQ ID NO: 2978423 - RNA, 13 nt, Mycobacterium avium subsp. paratuberculosis
ccgaagccgccgu

SEQ ID NO: 2978424 - RNA, 20 nt, Mycobacterium avium subsp. paratuberculosis
ccgaagccgccguccccgcg

SEQ ID NO: 2978425 - RNA, 19 nt, Mycobacterium avium subsp. paratuberculosis
ccgaagccggcgcaggugu

SEQ ID NO: 2978426 - RNA, 13 nt, Mycobacterium avium subsp. paratuberculosis
ccgaagccgucga

SEQ ID NO: 2978427 - RNA, 19 nt, Mycobacterium avium subsp. paratuberculosis
ccgaagcgccacggggcgc

SEQ ID NO: 2978428 - RNA, 21 nt, Mycobacterium avium subsp. paratuberculosis
ccgaagcgccacggggcgccg

SEQ ID NO: 2978429 - RNA, 15 nt, Mycobacterium avium subsp. paratuberculosis
ccgaagcgccgcaug

SEQ ID NO: 2978430 - RNA, 16 nt, Mycobacterium avium subsp. paratuberculosis
ccgaagcgccgcaugc

SEQ ID NO: 2978431 - RNA, 18 nt, Mycobacterium avium subsp. paratuberculosis
ccgaagcgccgcaugccc

SEQ ID NO: 2978432 - RNA, 19 nt, Mycobacterium avium subsp. paratuberculosis
ccgaagcgcuaacaaaagc

SEQ ID NO: 2978433 - RNA, 23 nt, Mycobacterium avium subsp. paratuberculosis
ccgaagcgcuaacaaaagcccga

SEQ ID NO: 2978434 - RNA, 14 nt, Mycobacterium avium subsp. paratuberculosis
ccgaagcggcccga

SEQ ID NO: 2978435 - RNA, 15 nt, Mycobacterium avium subsp. paratuberculosis
ccgaagcggcccgag

SEQ ID NO: 2978436 - RNA, 23 nt, Mycobacterium avium subsp. paratuberculosis
ccgaagcggcgcacgcagugccg

SEQ ID NO: 2978437 - RNA, 20 nt, Mycobacterium avium subsp. paratuberculosis
ccgaagcgggucggggagcc

SEQ ID NO: 2978438 - RNA, 17 nt, Mycobacterium avium subsp. paratuberculosis
ccgaagcguuccgccgu

SEQ ID NO: 2978439 - RNA, 18 nt, Mycobacterium avium subsp. paratuberculosis
ccgaagcguuccgccguc

SEQ ID NO: 2978440 - RNA, 17 nt, Mycobacterium avium subsp. paratuberculosis
ccgaagcucaucaccgg

SEQ ID NO: 2978441 - RNA, 13 nt, Mycobacterium avium subsp. paratuberculosis
ccgaaggccgggu

SEQ ID NO: 2978442 - RNA, 14 nt, Mycobacterium avium subsp. paratuberculosis
ccgaaggcggcgcc

SEQ ID NO: 2978443 - RNA, 20 nt, Mycobacterium avium subsp. paratuberculosis
ccgaagggaaaggcagcagc

SEQ ID NO: 2978444 - RNA, 21 nt, Mycobacterium avium subsp. paratuberculosis
ccgaagggaaaggcagcagcc

SEQ ID NO: 2978445 - RNA, 22 nt, Mycobacterium avium subsp. paratuberculosis
ccgaagggaaaggcagcagcca

SEQ ID NO: 2978446 - RNA, 15 nt, Mycobacterium avium subsp. paratuberculosis
ccgaaguauccgguc

SEQ ID NO: 2978447 - RNA, 21 nt, Mycobacterium avium subsp. paratuberculosis
ccgaaguauccggucagcgcc

SEQ ID NO: 2978448 - RNA, 13 nt, Mycobacterium avium subsp. paratuberculosis
ccgaaguccgcca

SEQ ID NO: 2978449 - RNA, 13 nt, Mycobacterium avium subsp. paratuberculosis
ccgaagucgacgc

SEQ ID NO: 2978450 - RNA, 21 nt, Mycobacterium avium subsp. paratuberculosis
ccgaagugcucgaacgcgccg

SEQ ID NO: 2978451 - RNA, 16 nt, Mycobacterium avium subsp. paratuberculosis
ccgaaguuggcgucgg

SEQ ID NO: 2978452 - RNA, 18 nt, Mycobacterium avium subsp. paratuberculosis
ccgaaguuggcgucgggc

SEQ ID NO: 2978453 - RNA, 20 nt, Mycobacterium avium subsp. paratuberculosis
ccgaaguuggcgucgggcac

SEQ ID NO: 2978454 - RNA, 16 nt, Mycobacterium avium subsp. paratuberculosis
ccgaaguugucggguu

SEQ ID NO: 2978455 - RNA, 13 nt, Mycobacterium avium subsp. paratuberculosis
ccgaauccaccgg

SEQ ID NO: 2978456 - RNA, 13 nt, Mycobacterium avium subsp. paratuberculosis
ccgaauccagcgc

SEQ ID NO: 2978457 - RNA, 18 nt, Mycobacterium avium subsp. paratuberculosis
ccgaauccagcgcgccgc

SEQ ID NO: 2978458 - RNA, 14 nt, Mycobacterium avium subsp. paratuberculosis
ccgaauccgggcau

SEQ ID NO: 2978459 - RNA, 12 nt, Mycobacterium avium subsp. paratuberculosis
ccgaaucgagcc

SEQ ID NO: 2978460 - RNA, 18 nt, Mycobacterium avium subsp. paratuberculosis
ccgaaucgccgagcucga

SEQ ID NO: 2978461 - RNA, 16 nt, Mycobacterium avium subsp. paratuberculosis
ccgaaucggucgacca

SEQ ID NO: 2978462 - RNA, 18 nt, Mycobacterium avium subsp. paratuberculosis
ccgaaucggucgaccagc

SEQ ID NO: 2978463 - RNA, 22 nt, Mycobacterium avium subsp. paratuberculosis
ccgaaucggucgaccagcuccu

SEQ ID NO: 2978464 - RNA, 18 nt, Mycobacterium avium subsp. paratuberculosis
ccgaaugagacgacccga

SEQ ID NO: 2978465 - RNA, 16 nt, Mycobacterium avium subsp. paratuberculosis
ccgaaugccacgccga

SEQ ID NO: 2978466 - RNA, 19 nt, Mycobacterium avium subsp. paratuberculosis
ccgaauugcgcugcaccgc

SEQ ID NO: 2978467 - RNA, 19 nt, Mycobacterium avium subsp. paratuberculosis
ccgaauugcuuacgcaucg

SEQ ID NO: 2978468 - RNA, 23 nt, Mycobacterium avium subsp. paratuberculosis
ccgaauugcuuacgcaucgccga

SEQ ID NO: 2978469 - RNA, 17 nt, Mycobacterium avium subsp. paratuberculosis
ccgaauuguucggccac

SEQ ID NO: 2978470 - RNA, 21 nt, Mycobacterium avium subsp. paratuberculosis
ccgaauuguucggccaccgcg

SEQ ID NO: 2978471 - RNA, 22 nt, Mycobacterium avium subsp. paratuberculosis
ccgaauuguucggccaccgcgc

SEQ ID NO: 2978472 - RNA, 17 nt, Mycobacterium avium subsp. paratuberculosis
ccgacaacauccgcgac

SEQ ID NO: 2978473 - RNA, 18 nt, Mycobacterium avium subsp. paratuberculosis
ccgacaacauccgcgacg

SEQ ID NO: 2978474 - RNA, 16 nt, Mycobacterium avium subsp. paratuberculosis
ccgacaacgacagcac

SEQ ID NO: 2978475 - RNA, 18 nt, Mycobacterium avium subsp. paratuberculosis
ccgacaagggccgggcgc

SEQ ID NO: 2978476 - RNA, 24 nt, Mycobacterium avium subsp. paratuberculosis
ccgacaagggccgggcgcuggccg

SEQ ID NO: 2978477 - RNA, 15 nt, Mycobacterium avium subsp. paratuberculosis
ccgacaccaccgcgc

SEQ ID NO: 2978478 - RNA, 13 nt, Mycobacterium avium subsp. paratuberculosis
ccgacaccaccgg

SEQ ID NO: 2978479 - RNA, 15 nt, Mycobacterium avium subsp. paratuberculosis
ccgacaccaccggcc

SEQ ID NO: 2978480 - RNA, 16 nt, Mycobacterium avium subsp. paratuberculosis
ccgacaccaccggccg

SEQ ID NO: 2978481 - RNA, 17 nt, Mycobacterium avium subsp. paratuberculosis
ccgacaccaccggccgc

SEQ ID NO: 2978482 - RNA, 18 nt, Mycobacterium avium subsp. paratuberculosis
ccgacaccaccggccgcc

SEQ ID NO: 2978483 - RNA, 19 nt, Mycobacterium avium subsp. paratuberculosis
ccgacaccaccggccgccc

SEQ ID NO: 2978484 - RNA, 13 nt, Mycobacterium avium subsp. paratuberculosis
ccgacaccagcgc

SEQ ID NO: 2978485 - RNA, 16 nt, Mycobacterium avium subsp. paratuberculosis
ccgacaccagcgcgca

SEQ ID NO: 2978486 - RNA, 17 nt, Mycobacterium avium subsp. paratuberculosis
ccgacaccagcgcgcac

SEQ ID NO: 2978487 - RNA, 16 nt, Mycobacterium avium subsp. paratuberculosis
ccgacaccagggugcg

SEQ ID NO: 2978488 - RNA, 13 nt, Mycobacterium avium subsp. paratuberculosis
ccgacaccccaca

SEQ ID NO: 2978489 - RNA, 16 nt, Mycobacterium avium subsp. paratuberculosis
ccgacaccccacaccg

SEQ ID NO: 2978490 - RNA, 19 nt, Mycobacterium avium subsp. paratuberculosis
ccgacaccccacaccgucc

SEQ ID NO: 2978491 - RNA, 18 nt, Mycobacterium avium subsp. paratuberculosis
ccgacaccccgaugcggu

SEQ ID NO: 2978492 - RNA, 14 nt, Mycobacterium avium subsp. paratuberculosis
ccgacaccgccagc

SEQ ID NO: 2978493 - RNA, 16 nt, Mycobacterium avium subsp. paratuberculosis
ccgacaccgccagcag

SEQ ID NO: 2978494 - RNA, 20 nt, Mycobacterium avium subsp. paratuberculosis
ccgacaccgccagcagcgcc

SEQ ID NO: 2978495 - RNA, 20 nt, Mycobacterium avium subsp. paratuberculosis
ccgacaccgccccgccgcgc

SEQ ID NO: 2978496 - RNA, 21 nt, Mycobacterium avium subsp. paratuberculosis
ccgacaccgccccgccgcgcc

SEQ ID NO: 2978497 - RNA, 22 nt, Mycobacterium avium subsp. paratuberculosis
ccgacaccgccccgccgcgccg

SEQ ID NO: 2978498 - RNA, 12 nt, Mycobacterium avium subsp. paratuberculosis
ccgacaccgccu

SEQ ID NO: 2978499 - RNA, 14 nt, Mycobacterium avium subsp. paratuberculosis
ccgacaccgccuuc

SEQ ID NO: 2978500 - RNA, 20 nt, Mycobacterium avium subsp. paratuberculosis
ccgacaccgccuucgacggc

SEQ ID NO: 2978501 - RNA, 15 nt, Mycobacterium avium subsp. paratuberculosis
ccgacaccggguccc

SEQ ID NO: 2978502 - RNA, 19 nt, Mycobacterium avium subsp. paratuberculosis
ccgacaccgggucccccgc

SEQ ID NO: 2978503 - RNA, 15 nt, Mycobacterium avium subsp. paratuberculosis
ccgacaccguggugg

SEQ ID NO: 2978504 - RNA, 21 nt, Mycobacterium avium subsp. paratuberculosis
ccgacaccgugguggcggcga

SEQ ID NO: 2978505 - RNA, 16 nt, Mycobacterium avium subsp. paratuberculosis
ccgacaccucgccguc

SEQ ID NO: 2978506 - RNA, 17 nt, Mycobacterium avium subsp. paratuberculosis
ccgacaccucgccgucc

SEQ ID NO: 2978507 - RNA, 12 nt, Mycobacterium avium subsp. paratuberculosis
ccgacacgccga

SEQ ID NO: 2978508 - RNA, 14 nt, Mycobacterium avium subsp. paratuberculosis
ccgacacgccgauc

SEQ ID NO: 2978509 - RNA, 15 nt, Mycobacterium avium subsp. paratuberculosis
ccgacacgccgaucg

SEQ ID NO: 2978510 - RNA, 15 nt, Mycobacterium avium subsp. paratuberculosis
ccgacacgccgaugu

SEQ ID NO: 2978511 - RNA, 20 nt, Mycobacterium avium subsp. paratuberculosis
ccgacagaugcggcaccagc

SEQ ID NO: 2978512 - RNA, 22 nt, Mycobacterium avium subsp. paratuberculosis
ccgacagaugcggcaccagccc

SEQ ID NO: 2978513 - RNA, 14 nt, Mycobacterium avium subsp. paratuberculosis
ccgacagcaaaccg

SEQ ID NO: 2978514 - RNA, 13 nt, Mycobacterium avium subsp. paratuberculosis
ccgacagcacccg

SEQ ID NO: 2978515 - RNA, 16 nt, Mycobacterium avium subsp. paratuberculosis
ccgacagcacccggcc

SEQ ID NO: 2978516 - RNA, 19 nt, Mycobacterium avium subsp. paratuberculosis
ccgacagcacccggccccc

SEQ ID NO: 2978517 - RNA, 14 nt, Mycobacterium avium subsp. paratuberculosis
ccgacagcaccucg

SEQ ID NO: 2978518 - RNA, 15 nt, Mycobacterium avium subsp. paratuberculosis
ccgacagcaccucgc

SEQ ID NO: 2978519 - RNA, 12 nt, Mycobacterium avium subsp. paratuberculosis
ccgacagcagcu

SEQ ID NO: 2978520 - RNA, 14 nt, Mycobacterium avium subsp. paratuberculosis
ccgacagcagcuca

SEQ ID NO: 2978521 - RNA, 11 nt, Mycobacterium avium subsp. paratuberculosis
ccgacagcccc

SEQ ID NO: 2978522 - RNA, 17 nt, Mycobacterium avium subsp. paratuberculosis
ccgacagcccccgcagc

SEQ ID NO: 2978523 - RNA, 19 nt, Mycobacterium avium subsp. paratuberculosis
ccgacagcccccgcagccc

SEQ ID NO: 2978524 - RNA, 21 nt, Mycobacterium avium subsp. paratuberculosis
ccgacagcccccgcagcccgu

SEQ ID NO: 2978525 - RNA, 14 nt, Mycobacterium avium subsp. paratuberculosis
ccgacagcccgccc

SEQ ID NO: 2978526 - RNA, 17 nt, Mycobacterium avium subsp. paratuberculosis
ccgacagccgcaccaga

SEQ ID NO: 2978527 - RNA, 17 nt, Mycobacterium avium subsp. paratuberculosis
ccgacagccgcaccggc

SEQ ID NO: 2978528 - RNA, 13 nt, Mycobacterium avium subsp. paratuberculosis
ccgacagcgccug

SEQ ID NO: 2978529 - RNA, 14 nt, Mycobacterium avium subsp. paratuberculosis
ccgacagcgccugc

SEQ ID NO: 2978530 - RNA, 18 nt, Mycobacterium avium subsp. paratuberculosis
ccgacagcgcgucggcga

SEQ ID NO: 2978531 - RNA, 13 nt, Mycobacterium avium subsp. paratuberculosis
ccgacagcgggau

SEQ ID NO: 2978532 - RNA, 17 nt, Mycobacterium avium subsp. paratuberculosis
ccgacagcgucguccau

SEQ ID NO: 2978533 - RNA, 18 nt, Mycobacterium avium subsp. paratuberculosis
ccgacagcuugauguugc

SEQ ID NO: 2978534 - RNA, 16 nt, Mycobacterium avium subsp. paratuberculosis
ccgacagggagccgac

SEQ ID NO: 2978535 - RNA, 14 nt, Mycobacterium avium subsp. paratuberculosis
ccgacagggccagc

SEQ ID NO: 2978536 - RNA, 15 nt, Mycobacterium avium subsp. paratuberculosis
ccgacagggccagcg

SEQ ID NO: 2978537 - RNA, 17 nt, Mycobacterium avium subsp. paratuberculosis
ccgacagggccagcgcc

SEQ ID NO: 2978538 - RNA, 22 nt, Mycobacterium avium subsp. paratuberculosis
ccgacagguagcaggcgcgcag

SEQ ID NO: 2978539 - RNA, 23 nt, Mycobacterium avium subsp. paratuberculosis
ccgacagguagcaggcgcgcagc

SEQ ID NO: 2978540 - RNA, 19 nt, Mycobacterium avium subsp. paratuberculosis
ccgacaggucgaagggcau

SEQ ID NO: 2978541 - RNA, 22 nt, Mycobacterium avium subsp. paratuberculosis
ccgacaggucgaagggcaucgg

SEQ ID NO: 2978542 - RNA, 15 nt, Mycobacterium avium subsp. paratuberculosis
ccgacagucccacca

SEQ ID NO: 2978543 - RNA, 17 nt, Mycobacterium avium subsp. paratuberculosis
ccgacagucgcgggcag

SEQ ID NO: 2978544 - RNA, 18 nt, Mycobacterium avium subsp. paratuberculosis
ccgacagucgcgggcagc

SEQ ID NO: 2978545 - RNA, 20 nt, Mycobacterium avium subsp. paratuberculosis
ccgacagucgcgggcagccg

SEQ ID NO: 2978546 - RNA, 22 nt, Mycobacterium avium subsp. paratuberculosis
ccgacagucgcgggcggggcgc

SEQ ID NO: 2978547 - RNA, 17 nt, Mycobacterium avium subsp. paratuberculosis
ccgacaguucggcgcgc

SEQ ID NO: 2978548 - RNA, 16 nt, Mycobacterium avium subsp. paratuberculosis
ccgacauaggucaggu

SEQ ID NO: 2978549 - RNA, 21 nt, Mycobacterium avium subsp. paratuberculosis
ccgacaucaccaaccgcucgg

SEQ ID NO: 2978550 - RNA, 16 nt, Mycobacterium avium subsp. paratuberculosis
ccgacaucagaucgcc

SEQ ID NO: 2978551 - RNA, 19 nt, Mycobacterium avium subsp. paratuberculosis
ccgacaucagaucgccgac

SEQ ID NO: 2978552 - RNA, 21 nt, Mycobacterium avium subsp. paratuberculosis
ccgacaucagaucgccgacga

SEQ ID NO: 2978553 - RNA, 15 nt, Mycobacterium avium subsp. paratuberculosis
ccgacaucagugcgg

SEQ ID NO: 2978554 - RNA, 19 nt, Mycobacterium avium subsp. paratuberculosis
ccgacaucagugcgggcau

SEQ ID NO: 2978555 - RNA, 22 nt, Mycobacterium avium subsp. paratuberculosis
ccgacaucagugcgggcaucgg

SEQ ID NO: 2978556 - RNA, 23 nt, Mycobacterium avium subsp. paratuberculosis
ccgacauccaggaccgcgcgccg

SEQ ID NO: 2978557 - RNA, 21 nt, Mycobacterium avium subsp. paratuberculosis
ccgacaucgaaugcagcggcu

SEQ ID NO: 2978558 - RNA, 17 nt, Mycobacterium avium subsp. paratuberculosis
ccgacaucgccaucagc

SEQ ID NO: 2978559 - RNA, 19 nt, Mycobacterium avium subsp. paratuberculosis
ccgacaucgccaucagcag

SEQ ID NO: 2978560 - RNA, 13 nt, Mycobacterium avium subsp. paratuberculosis
ccgacaucgcggc

SEQ ID NO: 2978561 - RNA, 17 nt, Mycobacterium avium subsp. paratuberculosis
ccgacaucgcggcgauc

SEQ ID NO: 2978562 - RNA, 16 nt, Mycobacterium avium subsp. paratuberculosis
ccgacaucgucggcuc

SEQ ID NO: 2978563 - RNA, 17 nt, Mycobacterium avium subsp. paratuberculosis
ccgacaucgucggcucg

SEQ ID NO: 2978564 - RNA, 17 nt, Mycobacterium avium subsp. paratuberculosis
ccgacaucugccgggcg

SEQ ID NO: 2978565 - RNA, 18 nt, Mycobacterium avium subsp. paratuberculosis
ccgacaucugccgggcgg

SEQ ID NO: 2978566 - RNA, 19 nt, Mycobacterium avium subsp. paratuberculosis
ccgacaucugccgggcggc

SEQ ID NO: 2978567 - RNA, 16 nt, Mycobacterium avium subsp. paratuberculosis
ccgacauggacgcggc

SEQ ID NO: 2978568 - RNA, 20 nt, Mycobacterium avium subsp. paratuberculosis
ccgacauggacgcggccuca

SEQ ID NO: 2978569 - RNA, 16 nt, Mycobacterium avium subsp. paratuberculosis
ccgacauggccagcac

SEQ ID NO: 2978570 - RNA, 18 nt, Mycobacterium avium subsp. paratuberculosis
ccgacauggccagcacca

SEQ ID NO: 2978571 - RNA, 19 nt, Mycobacterium avium subsp. paratuberculosis
ccgacauggccagcaccau

SEQ ID NO: 2978572 - RNA, 20 nt, Mycobacterium avium subsp. paratuberculosis
ccgacauggccagcaccauc

SEQ ID NO: 2978573 - RNA, 14 nt, Mycobacterium avium subsp. paratuberculosis
ccgaccaacgggcg

SEQ ID NO: 2978574 - RNA, 18 nt, Mycobacterium avium subsp. paratuberculosis
ccgaccaacgggcggcgg

SEQ ID NO: 2978575 - RNA, 13 nt, Mycobacterium avium subsp. paratuberculosis
ccgaccacaccgg

SEQ ID NO: 2978576 - RNA, 16 nt, Mycobacterium avium subsp. paratuberculosis
ccgaccacaccggcgc

SEQ ID NO: 2978577 - RNA, 19 nt, Mycobacterium avium subsp. paratuberculosis
ccgaccacaccggcgcugc

SEQ ID NO: 2978578 - RNA, 22 nt, Mycobacterium avium subsp. paratuberculosis
ccgaccacccccagcccgccgg

SEQ ID NO: 2978579 - RNA, 23 nt, Mycobacterium avium subsp. paratuberculosis
ccgaccaccuugcgcagcagcag

SEQ ID NO: 2978580 - RNA, 15 nt, Mycobacterium avium subsp. paratuberculosis
ccgaccacgccgcgc

SEQ ID NO: 2978581 - RNA, 16 nt, Mycobacterium avium subsp. paratuberculosis
ccgaccacgccgcgcu

SEQ ID NO: 2978582 - RNA, 14 nt, Mycobacterium avium subsp. paratuberculosis
ccgaccacggcccc

SEQ ID NO: 2978583 - RNA, 13 nt, Mycobacterium avium subsp. paratuberculosis
ccgaccagcaccc

SEQ ID NO: 2978584 - RNA, 15 nt, Mycobacterium avium subsp. paratuberculosis
ccgaccagcacccgg

SEQ ID NO: 2978585 - RNA, 14 nt, Mycobacterium avium subsp. paratuberculosis
ccgaccagcaccgc

SEQ ID NO: 2978586 - RNA, 17 nt, Mycobacterium avium subsp. paratuberculosis
ccgaccagcaccgcggc

SEQ ID NO: 2978587 - RNA, 18 nt, Mycobacterium avium subsp. paratuberculosis
ccgaccagcaccgcggcg

SEQ ID NO: 2978588 - RNA, 16 nt, Mycobacterium avium subsp. paratuberculosis
ccgaccagcaggacgc

SEQ ID NO: 2978589 - RNA, 24 nt, Mycobacterium avium subsp. paratuberculosis
ccgaccagcaggacgcgcccggcg

SEQ ID NO: 2978590 - RNA, 12 nt, Mycobacterium avium subsp. paratuberculosis
ccgaccagccgg

SEQ ID NO: 2978591 - RNA, 12 nt, Mycobacterium avium subsp. paratuberculosis
ccgaccagcgcg

SEQ ID NO: 2978592 - RNA, 14 nt, Mycobacterium avium subsp. paratuberculosis
ccgaccagcgcgau

SEQ ID NO: 2978593 - RNA, 13 nt, Mycobacterium avium subsp. paratuberculosis
ccgaccagcggcc

SEQ ID NO: 2978594 - RNA, 18 nt, Mycobacterium avium subsp. paratuberculosis
ccgaccagcggcccaccg

SEQ ID NO: 2978595 - RNA, 19 nt, Mycobacterium avium subsp. paratuberculosis
ccgaccagcggcccaccgc

SEQ ID NO: 2978596 - RNA, 21 nt, Mycobacterium avium subsp. paratuberculosis
ccgaccagcggcccaccgcga

SEQ ID NO: 2978597 - RNA, 13 nt, Mycobacterium avium subsp. paratuberculosis
ccgaccagcggga

SEQ ID NO: 2978598 - RNA, 16 nt, Mycobacterium avium subsp. paratuberculosis
ccgaccagcgggauga

SEQ ID NO: 2978599 - RNA, 17 nt, Mycobacterium avium subsp. paratuberculosis
ccgaccagcgggccgac

SEQ ID NO: 2978600 - RNA, 20 nt, Mycobacterium avium subsp. paratuberculosis
ccgaccagcgggccgacagc

SEQ ID NO: 2978601 - RNA, 17 nt, Mycobacterium avium subsp. paratuberculosis
ccgaccaggaacacggc

SEQ ID NO: 2978602 - RNA, 21 nt, Mycobacterium avium subsp. paratuberculosis
ccgaccaggaacacggcucgg

SEQ ID NO: 2978603 - RNA, 14 nt, Mycobacterium avium subsp. paratuberculosis
ccgaccaggaagua

SEQ ID NO: 2978604 - RNA, 17 nt, Mycobacterium avium subsp. paratuberculosis
ccgaccaggaucgggau

SEQ ID NO: 2978605 - RNA, 15 nt, Mycobacterium avium subsp. paratuberculosis
ccgaccagguagcgc

SEQ ID NO: 2978606 - RNA, 22 nt, Mycobacterium avium subsp. paratuberculosis
ccgaccagguccgguucgaccg

SEQ ID NO: 2978607 - RNA, 18 nt, Mycobacterium avium subsp. paratuberculosis
ccgaccaguucggccacc

SEQ ID NO: 2978608 - RNA, 19 nt, Mycobacterium avium subsp. paratuberculosis
ccgaccaguucggccaccg

SEQ ID NO: 2978609 - RNA, 14 nt, Mycobacterium avium subsp. paratuberculosis
ccgacccaauacga

SEQ ID NO: 2978610 - RNA, 19 nt, Mycobacterium avium subsp. paratuberculosis
ccgacccaauacgaucagc

SEQ ID NO: 2978611 - RNA, 19 nt, Mycobacterium avium subsp. paratuberculosis
ccgaccccgaugcgcucgc

SEQ ID NO: 2978612 - RNA, 12 nt, Mycobacterium avium subsp. paratuberculosis
ccgaccccgcca

SEQ ID NO: 2978613 - RNA, 14 nt, Mycobacterium avium subsp. paratuberculosis
ccgaccccgccagc

SEQ ID NO: 2978614 - RNA, 15 nt, Mycobacterium avium subsp. paratuberculosis
ccgaccccggcgagc

SEQ ID NO: 2978615 - RNA, 19 nt, Mycobacterium avium subsp. paratuberculosis
ccgaccccggcgagcgcgu

SEQ ID NO: 2978616 - RNA, 16 nt, Mycobacterium avium subsp. paratuberculosis
ccgaccccucggcggc

SEQ ID NO: 2978617 - RNA, 19 nt, Mycobacterium avium subsp. paratuberculosis
ccgaccccucggcggccgu

SEQ ID NO: 2978618 - RNA, 22 nt, Mycobacterium avium subsp. paratuberculosis
ccgaccccucggcggccgucgg

SEQ ID NO: 2978619 - RNA, 12 nt, Mycobacterium avium subsp. paratuberculosis
ccgacccgaagc

SEQ ID NO: 2978620 - RNA, 16 nt, Mycobacterium avium subsp. paratuberculosis
ccgacccgcaccaccg

SEQ ID NO: 2978621 - RNA, 13 nt, Mycobacterium avium subsp. paratuberculosis
ccgacccgcccgc

SEQ ID NO: 2978622 - RNA, 15 nt, Mycobacterium avium subsp. paratuberculosis
ccgacccgcugcagc

SEQ ID NO: 2978623 - RNA, 13 nt, Mycobacterium avium subsp. paratuberculosis
ccgacccggccag

SEQ ID NO: 2978624 - RNA, 16 nt, Mycobacterium avium subsp. paratuberculosis
ccgacccggccagcgg

SEQ ID NO: 2978625 - RNA, 18 nt, Mycobacterium avium subsp. paratuberculosis
ccgacccggccagcggca

SEQ ID NO: 2978626 - RNA, 13 nt, Mycobacterium avium subsp. paratuberculosis
ccgacccggccga

SEQ ID NO: 2978627 - RNA, 15 nt, Mycobacterium avium subsp. paratuberculosis
ccgacccggccgaug

SEQ ID NO: 2978628 - RNA, 18 nt, Mycobacterium avium subsp. paratuberculosis
ccgacccggucagcucgc

SEQ ID NO: 2978629 - RNA, 19 nt, Mycobacterium avium subsp. paratuberculosis
ccgacccggucagcucgcc

SEQ ID NO: 2978630 - RNA, 23 nt, Mycobacterium avium subsp. paratuberculosis
ccgacccggucagcucgccgucc

SEQ ID NO: 2978631 - RNA, 24 nt, Mycobacterium avium subsp. paratuberculosis
ccgacccggucagcucgccguccg

SEQ ID NO: 2978632 - RNA, 21 nt, Mycobacterium avium subsp. paratuberculosis
ccgacccgguugauccggauc

SEQ ID NO: 2978633 - RNA, 12 nt, Mycobacterium avium subsp. paratuberculosis
ccgacccgucca

SEQ ID NO: 2978634 - RNA, 16 nt, Mycobacterium avium subsp. paratuberculosis
ccgacccguccagcgu

SEQ ID NO: 2978635 - RNA, 14 nt, Mycobacterium avium subsp. paratuberculosis
ccgacccugcgucc

SEQ ID NO: 2978636 - RNA, 19 nt, Mycobacterium avium subsp. paratuberculosis
ccgacccugcguccggccc

SEQ ID NO: 2978637 - RNA, 20 nt, Mycobacterium avium subsp. paratuberculosis
ccgacccugcguccggcccg

SEQ ID NO: 2978638 - RNA, 12 nt, Mycobacterium avium subsp. paratuberculosis
ccgaccgacagc

SEQ ID NO: 2978639 - RNA, 16 nt, Mycobacterium avium subsp. paratuberculosis
ccgaccgacagccgca

SEQ ID NO: 2978640 - RNA, 12 nt, Mycobacterium avium subsp. paratuberculosis
ccgaccgacagu

SEQ ID NO: 2978641 - RNA, 21 nt, Mycobacterium avium subsp. paratuberculosis
ccgaccgacaguucggcgcgc

SEQ ID NO: 2978642 - RNA, 16 nt, Mycobacterium avium subsp. paratuberculosis
ccgaccgacgcgguca

SEQ ID NO: 2978643 - RNA, 21 nt, Mycobacterium avium subsp. paratuberculosis
ccgaccgacgcggucaccggc

SEQ ID NO: 2978644 - RNA, 16 nt, Mycobacterium avium subsp. paratuberculosis
ccgaccgagggcgcgg

SEQ ID NO: 2978645 - RNA, 12 nt, Mycobacterium avium subsp. paratuberculosis
ccgaccgccacc

SEQ ID NO: 2978646 - RNA, 18 nt, Mycobacterium avium subsp. paratuberculosis
ccgaccgccaccacccgg

SEQ ID NO: 2978647 - RNA, 16 nt, Mycobacterium avium subsp. paratuberculosis
ccgaccgcccgcuguu

SEQ ID NO: 2978648 - RNA, 19 nt, Mycobacterium avium subsp. paratuberculosis
ccgaccgccgagcgggcga

SEQ ID NO: 2978649 - RNA, 20 nt, Mycobacterium avium subsp. paratuberculosis
ccgaccgccgagcgggcgau

SEQ ID NO: 2978650 - RNA, 22 nt, Mycobacterium avium subsp. paratuberculosis
ccgaccgccgagcgggcgaucu

SEQ ID NO: 2978651 - RNA, 11 nt, Mycobacterium avium subsp. paratuberculosis
ccgaccgccgc

SEQ ID NO: 2978652 - RNA, 13 nt, Mycobacterium avium subsp. paratuberculosis
ccgaccgccgcca

SEQ ID NO: 2978653 - RNA, 12 nt, Mycobacterium avium subsp. paratuberculosis
ccgaccgccgcg

SEQ ID NO: 2978654 - RNA, 13 nt, Mycobacterium avium subsp. paratuberculosis
ccgaccgccgcgg

SEQ ID NO: 2978655 - RNA, 21 nt, Mycobacterium avium subsp. paratuberculosis
ccgaccgccgcggccgccuuc

SEQ ID NO: 2978656 - RNA, 13 nt, Mycobacterium avium subsp. paratuberculosis
ccgaccgccucga

SEQ ID NO: 2978657 - RNA, 12 nt, Mycobacterium avium subsp. paratuberculosis
ccgaccgcgagc

SEQ ID NO: 2978658 - RNA, 18 nt, Mycobacterium avium subsp. paratuberculosis
ccgaccgcgaugcagaac

SEQ ID NO: 2978659 - RNA, 15 nt, Mycobacterium avium subsp. paratuberculosis
ccgaccgcgccgaac

SEQ ID NO: 2978660 - RNA, 21 nt, Mycobacterium avium subsp. paratuberculosis
ccgaccgcguacagggcgucg

SEQ ID NO: 2978661 - RNA, 14 nt, Mycobacterium avium subsp. paratuberculosis
ccgaccggcucagc

SEQ ID NO: 2978662 - RNA, 16 nt, Mycobacterium avium subsp. paratuberculosis
ccgaccggcucagccc

SEQ ID NO: 2978663 - RNA, 19 nt, Mycobacterium avium subsp. paratuberculosis
ccgaccggcucagcccggc

SEQ ID NO: 2978664 - RNA, 22 nt, Mycobacterium avium subsp. paratuberculosis
ccgaccggcucucagccggaac

SEQ ID NO: 2978665 - RNA, 12 nt, Mycobacterium avium subsp. paratuberculosis
ccgaccgggcgc

SEQ ID NO: 2978666 - RNA, 22 nt, Mycobacterium avium subsp. paratuberculosis
ccgaccgggcgcuccguugggu

SEQ ID NO: 2978667 - RNA, 13 nt, Mycobacterium avium subsp. paratuberculosis
ccgaccgguccgc

SEQ ID NO: 2978668 - RNA, 14 nt, Mycobacterium avium subsp. paratuberculosis
ccgaccggucucga

SEQ ID NO: 2978669 - RNA, 17 nt, Mycobacterium avium subsp. paratuberculosis
ccgaccggucucgaccg

SEQ ID NO: 2978670 - RNA, 14 nt, Mycobacterium avium subsp. paratuberculosis
ccgaccucgaggcc

SEQ ID NO: 2978671 - RNA, 13 nt, Mycobacterium avium subsp. paratuberculosis
ccgaccucggcca

SEQ ID NO: 2978672 - RNA, 15 nt, Mycobacterium avium subsp. paratuberculosis
ccgaccucggccagc

SEQ ID NO: 2978673 - RNA, 18 nt, Mycobacterium avium subsp. paratuberculosis
ccgaccucggccagcgug

SEQ ID NO: 2978674 - RNA, 13 nt, Mycobacterium avium subsp. paratuberculosis
ccgaccucggcga

SEQ ID NO: 2978675 - RNA, 15 nt, Mycobacterium avium subsp. paratuberculosis
ccgaccucggcgacg

SEQ ID NO: 2978676 - RNA, 13 nt, Mycobacterium avium subsp. paratuberculosis
ccgaccucgucga

SEQ ID NO: 2978677 - RNA, 21 nt, Mycobacterium avium subsp. paratuberculosis
ccgaccugcgcgacggcgcug

SEQ ID NO: 2978678 - RNA, 14 nt, Mycobacterium avium subsp. paratuberculosis
ccgaccugggcggc

SEQ ID NO: 2978679 - RNA, 21 nt, Mycobacterium avium subsp. paratuberculosis
ccgaccugggcggccaccgcg

SEQ ID NO: 2978680 - RNA, 13 nt, Mycobacterium avium subsp. paratuberculosis
ccgaccuggucgc

SEQ ID NO: 2978681 - RNA, 15 nt, Mycobacterium avium subsp. paratuberculosis
ccgaccuggucgccg

SEQ ID NO: 2978682 - RNA, 16 nt, Mycobacterium avium subsp. paratuberculosis
ccgaccuggucgccga

SEQ ID NO: 2978683 - RNA, 16 nt, Mycobacterium avium subsp. paratuberculosis
ccgaccuugacccagg

SEQ ID NO: 2978684 - RNA, 20 nt, Mycobacterium avium subsp. paratuberculosis
ccgaccuugacccaggcccg

SEQ ID NO: 2978685 - RNA, 18 nt, Mycobacterium avium subsp. paratuberculosis
ccgaccuuuugcccggcg

SEQ ID NO: 2978686 - RNA, 20 nt, Mycobacterium avium subsp. paratuberculosis
ccgacgaaaucgucgggcac

SEQ ID NO: 2978687 - RNA, 22 nt, Mycobacterium avium subsp. paratuberculosis
ccgacgaaaucgucgggcacca

SEQ ID NO: 2978688 - RNA, 23 nt, Mycobacterium avium subsp. paratuberculosis
ccgacgaaaucgucgggcaccag

SEQ ID NO: 2978689 - RNA, 20 nt, Mycobacterium avium subsp. paratuberculosis
ccgacgaaaucgucgggccg

SEQ ID NO: 2978690 - RNA, 17 nt, Mycobacterium avium subsp. paratuberculosis
ccgacgaacagguucgc

SEQ ID NO: 2978691 - RNA, 15 nt, Mycobacterium avium subsp. paratuberculosis
ccgacgaagaucccg

SEQ ID NO: 2978692 - RNA, 22 nt, Mycobacterium avium subsp. paratuberculosis
ccgacgaagaucccgcuggcca

SEQ ID NO: 2978693 - RNA, 16 nt, Mycobacterium avium subsp. paratuberculosis
ccgacgaagccgccgc

SEQ ID NO: 2978694 - RNA, 18 nt, Mycobacterium avium subsp. paratuberculosis
ccgacgaagccgccgccc

SEQ ID NO: 2978695 - RNA, 17 nt, Mycobacterium avium subsp. paratuberculosis
ccgacgaccaucagcgc

SEQ ID NO: 2978696 - RNA, 19 nt, Mycobacterium avium subsp. paratuberculosis
ccgacgaccaucagcgccc

SEQ ID NO: 2978697 - RNA, 22 nt, Mycobacterium avium subsp. paratuberculosis
ccgacgaccucgucgucgauga

SEQ ID NO: 2978698 - RNA, 16 nt, Mycobacterium avium subsp. paratuberculosis
ccgacgacgacgucga

SEQ ID NO: 2978699 - RNA, 22 nt, Mycobacterium avium subsp. paratuberculosis
ccgacgacgacgucgacgaccc

SEQ ID NO: 2978700 - RNA, 14 nt, Mycobacterium avium subsp. paratuberculosis
ccgacgacgccguc

SEQ ID NO: 2978701 - RNA, 12 nt, Mycobacterium avium subsp. paratuberculosis
ccgacgacgucg

SEQ ID NO: 2978702 - RNA, 15 nt, Mycobacterium avium subsp. paratuberculosis
ccgacgacgucgcgc

SEQ ID NO: 2978703 - RNA, 13 nt, Mycobacterium avium subsp. paratuberculosis
ccgacgacgucgu

SEQ ID NO: 2978704 - RNA, 20 nt, Mycobacterium avium subsp. paratuberculosis
ccgacgacgugacgaccugg

SEQ ID NO: 2978705 - RNA, 22 nt, Mycobacterium avium subsp. paratuberculosis
ccgacgagaucagcaccaggug

SEQ ID NO: 2978706 - RNA, 13 nt, Mycobacterium avium subsp. paratuberculosis
ccgacgagcucgc

SEQ ID NO: 2978707 - RNA, 15 nt, Mycobacterium avium subsp. paratuberculosis
ccgacgagcucgccg

SEQ ID NO: 2978708 - RNA, 16 nt, Mycobacterium avium subsp. paratuberculosis
ccgacgaggagaccuc

SEQ ID NO: 2978709 - RNA, 18 nt, Mycobacterium avium subsp. paratuberculosis
ccgacgaggagaccuccu

SEQ ID NO: 2978710 - RNA, 14 nt, Mycobacterium avium subsp. paratuberculosis
ccgacgagucgccg

SEQ ID NO: 2978711 - RNA, 17 nt, Mycobacterium avium subsp. paratuberculosis
ccgacgauacgugcucc

SEQ ID NO: 2978712 - RNA, 18 nt, Mycobacterium avium subsp. paratuberculosis
ccgacgaucccggcgagc

SEQ ID NO: 2978713 - RNA, 14 nt, Mycobacterium avium subsp. paratuberculosis
ccgacgauccgcgc

SEQ ID NO: 2978714 - RNA, 16 nt, Mycobacterium avium subsp. paratuberculosis
ccgacgauccgcgccg

SEQ ID NO: 2978715 - RNA, 15 nt, Mycobacterium avium subsp. paratuberculosis
ccgacgauccgggcc

SEQ ID NO: 2978716 - RNA, 16 nt, Mycobacterium avium subsp. paratuberculosis
ccgacgauccgggccg

SEQ ID NO: 2978717 - RNA, 19 nt, Mycobacterium avium subsp. paratuberculosis
ccgacgauccgggccgguc

SEQ ID NO: 2978718 - RNA, 21 nt, Mycobacterium avium subsp. paratuberculosis
ccgacgauccgggccggucgg

SEQ ID NO: 2978719 - RNA, 16 nt, Mycobacterium avium subsp. paratuberculosis
ccgacgauccgggcgc

SEQ ID NO: 2978720 - RNA, 22 nt, Mycobacterium avium subsp. paratuberculosis
ccgacgauccgggcgcccuuga

SEQ ID NO: 2978721 - RNA, 15 nt, Mycobacterium avium subsp. paratuberculosis
ccgacgaucgcgccg

SEQ ID NO: 2978722 - RNA, 21 nt, Mycobacterium avium subsp. paratuberculosis
ccgacgaucgcgccggccgcc

SEQ ID NO: 2978723 - RNA, 22 nt, Mycobacterium avium subsp. paratuberculosis
ccgacgaucgcgccggccgccg

SEQ ID NO: 2978724 - RNA, 20 nt, Mycobacterium avium subsp. paratuberculosis
ccgacgaugaacagucggcc

SEQ ID NO: 2978725 - RNA, 16 nt, Mycobacterium avium subsp. paratuberculosis
ccgacgaugagggcca

SEQ ID NO: 2978726 - RNA, 20 nt, Mycobacterium avium subsp. paratuberculosis
ccgacgaugagggccagcag

SEQ ID NO: 2978727 - RNA, 18 nt, Mycobacterium avium subsp. paratuberculosis
ccgacgaugagggugaug

SEQ ID NO: 2978728 - RNA, 17 nt, Mycobacterium avium subsp. paratuberculosis
ccgacgaugcggggcgg

SEQ ID NO: 2978729 - RNA, 20 nt, Mycobacterium avium subsp. paratuberculosis
ccgacgaugcggggcggcgg

SEQ ID NO: 2978730 - RNA, 22 nt, Mycobacterium avium subsp. paratuberculosis
ccgacgaugucgaaacccagga

SEQ ID NO: 2978731 - RNA, 18 nt, Mycobacterium avium subsp. paratuberculosis
ccgacgcauguccgccgu

SEQ ID NO: 2978732 - RNA, 19 nt, Mycobacterium avium subsp. paratuberculosis
ccgacgcauguccgccguc

SEQ ID NO: 2978733 - RNA, 20 nt, Mycobacterium avium subsp. paratuberculosis
ccgacgcauguccgccguca

SEQ ID NO: 2978734 - RNA, 15 nt, Mycobacterium avium subsp. paratuberculosis
ccgacgccacgucgu

SEQ ID NO: 2978735 - RNA, 15 nt, Mycobacterium avium subsp. paratuberculosis
ccgacgccagcacgu

SEQ ID NO: 2978736 - RNA, 21 nt, Mycobacterium avium subsp. paratuberculosis
ccgacgccagcacguggccgg

SEQ ID NO: 2978737 - RNA, 14 nt, Mycobacterium avium subsp. paratuberculosis
ccgacgccagcggg

SEQ ID NO: 2978738 - RNA, 15 nt, Mycobacterium avium subsp. paratuberculosis
ccgacgccagcgggc

SEQ ID NO: 2978739 - RNA, 20 nt, Mycobacterium avium subsp. paratuberculosis
ccgacgccagcgggccgugc

SEQ ID NO: 2978740 - RNA, 14 nt, Mycobacterium avium subsp. paratuberculosis
ccgacgcccacagc

SEQ ID NO: 2978741 - RNA, 15 nt, Mycobacterium avium subsp. paratuberculosis
ccgacgcccacagcg

SEQ ID NO: 2978742 - RNA, 17 nt, Mycobacterium avium subsp. paratuberculosis
ccgacgcccacagcgcc

SEQ ID NO: 2978743 - RNA, 19 nt, Mycobacterium avium subsp. paratuberculosis
ccgacgcccacagcgccag

SEQ ID NO: 2978744 - RNA, 20 nt, Mycobacterium avium subsp. paratuberculosis
ccgacgcccacagcgccagc

SEQ ID NO: 2978745 - RNA, 16 nt, Mycobacterium avium subsp. paratuberculosis
ccgacgcccagcaccg

SEQ ID NO: 2978746 - RNA, 17 nt, Mycobacterium avium subsp. paratuberculosis
ccgacgcccagcaccga

SEQ ID NO: 2978747 - RNA, 14 nt, Mycobacterium avium subsp. paratuberculosis
ccgacgcccagcgc

SEQ ID NO: 2978748 - RNA, 17 nt, Mycobacterium avium subsp. paratuberculosis
ccgacgcccagcgcggc

SEQ ID NO: 2978749 - RNA, 19 nt, Mycobacterium avium subsp. paratuberculosis
ccgacgcccagcgcggcga

SEQ ID NO: 2978750 - RNA, 14 nt, Mycobacterium avium subsp. paratuberculosis
ccgacgcccaggcu

SEQ ID NO: 2978751 - RNA, 13 nt, Mycobacterium avium subsp. paratuberculosis
ccgacgcccggcu

SEQ ID NO: 2978752 - RNA, 19 nt, Mycobacterium avium subsp. paratuberculosis
ccgacgcccggcuucgccg

SEQ ID NO: 2978753 - RNA, 21 nt, Mycobacterium avium subsp. paratuberculosis
ccgacgcccggcuucgccgcc

SEQ ID NO: 2978754 - RNA, 22 nt, Mycobacterium avium subsp. paratuberculosis
ccgacgcccggcuucgccgccg

SEQ ID NO: 2978755 - RNA, 20 nt, Mycobacterium avium subsp. paratuberculosis
ccgacgccgaagaucagcgc

SEQ ID NO: 2978756 - RNA, 21 nt, Mycobacterium avium subsp. paratuberculosis
ccgacgccgaagaucagcgcg

SEQ ID NO: 2978757 - RNA, 14 nt, Mycobacterium avium subsp. paratuberculosis
ccgacgccgacacc

SEQ ID NO: 2978758 - RNA, 16 nt, Mycobacterium avium subsp. paratuberculosis
ccgacgccgacaccag

SEQ ID NO: 2978759 - RNA, 13 nt, Mycobacterium avium subsp. paratuberculosis
ccgacgccggcca

SEQ ID NO: 2978760 - RNA, 22 nt, Mycobacterium avium subsp. paratuberculosis
ccgacgccggccaccaacaggu

SEQ ID NO: 2978761 - RNA, 13 nt, Mycobacterium avium subsp. paratuberculosis
ccgacgccgucga

SEQ ID NO: 2978762 - RNA, 20 nt, Mycobacterium avium subsp. paratuberculosis
ccgacgccgucgagccuggu

SEQ ID NO: 2978763 - RNA, 22 nt, Mycobacterium avium subsp. paratuberculosis
ccgacgccuccacauacgcggc

SEQ ID NO: 2978764 - RNA, 14 nt, Mycobacterium avium subsp. paratuberculosis
ccgacgccugcgcg

SEQ ID NO: 2978765 - RNA, 18 nt, Mycobacterium avium subsp. paratuberculosis
ccgacgcgacggucgugc

SEQ ID NO: 2978766 - RNA, 21 nt, Mycobacterium avium subsp. paratuberculosis
ccgacgcgacggucgugcugg

SEQ ID NO: 2978767 - RNA, 17 nt, Mycobacterium avium subsp. paratuberculosis
ccgacgcgccgucggcc

SEQ ID NO: 2978768 - RNA, 23 nt, Mycobacterium avium subsp. paratuberculosis
ccgacgcgcugcgcgccgcccuc

SEQ ID NO: 2978769 - RNA, 14 nt, Mycobacterium avium subsp. paratuberculosis
ccgacgcggcgacc

SEQ ID NO: 2978770 - RNA, 19 nt, Mycobacterium avium subsp. paratuberculosis
ccgacgcggcgaccaccac

SEQ ID NO: 2978771 - RNA, 23 nt, Mycobacterium avium subsp. paratuberculosis
ccgacgcggcgaccaccaccgcc

SEQ ID NO: 2978772 - RNA, 13 nt, Mycobacterium avium subsp. paratuberculosis
ccgacgcggcgcg

SEQ ID NO: 2978773 - RNA, 18 nt, Mycobacterium avium subsp. paratuberculosis
ccgacgcggcgcgacacc

SEQ ID NO: 2978774 - RNA, 21 nt, Mycobacterium avium subsp. paratuberculosis
ccgacgcggcgcgacaccgcg

SEQ ID NO: 2978775 - RNA, 23 nt, Mycobacterium avium subsp. paratuberculosis
ccgacgcggcgcgacaccgcggc

SEQ ID NO: 2978776 - RNA, 13 nt, Mycobacterium avium subsp. paratuberculosis
ccgacgcggcggc

SEQ ID NO: 2978777 - RNA, 17 nt, Mycobacterium avium subsp. paratuberculosis
ccgacgcggcggccgac

SEQ ID NO: 2978778 - RNA, 15 nt, Mycobacterium avium subsp. paratuberculosis
ccgacgcggucaccg

SEQ ID NO: 2978779 - RNA, 22 nt, Mycobacterium avium subsp. paratuberculosis
ccgacgcgguggcgugcucgau

SEQ ID NO: 2978780 - RNA, 12 nt, Mycobacterium avium subsp. paratuberculosis
ccgacgcgucgc

SEQ ID NO: 2978781 - RNA, 23 nt, Mycobacterium avium subsp. paratuberculosis
ccgacgcugacgaugcggccggc

SEQ ID NO: 2978782 - RNA, 13 nt, Mycobacterium avium subsp. paratuberculosis
ccgacgcuggccg

SEQ ID NO: 2978783 - RNA, 14 nt, Mycobacterium avium subsp. paratuberculosis
ccgacgcuggccga

SEQ ID NO: 2978784 - RNA, 16 nt, Mycobacterium avium subsp. paratuberculosis
ccgacgcuggccgaga

SEQ ID NO: 2978785 - RNA, 22 nt, Mycobacterium avium subsp. paratuberculosis
ccgacgcuggccgagagccggu

SEQ ID NO: 2978786 - RNA, 18 nt, Mycobacterium avium subsp. paratuberculosis
ccgacgcuucguggacga

SEQ ID NO: 2978787 - RNA, 17 nt, Mycobacterium avium subsp. paratuberculosis
ccgacggagacgaccag

SEQ ID NO: 2978788 - RNA, 20 nt, Mycobacterium avium subsp. paratuberculosis
ccgacggagccgagcaccag

SEQ ID NO: 2978789 - RNA, 21 nt, Mycobacterium avium subsp. paratuberculosis
ccgacggagccgagcaccagg

SEQ ID NO: 2978790 - RNA, 20 nt, Mycobacterium avium subsp. paratuberculosis
ccgacggcaccucucgggaa

SEQ ID NO: 2978791 - RNA, 16 nt, Mycobacterium avium subsp. paratuberculosis
ccgacggcagcaccgc

SEQ ID NO: 2978792 - RNA, 12 nt, Mycobacterium avium subsp. paratuberculosis
ccgacggccagc

SEQ ID NO: 2978793 - RNA, 22 nt, Mycobacterium avium subsp. paratuberculosis
ccgacggccgcaccccacccgc

SEQ ID NO: 2978794 - RNA, 13 nt, Mycobacterium avium subsp. paratuberculosis
ccgacggccgcgc

SEQ ID NO: 2978795 - RNA, 17 nt, Mycobacterium avium subsp. paratuberculosis
ccgacggccgcgccguu

SEQ ID NO: 2978796 - RNA, 18 nt, Mycobacterium avium subsp. paratuberculosis
ccgacggccgcgccguug

SEQ ID NO: 2978797 - RNA, 19 nt, Mycobacterium avium subsp. paratuberculosis
ccgacggccgcgccguuga

SEQ ID NO: 2978798 - RNA, 15 nt, Mycobacterium avium subsp. paratuberculosis
ccgacggcgaccagu

SEQ ID NO: 2978799 - RNA, 10 nt, Mycobacterium avium subsp. paratuberculosis
ccgacggcgc

SEQ ID NO: 2978800 - RNA, 13 nt, Mycobacterium avium subsp. paratuberculosis
ccgacggcgccgc

SEQ ID NO: 2978801 - RNA, 18 nt, Mycobacterium avium subsp. paratuberculosis
ccgacggcgccgcggccg

SEQ ID NO: 2978802 - RNA, 11 nt, Mycobacterium avium subsp. paratuberculosis
ccgacggcgcg

SEQ ID NO: 2978803 - RNA, 15 nt, Mycobacterium avium subsp. paratuberculosis
ccgacggcgcgcccg

SEQ ID NO: 2978804 - RNA, 20 nt, Mycobacterium avium subsp. paratuberculosis
ccgacggcgucuuggggaug

SEQ ID NO: 2978805 - RNA, 23 nt, Mycobacterium avium subsp. paratuberculosis
ccgacggcuaccugaccagcggc

SEQ ID NO: 2978806 - RNA, 20 nt, Mycobacterium avium subsp. paratuberculosis
ccgacggcugcccggcccgc

SEQ ID NO: 2978807 - RNA, 17 nt, Mycobacterium avium subsp. paratuberculosis
ccgacggcugcgguugg

SEQ ID NO: 2978808 - RNA, 15 nt, Mycobacterium avium subsp. paratuberculosis
ccgacggcugggugg

SEQ ID NO: 2978809 - RNA, 17 nt, Mycobacterium avium subsp. paratuberculosis
ccgacggcuggguggcg

SEQ ID NO: 2978810 - RNA, 13 nt, Mycobacterium avium subsp. paratuberculosis
ccgacggcuucca

SEQ ID NO: 2978811 - RNA, 21 nt, Mycobacterium avium subsp. paratuberculosis
ccgacgggaacucggccagcu

SEQ ID NO: 2978812 - RNA, 21 nt, Mycobacterium avium subsp. paratuberculosis
ccgacgggauccggauugccg

SEQ ID NO: 2978813 - RNA, 13 nt, Mycobacterium avium subsp. paratuberculosis
ccgacgggcccag

SEQ ID NO: 2978814 - RNA, 15 nt, Mycobacterium avium subsp. paratuberculosis
ccgacgggcccagcg

SEQ ID NO: 2978815 - RNA, 19 nt, Mycobacterium avium subsp. paratuberculosis
ccgacgggcccagcgcgac

SEQ ID NO: 2978816 - RNA, 21 nt, Mycobacterium avium subsp. paratuberculosis
ccgacgggcccagcgcgacgu

SEQ ID NO: 2978817 - RNA, 13 nt, Mycobacterium avium subsp. paratuberculosis
ccgacgggcccgc

SEQ ID NO: 2978818 - RNA, 18 nt, Mycobacterium avium subsp. paratuberculosis
ccgacgggcgugccggcg

SEQ ID NO: 2978819 - RNA, 23 nt, Mycobacterium avium subsp. paratuberculosis
ccgacgggguucaguagcagcgu

SEQ ID NO: 2978820 - RNA, 18 nt, Mycobacterium avium subsp. paratuberculosis
ccgacggguucgcgcagc

SEQ ID NO: 2978821 - RNA, 20 nt, Mycobacterium avium subsp. paratuberculosis
ccgacggguucgcgcagcca

SEQ ID NO: 2978822 - RNA, 22 nt, Mycobacterium avium subsp. paratuberculosis
ccgacggguucgcgcagccacc

SEQ ID NO: 2978823 - RNA, 14 nt, Mycobacterium avium subsp. paratuberculosis
ccgacggucgccac

SEQ ID NO: 2978824 - RNA, 16 nt, Mycobacterium avium subsp. paratuberculosis
ccgacggucgccacca

SEQ ID NO: 2978825 - RNA, 16 nt, Mycobacterium avium subsp. paratuberculosis
ccgacggucgggccca

SEQ ID NO: 2978826 - RNA, 21 nt, Mycobacterium avium subsp. paratuberculosis
ccgacggucgggcccagguag

SEQ ID NO: 2978827 - RNA, 19 nt, Mycobacterium avium subsp. paratuberculosis
ccgacggugagcaccgccg

SEQ ID NO: 2978828 - RNA, 20 nt, Mycobacterium avium subsp. paratuberculosis
ccgacggugagcaccgccgu

SEQ ID NO: 2978829 - RNA, 11 nt, Mycobacterium avium subsp. paratuberculosis
ccgacggugcg

SEQ ID NO: 2978830 - RNA, 22 nt, Mycobacterium avium subsp. paratuberculosis
ccgacggugcgugccagcagcu

SEQ ID NO: 2978831 - RNA, 13 nt, Mycobacterium avium subsp. paratuberculosis
ccgacgguggccc

SEQ ID NO: 2978832 - RNA, 14 nt, Mycobacterium avium subsp. paratuberculosis
ccgacgguggcgaa

SEQ ID NO: 2978833 - RNA, 23 nt, Mycobacterium avium subsp. paratuberculosis
ccgacgguggcgaagcacgacca

SEQ ID NO: 2978834 - RNA, 23 nt, Mycobacterium avium subsp. paratuberculosis
ccgacggugucguagacgacguc

SEQ ID NO: 2978835 - RNA, 16 nt, Mycobacterium avium subsp. paratuberculosis
ccgacguagacgagcc

SEQ ID NO: 2978836 - RNA, 20 nt, Mycobacterium avium subsp. paratuberculosis
ccgacguaggacagcaccac

SEQ ID NO: 2978837 - RNA, 19 nt, Mycobacterium avium subsp. paratuberculosis
ccgacgucaggguggccuc

SEQ ID NO: 2978838 - RNA, 13 nt, Mycobacterium avium subsp. paratuberculosis
ccgacgucccagc

SEQ ID NO: 2978839 - RNA, 15 nt, Mycobacterium avium subsp. paratuberculosis
ccgacgucccagcac

SEQ ID NO: 2978840 - RNA, 21 nt, Mycobacterium avium subsp. paratuberculosis
ccgacgucccagcacaacgcc

SEQ ID NO: 2978841 - RNA, 16 nt, Mycobacterium avium subsp. paratuberculosis
ccgacguccugguuga

SEQ ID NO: 2978842 - RNA, 16 nt, Mycobacterium avium subsp. paratuberculosis
ccgacgucgaccaggu

SEQ ID NO: 2978843 - RNA, 13 nt, Mycobacterium avium subsp. paratuberculosis
ccgacgucgacgc

SEQ ID NO: 2978844 - RNA, 15 nt, Mycobacterium avium subsp. paratuberculosis
ccgacgucgacgcgg

SEQ ID NO: 2978845 - RNA, 16 nt, Mycobacterium avium subsp. paratuberculosis
ccgacgucgacgcggg

SEQ ID NO: 2978846 - RNA, 12 nt, Mycobacterium avium subsp. paratuberculosis
ccgacgucggaa

SEQ ID NO: 2978847 - RNA, 15 nt, Mycobacterium avium subsp. paratuberculosis
ccgacgucugguugg

SEQ ID NO: 2978848 - RNA, 20 nt, Mycobacterium avium subsp. paratuberculosis
ccgacgucugguuggccggc

SEQ ID NO: 2978849 - RNA, 15 nt, Mycobacterium avium subsp. paratuberculosis
ccgacgugcagcgcc

SEQ ID NO: 2978850 - RNA, 16 nt, Mycobacterium avium subsp. paratuberculosis
ccgacgugcagcgcca

SEQ ID NO: 2978851 - RNA, 18 nt, Mycobacterium avium subsp. paratuberculosis
ccgacgugcagcgccagc

SEQ ID NO: 2978852 - RNA, 13 nt, Mycobacterium avium subsp. paratuberculosis
ccgacgugccggu

SEQ ID NO: 2978853 - RNA, 22 nt, Mycobacterium avium subsp. paratuberculosis
ccgacgugccgguggacgaggu

SEQ ID NO: 2978854 - RNA, 20 nt, Mycobacterium avium subsp. paratuberculosis
ccgacgugcuuggccagcuc

SEQ ID NO: 2978855 - RNA, 21 nt, Mycobacterium avium subsp. paratuberculosis
ccgacgugcuuggccagcucg

SEQ ID NO: 2978856 - RNA, 22 nt, Mycobacterium avium subsp. paratuberculosis
ccgacgugggugguggugccgu

SEQ ID NO: 2978857 - RNA, 20 nt, Mycobacterium avium subsp. paratuberculosis
ccgacgugucgucgucgccg

SEQ ID NO: 2978858 - RNA, 21 nt, Mycobacterium avium subsp. paratuberculosis
ccgacgugucgucgucgccgc

SEQ ID NO: 2978859 - RNA, 23 nt, Mycobacterium avium subsp. paratuberculosis
ccgacgugucgucgucgccgccg

SEQ ID NO: 2978860 - RNA, 21 nt, Mycobacterium avium subsp. paratuberculosis
ccgacguuguugucgaugaug

SEQ ID NO: 2978861 - RNA, 20 nt, Mycobacterium avium subsp. paratuberculosis
ccgacuagcgcggcggccuc

SEQ ID NO: 2978862 - RNA, 15 nt, Mycobacterium avium subsp. paratuberculosis
ccgacuccagcagcg

SEQ ID NO: 2978863 - RNA, 14 nt, Mycobacterium avium subsp. paratuberculosis
ccgacuccccgccc

SEQ ID NO: 2978864 - RNA, 21 nt, Mycobacterium avium subsp. paratuberculosis
ccgacuccccgcccggcaaca

SEQ ID NO: 2978865 - RNA, 14 nt, Mycobacterium avium subsp. paratuberculosis
ccgacuccucacac

SEQ ID NO: 2978866 - RNA, 15 nt, Mycobacterium avium subsp. paratuberculosis
ccgacuccucacacc

SEQ ID NO: 2978867 - RNA, 17 nt, Mycobacterium avium subsp. paratuberculosis
ccgacuccuccggcccg

SEQ ID NO: 2978868 - RNA, 21 nt, Mycobacterium avium subsp. paratuberculosis
ccgacucgauguagccgggcu

SEQ ID NO: 2978869 - RNA, 22 nt, Mycobacterium avium subsp. paratuberculosis
ccgacucgauguagccgggcuc

SEQ ID NO: 2978870 - RNA, 17 nt, Mycobacterium avium subsp. paratuberculosis
ccgacugauccaccauc

SEQ ID NO: 2978871 - RNA, 12 nt, Mycobacterium avium subsp. paratuberculosis
ccgacugcggcg

SEQ ID NO: 2978872 - RNA, 21 nt, Mycobacterium avium subsp. paratuberculosis
ccgacuggugauagaucaucc

SEQ ID NO: 2978873 - RNA, 14 nt, Mycobacterium avium subsp. paratuberculosis
ccgacugugcgaug

SEQ ID NO: 2978874 - RNA, 17 nt, Mycobacterium avium subsp. paratuberculosis
ccgacuguuugaugccg

SEQ ID NO: 2978875 - RNA, 16 nt, Mycobacterium avium subsp. paratuberculosis
ccgacuuacggcguga

SEQ ID NO: 2978876 - RNA, 16 nt, Mycobacterium avium subsp. paratuberculosis
ccgacuucauggcgaa

SEQ ID NO: 2978877 - RNA, 14 nt, Mycobacterium avium subsp. paratuberculosis
ccgacuucggcucg

SEQ ID NO: 2978878 - RNA, 15 nt, Mycobacterium avium subsp. paratuberculosis
ccgacuucggcucgg

SEQ ID NO: 2978879 - RNA, 18 nt, Mycobacterium avium subsp. paratuberculosis
ccgacuucggcucggcga

SEQ ID NO: 2978880 - RNA, 20 nt, Mycobacterium avium subsp. paratuberculosis
ccgacuucggcucggcgaca

SEQ ID NO: 2978881 - RNA, 16 nt, Mycobacterium avium subsp. paratuberculosis
ccgacuugaucgcggc

SEQ ID NO: 2978882 - RNA, 18 nt, Mycobacterium avium subsp. paratuberculosis
ccgacuuggucagcccgc

SEQ ID NO: 2978883 - RNA, 20 nt, Mycobacterium avium subsp. paratuberculosis
ccgacuuggucagcccgcgc

SEQ ID NO: 2978884 - RNA, 22 nt, Mycobacterium avium subsp. paratuberculosis
ccgacuuggugccaugccgggu

SEQ ID NO: 2978885 - RNA, 17 nt, Mycobacterium avium subsp. paratuberculosis
ccgagaacaggccgagc

SEQ ID NO: 2978886 - RNA, 19 nt, Mycobacterium avium subsp. paratuberculosis
ccgagaacaggccgagcgc

SEQ ID NO: 2978887 - RNA, 14 nt, Mycobacterium avium subsp. paratuberculosis
ccgagaagggccgc

SEQ ID NO: 2978888 - RNA, 16 nt, Mycobacterium avium subsp. paratuberculosis
ccgagaagggccgccg

SEQ ID NO: 2978889 - RNA, 19 nt, Mycobacterium avium subsp. paratuberculosis
ccgagaagggccgccgcug

SEQ ID NO: 2978890 - RNA, 14 nt, Mycobacterium avium subsp. paratuberculosis
ccgagaaugccgua

SEQ ID NO: 2978891 - RNA, 18 nt, Mycobacterium avium subsp. paratuberculosis
ccgagaaugccguagauc

SEQ ID NO: 2978892 - RNA, 16 nt, Mycobacterium avium subsp. paratuberculosis
ccgagaccaugccgcc

SEQ ID NO: 2978893 - RNA, 17 nt, Mycobacterium avium subsp. paratuberculosis
ccgagaccaugccgccg

SEQ ID NO: 2978894 - RNA, 12 nt, Mycobacterium avium subsp. paratuberculosis
ccgagacggcgu

SEQ ID NO: 2978895 - RNA, 12 nt, Mycobacterium avium subsp. paratuberculosis
ccgagacgucgg

SEQ ID NO: 2978896 - RNA, 15 nt, Mycobacterium avium subsp. paratuberculosis
ccgagacgucggcgu

SEQ ID NO: 2978897 - RNA, 15 nt, Mycobacterium avium subsp. paratuberculosis
ccgagacguggucgg

SEQ ID NO: 2978898 - RNA, 12 nt, Mycobacterium avium subsp. paratuberculosis
ccgagacugaug

SEQ ID NO: 2978899 - RNA, 19 nt, Mycobacterium avium subsp. paratuberculosis
ccgagacugaugguggcgc

SEQ ID NO: 2978900 - RNA, 20 nt, Mycobacterium avium subsp. paratuberculosis
ccgagacugaugguggcgcg

SEQ ID NO: 2978901 - RNA, 18 nt, Mycobacterium avium subsp. paratuberculosis
ccgagagcgcgucgacgc

SEQ ID NO: 2978902 - RNA, 20 nt, Mycobacterium avium subsp. paratuberculosis
ccgagaguccgccgccgggc

SEQ ID NO: 2978903 - RNA, 23 nt, Mycobacterium avium subsp. paratuberculosis
ccgagaucaccggcuuggcggug

SEQ ID NO: 2978904 - RNA, 16 nt, Mycobacterium avium subsp. paratuberculosis
ccgagaucaugccggc

SEQ ID NO: 2978905 - RNA, 21 nt, Mycobacterium avium subsp. paratuberculosis
ccgagaucaugccggcgaacu

SEQ ID NO: 2978906 - RNA, 15 nt, Mycobacterium avium subsp. paratuberculosis
ccgagauccaccgcg

SEQ ID NO: 2978907 - RNA, 16 nt, Mycobacterium avium subsp. paratuberculosis
ccgagauccaccgcgc

SEQ ID NO: 2978908 - RNA, 17 nt, Mycobacterium avium subsp. paratuberculosis
ccgagauccaccgcgcg

SEQ ID NO: 2978909 - RNA, 21 nt, Mycobacterium avium subsp. paratuberculosis
ccgagauccaccgcgcggcca

SEQ ID NO: 2978910 - RNA, 15 nt, Mycobacterium avium subsp. paratuberculosis
ccgagaucccagcgg

SEQ ID NO: 2978911 - RNA, 19 nt, Mycobacterium avium subsp. paratuberculosis
ccgagaucccagcgggaca

SEQ ID NO: 2978912 - RNA, 15 nt, Mycobacterium avium subsp. paratuberculosis
ccgagaucgacccgc

SEQ ID NO: 2978913 - RNA, 21 nt, Mycobacterium avium subsp. paratuberculosis
ccgagaucgacgcugaccagc

SEQ ID NO: 2978914 - RNA, 22 nt, Mycobacterium avium subsp. paratuberculosis
ccgagaucgacgcugaccagcu

SEQ ID NO: 2978915 - RNA, 13 nt, Mycobacterium avium subsp. paratuberculosis
ccgagaucgcggg

SEQ ID NO: 2978916 - RNA, 15 nt, Mycobacterium avium subsp. paratuberculosis
ccgagaucgcggugg

SEQ ID NO: 2978917 - RNA, 18 nt, Mycobacterium avium subsp. paratuberculosis
ccgagaucgcgguggcgc

SEQ ID NO: 2978918 - RNA, 22 nt, Mycobacterium avium subsp. paratuberculosis
ccgagaucgcgguggcgcccgc

SEQ ID NO: 2978919 - RNA, 18 nt, Mycobacterium avium subsp. paratuberculosis
ccgagaucucgucgaugg

SEQ ID NO: 2978920 - RNA, 16 nt, Mycobacterium avium subsp. paratuberculosis
ccgagaugaagacccg

SEQ ID NO: 2978921 - RNA, 20 nt, Mycobacterium avium subsp. paratuberculosis
ccgagaugaagacccggccg

SEQ ID NO: 2978922 - RNA, 22 nt, Mycobacterium avium subsp. paratuberculosis
ccgagaugaagacccggccgug

SEQ ID NO: 2978923 - RNA, 15 nt, Mycobacterium avium subsp. paratuberculosis
ccgagauggacagca

SEQ ID NO: 2978924 - RNA, 17 nt, Mycobacterium avium subsp. paratuberculosis
ccgagauggccaccauc

SEQ ID NO: 2978925 - RNA, 16 nt, Mycobacterium avium subsp. paratuberculosis
ccgagauguaguccuc

SEQ ID NO: 2978926 - RNA, 20 nt, Mycobacterium avium subsp. paratuberculosis
ccgagauuggacgacaccac

SEQ ID NO: 2978927 - RNA, 16 nt, Mycobacterium avium subsp. paratuberculosis
ccgagcaacagcccga

SEQ ID NO: 2978928 - RNA, 21 nt, Mycobacterium avium subsp. paratuberculosis
ccgagcaacagcccgaccguc

SEQ ID NO: 2978929 - RNA, 12 nt, Mycobacterium avium subsp. paratuberculosis
ccgagcacaccg

SEQ ID NO: 2978930 - RNA, 21 nt, Mycobacterium avium subsp. paratuberculosis
ccgagcacaccgucgcccgcc

SEQ ID NO: 2978931 - RNA, 22 nt, Mycobacterium avium subsp. paratuberculosis
ccgagcacaccgucgcccgccc

SEQ ID NO: 2978932 - RNA, 23 nt, Mycobacterium avium subsp. paratuberculosis
ccgagcaccaccaggcccaccac

SEQ ID NO: 2978933 - RNA, 15 nt, Mycobacterium avium subsp. paratuberculosis
ccgagcaccagcgga

SEQ ID NO: 2978934 - RNA, 16 nt, Mycobacterium avium subsp. paratuberculosis
ccgagcaccaggcgca

SEQ ID NO: 2978935 - RNA, 16 nt, Mycobacterium avium subsp. paratuberculosis
ccgagcaccccggcgg

SEQ ID NO: 2978936 - RNA, 17 nt, Mycobacterium avium subsp. paratuberculosis
ccgagcaccccggcggc

SEQ ID NO: 2978937 - RNA, 18 nt, Mycobacterium avium subsp. paratuberculosis
ccgagcaccccggcggcc

SEQ ID NO: 2978938 - RNA, 21 nt, Mycobacterium avium subsp. paratuberculosis
ccgagcaccccggcggccgcg

SEQ ID NO: 2978939 - RNA, 22 nt, Mycobacterium avium subsp. paratuberculosis
ccgagcaccccggcggccgcgu

SEQ ID NO: 2978940 - RNA, 21 nt, Mycobacterium avium subsp. paratuberculosis
ccgagcaccggcagcaccgcc

SEQ ID NO: 2978941 - RNA, 22 nt, Mycobacterium avium subsp. paratuberculosis
ccgagcaccggcagcaccgccg

SEQ ID NO: 2978942 - RNA, 13 nt, Mycobacterium avium subsp. paratuberculosis
ccgagcaccgggc

SEQ ID NO: 2978943 - RNA, 16 nt, Mycobacterium avium subsp. paratuberculosis
ccgagcaccgggccga

SEQ ID NO: 2978944 - RNA, 16 nt, Mycobacterium avium subsp. paratuberculosis
ccgagcaccgggcugu

SEQ ID NO: 2978945 - RNA, 19 nt, Mycobacterium avium subsp. paratuberculosis
ccgagcaccgggcugucgg

SEQ ID NO: 2978946 - RNA, 18 nt, Mycobacterium avium subsp. paratuberculosis
ccgagcaccuccgacauc

SEQ ID NO: 2978947 - RNA, 18 nt, Mycobacterium avium subsp. paratuberculosis
ccgagcaccucgucgccg

SEQ ID NO: 2978948 - RNA, 19 nt, Mycobacterium avium subsp. paratuberculosis
ccgagcaccucgucgccgu

SEQ ID NO: 2978949 - RNA, 20 nt, Mycobacterium avium subsp. paratuberculosis
ccgagcaccugaacggccgc

SEQ ID NO: 2978950 - RNA, 23 nt, Mycobacterium avium subsp. paratuberculosis
ccgagcaccugaacggccgcgca

SEQ ID NO: 2978951 - RNA, 14 nt, Mycobacterium avium subsp. paratuberculosis
ccgagcaccuggcc

SEQ ID NO: 2978952 - RNA, 18 nt, Mycobacterium avium subsp. paratuberculosis
ccgagcacgaacgcggcc

SEQ ID NO: 2978953 - RNA, 22 nt, Mycobacterium avium subsp. paratuberculosis
ccgagcacgaacgcggccgcca

SEQ ID NO: 2978954 - RNA, 23 nt, Mycobacterium avium subsp. paratuberculosis
ccgagcacgaacgcggccgccau

SEQ ID NO: 2978955 - RNA, 13 nt, Mycobacterium avium subsp. paratuberculosis
ccgagcacgcagc

SEQ ID NO: 2978956 - RNA, 15 nt, Mycobacterium avium subsp. paratuberculosis
ccgagcacgcagccg

SEQ ID NO: 2978957 - RNA, 14 nt, Mycobacterium avium subsp. paratuberculosis
ccgagcacgcggcc

SEQ ID NO: 2978958 - RNA, 15 nt, Mycobacterium avium subsp. paratuberculosis
ccgagcacgcggccg

SEQ ID NO: 2978959 - RNA, 16 nt, Mycobacterium avium subsp. paratuberculosis
ccgagcacgcggccgc

SEQ ID NO: 2978960 - RNA, 18 nt, Mycobacterium avium subsp. paratuberculosis
ccgagcacgcggccgcgc

SEQ ID NO: 2978961 - RNA, 22 nt, Mycobacterium avium subsp. paratuberculosis
ccgagcacgcggccgcgccggc

SEQ ID NO: 2978962 - RNA, 23 nt, Mycobacterium avium subsp. paratuberculosis
ccgagcacggcucguccaucagc

SEQ ID NO: 2978963 - RNA, 13 nt, Mycobacterium avium subsp. paratuberculosis
ccgagcacgucga

SEQ ID NO: 2978964 - RNA, 15 nt, Mycobacterium avium subsp. paratuberculosis
ccgagcagaucgggu

SEQ ID NO: 2978965 - RNA, 20 nt, Mycobacterium avium subsp. paratuberculosis
ccgagcagaucgggucccag

SEQ ID NO: 2978966 - RNA, 18 nt, Mycobacterium avium subsp. paratuberculosis
ccgagcagcaccgcgacc

SEQ ID NO: 2978967 - RNA, 22 nt, Mycobacterium avium subsp. paratuberculosis
ccgagcagcaccgcgacccagg

SEQ ID NO: 2978968 - RNA, 14 nt, Mycobacterium avium subsp. paratuberculosis
ccgagcagcaccgg

SEQ ID NO: 2978969 - RNA, 13 nt, Mycobacterium avium subsp. paratuberculosis
ccgagcagcagcc

SEQ ID NO: 2978970 - RNA, 18 nt, Mycobacterium avium subsp. paratuberculosis
ccgagcagcagccgcagc

SEQ ID NO: 2978971 - RNA, 21 nt, Mycobacterium avium subsp. paratuberculosis
ccgagcagcagccgcagcggc

SEQ ID NO: 2978972 - RNA, 15 nt, Mycobacterium avium subsp. paratuberculosis
ccgagcagccgggcc

SEQ ID NO: 2978973 - RNA, 17 nt, Mycobacterium avium subsp. paratuberculosis
ccgagcagccgguccau

SEQ ID NO: 2978974 - RNA, 23 nt, Mycobacterium avium subsp. paratuberculosis
ccgagcagcggggugagcaccgc

SEQ ID NO: 2978975 - RNA, 16 nt, Mycobacterium avium subsp. paratuberculosis
ccgagcagcgggucgu

SEQ ID NO: 2978976 - RNA, 16 nt, Mycobacterium avium subsp. paratuberculosis
ccgagcagcucagccg

SEQ ID NO: 2978977 - RNA, 15 nt, Mycobacterium avium subsp. paratuberculosis
ccgagcagcucggcg

SEQ ID NO: 2978978 - RNA, 17 nt, Mycobacterium avium subsp. paratuberculosis
ccgagcagcucggcggc

SEQ ID NO: 2978979 - RNA, 18 nt, Mycobacterium avium subsp. paratuberculosis
ccgagcagcucggcggcc

SEQ ID NO: 2978980 - RNA, 11 nt, Mycobacterium avium subsp. paratuberculosis
ccgagcaggcg

SEQ ID NO: 2978981 - RNA, 22 nt, Mycobacterium avium subsp. paratuberculosis
ccgagcaggcggaucggcccga

SEQ ID NO: 2978982 - RNA, 19 nt, Mycobacterium avium subsp. paratuberculosis
ccgagcaucagcugccguc

SEQ ID NO: 2978983 - RNA, 24 nt, Mycobacterium avium subsp. paratuberculosis
ccgagcaucagcugccguccgggu

SEQ ID NO: 2978984 - RNA, 13 nt, Mycobacterium avium subsp. paratuberculosis
ccgagcaucgccg

SEQ ID NO: 2978985 - RNA, 15 nt, Mycobacterium avium subsp. paratuberculosis
ccgagcaucgccgag

SEQ ID NO: 2978986 - RNA, 16 nt, Mycobacterium avium subsp. paratuberculosis
ccgagcaucgccgagc

SEQ ID NO: 2978987 - RNA, 23 nt, Mycobacterium avium subsp. paratuberculosis
ccgagcaucggguugccggcggc

SEQ ID NO: 2978988 - RNA, 17 nt, Mycobacterium avium subsp. paratuberculosis
ccgagcauuucgcgcac

SEQ ID NO: 2978989 - RNA, 12 nt, Mycobacterium avium subsp. paratuberculosis
ccgagcccgacg

SEQ ID NO: 2978990 - RNA, 14 nt, Mycobacterium avium subsp. paratuberculosis
ccgagcccgacggc

SEQ ID NO: 2978991 - RNA, 17 nt, Mycobacterium avium subsp. paratuberculosis
ccgagcccgacggcagc

SEQ ID NO: 2978992 - RNA, 15 nt, Mycobacterium avium subsp. paratuberculosis
ccgagcccgccggcg

SEQ ID NO: 2978993 - RNA, 19 nt, Mycobacterium avium subsp. paratuberculosis
ccgagcccgccggcggcga

SEQ ID NO: 2978994 - RNA, 15 nt, Mycobacterium avium subsp. paratuberculosis
ccgagcccugcgcca

SEQ ID NO: 2978995 - RNA, 17 nt, Mycobacterium avium subsp. paratuberculosis
ccgagcccugcgccagc

SEQ ID NO: 2978996 - RNA, 17 nt, Mycobacterium avium subsp. paratuberculosis
ccgagccgaugcccagc

SEQ ID NO: 2978997 - RNA, 16 nt, Mycobacterium avium subsp. paratuberculosis
ccgagccgcacaacau

SEQ ID NO: 2978998 - RNA, 15 nt, Mycobacterium avium subsp. paratuberculosis
ccgagccgcaccgcc

SEQ ID NO: 2978999 - RNA, 23 nt, Mycobacterium avium subsp. paratuberculosis
ccgagccgccggaucggcagcgc

SEQ ID NO: 2979000 - RNA, 18 nt, Mycobacterium avium subsp. paratuberculosis
ccgagccgcgccacgcgc

SEQ ID NO: 2979001 - RNA, 15 nt, Mycobacterium avium subsp. paratuberculosis
ccgagccgcgcgccg

SEQ ID NO: 2979002 - RNA, 21 nt, Mycobacterium avium subsp. paratuberculosis
ccgagccgcggauggccucgg

SEQ ID NO: 2979003 - RNA, 12 nt, Mycobacterium avium subsp. paratuberculosis
ccgagccgcggg

SEQ ID NO: 2979004 - RNA, 17 nt, Mycobacterium avium subsp. paratuberculosis
ccgagccgcuugguggc

SEQ ID NO: 2979005 - RNA, 19 nt, Mycobacterium avium subsp. paratuberculosis
ccgagccgcuugguggcgc

SEQ ID NO: 2979006 - RNA, 20 nt, Mycobacterium avium subsp. paratuberculosis
ccgagccgcuugguggcgcc

SEQ ID NO: 2979007 - RNA, 13 nt, Mycobacterium avium subsp. paratuberculosis
ccgagccggcggc

SEQ ID NO: 2979008 - RNA, 14 nt, Mycobacterium avium subsp. paratuberculosis
ccgagccggcggcg

SEQ ID NO: 2979009 - RNA, 17 nt, Mycobacterium avium subsp. paratuberculosis
ccgagccggcgucgccg

SEQ ID NO: 2979010 - RNA, 18 nt, Mycobacterium avium subsp. paratuberculosis
ccgagccggcgucgccgc

SEQ ID NO: 2979011 - RNA, 11 nt, Mycobacterium avium subsp. paratuberculosis
ccgagccgggc

SEQ ID NO: 2979012 - RNA, 13 nt, Mycobacterium avium subsp. paratuberculosis
ccgagccgggcag

SEQ ID NO: 2979013 - RNA, 14 nt, Mycobacterium avium subsp. paratuberculosis
ccgagccgggcagc

SEQ ID NO: 2979014 - RNA, 16 nt, Mycobacterium avium subsp. paratuberculosis
ccgagccgggcagcgc

SEQ ID NO: 2979015 - RNA, 13 nt, Mycobacterium avium subsp. paratuberculosis
ccgagccgggcca

SEQ ID NO: 2979016 - RNA, 17 nt, Mycobacterium avium subsp. paratuberculosis
ccgagccgggcggccag

SEQ ID NO: 2979017 - RNA, 18 nt, Mycobacterium avium subsp. paratuberculosis
ccgagccgggcggccagc

SEQ ID NO: 2979018 - RNA, 21 nt, Mycobacterium avium subsp. paratuberculosis
ccgagccgggcggccagcgug

SEQ ID NO: 2979019 - RNA, 19 nt, Mycobacterium avium subsp. paratuberculosis
ccgagccgguccgaccagc

SEQ ID NO: 2979020 - RNA, 20 nt, Mycobacterium avium subsp. paratuberculosis
ccgagccgguccgaccagcg

SEQ ID NO: 2979021 - RNA, 22 nt, Mycobacterium avium subsp. paratuberculosis
ccgagccgguccgaccagcggc

SEQ ID NO: 2979022 - RNA, 23 nt, Mycobacterium avium subsp. paratuberculosis
ccgagccgguccgaccagcggcc

SEQ ID NO: 2979023 - RNA, 21 nt, Mycobacterium avium subsp. paratuberculosis
ccgagccggugaugacgucgc

SEQ ID NO: 2979024 - RNA, 15 nt, Mycobacterium avium subsp. paratuberculosis
ccgagccggugccgc

SEQ ID NO: 2979025 - RNA, 18 nt, Mycobacterium avium subsp. paratuberculosis
ccgagccguaggccaggu

SEQ ID NO: 2979026 - RNA, 15 nt, Mycobacterium avium subsp. paratuberculosis
ccgagccgucgucgc

SEQ ID NO: 2979027 - RNA, 23 nt, Mycobacterium avium subsp. paratuberculosis
ccgagccugggauugccgggcac

SEQ ID NO: 2979028 - RNA, 16 nt, Mycobacterium avium subsp. paratuberculosis
ccgagcgagcgcacca

SEQ ID NO: 2979029 - RNA, 17 nt, Mycobacterium avium subsp. paratuberculosis
ccgagcgcaagggccga

SEQ ID NO: 2979030 - RNA, 18 nt, Mycobacterium avium subsp. paratuberculosis
ccgagcgcgccgagcagc

SEQ ID NO: 2979031 - RNA, 20 nt, Mycobacterium avium subsp. paratuberculosis
ccgagcgcgccgagcagcug

SEQ ID NO: 2979032 - RNA, 14 nt, Mycobacterium avium subsp. paratuberculosis
ccgagcgcgccgcc

SEQ ID NO: 2979033 - RNA, 15 nt, Mycobacterium avium subsp. paratuberculosis
ccgagcgcgccgccg

SEQ ID NO: 2979034 - RNA, 14 nt, Mycobacterium avium subsp. paratuberculosis
ccgagcgcgcgauc

SEQ ID NO: 2979035 - RNA, 20 nt, Mycobacterium avium subsp. paratuberculosis
ccgagcgcugcccgugccgc

SEQ ID NO: 2979036 - RNA, 18 nt, Mycobacterium avium subsp. paratuberculosis
ccgagcgcugguugucga

SEQ ID NO: 2979037 - RNA, 21 nt, Mycobacterium avium subsp. paratuberculosis
ccgagcgcugguugucgacgc

SEQ ID NO: 2979038 - RNA, 20 nt, Mycobacterium avium subsp. paratuberculosis
ccgagcggaugccguagcgc

SEQ ID NO: 2979039 - RNA, 22 nt, Mycobacterium avium subsp. paratuberculosis
ccgagcggaugccguagcgcau

SEQ ID NO: 2979040 - RNA, 13 nt, Mycobacterium avium subsp. paratuberculosis
ccgagcggccguc

SEQ ID NO: 2979041 - RNA, 15 nt, Mycobacterium avium subsp. paratuberculosis
ccgagcggcgcaggc

SEQ ID NO: 2979042 - RNA, 14 nt, Mycobacterium avium subsp. paratuberculosis
ccgagcggcugcug

SEQ ID NO: 2979043 - RNA, 15 nt, Mycobacterium avium subsp. paratuberculosis
ccgagcggcugcugg

SEQ ID NO: 2979044 - RNA, 19 nt, Mycobacterium avium subsp. paratuberculosis
ccgagcggcugcuggucga

SEQ ID NO: 2979045 - RNA, 22 nt, Mycobacterium avium subsp. paratuberculosis
ccgagcggcugcuggucgacgu

SEQ ID NO: 2979046 - RNA, 23 nt, Mycobacterium avium subsp. paratuberculosis
ccgagcggcugcuggucgacguc

SEQ ID NO: 2979047 - RNA, 12 nt, Mycobacterium avium subsp. paratuberculosis
ccgagcgggccg

SEQ ID NO: 2979048 - RNA, 13 nt, Mycobacterium avium subsp. paratuberculosis
ccgagcgggccgu

SEQ ID NO: 2979049 - RNA, 21 nt, Mycobacterium avium subsp. paratuberculosis
ccgagcgggccguggcaccgg

SEQ ID NO: 2979050 - RNA, 12 nt, Mycobacterium avium subsp. paratuberculosis
ccgagcgggccu

SEQ ID NO: 2979051 - RNA, 12 nt, Mycobacterium avium subsp. paratuberculosis
ccgagcggggug

SEQ ID NO: 2979052 - RNA, 14 nt, Mycobacterium avium subsp. paratuberculosis
ccgagcggggugug

SEQ ID NO: 2979053 - RNA, 15 nt, Mycobacterium avium subsp. paratuberculosis
ccgagcggggugugg

SEQ ID NO: 2979054 - RNA, 12 nt, Mycobacterium avium subsp. paratuberculosis
ccgagcgucacg

SEQ ID NO: 2979055 - RNA, 13 nt, Mycobacterium avium subsp. paratuberculosis
ccgagcgucacgc

SEQ ID NO: 2979056 - RNA, 17 nt, Mycobacterium avium subsp. paratuberculosis
ccgagcgucacgccagc

SEQ ID NO: 2979057 - RNA, 19 nt, Mycobacterium avium subsp. paratuberculosis
ccgagcgucacgccagcgu

SEQ ID NO: 2979058 - RNA, 21 nt, Mycobacterium avium subsp. paratuberculosis
ccgagcgucacgcuagcguga

SEQ ID NO: 2979059 - RNA, 20 nt, Mycobacterium avium subsp. paratuberculosis
ccgagcgucacgcuggcgug

SEQ ID NO: 2979060 - RNA, 21 nt, Mycobacterium avium subsp. paratuberculosis
ccgagcgugcauucagugcga

SEQ ID NO: 2979061 - RNA, 24 nt, Mycobacterium avium subsp. paratuberculosis
ccgagcgugcauucagugcgagaa

SEQ ID NO: 2979062 - RNA, 15 nt, Mycobacterium avium subsp. paratuberculosis
ccgagcguucggcgc

SEQ ID NO: 2979063 - RNA, 18 nt, Mycobacterium avium subsp. paratuberculosis
ccgagcguucggcgcgga

SEQ ID NO: 2979064 - RNA, 19 nt, Mycobacterium avium subsp. paratuberculosis
ccgagcguucggcgcggau

SEQ ID NO: 2979065 - RNA, 21 nt, Mycobacterium avium subsp. paratuberculosis
ccgagcucgauguccagguag

SEQ ID NO: 2979066 - RNA, 12 nt, Mycobacterium avium subsp. paratuberculosis
ccgagcucggcc

SEQ ID NO: 2979067 - RNA, 19 nt, Mycobacterium avium subsp. paratuberculosis
ccgagcucggccaccagcg

SEQ ID NO: 2979068 - RNA, 21 nt, Mycobacterium avium subsp. paratuberculosis
ccgagcucgggcgcgaacagc

SEQ ID NO: 2979069 - RNA, 16 nt, Mycobacterium avium subsp. paratuberculosis
ccgagcugaucgcggc

SEQ ID NO: 2979070 - RNA, 20 nt, Mycobacterium avium subsp. paratuberculosis
ccgagcugaucgcggccggc

SEQ ID NO: 2979071 - RNA, 15 nt, Mycobacterium avium subsp. paratuberculosis
ccgagcugggccggc

SEQ ID NO: 2979072 - RNA, 21 nt, Mycobacterium avium subsp. paratuberculosis
ccgagcuugggccggugcagc

SEQ ID NO: 2979073 - RNA, 12 nt, Mycobacterium avium subsp. paratuberculosis
ccgaggaaccgg

SEQ ID NO: 2979074 - RNA, 19 nt, Mycobacterium avium subsp. paratuberculosis
ccgaggaaccggcagccgg

SEQ ID NO: 2979075 - RNA, 20 nt, Mycobacterium avium subsp. paratuberculosis
ccgaggaagacgucgaaccc

SEQ ID NO: 2979076 - RNA, 16 nt, Mycobacterium avium subsp. paratuberculosis
ccgaggagacgucggc

SEQ ID NO: 2979077 - RNA, 16 nt, Mycobacterium avium subsp. paratuberculosis
ccgaggaggccgcggc

SEQ ID NO: 2979078 - RNA, 15 nt, Mycobacterium avium subsp. paratuberculosis
ccgaggaugaccgcg

SEQ ID NO: 2979079 - RNA, 17 nt, Mycobacterium avium subsp. paratuberculosis
ccgaggaugaccgcggc

SEQ ID NO: 2979080 - RNA, 19 nt, Mycobacterium avium subsp. paratuberculosis
ccgaggaugccgcccacca

SEQ ID NO: 2979081 - RNA, 20 nt, Mycobacterium avium subsp. paratuberculosis
ccgaggaugccgcccaccac

SEQ ID NO: 2979082 - RNA, 23 nt, Mycobacterium avium subsp. paratuberculosis
ccgaggaugccgcccaccaccgg

SEQ ID NO: 2979083 - RNA, 23 nt, Mycobacterium avium subsp. paratuberculosis
ccgaggauggggucgcgggcgcc

SEQ ID NO: 2979084 - RNA, 22 nt, Mycobacterium avium subsp. paratuberculosis
ccgaggauuucgcgaucgagga

SEQ ID NO: 2979085 - RNA, 22 nt, Mycobacterium avium subsp. paratuberculosis
ccgaggcaaucgagcgggcggg

SEQ ID NO: 2979086 - RNA, 21 nt, Mycobacterium avium subsp. paratuberculosis
ccgaggcacagcagcacguug

SEQ ID NO: 2979087 - RNA, 17 nt, Mycobacterium avium subsp. paratuberculosis
ccgaggccgauggcgcc

SEQ ID NO: 2979088 - RNA, 12 nt, Mycobacterium avium subsp. paratuberculosis
ccgaggccgccc

SEQ ID NO: 2979089 - RNA, 14 nt, Mycobacterium avium subsp. paratuberculosis
ccgaggccgcccgc

SEQ ID NO: 2979090 - RNA, 22 nt, Mycobacterium avium subsp. paratuberculosis
ccgaggccgcccgcuccugcag

SEQ ID NO: 2979091 - RNA, 22 nt, Mycobacterium avium subsp. paratuberculosis
ccgaggcgagugaggacgaggc

SEQ ID NO: 2979092 - RNA, 14 nt, Mycobacterium avium subsp. paratuberculosis
ccgaggcgaucgcg

SEQ ID NO: 2979093 - RNA, 17 nt, Mycobacterium avium subsp. paratuberculosis
ccgaggcgaucgcggcc

SEQ ID NO: 2979094 - RNA, 18 nt, Mycobacterium avium subsp. paratuberculosis
ccgaggcgaugccgugcu

SEQ ID NO: 2979095 - RNA, 15 nt, Mycobacterium avium subsp. paratuberculosis
ccgaggcgcaacacc

SEQ ID NO: 2979096 - RNA, 16 nt, Mycobacterium avium subsp. paratuberculosis
ccgaggcgcaacaccg

SEQ ID NO: 2979097 - RNA, 17 nt, Mycobacterium avium subsp. paratuberculosis
ccgaggcgcaacaccgg

SEQ ID NO: 2979098 - RNA, 19 nt, Mycobacterium avium subsp. paratuberculosis
ccgaggcgcaggaggcggc

SEQ ID NO: 2979099 - RNA, 18 nt, Mycobacterium avium subsp. paratuberculosis
ccgaggcgguuccggugg

SEQ ID NO: 2979100 - RNA, 22 nt, Mycobacterium avium subsp. paratuberculosis
ccgaggcgguuccgguggcgcg

SEQ ID NO: 2979101 - RNA, 12 nt, Mycobacterium avium subsp. paratuberculosis
ccgaggcgugcc

SEQ ID NO: 2979102 - RNA, 14 nt, Mycobacterium avium subsp. paratuberculosis
ccgaggcugacgau

SEQ ID NO: 2979103 - RNA, 20 nt, Mycobacterium avium subsp. paratuberculosis
ccgaggcugacgaucgucga

SEQ ID NO: 2979104 - RNA, 14 nt, Mycobacterium avium subsp. paratuberculosis
ccgagggccagcag

SEQ ID NO: 2979105 - RNA, 16 nt, Mycobacterium avium subsp. paratuberculosis
ccgagggccagcagcc

SEQ ID NO: 2979106 - RNA, 15 nt, Mycobacterium avium subsp. paratuberculosis
ccgagggcgacgaug

SEQ ID NO: 2979107 - RNA, 14 nt, Mycobacterium avium subsp. paratuberculosis
ccgagggcgcggga

SEQ ID NO: 2979108 - RNA, 18 nt, Mycobacterium avium subsp. paratuberculosis
ccgagggguccggggcac

SEQ ID NO: 2979109 - RNA, 14 nt, Mycobacterium avium subsp. paratuberculosis
ccgagggugccggc

SEQ ID NO: 2979110 - RNA, 19 nt, Mycobacterium avium subsp. paratuberculosis
ccgagggugccggccaccg

SEQ ID NO: 2979111 - RNA, 20 nt, Mycobacterium avium subsp. paratuberculosis
ccgagggugccggccaccgg

SEQ ID NO: 2979112 - RNA, 22 nt, Mycobacterium avium subsp. paratuberculosis
ccgagggugccggccaccggcg

SEQ ID NO: 2979113 - RNA, 17 nt, Mycobacterium avium subsp. paratuberculosis
ccgaggguucgguggcc

SEQ ID NO: 2979114 - RNA, 18 nt, Mycobacterium avium subsp. paratuberculosis
ccgaggguucgguggccc

SEQ ID NO: 2979115 - RNA, 21 nt, Mycobacterium avium subsp. paratuberculosis
ccgaggguucgguggccccgg

SEQ ID NO: 2979116 - RNA, 15 nt, Mycobacterium avium subsp. paratuberculosis
ccgagguagccgcgc

SEQ ID NO: 2979117 - RNA, 16 nt, Mycobacterium avium subsp. paratuberculosis
ccgagguagccgcgca

SEQ ID NO: 2979118 - RNA, 17 nt, Mycobacterium avium subsp. paratuberculosis
ccgagguagggccgggu

SEQ ID NO: 2979119 - RNA, 17 nt, Mycobacterium avium subsp. paratuberculosis
ccgagguagucggccuc

SEQ ID NO: 2979120 - RNA, 17 nt, Mycobacterium avium subsp. paratuberculosis
ccgaggucaccgcgacc

SEQ ID NO: 2979121 - RNA, 17 nt, Mycobacterium avium subsp. paratuberculosis
ccgaggucaccgcggga

SEQ ID NO: 2979122 - RNA, 13 nt, Mycobacterium avium subsp. paratuberculosis
ccgaggucagcgc

SEQ ID NO: 2979123 - RNA, 19 nt, Mycobacterium avium subsp. paratuberculosis
ccgaggucauaucgacggc

SEQ ID NO: 2979124 - RNA, 22 nt, Mycobacterium avium subsp. paratuberculosis
ccgaggucauaucgacggcccc

SEQ ID NO: 2979125 - RNA, 16 nt, Mycobacterium avium subsp. paratuberculosis
ccgaggucgccgacgc

SEQ ID NO: 2979126 - RNA, 19 nt, Mycobacterium avium subsp. paratuberculosis
ccgaggucgccgacgccgu

SEQ ID NO: 2979127 - RNA, 20 nt, Mycobacterium avium subsp. paratuberculosis
ccgaggucgcggcggccggc

SEQ ID NO: 2979128 - RNA, 14 nt, Mycobacterium avium subsp. paratuberculosis
ccgaggucggucgc

SEQ ID NO: 2979129 - RNA, 22 nt, Mycobacterium avium subsp. paratuberculosis
ccgaggucuuucaucgccccgg

SEQ ID NO: 2979130 - RNA, 19 nt, Mycobacterium avium subsp. paratuberculosis
ccgaggugaauaccacugc

SEQ ID NO: 2979131 - RNA, 21 nt, Mycobacterium avium subsp. paratuberculosis
ccgaggugaauaccacugcgc

SEQ ID NO: 2979132 - RNA, 19 nt, Mycobacterium avium subsp. paratuberculosis
ccgaggugacgucgcgccg

SEQ ID NO: 2979133 - RNA, 14 nt, Mycobacterium avium subsp. paratuberculosis
ccgaggugaucgcg

SEQ ID NO: 2979134 - RNA, 24 nt, Mycobacterium avium subsp. paratuberculosis
ccgaggugaucgcgaacgcgccgg

SEQ ID NO: 2979135 - RNA, 18 nt, Mycobacterium avium subsp. paratuberculosis
ccgaggugcaacacucga

SEQ ID NO: 2979136 - RNA, 22 nt, Mycobacterium avium subsp. paratuberculosis
ccgaggugcaacacucgagcgc

SEQ ID NO: 2979137 - RNA, 13 nt, Mycobacterium avium subsp. paratuberculosis
ccgaggugccgcg

SEQ ID NO: 2979138 - RNA, 19 nt, Mycobacterium avium subsp. paratuberculosis
ccgaggugcugucgucgcc

SEQ ID NO: 2979139 - RNA, 15 nt, Mycobacterium avium subsp. paratuberculosis
ccgagguggcccagc

SEQ ID NO: 2979140 - RNA, 18 nt, Mycobacterium avium subsp. paratuberculosis
ccgagguggcccagccgc

SEQ ID NO: 2979141 - RNA, 20 nt, Mycobacterium avium subsp. paratuberculosis
ccgagguggcccgccacgug

SEQ ID NO: 2979142 - RNA, 21 nt, Mycobacterium avium subsp. paratuberculosis
ccgagguggcccgccacgugc

SEQ ID NO: 2979143 - RNA, 15 nt, Mycobacterium avium subsp. paratuberculosis
ccgagguggccgcca

SEQ ID NO: 2979144 - RNA, 17 nt, Mycobacterium avium subsp. paratuberculosis
ccgagguggccgccagc

SEQ ID NO: 2979145 - RNA, 22 nt, Mycobacterium avium subsp. paratuberculosis
ccgaguagaacuucgccagcgg

SEQ ID NO: 2979146 - RNA, 17 nt, Mycobacterium avium subsp. paratuberculosis
ccgaguauccgcgcagc

SEQ ID NO: 2979147 - RNA, 20 nt, Mycobacterium avium subsp. paratuberculosis
ccgaguauccgcgcagcguc

SEQ ID NO: 2979148 - RNA, 12 nt, Mycobacterium avium subsp. paratuberculosis
ccgagucacccg

SEQ ID NO: 2979149 - RNA, 14 nt, Mycobacterium avium subsp. paratuberculosis
ccgagucacccggc

SEQ ID NO: 2979150 - RNA, 16 nt, Mycobacterium avium subsp. paratuberculosis
ccgagucacccggcug

SEQ ID NO: 2979151 - RNA, 18 nt, Mycobacterium avium subsp. paratuberculosis
ccgagucacccggcuggc

SEQ ID NO: 2979152 - RNA, 14 nt, Mycobacterium avium subsp. paratuberculosis
ccgaguccacgacg

SEQ ID NO: 2979153 - RNA, 16 nt, Mycobacterium avium subsp. paratuberculosis
ccgaguccacgacguc

SEQ ID NO: 2979154 - RNA, 15 nt, Mycobacterium avium subsp. paratuberculosis
ccgaguccgggccgc

SEQ ID NO: 2979155 - RNA, 19 nt, Mycobacterium avium subsp. paratuberculosis
ccgaguccgggccgccggc

SEQ ID NO: 2979156 - RNA, 20 nt, Mycobacterium avium subsp. paratuberculosis
ccgaguccgggccgccggcc

SEQ ID NO: 2979157 - RNA, 23 nt, Mycobacterium avium subsp. paratuberculosis
ccgaguccgggccgccggccgcg

SEQ ID NO: 2979158 - RNA, 18 nt, Mycobacterium avium subsp. paratuberculosis
ccgaguccuugaccuugg

SEQ ID NO: 2979159 - RNA, 20 nt, Mycobacterium avium subsp. paratuberculosis
ccgagucgacgugcucggcg

SEQ ID NO: 2979160 - RNA, 15 nt, Mycobacterium avium subsp. paratuberculosis
ccgagucgaucgcca

SEQ ID NO: 2979161 - RNA, 17 nt, Mycobacterium avium subsp. paratuberculosis
ccgagucgaucgccagc

SEQ ID NO: 2979162 - RNA, 21 nt, Mycobacterium avium subsp. paratuberculosis
ccgagucgaucgccagcgcgc

SEQ ID NO: 2979163 - RNA, 23 nt, Mycobacterium avium subsp. paratuberculosis
ccgagucgaucgccagcgcgcag

SEQ ID NO: 2979164 - RNA, 13 nt, Mycobacterium avium subsp. paratuberculosis
ccgagucgcgccg

SEQ ID NO: 2979165 - RNA, 18 nt, Mycobacterium avium subsp. paratuberculosis
ccgagucgcgccgcgucg

SEQ ID NO: 2979166 - RNA, 14 nt, Mycobacterium avium subsp. paratuberculosis
ccgagucgcgcgac

SEQ ID NO: 2979167 - RNA, 15 nt, Mycobacterium avium subsp. paratuberculosis
ccgagucgcgcgacc

SEQ ID NO: 2979168 - RNA, 21 nt, Mycobacterium avium subsp. paratuberculosis
ccgagucggagacccgcccgg

SEQ ID NO: 2979169 - RNA, 15 nt, Mycobacterium avium subsp. paratuberculosis
ccgagucggcgucgg

SEQ ID NO: 2979170 - RNA, 15 nt, Mycobacterium avium subsp. paratuberculosis
ccgagucggugacca

SEQ ID NO: 2979171 - RNA, 12 nt, Mycobacterium avium subsp. paratuberculosis
ccgagucgucgc

SEQ ID NO: 2979172 - RNA, 14 nt, Mycobacterium avium subsp. paratuberculosis
ccgagucgucgcgc

SEQ ID NO: 2979173 - RNA, 17 nt, Mycobacterium avium subsp. paratuberculosis
ccgagucgucgcgcacc

SEQ ID NO: 2979174 - RNA, 18 nt, Mycobacterium avium subsp. paratuberculosis
ccgagucgucgcgcacca

SEQ ID NO: 2979175 - RNA, 20 nt, Mycobacterium avium subsp. paratuberculosis
ccgagucgucgcgcaccagc

SEQ ID NO: 2979176 - RNA, 17 nt, Mycobacterium avium subsp. paratuberculosis
ccgagugcggcgcggug

SEQ ID NO: 2979177 - RNA, 19 nt, Mycobacterium avium subsp. paratuberculosis
ccgagugggaccgucggca

SEQ ID NO: 2979178 - RNA, 18 nt, Mycobacterium avium subsp. paratuberculosis
ccgaguuccugcgaccgc

SEQ ID NO: 2979179 - RNA, 22 nt, Mycobacterium avium subsp. paratuberculosis
ccgaguuccugcgaccgccgcc

SEQ ID NO: 2979180 - RNA, 16 nt, Mycobacterium avium subsp. paratuberculosis
ccgaguucgaccucgg

SEQ ID NO: 2979181 - RNA, 18 nt, Mycobacterium avium subsp. paratuberculosis
ccgaguucgaccucggug

SEQ ID NO: 2979182 - RNA, 19 nt, Mycobacterium avium subsp. paratuberculosis
ccgaguugauaggucacgc

SEQ ID NO: 2979183 - RNA, 20 nt, Mycobacterium avium subsp. paratuberculosis
ccgaguugauaggucacgcc

SEQ ID NO: 2979184 - RNA, 19 nt, Mycobacterium avium subsp. paratuberculosis
ccgaguuggccggcacucg

SEQ ID NO: 2979185 - RNA, 18 nt, Mycobacterium avium subsp. paratuberculosis
ccgaguuugcggugaucc

SEQ ID NO: 2979186 - RNA, 19 nt, Mycobacterium avium subsp. paratuberculosis
ccgaguuugcggugauccc

SEQ ID NO: 2979187 - RNA, 19 nt, Mycobacterium avium subsp. paratuberculosis
ccgaguuuggcgucgaugc

SEQ ID NO: 2979188 - RNA, 19 nt, Mycobacterium avium subsp. paratuberculosis
ccgauagccccgccaggcg

SEQ ID NO: 2979189 - RNA, 20 nt, Mycobacterium avium subsp. paratuberculosis
ccgauagcuugagccccgcc

SEQ ID NO: 2979190 - RNA, 18 nt, Mycobacterium avium subsp. paratuberculosis
ccgauauaggugagaaaa

SEQ ID NO: 2979191 - RNA, 14 nt, Mycobacterium avium subsp. paratuberculosis
ccgaucaacaccgc

SEQ ID NO: 2979192 - RNA, 16 nt, Mycobacterium avium subsp. paratuberculosis
ccgaucaacaccgcca

SEQ ID NO: 2979193 - RNA, 18 nt, Mycobacterium avium subsp. paratuberculosis
ccgaucaacaccgccagc

SEQ ID NO: 2979194 - RNA, 22 nt, Mycobacterium avium subsp. paratuberculosis
ccgaucaacaccgccagcaccg

SEQ ID NO: 2979195 - RNA, 23 nt, Mycobacterium avium subsp. paratuberculosis
ccgaucaacaggcccagcagcgc

SEQ ID NO: 2979196 - RNA, 16 nt, Mycobacterium avium subsp. paratuberculosis
ccgaucaacggcagcg

SEQ ID NO: 2979197 - RNA, 14 nt, Mycobacterium avium subsp. paratuberculosis
ccgaucaccaggcc

SEQ ID NO: 2979198 - RNA, 20 nt, Mycobacterium avium subsp. paratuberculosis
ccgaucaccaggcccaggcc

SEQ ID NO: 2979199 - RNA, 19 nt, Mycobacterium avium subsp. paratuberculosis
ccgaucacccccgacaccg

SEQ ID NO: 2979200 - RNA, 22 nt, Mycobacterium avium subsp. paratuberculosis
ccgaucacccccgacaccgugg

SEQ ID NO: 2979201 - RNA, 13 nt, Mycobacterium avium subsp. paratuberculosis
ccgaucaccgccg

SEQ ID NO: 2979202 - RNA, 12 nt, Mycobacterium avium subsp. paratuberculosis
ccgaucaccgcg

SEQ ID NO: 2979203 - RNA, 13 nt, Mycobacterium avium subsp. paratuberculosis
ccgaucaccgcgu

SEQ ID NO: 2979204 - RNA, 14 nt, Mycobacterium avium subsp. paratuberculosis
ccgaucaccgcguu

SEQ ID NO: 2979205 - RNA, 16 nt, Mycobacterium avium subsp. paratuberculosis
ccgaucaccgcguugu

SEQ ID NO: 2979206 - RNA, 12 nt, Mycobacterium avium subsp. paratuberculosis
ccgaucaccggc

SEQ ID NO: 2979207 - RNA, 15 nt, Mycobacterium avium subsp. paratuberculosis
ccgaucaccggcacg

SEQ ID NO: 2979208 - RNA, 15 nt, Mycobacterium avium subsp. paratuberculosis
ccgaucaccggcagc

SEQ ID NO: 2979209 - RNA, 15 nt, Mycobacterium avium subsp. paratuberculosis
ccgaucaccucgaac

SEQ ID NO: 2979210 - RNA, 18 nt, Mycobacterium avium subsp. paratuberculosis
ccgaucaccucgccggcc

SEQ ID NO: 2979211 - RNA, 17 nt, Mycobacterium avium subsp. paratuberculosis
ccgaucaccugacagac

SEQ ID NO: 2979212 - RNA, 13 nt, Mycobacterium avium subsp. paratuberculosis
ccgaucaccuugc

SEQ ID NO: 2979213 - RNA, 16 nt, Mycobacterium avium subsp. paratuberculosis
ccgaucacgcggaucg

SEQ ID NO: 2979214 - RNA, 22 nt, Mycobacterium avium subsp. paratuberculosis
ccgaucagcaccagguugucgc

SEQ ID NO: 2979215 - RNA, 19 nt, Mycobacterium avium subsp. paratuberculosis
ccgaucagcggcgggccca

SEQ ID NO: 2979216 - RNA, 22 nt, Mycobacterium avium subsp. paratuberculosis
ccgaucagcggcgggcccagca

SEQ ID NO: 2979217 - RNA, 22 nt, Mycobacterium avium subsp. paratuberculosis
ccgaucagcgucagcaccgcga

SEQ ID NO: 2979218 - RNA, 16 nt, Mycobacterium avium subsp. paratuberculosis
ccgaucaggaucggcg

SEQ ID NO: 2979219 - RNA, 14 nt, Mycobacterium avium subsp. paratuberculosis
ccgaucaggcugga

SEQ ID NO: 2979220 - RNA, 14 nt, Mycobacterium avium subsp. paratuberculosis
ccgaucagugccgc

SEQ ID NO: 2979221 - RNA, 15 nt, Mycobacterium avium subsp. paratuberculosis
ccgaucagugccgcg

SEQ ID NO: 2979222 - RNA, 17 nt, Mycobacterium avium subsp. paratuberculosis
ccgaucagugccgcgcc

SEQ ID NO: 2979223 - RNA, 17 nt, Mycobacterium avium subsp. paratuberculosis
ccgaucaucucaccgac

SEQ ID NO: 2979224 - RNA, 18 nt, Mycobacterium avium subsp. paratuberculosis
ccgaucauggucggcgac

SEQ ID NO: 2979225 - RNA, 19 nt, Mycobacterium avium subsp. paratuberculosis
ccgaucauggucggcgacg

SEQ ID NO: 2979226 - RNA, 20 nt, Mycobacterium avium subsp. paratuberculosis
ccgaucauggucggcgacgc

SEQ ID NO: 2979227 - RNA, 21 nt, Mycobacterium avium subsp. paratuberculosis
ccgaucauggucggcgacgcc

SEQ ID NO: 2979228 - RNA, 22 nt, Mycobacterium avium subsp. paratuberculosis
ccgaucauggucggcgacgccg

SEQ ID NO: 2979229 - RNA, 15 nt, Mycobacterium avium subsp. paratuberculosis
ccgauccacggcgac

SEQ ID NO: 2979230 - RNA, 19 nt, Mycobacterium avium subsp. paratuberculosis
ccgauccacggcgaccccg

SEQ ID NO: 2979231 - RNA, 16 nt, Mycobacterium avium subsp. paratuberculosis
ccgauccagacggucu

SEQ ID NO: 2979232 - RNA, 16 nt, Mycobacterium avium subsp. paratuberculosis
ccgauccagccgucgu

SEQ ID NO: 2979233 - RNA, 16 nt, Mycobacterium avium subsp. paratuberculosis
ccgauccagggcccgc

SEQ ID NO: 2979234 - RNA, 19 nt, Mycobacterium avium subsp. paratuberculosis
ccgaucccgaugcggacgc

SEQ ID NO: 2979235 - RNA, 14 nt, Mycobacterium avium subsp. paratuberculosis
ccgaucccggccac

SEQ ID NO: 2979236 - RNA, 16 nt, Mycobacterium avium subsp. paratuberculosis
ccgaucccggccacgu

SEQ ID NO: 2979237 - RNA, 23 nt, Mycobacterium avium subsp. paratuberculosis
ccgaucccggccacgucgaugcc

SEQ ID NO: 2979238 - RNA, 14 nt, Mycobacterium avium subsp. paratuberculosis
ccgaucccgggccg

SEQ ID NO: 2979239 - RNA, 15 nt, Mycobacterium avium subsp. paratuberculosis
ccgaucccgggccgu

SEQ ID NO: 2979240 - RNA, 21 nt, Mycobacterium avium subsp. paratuberculosis
ccgauccgagcgcugcccgug

SEQ ID NO: 2979241 - RNA, 16 nt, Mycobacterium avium subsp. paratuberculosis
ccgauccgcaccggac

SEQ ID NO: 2979242 - RNA, 17 nt, Mycobacterium avium subsp. paratuberculosis
ccgauccgcaccggacg

SEQ ID NO: 2979243 - RNA, 13 nt, Mycobacterium avium subsp. paratuberculosis
ccgauccgcagcc

SEQ ID NO: 2979244 - RNA, 17 nt, Mycobacterium avium subsp. paratuberculosis
ccgauccgcagccgcug

SEQ ID NO: 2979245 - RNA, 14 nt, Mycobacterium avium subsp. paratuberculosis
ccgauccgccggcg

SEQ ID NO: 2979246 - RNA, 15 nt, Mycobacterium avium subsp. paratuberculosis
ccgauccgccggcga

SEQ ID NO: 2979247 - RNA, 17 nt, Mycobacterium avium subsp. paratuberculosis
ccgauccgccggcgaag

SEQ ID NO: 2979248 - RNA, 13 nt, Mycobacterium avium subsp. paratuberculosis
ccgauccgccguu

SEQ ID NO: 2979249 - RNA, 16 nt, Mycobacterium avium subsp. paratuberculosis
ccgauccgcgccgccg

SEQ ID NO: 2979250 - RNA, 13 nt, Mycobacterium avium subsp. paratuberculosis
ccgauccgcgggu

SEQ ID NO: 2979251 - RNA, 13 nt, Mycobacterium avium subsp. paratuberculosis
ccgauccggcgcc

SEQ ID NO: 2979252 - RNA, 14 nt, Mycobacterium avium subsp. paratuberculosis
ccgauccggcgccc

SEQ ID NO: 2979253 - RNA, 14 nt, Mycobacterium avium subsp. paratuberculosis
ccgauccgggcggc

SEQ ID NO: 2979254 - RNA, 13 nt, Mycobacterium avium subsp. paratuberculosis
ccgaucgacgaau

SEQ ID NO: 2979255 - RNA, 22 nt, Mycobacterium avium subsp. paratuberculosis
ccgaucgaucagccgcgacagc

SEQ ID NO: 2979256 - RNA, 20 nt, Mycobacterium avium subsp. paratuberculosis
ccgaucgaucaucgccucgg

SEQ ID NO: 2979257 - RNA, 21 nt, Mycobacterium avium subsp. paratuberculosis
ccgaucgcccgguaggccgcc

SEQ ID NO: 2979258 - RNA, 17 nt, Mycobacterium avium subsp. paratuberculosis
ccgaucgccgagucgau

SEQ ID NO: 2979259 - RNA, 14 nt, Mycobacterium avium subsp. paratuberculosis
ccgaucgccgcggc

SEQ ID NO: 2979260 - RNA, 17 nt, Mycobacterium avium subsp. paratuberculosis
ccgaucgcgaucaccgc

SEQ ID NO: 2979261 - RNA, 18 nt, Mycobacterium avium subsp. paratuberculosis
ccgaucgcgaucaccgcg

SEQ ID NO: 2979262 - RNA, 21 nt, Mycobacterium avium subsp. paratuberculosis
ccgaucgcgaucaccgcggcc

SEQ ID NO: 2979263 - RNA, 15 nt, Mycobacterium avium subsp. paratuberculosis
ccgaucgcgcgcagg

SEQ ID NO: 2979264 - RNA, 16 nt, Mycobacterium avium subsp. paratuberculosis
ccgaucgcgcgcagga

SEQ ID NO: 2979265 - RNA, 13 nt, Mycobacterium avium subsp. paratuberculosis
ccgaucgcggccc

SEQ ID NO: 2979266 - RNA, 18 nt, Mycobacterium avium subsp. paratuberculosis
ccgaucgcggcgaucagc

SEQ ID NO: 2979267 - RNA, 19 nt, Mycobacterium avium subsp. paratuberculosis
ccgaucgcggcgaucagcc

SEQ ID NO: 2979268 - RNA, 23 nt, Mycobacterium avium subsp. paratuberculosis
ccgaucgcggcgaucagcccggc

SEQ ID NO: 2979269 - RNA, 16 nt, Mycobacterium avium subsp. paratuberculosis
ccgaucgcgucgacga

SEQ ID NO: 2979270 - RNA, 23 nt, Mycobacterium avium subsp. paratuberculosis
ccgaucgcgucgacgauggcguc

SEQ ID NO: 2979271 - RNA, 23 nt, Mycobacterium avium subsp. paratuberculosis
ccgaucggcacccgcaacaccac

SEQ ID NO: 2979272 - RNA, 12 nt, Mycobacterium avium subsp. paratuberculosis
ccgaucggcacg

SEQ ID NO: 2979273 - RNA, 15 nt, Mycobacterium avium subsp. paratuberculosis
ccgaucggcacgucg

SEQ ID NO: 2979274 - RNA, 16 nt, Mycobacterium avium subsp. paratuberculosis
ccgaucggcacgucga

SEQ ID NO: 2979275 - RNA, 23 nt, Mycobacterium avium subsp. paratuberculosis
ccgaucggcacgucgagcaguug

SEQ ID NO: 2979276 - RNA, 13 nt, Mycobacterium avium subsp. paratuberculosis
ccgaucggcccgg

SEQ ID NO: 2979277 - RNA, 16 nt, Mycobacterium avium subsp. paratuberculosis
ccgaucggcccggcca

SEQ ID NO: 2979278 - RNA, 19 nt, Mycobacterium avium subsp. paratuberculosis
ccgaucgggaccgucaccg

SEQ ID NO: 2979279 - RNA, 21 nt, Mycobacterium avium subsp. paratuberculosis
ccgaucgggaccgucaccgug

SEQ ID NO: 2979280 - RNA, 23 nt, Mycobacterium avium subsp. paratuberculosis
ccgaucgggaccgucaccguggc

SEQ ID NO: 2979281 - RNA, 18 nt, Mycobacterium avium subsp. paratuberculosis
ccgaucggggccaggaug

SEQ ID NO: 2979282 - RNA, 18 nt, Mycobacterium avium subsp. paratuberculosis
ccgaucggggcgcagccc

SEQ ID NO: 2979283 - RNA, 23 nt, Mycobacterium avium subsp. paratuberculosis
ccgaucggggcgcagcccggcgg

SEQ ID NO: 2979284 - RNA, 15 nt, Mycobacterium avium subsp. paratuberculosis
ccgaucguccggcgc

SEQ ID NO: 2979285 - RNA, 22 nt, Mycobacterium avium subsp. paratuberculosis
ccgaucgugaauucggccgggu

SEQ ID NO: 2979286 - RNA, 23 nt, Mycobacterium avium subsp. paratuberculosis
ccgaucgugacgccguccgacgu

SEQ ID NO: 2979287 - RNA, 18 nt, Mycobacterium avium subsp. paratuberculosis
ccgaucuccaccgagugc

SEQ ID NO: 2979288 - RNA, 19 nt, Mycobacterium avium subsp. paratuberculosis
ccgaucuccaccgagugcg

SEQ ID NO: 2979289 - RNA, 15 nt, Mycobacterium avium subsp. paratuberculosis
ccgaucucgaccagc

SEQ ID NO: 2979290 - RNA, 16 nt, Mycobacterium avium subsp. paratuberculosis
ccgaucucgcgcgggu

SEQ ID NO: 2979291 - RNA, 14 nt, Mycobacterium avium subsp. paratuberculosis
ccgaucucgcgguc

SEQ ID NO: 2979292 - RNA, 17 nt, Mycobacterium avium subsp. paratuberculosis
ccgaucucguagcccac

SEQ ID NO: 2979293 - RNA, 19 nt, Mycobacterium avium subsp. paratuberculosis
ccgaucucguagcccaccu

SEQ ID NO: 2979294 - RNA, 19 nt, Mycobacterium avium subsp. paratuberculosis
ccgaucugaccgagcagcg

SEQ ID NO: 2979295 - RNA, 19 nt, Mycobacterium avium subsp. paratuberculosis
ccgaucugcucgaugcggc

SEQ ID NO: 2979296 - RNA, 14 nt, Mycobacterium avium subsp. paratuberculosis
ccgaucuggcgggc

SEQ ID NO: 2979297 - RNA, 20 nt, Mycobacterium avium subsp. paratuberculosis
ccgaucugggaucggugcgc

SEQ ID NO: 2979298 - RNA, 14 nt, Mycobacterium avium subsp. paratuberculosis
ccgaucugucgcgc

SEQ ID NO: 2979299 - RNA, 15 nt, Mycobacterium avium subsp. paratuberculosis
ccgaucugucgcgcu

SEQ ID NO: 2979300 - RNA, 19 nt, Mycobacterium avium subsp. paratuberculosis
ccgaucuuggcgagcugac

SEQ ID NO: 2979301 - RNA, 23 nt, Mycobacterium avium subsp. paratuberculosis
ccgaucuuggcgagcugaccggc

SEQ ID NO: 2979302 - RNA, 13 nt, Mycobacterium avium subsp. paratuberculosis
ccgaucuugucga

SEQ ID NO: 2979303 - RNA, 17 nt, Mycobacterium avium subsp. paratuberculosis
ccgaugaagaacacccc

SEQ ID NO: 2979304 - RNA, 23 nt, Mycobacterium avium subsp. paratuberculosis
ccgaugaagaacaccccgaccga

SEQ ID NO: 2979305 - RNA, 14 nt, Mycobacterium avium subsp. paratuberculosis
ccgaugaaguaccc

SEQ ID NO: 2979306 - RNA, 15 nt, Mycobacterium avium subsp. paratuberculosis
ccgaugaccaccgcu

SEQ ID NO: 2979307 - RNA, 14 nt, Mycobacterium avium subsp. paratuberculosis
ccgaugaccgcggc

SEQ ID NO: 2979308 - RNA, 17 nt, Mycobacterium avium subsp. paratuberculosis
ccgaugaccgcggcggg

SEQ ID NO: 2979309 - RNA, 18 nt, Mycobacterium avium subsp. paratuberculosis
ccgaugaccgcggcgggc

SEQ ID NO: 2979310 - RNA, 15 nt, Mycobacterium avium subsp. paratuberculosis
ccgaugaccggcccg

SEQ ID NO: 2979311 - RNA, 15 nt, Mycobacterium avium subsp. paratuberculosis
ccgaugacgagcagc

SEQ ID NO: 2979312 - RNA, 15 nt, Mycobacterium avium subsp. paratuberculosis
ccgaugacgcugccg

SEQ ID NO: 2979313 - RNA, 19 nt, Mycobacterium avium subsp. paratuberculosis
ccgaugagccucagcgcgc

SEQ ID NO: 2979314 - RNA, 15 nt, Mycobacterium avium subsp. paratuberculosis
ccgaugaucgagcac

SEQ ID NO: 2979315 - RNA, 22 nt, Mycobacterium avium subsp. paratuberculosis
ccgaugaugaaaccggccagca

SEQ ID NO: 2979316 - RNA, 15 nt, Mycobacterium avium subsp. paratuberculosis
ccgaugaugaugccg

SEQ ID NO: 2979317 - RNA, 19 nt, Mycobacterium avium subsp. paratuberculosis
ccgaugaugguggcggcca

SEQ ID NO: 2979318 - RNA, 15 nt, Mycobacterium avium subsp. paratuberculosis
ccgaugcagggccga

SEQ ID NO: 2979319 - RNA, 20 nt, Mycobacterium avium subsp. paratuberculosis
ccgaugcaguuauccacaau

SEQ ID NO: 2979320 - RNA, 16 nt, Mycobacterium avium subsp. paratuberculosis
ccgaugcccaucacgc

SEQ ID NO: 2979321 - RNA, 19 nt, Mycobacterium avium subsp. paratuberculosis
ccgaugcccgacaccgccc

SEQ ID NO: 2979322 - RNA, 22 nt, Mycobacterium avium subsp. paratuberculosis
ccgaugcccgacaccgccccgc

SEQ ID NO: 2979323 - RNA, 15 nt, Mycobacterium avium subsp. paratuberculosis
ccgaugcccgccccg

SEQ ID NO: 2979324 - RNA, 19 nt, Mycobacterium avium subsp. paratuberculosis
ccgaugccgaacgucacca

SEQ ID NO: 2979325 - RNA, 22 nt, Mycobacterium avium subsp. paratuberculosis
ccgaugccgccgagggccagca

SEQ ID NO: 2979326 - RNA, 13 nt, Mycobacterium avium subsp. paratuberculosis
ccgaugccgcgcu

SEQ ID NO: 2979327 - RNA, 14 nt, Mycobacterium avium subsp. paratuberculosis
ccgaugccgcgcug

SEQ ID NO: 2979328 - RNA, 13 nt, Mycobacterium avium subsp. paratuberculosis
ccgaugcgcccgc

SEQ ID NO: 2979329 - RNA, 16 nt, Mycobacterium avium subsp. paratuberculosis
ccgaugcgcccgcgcc

SEQ ID NO: 2979330 - RNA, 20 nt, Mycobacterium avium subsp. paratuberculosis
ccgaugcgcccgcgccaccc

SEQ ID NO: 2979331 - RNA, 17 nt, Mycobacterium avium subsp. paratuberculosis
ccgaugcgcucgccgau

SEQ ID NO: 2979332 - RNA, 22 nt, Mycobacterium avium subsp. paratuberculosis
ccgaugcggaccggggacuuga

SEQ ID NO: 2979333 - RNA, 15 nt, Mycobacterium avium subsp. paratuberculosis
ccgaugcgggccagg

SEQ ID NO: 2979334 - RNA, 13 nt, Mycobacterium avium subsp. paratuberculosis
ccgaugcggugcc

SEQ ID NO: 2979335 - RNA, 22 nt, Mycobacterium avium subsp. paratuberculosis
ccgaugcggugccgggccaggu

SEQ ID NO: 2979336 - RNA, 20 nt, Mycobacterium avium subsp. paratuberculosis
ccgaugcgguugaucaacgg

SEQ ID NO: 2979337 - RNA, 22 nt, Mycobacterium avium subsp. paratuberculosis
ccgaugcucgaugcgcaccugc

SEQ ID NO: 2979338 - RNA, 23 nt, Mycobacterium avium subsp. paratuberculosis
ccgaugcugagcgggucggccgg

SEQ ID NO: 2979339 - RNA, 20 nt, Mycobacterium avium subsp. paratuberculosis
ccgaugcuggccaucgccga

SEQ ID NO: 2979340 - RNA, 22 nt, Mycobacterium avium subsp. paratuberculosis
ccgaugcuggccaucgccgagc

SEQ ID NO: 2979341 - RNA, 21 nt, Mycobacterium avium subsp. paratuberculosis
ccgauggaggugccgcgcagc

SEQ ID NO: 2979342 - RNA, 16 nt, Mycobacterium avium subsp. paratuberculosis
ccgauggccaccgggc

SEQ ID NO: 2979343 - RNA, 19 nt, Mycobacterium avium subsp. paratuberculosis
ccgauggcccaggccgcgg

SEQ ID NO: 2979344 - RNA, 13 nt, Mycobacterium avium subsp. paratuberculosis
ccgauggccgccc

SEQ ID NO: 2979345 - RNA, 17 nt, Mycobacterium avium subsp. paratuberculosis
ccgauggccugguggcc

SEQ ID NO: 2979346 - RNA, 18 nt, Mycobacterium avium subsp. paratuberculosis
ccgauggccugguggccc

SEQ ID NO: 2979347 - RNA, 14 nt, Mycobacterium avium subsp. paratuberculosis
ccgauggcgacggu

SEQ ID NO: 2979348 - RNA, 15 nt, Mycobacterium avium subsp. paratuberculosis
ccgauggcgacgguc

SEQ ID NO: 2979349 - RNA, 20 nt, Mycobacterium avium subsp. paratuberculosis
ccgauggcgacggucugccg

SEQ ID NO: 2979350 - RNA, 14 nt, Mycobacterium avium subsp. paratuberculosis
ccgauggcgcccag

SEQ ID NO: 2979351 - RNA, 19 nt, Mycobacterium avium subsp. paratuberculosis
ccgauggcggccugcagga

SEQ ID NO: 2979352 - RNA, 14 nt, Mycobacterium avium subsp. paratuberculosis
ccgauggcggcggc

SEQ ID NO: 2979353 - RNA, 18 nt, Mycobacterium avium subsp. paratuberculosis
ccgauggcggcggcccgc

SEQ ID NO: 2979354 - RNA, 21 nt, Mycobacterium avium subsp. paratuberculosis
ccgauggcggcggcccgccgc

SEQ ID NO: 2979355 - RNA, 23 nt, Mycobacterium avium subsp. paratuberculosis
ccgauggcggcggcccgccgcgc

SEQ ID NO: 2979356 - RNA, 18 nt, Mycobacterium avium subsp. paratuberculosis
ccgauggcgguccaccac

SEQ ID NO: 2979357 - RNA, 19 nt, Mycobacterium avium subsp. paratuberculosis
ccgauggcucgcgggggcc

SEQ ID NO: 2979358 - RNA, 17 nt, Mycobacterium avium subsp. paratuberculosis
ccgauggguuggccguc

SEQ ID NO: 2979359 - RNA, 12 nt, Mycobacterium avium subsp. paratuberculosis
ccgauggucagc

SEQ ID NO: 2979360 - RNA, 16 nt, Mycobacterium avium subsp. paratuberculosis
ccgauggucagcugcc

SEQ ID NO: 2979361 - RNA, 19 nt, Mycobacterium avium subsp. paratuberculosis
ccgauggucagcugccgca

SEQ ID NO: 2979362 - RNA, 21 nt, Mycobacterium avium subsp. paratuberculosis
ccgauggugaaccacuucugg

SEQ ID NO: 2979363 - RNA, 22 nt, Mycobacterium avium subsp. paratuberculosis
ccgauggugaagccgugcacgc

SEQ ID NO: 2979364 - RNA, 14 nt, Mycobacterium avium subsp. paratuberculosis
ccgauggugacggu

SEQ ID NO: 2979365 - RNA, 16 nt, Mycobacterium avium subsp. paratuberculosis
ccgauggugacggugc

SEQ ID NO: 2979366 - RNA, 21 nt, Mycobacterium avium subsp. paratuberculosis
ccgauggugacggugccgccg

SEQ ID NO: 2979367 - RNA, 17 nt, Mycobacterium avium subsp. paratuberculosis
ccgauggugguaccgac

SEQ ID NO: 2979368 - RNA, 13 nt, Mycobacterium avium subsp. paratuberculosis
ccgauguacuccu

SEQ ID NO: 2979369 - RNA, 20 nt, Mycobacterium avium subsp. paratuberculosis
ccgauguacugggccgucgc

SEQ ID NO: 2979370 - RNA, 21 nt, Mycobacterium avium subsp. paratuberculosis
ccgauguacugggccgucgcc

SEQ ID NO: 2979371 - RNA, 19 nt, Mycobacterium avium subsp. paratuberculosis
ccgauguaggacaggucgc

SEQ ID NO: 2979372 - RNA, 19 nt, Mycobacterium avium subsp. paratuberculosis
ccgauguccccgcggguga

SEQ ID NO: 2979373 - RNA, 15 nt, Mycobacterium avium subsp. paratuberculosis
ccgaugucggccggu

SEQ ID NO: 2979374 - RNA, 13 nt, Mycobacterium avium subsp. paratuberculosis
ccgaugucggcga

SEQ ID NO: 2979375 - RNA, 13 nt, Mycobacterium avium subsp. paratuberculosis
ccgaugucgucga

SEQ ID NO: 2979376 - RNA, 15 nt, Mycobacterium avium subsp. paratuberculosis
ccgaugucgucgaac

SEQ ID NO: 2979377 - RNA, 17 nt, Mycobacterium avium subsp. paratuberculosis
ccgaugucgucgaacgc

SEQ ID NO: 2979378 - RNA, 16 nt, Mycobacterium avium subsp. paratuberculosis
ccgaugucugaucgcg

SEQ ID NO: 2979379 - RNA, 19 nt, Mycobacterium avium subsp. paratuberculosis
ccgaugugaucggcggcca

SEQ ID NO: 2979380 - RNA, 13 nt, Mycobacterium avium subsp. paratuberculosis
ccgauguggccgg

SEQ ID NO: 2979381 - RNA, 15 nt, Mycobacterium avium subsp. paratuberculosis
ccgauguggccggcg

SEQ ID NO: 2979382 - RNA, 17 nt, Mycobacterium avium subsp. paratuberculosis
ccgauguggcgggcguc

SEQ ID NO: 2979383 - RNA, 19 nt, Mycobacterium avium subsp. paratuberculosis
ccgauguggcgggcguccu

SEQ ID NO: 2979384 - RNA, 15 nt, Mycobacterium avium subsp. paratuberculosis
ccgauguucaccccg

SEQ ID NO: 2979385 - RNA, 16 nt, Mycobacterium avium subsp. paratuberculosis
ccgauguucaccccga

SEQ ID NO: 2979386 - RNA, 15 nt, Mycobacterium avium subsp. paratuberculosis
ccgauguuuugggug

SEQ ID NO: 2979387 - RNA, 18 nt, Mycobacterium avium subsp. paratuberculosis
ccgauucaaccccgcgcg

SEQ ID NO: 2979388 - RNA, 23 nt, Mycobacterium avium subsp. paratuberculosis
ccgauucaaccccgcgcgcgggc

SEQ ID NO: 2979389 - RNA, 21 nt, Mycobacterium avium subsp. paratuberculosis
ccgauucagccggcgggcgcu

SEQ ID NO: 2979390 - RNA, 23 nt, Mycobacterium avium subsp. paratuberculosis
ccgauuccagcaacugcucgacc

SEQ ID NO: 2979391 - RNA, 17 nt, Mycobacterium avium subsp. paratuberculosis
ccgauuccccggcgugu

SEQ ID NO: 2979392 - RNA, 14 nt, Mycobacterium avium subsp. paratuberculosis
ccgauuccggccgg

SEQ ID NO: 2979393 - RNA, 18 nt, Mycobacterium avium subsp. paratuberculosis
ccgauuccggccggccgc

SEQ ID NO: 2979394 - RNA, 19 nt, Mycobacterium avium subsp. paratuberculosis
ccgauuccggccggccgcc

SEQ ID NO: 2979395 - RNA, 13 nt, Mycobacterium avium subsp. paratuberculosis
ccgauuccgucgg

SEQ ID NO: 2979396 - RNA, 18 nt, Mycobacterium avium subsp. paratuberculosis
ccgauucggcgccgcgac

SEQ ID NO: 2979397 - RNA, 13 nt, Mycobacterium avium subsp. paratuberculosis
ccgauugcccgac

SEQ ID NO: 2979398 - RNA, 15 nt, Mycobacterium avium subsp. paratuberculosis
ccgauugcccgacuc

SEQ ID NO: 2979399 - RNA, 17 nt, Mycobacterium avium subsp. paratuberculosis
ccgauugcccgacuccu

SEQ ID NO: 2979400 - RNA, 20 nt, Mycobacterium avium subsp. paratuberculosis
ccgauugcccgacuccucac

SEQ ID NO: 2979401 - RNA, 17 nt, Mycobacterium avium subsp. paratuberculosis
ccgauuucccgacuccu

SEQ ID NO: 2979402 - RNA, 15 nt, Mycobacterium avium subsp. paratuberculosis
ccgauuucgcggccg

SEQ ID NO: 2979403 - RNA, 16 nt, Mycobacterium avium subsp. paratuberculosis
ccgcaaacacgagcag

SEQ ID NO: 2979404 - RNA, 17 nt, Mycobacterium avium subsp. paratuberculosis
ccgcaaacacgagcaga

SEQ ID NO: 2979405 - RNA, 16 nt, Mycobacterium avium subsp. paratuberculosis
ccgcaaagcaccgcga

SEQ ID NO: 2979406 - RNA, 21 nt, Mycobacterium avium subsp. paratuberculosis
ccgcaaagcaccgcgaacagc

SEQ ID NO: 2979407 - RNA, 22 nt, Mycobacterium avium subsp. paratuberculosis
ccgcaaagcaccgcgaacagca

SEQ ID NO: 2979408 - RNA, 17 nt, Mycobacterium avium subsp. paratuberculosis
ccgcaaaucagccgagc

SEQ ID NO: 2979409 - RNA, 15 nt, Mycobacterium avium subsp. paratuberculosis
ccgcaacaccacguc

SEQ ID NO: 2979410 - RNA, 20 nt, Mycobacterium avium subsp. paratuberculosis
ccgcaacaccacgucggugc

SEQ ID NO: 2979411 - RNA, 22 nt, Mycobacterium avium subsp. paratuberculosis
ccgcaacaccacgucggugccg

SEQ ID NO: 2979412 - RNA, 14 nt, Mycobacterium avium subsp. paratuberculosis
ccgcaacaccagca

SEQ ID NO: 2979413 - RNA, 16 nt, Mycobacterium avium subsp. paratuberculosis
ccgcaacaccagcacg

SEQ ID NO: 2979414 - RNA, 23 nt, Mycobacterium avium subsp. paratuberculosis
ccgcaacaccgaaagccgacacc

SEQ ID NO: 2979415 - RNA, 12 nt, Mycobacterium avium subsp. paratuberculosis
ccgcaacacggc

SEQ ID NO: 2979416 - RNA, 17 nt, Mycobacterium avium subsp. paratuberculosis
ccgcaacacggccucga

SEQ ID NO: 2979417 - RNA, 14 nt, Mycobacterium avium subsp. paratuberculosis
ccgcaacagccggc

SEQ ID NO: 2979418 - RNA, 21 nt, Mycobacterium avium subsp. paratuberculosis
ccgcaacagccggcccgagcc

SEQ ID NO: 2979419 - RNA, 20 nt, Mycobacterium avium subsp. paratuberculosis
ccgcaaccaaaaagcuagcg

SEQ ID NO: 2979420 - RNA, 13 nt, Mycobacterium avium subsp. paratuberculosis
ccgcaaccgccgg

SEQ ID NO: 2979421 - RNA, 22 nt, Mycobacterium avium subsp. paratuberculosis
ccgcaaccgccggcagcggcug

SEQ ID NO: 2979422 - RNA, 13 nt, Mycobacterium avium subsp. paratuberculosis
ccgcaaccgucag

SEQ ID NO: 2979423 - RNA, 17 nt, Mycobacterium avium subsp. paratuberculosis
ccgcaaccuucuuggcc

SEQ ID NO: 2979424 - RNA, 17 nt, Mycobacterium avium subsp. paratuberculosis
ccgcaacgccggcgugc

SEQ ID NO: 2979425 - RNA, 13 nt, Mycobacterium avium subsp. paratuberculosis
ccgcaacgcgcgc

SEQ ID NO: 2979426 - RNA, 21 nt, Mycobacterium avium subsp. paratuberculosis
ccgcaacgcgcgcgacggcgc

SEQ ID NO: 2979427 - RNA, 14 nt, Mycobacterium avium subsp. paratuberculosis
ccgcaacgcugacc

SEQ ID NO: 2979428 - RNA, 17 nt, Mycobacterium avium subsp. paratuberculosis
ccgcaacgcugaccgca

SEQ ID NO: 2979429 - RNA, 16 nt, Mycobacterium avium subsp. paratuberculosis
ccgcaacggcggucgu

SEQ ID NO: 2979430 - RNA, 17 nt, Mycobacterium avium subsp. paratuberculosis
ccgcaacggcucccagg

SEQ ID NO: 2979431 - RNA, 13 nt, Mycobacterium avium subsp. paratuberculosis
ccgcaacgggccg

SEQ ID NO: 2979432 - RNA, 22 nt, Mycobacterium avium subsp. paratuberculosis
ccgcaacgggccgcagccgcgc

SEQ ID NO: 2979433 - RNA, 19 nt, Mycobacterium avium subsp. paratuberculosis
ccgcaacgugcgccggccu

SEQ ID NO: 2979434 - RNA, 19 nt, Mycobacterium avium subsp. paratuberculosis
ccgcaacguuguuccacgu

SEQ ID NO: 2979435 - RNA, 22 nt, Mycobacterium avium subsp. paratuberculosis
ccgcaacguuguuccacguguc

SEQ ID NO: 2979436 - RNA, 15 nt, Mycobacterium avium subsp. paratuberculosis
ccgcaacuccacaac

SEQ ID NO: 2979437 - RNA, 16 nt, Mycobacterium avium subsp. paratuberculosis
ccgcaacucgggcucg

SEQ ID NO: 2979438 - RNA, 21 nt, Mycobacterium avium subsp. paratuberculosis
ccgcaacucgggcucgucguu

SEQ ID NO: 2979439 - RNA, 17 nt, Mycobacterium avium subsp. paratuberculosis
ccgcaacuguucgcggc

SEQ ID NO: 2979440 - RNA, 16 nt, Mycobacterium avium subsp. paratuberculosis
ccgcaacuugcccgac

SEQ ID NO: 2979441 - RNA, 19 nt, Mycobacterium avium subsp. paratuberculosis
ccgcaacuugcccgacggc

SEQ ID NO: 2979442 - RNA, 21 nt, Mycobacterium avium subsp. paratuberculosis
ccgcaacuugcccgacggcgu

SEQ ID NO: 2979443 - RNA, 21 nt, Mycobacterium avium subsp. paratuberculosis
ccgcaagcgaagccgugaccc

SEQ ID NO: 2979444 - RNA, 16 nt, Mycobacterium avium subsp. paratuberculosis
ccgcaaggccgccagc

SEQ ID NO: 2979445 - RNA, 20 nt, Mycobacterium avium subsp. paratuberculosis
ccgcaaggugauucgcgcgg

SEQ ID NO: 2979446 - RNA, 21 nt, Mycobacterium avium subsp. paratuberculosis
ccgcaagugcggucagcuccc

SEQ ID NO: 2979447 - RNA, 15 nt, Mycobacterium avium subsp. paratuberculosis
ccgcaauacaccgcg

SEQ ID NO: 2979448 - RNA, 17 nt, Mycobacterium avium subsp. paratuberculosis
ccgcaauacaccgcgaa

SEQ ID NO: 2979449 - RNA, 19 nt, Mycobacterium avium subsp. paratuberculosis
ccgcaauacggugcccgcc

SEQ ID NO: 2979450 - RNA, 21 nt, Mycobacterium avium subsp. paratuberculosis
ccgcaauacggugcccgccgc

SEQ ID NO: 2979451 - RNA, 21 nt, Mycobacterium avium subsp. paratuberculosis
ccgcaauccuguuccccggcg

SEQ ID NO: 2979452 - RNA, 16 nt, Mycobacterium avium subsp. paratuberculosis
ccgcaaucggcgccgg

SEQ ID NO: 2979453 - RNA, 18 nt, Mycobacterium avium subsp. paratuberculosis
ccgcaauugcgccagcag

SEQ ID NO: 2979454 - RNA, 19 nt, Mycobacterium avium subsp. paratuberculosis
ccgcaauugcgccagcagc

SEQ ID NO: 2979455 - RNA, 13 nt, Mycobacterium avium subsp. paratuberculosis
ccgcacaccgcgc

SEQ ID NO: 2979456 - RNA, 16 nt, Mycobacterium avium subsp. paratuberculosis
ccgcacaccgcgcaga

SEQ ID NO: 2979457 - RNA, 14 nt, Mycobacterium avium subsp. paratuberculosis
ccgcacaccgcggc

SEQ ID NO: 2979458 - RNA, 15 nt, Mycobacterium avium subsp. paratuberculosis
ccgcacaccgcggcg

SEQ ID NO: 2979459 - RNA, 16 nt, Mycobacterium avium subsp. paratuberculosis
ccgcacaccgcggcgg

SEQ ID NO: 2979460 - RNA, 17 nt, Mycobacterium avium subsp. paratuberculosis
ccgcacaccgcggcggc

SEQ ID NO: 2979461 - RNA, 21 nt, Mycobacterium avium subsp. paratuberculosis
ccgcacaccgcggcggcgucg

SEQ ID NO: 2979462 - RNA, 22 nt, Mycobacterium avium subsp. paratuberculosis
ccgcacaccgcggcggcgucgg

SEQ ID NO: 2979463 - RNA, 14 nt, Mycobacterium avium subsp. paratuberculosis
ccgcacaccggcca

SEQ ID NO: 2979464 - RNA, 16 nt, Mycobacterium avium subsp. paratuberculosis
ccgcacagccggcggc

SEQ ID NO: 2979465 - RNA, 23 nt, Mycobacterium avium subsp. paratuberculosis
ccgcacaugccgaggcacagcag

SEQ ID NO: 2979466 - RNA, 14 nt, Mycobacterium avium subsp. paratuberculosis
ccgcaccacccagc

SEQ ID NO: 2979467 - RNA, 15 nt, Mycobacterium avium subsp. paratuberculosis
ccgcaccacccagcc

SEQ ID NO: 2979468 - RNA, 17 nt, Mycobacterium avium subsp. paratuberculosis
ccgcaccacccagcccu

SEQ ID NO: 2979469 - RNA, 17 nt, Mycobacterium avium subsp. paratuberculosis
ccgcaccaccgcccgga

SEQ ID NO: 2979470 - RNA, 12 nt, Mycobacterium avium subsp. paratuberculosis
ccgcaccagauc

SEQ ID NO: 2979471 - RNA, 19 nt, Mycobacterium avium subsp. paratuberculosis
ccgcaccagaucgucgggc

SEQ ID NO: 2979472 - RNA, 22 nt, Mycobacterium avium subsp. paratuberculosis
ccgcaccagaucgucgggcacc

SEQ ID NO: 2979473 - RNA, 16 nt, Mycobacterium avium subsp. paratuberculosis
ccgcaccagcaccccg

SEQ ID NO: 2979474 - RNA, 20 nt, Mycobacterium avium subsp. paratuberculosis
ccgcaccagcaccccgccgc

SEQ ID NO: 2979475 - RNA, 23 nt, Mycobacterium avium subsp. paratuberculosis
ccgcaccagcaccccgccgcagc

SEQ ID NO: 2979476 - RNA, 13 nt, Mycobacterium avium subsp. paratuberculosis
ccgcaccagcagg

SEQ ID NO: 2979477 - RNA, 23 nt, Mycobacterium avium subsp. paratuberculosis
ccgcaccagcagguccauggccu

SEQ ID NO: 2979478 - RNA, 23 nt, Mycobacterium avium subsp. paratuberculosis
ccgcaccagguagguggccgucg

SEQ ID NO: 2979479 - RNA, 14 nt, Mycobacterium avium subsp. paratuberculosis
ccgcacccagcggg

SEQ ID NO: 2979480 - RNA, 18 nt, Mycobacterium avium subsp. paratuberculosis
ccgcacccagcgggcgac

SEQ ID NO: 2979481 - RNA, 23 nt, Mycobacterium avium subsp. paratuberculosis
ccgcacccagcgggcgacgucgg

SEQ ID NO: 2979482 - RNA, 21 nt, Mycobacterium avium subsp. paratuberculosis
ccgcacccccagcucgacgac

SEQ ID NO: 2979483 - RNA, 14 nt, Mycobacterium avium subsp. paratuberculosis
ccgcacccccucca

SEQ ID NO: 2979484 - RNA, 18 nt, Mycobacterium avium subsp. paratuberculosis
ccgcacccccuccacacg

SEQ ID NO: 2979485 - RNA, 18 nt, Mycobacterium avium subsp. paratuberculosis
ccgcaccccgucgcggac

SEQ ID NO: 2979486 - RNA, 21 nt, Mycobacterium avium subsp. paratuberculosis
ccgcaccccgugguagacgcc

SEQ ID NO: 2979487 - RNA, 23 nt, Mycobacterium avium subsp. paratuberculosis
ccgcaccccgugguagacgccgg

SEQ ID NO: 2979488 - RNA, 20 nt, Mycobacterium avium subsp. paratuberculosis
ccgcacccgauccacggcga

SEQ ID NO: 2979489 - RNA, 13 nt, Mycobacterium avium subsp. paratuberculosis
ccgcacccgccgc

SEQ ID NO: 2979490 - RNA, 17 nt, Mycobacterium avium subsp. paratuberculosis
ccgcacccgggcccggu

SEQ ID NO: 2979491 - RNA, 19 nt, Mycobacterium avium subsp. paratuberculosis
ccgcacccguucggcgucg

SEQ ID NO: 2979492 - RNA, 20 nt, Mycobacterium avium subsp. paratuberculosis
ccgcacccguucggcgucga

SEQ ID NO: 2979493 - RNA, 22 nt, Mycobacterium avium subsp. paratuberculosis
ccgcacccuugacuaccgcgcc

SEQ ID NO: 2979494 - RNA, 23 nt, Mycobacterium avium subsp. paratuberculosis
ccgcacccuugacuaccgcgccc

SEQ ID NO: 2979495 - RNA, 24 nt, Mycobacterium avium subsp. paratuberculosis
ccgcacccuugacuaccgcgccca

SEQ ID NO: 2979496 - RNA, 13 nt, Mycobacterium avium subsp. paratuberculosis
ccgcaccgaccag

SEQ ID NO: 2979497 - RNA, 16 nt, Mycobacterium avium subsp. paratuberculosis
ccgcaccgaccagcgg

SEQ ID NO: 2979498 - RNA, 17 nt, Mycobacterium avium subsp. paratuberculosis
ccgcaccgaccagcggg

SEQ ID NO: 2979499 - RNA, 13 nt, Mycobacterium avium subsp. paratuberculosis
ccgcaccgacgaa

SEQ ID NO: 2979500 - RNA, 23 nt, Mycobacterium avium subsp. paratuberculosis
ccgcaccgagaccaugccgccga

SEQ ID NO: 2979501 - RNA, 15 nt, Mycobacterium avium subsp. paratuberculosis
ccgcaccgagccugg

SEQ ID NO: 2979502 - RNA, 23 nt, Mycobacterium avium subsp. paratuberculosis
ccgcaccgauggguuggccgucg

SEQ ID NO: 2979503 - RNA, 20 nt, Mycobacterium avium subsp. paratuberculosis
ccgcaccgccaggcuggcca

SEQ ID NO: 2979504 - RNA, 13 nt, Mycobacterium avium subsp. paratuberculosis
ccgcaccgccccg

SEQ ID NO: 2979505 - RNA, 24 nt, Mycobacterium avium subsp. paratuberculosis
ccgcaccgccucaugccagacgcg

SEQ ID NO: 2979506 - RNA, 13 nt, Mycobacterium avium subsp. paratuberculosis
ccgcaccgcgacc

SEQ ID NO: 2979507 - RNA, 14 nt, Mycobacterium avium subsp. paratuberculosis
ccgcaccgcgaccg

SEQ ID NO: 2979508 - RNA, 12 nt, Mycobacterium avium subsp. paratuberculosis
ccgcaccggccg

SEQ ID NO: 2979509 - RNA, 14 nt, Mycobacterium avium subsp. paratuberculosis
ccgcaccggccggc

SEQ ID NO: 2979510 - RNA, 13 nt, Mycobacterium avium subsp. paratuberculosis
ccgcaccggcgcc

SEQ ID NO: 2979511 - RNA, 14 nt, Mycobacterium avium subsp. paratuberculosis
ccgcaccggcgccg

SEQ ID NO: 2979512 - RNA, 13 nt, Mycobacterium avium subsp. paratuberculosis
ccgcaccucgccc

SEQ ID NO: 2979513 - RNA, 16 nt, Mycobacterium avium subsp. paratuberculosis
ccgcaccucgccgauc

SEQ ID NO: 2979514 - RNA, 15 nt, Mycobacterium avium subsp. paratuberculosis
ccgcaccucgccggc

SEQ ID NO: 2979515 - RNA, 17 nt, Mycobacterium avium subsp. paratuberculosis
ccgcaccucgccggccg

SEQ ID NO: 2979516 - RNA, 19 nt, Mycobacterium avium subsp. paratuberculosis
ccgcaccucgccggccgcc

SEQ ID NO: 2979517 - RNA, 14 nt, Mycobacterium avium subsp. paratuberculosis
ccgcaccucgcugg

SEQ ID NO: 2979518 - RNA, 22 nt, Mycobacterium avium subsp. paratuberculosis
ccgcaccucgcuggcggcgcgg

SEQ ID NO: 2979519 - RNA, 18 nt, Mycobacterium avium subsp. paratuberculosis
ccgcaccucggggcgugg

SEQ ID NO: 2979520 - RNA, 18 nt, Mycobacterium avium subsp. paratuberculosis
ccgcaccugaucgaugcc

SEQ ID NO: 2979521 - RNA, 16 nt, Mycobacterium avium subsp. paratuberculosis
ccgcaccugcgcgccg

SEQ ID NO: 2979522 - RNA, 18 nt, Mycobacterium avium subsp. paratuberculosis
ccgcaccugcgcgccguu

SEQ ID NO: 2979523 - RNA, 21 nt, Mycobacterium avium subsp. paratuberculosis
ccgcaccuggcagcauccgcc

SEQ ID NO: 2979524 - RNA, 22 nt, Mycobacterium avium subsp. paratuberculosis
ccgcaccugguugaacggcacc

SEQ ID NO: 2979525 - RNA, 24 nt, Mycobacterium avium subsp. paratuberculosis
ccgcacgaauugccgguggugcgg

SEQ ID NO: 2979526 - RNA, 13 nt, Mycobacterium avium subsp. paratuberculosis
ccgcacgaccaug

SEQ ID NO: 2979527 - RNA, 13 nt, Mycobacterium avium subsp. paratuberculosis
ccgcacgaucagg

SEQ ID NO: 2979528 - RNA, 17 nt, Mycobacterium avium subsp. paratuberculosis
ccgcacgaucagggugu

SEQ ID NO: 2979529 - RNA, 15 nt, Mycobacterium avium subsp. paratuberculosis
ccgcacgaugccgcg

SEQ ID NO: 2979530 - RNA, 12 nt, Mycobacterium avium subsp. paratuberculosis
ccgcacgccagc

SEQ ID NO: 2979531 - RNA, 13 nt, Mycobacterium avium subsp. paratuberculosis
ccgcacgcccggg

SEQ ID NO: 2979532 - RNA, 15 nt, Mycobacterium avium subsp. paratuberculosis
ccgcacgcccgggca

SEQ ID NO: 2979533 - RNA, 17 nt, Mycobacterium avium subsp. paratuberculosis
ccgcacgcccgggcaug

SEQ ID NO: 2979534 - RNA, 22 nt, Mycobacterium avium subsp. paratuberculosis
ccgcacgcccgggcaugcccgu

SEQ ID NO: 2979535 - RNA, 21 nt, Mycobacterium avium subsp. paratuberculosis
ccgcacgccggguugggcggc

SEQ ID NO: 2979536 - RNA, 17 nt, Mycobacterium avium subsp. paratuberculosis
ccgcacgcgaacaccag

SEQ ID NO: 2979537 - RNA, 13 nt, Mycobacterium avium subsp. paratuberculosis
ccgcacgcgaccg

SEQ ID NO: 2979538 - RNA, 16 nt, Mycobacterium avium subsp. paratuberculosis
ccgcacgcgaccgcgu

SEQ ID NO: 2979539 - RNA, 19 nt, Mycobacterium avium subsp. paratuberculosis
ccgcacgcgaccgcgucga

SEQ ID NO: 2979540 - RNA, 23 nt, Mycobacterium avium subsp. paratuberculosis
ccgcacgcgaccgcgucgacggc

SEQ ID NO: 2979541 - RNA, 14 nt, Mycobacterium avium subsp. paratuberculosis
ccgcacgcugucgg

SEQ ID NO: 2979542 - RNA, 16 nt, Mycobacterium avium subsp. paratuberculosis
ccgcacggcccaucac

SEQ ID NO: 2979543 - RNA, 21 nt, Mycobacterium avium subsp. paratuberculosis
ccgcacggcccaucaccagcg

SEQ ID NO: 2979544 - RNA, 12 nt, Mycobacterium avium subsp. paratuberculosis
ccgcacggccgc

SEQ ID NO: 2979545 - RNA, 14 nt, Mycobacterium avium subsp. paratuberculosis
ccgcacggccgcca

SEQ ID NO: 2979546 - RNA, 20 nt, Mycobacterium avium subsp. paratuberculosis
ccgcacggccgccagggucu

SEQ ID NO: 2979547 - RNA, 20 nt, Mycobacterium avium subsp. paratuberculosis
ccgcacggucgcggugucgg

SEQ ID NO: 2979548 - RNA, 23 nt, Mycobacterium avium subsp. paratuberculosis
ccgcacggucgcggugucggcgu

SEQ ID NO: 2979549 - RNA, 13 nt, Mycobacterium avium subsp. paratuberculosis
ccgcacggugcag

SEQ ID NO: 2979550 - RNA, 17 nt, Mycobacterium avium subsp. paratuberculosis
ccgcacguauccgcggu

SEQ ID NO: 2979551 - RNA, 16 nt, Mycobacterium avium subsp. paratuberculosis
ccgcacgucccgcccg

SEQ ID NO: 2979552 - RNA, 17 nt, Mycobacterium avium subsp. paratuberculosis
ccgcacgucccgcccgg

SEQ ID NO: 2979553 - RNA, 20 nt, Mycobacterium avium subsp. paratuberculosis
ccgcacgucccgcccggcgc

SEQ ID NO: 2979554 - RNA, 18 nt, Mycobacterium avium subsp. paratuberculosis
ccgcacgugcgcgccgac

SEQ ID NO: 2979555 - RNA, 22 nt, Mycobacterium avium subsp. paratuberculosis
ccgcacuccgucgcgaucacac

SEQ ID NO: 2979556 - RNA, 17 nt, Mycobacterium avium subsp. paratuberculosis
ccgcacugaacgggaug

SEQ ID NO: 2979557 - RNA, 16 nt, Mycobacterium avium subsp. paratuberculosis
ccgcacugcacggccu

SEQ ID NO: 2979558 - RNA, 23 nt, Mycobacterium avium subsp. paratuberculosis
ccgcacugcaucucgaccugggu

SEQ ID NO: 2979559 - RNA, 15 nt, Mycobacterium avium subsp. paratuberculosis
ccgcacuuggccucg

SEQ ID NO: 2979560 - RNA, 17 nt, Mycobacterium avium subsp. paratuberculosis
ccgcacuuggccucggg

SEQ ID NO: 2979561 - RNA, 20 nt, Mycobacterium avium subsp. paratuberculosis
ccgcacuuggccucgggcga

SEQ ID NO: 2979562 - RNA, 21 nt, Mycobacterium avium subsp. paratuberculosis
ccgcacuuggccucgggcgac

SEQ ID NO: 2979563 - RNA, 22 nt, Mycobacterium avium subsp. paratuberculosis
ccgcagauacaucucgguggug

SEQ ID NO: 2979564 - RNA, 16 nt, Mycobacterium avium subsp. paratuberculosis
ccgcagaucagggcga

SEQ ID NO: 2979565 - RNA, 13 nt, Mycobacterium avium subsp. paratuberculosis
ccgcagcaccacc

SEQ ID NO: 2979566 - RNA, 16 nt, Mycobacterium avium subsp. paratuberculosis
ccgcagcaccaccucg

SEQ ID NO: 2979567 - RNA, 17 nt, Mycobacterium avium subsp. paratuberculosis
ccgcagcaccaccucgu

SEQ ID NO: 2979568 - RNA, 12 nt, Mycobacterium avium subsp. paratuberculosis
ccgcagcacgcc

SEQ ID NO: 2979569 - RNA, 13 nt, Mycobacterium avium subsp. paratuberculosis
ccgcagcacgcug

SEQ ID NO: 2979570 - RNA, 15 nt, Mycobacterium avium subsp. paratuberculosis
ccgcagcacgcugaa

SEQ ID NO: 2979571 - RNA, 21 nt, Mycobacterium avium subsp. paratuberculosis
ccgcagcacgcugaagcccac

SEQ ID NO: 2979572 - RNA, 14 nt, Mycobacterium avium subsp. paratuberculosis
ccgcagcagccgcg

SEQ ID NO: 2979573 - RNA, 20 nt, Mycobacterium avium subsp. paratuberculosis
ccgcagcagcgaggccucgc

SEQ ID NO: 2979574 - RNA, 22 nt, Mycobacterium avium subsp. paratuberculosis
ccgcagcagcgaggccucgccg

SEQ ID NO: 2979575 - RNA, 20 nt, Mycobacterium avium subsp. paratuberculosis
ccgcagcaggugcaucgcca

SEQ ID NO: 2979576 - RNA, 21 nt, Mycobacterium avium subsp. paratuberculosis
ccgcagcaggugcaucgccac

SEQ ID NO: 2979577 - RNA, 18 nt, Mycobacterium avium subsp. paratuberculosis
ccgcagcaggugcgccag

SEQ ID NO: 2979578 - RNA, 16 nt, Mycobacterium avium subsp. paratuberculosis
ccgcagccagcgcagc

SEQ ID NO: 2979579 - RNA, 14 nt, Mycobacterium avium subsp. paratuberculosis
ccgcagcccaggcc

SEQ ID NO: 2979580 - RNA, 19 nt, Mycobacterium avium subsp. paratuberculosis
ccgcagcccaggcccagca

SEQ ID NO: 2979581 - RNA, 16 nt, Mycobacterium avium subsp. paratuberculosis
ccgcagcccgaccuuc

SEQ ID NO: 2979582 - RNA, 14 nt, Mycobacterium avium subsp. paratuberculosis
ccgcagcccgucga

SEQ ID NO: 2979583 - RNA, 12 nt, Mycobacterium avium subsp. paratuberculosis
ccgcagccgcga

SEQ ID NO: 2979584 - RNA, 12 nt, Mycobacterium avium subsp. paratuberculosis
ccgcagccgcgc

SEQ ID NO: 2979585 - RNA, 13 nt, Mycobacterium avium subsp. paratuberculosis
ccgcagccgcgcg

SEQ ID NO: 2979586 - RNA, 19 nt, Mycobacterium avium subsp. paratuberculosis
ccgcagccgcgcggccggc

SEQ ID NO: 2979587 - RNA, 20 nt, Mycobacterium avium subsp. paratuberculosis
ccgcagccgcgcggccggcc

SEQ ID NO: 2979588 - RNA, 19 nt, Mycobacterium avium subsp. paratuberculosis
ccgcagccgcuggccgcgc

SEQ ID NO: 2979589 - RNA, 16 nt, Mycobacterium avium subsp. paratuberculosis
ccgcagccggaucacc

SEQ ID NO: 2979590 - RNA, 12 nt, Mycobacterium avium subsp. paratuberculosis
ccgcagccgggu

SEQ ID NO: 2979591 - RNA, 18 nt, Mycobacterium avium subsp. paratuberculosis
ccgcagccgucccaggac

SEQ ID NO: 2979592 - RNA, 18 nt, Mycobacterium avium subsp. paratuberculosis
ccgcagccuucuucgccg

SEQ ID NO: 2979593 - RNA, 16 nt, Mycobacterium avium subsp. paratuberculosis
ccgcagcgaacgcggc

SEQ ID NO: 2979594 - RNA, 18 nt, Mycobacterium avium subsp. paratuberculosis
ccgcagcgaccgcggaug

SEQ ID NO: 2979595 - RNA, 20 nt, Mycobacterium avium subsp. paratuberculosis
ccgcagcgaggcgauggugc

SEQ ID NO: 2979596 - RNA, 18 nt, Mycobacterium avium subsp. paratuberculosis
ccgcagcgcagcgucggc

SEQ ID NO: 2979597 - RNA, 20 nt, Mycobacterium avium subsp. paratuberculosis
ccgcagcgcagcgucggcgu

SEQ ID NO: 2979598 - RNA, 23 nt, Mycobacterium avium subsp. paratuberculosis
ccgcagcgcaucgccggcgaugc

SEQ ID NO: 2979599 - RNA, 21 nt, Mycobacterium avium subsp. paratuberculosis
ccgcagcgcaucguugccggc

SEQ ID NO: 2979600 - RNA, 17 nt, Mycobacterium avium subsp. paratuberculosis
ccgcagcgccagcgcgc

SEQ ID NO: 2979601 - RNA, 13 nt, Mycobacterium avium subsp. paratuberculosis
ccgcagcgcccgg

SEQ ID NO: 2979602 - RNA, 17 nt, Mycobacterium avium subsp. paratuberculosis
ccgcagcgcccggcagc

SEQ ID NO: 2979603 - RNA, 21 nt, Mycobacterium avium subsp. paratuberculosis
ccgcagcgcccggcagcgguc

SEQ ID NO: 2979604 - RNA, 14 nt, Mycobacterium avium subsp. paratuberculosis
ccgcagcgccucgg

SEQ ID NO: 2979605 - RNA, 18 nt, Mycobacterium avium subsp. paratuberculosis
ccgcagcgccucggcgug

SEQ ID NO: 2979606 - RNA, 14 nt, Mycobacterium avium subsp. paratuberculosis
ccgcagcgcgacga

SEQ ID NO: 2979607 - RNA, 20 nt, Mycobacterium avium subsp. paratuberculosis
ccgcagcgcgacgaacagca

SEQ ID NO: 2979608 - RNA, 23 nt, Mycobacterium avium subsp. paratuberculosis
ccgcagcgcgacgaacagcaccg

SEQ ID NO: 2979609 - RNA, 16 nt, Mycobacterium avium subsp. paratuberculosis
ccgcagcgcgcgaccg

SEQ ID NO: 2979610 - RNA, 18 nt, Mycobacterium avium subsp. paratuberculosis
ccgcagcgcgcgaccgcg

SEQ ID NO: 2979611 - RNA, 19 nt, Mycobacterium avium subsp. paratuberculosis
ccgcagcgcgcgcucgguc

SEQ ID NO: 2979612 - RNA, 22 nt, Mycobacterium avium subsp. paratuberculosis
ccgcagcgcgcgcucggucagc

SEQ ID NO: 2979613 - RNA, 12 nt, Mycobacterium avium subsp. paratuberculosis
ccgcagcgcggc

SEQ ID NO: 2979614 - RNA, 19 nt, Mycobacterium avium subsp. paratuberculosis
ccgcagcggcaggucgucg

SEQ ID NO: 2979615 - RNA, 16 nt, Mycobacterium avium subsp. paratuberculosis
ccgcagcggcgccgca

SEQ ID NO: 2979616 - RNA, 18 nt, Mycobacterium avium subsp. paratuberculosis
ccgcagcggcgccgcagc

SEQ ID NO: 2979617 - RNA, 19 nt, Mycobacterium avium subsp. paratuberculosis
ccgcagcggcgccgcagcu

SEQ ID NO: 2979618 - RNA, 13 nt, Mycobacterium avium subsp. paratuberculosis
ccgcagcggcggc

SEQ ID NO: 2979619 - RNA, 21 nt, Mycobacterium avium subsp. paratuberculosis
ccgcagcggcggcacgguugg

SEQ ID NO: 2979620 - RNA, 15 nt, Mycobacterium avium subsp. paratuberculosis
ccgcagcggcggcuc

SEQ ID NO: 2979621 - RNA, 16 nt, Mycobacterium avium subsp. paratuberculosis
ccgcagcggcggcucg

SEQ ID NO: 2979622 - RNA, 18 nt, Mycobacterium avium subsp. paratuberculosis
ccgcagcggcggcucguc

SEQ ID NO: 2979623 - RNA, 14 nt, Mycobacterium avium subsp. paratuberculosis
ccgcagcggcgguu

SEQ ID NO: 2979624 - RNA, 23 nt, Mycobacterium avium subsp. paratuberculosis
ccgcagcggcgguugcucgucgg

SEQ ID NO: 2979625 - RNA, 16 nt, Mycobacterium avium subsp. paratuberculosis
ccgcagcggcuugacc

SEQ ID NO: 2979626 - RNA, 20 nt, Mycobacterium avium subsp. paratuberculosis
ccgcagcgggauuggcgcca

SEQ ID NO: 2979627 - RNA, 23 nt, Mycobacterium avium subsp. paratuberculosis
ccgcagcggggcgcuguccuggu

SEQ ID NO: 2979628 - RNA, 15 nt, Mycobacterium avium subsp. paratuberculosis
ccgcagcggugaucg

SEQ ID NO: 2979629 - RNA, 17 nt, Mycobacterium avium subsp. paratuberculosis
ccgcagcgugggcaccg

SEQ ID NO: 2979630 - RNA, 19 nt, Mycobacterium avium subsp. paratuberculosis
ccgcagcgugggcaccggc

SEQ ID NO: 2979631 - RNA, 22 nt, Mycobacterium avium subsp. paratuberculosis
ccgcagcgugggcaccggcacc

SEQ ID NO: 2979632 - RNA, 23 nt, Mycobacterium avium subsp. paratuberculosis
ccgcagcgugggcaccggcaccg

SEQ ID NO: 2979633 - RNA, 22 nt, Mycobacterium avium subsp. paratuberculosis
ccgcagcuccagcgaguuggcc

SEQ ID NO: 2979634 - RNA, 19 nt, Mycobacterium avium subsp. paratuberculosis
ccgcagcucccccggcgug

SEQ ID NO: 2979635 - RNA, 15 nt, Mycobacterium avium subsp. paratuberculosis
ccgcagcucgaucac

SEQ ID NO: 2979636 - RNA, 16 nt, Mycobacterium avium subsp. paratuberculosis
ccgcagcucgaucacc

SEQ ID NO: 2979637 - RNA, 11 nt, Mycobacterium avium subsp. paratuberculosis
ccgcagcucgc

SEQ ID NO: 2979638 - RNA, 19 nt, Mycobacterium avium subsp. paratuberculosis
ccgcagcucgcccagcacc

SEQ ID NO: 2979639 - RNA, 20 nt, Mycobacterium avium subsp. paratuberculosis
ccgcagcucgcccagcaccg

SEQ ID NO: 2979640 - RNA, 22 nt, Mycobacterium avium subsp. paratuberculosis
ccgcagcucgcccagcaccguc

SEQ ID NO: 2979641 - RNA, 23 nt, Mycobacterium avium subsp. paratuberculosis
ccgcagcucgcccagcaccgucu

SEQ ID NO: 2979642 - RNA, 14 nt, Mycobacterium avium subsp. paratuberculosis
ccgcagcucgccga

SEQ ID NO: 2979643 - RNA, 16 nt, Mycobacterium avium subsp. paratuberculosis
ccgcagcucgccggug

SEQ ID NO: 2979644 - RNA, 17 nt, Mycobacterium avium subsp. paratuberculosis
ccgcagcucgccggugg

SEQ ID NO: 2979645 - RNA, 12 nt, Mycobacterium avium subsp. paratuberculosis
ccgcagcucguu

SEQ ID NO: 2979646 - RNA, 22 nt, Mycobacterium avium subsp. paratuberculosis
ccgcagcugaucggggcccacc

SEQ ID NO: 2979647 - RNA, 18 nt, Mycobacterium avium subsp. paratuberculosis
ccgcagcugcugcggccg

SEQ ID NO: 2979648 - RNA, 20 nt, Mycobacterium avium subsp. paratuberculosis
ccgcagcugcugcggccgga

SEQ ID NO: 2979649 - RNA, 20 nt, Mycobacterium avium subsp. paratuberculosis
ccgcagcuucugcagcucgc

SEQ ID NO: 2979650 - RNA, 21 nt, Mycobacterium avium subsp. paratuberculosis
ccgcagcuucuggucaugaag

SEQ ID NO: 2979651 - RNA, 20 nt, Mycobacterium avium subsp. paratuberculosis
ccgcaggaaaggaaggcgca

SEQ ID NO: 2979652 - RNA, 17 nt, Mycobacterium avium subsp. paratuberculosis
ccgcaggagaucggcgc

SEQ ID NO: 2979653 - RNA, 20 nt, Mycobacterium avium subsp. paratuberculosis
ccgcaggagaucggcgcgga

SEQ ID NO: 2979654 - RNA, 18 nt, Mycobacterium avium subsp. paratuberculosis
ccgcaggaucgagccggc

SEQ ID NO: 2979655 - RNA, 19 nt, Mycobacterium avium subsp. paratuberculosis
ccgcaggaucgagccggcc

SEQ ID NO: 2979656 - RNA, 20 nt, Mycobacterium avium subsp. paratuberculosis
ccgcaggaucgagccggccg

SEQ ID NO: 2979657 - RNA, 21 nt, Mycobacterium avium subsp. paratuberculosis
ccgcaggaucgagccggccgu

SEQ ID NO: 2979658 - RNA, 22 nt, Mycobacterium avium subsp. paratuberculosis
ccgcaggaucgagccggccguc

SEQ ID NO: 2979659 - RNA, 12 nt, Mycobacterium avium subsp. paratuberculosis
ccgcaggccgcg

SEQ ID NO: 2979660 - RNA, 13 nt, Mycobacterium avium subsp. paratuberculosis
ccgcaggccgcga

SEQ ID NO: 2979661 - RNA, 13 nt, Mycobacterium avium subsp. paratuberculosis
ccgcaggccgucg

SEQ ID NO: 2979662 - RNA, 17 nt, Mycobacterium avium subsp. paratuberculosis
ccgcaggccgucgccgg

SEQ ID NO: 2979663 - RNA, 22 nt, Mycobacterium avium subsp. paratuberculosis
ccgcaggcgaacaccucgguga

SEQ ID NO: 2979664 - RNA, 22 nt, Mycobacterium avium subsp. paratuberculosis
ccgcaggcgaaggucagaucgu

SEQ ID NO: 2979665 - RNA, 18 nt, Mycobacterium avium subsp. paratuberculosis
ccgcaggcggccagcacc

SEQ ID NO: 2979666 - RNA, 17 nt, Mycobacterium avium subsp. paratuberculosis
ccgcagggccugcucgc

SEQ ID NO: 2979667 - RNA, 14 nt, Mycobacterium avium subsp. paratuberculosis
ccgcagggcgccgg

SEQ ID NO: 2979668 - RNA, 13 nt, Mycobacterium avium subsp. paratuberculosis
ccgcaggguggcc

SEQ ID NO: 2979669 - RNA, 15 nt, Mycobacterium avium subsp. paratuberculosis
ccgcaggguggccag

SEQ ID NO: 2979670 - RNA, 23 nt, Mycobacterium avium subsp. paratuberculosis
ccgcaggguggccagcaccgcgu

SEQ ID NO: 2979671 - RNA, 16 nt, Mycobacterium avium subsp. paratuberculosis
ccgcaggugcagcucc

SEQ ID NO: 2979672 - RNA, 17 nt, Mycobacterium avium subsp. paratuberculosis
ccgcaggugcagcuccu

SEQ ID NO: 2979673 - RNA, 18 nt, Mycobacterium avium subsp. paratuberculosis
ccgcaggugcagcuccuu

SEQ ID NO: 2979674 - RNA, 17 nt, Mycobacterium avium subsp. paratuberculosis
ccgcaggugcucgccgg

SEQ ID NO: 2979675 - RNA, 18 nt, Mycobacterium avium subsp. paratuberculosis
ccgcaggugcucgccggc

SEQ ID NO: 2979676 - RNA, 20 nt, Mycobacterium avium subsp. paratuberculosis
ccgcaggugcucgccggcgc

SEQ ID NO: 2979677 - RNA, 13 nt, Mycobacterium avium subsp. paratuberculosis
ccgcagguggugg

SEQ ID NO: 2979678 - RNA, 20 nt, Mycobacterium avium subsp. paratuberculosis
ccgcagguggugggcgugca

SEQ ID NO: 2979679 - RNA, 20 nt, Mycobacterium avium subsp. paratuberculosis
ccgcagguucaugugaccgg

SEQ ID NO: 2979680 - RNA, 13 nt, Mycobacterium avium subsp. paratuberculosis
ccgcagucgauca

SEQ ID NO: 2979681 - RNA, 14 nt, Mycobacterium avium subsp. paratuberculosis
ccgcagucgaucac

SEQ ID NO: 2979682 - RNA, 16 nt, Mycobacterium avium subsp. paratuberculosis
ccgcagucgaucaccg

SEQ ID NO: 2979683 - RNA, 17 nt, Mycobacterium avium subsp. paratuberculosis
ccgcagucgaucaccga

SEQ ID NO: 2979684 - RNA, 15 nt, Mycobacterium avium subsp. paratuberculosis
ccgcagucguucggc

SEQ ID NO: 2979685 - RNA, 23 nt, Mycobacterium avium subsp. paratuberculosis
ccgcagucguucggccagcacca

SEQ ID NO: 2979686 - RNA, 15 nt, Mycobacterium avium subsp. paratuberculosis
ccgcagucuuguuga

SEQ ID NO: 2979687 - RNA, 20 nt, Mycobacterium avium subsp. paratuberculosis
ccgcagucuuguugaccuuc

SEQ ID NO: 2979688 - RNA, 23 nt, Mycobacterium avium subsp. paratuberculosis
ccgcagugaaauucgcgccucgg

SEQ ID NO: 2979689 - RNA, 18 nt, Mycobacterium avium subsp. paratuberculosis
ccgcagugccggcgcacc

SEQ ID NO: 2979690 - RNA, 15 nt, Mycobacterium avium subsp. paratuberculosis
ccgcaguucggccgc

SEQ ID NO: 2979691 - RNA, 16 nt, Mycobacterium avium subsp. paratuberculosis
ccgcaguucggccgcc

SEQ ID NO: 2979692 - RNA, 19 nt, Mycobacterium avium subsp. paratuberculosis
ccgcaguucggccgccgug

SEQ ID NO: 2979693 - RNA, 22 nt, Mycobacterium avium subsp. paratuberculosis
ccgcaguucggccgccgugcug

SEQ ID NO: 2979694 - RNA, 20 nt, Mycobacterium avium subsp. paratuberculosis
ccgcauagcgggagccggcc

SEQ ID NO: 2979695 - RNA, 23 nt, Mycobacterium avium subsp. paratuberculosis
ccgcauagcgggagccggccagg

SEQ ID NO: 2979696 - RNA, 23 nt, Mycobacterium avium subsp. paratuberculosis
ccgcauauaggugcugagcgugg

SEQ ID NO: 2979697 - RNA, 18 nt, Mycobacterium avium subsp. paratuberculosis
ccgcaucaacugcaccag

SEQ ID NO: 2979698 - RNA, 20 nt, Mycobacterium avium subsp. paratuberculosis
ccgcaucaacugcaccagcg

SEQ ID NO: 2979699 - RNA, 19 nt, Mycobacterium avium subsp. paratuberculosis
ccgcaucaauuacaacugu

SEQ ID NO: 2979700 - RNA, 21 nt, Mycobacterium avium subsp. paratuberculosis
ccgcaucaccuucugcgcgcc

SEQ ID NO: 2979701 - RNA, 22 nt, Mycobacterium avium subsp. paratuberculosis
ccgcaucaccuucugcgcgccg

SEQ ID NO: 2979702 - RNA, 23 nt, Mycobacterium avium subsp. paratuberculosis
ccgcaucaccuucugcgcgccgu

SEQ ID NO: 2979703 - RNA, 13 nt, Mycobacterium avium subsp. paratuberculosis
ccgcauccagcgc

SEQ ID NO: 2979704 - RNA, 14 nt, Mycobacterium avium subsp. paratuberculosis
ccgcauccagcgcc

SEQ ID NO: 2979705 - RNA, 16 nt, Mycobacterium avium subsp. paratuberculosis
ccgcauccagcgccgc

SEQ ID NO: 2979706 - RNA, 18 nt, Mycobacterium avium subsp. paratuberculosis
ccgcaucccccucggcgg

SEQ ID NO: 2979707 - RNA, 19 nt, Mycobacterium avium subsp. paratuberculosis
ccgcaucccccucggcggg

SEQ ID NO: 2979708 - RNA, 17 nt, Mycobacterium avium subsp. paratuberculosis
ccgcauccgccgggcgg

SEQ ID NO: 2979709 - RNA, 19 nt, Mycobacterium avium subsp. paratuberculosis
ccgcauccgccgggcggcg

SEQ ID NO: 2979710 - RNA, 14 nt, Mycobacterium avium subsp. paratuberculosis
ccgcauccgcgagc

SEQ ID NO: 2979711 - RNA, 16 nt, Mycobacterium avium subsp. paratuberculosis
ccgcauccgcgagccg

SEQ ID NO: 2979712 - RNA, 21 nt, Mycobacterium avium subsp. paratuberculosis
ccgcauccgcgagccgagccg

SEQ ID NO: 2979713 - RNA, 19 nt, Mycobacterium avium subsp. paratuberculosis
ccgcaucgaaccgccgcgc

SEQ ID NO: 2979714 - RNA, 20 nt, Mycobacterium avium subsp. paratuberculosis
ccgcaucgaaccgccgcgcu

SEQ ID NO: 2979715 - RNA, 23 nt, Mycobacterium avium subsp. paratuberculosis
ccgcaucgcacagauacgcgacg

SEQ ID NO: 2979716 - RNA, 17 nt, Mycobacterium avium subsp. paratuberculosis
ccgcaucgccgaaccgg

SEQ ID NO: 2979717 - RNA, 13 nt, Mycobacterium avium subsp. paratuberculosis
ccgcaucgccgag

SEQ ID NO: 2979718 - RNA, 17 nt, Mycobacterium avium subsp. paratuberculosis
ccgcaucgcggcgaugg

SEQ ID NO: 2979719 - RNA, 18 nt, Mycobacterium avium subsp. paratuberculosis
ccgcaugaugcggccaug

SEQ ID NO: 2979720 - RNA, 15 nt, Mycobacterium avium subsp. paratuberculosis
ccgcaugcaccggug

SEQ ID NO: 2979721 - RNA, 18 nt, Mycobacterium avium subsp. paratuberculosis
ccgcaugcaccggugcac

SEQ ID NO: 2979722 - RNA, 14 nt, Mycobacterium avium subsp. paratuberculosis
ccgcaugcccgggc

SEQ ID NO: 2979723 - RNA, 15 nt, Mycobacterium avium subsp. paratuberculosis
ccgcaugcccgggcg

SEQ ID NO: 2979724 - RNA, 16 nt, Mycobacterium avium subsp. paratuberculosis
ccgcaugcccgggcga

SEQ ID NO: 2979725 - RNA, 17 nt, Mycobacterium avium subsp. paratuberculosis
ccgcaugcccgggcgac

SEQ ID NO: 2979726 - RNA, 18 nt, Mycobacterium avium subsp. paratuberculosis
ccgcaugcccgggcgacu

SEQ ID NO: 2979727 - RNA, 17 nt, Mycobacterium avium subsp. paratuberculosis
ccgcaugcccuugucgc

SEQ ID NO: 2979728 - RNA, 24 nt, Mycobacterium avium subsp. paratuberculosis
ccgcaugcugaucuuggcacgggc

SEQ ID NO: 2979729 - RNA, 16 nt, Mycobacterium avium subsp. paratuberculosis
ccgcauguccggggug

SEQ ID NO: 2979730 - RNA, 21 nt, Mycobacterium avium subsp. paratuberculosis
ccgcauguccggggugagcag

SEQ ID NO: 2979731 - RNA, 17 nt, Mycobacterium avium subsp. paratuberculosis
ccgcaugucgaagaagu

SEQ ID NO: 2979732 - RNA, 19 nt, Mycobacterium avium subsp. paratuberculosis
ccgcaugucgaccucggcc

SEQ ID NO: 2979733 - RNA, 17 nt, Mycobacterium avium subsp. paratuberculosis
ccgcauguucucgagcc

SEQ ID NO: 2979734 - RNA, 21 nt, Mycobacterium avium subsp. paratuberculosis
ccgcauguucucgagcccgau

SEQ ID NO: 2979735 - RNA, 23 nt, Mycobacterium avium subsp. paratuberculosis
ccgcauguugugcccgacggcgc

SEQ ID NO: 2979736 - RNA, 21 nt, Mycobacterium avium subsp. paratuberculosis
ccgcauuccgucuuggccagg

SEQ ID NO: 2979737 - RNA, 15 nt, Mycobacterium avium subsp. paratuberculosis
ccgcauucggccgcc

SEQ ID NO: 2979738 - RNA, 19 nt, Mycobacterium avium subsp. paratuberculosis
ccgcauucggccgccaccg

SEQ ID NO: 2979739 - RNA, 14 nt, Mycobacterium avium subsp. paratuberculosis
ccgcauucggugag

SEQ ID NO: 2979740 - RNA, 20 nt, Mycobacterium avium subsp. paratuberculosis
ccgcauuggugccggccucg

SEQ ID NO: 2979741 - RNA, 20 nt, Mycobacterium avium subsp. paratuberculosis
ccgcauuugccgacaugcug

SEQ ID NO: 2979742 - RNA, 21 nt, Mycobacterium avium subsp. paratuberculosis
ccgccaaccaggucgcggcgc

SEQ ID NO: 2979743 - RNA, 19 nt, Mycobacterium avium subsp. paratuberculosis
ccgccaaggggaacaacgc

SEQ ID NO: 2979744 - RNA, 21 nt, Mycobacterium avium subsp. paratuberculosis
ccgccaaggggaacaacgcgc

SEQ ID NO: 2979745 - RNA, 22 nt, Mycobacterium avium subsp. paratuberculosis
ccgccaaggggaacaacgcgca

SEQ ID NO: 2979746 - RNA, 17 nt, Mycobacterium avium subsp. paratuberculosis
ccgccaagugcggugug

SEQ ID NO: 2979747 - RNA, 13 nt, Mycobacterium avium subsp. paratuberculosis
ccgccaaucaccg

SEQ ID NO: 2979748 - RNA, 18 nt, Mycobacterium avium subsp. paratuberculosis
ccgccaaucaccgcggug

SEQ ID NO: 2979749 - RNA, 19 nt, Mycobacterium avium subsp. paratuberculosis
ccgccaaucaccgcggugu

SEQ ID NO: 2979750 - RNA, 23 nt, Mycobacterium avium subsp. paratuberculosis
ccgccacaccucggcgaccucgg

SEQ ID NO: 2979751 - RNA, 12 nt, Mycobacterium avium subsp. paratuberculosis
ccgccacagcgc

SEQ ID NO: 2979752 - RNA, 18 nt, Mycobacterium avium subsp. paratuberculosis
ccgccacagcgccucgcg

SEQ ID NO: 2979753 - RNA, 22 nt, Mycobacterium avium subsp. paratuberculosis
ccgccacagcgccucgcggucg

SEQ ID NO: 2979754 - RNA, 15 nt, Mycobacterium avium subsp. paratuberculosis
ccgccacaucgggau

SEQ ID NO: 2979755 - RNA, 15 nt, Mycobacterium avium subsp. paratuberculosis
ccgccaccacccggc

SEQ ID NO: 2979756 - RNA, 17 nt, Mycobacterium avium subsp. paratuberculosis
ccgccaccacccggcga

SEQ ID NO: 2979757 - RNA, 13 nt, Mycobacterium avium subsp. paratuberculosis
ccgccaccacggc

SEQ ID NO: 2979758 - RNA, 16 nt, Mycobacterium avium subsp. paratuberculosis
ccgccaccacggcagu

SEQ ID NO: 2979759 - RNA, 12 nt, Mycobacterium avium subsp. paratuberculosis
ccgccaccagca

SEQ ID NO: 2979760 - RNA, 13 nt, Mycobacterium avium subsp. paratuberculosis
ccgccaccagcag

SEQ ID NO: 2979761 - RNA, 13 nt, Mycobacterium avium subsp. paratuberculosis
ccgccaccagcgc

SEQ ID NO: 2979762 - RNA, 21 nt, Mycobacterium avium subsp. paratuberculosis
ccgccaccaggccgugguugg

SEQ ID NO: 2979763 - RNA, 16 nt, Mycobacterium avium subsp. paratuberculosis
ccgccacccgaggccg

SEQ ID NO: 2979764 - RNA, 13 nt, Mycobacterium avium subsp. paratuberculosis
ccgccacccgcug

SEQ ID NO: 2979765 - RNA, 23 nt, Mycobacterium avium subsp. paratuberculosis
ccgccacccgcugcucgaccucg

SEQ ID NO: 2979766 - RNA, 14 nt, Mycobacterium avium subsp. paratuberculosis
ccgccaccgcccgc

SEQ ID NO: 2979767 - RNA, 16 nt, Mycobacterium avium subsp. paratuberculosis
ccgccaccgcccgcug

SEQ ID NO: 2979768 - RNA, 14 nt, Mycobacterium avium subsp. paratuberculosis
ccgccaccgcgaaa

SEQ ID NO: 2979769 - RNA, 21 nt, Mycobacterium avium subsp. paratuberculosis
ccgccaccgcgaaagcgucgg

SEQ ID NO: 2979770 - RNA, 12 nt, Mycobacterium avium subsp. paratuberculosis
ccgccaccggcc

SEQ ID NO: 2979771 - RNA, 14 nt, Mycobacterium avium subsp. paratuberculosis
ccgccaccggcccg

SEQ ID NO: 2979772 - RNA, 22 nt, Mycobacterium avium subsp. paratuberculosis
ccgccaccggcccggccggcgc

SEQ ID NO: 2979773 - RNA, 13 nt, Mycobacterium avium subsp. paratuberculosis
ccgccaccggccg

SEQ ID NO: 2979774 - RNA, 12 nt, Mycobacterium avium subsp. paratuberculosis
ccgccaccgucg

SEQ ID NO: 2979775 - RNA, 17 nt, Mycobacterium avium subsp. paratuberculosis
ccgccaccgucgccggc

SEQ ID NO: 2979776 - RNA, 19 nt, Mycobacterium avium subsp. paratuberculosis
ccgccaccgucgccggcug

SEQ ID NO: 2979777 - RNA, 18 nt, Mycobacterium avium subsp. paratuberculosis
ccgccacgacgcggcgau

SEQ ID NO: 2979778 - RNA, 17 nt, Mycobacterium avium subsp. paratuberculosis
ccgccacgccguugggc

SEQ ID NO: 2979779 - RNA, 14 nt, Mycobacterium avium subsp. paratuberculosis
ccgccacgcggcgc

SEQ ID NO: 2979780 - RNA, 14 nt, Mycobacterium avium subsp. paratuberculosis
ccgccacggccacc

SEQ ID NO: 2979781 - RNA, 16 nt, Mycobacterium avium subsp. paratuberculosis
ccgccacggccagcac

SEQ ID NO: 2979782 - RNA, 17 nt, Mycobacterium avium subsp. paratuberculosis
ccgccacggccagcacc

SEQ ID NO: 2979783 - RNA, 19 nt, Mycobacterium avium subsp. paratuberculosis
ccgccacggccagcaccgc

SEQ ID NO: 2979784 - RNA, 23 nt, Mycobacterium avium subsp. paratuberculosis
ccgccacggccagcaccgccagc

SEQ ID NO: 2979785 - RNA, 14 nt, Mycobacterium avium subsp. paratuberculosis
ccgccacggcgacg

SEQ ID NO: 2979786 - RNA, 18 nt, Mycobacterium avium subsp. paratuberculosis
ccgccacggcgacgacca

SEQ ID NO: 2979787 - RNA, 22 nt, Mycobacterium avium subsp. paratuberculosis
ccgccacggcgacgaccaccag

SEQ ID NO: 2979788 - RNA, 23 nt, Mycobacterium avium subsp. paratuberculosis
ccgccacggcgccaugcgccgcg

SEQ ID NO: 2979789 - RNA, 12 nt, Mycobacterium avium subsp. paratuberculosis
ccgccacggcgg

SEQ ID NO: 2979790 - RNA, 18 nt, Mycobacterium avium subsp. paratuberculosis
ccgccacggggcccgcga

SEQ ID NO: 2979791 - RNA, 22 nt, Mycobacterium avium subsp. paratuberculosis
ccgccacgucgaacccgacccc

SEQ ID NO: 2979792 - RNA, 13 nt, Mycobacterium avium subsp. paratuberculosis
ccgccacgugcgg

SEQ ID NO: 2979793 - RNA, 17 nt, Mycobacterium avium subsp. paratuberculosis
ccgccacgugcggcugc

SEQ ID NO: 2979794 - RNA, 22 nt, Mycobacterium avium subsp. paratuberculosis
ccgccacgugcggcugcgcguu

SEQ ID NO: 2979795 - RNA, 14 nt, Mycobacterium avium subsp. paratuberculosis
ccgccagaacgggu

SEQ ID NO: 2979796 - RNA, 23 nt, Mycobacterium avium subsp. paratuberculosis
ccgccagauagggcagcgucccg

SEQ ID NO: 2979797 - RNA, 13 nt, Mycobacterium avium subsp. paratuberculosis
ccgccagaucgcc

SEQ ID NO: 2979798 - RNA, 16 nt, Mycobacterium avium subsp. paratuberculosis
ccgccagaucgccauc

SEQ ID NO: 2979799 - RNA, 17 nt, Mycobacterium avium subsp. paratuberculosis
ccgccagaucgccauca

SEQ ID NO: 2979800 - RNA, 17 nt, Mycobacterium avium subsp. paratuberculosis
ccgccagaucgccuggc

SEQ ID NO: 2979801 - RNA, 18 nt, Mycobacterium avium subsp. paratuberculosis
ccgccagcaaccccgcgg

SEQ ID NO: 2979802 - RNA, 11 nt, Mycobacterium avium subsp. paratuberculosis
ccgccagcacc

SEQ ID NO: 2979803 - RNA, 22 nt, Mycobacterium avium subsp. paratuberculosis
ccgccagcaccaccgucaccgc

SEQ ID NO: 2979804 - RNA, 12 nt, Mycobacterium avium subsp. paratuberculosis
ccgccagcaccg

SEQ ID NO: 2979805 - RNA, 15 nt, Mycobacterium avium subsp. paratuberculosis
ccgccagcaccgaca

SEQ ID NO: 2979806 - RNA, 16 nt, Mycobacterium avium subsp. paratuberculosis
ccgccagcaccgacag

SEQ ID NO: 2979807 - RNA, 18 nt, Mycobacterium avium subsp. paratuberculosis
ccgccagcaccgacaguc

SEQ ID NO: 2979808 - RNA, 13 nt, Mycobacterium avium subsp. paratuberculosis
ccgccagcaccgc

SEQ ID NO: 2979809 - RNA, 15 nt, Mycobacterium avium subsp. paratuberculosis
ccgccagcaccgcca

SEQ ID NO: 2979810 - RNA, 18 nt, Mycobacterium avium subsp. paratuberculosis
ccgccagcaccgccaccg

SEQ ID NO: 2979811 - RNA, 14 nt, Mycobacterium avium subsp. paratuberculosis
ccgccagcaccgcg

SEQ ID NO: 2979812 - RNA, 12 nt, Mycobacterium avium subsp. paratuberculosis
ccgccagcaccu

SEQ ID NO: 2979813 - RNA, 20 nt, Mycobacterium avium subsp. paratuberculosis
ccgccagcagaugccgccca

SEQ ID NO: 2979814 - RNA, 12 nt, Mycobacterium avium subsp. paratuberculosis
ccgccagcagca

SEQ ID NO: 2979815 - RNA, 18 nt, Mycobacterium avium subsp. paratuberculosis
ccgccagcagcacggcaa

SEQ ID NO: 2979816 - RNA, 23 nt, Mycobacterium avium subsp. paratuberculosis
ccgccagcagcagccgcgccgcc

SEQ ID NO: 2979817 - RNA, 24 nt, Mycobacterium avium subsp. paratuberculosis
ccgccagcagcagcgccgccaccg

SEQ ID NO: 2979818 - RNA, 14 nt, Mycobacterium avium subsp. paratuberculosis
ccgccagccaccac

SEQ ID NO: 2979819 - RNA, 18 nt, Mycobacterium avium subsp. paratuberculosis
ccgccagccagccggugc

SEQ ID NO: 2979820 - RNA, 12 nt, Mycobacterium avium subsp. paratuberculosis
ccgccagccgca

SEQ ID NO: 2979821 - RNA, 17 nt, Mycobacterium avium subsp. paratuberculosis
ccgccagccgcagcagg

SEQ ID NO: 2979822 - RNA, 15 nt, Mycobacterium avium subsp. paratuberculosis
ccgccagccgcgucu

SEQ ID NO: 2979823 - RNA, 16 nt, Mycobacterium avium subsp. paratuberculosis
ccgccagccggucauc

SEQ ID NO: 2979824 - RNA, 17 nt, Mycobacterium avium subsp. paratuberculosis
ccgccagccggucaucg

SEQ ID NO: 2979825 - RNA, 14 nt, Mycobacterium avium subsp. paratuberculosis
ccgccagcgcaccg

SEQ ID NO: 2979826 - RNA, 16 nt, Mycobacterium avium subsp. paratuberculosis
ccgccagcgcaccgag

SEQ ID NO: 2979827 - RNA, 18 nt, Mycobacterium avium subsp. paratuberculosis
ccgccagcgcaccgagcc

SEQ ID NO: 2979828 - RNA, 23 nt, Mycobacterium avium subsp. paratuberculosis
ccgccagcgcaccgagcccguuc

SEQ ID NO: 2979829 - RNA, 15 nt, Mycobacterium avium subsp. paratuberculosis
ccgccagcgccaccc

SEQ ID NO: 2979830 - RNA, 16 nt, Mycobacterium avium subsp. paratuberculosis
ccgccagcgcccgcgc

SEQ ID NO: 2979831 - RNA, 14 nt, Mycobacterium avium subsp. paratuberculosis
ccgccagcgccggc

SEQ ID NO: 2979832 - RNA, 16 nt, Mycobacterium avium subsp. paratuberculosis
ccgccagcgccggcag

SEQ ID NO: 2979833 - RNA, 14 nt, Mycobacterium avium subsp. paratuberculosis
ccgccagcgcggcg

SEQ ID NO: 2979834 - RNA, 15 nt, Mycobacterium avium subsp. paratuberculosis
ccgccagcgcggcgg

SEQ ID NO: 2979835 - RNA, 16 nt, Mycobacterium avium subsp. paratuberculosis
ccgccagcgcggcggc

SEQ ID NO: 2979836 - RNA, 19 nt, Mycobacterium avium subsp. paratuberculosis
ccgccagcgcggcggcgcc

SEQ ID NO: 2979837 - RNA, 21 nt, Mycobacterium avium subsp. paratuberculosis
ccgccagcgucccguccuggg

SEQ ID NO: 2979838 - RNA, 19 nt, Mycobacterium avium subsp. paratuberculosis
ccgccagcucguccagcgu

SEQ ID NO: 2979839 - RNA, 17 nt, Mycobacterium avium subsp. paratuberculosis
ccgccaggaaggccagu

SEQ ID NO: 2979840 - RNA, 21 nt, Mycobacterium avium subsp. paratuberculosis
ccgccaggaauaacgccggcc

SEQ ID NO: 2979841 - RNA, 17 nt, Mycobacterium avium subsp. paratuberculosis
ccgccaggaccacccac

SEQ ID NO: 2979842 - RNA, 19 nt, Mycobacterium avium subsp. paratuberculosis
ccgccaggaugucguccuc

SEQ ID NO: 2979843 - RNA, 17 nt, Mycobacterium avium subsp. paratuberculosis
ccgccaggcuggccagg

SEQ ID NO: 2979844 - RNA, 20 nt, Mycobacterium avium subsp. paratuberculosis
ccgccaggcuggccaggcug

SEQ ID NO: 2979845 - RNA, 13 nt, Mycobacterium avium subsp. paratuberculosis
ccgccagggccag

SEQ ID NO: 2979846 - RNA, 14 nt, Mycobacterium avium subsp. paratuberculosis
ccgccagggcgacg

SEQ ID NO: 2979847 - RNA, 20 nt, Mycobacterium avium subsp. paratuberculosis
ccgccagggcgacgccgcgg

SEQ ID NO: 2979848 - RNA, 19 nt, Mycobacterium avium subsp. paratuberculosis
ccgccagggcgcggcgcac

SEQ ID NO: 2979849 - RNA, 21 nt, Mycobacterium avium subsp. paratuberculosis
ccgccagggcgcggcgcaccg

SEQ ID NO: 2979850 - RNA, 22 nt, Mycobacterium avium subsp. paratuberculosis
ccgccagggcgcggcgcaccga

SEQ ID NO: 2979851 - RNA, 17 nt, Mycobacterium avium subsp. paratuberculosis
ccgccagggucucgggc

SEQ ID NO: 2979852 - RNA, 19 nt, Mycobacterium avium subsp. paratuberculosis
ccgccagggucucgggcag

SEQ ID NO: 2979853 - RNA, 17 nt, Mycobacterium avium subsp. paratuberculosis
ccgccagggugccgcug

SEQ ID NO: 2979854 - RNA, 18 nt, Mycobacterium avium subsp. paratuberculosis
ccgccagggugccgcugc

SEQ ID NO: 2979855 - RNA, 15 nt, Mycobacterium avium subsp. paratuberculosis
ccgccaggucggggc

SEQ ID NO: 2979856 - RNA, 14 nt, Mycobacterium avium subsp. paratuberculosis
ccgccagguuggcg

SEQ ID NO: 2979857 - RNA, 19 nt, Mycobacterium avium subsp. paratuberculosis
ccgccagguuggcggcggc

SEQ ID NO: 2979858 - RNA, 21 nt, Mycobacterium avium subsp. paratuberculosis
ccgccagguuggcggcggccc

SEQ ID NO: 2979859 - RNA, 23 nt, Mycobacterium avium subsp. paratuberculosis
ccgccagguuggcggcggcccgc

SEQ ID NO: 2979860 - RNA, 22 nt, Mycobacterium avium subsp. paratuberculosis
ccgccagucugagcccgggcag

SEQ ID NO: 2979861 - RNA, 16 nt, Mycobacterium avium subsp. paratuberculosis
ccgccaguuguuggcc

SEQ ID NO: 2979862 - RNA, 20 nt, Mycobacterium avium subsp. paratuberculosis
ccgccaguuguuggccgggc

SEQ ID NO: 2979863 - RNA, 15 nt, Mycobacterium avium subsp. paratuberculosis
ccgccaucaccgcgc

SEQ ID NO: 2979864 - RNA, 16 nt, Mycobacterium avium subsp. paratuberculosis
ccgccaucaccgcgcu

SEQ ID NO: 2979865 - RNA, 17 nt, Mycobacterium avium subsp. paratuberculosis
ccgccaucaccgcgcuu

SEQ ID NO: 2979866 - RNA, 18 nt, Mycobacterium avium subsp. paratuberculosis
ccgccaucgaucgggcgu

SEQ ID NO: 2979867 - RNA, 16 nt, Mycobacterium avium subsp. paratuberculosis
ccgccaucgcccggug

SEQ ID NO: 2979868 - RNA, 14 nt, Mycobacterium avium subsp. paratuberculosis
ccgccaucgccgcc

SEQ ID NO: 2979869 - RNA, 15 nt, Mycobacterium avium subsp. paratuberculosis
ccgccaucgccgccg

SEQ ID NO: 2979870 - RNA, 20 nt, Mycobacterium avium subsp. paratuberculosis
ccgccaucgccgccgccauc

SEQ ID NO: 2979871 - RNA, 15 nt, Mycobacterium avium subsp. paratuberculosis
ccgccaucgccucgu

SEQ ID NO: 2979872 - RNA, 14 nt, Mycobacterium avium subsp. paratuberculosis
ccgccaucgcggcg

SEQ ID NO: 2979873 - RNA, 19 nt, Mycobacterium avium subsp. paratuberculosis
ccgccaucgcggcguugug

SEQ ID NO: 2979874 - RNA, 18 nt, Mycobacterium avium subsp. paratuberculosis
ccgccaucuccuccgggc

SEQ ID NO: 2979875 - RNA, 19 nt, Mycobacterium avium subsp. paratuberculosis
ccgccaucuccuccgggcu

SEQ ID NO: 2979876 - RNA, 20 nt, Mycobacterium avium subsp. paratuberculosis
ccgccaucuccuccgggcug

SEQ ID NO: 2979877 - RNA, 16 nt, Mycobacterium avium subsp. paratuberculosis
ccgccauggcggcauc

SEQ ID NO: 2979878 - RNA, 17 nt, Mycobacterium avium subsp. paratuberculosis
ccgccauggcggcaucc

SEQ ID NO: 2979879 - RNA, 22 nt, Mycobacterium avium subsp. paratuberculosis
ccgccauggcggcauccccagc

SEQ ID NO: 2979880 - RNA, 20 nt, Mycobacterium avium subsp. paratuberculosis
ccgccauguacagaccccac

SEQ ID NO: 2979881 - RNA, 16 nt, Mycobacterium avium subsp. paratuberculosis
ccgcccaacgacgucg

SEQ ID NO: 2979882 - RNA, 17 nt, Mycobacterium avium subsp. paratuberculosis
ccgcccaacgacgucgg

SEQ ID NO: 2979883 - RNA, 20 nt, Mycobacterium avium subsp. paratuberculosis
ccgcccaacgacgucggcgu

SEQ ID NO: 2979884 - RNA, 20 nt, Mycobacterium avium subsp. paratuberculosis
ccgcccacaccgacaccggc

SEQ ID NO: 2979885 - RNA, 21 nt, Mycobacterium avium subsp. paratuberculosis
ccgcccacaccgacaccggcc

SEQ ID NO: 2979886 - RNA, 22 nt, Mycobacterium avium subsp. paratuberculosis
ccgcccacaccgacaccggccg

SEQ ID NO: 2979887 - RNA, 19 nt, Mycobacterium avium subsp. paratuberculosis
ccgcccacauacaccggga

SEQ ID NO: 2979888 - RNA, 12 nt, Mycobacterium avium subsp. paratuberculosis
ccgcccaccacc

SEQ ID NO: 2979889 - RNA, 23 nt, Mycobacterium avium subsp. paratuberculosis
ccgcccaccuucccaaccccggg

SEQ ID NO: 2979890 - RNA, 14 nt, Mycobacterium avium subsp. paratuberculosis
ccgcccacgccgcc

SEQ ID NO: 2979891 - RNA, 17 nt, Mycobacterium avium subsp. paratuberculosis
ccgcccacgccgcccag

SEQ ID NO: 2979892 - RNA, 15 nt, Mycobacterium avium subsp. paratuberculosis
ccgcccacgggucgc

SEQ ID NO: 2979893 - RNA, 15 nt, Mycobacterium avium subsp. paratuberculosis
ccgcccacguucagc

SEQ ID NO: 2979894 - RNA, 14 nt, Mycobacterium avium subsp. paratuberculosis
ccgcccagacgcgg

SEQ ID NO: 2979895 - RNA, 15 nt, Mycobacterium avium subsp. paratuberculosis
ccgcccagacgcggg

SEQ ID NO: 2979896 - RNA, 16 nt, Mycobacterium avium subsp. paratuberculosis
ccgcccagcagcgggc

SEQ ID NO: 2979897 - RNA, 21 nt, Mycobacterium avium subsp. paratuberculosis
ccgcccagcagcgggcccggg

SEQ ID NO: 2979898 - RNA, 19 nt, Mycobacterium avium subsp. paratuberculosis
ccgcccagcaucgccgcga

SEQ ID NO: 2979899 - RNA, 15 nt, Mycobacterium avium subsp. paratuberculosis
ccgcccagcccgcgc

SEQ ID NO: 2979900 - RNA, 23 nt, Mycobacterium avium subsp. paratuberculosis
ccgcccagcgacucggccaggau

SEQ ID NO: 2979901 - RNA, 13 nt, Mycobacterium avium subsp. paratuberculosis
ccgcccagcgcag

SEQ ID NO: 2979902 - RNA, 14 nt, Mycobacterium avium subsp. paratuberculosis
ccgcccagcgcagc

SEQ ID NO: 2979903 - RNA, 17 nt, Mycobacterium avium subsp. paratuberculosis
ccgcccagcgccacggu

SEQ ID NO: 2979904 - RNA, 12 nt, Mycobacterium avium subsp. paratuberculosis
ccgcccagcggc

SEQ ID NO: 2979905 - RNA, 16 nt, Mycobacterium avium subsp. paratuberculosis
ccgcccagcggccccg

SEQ ID NO: 2979906 - RNA, 12 nt, Mycobacterium avium subsp. paratuberculosis
ccgcccagcggu

SEQ ID NO: 2979907 - RNA, 23 nt, Mycobacterium avium subsp. paratuberculosis
ccgcccagcggugaauugggcga

SEQ ID NO: 2979908 - RNA, 15 nt, Mycobacterium avium subsp. paratuberculosis
ccgcccaggacccgu

SEQ ID NO: 2979909 - RNA, 19 nt, Mycobacterium avium subsp. paratuberculosis
ccgcccaggccccggccga

SEQ ID NO: 2979910 - RNA, 12 nt, Mycobacterium avium subsp. paratuberculosis
ccgcccaggccg

SEQ ID NO: 2979911 - RNA, 18 nt, Mycobacterium avium subsp. paratuberculosis
ccgcccaggccgagcgca

SEQ ID NO: 2979912 - RNA, 14 nt, Mycobacterium avium subsp. paratuberculosis
ccgcccaggccgcc

SEQ ID NO: 2979913 - RNA, 15 nt, Mycobacterium avium subsp. paratuberculosis
ccgcccaggccgcca

SEQ ID NO: 2979914 - RNA, 17 nt, Mycobacterium avium subsp. paratuberculosis
ccgcccaggccgccagc

SEQ ID NO: 2979915 - RNA, 16 nt, Mycobacterium avium subsp. paratuberculosis
ccgcccaggcgggcca

SEQ ID NO: 2979916 - RNA, 19 nt, Mycobacterium avium subsp. paratuberculosis
ccgcccaggcgggccagcu

SEQ ID NO: 2979917 - RNA, 15 nt, Mycobacterium avium subsp. paratuberculosis
ccgcccagucgccgc

SEQ ID NO: 2979918 - RNA, 16 nt, Mycobacterium avium subsp. paratuberculosis
ccgcccagucgccgcc

SEQ ID NO: 2979919 - RNA, 21 nt, Mycobacterium avium subsp. paratuberculosis
ccgcccaguugcacgguguag

SEQ ID NO: 2979920 - RNA, 13 nt, Mycobacterium avium subsp. paratuberculosis
ccgcccaucaccc

SEQ ID NO: 2979921 - RNA, 18 nt, Mycobacterium avium subsp. paratuberculosis
ccgcccaucaccccgaag

SEQ ID NO: 2979922 - RNA, 22 nt, Mycobacterium avium subsp. paratuberculosis
ccgcccaucaccccgaagcuca

SEQ ID NO: 2979923 - RNA, 21 nt, Mycobacterium avium subsp. paratuberculosis
ccgcccaucagcaggaccagg

SEQ ID NO: 2979924 - RNA, 14 nt, Mycobacterium avium subsp. paratuberculosis
ccgcccaucgaccg

SEQ ID NO: 2979925 - RNA, 15 nt, Mycobacterium avium subsp. paratuberculosis
ccgcccaucgaccgg

SEQ ID NO: 2979926 - RNA, 23 nt, Mycobacterium avium subsp. paratuberculosis
ccgcccaugcccaugucgaucgg

SEQ ID NO: 2979927 - RNA, 12 nt, Mycobacterium avium subsp. paratuberculosis
ccgccccagccg

SEQ ID NO: 2979928 - RNA, 12 nt, Mycobacterium avium subsp. paratuberculosis
ccgcccccgccc

SEQ ID NO: 2979929 - RNA, 15 nt, Mycobacterium avium subsp. paratuberculosis
ccgcccccgccgcga

SEQ ID NO: 2979930 - RNA, 13 nt, Mycobacterium avium subsp. paratuberculosis
ccgcccccgcggc

SEQ ID NO: 2979931 - RNA, 14 nt, Mycobacterium avium subsp. paratuberculosis
ccgcccccgcggcg

SEQ ID NO: 2979932 - RNA, 16 nt, Mycobacterium avium subsp. paratuberculosis
ccgcccccgcggcggc

SEQ ID NO: 2979933 - RNA, 17 nt, Mycobacterium avium subsp. paratuberculosis
ccgcccccgcggcgucc

SEQ ID NO: 2979934 - RNA, 13 nt, Mycobacterium avium subsp. paratuberculosis
ccgccccgacgau

SEQ ID NO: 2979935 - RNA, 14 nt, Mycobacterium avium subsp. paratuberculosis
ccgccccgacgauc

SEQ ID NO: 2979936 - RNA, 17 nt, Mycobacterium avium subsp. paratuberculosis
ccgccccgacgaucgcg

SEQ ID NO: 2979937 - RNA, 20 nt, Mycobacterium avium subsp. paratuberculosis
ccgccccgacgugcagcgcc

SEQ ID NO: 2979938 - RNA, 23 nt, Mycobacterium avium subsp. paratuberculosis
ccgccccgacgugcagcgccagc

SEQ ID NO: 2979939 - RNA, 14 nt, Mycobacterium avium subsp. paratuberculosis
ccgccccgaugcgc

SEQ ID NO: 2979940 - RNA, 17 nt, Mycobacterium avium subsp. paratuberculosis
ccgccccgcaaccguuc

SEQ ID NO: 2979941 - RNA, 17 nt, Mycobacterium avium subsp. paratuberculosis
ccgccccgcccggcggc

SEQ ID NO: 2979942 - RNA, 12 nt, Mycobacterium avium subsp. paratuberculosis
ccgccccgccgc

SEQ ID NO: 2979943 - RNA, 15 nt, Mycobacterium avium subsp. paratuberculosis
ccgccccgccgcgcc

SEQ ID NO: 2979944 - RNA, 23 nt, Mycobacterium avium subsp. paratuberculosis
ccgccccgccgcgccgggcgccc

SEQ ID NO: 2979945 - RNA, 21 nt, Mycobacterium avium subsp. paratuberculosis
ccgccccgcugccggaccucg

SEQ ID NO: 2979946 - RNA, 13 nt, Mycobacterium avium subsp. paratuberculosis
ccgccccggccgc

SEQ ID NO: 2979947 - RNA, 14 nt, Mycobacterium avium subsp. paratuberculosis
ccgccccggccgcg

SEQ ID NO: 2979948 - RNA, 14 nt, Mycobacterium avium subsp. paratuberculosis
ccgccccuccaggc

SEQ ID NO: 2979949 - RNA, 13 nt, Mycobacterium avium subsp. paratuberculosis
ccgccccuguggu

SEQ ID NO: 2979950 - RNA, 15 nt, Mycobacterium avium subsp. paratuberculosis
ccgcccgaaccgcgu

SEQ ID NO: 2979951 - RNA, 19 nt, Mycobacterium avium subsp. paratuberculosis
ccgcccgagaguccgccgc

SEQ ID NO: 2979952 - RNA, 22 nt, Mycobacterium avium subsp. paratuberculosis
ccgcccgagcgucauuccgccg

SEQ ID NO: 2979953 - RNA, 21 nt, Mycobacterium avium subsp. paratuberculosis
ccgcccgaucccgucgucggc

SEQ ID NO: 2979954 - RNA, 15 nt, Mycobacterium avium subsp. paratuberculosis
ccgcccgcaccagca

SEQ ID NO: 2979955 - RNA, 16 nt, Mycobacterium avium subsp. paratuberculosis
ccgcccgcagcggcgg

SEQ ID NO: 2979956 - RNA, 22 nt, Mycobacterium avium subsp. paratuberculosis
ccgcccgccgggcacccgggug

SEQ ID NO: 2979957 - RNA, 16 nt, Mycobacterium avium subsp. paratuberculosis
ccgcccgccgguggcc

SEQ ID NO: 2979958 - RNA, 12 nt, Mycobacterium avium subsp. paratuberculosis
ccgcccgcgacu

SEQ ID NO: 2979959 - RNA, 13 nt, Mycobacterium avium subsp. paratuberculosis
ccgcccgcgacug

SEQ ID NO: 2979960 - RNA, 20 nt, Mycobacterium avium subsp. paratuberculosis
ccgcccgcgacugucggcuc

SEQ ID NO: 2979961 - RNA, 14 nt, Mycobacterium avium subsp. paratuberculosis
ccgcccgcgcggcg

SEQ ID NO: 2979962 - RNA, 17 nt, Mycobacterium avium subsp. paratuberculosis
ccgcccgcgcggcggcc

SEQ ID NO: 2979963 - RNA, 19 nt, Mycobacterium avium subsp. paratuberculosis
ccgcccgcgcggcggccaa

SEQ ID NO: 2979964 - RNA, 15 nt, Mycobacterium avium subsp. paratuberculosis
ccgcccgcgcguggu

SEQ ID NO: 2979965 - RNA, 17 nt, Mycobacterium avium subsp. paratuberculosis
ccgcccgcuccugcagg

SEQ ID NO: 2979966 - RNA, 17 nt, Mycobacterium avium subsp. paratuberculosis
ccgcccgcucgacggcc

SEQ ID NO: 2979967 - RNA, 14 nt, Mycobacterium avium subsp. paratuberculosis
ccgcccgcugaccg

SEQ ID NO: 2979968 - RNA, 20 nt, Mycobacterium avium subsp. paratuberculosis
ccgcccgcuggggcgcaccg

SEQ ID NO: 2979969 - RNA, 22 nt, Mycobacterium avium subsp. paratuberculosis
ccgcccgcuggggcgcaccgcc

SEQ ID NO: 2979970 - RNA, 16 nt, Mycobacterium avium subsp. paratuberculosis
ccgcccggacaccccg

SEQ ID NO: 2979971 - RNA, 16 nt, Mycobacterium avium subsp. paratuberculosis
ccgcccggaccgcggu

SEQ ID NO: 2979972 - RNA, 19 nt, Mycobacterium avium subsp. paratuberculosis
ccgcccggaccgcggucgg

SEQ ID NO: 2979973 - RNA, 15 nt, Mycobacterium avium subsp. paratuberculosis
ccgcccggaccggcu

SEQ ID NO: 2979974 - RNA, 16 nt, Mycobacterium avium subsp. paratuberculosis
ccgcccggaccggcuc

SEQ ID NO: 2979975 - RNA, 16 nt, Mycobacterium avium subsp. paratuberculosis
ccgcccggagaacucc

SEQ ID NO: 2979976 - RNA, 17 nt, Mycobacterium avium subsp. paratuberculosis
ccgcccggaucagcuga

SEQ ID NO: 2979977 - RNA, 18 nt, Mycobacterium avium subsp. paratuberculosis
ccgcccggaucagcugac

SEQ ID NO: 2979978 - RNA, 14 nt, Mycobacterium avium subsp. paratuberculosis
ccgcccggaugccg

SEQ ID NO: 2979979 - RNA, 18 nt, Mycobacterium avium subsp. paratuberculosis
ccgcccggaugccggcgc

SEQ ID NO: 2979980 - RNA, 19 nt, Mycobacterium avium subsp. paratuberculosis
ccgcccggaugccggcgcc

SEQ ID NO: 2979981 - RNA, 12 nt, Mycobacterium avium subsp. paratuberculosis
ccgcccggcccg

SEQ ID NO: 2979982 - RNA, 13 nt, Mycobacterium avium subsp. paratuberculosis
ccgcccggcccgg

SEQ ID NO: 2979983 - RNA, 14 nt, Mycobacterium avium subsp. paratuberculosis
ccgcccggcccggc

SEQ ID NO: 2979984 - RNA, 15 nt, Mycobacterium avium subsp. paratuberculosis
ccgcccggcccggcg

SEQ ID NO: 2979985 - RNA, 20 nt, Mycobacterium avium subsp. paratuberculosis
ccgcccggcccggcgcggcc

SEQ ID NO: 2979986 - RNA, 12 nt, Mycobacterium avium subsp. paratuberculosis
ccgcccggccgg

SEQ ID NO: 2979987 - RNA, 17 nt, Mycobacterium avium subsp. paratuberculosis
ccgcccggccggucgcc

SEQ ID NO: 2979988 - RNA, 12 nt, Mycobacterium avium subsp. paratuberculosis
ccgcccggcgag

SEQ ID NO: 2979989 - RNA, 13 nt, Mycobacterium avium subsp. paratuberculosis
ccgcccggcgaua

SEQ ID NO: 2979990 - RNA, 21 nt, Mycobacterium avium subsp. paratuberculosis
ccgcccggcgauacccgggag

SEQ ID NO: 2979991 - RNA, 23 nt, Mycobacterium avium subsp. paratuberculosis
ccgcccggcgauacccgggagca

SEQ ID NO: 2979992 - RNA, 12 nt, Mycobacterium avium subsp. paratuberculosis
ccgcccggcgcc

SEQ ID NO: 2979993 - RNA, 16 nt, Mycobacterium avium subsp. paratuberculosis
ccgcccggcgccccgc

SEQ ID NO: 2979994 - RNA, 14 nt, Mycobacterium avium subsp. paratuberculosis
ccgcccggcgccgg

SEQ ID NO: 2979995 - RNA, 15 nt, Mycobacterium avium subsp. paratuberculosis
ccgcccggcgccggc

SEQ ID NO: 2979996 - RNA, 16 nt, Mycobacterium avium subsp. paratuberculosis
ccgcccggcgccggcc

SEQ ID NO: 2979997 - RNA, 20 nt, Mycobacterium avium subsp. paratuberculosis
ccgcccggcgccggccgaca

SEQ ID NO: 2979998 - RNA, 16 nt, Mycobacterium avium subsp. paratuberculosis
ccgcccggcgcgcagc

SEQ ID NO: 2979999 - RNA, 16 nt, Mycobacterium avium subsp. paratuberculosis
ccgcccggcggccacc

SEQ ID NO: 2980000 - RNA, 16 nt, Mycobacterium avium subsp. paratuberculosis
ccgcccggcggcgcug

SEQ ID NO: 2980001 - RNA, 17 nt, Mycobacterium avium subsp. paratuberculosis
ccgcccggcggcgcugc

SEQ ID NO: 2980002 - RNA, 21 nt, Mycobacterium avium subsp. paratuberculosis
ccgcccgggaaaauuuccugg

SEQ ID NO: 2980003 - RNA, 13 nt, Mycobacterium avium subsp. paratuberculosis
ccgcccgggaagc

SEQ ID NO: 2980004 - RNA, 12 nt, Mycobacterium avium subsp. paratuberculosis
ccgcccgggcac

SEQ ID NO: 2980005 - RNA, 18 nt, Mycobacterium avium subsp. paratuberculosis
ccgcccgggcacgacggu

SEQ ID NO: 2980006 - RNA, 23 nt, Mycobacterium avium subsp. paratuberculosis
ccgcccgggcacgacggucagca

SEQ ID NO: 2980007 - RNA, 15 nt, Mycobacterium avium subsp. paratuberculosis
ccgcccgggccaggc

SEQ ID NO: 2980008 - RNA, 12 nt, Mycobacterium avium subsp. paratuberculosis
ccgcccgggccc

SEQ ID NO: 2980009 - RNA, 13 nt, Mycobacterium avium subsp. paratuberculosis
ccgcccgggccgc

SEQ ID NO: 2980010 - RNA, 15 nt, Mycobacterium avium subsp. paratuberculosis
ccgcccgggccgcgc

SEQ ID NO: 2980011 - RNA, 13 nt, Mycobacterium avium subsp. paratuberculosis
ccgcccgggccgu

SEQ ID NO: 2980012 - RNA, 22 nt, Mycobacterium avium subsp. paratuberculosis
ccgcccgggccguaucggcccc

SEQ ID NO: 2980013 - RNA, 23 nt, Mycobacterium avium subsp. paratuberculosis
ccgcccgggccguaucggccccg

SEQ ID NO: 2980014 - RNA, 20 nt, Mycobacterium avium subsp. paratuberculosis
ccgcccgggcggcccgggug

SEQ ID NO: 2980015 - RNA, 16 nt, Mycobacterium avium subsp. paratuberculosis
ccgcccggggcggcga

SEQ ID NO: 2980016 - RNA, 19 nt, Mycobacterium avium subsp. paratuberculosis
ccgcccggggcggcgaugc

SEQ ID NO: 2980017 - RNA, 17 nt, Mycobacterium avium subsp. paratuberculosis
ccgcccgggucgucggu

SEQ ID NO: 2980018 - RNA, 14 nt, Mycobacterium avium subsp. paratuberculosis
ccgcccgggugaug

SEQ ID NO: 2980019 - RNA, 15 nt, Mycobacterium avium subsp. paratuberculosis
ccgcccgggugaugg

SEQ ID NO: 2980020 - RNA, 13 nt, Mycobacterium avium subsp. paratuberculosis
ccgcccgggugca

SEQ ID NO: 2980021 - RNA, 18 nt, Mycobacterium avium subsp. paratuberculosis
ccgcccgggugcaggccc

SEQ ID NO: 2980022 - RNA, 20 nt, Mycobacterium avium subsp. paratuberculosis
ccgcccgguccgggucgcug

SEQ ID NO: 2980023 - RNA, 16 nt, Mycobacterium avium subsp. paratuberculosis
ccgcccguagacccac

SEQ ID NO: 2980024 - RNA, 17 nt, Mycobacterium avium subsp. paratuberculosis
ccgcccguagacccaca

SEQ ID NO: 2980025 - RNA, 21 nt, Mycobacterium avium subsp. paratuberculosis
ccgcccguagaugcggcccag

SEQ ID NO: 2980026 - RNA, 14 nt, Mycobacterium avium subsp. paratuberculosis
ccgcccguccagcg

SEQ ID NO: 2980027 - RNA, 23 nt, Mycobacterium avium subsp. paratuberculosis
ccgcccguccagcgcaugccacu

SEQ ID NO: 2980028 - RNA, 18 nt, Mycobacterium avium subsp. paratuberculosis
ccgcccguccgggccggc

SEQ ID NO: 2980029 - RNA, 20 nt, Mycobacterium avium subsp. paratuberculosis
ccgcccguccgggccggcca

SEQ ID NO: 2980030 - RNA, 21 nt, Mycobacterium avium subsp. paratuberculosis
ccgcccguccgggccggccag

SEQ ID NO: 2980031 - RNA, 16 nt, Mycobacterium avium subsp. paratuberculosis
ccgcccguccuggaug

SEQ ID NO: 2980032 - RNA, 19 nt, Mycobacterium avium subsp. paratuberculosis
ccgcccgucggggcccggc

SEQ ID NO: 2980033 - RNA, 22 nt, Mycobacterium avium subsp. paratuberculosis
ccgcccgucggggcccggcccg

SEQ ID NO: 2980034 - RNA, 14 nt, Mycobacterium avium subsp. paratuberculosis
ccgcccucaggcgu

SEQ ID NO: 2980035 - RNA, 17 nt, Mycobacterium avium subsp. paratuberculosis
ccgcccucgccccggau

SEQ ID NO: 2980036 - RNA, 18 nt, Mycobacterium avium subsp. paratuberculosis
ccgcccucgccccggaug

SEQ ID NO: 2980037 - RNA, 15 nt, Mycobacterium avium subsp. paratuberculosis
ccgcccucgcccucg

SEQ ID NO: 2980038 - RNA, 14 nt, Mycobacterium avium subsp. paratuberculosis
ccgcccucgccgaa

SEQ ID NO: 2980039 - RNA, 23 nt, Mycobacterium avium subsp. paratuberculosis
ccgcccucgccgaaccggggccg

SEQ ID NO: 2980040 - RNA, 15 nt, Mycobacterium avium subsp. paratuberculosis
ccgcccucgcugccg

SEQ ID NO: 2980041 - RNA, 20 nt, Mycobacterium avium subsp. paratuberculosis
ccgcccucgcugccgccccc

SEQ ID NO: 2980042 - RNA, 21 nt, Mycobacterium avium subsp. paratuberculosis
ccgcccucucacggcgguagc

SEQ ID NO: 2980043 - RNA, 22 nt, Mycobacterium avium subsp. paratuberculosis
ccgcccugcgggaacagcggga

SEQ ID NO: 2980044 - RNA, 20 nt, Mycobacterium avium subsp. paratuberculosis
ccgcccugcuugaacagcac

SEQ ID NO: 2980045 - RNA, 22 nt, Mycobacterium avium subsp. paratuberculosis
ccgcccugcuugaacagcaccc

SEQ ID NO: 2980046 - RNA, 17 nt, Mycobacterium avium subsp. paratuberculosis
ccgcccuggcuguagcg

SEQ ID NO: 2980047 - RNA, 22 nt, Mycobacterium avium subsp. paratuberculosis
ccgcccuugaacggcaccagcg

SEQ ID NO: 2980048 - RNA, 23 nt, Mycobacterium avium subsp. paratuberculosis
ccgcccuugaacggcaccagcgg

SEQ ID NO: 2980049 - RNA, 17 nt, Mycobacterium avium subsp. paratuberculosis
ccgcccuugcucgcggc

SEQ ID NO: 2980050 - RNA, 18 nt, Mycobacterium avium subsp. paratuberculosis
ccgcccuugcucgcggcg

SEQ ID NO: 2980051 - RNA, 21 nt, Mycobacterium avium subsp. paratuberculosis
ccgcccuugcucgcggcguag

SEQ ID NO: 2980052 - RNA, 16 nt, Mycobacterium avium subsp. paratuberculosis
ccgcccuuggccgcgg

SEQ ID NO: 2980053 - RNA, 18 nt, Mycobacterium avium subsp. paratuberculosis
ccgccgaaacaccggcuu

SEQ ID NO: 2980054 - RNA, 20 nt, Mycobacterium avium subsp. paratuberculosis
ccgccgaaacaccggcuucg

SEQ ID NO: 2980055 - RNA, 21 nt, Mycobacterium avium subsp. paratuberculosis
ccgccgaaacaccggcuucgg

SEQ ID NO: 2980056 - RNA, 13 nt, Mycobacterium avium subsp. paratuberculosis
ccgccgaaacccg

SEQ ID NO: 2980057 - RNA, 15 nt, Mycobacterium avium subsp. paratuberculosis
ccgccgaaacccgcu

SEQ ID NO: 2980058 - RNA, 16 nt, Mycobacterium avium subsp. paratuberculosis
ccgccgaaacccgcug

SEQ ID NO: 2980059 - RNA, 21 nt, Mycobacterium avium subsp. paratuberculosis
ccgccgaaacccgcugucaau

SEQ ID NO: 2980060 - RNA, 15 nt, Mycobacterium avium subsp. paratuberculosis
ccgccgaaagccucc

SEQ ID NO: 2980061 - RNA, 16 nt, Mycobacterium avium subsp. paratuberculosis
ccgccgaaagccuccg

SEQ ID NO: 2980062 - RNA, 21 nt, Mycobacterium avium subsp. paratuberculosis
ccgccgaaagccuccgcgauc

SEQ ID NO: 2980063 - RNA, 22 nt, Mycobacterium avium subsp. paratuberculosis
ccgccgaaagccuccgcgauca

SEQ ID NO: 2980064 - RNA, 23 nt, Mycobacterium avium subsp. paratuberculosis
ccgccgaaagguuuucccggccg

SEQ ID NO: 2980065 - RNA, 17 nt, Mycobacterium avium subsp. paratuberculosis
ccgccgaacaccggcag

SEQ ID NO: 2980066 - RNA, 21 nt, Mycobacterium avium subsp. paratuberculosis
ccgccgaacaccggcagcgcc

SEQ ID NO: 2980067 - RNA, 22 nt, Mycobacterium avium subsp. paratuberculosis
ccgccgaacaccggcagcgcca

SEQ ID NO: 2980068 - RNA, 20 nt, Mycobacterium avium subsp. paratuberculosis
ccgccgaacagcagcgcgcc

SEQ ID NO: 2980069 - RNA, 18 nt, Mycobacterium avium subsp. paratuberculosis
ccgccgaacagccgggug

SEQ ID NO: 2980070 - RNA, 18 nt, Mycobacterium avium subsp. paratuberculosis
ccgccgaaccagaucggc

SEQ ID NO: 2980071 - RNA, 13 nt, Mycobacterium avium subsp. paratuberculosis
ccgccgaacccca

SEQ ID NO: 2980072 - RNA, 15 nt, Mycobacterium avium subsp. paratuberculosis
ccgccgaaccccagc

SEQ ID NO: 2980073 - RNA, 18 nt, Mycobacterium avium subsp. paratuberculosis
ccgccgaaccccagcucc

SEQ ID NO: 2980074 - RNA, 17 nt, Mycobacterium avium subsp. paratuberculosis
ccgccgaacccgcccuc

SEQ ID NO: 2980075 - RNA, 18 nt, Mycobacterium avium subsp. paratuberculosis
ccgccgaacccgcccucg

SEQ ID NO: 2980076 - RNA, 13 nt, Mycobacterium avium subsp. paratuberculosis
ccgccgaaccgau

SEQ ID NO: 2980077 - RNA, 17 nt, Mycobacterium avium subsp. paratuberculosis
ccgccgaaccgaucacc

SEQ ID NO: 2980078 - RNA, 19 nt, Mycobacterium avium subsp. paratuberculosis
ccgccgaaccgaucaccgg

SEQ ID NO: 2980079 - RNA, 22 nt, Mycobacterium avium subsp. paratuberculosis
ccgccgaaccgaucaccggcag

SEQ ID NO: 2980080 - RNA, 13 nt, Mycobacterium avium subsp. paratuberculosis
ccgccgaacgccu

SEQ ID NO: 2980081 - RNA, 21 nt, Mycobacterium avium subsp. paratuberculosis
ccgccgaacgccuccgccgcc

SEQ ID NO: 2980082 - RNA, 16 nt, Mycobacterium avium subsp. paratuberculosis
ccgccgaagccggcuc

SEQ ID NO: 2980083 - RNA, 15 nt, Mycobacterium avium subsp. paratuberculosis
ccgccgaagcggcgc

SEQ ID NO: 2980084 - RNA, 15 nt, Mycobacterium avium subsp. paratuberculosis
ccgccgacaccaccg

SEQ ID NO: 2980085 - RNA, 19 nt, Mycobacterium avium subsp. paratuberculosis
ccgccgacaccaccgcgcg

SEQ ID NO: 2980086 - RNA, 13 nt, Mycobacterium avium subsp. paratuberculosis
ccgccgacaccag

SEQ ID NO: 2980087 - RNA, 16 nt, Mycobacterium avium subsp. paratuberculosis
ccgccgacaccagggu

SEQ ID NO: 2980088 - RNA, 13 nt, Mycobacterium avium subsp. paratuberculosis
ccgccgacagcac

SEQ ID NO: 2980089 - RNA, 16 nt, Mycobacterium avium subsp. paratuberculosis
ccgccgacagcaccuc

SEQ ID NO: 2980090 - RNA, 13 nt, Mycobacterium avium subsp. paratuberculosis
ccgccgacagcgg

SEQ ID NO: 2980091 - RNA, 17 nt, Mycobacterium avium subsp. paratuberculosis
ccgccgacagcgggaug

SEQ ID NO: 2980092 - RNA, 15 nt, Mycobacterium avium subsp. paratuberculosis
ccgccgacaucgccc

SEQ ID NO: 2980093 - RNA, 17 nt, Mycobacterium avium subsp. paratuberculosis
ccgccgacaucgcccgg

SEQ ID NO: 2980094 - RNA, 17 nt, Mycobacterium avium subsp. paratuberculosis
ccgccgaccacgccgcg

SEQ ID NO: 2980095 - RNA, 22 nt, Mycobacterium avium subsp. paratuberculosis
ccgccgacccaauacgaucagc

SEQ ID NO: 2980096 - RNA, 16 nt, Mycobacterium avium subsp. paratuberculosis
ccgccgaccgcccgcu

SEQ ID NO: 2980097 - RNA, 14 nt, Mycobacterium avium subsp. paratuberculosis
ccgccgaccgccga

SEQ ID NO: 2980098 - RNA, 18 nt, Mycobacterium avium subsp. paratuberculosis
ccgccgaccgccgagcgg

SEQ ID NO: 2980099 - RNA, 17 nt, Mycobacterium avium subsp. paratuberculosis
ccgccgaccgguccgcc

SEQ ID NO: 2980100 - RNA, 19 nt, Mycobacterium avium subsp. paratuberculosis
ccgccgaccgguccgccgc

SEQ ID NO: 2980101 - RNA, 21 nt, Mycobacterium avium subsp. paratuberculosis
ccgccgaccgguccgccgccg

SEQ ID NO: 2980102 - RNA, 22 nt, Mycobacterium avium subsp. paratuberculosis
ccgccgacgaagaugcgcccgg

SEQ ID NO: 2980103 - RNA, 22 nt, Mycobacterium avium subsp. paratuberculosis
ccgccgacgacggcgaacgucg

SEQ ID NO: 2980104 - RNA, 14 nt, Mycobacterium avium subsp. paratuberculosis
ccgccgacgauacg

SEQ ID NO: 2980105 - RNA, 16 nt, Mycobacterium avium subsp. paratuberculosis
ccgccgacgaugucga

SEQ ID NO: 2980106 - RNA, 17 nt, Mycobacterium avium subsp. paratuberculosis
ccgccgacgcccaggcu

SEQ ID NO: 2980107 - RNA, 19 nt, Mycobacterium avium subsp. paratuberculosis
ccgccgacgcccaggcuca

SEQ ID NO: 2980108 - RNA, 15 nt, Mycobacterium avium subsp. paratuberculosis
ccgccgacgccugcg

SEQ ID NO: 2980109 - RNA, 19 nt, Mycobacterium avium subsp. paratuberculosis
ccgccgacggagacgacca

SEQ ID NO: 2980110 - RNA, 22 nt, Mycobacterium avium subsp. paratuberculosis
ccgccgacggagacgaccaggu

SEQ ID NO: 2980111 - RNA, 14 nt, Mycobacterium avium subsp. paratuberculosis
ccgccgacggcugc

SEQ ID NO: 2980112 - RNA, 19 nt, Mycobacterium avium subsp. paratuberculosis
ccgccgacggcugcccggc

SEQ ID NO: 2980113 - RNA, 22 nt, Mycobacterium avium subsp. paratuberculosis
ccgccgacggcugcccggcccg

SEQ ID NO: 2980114 - RNA, 15 nt, Mycobacterium avium subsp. paratuberculosis
ccgccgacgguggcc

SEQ ID NO: 2980115 - RNA, 16 nt, Mycobacterium avium subsp. paratuberculosis
ccgccgacgguggccc

SEQ ID NO: 2980116 - RNA, 12 nt, Mycobacterium avium subsp. paratuberculosis
ccgccgacgucg

SEQ ID NO: 2980117 - RNA, 15 nt, Mycobacterium avium subsp. paratuberculosis
ccgccgacuccccgc

SEQ ID NO: 2980118 - RNA, 16 nt, Mycobacterium avium subsp. paratuberculosis
ccgccgacuccccgcc

SEQ ID NO: 2980119 - RNA, 17 nt, Mycobacterium avium subsp. paratuberculosis
ccgccgacuccccgccc

SEQ ID NO: 2980120 - RNA, 20 nt, Mycobacterium avium subsp. paratuberculosis
ccgccgacuccccgcccggc

SEQ ID NO: 2980121 - RNA, 14 nt, Mycobacterium avium subsp. paratuberculosis
ccgccgagacggcg

SEQ ID NO: 2980122 - RNA, 15 nt, Mycobacterium avium subsp. paratuberculosis
ccgccgagacggcgu

SEQ ID NO: 2980123 - RNA, 17 nt, Mycobacterium avium subsp. paratuberculosis
ccgccgagacggcgugg

SEQ ID NO: 2980124 - RNA, 20 nt, Mycobacterium avium subsp. paratuberculosis
ccgccgagauccaccgcgcg

SEQ ID NO: 2980125 - RNA, 23 nt, Mycobacterium avium subsp. paratuberculosis
ccgccgagauccaccgcgcggcc

SEQ ID NO: 2980126 - RNA, 23 nt, Mycobacterium avium subsp. paratuberculosis
ccgccgagcaacagcccgaccgu

SEQ ID NO: 2980127 - RNA, 12 nt, Mycobacterium avium subsp. paratuberculosis
ccgccgagcaga

SEQ ID NO: 2980128 - RNA, 15 nt, Mycobacterium avium subsp. paratuberculosis
ccgccgagcagauca

SEQ ID NO: 2980129 - RNA, 13 nt, Mycobacterium avium subsp. paratuberculosis
ccgccgagccgcg

SEQ ID NO: 2980130 - RNA, 17 nt, Mycobacterium avium subsp. paratuberculosis
ccgccgagccgcgggug

SEQ ID NO: 2980131 - RNA, 18 nt, Mycobacterium avium subsp. paratuberculosis
ccgccgagccgcggguga

SEQ ID NO: 2980132 - RNA, 14 nt, Mycobacterium avium subsp. paratuberculosis
ccgccgagccgcuc

SEQ ID NO: 2980133 - RNA, 20 nt, Mycobacterium avium subsp. paratuberculosis
ccgccgagccgcuccaccgc

SEQ ID NO: 2980134 - RNA, 16 nt, Mycobacterium avium subsp. paratuberculosis
ccgccgagccggcacg

SEQ ID NO: 2980135 - RNA, 17 nt, Mycobacterium avium subsp. paratuberculosis
ccgccgagccggcacgg

SEQ ID NO: 2980136 - RNA, 20 nt, Mycobacterium avium subsp. paratuberculosis
ccgccgagccggcacggccg

SEQ ID NO: 2980137 - RNA, 14 nt, Mycobacterium avium subsp. paratuberculosis
ccgccgagccgucg

SEQ ID NO: 2980138 - RNA, 15 nt, Mycobacterium avium subsp. paratuberculosis
ccgccgagccgucgu

SEQ ID NO: 2980139 - RNA, 16 nt, Mycobacterium avium subsp. paratuberculosis
ccgccgagccgucguc

SEQ ID NO: 2980140 - RNA, 15 nt, Mycobacterium avium subsp. paratuberculosis
ccgccgagcgggcga

SEQ ID NO: 2980141 - RNA, 15 nt, Mycobacterium avium subsp. paratuberculosis
ccgccgagcgucacg

SEQ ID NO: 2980142 - RNA, 21 nt, Mycobacterium avium subsp. paratuberculosis
ccgccgagcgucacgcuagcg

SEQ ID NO: 2980143 - RNA, 15 nt, Mycobacterium avium subsp. paratuberculosis
ccgccgaggcgaugc

SEQ ID NO: 2980144 - RNA, 21 nt, Mycobacterium avium subsp. paratuberculosis
ccgccgaggcgaugccgugcu

SEQ ID NO: 2980145 - RNA, 17 nt, Mycobacterium avium subsp. paratuberculosis
ccgccgagggccagcag

SEQ ID NO: 2980146 - RNA, 19 nt, Mycobacterium avium subsp. paratuberculosis
ccgccgagggccagcagcc

SEQ ID NO: 2980147 - RNA, 17 nt, Mycobacterium avium subsp. paratuberculosis
ccgccgagucgcgccgc

SEQ ID NO: 2980148 - RNA, 18 nt, Mycobacterium avium subsp. paratuberculosis
ccgccgagucgcgccgcg

SEQ ID NO: 2980149 - RNA, 19 nt, Mycobacterium avium subsp. paratuberculosis
ccgccgagucgcgccgcgu

SEQ ID NO: 2980150 - RNA, 22 nt, Mycobacterium avium subsp. paratuberculosis
ccgccgagucgcgccgcgucgc

SEQ ID NO: 2980151 - RNA, 19 nt, Mycobacterium avium subsp. paratuberculosis
ccgccgaucaacaggccca

SEQ ID NO: 2980152 - RNA, 21 nt, Mycobacterium avium subsp. paratuberculosis
ccgccgaucgaucagccgcga

SEQ ID NO: 2980153 - RNA, 23 nt, Mycobacterium avium subsp. paratuberculosis
ccgccgaucgaucagccgcgaca

SEQ ID NO: 2980154 - RNA, 22 nt, Mycobacterium avium subsp. paratuberculosis
ccgccgaucgugacgccguccg

SEQ ID NO: 2980155 - RNA, 20 nt, Mycobacterium avium subsp. paratuberculosis
ccgccgaucuugagccggau

SEQ ID NO: 2980156 - RNA, 15 nt, Mycobacterium avium subsp. paratuberculosis
ccgccgaugacggcg

SEQ ID NO: 2980157 - RNA, 16 nt, Mycobacterium avium subsp. paratuberculosis
ccgccgaugacggcgc

SEQ ID NO: 2980158 - RNA, 17 nt, Mycobacterium avium subsp. paratuberculosis
ccgccgaugacggcgcg

SEQ ID NO: 2980159 - RNA, 18 nt, Mycobacterium avium subsp. paratuberculosis
ccgccgaugaugguggcg

SEQ ID NO: 2980160 - RNA, 19 nt, Mycobacterium avium subsp. paratuberculosis
ccgccgaugaugguggcgg

SEQ ID NO: 2980161 - RNA, 22 nt, Mycobacterium avium subsp. paratuberculosis
ccgccgaugaugguggcggcca

SEQ ID NO: 2980162 - RNA, 19 nt, Mycobacterium avium subsp. paratuberculosis
ccgccgauggacacgcugc

SEQ ID NO: 2980163 - RNA, 16 nt, Mycobacterium avium subsp. paratuberculosis
ccgccgauggcgacgg

SEQ ID NO: 2980164 - RNA, 23 nt, Mycobacterium avium subsp. paratuberculosis
ccgccgaugugaucggcggccac

SEQ ID NO: 2980165 - RNA, 18 nt, Mycobacterium avium subsp. paratuberculosis
ccgccgauucaaccccgc

SEQ ID NO: 2980166 - RNA, 19 nt, Mycobacterium avium subsp. paratuberculosis
ccgccgauucaaccccgcg

SEQ ID NO: 2980167 - RNA, 20 nt, Mycobacterium avium subsp. paratuberculosis
ccgccgauucaaccccgcgc

SEQ ID NO: 2980168 - RNA, 22 nt, Mycobacterium avium subsp. paratuberculosis
ccgccgauucaaccccgcgcgc

SEQ ID NO: 2980169 - RNA, 24 nt, Mycobacterium avium subsp. paratuberculosis
ccgccgauucaaccccgcgcgcgg

SEQ ID NO: 2980170 - RNA, 18 nt, Mycobacterium avium subsp. paratuberculosis
ccgccgauuccggccggc

SEQ ID NO: 2980171 - RNA, 13 nt, Mycobacterium avium subsp. paratuberculosis
ccgccgcaacagc

SEQ ID NO: 2980172 - RNA, 16 nt, Mycobacterium avium subsp. paratuberculosis
ccgccgcaacagccgg

SEQ ID NO: 2980173 - RNA, 20 nt, Mycobacterium avium subsp. paratuberculosis
ccgccgcaacagccggcccg

SEQ ID NO: 2980174 - RNA, 22 nt, Mycobacterium avium subsp. paratuberculosis
ccgccgcaacagccggcccgag

SEQ ID NO: 2980175 - RNA, 19 nt, Mycobacterium avium subsp. paratuberculosis
ccgccgcacacuuccggga

SEQ ID NO: 2980176 - RNA, 16 nt, Mycobacterium avium subsp. paratuberculosis
ccgccgcacccagcgg

SEQ ID NO: 2980177 - RNA, 15 nt, Mycobacterium avium subsp. paratuberculosis
ccgccgcaccggccg

SEQ ID NO: 2980178 - RNA, 17 nt, Mycobacterium avium subsp. paratuberculosis
ccgccgcaccggccggc

SEQ ID NO: 2980179 - RNA, 17 nt, Mycobacterium avium subsp. paratuberculosis
ccgccgcaccucgccgg

SEQ ID NO: 2980180 - RNA, 18 nt, Mycobacterium avium subsp. paratuberculosis
ccgccgcaccucgccggc

SEQ ID NO: 2980181 - RNA, 20 nt, Mycobacterium avium subsp. paratuberculosis
ccgccgcaccucgccggccg

SEQ ID NO: 2980182 - RNA, 21 nt, Mycobacterium avium subsp. paratuberculosis
ccgccgcaccucgccggccgc

SEQ ID NO: 2980183 - RNA, 13 nt, Mycobacterium avium subsp. paratuberculosis
ccgccgcagcagc

SEQ ID NO: 2980184 - RNA, 14 nt, Mycobacterium avium subsp. paratuberculosis
ccgccgcagcagcc

SEQ ID NO: 2980185 - RNA, 19 nt, Mycobacterium avium subsp. paratuberculosis
ccgccgcagcagccgcgcc

SEQ ID NO: 2980186 - RNA, 18 nt, Mycobacterium avium subsp. paratuberculosis
ccgccgcagcccaggccc

SEQ ID NO: 2980187 - RNA, 19 nt, Mycobacterium avium subsp. paratuberculosis
ccgccgcagcccaggccca

SEQ ID NO: 2980188 - RNA, 22 nt, Mycobacterium avium subsp. paratuberculosis
ccgccgcagcccaggcccagca

SEQ ID NO: 2980189 - RNA, 14 nt, Mycobacterium avium subsp. paratuberculosis
ccgccgcagcgcag

SEQ ID NO: 2980190 - RNA, 18 nt, Mycobacterium avium subsp. paratuberculosis
ccgccgcagcggcgccgc

SEQ ID NO: 2980191 - RNA, 22 nt, Mycobacterium avium subsp. paratuberculosis
ccgccgcagcggcgccgcagcu

SEQ ID NO: 2980192 - RNA, 13 nt, Mycobacterium avium subsp. paratuberculosis
ccgccgcauaccg

SEQ ID NO: 2980193 - RNA, 17 nt, Mycobacterium avium subsp. paratuberculosis
ccgccgcauaccgcccg

SEQ ID NO: 2980194 - RNA, 20 nt, Mycobacterium avium subsp. paratuberculosis
ccgccgcauaccgcccgcgc

SEQ ID NO: 2980195 - RNA, 20 nt, Mycobacterium avium subsp. paratuberculosis
ccgccgcauuccucggccag

SEQ ID NO: 2980196 - RNA, 21 nt, Mycobacterium avium subsp. paratuberculosis
ccgccgcauuccucggccagc

SEQ ID NO: 2980197 - RNA, 22 nt, Mycobacterium avium subsp. paratuberculosis
ccgccgcauuccucggccagcu

SEQ ID NO: 2980198 - RNA, 12 nt, Mycobacterium avium subsp. paratuberculosis
ccgccgccacca

SEQ ID NO: 2980199 - RNA, 15 nt, Mycobacterium avium subsp. paratuberculosis
ccgccgccaccgucg

SEQ ID NO: 2980200 - RNA, 20 nt, Mycobacterium avium subsp. paratuberculosis
ccgccgccaccgucgccggc

SEQ ID NO: 2980201 - RNA, 14 nt, Mycobacterium avium subsp. paratuberculosis
ccgccgccagcacc

SEQ ID NO: 2980202 - RNA, 14 nt, Mycobacterium avium subsp. paratuberculosis
ccgccgccagcagc

SEQ ID NO: 2980203 - RNA, 18 nt, Mycobacterium avium subsp. paratuberculosis
ccgccgccagccagccgg

SEQ ID NO: 2980204 - RNA, 23 nt, Mycobacterium avium subsp. paratuberculosis
ccgccgccagccagccggugcgg

SEQ ID NO: 2980205 - RNA, 14 nt, Mycobacterium avium subsp. paratuberculosis
ccgccgccagcgcg

SEQ ID NO: 2980206 - RNA, 15 nt, Mycobacterium avium subsp. paratuberculosis
ccgccgccagcgcgg

SEQ ID NO: 2980207 - RNA, 13 nt, Mycobacterium avium subsp. paratuberculosis
ccgccgccauccg

SEQ ID NO: 2980208 - RNA, 19 nt, Mycobacterium avium subsp. paratuberculosis
ccgccgccauccgcgccga

SEQ ID NO: 2980209 - RNA, 20 nt, Mycobacterium avium subsp. paratuberculosis
ccgccgccauccguucggcu

SEQ ID NO: 2980210 - RNA, 21 nt, Mycobacterium avium subsp. paratuberculosis
ccgccgccaucuccuccgggc

SEQ ID NO: 2980211 - RNA, 13 nt, Mycobacterium avium subsp. paratuberculosis
ccgccgcccacgc

SEQ ID NO: 2980212 - RNA, 20 nt, Mycobacterium avium subsp. paratuberculosis
ccgccgcccacgccgcccag

SEQ ID NO: 2980213 - RNA, 14 nt, Mycobacterium avium subsp. paratuberculosis
ccgccgcccaggcc

SEQ ID NO: 2980214 - RNA, 15 nt, Mycobacterium avium subsp. paratuberculosis
ccgccgcccaggccg

SEQ ID NO: 2980215 - RNA, 16 nt, Mycobacterium avium subsp. paratuberculosis
ccgccgcccaggccga

SEQ ID NO: 2980216 - RNA, 14 nt, Mycobacterium avium subsp. paratuberculosis
ccgccgcccgcgcg

SEQ ID NO: 2980217 - RNA, 17 nt, Mycobacterium avium subsp. paratuberculosis
ccgccgcccgcgcggcg

SEQ ID NO: 2980218 - RNA, 18 nt, Mycobacterium avium subsp. paratuberculosis
ccgccgcccgcgcggcgg

SEQ ID NO: 2980219 - RNA, 14 nt, Mycobacterium avium subsp. paratuberculosis
ccgccgcccugcgg

SEQ ID NO: 2980220 - RNA, 13 nt, Mycobacterium avium subsp. paratuberculosis
ccgccgccgaaca

SEQ ID NO: 2980221 - RNA, 15 nt, Mycobacterium avium subsp. paratuberculosis
ccgccgccgaacagc

SEQ ID NO: 2980222 - RNA, 13 nt, Mycobacterium avium subsp. paratuberculosis
ccgccgccgacca

SEQ ID NO: 2980223 - RNA, 23 nt, Mycobacterium avium subsp. paratuberculosis
ccgccgccgagcucggccaccag

SEQ ID NO: 2980224 - RNA, 21 nt, Mycobacterium avium subsp. paratuberculosis
ccgccgccgaucuugagccgg

SEQ ID NO: 2980225 - RNA, 14 nt, Mycobacterium avium subsp. paratuberculosis
ccgccgccgcggcc

SEQ ID NO: 2980226 - RNA, 16 nt, Mycobacterium avium subsp. paratuberculosis
ccgccgccgcggccgc

SEQ ID NO: 2980227 - RNA, 13 nt, Mycobacterium avium subsp. paratuberculosis
ccgccgccgcggg

SEQ ID NO: 2980228 - RNA, 16 nt, Mycobacterium avium subsp. paratuberculosis
ccgccgccgcgggugg

SEQ ID NO: 2980229 - RNA, 13 nt, Mycobacterium avium subsp. paratuberculosis
ccgccgccgcugu

SEQ ID NO: 2980230 - RNA, 13 nt, Mycobacterium avium subsp. paratuberculosis
ccgccgccggcgg

SEQ ID NO: 2980231 - RNA, 14 nt, Mycobacterium avium subsp. paratuberculosis
ccgccgccggcgga

SEQ ID NO: 2980232 - RNA, 14 nt, Mycobacterium avium subsp. paratuberculosis
ccgccgccggcggc

SEQ ID NO: 2980233 - RNA, 15 nt, Mycobacterium avium subsp. paratuberculosis
ccgccgccggcgucg

SEQ ID NO: 2980234 - RNA, 18 nt, Mycobacterium avium subsp. paratuberculosis
ccgccgccgucgguguag

SEQ ID NO: 2980235 - RNA, 21 nt, Mycobacterium avium subsp. paratuberculosis
ccgccgccgugcauccagccg

SEQ ID NO: 2980236 - RNA, 11 nt, Mycobacterium avium subsp. paratuberculosis
ccgccgccuca

SEQ ID NO: 2980237 - RNA, 22 nt, Mycobacterium avium subsp. paratuberculosis
ccgccgcgaacgggucgggggu

SEQ ID NO: 2980238 - RNA, 13 nt, Mycobacterium avium subsp. paratuberculosis
ccgccgcgacacc

SEQ ID NO: 2980239 - RNA, 12 nt, Mycobacterium avium subsp. paratuberculosis
ccgccgcgacca

SEQ ID NO: 2980240 - RNA, 20 nt, Mycobacterium avium subsp. paratuberculosis
ccgccgcgaccacagcgccu

SEQ ID NO: 2980241 - RNA, 12 nt, Mycobacterium avium subsp. paratuberculosis
ccgccgcgaccg

SEQ ID NO: 2980242 - RNA, 15 nt, Mycobacterium avium subsp. paratuberculosis
ccgccgcgaccgcga

SEQ ID NO: 2980243 - RNA, 14 nt, Mycobacterium avium subsp. paratuberculosis
ccgccgcgaccguc

SEQ ID NO: 2980244 - RNA, 16 nt, Mycobacterium avium subsp. paratuberculosis
ccgccgcgaccgucag

SEQ ID NO: 2980245 - RNA, 17 nt, Mycobacterium avium subsp. paratuberculosis
ccgccgcgaccgucagc

SEQ ID NO: 2980246 - RNA, 14 nt, Mycobacterium avium subsp. paratuberculosis
ccgccgcgacgaug

SEQ ID NO: 2980247 - RNA, 15 nt, Mycobacterium avium subsp. paratuberculosis
ccgccgcgacgaugc

SEQ ID NO: 2980248 - RNA, 19 nt, Mycobacterium avium subsp. paratuberculosis
ccgccgcgacgaugccggc

SEQ ID NO: 2980249 - RNA, 17 nt, Mycobacterium avium subsp. paratuberculosis
ccgccgcgacgccgugc

SEQ ID NO: 2980250 - RNA, 12 nt, Mycobacterium avium subsp. paratuberculosis
ccgccgcgacgg

SEQ ID NO: 2980251 - RNA, 13 nt, Mycobacterium avium subsp. paratuberculosis
ccgccgcgacggc

SEQ ID NO: 2980252 - RNA, 15 nt, Mycobacterium avium subsp. paratuberculosis
ccgccgcgacggccg

SEQ ID NO: 2980253 - RNA, 19 nt, Mycobacterium avium subsp. paratuberculosis
ccgccgcgacggccgccga

SEQ ID NO: 2980254 - RNA, 15 nt, Mycobacterium avium subsp. paratuberculosis
ccgccgcgacggguu

SEQ ID NO: 2980255 - RNA, 20 nt, Mycobacterium avium subsp. paratuberculosis
ccgccgcgaucagggcccac

SEQ ID NO: 2980256 - RNA, 20 nt, Mycobacterium avium subsp. paratuberculosis
ccgccgcgaucuugccgccg

SEQ ID NO: 2980257 - RNA, 22 nt, Mycobacterium avium subsp. paratuberculosis
ccgccgcgaucuugccgccgcg

SEQ ID NO: 2980258 - RNA, 16 nt, Mycobacterium avium subsp. paratuberculosis
ccgccgcgcaccgcgc

SEQ ID NO: 2980259 - RNA, 12 nt, Mycobacterium avium subsp. paratuberculosis
ccgccgcgcagg

SEQ ID NO: 2980260 - RNA, 16 nt, Mycobacterium avium subsp. paratuberculosis
ccgccgcgcauccgca

SEQ ID NO: 2980261 - RNA, 20 nt, Mycobacterium avium subsp. paratuberculosis
ccgccgcgcauccgcaccga

SEQ ID NO: 2980262 - RNA, 14 nt, Mycobacterium avium subsp. paratuberculosis
ccgccgcgccaccg

SEQ ID NO: 2980263 - RNA, 13 nt, Mycobacterium avium subsp. paratuberculosis
ccgccgcgcccgg

SEQ ID NO: 2980264 - RNA, 14 nt, Mycobacterium avium subsp. paratuberculosis
ccgccgcgcccggc

SEQ ID NO: 2980265 - RNA, 16 nt, Mycobacterium avium subsp. paratuberculosis
ccgccgcgcccggcuu

SEQ ID NO: 2980266 - RNA, 21 nt, Mycobacterium avium subsp. paratuberculosis
ccgccgcgcccggcuucgccg

SEQ ID NO: 2980267 - RNA, 14 nt, Mycobacterium avium subsp. paratuberculosis
ccgccgcgcccguc

SEQ ID NO: 2980268 - RNA, 16 nt, Mycobacterium avium subsp. paratuberculosis
ccgccgcgcccgucga

SEQ ID NO: 2980269 - RNA, 21 nt, Mycobacterium avium subsp. paratuberculosis
ccgccgcgccgggcgcccgag

SEQ ID NO: 2980270 - RNA, 14 nt, Mycobacterium avium subsp. paratuberculosis
ccgccgcgcgcggc

SEQ ID NO: 2980271 - RNA, 16 nt, Mycobacterium avium subsp. paratuberculosis
ccgccgcgcgcggcca

SEQ ID NO: 2980272 - RNA, 13 nt, Mycobacterium avium subsp. paratuberculosis
ccgccgcgcggcc

SEQ ID NO: 2980273 - RNA, 13 nt, Mycobacterium avium subsp. paratuberculosis
ccgccgcgcgggu

SEQ ID NO: 2980274 - RNA, 20 nt, Mycobacterium avium subsp. paratuberculosis
ccgccgcgcggguacggcgg

SEQ ID NO: 2980275 - RNA, 13 nt, Mycobacterium avium subsp. paratuberculosis
ccgccgcgcucgc

SEQ ID NO: 2980276 - RNA, 20 nt, Mycobacterium avium subsp. paratuberculosis
ccgccgcgcucgcaccagcg

SEQ ID NO: 2980277 - RNA, 21 nt, Mycobacterium avium subsp. paratuberculosis
ccgccgcgcucgcaccagcgc

SEQ ID NO: 2980278 - RNA, 13 nt, Mycobacterium avium subsp. paratuberculosis
ccgccgcggacau

SEQ ID NO: 2980279 - RNA, 12 nt, Mycobacterium avium subsp. paratuberculosis
ccgccgcggagc

SEQ ID NO: 2980280 - RNA, 14 nt, Mycobacterium avium subsp. paratuberculosis
ccgccgcggagcgg

SEQ ID NO: 2980281 - RNA, 17 nt, Mycobacterium avium subsp. paratuberculosis
ccgccgcggagcggcgg

SEQ ID NO: 2980282 - RNA, 21 nt, Mycobacterium avium subsp. paratuberculosis
ccgccgcggagcggcggucac

SEQ ID NO: 2980283 - RNA, 14 nt, Mycobacterium avium subsp. paratuberculosis
ccgccgcggaucgg

SEQ ID NO: 2980284 - RNA, 10 nt, Mycobacterium avium subsp. paratuberculosis
ccgccgcggc

SEQ ID NO: 2980285 - RNA, 13 nt, Mycobacterium avium subsp. paratuberculosis
ccgccgcggcaac

SEQ ID NO: 2980286 - RNA, 13 nt, Mycobacterium avium subsp. paratuberculosis
ccgccgcggcacc

SEQ ID NO: 2980287 - RNA, 23 nt, Mycobacterium avium subsp. paratuberculosis
ccgccgcggcaccuucaccgacc

SEQ ID NO: 2980288 - RNA, 13 nt, Mycobacterium avium subsp. paratuberculosis
ccgccgcggccac

SEQ ID NO: 2980289 - RNA, 14 nt, Mycobacterium avium subsp. paratuberculosis
ccgccgcggccagg

SEQ ID NO: 2980290 - RNA, 14 nt, Mycobacterium avium subsp. paratuberculosis
ccgccgcggccgcc

SEQ ID NO: 2980291 - RNA, 15 nt, Mycobacterium avium subsp. paratuberculosis
ccgccgcggccgcga

SEQ ID NO: 2980292 - RNA, 20 nt, Mycobacterium avium subsp. paratuberculosis
ccgccgcggccgcggcgggc

SEQ ID NO: 2980293 - RNA, 15 nt, Mycobacterium avium subsp. paratuberculosis
ccgccgcggccgcug

SEQ ID NO: 2980294 - RNA, 22 nt, Mycobacterium avium subsp. paratuberculosis
ccgccgcggccgcuggcguuga

SEQ ID NO: 2980295 - RNA, 14 nt, Mycobacterium avium subsp. paratuberculosis
ccgccgcggcgacc

SEQ ID NO: 2980296 - RNA, 15 nt, Mycobacterium avium subsp. paratuberculosis
ccgccgcggcgacca

SEQ ID NO: 2980297 - RNA, 21 nt, Mycobacterium avium subsp. paratuberculosis
ccgccgcggcgaccacgaaca

SEQ ID NO: 2980298 - RNA, 16 nt, Mycobacterium avium subsp. paratuberculosis
ccgccgcggcgaccgg

SEQ ID NO: 2980299 - RNA, 20 nt, Mycobacterium avium subsp. paratuberculosis
ccgccgcggcgaccggggcg

SEQ ID NO: 2980300 - RNA, 13 nt, Mycobacterium avium subsp. paratuberculosis
ccgccgcggcgag

SEQ ID NO: 2980301 - RNA, 12 nt, Mycobacterium avium subsp. paratuberculosis
ccgccgcggcgc

SEQ ID NO: 2980302 - RNA, 14 nt, Mycobacterium avium subsp. paratuberculosis
ccgccgcggcgccc

SEQ ID NO: 2980303 - RNA, 20 nt, Mycobacterium avium subsp. paratuberculosis
ccgccgcggcgcccggcgcc

SEQ ID NO: 2980304 - RNA, 13 nt, Mycobacterium avium subsp. paratuberculosis
ccgccgcggcggc

SEQ ID NO: 2980305 - RNA, 14 nt, Mycobacterium avium subsp. paratuberculosis
ccgccgcggcggca

SEQ ID NO: 2980306 - RNA, 15 nt, Mycobacterium avium subsp. paratuberculosis
ccgccgcggcggccu

SEQ ID NO: 2980307 - RNA, 16 nt, Mycobacterium avium subsp. paratuberculosis
ccgccgcggcggccug

SEQ ID NO: 2980308 - RNA, 22 nt, Mycobacterium avium subsp. paratuberculosis
ccgccgcggcggccugcuugac

SEQ ID NO: 2980309 - RNA, 14 nt, Mycobacterium avium subsp. paratuberculosis
ccgccgcggcggug

SEQ ID NO: 2980310 - RNA, 23 nt, Mycobacterium avium subsp. paratuberculosis
ccgccgcggcgguggccugcccg

SEQ ID NO: 2980311 - RNA, 15 nt, Mycobacterium avium subsp. paratuberculosis
ccgccgcggcuccag

SEQ ID NO: 2980312 - RNA, 14 nt, Mycobacterium avium subsp. paratuberculosis
ccgccgcgggcucc

SEQ ID NO: 2980313 - RNA, 15 nt, Mycobacterium avium subsp. paratuberculosis
ccgccgcgggucggc

SEQ ID NO: 2980314 - RNA, 17 nt, Mycobacterium avium subsp. paratuberculosis
ccgccgcgggucggcga

SEQ ID NO: 2980315 - RNA, 18 nt, Mycobacterium avium subsp. paratuberculosis
ccgccgcgggucggcgac

SEQ ID NO: 2980316 - RNA, 22 nt, Mycobacterium avium subsp. paratuberculosis
ccgccgcgggucggcgacggcg

SEQ ID NO: 2980317 - RNA, 19 nt, Mycobacterium avium subsp. paratuberculosis
ccgccgcggguggccagcc

SEQ ID NO: 2980318 - RNA, 14 nt, Mycobacterium avium subsp. paratuberculosis
ccgccgcggugcug

SEQ ID NO: 2980319 - RNA, 13 nt, Mycobacterium avium subsp. paratuberculosis
ccgccgcgguggg

SEQ ID NO: 2980320 - RNA, 18 nt, Mycobacterium avium subsp. paratuberculosis
ccgccgcguacaccggcu

SEQ ID NO: 2980321 - RNA, 19 nt, Mycobacterium avium subsp. paratuberculosis
ccgccgcguacaccggcug

SEQ ID NO: 2980322 - RNA, 16 nt, Mycobacterium avium subsp. paratuberculosis
ccgccgcguacagcag

SEQ ID NO: 2980323 - RNA, 20 nt, Mycobacterium avium subsp. paratuberculosis
ccgccgcguacagccagccc

SEQ ID NO: 2980324 - RNA, 18 nt, Mycobacterium avium subsp. paratuberculosis
ccgccgcguaggccagga

SEQ ID NO: 2980325 - RNA, 15 nt, Mycobacterium avium subsp. paratuberculosis
ccgccgcgucagcgg

SEQ ID NO: 2980326 - RNA, 20 nt, Mycobacterium avium subsp. paratuberculosis
ccgccgcgucagcggcgggc

SEQ ID NO: 2980327 - RNA, 12 nt, Mycobacterium avium subsp. paratuberculosis
ccgccgcguccg

SEQ ID NO: 2980328 - RNA, 18 nt, Mycobacterium avium subsp. paratuberculosis
ccgccgcguccggggugc

SEQ ID NO: 2980329 - RNA, 12 nt, Mycobacterium avium subsp. paratuberculosis
ccgccgcgucgc

SEQ ID NO: 2980330 - RNA, 18 nt, Mycobacterium avium subsp. paratuberculosis
ccgccgcgucgccgccgg

SEQ ID NO: 2980331 - RNA, 19 nt, Mycobacterium avium subsp. paratuberculosis
ccgccgcgucgccgccggg

SEQ ID NO: 2980332 - RNA, 14 nt, Mycobacterium avium subsp. paratuberculosis
ccgccgcgucgguc

SEQ ID NO: 2980333 - RNA, 17 nt, Mycobacterium avium subsp. paratuberculosis
ccgccgcgucggucagc

SEQ ID NO: 2980334 - RNA, 20 nt, Mycobacterium avium subsp. paratuberculosis
ccgccgcgucggucagcgcc

SEQ ID NO: 2980335 - RNA, 13 nt, Mycobacterium avium subsp. paratuberculosis
ccgccgcgucguc

SEQ ID NO: 2980336 - RNA, 21 nt, Mycobacterium avium subsp. paratuberculosis
ccgccgcgucgugccgagcgu

SEQ ID NO: 2980337 - RNA, 15 nt, Mycobacterium avium subsp. paratuberculosis
ccgccgcguggccuc

SEQ ID NO: 2980338 - RNA, 22 nt, Mycobacterium avium subsp. paratuberculosis
ccgccgcuagguuuggccagca

SEQ ID NO: 2980339 - RNA, 23 nt, Mycobacterium avium subsp. paratuberculosis
ccgccgcuagucgcccagcagcc

SEQ ID NO: 2980340 - RNA, 14 nt, Mycobacterium avium subsp. paratuberculosis
ccgccgcucaccgc

SEQ ID NO: 2980341 - RNA, 15 nt, Mycobacterium avium subsp. paratuberculosis
ccgccgcucaccgcc

SEQ ID NO: 2980342 - RNA, 23 nt, Mycobacterium avium subsp. paratuberculosis
ccgccgcucagcgauugcggccg

SEQ ID NO: 2980343 - RNA, 14 nt, Mycobacterium avium subsp. paratuberculosis
ccgccgcugacgcg

SEQ ID NO: 2980344 - RNA, 12 nt, Mycobacterium avium subsp. paratuberculosis
ccgccgcugcag

SEQ ID NO: 2980345 - RNA, 17 nt, Mycobacterium avium subsp. paratuberculosis
ccgccggaacucggccg

SEQ ID NO: 2980346 - RNA, 20 nt, Mycobacterium avium subsp. paratuberculosis
ccgccggaacucggccggca

SEQ ID NO: 2980347 - RNA, 20 nt, Mycobacterium avium subsp. paratuberculosis
ccgccggacaccaccgcggu

SEQ ID NO: 2980348 - RNA, 16 nt, Mycobacterium avium subsp. paratuberculosis
ccgccggagaccagca

SEQ ID NO: 2980349 - RNA, 17 nt, Mycobacterium avium subsp. paratuberculosis
ccgccggagaccagcag

SEQ ID NO: 2980350 - RNA, 21 nt, Mycobacterium avium subsp. paratuberculosis
ccgccggagacgacucuucca

SEQ ID NO: 2980351 - RNA, 14 nt, Mycobacterium avium subsp. paratuberculosis
ccgccggagaugau

SEQ ID NO: 2980352 - RNA, 15 nt, Mycobacterium avium subsp. paratuberculosis
ccgccggagccgauc

SEQ ID NO: 2980353 - RNA, 21 nt, Mycobacterium avium subsp. paratuberculosis
ccgccggagccgaucgccucc

SEQ ID NO: 2980354 - RNA, 14 nt, Mycobacterium avium subsp. paratuberculosis
ccgccggaucggca

SEQ ID NO: 2980355 - RNA, 16 nt, Mycobacterium avium subsp. paratuberculosis
ccgccggaucggcagc

SEQ ID NO: 2980356 - RNA, 18 nt, Mycobacterium avium subsp. paratuberculosis
ccgccggaucggcagcgc

SEQ ID NO: 2980357 - RNA, 22 nt, Mycobacterium avium subsp. paratuberculosis
ccgccggaucgugucccggcgc

SEQ ID NO: 2980358 - RNA, 20 nt, Mycobacterium avium subsp. paratuberculosis
ccgccggauuacucgccggc

SEQ ID NO: 2980359 - RNA, 22 nt, Mycobacterium avium subsp. paratuberculosis
ccgccggauuacucgccggcgg

SEQ ID NO: 2980360 - RNA, 14 nt, Mycobacterium avium subsp. paratuberculosis
ccgccggcaccguc

SEQ ID NO: 2980361 - RNA, 15 nt, Mycobacterium avium subsp. paratuberculosis
ccgccggcaccgucc

SEQ ID NO: 2980362 - RNA, 18 nt, Mycobacterium avium subsp. paratuberculosis
ccgccggcagcggcugcu

SEQ ID NO: 2980363 - RNA, 11 nt, Mycobacterium avium subsp. paratuberculosis
ccgccggccac

SEQ ID NO: 2980364 - RNA, 18 nt, Mycobacterium avium subsp. paratuberculosis
ccgccggccaccaggguc

SEQ ID NO: 2980365 - RNA, 16 nt, Mycobacterium avium subsp. paratuberculosis
ccgccggccagcuccg

SEQ ID NO: 2980366 - RNA, 14 nt, Mycobacterium avium subsp. paratuberculosis
ccgccggcccagcu

SEQ ID NO: 2980367 - RNA, 15 nt, Mycobacterium avium subsp. paratuberculosis
ccgccggcccagcuc

SEQ ID NO: 2980368 - RNA, 13 nt, Mycobacterium avium subsp. paratuberculosis
ccgccggcccagg

SEQ ID NO: 2980369 - RNA, 13 nt, Mycobacterium avium subsp. paratuberculosis
ccgccggcccggc

SEQ ID NO: 2980370 - RNA, 14 nt, Mycobacterium avium subsp. paratuberculosis
ccgccggcccggcg

SEQ ID NO: 2980371 - RNA, 13 nt, Mycobacterium avium subsp. paratuberculosis
ccgccggccgcgc

SEQ ID NO: 2980372 - RNA, 15 nt, Mycobacterium avium subsp. paratuberculosis
ccgccggccgcggcg

SEQ ID NO: 2980373 - RNA, 17 nt, Mycobacterium avium subsp. paratuberculosis
ccgccggccgcggcgug

SEQ ID NO: 2980374 - RNA, 13 nt, Mycobacterium avium subsp. paratuberculosis
ccgccggccucgg

SEQ ID NO: 2980375 - RNA, 21 nt, Mycobacterium avium subsp. paratuberculosis
ccgccggccucgggguugcug

SEQ ID NO: 2980376 - RNA, 18 nt, Mycobacterium avium subsp. paratuberculosis
ccgccggcgaacgacguc

SEQ ID NO: 2980377 - RNA, 19 nt, Mycobacterium avium subsp. paratuberculosis
ccgccggcgaacgacgucg

SEQ ID NO: 2980378 - RNA, 20 nt, Mycobacterium avium subsp. paratuberculosis
ccgccggcgaagcucgacga

SEQ ID NO: 2980379 - RNA, 19 nt, Mycobacterium avium subsp. paratuberculosis
ccgccggcgaucucgucgc

SEQ ID NO: 2980380 - RNA, 16 nt, Mycobacterium avium subsp. paratuberculosis
ccgccggcgcagucca

SEQ ID NO: 2980381 - RNA, 22 nt, Mycobacterium avium subsp. paratuberculosis
ccgccggcgcaguccagggugg

SEQ ID NO: 2980382 - RNA, 14 nt, Mycobacterium avium subsp. paratuberculosis
ccgccggcgcccug

SEQ ID NO: 2980383 - RNA, 14 nt, Mycobacterium avium subsp. paratuberculosis
ccgccggcgccguc

SEQ ID NO: 2980384 - RNA, 12 nt, Mycobacterium avium subsp. paratuberculosis
ccgccggcgcug

SEQ ID NO: 2980385 - RNA, 19 nt, Mycobacterium avium subsp. paratuberculosis
ccgccggcgcuggcgcgcc

SEQ ID NO: 2980386 - RNA, 11 nt, Mycobacterium avium subsp. paratuberculosis
ccgccggcggc

SEQ ID NO: 2980387 - RNA, 13 nt, Mycobacterium avium subsp. paratuberculosis
ccgccggcggcca

SEQ ID NO: 2980388 - RNA, 21 nt, Mycobacterium avium subsp. paratuberculosis
ccgccggcggccaaucccacc

SEQ ID NO: 2980389 - RNA, 22 nt, Mycobacterium avium subsp. paratuberculosis
ccgccggcggccacgaugggga

SEQ ID NO: 2980390 - RNA, 15 nt, Mycobacterium avium subsp. paratuberculosis
ccgccggcggccucc

SEQ ID NO: 2980391 - RNA, 16 nt, Mycobacterium avium subsp. paratuberculosis
ccgccggcggccuccg

SEQ ID NO: 2980392 - RNA, 13 nt, Mycobacterium avium subsp. paratuberculosis
ccgccggcggcga

SEQ ID NO: 2980393 - RNA, 14 nt, Mycobacterium avium subsp. paratuberculosis
ccgccggcggcgau

SEQ ID NO: 2980394 - RNA, 16 nt, Mycobacterium avium subsp. paratuberculosis
ccgccggcggcgauga

SEQ ID NO: 2980395 - RNA, 14 nt, Mycobacterium avium subsp. paratuberculosis
ccgccggcggcguc

SEQ ID NO: 2980396 - RNA, 15 nt, Mycobacterium avium subsp. paratuberculosis
ccgccggcggguugg

SEQ ID NO: 2980397 - RNA, 13 nt, Mycobacterium avium subsp. paratuberculosis
ccgccggcggugc

SEQ ID NO: 2980398 - RNA, 14 nt, Mycobacterium avium subsp. paratuberculosis
ccgccggcggugcg

SEQ ID NO: 2980399 - RNA, 20 nt, Mycobacterium avium subsp. paratuberculosis
ccgccggcggugcggguggu

SEQ ID NO: 2980400 - RNA, 20 nt, Mycobacterium avium subsp. paratuberculosis
ccgccggcgguggcguagcg

SEQ ID NO: 2980401 - RNA, 19 nt, Mycobacterium avium subsp. paratuberculosis
ccgccggcgucgacgucgg

SEQ ID NO: 2980402 - RNA, 16 nt, Mycobacterium avium subsp. paratuberculosis
ccgccggcgucgccgc

SEQ ID NO: 2980403 - RNA, 23 nt, Mycobacterium avium subsp. paratuberculosis
ccgccggcgucgccgcucuucga

SEQ ID NO: 2980404 - RNA, 12 nt, Mycobacterium avium subsp. paratuberculosis
ccgccggcgucu

SEQ ID NO: 2980405 - RNA, 14 nt, Mycobacterium avium subsp. paratuberculosis
ccgccggcucagcg

SEQ ID NO: 2980406 - RNA, 15 nt, Mycobacterium avium subsp. paratuberculosis
ccgccggcucagcgg

SEQ ID NO: 2980407 - RNA, 16 nt, Mycobacterium avium subsp. paratuberculosis
ccgccggcucagcggc

SEQ ID NO: 2980408 - RNA, 17 nt, Mycobacterium avium subsp. paratuberculosis
ccgccggcucagcggca

SEQ ID NO: 2980409 - RNA, 21 nt, Mycobacterium avium subsp. paratuberculosis
ccgccgggauaacccagcacc

SEQ ID NO: 2980410 - RNA, 23 nt, Mycobacterium avium subsp. paratuberculosis
ccgccgggauaacccagcaccac

SEQ ID NO: 2980411 - RNA, 16 nt, Mycobacterium avium subsp. paratuberculosis
ccgccgggaucggcgg

SEQ ID NO: 2980412 - RNA, 18 nt, Mycobacterium avium subsp. paratuberculosis
ccgccgggaucggcgggg

SEQ ID NO: 2980413 - RNA, 18 nt, Mycobacterium avium subsp. paratuberculosis
ccgccgggaugcgccacc

SEQ ID NO: 2980414 - RNA, 22 nt, Mycobacterium avium subsp. paratuberculosis
ccgccgggaugcgccaccgaca

SEQ ID NO: 2980415 - RNA, 20 nt, Mycobacterium avium subsp. paratuberculosis
ccgccgggcaccucggcguc

SEQ ID NO: 2980416 - RNA, 17 nt, Mycobacterium avium subsp. paratuberculosis
ccgccgggcauccgggc

SEQ ID NO: 2980417 - RNA, 22 nt, Mycobacterium avium subsp. paratuberculosis
ccgccgggcauccgggccgccg

SEQ ID NO: 2980418 - RNA, 12 nt, Mycobacterium avium subsp. paratuberculosis
ccgccgggccag

SEQ ID NO: 2980419 - RNA, 14 nt, Mycobacterium avium subsp. paratuberculosis
ccgccgggccaggu

SEQ ID NO: 2980420 - RNA, 22 nt, Mycobacterium avium subsp. paratuberculosis
ccgccgggccaggugugcccgc

SEQ ID NO: 2980421 - RNA, 14 nt, Mycobacterium avium subsp. paratuberculosis
ccgccgggccgccg

SEQ ID NO: 2980422 - RNA, 15 nt, Mycobacterium avium subsp. paratuberculosis
ccgccgggccgccga

SEQ ID NO: 2980423 - RNA, 12 nt, Mycobacterium avium subsp. paratuberculosis
ccgccgggccgg

SEQ ID NO: 2980424 - RNA, 22 nt, Mycobacterium avium subsp. paratuberculosis
ccgccgggccggaucgcgcagu

SEQ ID NO: 2980425 - RNA, 16 nt, Mycobacterium avium subsp. paratuberculosis
ccgccgggccggcggc

SEQ ID NO: 2980426 - RNA, 19 nt, Mycobacterium avium subsp. paratuberculosis
ccgccgggcgccacgcugg

SEQ ID NO: 2980427 - RNA, 12 nt, Mycobacterium avium subsp. paratuberculosis
ccgccgggcgcg

SEQ ID NO: 2980428 - RNA, 14 nt, Mycobacterium avium subsp. paratuberculosis
ccgccgggcggcag

SEQ ID NO: 2980429 - RNA, 15 nt, Mycobacterium avium subsp. paratuberculosis
ccgccgggcggcagc

SEQ ID NO: 2980430 - RNA, 13 nt, Mycobacterium avium subsp. paratuberculosis
ccgccgggcggcg

SEQ ID NO: 2980431 - RNA, 15 nt, Mycobacterium avium subsp. paratuberculosis
ccgccgggcggcguc

SEQ ID NO: 2980432 - RNA, 12 nt, Mycobacterium avium subsp. paratuberculosis
ccgccgggcggg

SEQ ID NO: 2980433 - RNA, 14 nt, Mycobacterium avium subsp. paratuberculosis
ccgccgggcgggcc

SEQ ID NO: 2980434 - RNA, 15 nt, Mycobacterium avium subsp. paratuberculosis
ccgccgggcgggccg

SEQ ID NO: 2980435 - RNA, 16 nt, Mycobacterium avium subsp. paratuberculosis
ccgccgggcgggccgc

SEQ ID NO: 2980436 - RNA, 16 nt, Mycobacterium avium subsp. paratuberculosis
ccgccgggcgucgcgc

SEQ ID NO: 2980437 - RNA, 15 nt, Mycobacterium avium subsp. paratuberculosis
ccgccgggcugaccg

SEQ ID NO: 2980438 - RNA, 19 nt, Mycobacterium avium subsp. paratuberculosis
ccgccgggcugaccgucga

SEQ ID NO: 2980439 - RNA, 22 nt, Mycobacterium avium subsp. paratuberculosis
ccgccgggcugaccgucgacca

SEQ ID NO: 2980440 - RNA, 24 nt, Mycobacterium avium subsp. paratuberculosis
ccgccgggcugagcugugccgcgg

SEQ ID NO: 2980441 - RNA, 18 nt, Mycobacterium avium subsp. paratuberculosis
ccgccgggcuuccccaac

SEQ ID NO: 2980442 - RNA, 15 nt, Mycobacterium avium subsp. paratuberculosis
ccgccggggacccgc

SEQ ID NO: 2980443 - RNA, 19 nt, Mycobacterium avium subsp. paratuberculosis
ccgccggggacccgcaccg

SEQ ID NO: 2980444 - RNA, 21 nt, Mycobacterium avium subsp. paratuberculosis
ccgccggggacccgcaccgga

SEQ ID NO: 2980445 - RNA, 15 nt, Mycobacterium avium subsp. paratuberculosis
ccgccggggccccaa

SEQ ID NO: 2980446 - RNA, 16 nt, Mycobacterium avium subsp. paratuberculosis
ccgccggggccccaac

SEQ ID NO: 2980447 - RNA, 19 nt, Mycobacterium avium subsp. paratuberculosis
ccgccggggccccaacccc

SEQ ID NO: 2980448 - RNA, 12 nt, Mycobacterium avium subsp. paratuberculosis
ccgccggggccg

SEQ ID NO: 2980449 - RNA, 14 nt, Mycobacterium avium subsp. paratuberculosis
ccgccggggccggc

SEQ ID NO: 2980450 - RNA, 16 nt, Mycobacterium avium subsp. paratuberculosis
ccgccggggccggcga

SEQ ID NO: 2980451 - RNA, 18 nt, Mycobacterium avium subsp. paratuberculosis
ccgccggggccggcgaug

SEQ ID NO: 2980452 - RNA, 13 nt, Mycobacterium avium subsp. paratuberculosis
ccgccggggcgca

SEQ ID NO: 2980453 - RNA, 14 nt, Mycobacterium avium subsp. paratuberculosis
ccgccggggcgcag

SEQ ID NO: 2980454 - RNA, 15 nt, Mycobacterium avium subsp. paratuberculosis
ccgccggggcgccgc

SEQ ID NO: 2980455 - RNA, 16 nt, Mycobacterium avium subsp. paratuberculosis
ccgccggggcgccgcc

SEQ ID NO: 2980456 - RNA, 17 nt, Mycobacterium avium subsp. paratuberculosis
ccgccggggcgccgccg

SEQ ID NO: 2980457 - RNA, 19 nt, Mycobacterium avium subsp. paratuberculosis
ccgccggggcgccgccgaa

SEQ ID NO: 2980458 - RNA, 21 nt, Mycobacterium avium subsp. paratuberculosis
ccgccggggcgccgccgaaca

SEQ ID NO: 2980459 - RNA, 18 nt, Mycobacterium avium subsp. paratuberculosis
ccgccggggcgggcagca

SEQ ID NO: 2980460 - RNA, 14 nt, Mycobacterium avium subsp. paratuberculosis
ccgccggggcgucg

SEQ ID NO: 2980461 - RNA, 20 nt, Mycobacterium avium subsp. paratuberculosis
ccgccggggcgucggacgcc

SEQ ID NO: 2980462 - RNA, 14 nt, Mycobacterium avium subsp. paratuberculosis
ccgccgggguccgc

SEQ ID NO: 2980463 - RNA, 12 nt, Mycobacterium avium subsp. paratuberculosis
ccgccggggugc

SEQ ID NO: 2980464 - RNA, 19 nt, Mycobacterium avium subsp. paratuberculosis
ccgccggggugcaccgugg

SEQ ID NO: 2980465 - RNA, 16 nt, Mycobacterium avium subsp. paratuberculosis
ccgccggguccuugcg

SEQ ID NO: 2980466 - RNA, 15 nt, Mycobacterium avium subsp. paratuberculosis
ccgccggguggccgc

SEQ ID NO: 2980467 - RNA, 21 nt, Mycobacterium avium subsp. paratuberculosis
ccgccggguggccgccacguc

SEQ ID NO: 2980468 - RNA, 14 nt, Mycobacterium avium subsp. paratuberculosis
ccgccggguggcgg

SEQ ID NO: 2980469 - RNA, 15 nt, Mycobacterium avium subsp. paratuberculosis
ccgccggguggcggg

SEQ ID NO: 2980470 - RNA, 12 nt, Mycobacterium avium subsp. paratuberculosis
ccgccggucacg

SEQ ID NO: 2980471 - RNA, 16 nt, Mycobacterium avium subsp. paratuberculosis
ccgccggucacggcgu

SEQ ID NO: 2980472 - RNA, 17 nt, Mycobacterium avium subsp. paratuberculosis
ccgccggucacggcguc

SEQ ID NO: 2980473 - RNA, 22 nt, Mycobacterium avium subsp. paratuberculosis
ccgccggucacggcgucggcgu

SEQ ID NO: 2980474 - RNA, 16 nt, Mycobacterium avium subsp. paratuberculosis
ccgccgguccagugcc

SEQ ID NO: 2980475 - RNA, 19 nt, Mycobacterium avium subsp. paratuberculosis
ccgccgguccagugccggc

SEQ ID NO: 2980476 - RNA, 20 nt, Mycobacterium avium subsp. paratuberculosis
ccgccgguccagugccggcg

SEQ ID NO: 2980477 - RNA, 21 nt, Mycobacterium avium subsp. paratuberculosis
ccgccgguccagugccggcga

SEQ ID NO: 2980478 - RNA, 17 nt, Mycobacterium avium subsp. paratuberculosis
ccgccggucgcccccuc

SEQ ID NO: 2980479 - RNA, 20 nt, Mycobacterium avium subsp. paratuberculosis
ccgccggugaagaucagcgc

SEQ ID NO: 2980480 - RNA, 16 nt, Mycobacterium avium subsp. paratuberculosis
ccgccggugaccacgc

SEQ ID NO: 2980481 - RNA, 13 nt, Mycobacterium avium subsp. paratuberculosis
ccgccggugaucu

SEQ ID NO: 2980482 - RNA, 20 nt, Mycobacterium avium subsp. paratuberculosis
ccgccggugaucucccgugc

SEQ ID NO: 2980483 - RNA, 18 nt, Mycobacterium avium subsp. paratuberculosis
ccgccggugccagcaaca

SEQ ID NO: 2980484 - RNA, 19 nt, Mycobacterium avium subsp. paratuberculosis
ccgccggugccagcaacac

SEQ ID NO: 2980485 - RNA, 15 nt, Mycobacterium avium subsp. paratuberculosis
ccgccggugccgacg

SEQ ID NO: 2980486 - RNA, 16 nt, Mycobacterium avium subsp. paratuberculosis
ccgccggugccgacga

SEQ ID NO: 2980487 - RNA, 16 nt, Mycobacterium avium subsp. paratuberculosis
ccgccggugccguuga

SEQ ID NO: 2980488 - RNA, 15 nt, Mycobacterium avium subsp. paratuberculosis
ccgccggugcgcagc

SEQ ID NO: 2980489 - RNA, 22 nt, Mycobacterium avium subsp. paratuberculosis
ccgccgguggagauggccagca

SEQ ID NO: 2980490 - RNA, 23 nt, Mycobacterium avium subsp. paratuberculosis
ccgccgguggagauggccagcac

SEQ ID NO: 2980491 - RNA, 16 nt, Mycobacterium avium subsp. paratuberculosis
ccgccgguggccgcga

SEQ ID NO: 2980492 - RNA, 19 nt, Mycobacterium avium subsp. paratuberculosis
ccgccgguggccgcgcugg

SEQ ID NO: 2980493 - RNA, 13 nt, Mycobacterium avium subsp. paratuberculosis
ccgccgguggcgg

SEQ ID NO: 2980494 - RNA, 17 nt, Mycobacterium avium subsp. paratuberculosis
ccgccgguggcggcgag

SEQ ID NO: 2980495 - RNA, 19 nt, Mycobacterium avium subsp. paratuberculosis
ccgccgguggcggcgagga

SEQ ID NO: 2980496 - RNA, 15 nt, Mycobacterium avium subsp. paratuberculosis
ccgccgguggcgucg

SEQ ID NO: 2980497 - RNA, 19 nt, Mycobacterium avium subsp. paratuberculosis
ccgccgguggcgucgguga

SEQ ID NO: 2980498 - RNA, 22 nt, Mycobacterium avium subsp. paratuberculosis
ccgccgguggcgucggugaugc

SEQ ID NO: 2980499 - RNA, 17 nt, Mycobacterium avium subsp. paratuberculosis
ccgccgguggggugaug

SEQ ID NO: 2980500 - RNA, 18 nt, Mycobacterium avium subsp. paratuberculosis
ccgccggugucggcgacc

SEQ ID NO: 2980501 - RNA, 21 nt, Mycobacterium avium subsp. paratuberculosis
ccgccgguugaucacccgggu

SEQ ID NO: 2980502 - RNA, 17 nt, Mycobacterium avium subsp. paratuberculosis
ccgccguagccggcggu

SEQ ID NO: 2980503 - RNA, 19 nt, Mycobacterium avium subsp. paratuberculosis
ccgccguagccggcggugg

SEQ ID NO: 2980504 - RNA, 21 nt, Mycobacterium avium subsp. paratuberculosis
ccgccguagccggcgguggcc

SEQ ID NO: 2980505 - RNA, 16 nt, Mycobacterium avium subsp. paratuberculosis
ccgccguagcgccggc

SEQ ID NO: 2980506 - RNA, 20 nt, Mycobacterium avium subsp. paratuberculosis
ccgccguagcgccggcaaca

SEQ ID NO: 2980507 - RNA, 15 nt, Mycobacterium avium subsp. paratuberculosis
ccgccgucaccgcca

SEQ ID NO: 2980508 - RNA, 16 nt, Mycobacterium avium subsp. paratuberculosis
ccgccgucaccgccag

SEQ ID NO: 2980509 - RNA, 19 nt, Mycobacterium avium subsp. paratuberculosis
ccgccgucaccgccaggac

SEQ ID NO: 2980510 - RNA, 22 nt, Mycobacterium avium subsp. paratuberculosis
ccgccgucaccgccaggaccac

SEQ ID NO: 2980511 - RNA, 15 nt, Mycobacterium avium subsp. paratuberculosis
ccgccgucacgccgu

SEQ ID NO: 2980512 - RNA, 18 nt, Mycobacterium avium subsp. paratuberculosis
ccgccguccagcgucacc

SEQ ID NO: 2980513 - RNA, 17 nt, Mycobacterium avium subsp. paratuberculosis
ccgccgucccaccggcg

SEQ ID NO: 2980514 - RNA, 22 nt, Mycobacterium avium subsp. paratuberculosis
ccgccgucccaccggcgaugug

SEQ ID NO: 2980515 - RNA, 15 nt, Mycobacterium avium subsp. paratuberculosis
ccgccguccccgcgc

SEQ ID NO: 2980516 - RNA, 17 nt, Mycobacterium avium subsp. paratuberculosis
ccgccguccccgcgcgg

SEQ ID NO: 2980517 - RNA, 19 nt, Mycobacterium avium subsp. paratuberculosis
ccgccguccccgcgcggcu

SEQ ID NO: 2980518 - RNA, 20 nt, Mycobacterium avium subsp. paratuberculosis
ccgccguccccgcgcggcuc

SEQ ID NO: 2980519 - RNA, 21 nt, Mycobacterium avium subsp. paratuberculosis
ccgccguccccgcgcggcucg

SEQ ID NO: 2980520 - RNA, 19 nt, Mycobacterium avium subsp. paratuberculosis
ccgccgucccgucacggcu

SEQ ID NO: 2980521 - RNA, 22 nt, Mycobacterium avium subsp. paratuberculosis
ccgccguccugagguauucguc

SEQ ID NO: 2980522 - RNA, 12 nt, Mycobacterium avium subsp. paratuberculosis
ccgccgucgacc

SEQ ID NO: 2980523 - RNA, 14 nt, Mycobacterium avium subsp. paratuberculosis
ccgccgucgaccac

SEQ ID NO: 2980524 - RNA, 16 nt, Mycobacterium avium subsp. paratuberculosis
ccgccgucgaccacga

SEQ ID NO: 2980525 - RNA, 16 nt, Mycobacterium avium subsp. paratuberculosis
ccgccgucgacgacga

SEQ ID NO: 2980526 - RNA, 19 nt, Mycobacterium avium subsp. paratuberculosis
ccgccgucgacgcgugcgu

SEQ ID NO: 2980527 - RNA, 18 nt, Mycobacterium avium subsp. paratuberculosis
ccgccgucgccaccaccg

SEQ ID NO: 2980528 - RNA, 12 nt, Mycobacterium avium subsp. paratuberculosis
ccgccgucgggg

SEQ ID NO: 2980529 - RNA, 23 nt, Mycobacterium avium subsp. paratuberculosis
ccgccgucggggcgucggcggcc

SEQ ID NO: 2980530 - RNA, 14 nt, Mycobacterium avium subsp. paratuberculosis
ccgccgucggggug

SEQ ID NO: 2980531 - RNA, 15 nt, Mycobacterium avium subsp. paratuberculosis
ccgccgucggggugc

SEQ ID NO: 2980532 - RNA, 21 nt, Mycobacterium avium subsp. paratuberculosis
ccgccgucguagccgcgggug

SEQ ID NO: 2980533 - RNA, 20 nt, Mycobacterium avium subsp. paratuberculosis
ccgccgucuucccagugccg

SEQ ID NO: 2980534 - RNA, 15 nt, Mycobacterium avium subsp. paratuberculosis
ccgccgugaccggcg

SEQ ID NO: 2980535 - RNA, 16 nt, Mycobacterium avium subsp. paratuberculosis
ccgccgugaccggcga

SEQ ID NO: 2980536 - RNA, 22 nt, Mycobacterium avium subsp. paratuberculosis
ccgccgugcauccagccgucca

SEQ ID NO: 2980537 - RNA, 21 nt, Mycobacterium avium subsp. paratuberculosis
ccgccgugcgccccgcccugc

SEQ ID NO: 2980538 - RNA, 15 nt, Mycobacterium avium subsp. paratuberculosis
ccgccgugcgcggcg

SEQ ID NO: 2980539 - RNA, 13 nt, Mycobacterium avium subsp. paratuberculosis
ccgccguggacga

SEQ ID NO: 2980540 - RNA, 16 nt, Mycobacterium avium subsp. paratuberculosis
ccgccguggcagggcc

SEQ ID NO: 2980541 - RNA, 23 nt, Mycobacterium avium subsp. paratuberculosis
ccgccguggcagggccagcagcc

SEQ ID NO: 2980542 - RNA, 16 nt, Mycobacterium avium subsp. paratuberculosis
ccgccguggcccacgc

SEQ ID NO: 2980543 - RNA, 21 nt, Mycobacterium avium subsp. paratuberculosis
ccgccguggcguuacacccgc

SEQ ID NO: 2980544 - RNA, 18 nt, Mycobacterium avium subsp. paratuberculosis
ccgccguguaggccgcgc

SEQ ID NO: 2980545 - RNA, 21 nt, Mycobacterium avium subsp. paratuberculosis
ccgccguguaggccgcgcugg

SEQ ID NO: 2980546 - RNA, 22 nt, Mycobacterium avium subsp. paratuberculosis
ccgccguguaggccgcgcuggc

SEQ ID NO: 2980547 - RNA, 21 nt, Mycobacterium avium subsp. paratuberculosis
ccgccguuccgaugaagaaca

SEQ ID NO: 2980548 - RNA, 17 nt, Mycobacterium avium subsp. paratuberculosis
ccgccguucgccggcga

SEQ ID NO: 2980549 - RNA, 13 nt, Mycobacterium avium subsp. paratuberculosis
ccgccguucucgc

SEQ ID NO: 2980550 - RNA, 17 nt, Mycobacterium avium subsp. paratuberculosis
ccgccguucucgcgcag

SEQ ID NO: 2980551 - RNA, 18 nt, Mycobacterium avium subsp. paratuberculosis
ccgccguucucgcgcagg

SEQ ID NO: 2980552 - RNA, 22 nt, Mycobacterium avium subsp. paratuberculosis
ccgccguucucgcgcaggucac

SEQ ID NO: 2980553 - RNA, 14 nt, Mycobacterium avium subsp. paratuberculosis
ccgccguugaccgg

SEQ ID NO: 2980554 - RNA, 15 nt, Mycobacterium avium subsp. paratuberculosis
ccgccguugaccggu

SEQ ID NO: 2980555 - RNA, 18 nt, Mycobacterium avium subsp. paratuberculosis
ccgccguugaccggugcg

SEQ ID NO: 2980556 - RNA, 20 nt, Mycobacterium avium subsp. paratuberculosis
ccgccguugcgagucaucgc

SEQ ID NO: 2980557 - RNA, 22 nt, Mycobacterium avium subsp. paratuberculosis
ccgccguugcgagucaucgcca

SEQ ID NO: 2980558 - RNA, 16 nt, Mycobacterium avium subsp. paratuberculosis
ccgccguugcggccca

SEQ ID NO: 2980559 - RNA, 23 nt, Mycobacterium avium subsp. paratuberculosis
ccgccguuguugagcguggcagc

SEQ ID NO: 2980560 - RNA, 16 nt, Mycobacterium avium subsp. paratuberculosis
ccgccguuucagcagc

SEQ ID NO: 2980561 - RNA, 19 nt, Mycobacterium avium subsp. paratuberculosis
ccgccguuucagcagcgcg

SEQ ID NO: 2980562 - RNA, 20 nt, Mycobacterium avium subsp. paratuberculosis
ccgccguuucagcagcgcgu

SEQ ID NO: 2980563 - RNA, 17 nt, Mycobacterium avium subsp. paratuberculosis
ccgccuacuugaccagc

SEQ ID NO: 2980564 - RNA, 20 nt, Mycobacterium avium subsp. paratuberculosis
ccgccucacagcgacaacgg

SEQ ID NO: 2980565 - RNA, 22 nt, Mycobacterium avium subsp. paratuberculosis
ccgccucacagcgacaacgggc

SEQ ID NO: 2980566 - RNA, 14 nt, Mycobacterium avium subsp. paratuberculosis
ccgccucaccgaau

SEQ ID NO: 2980567 - RNA, 13 nt, Mycobacterium avium subsp. paratuberculosis
ccgccucaugcca

SEQ ID NO: 2980568 - RNA, 22 nt, Mycobacterium avium subsp. paratuberculosis
ccgccucaugccagacgcgcac

SEQ ID NO: 2980569 - RNA, 16 nt, Mycobacterium avium subsp. paratuberculosis
ccgccuccagcacguc

SEQ ID NO: 2980570 - RNA, 18 nt, Mycobacterium avium subsp. paratuberculosis
ccgccuccagcacgucgg

SEQ ID NO: 2980571 - RNA, 23 nt, Mycobacterium avium subsp. paratuberculosis
ccgccuccagcacgucggggugg

SEQ ID NO: 2980572 - RNA, 17 nt, Mycobacterium avium subsp. paratuberculosis
ccgccucccgcagcgcc

SEQ ID NO: 2980573 - RNA, 18 nt, Mycobacterium avium subsp. paratuberculosis
ccgccucccgcagcgcca

SEQ ID NO: 2980574 - RNA, 19 nt, Mycobacterium avium subsp. paratuberculosis
ccgccuccgacagccgcac

SEQ ID NO: 2980575 - RNA, 23 nt, Mycobacterium avium subsp. paratuberculosis
ccgccuccgacagccgcaccggc

SEQ ID NO: 2980576 - RNA, 13 nt, Mycobacterium avium subsp. paratuberculosis
ccgccuccgacca

SEQ ID NO: 2980577 - RNA, 15 nt, Mycobacterium avium subsp. paratuberculosis
ccgccuccgaccagc

SEQ ID NO: 2980578 - RNA, 16 nt, Mycobacterium avium subsp. paratuberculosis
ccgccuccgaccagcc

SEQ ID NO: 2980579 - RNA, 18 nt, Mycobacterium avium subsp. paratuberculosis
ccgccuccgaccagccgg

SEQ ID NO: 2980580 - RNA, 20 nt, Mycobacterium avium subsp. paratuberculosis
ccgccuccgaccagccgguc

SEQ ID NO: 2980581 - RNA, 13 nt, Mycobacterium avium subsp. paratuberculosis
ccgccuccgggcu

SEQ ID NO: 2980582 - RNA, 21 nt, Mycobacterium avium subsp. paratuberculosis
ccgccuccgggcugccguaga

SEQ ID NO: 2980583 - RNA, 20 nt, Mycobacterium avium subsp. paratuberculosis
ccgccuccgguuugcgccgg

SEQ ID NO: 2980584 - RNA, 23 nt, Mycobacterium avium subsp. paratuberculosis
ccgccuccgguuugcgccggcuc

SEQ ID NO: 2980585 - RNA, 19 nt, Mycobacterium avium subsp. paratuberculosis
ccgccucgaagucgccggc

SEQ ID NO: 2980586 - RNA, 21 nt, Mycobacterium avium subsp. paratuberculosis
ccgccucgaagucgccggccu

SEQ ID NO: 2980587 - RNA, 13 nt, Mycobacterium avium subsp. paratuberculosis
ccgccucgacggu

SEQ ID NO: 2980588 - RNA, 15 nt, Mycobacterium avium subsp. paratuberculosis
ccgccucgacgguga

SEQ ID NO: 2980589 - RNA, 13 nt, Mycobacterium avium subsp. paratuberculosis
ccgccucgccagc

SEQ ID NO: 2980590 - RNA, 22 nt, Mycobacterium avium subsp. paratuberculosis
ccgccucgccagccccaccggc

SEQ ID NO: 2980591 - RNA, 13 nt, Mycobacterium avium subsp. paratuberculosis
ccgccucgccggu

SEQ ID NO: 2980592 - RNA, 15 nt, Mycobacterium avium subsp. paratuberculosis
ccgccucgccgguca

SEQ ID NO: 2980593 - RNA, 16 nt, Mycobacterium avium subsp. paratuberculosis
ccgccucgccggucac

SEQ ID NO: 2980594 - RNA, 14 nt, Mycobacterium avium subsp. paratuberculosis
ccgccucggccacc

SEQ ID NO: 2980595 - RNA, 21 nt, Mycobacterium avium subsp. paratuberculosis
ccgccucggcgaggucgucga

SEQ ID NO: 2980596 - RNA, 14 nt, Mycobacterium avium subsp. paratuberculosis
ccgccucggcggcc

SEQ ID NO: 2980597 - RNA, 16 nt, Mycobacterium avium subsp. paratuberculosis
ccgccucggcggccgc

SEQ ID NO: 2980598 - RNA, 18 nt, Mycobacterium avium subsp. paratuberculosis
ccgccucggugagcagcu

SEQ ID NO: 2980599 - RNA, 14 nt, Mycobacterium avium subsp. paratuberculosis
ccgccucgucggga

SEQ ID NO: 2980600 - RNA, 16 nt, Mycobacterium avium subsp. paratuberculosis
ccgccugcccgggcgc

SEQ ID NO: 2980601 - RNA, 17 nt, Mycobacterium avium subsp. paratuberculosis
ccgccugcgcgaucgcc

SEQ ID NO: 2980602 - RNA, 21 nt, Mycobacterium avium subsp. paratuberculosis
ccgccugcgcgaucgccggau

SEQ ID NO: 2980603 - RNA, 14 nt, Mycobacterium avium subsp. paratuberculosis
ccgccugcgcgccg

SEQ ID NO: 2980604 - RNA, 15 nt, Mycobacterium avium subsp. paratuberculosis
ccgccugcgcgccgu

SEQ ID NO: 2980605 - RNA, 15 nt, Mycobacterium avium subsp. paratuberculosis
ccgccugcgcgggcg

SEQ ID NO: 2980606 - RNA, 18 nt, Mycobacterium avium subsp. paratuberculosis
ccgccugcgcgggcgcgg

SEQ ID NO: 2980607 - RNA, 19 nt, Mycobacterium avium subsp. paratuberculosis
ccgccugcgcgggcgcgga

SEQ ID NO: 2980608 - RNA, 23 nt, Mycobacterium avium subsp. paratuberculosis
ccgccugcgcgggcgcggacagc

SEQ ID NO: 2980609 - RNA, 14 nt, Mycobacterium avium subsp. paratuberculosis
ccgccugcggcagg

SEQ ID NO: 2980610 - RNA, 13 nt, Mycobacterium avium subsp. paratuberculosis
ccgccuggccacc

SEQ ID NO: 2980611 - RNA, 17 nt, Mycobacterium avium subsp. paratuberculosis
ccgccuggccaccucga

SEQ ID NO: 2980612 - RNA, 23 nt, Mycobacterium avium subsp. paratuberculosis
ccgccugucaguuugcgcgacgg

SEQ ID NO: 2980613 - RNA, 18 nt, Mycobacterium avium subsp. paratuberculosis
ccgccugugcgacggcgu

SEQ ID NO: 2980614 - RNA, 19 nt, Mycobacterium avium subsp. paratuberculosis
ccgccugugcgacggcguc

SEQ ID NO: 2980615 - RNA, 21 nt, Mycobacterium avium subsp. paratuberculosis
ccgccugugcgacggcgucgg

SEQ ID NO: 2980616 - RNA, 22 nt, Mycobacterium avium subsp. paratuberculosis
ccgccugugcgacggcgucggc

SEQ ID NO: 2980617 - RNA, 17 nt, Mycobacterium avium subsp. paratuberculosis
ccgccuucacgaccggc

SEQ ID NO: 2980618 - RNA, 19 nt, Mycobacterium avium subsp. paratuberculosis
ccgccuucacgaccggcag

SEQ ID NO: 2980619 - RNA, 13 nt, Mycobacterium avium subsp. paratuberculosis
ccgccuuccggga

SEQ ID NO: 2980620 - RNA, 15 nt, Mycobacterium avium subsp. paratuberculosis
ccgccuuccgggaau

SEQ ID NO: 2980621 - RNA, 14 nt, Mycobacterium avium subsp. paratuberculosis
ccgccuucgacgau

SEQ ID NO: 2980622 - RNA, 16 nt, Mycobacterium avium subsp. paratuberculosis
ccgccuucgacggccg

SEQ ID NO: 2980623 - RNA, 18 nt, Mycobacterium avium subsp. paratuberculosis
ccgccuucgacggccggc

SEQ ID NO: 2980624 - RNA, 20 nt, Mycobacterium avium subsp. paratuberculosis
ccgccuucgacggccggccc

SEQ ID NO: 2980625 - RNA, 19 nt, Mycobacterium avium subsp. paratuberculosis
ccgccuucgaugcccucca

SEQ ID NO: 2980626 - RNA, 19 nt, Mycobacterium avium subsp. paratuberculosis
ccgccuucuugcgcggcgc

SEQ ID NO: 2980627 - RNA, 17 nt, Mycobacterium avium subsp. paratuberculosis
ccgccuugacgccgggc

SEQ ID NO: 2980628 - RNA, 15 nt, Mycobacterium avium subsp. paratuberculosis
ccgccuugcccggcu

SEQ ID NO: 2980629 - RNA, 17 nt, Mycobacterium avium subsp. paratuberculosis
ccgccuugcccggcucg

SEQ ID NO: 2980630 - RNA, 16 nt, Mycobacterium avium subsp. paratuberculosis
ccgccuugggccgguc

SEQ ID NO: 2980631 - RNA, 23 nt, Mycobacterium avium subsp. paratuberculosis
ccgccuugggccggucggucggc

SEQ ID NO: 2980632 - RNA, 19 nt, Mycobacterium avium subsp. paratuberculosis
ccgccuuggugauccgggg

SEQ ID NO: 2980633 - RNA, 22 nt, Mycobacterium avium subsp. paratuberculosis
ccgccuuggugauccggggcac

SEQ ID NO: 2980634 - RNA, 15 nt, Mycobacterium avium subsp. paratuberculosis
ccgccuugucggcga

SEQ ID NO: 2980635 - RNA, 16 nt, Mycobacterium avium subsp. paratuberculosis
ccgccuuugagcgaca

SEQ ID NO: 2980636 - RNA, 21 nt, Mycobacterium avium subsp. paratuberculosis
ccgcgaaaaggcaagggcgau

SEQ ID NO: 2980637 - RNA, 16 nt, Mycobacterium avium subsp. paratuberculosis
ccgcgaaaauaccgcc

SEQ ID NO: 2980638 - RNA, 17 nt, Mycobacterium avium subsp. paratuberculosis
ccgcgaaaauaccgccg

SEQ ID NO: 2980639 - RNA, 18 nt, Mycobacterium avium subsp. paratuberculosis
ccgcgaaaauaccgccgg

SEQ ID NO: 2980640 - RNA, 21 nt, Mycobacterium avium subsp. paratuberculosis
ccgcgaaaauaccgccggccg

SEQ ID NO: 2980641 - RNA, 22 nt, Mycobacterium avium subsp. paratuberculosis
ccgcgaaaauaccgccggccgc

SEQ ID NO: 2980642 - RNA, 17 nt, Mycobacterium avium subsp. paratuberculosis
ccgcgaaacgcaacagc

SEQ ID NO: 2980643 - RNA, 14 nt, Mycobacterium avium subsp. paratuberculosis
ccgcgaaagcgucg

SEQ ID NO: 2980644 - RNA, 19 nt, Mycobacterium avium subsp. paratuberculosis
ccgcgaaaucuucgccguc

SEQ ID NO: 2980645 - RNA, 20 nt, Mycobacterium avium subsp. paratuberculosis
ccgcgaaaucuucgccguca

SEQ ID NO: 2980646 - RNA, 14 nt, Mycobacterium avium subsp. paratuberculosis
ccgcgaacacgcga

SEQ ID NO: 2980647 - RNA, 18 nt, Mycobacterium avium subsp. paratuberculosis
ccgcgaacaucgccagca

SEQ ID NO: 2980648 - RNA, 24 nt, Mycobacterium avium subsp. paratuberculosis
ccgcgaacaucgccagcaacgacc

SEQ ID NO: 2980649 - RNA, 14 nt, Mycobacterium avium subsp. paratuberculosis
ccgcgaacgccucg

SEQ ID NO: 2980650 - RNA, 15 nt, Mycobacterium avium subsp. paratuberculosis
ccgcgaacgccucgg

SEQ ID NO: 2980651 - RNA, 15 nt, Mycobacterium avium subsp. paratuberculosis
ccgcgaacgccucgu

SEQ ID NO: 2980652 - RNA, 22 nt, Mycobacterium avium subsp. paratuberculosis
ccgcgaacgccucguuggccag

SEQ ID NO: 2980653 - RNA, 23 nt, Mycobacterium avium subsp. paratuberculosis
ccgcgaacgccucguuggccagc

SEQ ID NO: 2980654 - RNA, 20 nt, Mycobacterium avium subsp. paratuberculosis
ccgcgaacggcccgccgccg

SEQ ID NO: 2980655 - RNA, 19 nt, Mycobacterium avium subsp. paratuberculosis
ccgcgaacgggugaccggc

SEQ ID NO: 2980656 - RNA, 21 nt, Mycobacterium avium subsp. paratuberculosis
ccgcgaacgggugaccggcgg

SEQ ID NO: 2980657 - RNA, 23 nt, Mycobacterium avium subsp. paratuberculosis
ccgcgaacgggugaccggcggcc

SEQ ID NO: 2980658 - RNA, 15 nt, Mycobacterium avium subsp. paratuberculosis
ccgcgaacgggugcg

SEQ ID NO: 2980659 - RNA, 19 nt, Mycobacterium avium subsp. paratuberculosis
ccgcgaacgggugcggcgc

SEQ ID NO: 2980660 - RNA, 14 nt, Mycobacterium avium subsp. paratuberculosis
ccgcgaacucgucg

SEQ ID NO: 2980661 - RNA, 18 nt, Mycobacterium avium subsp. paratuberculosis
ccgcgaacucgucgacgc

SEQ ID NO: 2980662 - RNA, 19 nt, Mycobacterium avium subsp. paratuberculosis
ccgcgaacucgucgacgcc

SEQ ID NO: 2980663 - RNA, 22 nt, Mycobacterium avium subsp. paratuberculosis
ccgcgaacucgucgaugcacgc

SEQ ID NO: 2980664 - RNA, 17 nt, Mycobacterium avium subsp. paratuberculosis
ccgcgaagaugucgccg

SEQ ID NO: 2980665 - RNA, 18 nt, Mycobacterium avium subsp. paratuberculosis
ccgcgaagaugucgccgu

SEQ ID NO: 2980666 - RNA, 17 nt, Mycobacterium avium subsp. paratuberculosis
ccgcgaaggcggcgucg

SEQ ID NO: 2980667 - RNA, 21 nt, Mycobacterium avium subsp. paratuberculosis
ccgcgaaggcggcgucgaugu

SEQ ID NO: 2980668 - RNA, 17 nt, Mycobacterium avium subsp. paratuberculosis
ccgcgaagguggcacgc

SEQ ID NO: 2980669 - RNA, 19 nt, Mycobacterium avium subsp. paratuberculosis
ccgcgaagguggcacgcca

SEQ ID NO: 2980670 - RNA, 20 nt, Mycobacterium avium subsp. paratuberculosis
ccgcgaaucgauaacgcgcg

SEQ ID NO: 2980671 - RNA, 21 nt, Mycobacterium avium subsp. paratuberculosis
ccgcgaauugagguagucggc

SEQ ID NO: 2980672 - RNA, 22 nt, Mycobacterium avium subsp. paratuberculosis
ccgcgaauuugguugcggugua

SEQ ID NO: 2980673 - RNA, 17 nt, Mycobacterium avium subsp. paratuberculosis
ccgcgacaaggucgacc

SEQ ID NO: 2980674 - RNA, 20 nt, Mycobacterium avium subsp. paratuberculosis
ccgcgacaaggucgaccgcg

SEQ ID NO: 2980675 - RNA, 21 nt, Mycobacterium avium subsp. paratuberculosis
ccgcgacaaggucgaccgcgc

SEQ ID NO: 2980676 - RNA, 17 nt, Mycobacterium avium subsp. paratuberculosis
ccgcgacacgccgcgca

SEQ ID NO: 2980677 - RNA, 16 nt, Mycobacterium avium subsp. paratuberculosis
ccgcgacacgucgaca

SEQ ID NO: 2980678 - RNA, 17 nt, Mycobacterium avium subsp. paratuberculosis
ccgcgacacgucgacac

SEQ ID NO: 2980679 - RNA, 19 nt, Mycobacterium avium subsp. paratuberculosis
ccgcgacacgucgacacgc

SEQ ID NO: 2980680 - RNA, 24 nt, Mycobacterium avium subsp. paratuberculosis
ccgcgacacgucgacacgccggcc

SEQ ID NO: 2980681 - RNA, 17 nt, Mycobacterium avium subsp. paratuberculosis
ccgcgacagccgcccgg

SEQ ID NO: 2980682 - RNA, 18 nt, Mycobacterium avium subsp. paratuberculosis
ccgcgacagccgcccggc

SEQ ID NO: 2980683 - RNA, 19 nt, Mycobacterium avium subsp. paratuberculosis
ccgcgacaucggcgccgac

SEQ ID NO: 2980684 - RNA, 17 nt, Mycobacterium avium subsp. paratuberculosis
ccgcgacaucggugacc

SEQ ID NO: 2980685 - RNA, 19 nt, Mycobacterium avium subsp. paratuberculosis
ccgcgacaucggugaccgu

SEQ ID NO: 2980686 - RNA, 14 nt, Mycobacterium avium subsp. paratuberculosis
ccgcgaccacagcg

SEQ ID NO: 2980687 - RNA, 14 nt, Mycobacterium avium subsp. paratuberculosis
ccgcgaccacgccg

SEQ ID NO: 2980688 - RNA, 15 nt, Mycobacterium avium subsp. paratuberculosis
ccgcgaccacgccgc

SEQ ID NO: 2980689 - RNA, 16 nt, Mycobacterium avium subsp. paratuberculosis
ccgcgaccacgccgcg

SEQ ID NO: 2980690 - RNA, 20 nt, Mycobacterium avium subsp. paratuberculosis
ccgcgaccacgccgcggucg

SEQ ID NO: 2980691 - RNA, 21 nt, Mycobacterium avium subsp. paratuberculosis
ccgcgaccacgccgcggucgc

SEQ ID NO: 2980692 - RNA, 12 nt, Mycobacterium avium subsp. paratuberculosis
ccgcgaccagcu

SEQ ID NO: 2980693 - RNA, 14 nt, Mycobacterium avium subsp. paratuberculosis
ccgcgaccagcucg

SEQ ID NO: 2980694 - RNA, 12 nt, Mycobacterium avium subsp. paratuberculosis
ccgcgacccaga

SEQ ID NO: 2980695 - RNA, 20 nt, Mycobacterium avium subsp. paratuberculosis
ccgcgacccagacuugggca

SEQ ID NO: 2980696 - RNA, 14 nt, Mycobacterium avium subsp. paratuberculosis
ccgcgacccaggcc

SEQ ID NO: 2980697 - RNA, 15 nt, Mycobacterium avium subsp. paratuberculosis
ccgcgacccaggccg

SEQ ID NO: 2980698 - RNA, 18 nt, Mycobacterium avium subsp. paratuberculosis
ccgcgacccaggccgccg

SEQ ID NO: 2980699 - RNA, 19 nt, Mycobacterium avium subsp. paratuberculosis
ccgcgacccaggccgccgc

SEQ ID NO: 2980700 - RNA, 22 nt, Mycobacterium avium subsp. paratuberculosis
ccgcgaccccuccaacggccgc

SEQ ID NO: 2980701 - RNA, 22 nt, Mycobacterium avium subsp. paratuberculosis
ccgcgacccgaacuucagcgcg

SEQ ID NO: 2980702 - RNA, 14 nt, Mycobacterium avium subsp. paratuberculosis
ccgcgacccggccg

SEQ ID NO: 2980703 - RNA, 15 nt, Mycobacterium avium subsp. paratuberculosis
ccgcgacccggccga

SEQ ID NO: 2980704 - RNA, 23 nt, Mycobacterium avium subsp. paratuberculosis
ccgcgacccggccgagcgcgccg

SEQ ID NO: 2980705 - RNA, 15 nt, Mycobacterium avium subsp. paratuberculosis
ccgcgacccgggccg

SEQ ID NO: 2980706 - RNA, 17 nt, Mycobacterium avium subsp. paratuberculosis
ccgcgacccgggccgcc

SEQ ID NO: 2980707 - RNA, 22 nt, Mycobacterium avium subsp. paratuberculosis
ccgcgacccgggccgccacggc

SEQ ID NO: 2980708 - RNA, 12 nt, Mycobacterium avium subsp. paratuberculosis
ccgcgaccgcag

SEQ ID NO: 2980709 - RNA, 13 nt, Mycobacterium avium subsp. paratuberculosis
ccgcgaccgcagc

SEQ ID NO: 2980710 - RNA, 12 nt, Mycobacterium avium subsp. paratuberculosis
ccgcgaccgccu

SEQ ID NO: 2980711 - RNA, 15 nt, Mycobacterium avium subsp. paratuberculosis
ccgcgaccgccucgu

SEQ ID NO: 2980712 - RNA, 22 nt, Mycobacterium avium subsp. paratuberculosis
ccgcgaccgcgaucagggccgc

SEQ ID NO: 2980713 - RNA, 17 nt, Mycobacterium avium subsp. paratuberculosis
ccgcgaccgucagcagg

SEQ ID NO: 2980714 - RNA, 20 nt, Mycobacterium avium subsp. paratuberculosis
ccgcgaccgucagcagggcc

SEQ ID NO: 2980715 - RNA, 14 nt, Mycobacterium avium subsp. paratuberculosis
ccgcgaccgucauc

SEQ ID NO: 2980716 - RNA, 19 nt, Mycobacterium avium subsp. paratuberculosis
ccgcgacgaacugccguug

SEQ ID NO: 2980717 - RNA, 17 nt, Mycobacterium avium subsp. paratuberculosis
ccgcgacgacaccaccg

SEQ ID NO: 2980718 - RNA, 21 nt, Mycobacterium avium subsp. paratuberculosis
ccgcgacgacaccaccgugcu

SEQ ID NO: 2980719 - RNA, 14 nt, Mycobacterium avium subsp. paratuberculosis
ccgcgacgacaccg

SEQ ID NO: 2980720 - RNA, 17 nt, Mycobacterium avium subsp. paratuberculosis
ccgcgacgaccgccugc

SEQ ID NO: 2980721 - RNA, 15 nt, Mycobacterium avium subsp. paratuberculosis
ccgcgacgaccucgc

SEQ ID NO: 2980722 - RNA, 19 nt, Mycobacterium avium subsp. paratuberculosis
ccgcgacgaccucgcccgc

SEQ ID NO: 2980723 - RNA, 20 nt, Mycobacterium avium subsp. paratuberculosis
ccgcgacgaccucgcccgcc

SEQ ID NO: 2980724 - RNA, 21 nt, Mycobacterium avium subsp. paratuberculosis
ccgcgacgaccucgcccgccg

SEQ ID NO: 2980725 - RNA, 23 nt, Mycobacterium avium subsp. paratuberculosis
ccgcgacgaccucgcccgccgcg

SEQ ID NO: 2980726 - RNA, 14 nt, Mycobacterium avium subsp. paratuberculosis
ccgcgacgaucacg

SEQ ID NO: 2980727 - RNA, 21 nt, Mycobacterium avium subsp. paratuberculosis
ccgcgacgaucgcgacggccg

SEQ ID NO: 2980728 - RNA, 16 nt, Mycobacterium avium subsp. paratuberculosis
ccgcgacgaugccggc

SEQ ID NO: 2980729 - RNA, 19 nt, Mycobacterium avium subsp. paratuberculosis
ccgcgacgaugccggcguc

SEQ ID NO: 2980730 - RNA, 20 nt, Mycobacterium avium subsp. paratuberculosis
ccgcgacgaugccggcgucg

SEQ ID NO: 2980731 - RNA, 20 nt, Mycobacterium avium subsp. paratuberculosis
ccgcgacgaugucgacccgc

SEQ ID NO: 2980732 - RNA, 14 nt, Mycobacterium avium subsp. paratuberculosis
ccgcgacgccagca

SEQ ID NO: 2980733 - RNA, 15 nt, Mycobacterium avium subsp. paratuberculosis
ccgcgacgccagcac

SEQ ID NO: 2980734 - RNA, 17 nt, Mycobacterium avium subsp. paratuberculosis
ccgcgacgccagcaccu

SEQ ID NO: 2980735 - RNA, 15 nt, Mycobacterium avium subsp. paratuberculosis
ccgcgacgcccaggu

SEQ ID NO: 2980736 - RNA, 16 nt, Mycobacterium avium subsp. paratuberculosis
ccgcgacgcccaggug

SEQ ID NO: 2980737 - RNA, 22 nt, Mycobacterium avium subsp. paratuberculosis
ccgcgacgcccaggugcacccg

SEQ ID NO: 2980738 - RNA, 24 nt, Mycobacterium avium subsp. paratuberculosis
ccgcgacgcccaggugcacccgau

SEQ ID NO: 2980739 - RNA, 19 nt, Mycobacterium avium subsp. paratuberculosis
ccgcgacgccgccgccgag

SEQ ID NO: 2980740 - RNA, 15 nt, Mycobacterium avium subsp. paratuberculosis
ccgcgacgccgugcu

SEQ ID NO: 2980741 - RNA, 17 nt, Mycobacterium avium subsp. paratuberculosis
ccgcgacgcugagcgcc

SEQ ID NO: 2980742 - RNA, 20 nt, Mycobacterium avium subsp. paratuberculosis
ccgcgacgcugagcgccagg

SEQ ID NO: 2980743 - RNA, 14 nt, Mycobacterium avium subsp. paratuberculosis
ccgcgacgcugccg

SEQ ID NO: 2980744 - RNA, 21 nt, Mycobacterium avium subsp. paratuberculosis
ccgcgacgcugccggggcgca

SEQ ID NO: 2980745 - RNA, 16 nt, Mycobacterium avium subsp. paratuberculosis
ccgcgacgcugccggu

SEQ ID NO: 2980746 - RNA, 15 nt, Mycobacterium avium subsp. paratuberculosis
ccgcgacggaccagu

SEQ ID NO: 2980747 - RNA, 13 nt, Mycobacterium avium subsp. paratuberculosis
ccgcgacggccgc

SEQ ID NO: 2980748 - RNA, 14 nt, Mycobacterium avium subsp. paratuberculosis
ccgcgacggccgcc

SEQ ID NO: 2980749 - RNA, 15 nt, Mycobacterium avium subsp. paratuberculosis
ccgcgacggccgccg

SEQ ID NO: 2980750 - RNA, 16 nt, Mycobacterium avium subsp. paratuberculosis
ccgcgacggccgccga

SEQ ID NO: 2980751 - RNA, 12 nt, Mycobacterium avium subsp. paratuberculosis
ccgcgacggcga

SEQ ID NO: 2980752 - RNA, 18 nt, Mycobacterium avium subsp. paratuberculosis
ccgcgacggcgagccggg

SEQ ID NO: 2980753 - RNA, 19 nt, Mycobacterium avium subsp. paratuberculosis
ccgcgacggcgagccgggc

SEQ ID NO: 2980754 - RNA, 23 nt, Mycobacterium avium subsp. paratuberculosis
ccgcgacggcgagccgggccggg

SEQ ID NO: 2980755 - RNA, 13 nt, Mycobacterium avium subsp. paratuberculosis
ccgcgacggcgcc

SEQ ID NO: 2980756 - RNA, 13 nt, Mycobacterium avium subsp. paratuberculosis
ccgcgacggcggg

SEQ ID NO: 2980757 - RNA, 17 nt, Mycobacterium avium subsp. paratuberculosis
ccgcgacggcgggucga

SEQ ID NO: 2980758 - RNA, 20 nt, Mycobacterium avium subsp. paratuberculosis
ccgcgacgggcugucccggc

SEQ ID NO: 2980759 - RNA, 23 nt, Mycobacterium avium subsp. paratuberculosis
ccgcgacgggcugucccggccgc

SEQ ID NO: 2980760 - RNA, 24 nt, Mycobacterium avium subsp. paratuberculosis
ccgcgacggguugcggaucggugc

SEQ ID NO: 2980761 - RNA, 20 nt, Mycobacterium avium subsp. paratuberculosis
ccgcgacggucaguccgggu

SEQ ID NO: 2980762 - RNA, 22 nt, Mycobacterium avium subsp. paratuberculosis
ccgcgacggucaguccggguug

SEQ ID NO: 2980763 - RNA, 13 nt, Mycobacterium avium subsp. paratuberculosis
ccgcgacggugag

SEQ ID NO: 2980764 - RNA, 21 nt, Mycobacterium avium subsp. paratuberculosis
ccgcgacggugagcaacaccg

SEQ ID NO: 2980765 - RNA, 18 nt, Mycobacterium avium subsp. paratuberculosis
ccgcgacgguuguucagc

SEQ ID NO: 2980766 - RNA, 22 nt, Mycobacterium avium subsp. paratuberculosis
ccgcgacguccaucgggaccgc

SEQ ID NO: 2980767 - RNA, 17 nt, Mycobacterium avium subsp. paratuberculosis
ccgcgacgucgguguag

SEQ ID NO: 2980768 - RNA, 22 nt, Mycobacterium avium subsp. paratuberculosis
ccgcgacgucgguguagucggc

SEQ ID NO: 2980769 - RNA, 23 nt, Mycobacterium avium subsp. paratuberculosis
ccgcgacgucgguguagucggcg

SEQ ID NO: 2980770 - RNA, 14 nt, Mycobacterium avium subsp. paratuberculosis
ccgcgacguggcgc

SEQ ID NO: 2980771 - RNA, 16 nt, Mycobacterium avium subsp. paratuberculosis
ccgcgacucggugucg

SEQ ID NO: 2980772 - RNA, 14 nt, Mycobacterium avium subsp. paratuberculosis
ccgcgacugcaccc

SEQ ID NO: 2980773 - RNA, 14 nt, Mycobacterium avium subsp. paratuberculosis
ccgcgacugcaggu

SEQ ID NO: 2980774 - RNA, 17 nt, Mycobacterium avium subsp. paratuberculosis
ccgcgacugucggcgcc

SEQ ID NO: 2980775 - RNA, 22 nt, Mycobacterium avium subsp. paratuberculosis
ccgcgacugucggcgccccgcc

SEQ ID NO: 2980776 - RNA, 16 nt, Mycobacterium avium subsp. paratuberculosis
ccgcgacugucggcuc

SEQ ID NO: 2980777 - RNA, 18 nt, Mycobacterium avium subsp. paratuberculosis
ccgcgacugucggcucgc

SEQ ID NO: 2980778 - RNA, 19 nt, Mycobacterium avium subsp. paratuberculosis
ccgcgacugucggcucgcc

SEQ ID NO: 2980779 - RNA, 14 nt, Mycobacterium avium subsp. paratuberculosis
ccgcgagacccggu

SEQ ID NO: 2980780 - RNA, 15 nt, Mycobacterium avium subsp. paratuberculosis
ccgcgagacccgguc

SEQ ID NO: 2980781 - RNA, 18 nt, Mycobacterium avium subsp. paratuberculosis
ccgcgagaucagcgccau

SEQ ID NO: 2980782 - RNA, 19 nt, Mycobacterium avium subsp. paratuberculosis
ccgcgagcacgacgucgac

SEQ ID NO: 2980783 - RNA, 14 nt, Mycobacterium avium subsp. paratuberculosis
ccgcgagcagacac

SEQ ID NO: 2980784 - RNA, 20 nt, Mycobacterium avium subsp. paratuberculosis
ccgcgagcagacacaaaagc

SEQ ID NO: 2980785 - RNA, 13 nt, Mycobacterium avium subsp. paratuberculosis
ccgcgagcccggc

SEQ ID NO: 2980786 - RNA, 14 nt, Mycobacterium avium subsp. paratuberculosis
ccgcgagcccggcg

SEQ ID NO: 2980787 - RNA, 14 nt, Mycobacterium avium subsp. paratuberculosis
ccgcgagccgagcc

SEQ ID NO: 2980788 - RNA, 21 nt, Mycobacterium avium subsp. paratuberculosis
ccgcgagccgcccaggcgggc

SEQ ID NO: 2980789 - RNA, 14 nt, Mycobacterium avium subsp. paratuberculosis
ccgcgagcgcagca

SEQ ID NO: 2980790 - RNA, 16 nt, Mycobacterium avium subsp. paratuberculosis
ccgcgagcgcagcagg

SEQ ID NO: 2980791 - RNA, 17 nt, Mycobacterium avium subsp. paratuberculosis
ccgcgagcgcgcgguga

SEQ ID NO: 2980792 - RNA, 21 nt, Mycobacterium avium subsp. paratuberculosis
ccgcgagcgcgcggugaugac

SEQ ID NO: 2980793 - RNA, 17 nt, Mycobacterium avium subsp. paratuberculosis
ccgcgagcgcuaccgcg

SEQ ID NO: 2980794 - RNA, 12 nt, Mycobacterium avium subsp. paratuberculosis
ccgcgagcugcc

SEQ ID NO: 2980795 - RNA, 13 nt, Mycobacterium avium subsp. paratuberculosis
ccgcgagcugccc

SEQ ID NO: 2980796 - RNA, 21 nt, Mycobacterium avium subsp. paratuberculosis
ccgcgagcugccccuucgcga

SEQ ID NO: 2980797 - RNA, 17 nt, Mycobacterium avium subsp. paratuberculosis
ccgcgaggaaucgcggc

SEQ ID NO: 2980798 - RNA, 19 nt, Mycobacterium avium subsp. paratuberculosis
ccgcgaggaaucgcggcag

SEQ ID NO: 2980799 - RNA, 20 nt, Mycobacterium avium subsp. paratuberculosis
ccgcgaggauuucgcucagc

SEQ ID NO: 2980800 - RNA, 22 nt, Mycobacterium avium subsp. paratuberculosis
ccgcgaggauuucgcucagccg

SEQ ID NO: 2980801 - RNA, 19 nt, Mycobacterium avium subsp. paratuberculosis
ccgcgagucaccggcucgc

SEQ ID NO: 2980802 - RNA, 21 nt, Mycobacterium avium subsp. paratuberculosis
ccgcgaguuguacccuucggc

SEQ ID NO: 2980803 - RNA, 19 nt, Mycobacterium avium subsp. paratuberculosis
ccgcgauagccaucagaac

SEQ ID NO: 2980804 - RNA, 24 nt, Mycobacterium avium subsp. paratuberculosis
ccgcgaucaacaccgguccggccg

SEQ ID NO: 2980805 - RNA, 16 nt, Mycobacterium avium subsp. paratuberculosis
ccgcgaucaccacccc

SEQ ID NO: 2980806 - RNA, 20 nt, Mycobacterium avium subsp. paratuberculosis
ccgcgaucaccaccccggug

SEQ ID NO: 2980807 - RNA, 14 nt, Mycobacterium avium subsp. paratuberculosis
ccgcgaucaccgag

SEQ ID NO: 2980808 - RNA, 21 nt, Mycobacterium avium subsp. paratuberculosis
ccgcgaucagccccagggugc

SEQ ID NO: 2980809 - RNA, 13 nt, Mycobacterium avium subsp. paratuberculosis
ccgcgaucagcuc

SEQ ID NO: 2980810 - RNA, 21 nt, Mycobacterium avium subsp. paratuberculosis
ccgcgaucagcucguggcggg

SEQ ID NO: 2980811 - RNA, 13 nt, Mycobacterium avium subsp. paratuberculosis
ccgcgaucagggc

SEQ ID NO: 2980812 - RNA, 23 nt, Mycobacterium avium subsp. paratuberculosis
ccgcgaucagggcccacagcagc

SEQ ID NO: 2980813 - RNA, 18 nt, Mycobacterium avium subsp. paratuberculosis
ccgcgaucagggccgcgg

SEQ ID NO: 2980814 - RNA, 19 nt, Mycobacterium avium subsp. paratuberculosis
ccgcgaucagggccgcggc

SEQ ID NO: 2980815 - RNA, 23 nt, Mycobacterium avium subsp. paratuberculosis
ccgcgaucagggccgcggccgcc

SEQ ID NO: 2980816 - RNA, 19 nt, Mycobacterium avium subsp. paratuberculosis
ccgcgauccagcgcuggcc

SEQ ID NO: 2980817 - RNA, 13 nt, Mycobacterium avium subsp. paratuberculosis
ccgcgauccgggc

SEQ ID NO: 2980818 - RNA, 16 nt, Mycobacterium avium subsp. paratuberculosis
ccgcgauccgggcaug

SEQ ID NO: 2980819 - RNA, 23 nt, Mycobacterium avium subsp. paratuberculosis
ccgcgaucgaguaguccgggaug

SEQ ID NO: 2980820 - RNA, 16 nt, Mycobacterium avium subsp. paratuberculosis
ccgcgaucgccaacgc

SEQ ID NO: 2980821 - RNA, 22 nt, Mycobacterium avium subsp. paratuberculosis
ccgcgaucgccagcgcgguguc

SEQ ID NO: 2980822 - RNA, 23 nt, Mycobacterium avium subsp. paratuberculosis
ccgcgaucgccagcgcggugucg

SEQ ID NO: 2980823 - RNA, 13 nt, Mycobacterium avium subsp. paratuberculosis
ccgcgaucgccga

SEQ ID NO: 2980824 - RNA, 19 nt, Mycobacterium avium subsp. paratuberculosis
ccgcgaucgccgacgucgg

SEQ ID NO: 2980825 - RNA, 17 nt, Mycobacterium avium subsp. paratuberculosis
ccgcgaucggauggugc

SEQ ID NO: 2980826 - RNA, 20 nt, Mycobacterium avium subsp. paratuberculosis
ccgcgaucggauggugccca

SEQ ID NO: 2980827 - RNA, 14 nt, Mycobacterium avium subsp. paratuberculosis
ccgcgaucggcgcc

SEQ ID NO: 2980828 - RNA, 16 nt, Mycobacterium avium subsp. paratuberculosis
ccgcgaucggcgccac

SEQ ID NO: 2980829 - RNA, 17 nt, Mycobacterium avium subsp. paratuberculosis
ccgcgaucggcgccacg

SEQ ID NO: 2980830 - RNA, 22 nt, Mycobacterium avium subsp. paratuberculosis
ccgcgaucggcgccacgaccag

SEQ ID NO: 2980831 - RNA, 14 nt, Mycobacterium avium subsp. paratuberculosis
ccgcgaucggcgug

SEQ ID NO: 2980832 - RNA, 22 nt, Mycobacterium avium subsp. paratuberculosis
ccgcgaucgucucgucgagaaa

SEQ ID NO: 2980833 - RNA, 22 nt, Mycobacterium avium subsp. paratuberculosis
ccgcgaucuccuuguugacgau

SEQ ID NO: 2980834 - RNA, 20 nt, Mycobacterium avium subsp. paratuberculosis
ccgcgaucucggcggacucg

SEQ ID NO: 2980835 - RNA, 21 nt, Mycobacterium avium subsp. paratuberculosis
ccgcgaucucggcggacucgg

SEQ ID NO: 2980836 - RNA, 20 nt, Mycobacterium avium subsp. paratuberculosis
ccgcgaucugcucggugucg

SEQ ID NO: 2980837 - RNA, 20 nt, Mycobacterium avium subsp. paratuberculosis
ccgcgaucuugccgccgcgg

SEQ ID NO: 2980838 - RNA, 15 nt, Mycobacterium avium subsp. paratuberculosis
ccgcgaugaucacac

SEQ ID NO: 2980839 - RNA, 23 nt, Mycobacterium avium subsp. paratuberculosis
ccgcgaugaucacacccacgaac

SEQ ID NO: 2980840 - RNA, 15 nt, Mycobacterium avium subsp. paratuberculosis
ccgcgaugauggcgu

SEQ ID NO: 2980841 - RNA, 18 nt, Mycobacterium avium subsp. paratuberculosis
ccgcgaugauggcgucga

SEQ ID NO: 2980842 - RNA, 19 nt, Mycobacterium avium subsp. paratuberculosis
ccgcgaugauggcgucgac

SEQ ID NO: 2980843 - RNA, 16 nt, Mycobacterium avium subsp. paratuberculosis
ccgcgaugcaacaccg

SEQ ID NO: 2980844 - RNA, 16 nt, Mycobacterium avium subsp. paratuberculosis
ccgcgaugcccgccgg

SEQ ID NO: 2980845 - RNA, 15 nt, Mycobacterium avium subsp. paratuberculosis
ccgcgaugcgacacc

SEQ ID NO: 2980846 - RNA, 17 nt, Mycobacterium avium subsp. paratuberculosis
ccgcgaugcgacaccgc

SEQ ID NO: 2980847 - RNA, 18 nt, Mycobacterium avium subsp. paratuberculosis
ccgcgaugcgacaccgcg

SEQ ID NO: 2980848 - RNA, 17 nt, Mycobacterium avium subsp. paratuberculosis
ccgcgauggcacacagc

SEQ ID NO: 2980849 - RNA, 14 nt, Mycobacterium avium subsp. paratuberculosis
ccgcgauggcccgc

SEQ ID NO: 2980850 - RNA, 18 nt, Mycobacterium avium subsp. paratuberculosis
ccgcgauggccuccgacc

SEQ ID NO: 2980851 - RNA, 20 nt, Mycobacterium avium subsp. paratuberculosis
ccgcgauggccuccgacccg

SEQ ID NO: 2980852 - RNA, 22 nt, Mycobacterium avium subsp. paratuberculosis
ccgcgauggccuccgacccguc

SEQ ID NO: 2980853 - RNA, 23 nt, Mycobacterium avium subsp. paratuberculosis
ccgcgauggccuccgacccgucc

SEQ ID NO: 2980854 - RNA, 13 nt, Mycobacterium avium subsp. paratuberculosis
ccgcgaugguggc

SEQ ID NO: 2980855 - RNA, 20 nt, Mycobacterium avium subsp. paratuberculosis
ccgcgaugucggugggccgc

SEQ ID NO: 2980856 - RNA, 22 nt, Mycobacterium avium subsp. paratuberculosis
ccgcgaugucggugggccgcac

SEQ ID NO: 2980857 - RNA, 23 nt, Mycobacterium avium subsp. paratuberculosis
ccgcgaugucggugggccgcacc

SEQ ID NO: 2980858 - RNA, 17 nt, Mycobacterium avium subsp. paratuberculosis
ccgcgcaaccgggccgc

SEQ ID NO: 2980859 - RNA, 19 nt, Mycobacterium avium subsp. paratuberculosis
ccgcgcaaccgggccgcac

SEQ ID NO: 2980860 - RNA, 18 nt, Mycobacterium avium subsp. paratuberculosis
ccgcgcaauacccgacca

SEQ ID NO: 2980861 - RNA, 22 nt, Mycobacterium avium subsp. paratuberculosis
ccgcgcaauacccgaccagcac

SEQ ID NO: 2980862 - RNA, 22 nt, Mycobacterium avium subsp. paratuberculosis
ccgcgcaaucaaaaaccccgcu

SEQ ID NO: 2980863 - RNA, 12 nt, Mycobacterium avium subsp. paratuberculosis
ccgcgcaccacg

SEQ ID NO: 2980864 - RNA, 21 nt, Mycobacterium avium subsp. paratuberculosis
ccgcgcaccccgaaccgcccg

SEQ ID NO: 2980865 - RNA, 22 nt, Mycobacterium avium subsp. paratuberculosis
ccgcgcaccccgaaccgcccgc

SEQ ID NO: 2980866 - RNA, 12 nt, Mycobacterium avium subsp. paratuberculosis
ccgcgcaccgcc

SEQ ID NO: 2980867 - RNA, 15 nt, Mycobacterium avium subsp. paratuberculosis
ccgcgcaccgccccg

SEQ ID NO: 2980868 - RNA, 14 nt, Mycobacterium avium subsp. paratuberculosis
ccgcgcaccggcgc

SEQ ID NO: 2980869 - RNA, 13 nt, Mycobacterium avium subsp. paratuberculosis
ccgcgcaccguca

SEQ ID NO: 2980870 - RNA, 22 nt, Mycobacterium avium subsp. paratuberculosis
ccgcgcaccgucaucgcggcga

SEQ ID NO: 2980871 - RNA, 14 nt, Mycobacterium avium subsp. paratuberculosis
ccgcgcacgcucgc

SEQ ID NO: 2980872 - RNA, 20 nt, Mycobacterium avium subsp. paratuberculosis
ccgcgcacgcucgcggugcg

SEQ ID NO: 2980873 - RNA, 17 nt, Mycobacterium avium subsp. paratuberculosis
ccgcgcagaaccgcacc

SEQ ID NO: 2980874 - RNA, 21 nt, Mycobacterium avium subsp. paratuberculosis
ccgcgcagaaccgcaccccgu

SEQ ID NO: 2980875 - RNA, 14 nt, Mycobacterium avium subsp. paratuberculosis
ccgcgcagaucgau

SEQ ID NO: 2980876 - RNA, 19 nt, Mycobacterium avium subsp. paratuberculosis
ccgcgcagaucgaugggga

SEQ ID NO: 2980877 - RNA, 19 nt, Mycobacterium avium subsp. paratuberculosis
ccgcgcagaucgccagcac

SEQ ID NO: 2980878 - RNA, 21 nt, Mycobacterium avium subsp. paratuberculosis
ccgcgcagaucgccagcaccg

SEQ ID NO: 2980879 - RNA, 13 nt, Mycobacterium avium subsp. paratuberculosis
ccgcgcagcaccg

SEQ ID NO: 2980880 - RNA, 21 nt, Mycobacterium avium subsp. paratuberculosis
ccgcgcagcaccgucaccuuc

SEQ ID NO: 2980881 - RNA, 22 nt, Mycobacterium avium subsp. paratuberculosis
ccgcgcagcagcguuccgucgg

SEQ ID NO: 2980882 - RNA, 23 nt, Mycobacterium avium subsp. paratuberculosis
ccgcgcagcagcguuccgucggc

SEQ ID NO: 2980883 - RNA, 17 nt, Mycobacterium avium subsp. paratuberculosis
ccgcgcagccagaccuc

SEQ ID NO: 2980884 - RNA, 16 nt, Mycobacterium avium subsp. paratuberculosis
ccgcgcagccagguga

SEQ ID NO: 2980885 - RNA, 19 nt, Mycobacterium avium subsp. paratuberculosis
ccgcgcagccaggugaaca

SEQ ID NO: 2980886 - RNA, 16 nt, Mycobacterium avium subsp. paratuberculosis
ccgcgcagcggggcgc

SEQ ID NO: 2980887 - RNA, 13 nt, Mycobacterium avium subsp. paratuberculosis
ccgcgcagcgugu

SEQ ID NO: 2980888 - RNA, 16 nt, Mycobacterium avium subsp. paratuberculosis
ccgcgcagcgugucgg

SEQ ID NO: 2980889 - RNA, 21 nt, Mycobacterium avium subsp. paratuberculosis
ccgcgcagcgugucggggucg

SEQ ID NO: 2980890 - RNA, 12 nt, Mycobacterium avium subsp. paratuberculosis
ccgcgcagcucg

SEQ ID NO: 2980891 - RNA, 13 nt, Mycobacterium avium subsp. paratuberculosis
ccgcgcagcucga

SEQ ID NO: 2980892 - RNA, 17 nt, Mycobacterium avium subsp. paratuberculosis
ccgcgcagcucgacgac

SEQ ID NO: 2980893 - RNA, 22 nt, Mycobacterium avium subsp. paratuberculosis
ccgcgcagcucgacgaccucgc

SEQ ID NO: 2980894 - RNA, 23 nt, Mycobacterium avium subsp. paratuberculosis
ccgcgcagcucgacgaccucgcc

SEQ ID NO: 2980895 - RNA, 22 nt, Mycobacterium avium subsp. paratuberculosis
ccgcgcagcucggggucggcgu

SEQ ID NO: 2980896 - RNA, 16 nt, Mycobacterium avium subsp. paratuberculosis
ccgcgcaggccccggg

SEQ ID NO: 2980897 - RNA, 17 nt, Mycobacterium avium subsp. paratuberculosis
ccgcgcaggccccgggg

SEQ ID NO: 2980898 - RNA, 15 nt, Mycobacterium avium subsp. paratuberculosis
ccgcgcaggccgccg

SEQ ID NO: 2980899 - RNA, 16 nt, Mycobacterium avium subsp. paratuberculosis
ccgcgcaggccgccga

SEQ ID NO: 2980900 - RNA, 19 nt, Mycobacterium avium subsp. paratuberculosis
ccgcgcaggccgccgacga

SEQ ID NO: 2980901 - RNA, 16 nt, Mycobacterium avium subsp. paratuberculosis
ccgcgcaggccgucca

SEQ ID NO: 2980902 - RNA, 17 nt, Mycobacterium avium subsp. paratuberculosis
ccgcgcaggccguccag

SEQ ID NO: 2980903 - RNA, 15 nt, Mycobacterium avium subsp. paratuberculosis
ccgcgcaggcggcga

SEQ ID NO: 2980904 - RNA, 23 nt, Mycobacterium avium subsp. paratuberculosis
ccgcgcaggcggcgacggccguc

SEQ ID NO: 2980905 - RNA, 17 nt, Mycobacterium avium subsp. paratuberculosis
ccgcgcagucggcgucg

SEQ ID NO: 2980906 - RNA, 18 nt, Mycobacterium avium subsp. paratuberculosis
ccgcgcagucggcgucgc

SEQ ID NO: 2980907 - RNA, 20 nt, Mycobacterium avium subsp. paratuberculosis
ccgcgcagucggcgucgcgg

SEQ ID NO: 2980908 - RNA, 21 nt, Mycobacterium avium subsp. paratuberculosis
ccgcgcagucggcgucgcggc

SEQ ID NO: 2980909 - RNA, 17 nt, Mycobacterium avium subsp. paratuberculosis
ccgcgcaucaucgccca

SEQ ID NO: 2980910 - RNA, 20 nt, Mycobacterium avium subsp. paratuberculosis
ccgcgcaucaucgcccagcg

SEQ ID NO: 2980911 - RNA, 17 nt, Mycobacterium avium subsp. paratuberculosis
ccgcgcauguuggugau

SEQ ID NO: 2980912 - RNA, 22 nt, Mycobacterium avium subsp. paratuberculosis
ccgcgcauguuggugaucagcc

SEQ ID NO: 2980913 - RNA, 17 nt, Mycobacterium avium subsp. paratuberculosis
ccgcgcauucaccagcu

SEQ ID NO: 2980914 - RNA, 19 nt, Mycobacterium avium subsp. paratuberculosis
ccgcgcauucaccagcugu

SEQ ID NO: 2980915 - RNA, 14 nt, Mycobacterium avium subsp. paratuberculosis
ccgcgccacagcgu

SEQ ID NO: 2980916 - RNA, 24 nt, Mycobacterium avium subsp. paratuberculosis
ccgcgccacagcgucucgaccgcg

SEQ ID NO: 2980917 - RNA, 15 nt, Mycobacterium avium subsp. paratuberculosis
ccgcgccaccgcggg

SEQ ID NO: 2980918 - RNA, 22 nt, Mycobacterium avium subsp. paratuberculosis
ccgcgccacguaucgcgccugc

SEQ ID NO: 2980919 - RNA, 14 nt, Mycobacterium avium subsp. paratuberculosis
ccgcgccagcaccu

SEQ ID NO: 2980920 - RNA, 15 nt, Mycobacterium avium subsp. paratuberculosis
ccgcgccagcaccuc

SEQ ID NO: 2980921 - RNA, 13 nt, Mycobacterium avium subsp. paratuberculosis
ccgcgccagccgc

SEQ ID NO: 2980922 - RNA, 18 nt, Mycobacterium avium subsp. paratuberculosis
ccgcgccagccgccgccg

SEQ ID NO: 2980923 - RNA, 19 nt, Mycobacterium avium subsp. paratuberculosis
ccgcgccagccgccgccga

SEQ ID NO: 2980924 - RNA, 20 nt, Mycobacterium avium subsp. paratuberculosis
ccgcgccagcucggcggccg

SEQ ID NO: 2980925 - RNA, 12 nt, Mycobacterium avium subsp. paratuberculosis
ccgcgcccaccc

SEQ ID NO: 2980926 - RNA, 12 nt, Mycobacterium avium subsp. paratuberculosis
ccgcgcccaccu

SEQ ID NO: 2980927 - RNA, 15 nt, Mycobacterium avium subsp. paratuberculosis
ccgcgcccaccugga

SEQ ID NO: 2980928 - RNA, 14 nt, Mycobacterium avium subsp. paratuberculosis
ccgcgcccagcacg

SEQ ID NO: 2980929 - RNA, 17 nt, Mycobacterium avium subsp. paratuberculosis
ccgcgcccagcacguca

SEQ ID NO: 2980930 - RNA, 20 nt, Mycobacterium avium subsp. paratuberculosis
ccgcgcccagcacgucaccg

SEQ ID NO: 2980931 - RNA, 13 nt, Mycobacterium avium subsp. paratuberculosis
ccgcgcccagccc

SEQ ID NO: 2980932 - RNA, 16 nt, Mycobacterium avium subsp. paratuberculosis
ccgcgcccagccccag

SEQ ID NO: 2980933 - RNA, 20 nt, Mycobacterium avium subsp. paratuberculosis
ccgcgcccaggggagcggcg

SEQ ID NO: 2980934 - RNA, 14 nt, Mycobacterium avium subsp. paratuberculosis
ccgcgcccagugug

SEQ ID NO: 2980935 - RNA, 15 nt, Mycobacterium avium subsp. paratuberculosis
ccgcgcccagugugg

SEQ ID NO: 2980936 - RNA, 14 nt, Mycobacterium avium subsp. paratuberculosis
ccgcgcccaucgcg

SEQ ID NO: 2980937 - RNA, 18 nt, Mycobacterium avium subsp. paratuberculosis
ccgcgcccaucgcggccg

SEQ ID NO: 2980938 - RNA, 19 nt, Mycobacterium avium subsp. paratuberculosis
ccgcgcccaucgcggccgc

SEQ ID NO: 2980939 - RNA, 17 nt, Mycobacterium avium subsp. paratuberculosis
ccgcgcccaugaacgcg

SEQ ID NO: 2980940 - RNA, 22 nt, Mycobacterium avium subsp. paratuberculosis
ccgcgcccaugaacgcgucgcc

SEQ ID NO: 2980941 - RNA, 13 nt, Mycobacterium avium subsp. paratuberculosis
ccgcgccccggcg

SEQ ID NO: 2980942 - RNA, 14 nt, Mycobacterium avium subsp. paratuberculosis
ccgcgccccggcgc

SEQ ID NO: 2980943 - RNA, 17 nt, Mycobacterium avium subsp. paratuberculosis
ccgcgccccggcgcagc

SEQ ID NO: 2980944 - RNA, 17 nt, Mycobacterium avium subsp. paratuberculosis
ccgcgccccggcgcgcc

SEQ ID NO: 2980945 - RNA, 18 nt, Mycobacterium avium subsp. paratuberculosis
ccgcgccccggcgcgccu

SEQ ID NO: 2980946 - RNA, 18 nt, Mycobacterium avium subsp. paratuberculosis
ccgcgccccggcggccac

SEQ ID NO: 2980947 - RNA, 13 nt, Mycobacterium avium subsp. paratuberculosis
ccgcgcccgcccc

SEQ ID NO: 2980948 - RNA, 16 nt, Mycobacterium avium subsp. paratuberculosis
ccgcgcccgccccguu

SEQ ID NO: 2980949 - RNA, 13 nt, Mycobacterium avium subsp. paratuberculosis
ccgcgcccgccgc

SEQ ID NO: 2980950 - RNA, 15 nt, Mycobacterium avium subsp. paratuberculosis
ccgcgcccgccgcgu

SEQ ID NO: 2980951 - RNA, 20 nt, Mycobacterium avium subsp. paratuberculosis
ccgcgcccgccgcguacacc

SEQ ID NO: 2980952 - RNA, 14 nt, Mycobacterium avium subsp. paratuberculosis
ccgcgcccgccggc

SEQ ID NO: 2980953 - RNA, 19 nt, Mycobacterium avium subsp. paratuberculosis
ccgcgcccgccggcccagc

SEQ ID NO: 2980954 - RNA, 20 nt, Mycobacterium avium subsp. paratuberculosis
ccgcgcccgccggcccagcu

SEQ ID NO: 2980955 - RNA, 14 nt, Mycobacterium avium subsp. paratuberculosis
ccgcgcccgcucga

SEQ ID NO: 2980956 - RNA, 12 nt, Mycobacterium avium subsp. paratuberculosis
ccgcgcccggcu

SEQ ID NO: 2980957 - RNA, 13 nt, Mycobacterium avium subsp. paratuberculosis
ccgcgcccggcuu

SEQ ID NO: 2980958 - RNA, 18 nt, Mycobacterium avium subsp. paratuberculosis
ccgcgcccggcuucgccg

SEQ ID NO: 2980959 - RNA, 20 nt, Mycobacterium avium subsp. paratuberculosis
ccgcgcccggcuucgccgcg

SEQ ID NO: 2980960 - RNA, 11 nt, Mycobacterium avium subsp. paratuberculosis
ccgcgcccguc

SEQ ID NO: 2980961 - RNA, 17 nt, Mycobacterium avium subsp. paratuberculosis
ccgcgcccgucgagcgu

SEQ ID NO: 2980962 - RNA, 21 nt, Mycobacterium avium subsp. paratuberculosis
ccgcgcccgucgagcgucacg

SEQ ID NO: 2980963 - RNA, 20 nt, Mycobacterium avium subsp. paratuberculosis
ccgcgcccuggugcaacacc

SEQ ID NO: 2980964 - RNA, 21 nt, Mycobacterium avium subsp. paratuberculosis
ccgcgcccuggugcaacaccg

SEQ ID NO: 2980965 - RNA, 20 nt, Mycobacterium avium subsp. paratuberculosis
ccgcgcccuucuucgcgggu

SEQ ID NO: 2980966 - RNA, 16 nt, Mycobacterium avium subsp. paratuberculosis
ccgcgccgaacaacug

SEQ ID NO: 2980967 - RNA, 19 nt, Mycobacterium avium subsp. paratuberculosis
ccgcgccgaacgcaccacc

SEQ ID NO: 2980968 - RNA, 22 nt, Mycobacterium avium subsp. paratuberculosis
ccgcgccgaacgcaccaccgcg

SEQ ID NO: 2980969 - RNA, 12 nt, Mycobacterium avium subsp. paratuberculosis
ccgcgccgacca

SEQ ID NO: 2980970 - RNA, 14 nt, Mycobacterium avium subsp. paratuberculosis
ccgcgccgaccagc

SEQ ID NO: 2980971 - RNA, 15 nt, Mycobacterium avium subsp. paratuberculosis
ccgcgccgaccagcg

SEQ ID NO: 2980972 - RNA, 16 nt, Mycobacterium avium subsp. paratuberculosis
ccgcgccgaccagcgc

SEQ ID NO: 2980973 - RNA, 17 nt, Mycobacterium avium subsp. paratuberculosis
ccgcgccgaccagcgcg

SEQ ID NO: 2980974 - RNA, 20 nt, Mycobacterium avium subsp. paratuberculosis
ccgcgccgaccagcgcguug

SEQ ID NO: 2980975 - RNA, 21 nt, Mycobacterium avium subsp. paratuberculosis
ccgcgccgaccagcgcguuga

SEQ ID NO: 2980976 - RNA, 12 nt, Mycobacterium avium subsp. paratuberculosis
ccgcgccgaccu

SEQ ID NO: 2980977 - RNA, 19 nt, Mycobacterium avium subsp. paratuberculosis
ccgcgccgaccucgucggc

SEQ ID NO: 2980978 - RNA, 13 nt, Mycobacterium avium subsp. paratuberculosis
ccgcgccgacggc

SEQ ID NO: 2980979 - RNA, 15 nt, Mycobacterium avium subsp. paratuberculosis
ccgcgccgacggccg

SEQ ID NO: 2980980 - RNA, 16 nt, Mycobacterium avium subsp. paratuberculosis
ccgcgccgacggccgc

SEQ ID NO: 2980981 - RNA, 17 nt, Mycobacterium avium subsp. paratuberculosis
ccgcgccgacggccgcg

SEQ ID NO: 2980982 - RNA, 18 nt, Mycobacterium avium subsp. paratuberculosis
ccgcgccgacggccgcgc

SEQ ID NO: 2980983 - RNA, 19 nt, Mycobacterium avium subsp. paratuberculosis
ccgcgccgacggccgcgcc

SEQ ID NO: 2980984 - RNA, 21 nt, Mycobacterium avium subsp. paratuberculosis
ccgcgccgacggccgcgccgu

SEQ ID NO: 2980985 - RNA, 16 nt, Mycobacterium avium subsp. paratuberculosis
ccgcgccgagcaaccg

SEQ ID NO: 2980986 - RNA, 16 nt, Mycobacterium avium subsp. paratuberculosis
ccgcgccgaggcgcuc

SEQ ID NO: 2980987 - RNA, 14 nt, Mycobacterium avium subsp. paratuberculosis
ccgcgccgaucacg

SEQ ID NO: 2980988 - RNA, 22 nt, Mycobacterium avium subsp. paratuberculosis
ccgcgccgccacaccucggcga

SEQ ID NO: 2980989 - RNA, 23 nt, Mycobacterium avium subsp. paratuberculosis
ccgcgccgccacaccucggcgac

SEQ ID NO: 2980990 - RNA, 15 nt, Mycobacterium avium subsp. paratuberculosis
ccgcgccgcccggag

SEQ ID NO: 2980991 - RNA, 16 nt, Mycobacterium avium subsp. paratuberculosis
ccgcgccgcccggagg

SEQ ID NO: 2980992 - RNA, 16 nt, Mycobacterium avium subsp. paratuberculosis
ccgcgccgcccggcga

SEQ ID NO: 2980993 - RNA, 18 nt, Mycobacterium avium subsp. paratuberculosis
ccgcgccgcccggcgauc

SEQ ID NO: 2980994 - RNA, 19 nt, Mycobacterium avium subsp. paratuberculosis
ccgcgccgcccggcgaucu

SEQ ID NO: 2980995 - RNA, 22 nt, Mycobacterium avium subsp. paratuberculosis
ccgcgccgcccggcgaucucgg

SEQ ID NO: 2980996 - RNA, 11 nt, Mycobacterium avium subsp. paratuberculosis
ccgcgccgccg

SEQ ID NO: 2980997 - RNA, 12 nt, Mycobacterium avium subsp. paratuberculosis
ccgcgccgccga

SEQ ID NO: 2980998 - RNA, 14 nt, Mycobacterium avium subsp. paratuberculosis
ccgcgccgccgcca

SEQ ID NO: 2980999 - RNA, 16 nt, Mycobacterium avium subsp. paratuberculosis
ccgcgccgccgccagc

SEQ ID NO: 2981000 - RNA, 16 nt, Mycobacterium avium subsp. paratuberculosis
ccgcgccgccgcccug

SEQ ID NO: 2981001 - RNA, 20 nt, Mycobacterium avium subsp. paratuberculosis
ccgcgccgccgcccuggccc

SEQ ID NO: 2981002 - RNA, 13 nt, Mycobacterium avium subsp. paratuberculosis
ccgcgccgccuuc

SEQ ID NO: 2981003 - RNA, 13 nt, Mycobacterium avium subsp. paratuberculosis
ccgcgccgcgccg

SEQ ID NO: 2981004 - RNA, 17 nt, Mycobacterium avium subsp. paratuberculosis
ccgcgccgcgccgccuu

SEQ ID NO: 2981005 - RNA, 13 nt, Mycobacterium avium subsp. paratuberculosis
ccgcgccgcggcc

SEQ ID NO: 2981006 - RNA, 14 nt, Mycobacterium avium subsp. paratuberculosis
ccgcgccgcggcca

SEQ ID NO: 2981007 - RNA, 18 nt, Mycobacterium avium subsp. paratuberculosis
ccgcgccgcggccagcgc

SEQ ID NO: 2981008 - RNA, 14 nt, Mycobacterium avium subsp. paratuberculosis
ccgcgccgcgucgu

SEQ ID NO: 2981009 - RNA, 15 nt, Mycobacterium avium subsp. paratuberculosis
ccgcgccgcgucguc

SEQ ID NO: 2981010 - RNA, 21 nt, Mycobacterium avium subsp. paratuberculosis
ccgcgccgcgucgucgucgac

SEQ ID NO: 2981011 - RNA, 13 nt, Mycobacterium avium subsp. paratuberculosis
ccgcgccggccgg

SEQ ID NO: 2981012 - RNA, 15 nt, Mycobacterium avium subsp. paratuberculosis
ccgcgccggccggac

SEQ ID NO: 2981013 - RNA, 16 nt, Mycobacterium avium subsp. paratuberculosis
ccgcgccggccggaca

SEQ ID NO: 2981014 - RNA, 13 nt, Mycobacterium avium subsp. paratuberculosis
ccgcgccggcggc

SEQ ID NO: 2981015 - RNA, 14 nt, Mycobacterium avium subsp. paratuberculosis
ccgcgccggcggcg

SEQ ID NO: 2981016 - RNA, 16 nt, Mycobacterium avium subsp. paratuberculosis
ccgcgccggcggcggc

SEQ ID NO: 2981017 - RNA, 12 nt, Mycobacterium avium subsp. paratuberculosis
ccgcgccggcgu

SEQ ID NO: 2981018 - RNA, 13 nt, Mycobacterium avium subsp. paratuberculosis
ccgcgccggcgug

SEQ ID NO: 2981019 - RNA, 20 nt, Mycobacterium avium subsp. paratuberculosis
ccgcgccggcgugucggcgc

SEQ ID NO: 2981020 - RNA, 13 nt, Mycobacterium avium subsp. paratuberculosis
ccgcgccgggcaa

SEQ ID NO: 2981021 - RNA, 13 nt, Mycobacterium avium subsp. paratuberculosis
ccgcgccgggcac

SEQ ID NO: 2981022 - RNA, 17 nt, Mycobacterium avium subsp. paratuberculosis
ccgcgccgggcaccacc

SEQ ID NO: 2981023 - RNA, 22 nt, Mycobacterium avium subsp. paratuberculosis
ccgcgccgggcgaagucgccgg

SEQ ID NO: 2981024 - RNA, 23 nt, Mycobacterium avium subsp. paratuberculosis
ccgcgccgggcgaagucgccggc

SEQ ID NO: 2981025 - RNA, 13 nt, Mycobacterium avium subsp. paratuberculosis
ccgcgccggggug

SEQ ID NO: 2981026 - RNA, 14 nt, Mycobacterium avium subsp. paratuberculosis
ccgcgccggggugg

SEQ ID NO: 2981027 - RNA, 22 nt, Mycobacterium avium subsp. paratuberculosis
ccgcgccggggugggccaucgg

SEQ ID NO: 2981028 - RNA, 14 nt, Mycobacterium avium subsp. paratuberculosis
ccgcgccggggugu

SEQ ID NO: 2981029 - RNA, 21 nt, Mycobacterium avium subsp. paratuberculosis
ccgcgccgggguguccagcgg

SEQ ID NO: 2981030 - RNA, 21 nt, Mycobacterium avium subsp. paratuberculosis
ccgcgccggucccgcggcggc

SEQ ID NO: 2981031 - RNA, 14 nt, Mycobacterium avium subsp. paratuberculosis
ccgcgccgguccgg

SEQ ID NO: 2981032 - RNA, 12 nt, Mycobacterium avium subsp. paratuberculosis
ccgcgccggugu

SEQ ID NO: 2981033 - RNA, 20 nt, Mycobacterium avium subsp. paratuberculosis
ccgcgccgguguucggcgcc

SEQ ID NO: 2981034 - RNA, 23 nt, Mycobacterium avium subsp. paratuberculosis
ccgcgccgguguucggcgccagc

SEQ ID NO: 2981035 - RNA, 12 nt, Mycobacterium avium subsp. paratuberculosis
ccgcgccgucgu

SEQ ID NO: 2981036 - RNA, 13 nt, Mycobacterium avium subsp. paratuberculosis
ccgcgccgucguc

SEQ ID NO: 2981037 - RNA, 15 nt, Mycobacterium avium subsp. paratuberculosis
ccgcgccgucgucga

SEQ ID NO: 2981038 - RNA, 22 nt, Mycobacterium avium subsp. paratuberculosis
ccgcgccgucgucgucggccgg

SEQ ID NO: 2981039 - RNA, 18 nt, Mycobacterium avium subsp. paratuberculosis
ccgcgccgucuuccgggc

SEQ ID NO: 2981040 - RNA, 20 nt, Mycobacterium avium subsp. paratuberculosis
ccgcgccgucuuccgggcca

SEQ ID NO: 2981041 - RNA, 17 nt, Mycobacterium avium subsp. paratuberculosis
ccgcgccgugcgccagc

SEQ ID NO: 2981042 - RNA, 22 nt, Mycobacterium avium subsp. paratuberculosis
ccgcgccgugcgccagcgaccg

SEQ ID NO: 2981043 - RNA, 19 nt, Mycobacterium avium subsp. paratuberculosis
ccgcgccgugggcgucacg

SEQ ID NO: 2981044 - RNA, 19 nt, Mycobacterium avium subsp. paratuberculosis
ccgcgccguugaccgcggc

SEQ ID NO: 2981045 - RNA, 18 nt, Mycobacterium avium subsp. paratuberculosis
ccgcgccucguugagcac

SEQ ID NO: 2981046 - RNA, 13 nt, Mycobacterium avium subsp. paratuberculosis
ccgcgccuggcgc

SEQ ID NO: 2981047 - RNA, 15 nt, Mycobacterium avium subsp. paratuberculosis
ccgcgccuggcgcag

SEQ ID NO: 2981048 - RNA, 17 nt, Mycobacterium avium subsp. paratuberculosis
ccgcgccuggcgcaggg

SEQ ID NO: 2981049 - RNA, 20 nt, Mycobacterium avium subsp. paratuberculosis
ccgcgccuggcgcagggcgu

SEQ ID NO: 2981050 - RNA, 20 nt, Mycobacterium avium subsp. paratuberculosis
ccgcgccuucgacccggugg

SEQ ID NO: 2981051 - RNA, 14 nt, Mycobacterium avium subsp. paratuberculosis
ccgcgccuucuugc

SEQ ID NO: 2981052 - RNA, 22 nt, Mycobacterium avium subsp. paratuberculosis
ccgcgccuucuugcugcccgcg

SEQ ID NO: 2981053 - RNA, 19 nt, Mycobacterium avium subsp. paratuberculosis
ccgcgccuuugacguucgc

SEQ ID NO: 2981054 - RNA, 16 nt, Mycobacterium avium subsp. paratuberculosis
ccgcgcgacaucaccg

SEQ ID NO: 2981055 - RNA, 19 nt, Mycobacterium avium subsp. paratuberculosis
ccgcgcgacaucaccgcgg

SEQ ID NO: 2981056 - RNA, 22 nt, Mycobacterium avium subsp. paratuberculosis
ccgcgcgacaucaccgcgggcg

SEQ ID NO: 2981057 - RNA, 17 nt, Mycobacterium avium subsp. paratuberculosis
ccgcgcgaccaucagcc

SEQ ID NO: 2981058 - RNA, 19 nt, Mycobacterium avium subsp. paratuberculosis
ccgcgcgaccaucagcccg

SEQ ID NO: 2981059 - RNA, 21 nt, Mycobacterium avium subsp. paratuberculosis
ccgcgcgaccaucagcccggu

SEQ ID NO: 2981060 - RNA, 14 nt, Mycobacterium avium subsp. paratuberculosis
ccgcgcgacgccgu

SEQ ID NO: 2981061 - RNA, 20 nt, Mycobacterium avium subsp. paratuberculosis
ccgcgcgagaguaucgccac

SEQ ID NO: 2981062 - RNA, 22 nt, Mycobacterium avium subsp. paratuberculosis
ccgcgcgagaguaucgccacgc

SEQ ID NO: 2981063 - RNA, 23 nt, Mycobacterium avium subsp. paratuberculosis
ccgcgcgagaguaucgccacgcc

SEQ ID NO: 2981064 - RNA, 15 nt, Mycobacterium avium subsp. paratuberculosis
ccgcgcgagcagacg

SEQ ID NO: 2981065 - RNA, 12 nt, Mycobacterium avium subsp. paratuberculosis
ccgcgcgagcgc

SEQ ID NO: 2981066 - RNA, 21 nt, Mycobacterium avium subsp. paratuberculosis
ccgcgcgagcgcagcgccagg

SEQ ID NO: 2981067 - RNA, 22 nt, Mycobacterium avium subsp. paratuberculosis
ccgcgcgagcgcagcgccaggc

SEQ ID NO: 2981068 - RNA, 13 nt, Mycobacterium avium subsp. paratuberculosis
ccgcgcgagcgcg

SEQ ID NO: 2981069 - RNA, 14 nt, Mycobacterium avium subsp. paratuberculosis
ccgcgcgagcgcgc

SEQ ID NO: 2981070 - RNA, 17 nt, Mycobacterium avium subsp. paratuberculosis
ccgcgcgaucaggccgg

SEQ ID NO: 2981071 - RNA, 19 nt, Mycobacterium avium subsp. paratuberculosis
ccgcgcgaucaggccggcc

SEQ ID NO: 2981072 - RNA, 20 nt, Mycobacterium avium subsp. paratuberculosis
ccgcgcgaucaggccggcca

SEQ ID NO: 2981073 - RNA, 15 nt, Mycobacterium avium subsp. paratuberculosis
ccgcgcgaucggcga

SEQ ID NO: 2981074 - RNA, 17 nt, Mycobacterium avium subsp. paratuberculosis
ccgcgcgaucggcgagc

SEQ ID NO: 2981075 - RNA, 18 nt, Mycobacterium avium subsp. paratuberculosis
ccgcgcgaucggcgagcc

SEQ ID NO: 2981076 - RNA, 19 nt, Mycobacterium avium subsp. paratuberculosis
ccgcgcgaucggcgagccg

SEQ ID NO: 2981077 - RNA, 13 nt, Mycobacterium avium subsp. paratuberculosis
ccgcgcgcaccac

SEQ ID NO: 2981078 - RNA, 14 nt, Mycobacterium avium subsp. paratuberculosis
ccgcgcgcaccacg

SEQ ID NO: 2981079 - RNA, 14 nt, Mycobacterium avium subsp. paratuberculosis
ccgcgcgcaggcac

SEQ ID NO: 2981080 - RNA, 18 nt, Mycobacterium avium subsp. paratuberculosis
ccgcgcgcaggccccggc

SEQ ID NO: 2981081 - RNA, 20 nt, Mycobacterium avium subsp. paratuberculosis
ccgcgcgcaggccccggcgc

SEQ ID NO: 2981082 - RNA, 16 nt, Mycobacterium avium subsp. paratuberculosis
ccgcgcgcaggcgcug

SEQ ID NO: 2981083 - RNA, 16 nt, Mycobacterium avium subsp. paratuberculosis
ccgcgcgccagcgcgu

SEQ ID NO: 2981084 - RNA, 18 nt, Mycobacterium avium subsp. paratuberculosis
ccgcgcgccagcgcgugc

SEQ ID NO: 2981085 - RNA, 12 nt, Mycobacterium avium subsp. paratuberculosis
ccgcgcgcccgc

SEQ ID NO: 2981086 - RNA, 14 nt, Mycobacterium avium subsp. paratuberculosis
ccgcgcgcccgcgg

SEQ ID NO: 2981087 - RNA, 13 nt, Mycobacterium avium subsp. paratuberculosis
ccgcgcgcccguc

SEQ ID NO: 2981088 - RNA, 18 nt, Mycobacterium avium subsp. paratuberculosis
ccgcgcgcccgucgucgg

SEQ ID NO: 2981089 - RNA, 19 nt, Mycobacterium avium subsp. paratuberculosis
ccgcgcgcccgucgucggu

SEQ ID NO: 2981090 - RNA, 12 nt, Mycobacterium avium subsp. paratuberculosis
ccgcgcgccgac

SEQ ID NO: 2981091 - RNA, 14 nt, Mycobacterium avium subsp. paratuberculosis
ccgcgcgccgacag

SEQ ID NO: 2981092 - RNA, 13 nt, Mycobacterium avium subsp. paratuberculosis
ccgcgcgccgaga

SEQ ID NO: 2981093 - RNA, 13 nt, Mycobacterium avium subsp. paratuberculosis
ccgcgcgccggcc

SEQ ID NO: 2981094 - RNA, 14 nt, Mycobacterium avium subsp. paratuberculosis
ccgcgcgccggcca

SEQ ID NO: 2981095 - RNA, 15 nt, Mycobacterium avium subsp. paratuberculosis
ccgcgcgccggccag

SEQ ID NO: 2981096 - RNA, 23 nt, Mycobacterium avium subsp. paratuberculosis
ccgcgcgccggccagcacggcgg

SEQ ID NO: 2981097 - RNA, 16 nt, Mycobacterium avium subsp. paratuberculosis
ccgcgcgcgcggccuc

SEQ ID NO: 2981098 - RNA, 17 nt, Mycobacterium avium subsp. paratuberculosis
ccgcgcgcgcggccucc

SEQ ID NO: 2981099 - RNA, 14 nt, Mycobacterium avium subsp. paratuberculosis
ccgcgcgcggcacg

SEQ ID NO: 2981100 - RNA, 15 nt, Mycobacterium avium subsp. paratuberculosis
ccgcgcgcggccacc

SEQ ID NO: 2981101 - RNA, 18 nt, Mycobacterium avium subsp. paratuberculosis
ccgcgcgcggccaccgcg

SEQ ID NO: 2981102 - RNA, 19 nt, Mycobacterium avium subsp. paratuberculosis
ccgcgcgcggccaccgcgc

SEQ ID NO: 2981103 - RNA, 13 nt, Mycobacterium avium subsp. paratuberculosis
ccgcgcgcggcgc

SEQ ID NO: 2981104 - RNA, 14 nt, Mycobacterium avium subsp. paratuberculosis
ccgcgcgcggcgcc

SEQ ID NO: 2981105 - RNA, 15 nt, Mycobacterium avium subsp. paratuberculosis
ccgcgcgcggcgccg

SEQ ID NO: 2981106 - RNA, 18 nt, Mycobacterium avium subsp. paratuberculosis
ccgcgcgcggcgcggagc

SEQ ID NO: 2981107 - RNA, 20 nt, Mycobacterium avium subsp. paratuberculosis
ccgcgcgcggcgcggagccg

SEQ ID NO: 2981108 - RNA, 22 nt, Mycobacterium avium subsp. paratuberculosis
ccgcgcgcggcgcggagccggc

SEQ ID NO: 2981109 - RNA, 14 nt, Mycobacterium avium subsp. paratuberculosis
ccgcgcgcgggcca

SEQ ID NO: 2981110 - RNA, 16 nt, Mycobacterium avium subsp. paratuberculosis
ccgcgcgcgggccagc

SEQ ID NO: 2981111 - RNA, 13 nt, Mycobacterium avium subsp. paratuberculosis
ccgcgcgcgucga

SEQ ID NO: 2981112 - RNA, 19 nt, Mycobacterium avium subsp. paratuberculosis
ccgcgcgcgucgacguucg

SEQ ID NO: 2981113 - RNA, 20 nt, Mycobacterium avium subsp. paratuberculosis
ccgcgcgcgucgacguucgc

SEQ ID NO: 2981114 - RNA, 21 nt, Mycobacterium avium subsp. paratuberculosis
ccgcgcgcucgggggugcccg

SEQ ID NO: 2981115 - RNA, 19 nt, Mycobacterium avium subsp. paratuberculosis
ccgcgcgcugacccccguu

SEQ ID NO: 2981116 - RNA, 15 nt, Mycobacterium avium subsp. paratuberculosis
ccgcgcgcugccgcg

SEQ ID NO: 2981117 - RNA, 17 nt, Mycobacterium avium subsp. paratuberculosis
ccgcgcgcugccgcgcc

SEQ ID NO: 2981118 - RNA, 18 nt, Mycobacterium avium subsp. paratuberculosis
ccgcgcgcugccgcgccc

SEQ ID NO: 2981119 - RNA, 20 nt, Mycobacterium avium subsp. paratuberculosis
ccgcgcggauuucucagcgg

SEQ ID NO: 2981120 - RNA, 21 nt, Mycobacterium avium subsp. paratuberculosis
ccgcgcggauuucucagcggc

SEQ ID NO: 2981121 - RNA, 14 nt, Mycobacterium avium subsp. paratuberculosis
ccgcgcggccacca

SEQ ID NO: 2981122 - RNA, 21 nt, Mycobacterium avium subsp. paratuberculosis
ccgcgcggccaccagcgcggc

SEQ ID NO: 2981123 - RNA, 16 nt, Mycobacterium avium subsp. paratuberculosis
ccgcgcggccagcggc

SEQ ID NO: 2981124 - RNA, 17 nt, Mycobacterium avium subsp. paratuberculosis
ccgcgcggccagcggcg

SEQ ID NO: 2981125 - RNA, 18 nt, Mycobacterium avium subsp. paratuberculosis
ccgcgcggccagcggcgc

SEQ ID NO: 2981126 - RNA, 20 nt, Mycobacterium avium subsp. paratuberculosis
ccgcgcggccagcggcgccg

SEQ ID NO: 2981127 - RNA, 12 nt, Mycobacterium avium subsp. paratuberculosis
ccgcgcggcccg

SEQ ID NO: 2981128 - RNA, 15 nt, Mycobacterium avium subsp. paratuberculosis
ccgcgcggcccgcga

SEQ ID NO: 2981129 - RNA, 21 nt, Mycobacterium avium subsp. paratuberculosis
ccgcgcggcccgcgacgucgg

SEQ ID NO: 2981130 - RNA, 12 nt, Mycobacterium avium subsp. paratuberculosis
ccgcgcggccgc

SEQ ID NO: 2981131 - RNA, 13 nt, Mycobacterium avium subsp. paratuberculosis
ccgcgcggccgcc

SEQ ID NO: 2981132 - RNA, 16 nt, Mycobacterium avium subsp. paratuberculosis
ccgcgcggccgccagg

SEQ ID NO: 2981133 - RNA, 16 nt, Mycobacterium avium subsp. paratuberculosis
ccgcgcggccgccucc

SEQ ID NO: 2981134 - RNA, 17 nt, Mycobacterium avium subsp. paratuberculosis
ccgcgcggccgccuccg

SEQ ID NO: 2981135 - RNA, 13 nt, Mycobacterium avium subsp. paratuberculosis
ccgcgcggccggc

SEQ ID NO: 2981136 - RNA, 14 nt, Mycobacterium avium subsp. paratuberculosis
ccgcgcggccggcc

SEQ ID NO: 2981137 - RNA, 16 nt, Mycobacterium avium subsp. paratuberculosis
ccgcgcggccggccac

SEQ ID NO: 2981138 - RNA, 21 nt, Mycobacterium avium subsp. paratuberculosis
ccgcgcggccggccacgcucg

SEQ ID NO: 2981139 - RNA, 13 nt, Mycobacterium avium subsp. paratuberculosis
ccgcgcggcgacg

SEQ ID NO: 2981140 - RNA, 18 nt, Mycobacterium avium subsp. paratuberculosis
ccgcgcggcgauggccga

SEQ ID NO: 2981141 - RNA, 20 nt, Mycobacterium avium subsp. paratuberculosis
ccgcgcggcgauggccgaca

SEQ ID NO: 2981142 - RNA, 13 nt, Mycobacterium avium subsp. paratuberculosis
ccgcgcggcgcag

SEQ ID NO: 2981143 - RNA, 14 nt, Mycobacterium avium subsp. paratuberculosis
ccgcgcggcgcagg

SEQ ID NO: 2981144 - RNA, 20 nt, Mycobacterium avium subsp. paratuberculosis
ccgcgcggcgcagggcggcc

SEQ ID NO: 2981145 - RNA, 23 nt, Mycobacterium avium subsp. paratuberculosis
ccgcgcggcgcagggcggccggc

SEQ ID NO: 2981146 - RNA, 20 nt, Mycobacterium avium subsp. paratuberculosis
ccgcgcggcgcagguccggc

SEQ ID NO: 2981147 - RNA, 23 nt, Mycobacterium avium subsp. paratuberculosis
ccgcgcggcgcagguccggcagc

SEQ ID NO: 2981148 - RNA, 14 nt, Mycobacterium avium subsp. paratuberculosis
ccgcgcggcgcagu

SEQ ID NO: 2981149 - RNA, 18 nt, Mycobacterium avium subsp. paratuberculosis
ccgcgcggcgcaguucga

SEQ ID NO: 2981150 - RNA, 13 nt, Mycobacterium avium subsp. paratuberculosis
ccgcgcggcgcca

SEQ ID NO: 2981151 - RNA, 18 nt, Mycobacterium avium subsp. paratuberculosis
ccgcgcggcgccagcggc

SEQ ID NO: 2981152 - RNA, 23 nt, Mycobacterium avium subsp. paratuberculosis
ccgcgcggcgccagcggccgauc

SEQ ID NO: 2981153 - RNA, 22 nt, Mycobacterium avium subsp. paratuberculosis
ccgcgcggcgcccccgcgacgu

SEQ ID NO: 2981154 - RNA, 12 nt, Mycobacterium avium subsp. paratuberculosis
ccgcgcggcggg

SEQ ID NO: 2981155 - RNA, 17 nt, Mycobacterium avium subsp. paratuberculosis
ccgcgcggcgggcccgc

SEQ ID NO: 2981156 - RNA, 18 nt, Mycobacterium avium subsp. paratuberculosis
ccgcgcggcgggcccgca

SEQ ID NO: 2981157 - RNA, 13 nt, Mycobacterium avium subsp. paratuberculosis
ccgcgcggcgguc

SEQ ID NO: 2981158 - RNA, 18 nt, Mycobacterium avium subsp. paratuberculosis
ccgcgcggcgguccagcg

SEQ ID NO: 2981159 - RNA, 14 nt, Mycobacterium avium subsp. paratuberculosis
ccgcgcggcggugc

SEQ ID NO: 2981160 - RNA, 23 nt, Mycobacterium avium subsp. paratuberculosis
ccgcgcggcggugcucgcgccgg

SEQ ID NO: 2981161 - RNA, 16 nt, Mycobacterium avium subsp. paratuberculosis
ccgcgcggcggugucg

SEQ ID NO: 2981162 - RNA, 12 nt, Mycobacterium avium subsp. paratuberculosis
ccgcgcggcguc

SEQ ID NO: 2981163 - RNA, 13 nt, Mycobacterium avium subsp. paratuberculosis
ccgcgcggcgucg

SEQ ID NO: 2981164 - RNA, 16 nt, Mycobacterium avium subsp. paratuberculosis
ccgcgcggcgucggcc

SEQ ID NO: 2981165 - RNA, 18 nt, Mycobacterium avium subsp. paratuberculosis
ccgcgcggcgucggccgg

SEQ ID NO: 2981166 - RNA, 23 nt, Mycobacterium avium subsp. paratuberculosis
ccgcgcggcgucggccgggcugc

SEQ ID NO: 2981167 - RNA, 19 nt, Mycobacterium avium subsp. paratuberculosis
ccgcgcggcgucggccugc

SEQ ID NO: 2981168 - RNA, 18 nt, Mycobacterium avium subsp. paratuberculosis
ccgcgcggcucacagcgc

SEQ ID NO: 2981169 - RNA, 17 nt, Mycobacterium avium subsp. paratuberculosis
ccgcgcggcucgcgggc

SEQ ID NO: 2981170 - RNA, 16 nt, Mycobacterium avium subsp. paratuberculosis
ccgcgcgggcgaccug

SEQ ID NO: 2981171 - RNA, 17 nt, Mycobacterium avium subsp. paratuberculosis
ccgcgcgggcgaccugc

SEQ ID NO: 2981172 - RNA, 20 nt, Mycobacterium avium subsp. paratuberculosis
ccgcgcgggcgaccugcggg

SEQ ID NO: 2981173 - RNA, 21 nt, Mycobacterium avium subsp. paratuberculosis
ccgcgcgggcgaccugcgggc

SEQ ID NO: 2981174 - RNA, 16 nt, Mycobacterium avium subsp. paratuberculosis
ccgcgcgggcggcguc

SEQ ID NO: 2981175 - RNA, 18 nt, Mycobacterium avium subsp. paratuberculosis
ccgcgcgggcggcgucgu

SEQ ID NO: 2981176 - RNA, 15 nt, Mycobacterium avium subsp. paratuberculosis
ccgcgcgggcugcag

SEQ ID NO: 2981177 - RNA, 19 nt, Mycobacterium avium subsp. paratuberculosis
ccgcgcgggcugcagggcc

SEQ ID NO: 2981178 - RNA, 23 nt, Mycobacterium avium subsp. paratuberculosis
ccgcgcgggcugcagggccgggu

SEQ ID NO: 2981179 - RNA, 14 nt, Mycobacterium avium subsp. paratuberculosis
ccgcgcgggggccg

SEQ ID NO: 2981180 - RNA, 20 nt, Mycobacterium avium subsp. paratuberculosis
ccgcgcgggggccgccgcga

SEQ ID NO: 2981181 - RNA, 17 nt, Mycobacterium avium subsp. paratuberculosis
ccgcgcggggucccaau

SEQ ID NO: 2981182 - RNA, 18 nt, Mycobacterium avium subsp. paratuberculosis
ccgcgcggguacggcggc

SEQ ID NO: 2981183 - RNA, 19 nt, Mycobacterium avium subsp. paratuberculosis
ccgcgcggguacggcggcc

SEQ ID NO: 2981184 - RNA, 20 nt, Mycobacterium avium subsp. paratuberculosis
ccgcgcggguacggcggccg

SEQ ID NO: 2981185 - RNA, 23 nt, Mycobacterium avium subsp. paratuberculosis
ccgcgcggguacggcggccgcgg

SEQ ID NO: 2981186 - RNA, 17 nt, Mycobacterium avium subsp. paratuberculosis
ccgcgcggugcaccagg

SEQ ID NO: 2981187 - RNA, 23 nt, Mycobacterium avium subsp. paratuberculosis
ccgcgcggugcaccaggacgcga

SEQ ID NO: 2981188 - RNA, 23 nt, Mycobacterium avium subsp. paratuberculosis
ccgcgcggugcccggaacggcgg

SEQ ID NO: 2981189 - RNA, 22 nt, Mycobacterium avium subsp. paratuberculosis
ccgcgcggugcucgcccugggg

SEQ ID NO: 2981190 - RNA, 13 nt, Mycobacterium avium subsp. paratuberculosis
ccgcgcguagauc

SEQ ID NO: 2981191 - RNA, 16 nt, Mycobacterium avium subsp. paratuberculosis
ccgcgcgucgcgcagc

SEQ ID NO: 2981192 - RNA, 21 nt, Mycobacterium avium subsp. paratuberculosis
ccgcgcgucgggcucgcgguc

SEQ ID NO: 2981193 - RNA, 22 nt, Mycobacterium avium subsp. paratuberculosis
ccgcgcgucgggcucgcggucg

SEQ ID NO: 2981194 - RNA, 23 nt, Mycobacterium avium subsp. paratuberculosis
ccgcgcgucgggcucgcggucgg

SEQ ID NO: 2981195 - RNA, 15 nt, Mycobacterium avium subsp. paratuberculosis
ccgcgcgucgggggu

SEQ ID NO: 2981196 - RNA, 23 nt, Mycobacterium avium subsp. paratuberculosis
ccgcgcgucucccccgaucagcg

SEQ ID NO: 2981197 - RNA, 13 nt, Mycobacterium avium subsp. paratuberculosis
ccgcgcgugcagc

SEQ ID NO: 2981198 - RNA, 18 nt, Mycobacterium avium subsp. paratuberculosis
ccgcgcgugcagccgggc

SEQ ID NO: 2981199 - RNA, 20 nt, Mycobacterium avium subsp. paratuberculosis
ccgcgcgugcagccgggcgg

SEQ ID NO: 2981200 - RNA, 12 nt, Mycobacterium avium subsp. paratuberculosis
ccgcgcgugggc

SEQ ID NO: 2981201 - RNA, 18 nt, Mycobacterium avium subsp. paratuberculosis
ccgcgcgugggccaacgc

SEQ ID NO: 2981202 - RNA, 21 nt, Mycobacterium avium subsp. paratuberculosis
ccgcgcgugggccaacgcgau

SEQ ID NO: 2981203 - RNA, 20 nt, Mycobacterium avium subsp. paratuberculosis
ccgcgcguggucccacacca

SEQ ID NO: 2981204 - RNA, 17 nt, Mycobacterium avium subsp. paratuberculosis
ccgcgcguuccagcacg

SEQ ID NO: 2981205 - RNA, 19 nt, Mycobacterium avium subsp. paratuberculosis
ccgcgcguuccagcacgcc

SEQ ID NO: 2981206 - RNA, 17 nt, Mycobacterium avium subsp. paratuberculosis
ccgcgcucaacccgggc

SEQ ID NO: 2981207 - RNA, 19 nt, Mycobacterium avium subsp. paratuberculosis
ccgcgcucaacccgggccg

SEQ ID NO: 2981208 - RNA, 14 nt, Mycobacterium avium subsp. paratuberculosis
ccgcgcucaccgcg

SEQ ID NO: 2981209 - RNA, 20 nt, Mycobacterium avium subsp. paratuberculosis
ccgcgcucaccgcggggugc

SEQ ID NO: 2981210 - RNA, 19 nt, Mycobacterium avium subsp. paratuberculosis
ccgcgcucaccgucgcggu

SEQ ID NO: 2981211 - RNA, 20 nt, Mycobacterium avium subsp. paratuberculosis
ccgcgcucaccgucgcgguc

SEQ ID NO: 2981212 - RNA, 18 nt, Mycobacterium avium subsp. paratuberculosis
ccgcgcuccugccagcgg

SEQ ID NO: 2981213 - RNA, 19 nt, Mycobacterium avium subsp. paratuberculosis
ccgcgcuccugccagcggc

SEQ ID NO: 2981214 - RNA, 14 nt, Mycobacterium avium subsp. paratuberculosis
ccgcgcucgcacca

SEQ ID NO: 2981215 - RNA, 19 nt, Mycobacterium avium subsp. paratuberculosis
ccgcgcucgcaccagcgcu

SEQ ID NO: 2981216 - RNA, 12 nt, Mycobacterium avium subsp. paratuberculosis
ccgcgcucggcc

SEQ ID NO: 2981217 - RNA, 15 nt, Mycobacterium avium subsp. paratuberculosis
ccgcgcucggccauc

SEQ ID NO: 2981218 - RNA, 20 nt, Mycobacterium avium subsp. paratuberculosis
ccgcgcucggccauccgggc

SEQ ID NO: 2981219 - RNA, 13 nt, Mycobacterium avium subsp. paratuberculosis
ccgcgcucggcga

SEQ ID NO: 2981220 - RNA, 14 nt, Mycobacterium avium subsp. paratuberculosis
ccgcgcucggcgac

SEQ ID NO: 2981221 - RNA, 16 nt, Mycobacterium avium subsp. paratuberculosis
ccgcgcucggcgacga

SEQ ID NO: 2981222 - RNA, 15 nt, Mycobacterium avium subsp. paratuberculosis
ccgcgcucgucgauc

SEQ ID NO: 2981223 - RNA, 18 nt, Mycobacterium avium subsp. paratuberculosis
ccgcgcugaacgcggugg

SEQ ID NO: 2981224 - RNA, 15 nt, Mycobacterium avium subsp. paratuberculosis
ccgcgcugaccagcg

SEQ ID NO: 2981225 - RNA, 16 nt, Mycobacterium avium subsp. paratuberculosis
ccgcgcugaccagcgu

SEQ ID NO: 2981226 - RNA, 14 nt, Mycobacterium avium subsp. paratuberculosis
ccgcgcugcccagc

SEQ ID NO: 2981227 - RNA, 19 nt, Mycobacterium avium subsp. paratuberculosis
ccgcgcugcccagcgcggu

SEQ ID NO: 2981228 - RNA, 15 nt, Mycobacterium avium subsp. paratuberculosis
ccgcgcugcgccggg

SEQ ID NO: 2981229 - RNA, 18 nt, Mycobacterium avium subsp. paratuberculosis
ccgcgcugcgccgggugg

SEQ ID NO: 2981230 - RNA, 14 nt, Mycobacterium avium subsp. paratuberculosis
ccgcgcuggccagc

SEQ ID NO: 2981231 - RNA, 17 nt, Mycobacterium avium subsp. paratuberculosis
ccgcgcuggccagcguc

SEQ ID NO: 2981232 - RNA, 18 nt, Mycobacterium avium subsp. paratuberculosis
ccgcgcuggccagcguca

SEQ ID NO: 2981233 - RNA, 19 nt, Mycobacterium avium subsp. paratuberculosis
ccgcgcuggccagcgucag

SEQ ID NO: 2981234 - RNA, 18 nt, Mycobacterium avium subsp. paratuberculosis
ccgcgcuggccgaucccg

SEQ ID NO: 2981235 - RNA, 23 nt, Mycobacterium avium subsp. paratuberculosis
ccgcgcuggccgaucccggccac

SEQ ID NO: 2981236 - RNA, 14 nt, Mycobacterium avium subsp. paratuberculosis
ccgcgcuggccggg

SEQ ID NO: 2981237 - RNA, 14 nt, Mycobacterium avium subsp. paratuberculosis
ccgcgcuggcgcag

SEQ ID NO: 2981238 - RNA, 15 nt, Mycobacterium avium subsp. paratuberculosis
ccgcgcuggcgcagg

SEQ ID NO: 2981239 - RNA, 20 nt, Mycobacterium avium subsp. paratuberculosis
ccgcgcuggcgcaggcgcug

SEQ ID NO: 2981240 - RNA, 17 nt, Mycobacterium avium subsp. paratuberculosis
ccgcgcugggcuggccg

SEQ ID NO: 2981241 - RNA, 18 nt, Mycobacterium avium subsp. paratuberculosis
ccgcgcugggcuggccgu

SEQ ID NO: 2981242 - RNA, 19 nt, Mycobacterium avium subsp. paratuberculosis
ccgcgcugggcuggccguc

SEQ ID NO: 2981243 - RNA, 17 nt, Mycobacterium avium subsp. paratuberculosis
ccgcgcuggucaacucg

SEQ ID NO: 2981244 - RNA, 22 nt, Mycobacterium avium subsp. paratuberculosis
ccgcgcuggucaacucgacccg

SEQ ID NO: 2981245 - RNA, 16 nt, Mycobacterium avium subsp. paratuberculosis
ccgcgcuggugcugcu

SEQ ID NO: 2981246 - RNA, 13 nt, Mycobacterium avium subsp. paratuberculosis
ccgcgcuguccac

SEQ ID NO: 2981247 - RNA, 15 nt, Mycobacterium avium subsp. paratuberculosis
ccgcgcuguccacgu

SEQ ID NO: 2981248 - RNA, 17 nt, Mycobacterium avium subsp. paratuberculosis
ccgcgcuugacggccgg

SEQ ID NO: 2981249 - RNA, 19 nt, Mycobacterium avium subsp. paratuberculosis
ccgcgcuugacggccgggc

SEQ ID NO: 2981250 - RNA, 21 nt, Mycobacterium avium subsp. paratuberculosis
ccgcgcuugacggccgggccc

SEQ ID NO: 2981251 - RNA, 15 nt, Mycobacterium avium subsp. paratuberculosis
ccgcgcuugccgcga

SEQ ID NO: 2981252 - RNA, 22 nt, Mycobacterium avium subsp. paratuberculosis
ccgcgcuugccgcgacccgggc

SEQ ID NO: 2981253 - RNA, 14 nt, Mycobacterium avium subsp. paratuberculosis
ccgcgcuugcgacc

SEQ ID NO: 2981254 - RNA, 16 nt, Mycobacterium avium subsp. paratuberculosis
ccgcgcuugcgaccgc

SEQ ID NO: 2981255 - RNA, 18 nt, Mycobacterium avium subsp. paratuberculosis
ccgcgcuugcgaccgccg

SEQ ID NO: 2981256 - RNA, 19 nt, Mycobacterium avium subsp. paratuberculosis
ccgcgcuugcgaccgccgc

SEQ ID NO: 2981257 - RNA, 21 nt, Mycobacterium avium subsp. paratuberculosis
ccgcgcuugcgaccgccgcua

SEQ ID NO: 2981258 - RNA, 20 nt, Mycobacterium avium subsp. paratuberculosis
ccgcgcuugcgaucgccgcg

SEQ ID NO: 2981259 - RNA, 16 nt, Mycobacterium avium subsp. paratuberculosis
ccgcgcuugguggcga

SEQ ID NO: 2981260 - RNA, 21 nt, Mycobacterium avium subsp. paratuberculosis
ccgcggaacccguugcgcccu

SEQ ID NO: 2981261 - RNA, 15 nt, Mycobacterium avium subsp. paratuberculosis
ccgcggaacgcucac

SEQ ID NO: 2981262 - RNA, 21 nt, Mycobacterium avium subsp. paratuberculosis
ccgcggaagccccaggcccgg

SEQ ID NO: 2981263 - RNA, 15 nt, Mycobacterium avium subsp. paratuberculosis
ccgcggaaggccagc

SEQ ID NO: 2981264 - RNA, 17 nt, Mycobacterium avium subsp. paratuberculosis
ccgcggaaggccagcuc

SEQ ID NO: 2981265 - RNA, 18 nt, Mycobacterium avium subsp. paratuberculosis
ccgcggacauucugcacg

SEQ ID NO: 2981266 - RNA, 20 nt, Mycobacterium avium subsp. paratuberculosis
ccgcggacauucugcacgac

SEQ ID NO: 2981267 - RNA, 18 nt, Mycobacterium avium subsp. paratuberculosis
ccgcggaccaccgcgugc

SEQ ID NO: 2981268 - RNA, 20 nt, Mycobacterium avium subsp. paratuberculosis
ccgcggaccccagcgugacg

SEQ ID NO: 2981269 - RNA, 12 nt, Mycobacterium avium subsp. paratuberculosis
ccgcggacccga

SEQ ID NO: 2981270 - RNA, 18 nt, Mycobacterium avium subsp. paratuberculosis
ccgcggacggccagcccg

SEQ ID NO: 2981271 - RNA, 13 nt, Mycobacterium avium subsp. paratuberculosis
ccgcggacggcga

SEQ ID NO: 2981272 - RNA, 23 nt, Mycobacterium avium subsp. paratuberculosis
ccgcggacggguugggcgccagc

SEQ ID NO: 2981273 - RNA, 19 nt, Mycobacterium avium subsp. paratuberculosis
ccgcggacuggccaccgcg

SEQ ID NO: 2981274 - RNA, 22 nt, Mycobacterium avium subsp. paratuberculosis
ccgcggacuggccaccgcgauc

SEQ ID NO: 2981275 - RNA, 12 nt, Mycobacterium avium subsp. paratuberculosis
ccgcggagcggc

SEQ ID NO: 2981276 - RNA, 16 nt, Mycobacterium avium subsp. paratuberculosis
ccgcggagcggcgguc

SEQ ID NO: 2981277 - RNA, 12 nt, Mycobacterium avium subsp. paratuberculosis
ccgcggaggcga

SEQ ID NO: 2981278 - RNA, 17 nt, Mycobacterium avium subsp. paratuberculosis
ccgcggaggcgagcagc

SEQ ID NO: 2981279 - RNA, 18 nt, Mycobacterium avium subsp. paratuberculosis
ccgcggaggcgagcagcc

SEQ ID NO: 2981280 - RNA, 19 nt, Mycobacterium avium subsp. paratuberculosis
ccgcggaggcgagcagccg

SEQ ID NO: 2981281 - RNA, 15 nt, Mycobacterium avium subsp. paratuberculosis
ccgcggaguaggcgc

SEQ ID NO: 2981282 - RNA, 16 nt, Mycobacterium avium subsp. paratuberculosis
ccgcggaguaggcgcc

SEQ ID NO: 2981283 - RNA, 18 nt, Mycobacterium avium subsp. paratuberculosis
ccgcggaguaggcgccgc

SEQ ID NO: 2981284 - RNA, 19 nt, Mycobacterium avium subsp. paratuberculosis
ccgcggaguaggcgccgcc

SEQ ID NO: 2981285 - RNA, 23 nt, Mycobacterium avium subsp. paratuberculosis
ccgcggaguaggcgccgccgcgc

SEQ ID NO: 2981286 - RNA, 15 nt, Mycobacterium avium subsp. paratuberculosis
ccgcggaucagcagg

SEQ ID NO: 2981287 - RNA, 17 nt, Mycobacterium avium subsp. paratuberculosis
ccgcggaucagcaggac

SEQ ID NO: 2981288 - RNA, 19 nt, Mycobacterium avium subsp. paratuberculosis
ccgcggaucagcaggaccg

SEQ ID NO: 2981289 - RNA, 20 nt, Mycobacterium avium subsp. paratuberculosis
ccgcggaucagcaggaccgg

SEQ ID NO: 2981290 - RNA, 22 nt, Mycobacterium avium subsp. paratuberculosis
ccgcggaucagcaggaccggga

SEQ ID NO: 2981291 - RNA, 22 nt, Mycobacterium avium subsp. paratuberculosis
ccgcggaucgguuucuccaccc

SEQ ID NO: 2981292 - RNA, 13 nt, Mycobacterium avium subsp. paratuberculosis
ccgcggaucuucu

SEQ ID NO: 2981293 - RNA, 20 nt, Mycobacterium avium subsp. paratuberculosis
ccgcggaugaccaggucgcc

SEQ ID NO: 2981294 - RNA, 22 nt, Mycobacterium avium subsp. paratuberculosis
ccgcggaugaccaggucgccgg

SEQ ID NO: 2981295 - RNA, 13 nt, Mycobacterium avium subsp. paratuberculosis
ccgcggaugacgg

SEQ ID NO: 2981296 - RNA, 15 nt, Mycobacterium avium subsp. paratuberculosis
ccgcggaugacgggu

SEQ ID NO: 2981297 - RNA, 19 nt, Mycobacterium avium subsp. paratuberculosis
ccgcggaugacgggugcuc

SEQ ID NO: 2981298 - RNA, 19 nt, Mycobacterium avium subsp. paratuberculosis
ccgcggauggccucggcga

SEQ ID NO: 2981299 - RNA, 22 nt, Mycobacterium avium subsp. paratuberculosis
ccgcggauggccucggcgaugc

SEQ ID NO: 2981300 - RNA, 21 nt, Mycobacterium avium subsp. paratuberculosis
ccgcggauggugacggccgug

SEQ ID NO: 2981301 - RNA, 18 nt, Mycobacterium avium subsp. paratuberculosis
ccgcggauguggaggcga

SEQ ID NO: 2981302 - RNA, 22 nt, Mycobacterium avium subsp. paratuberculosis
ccgcggauguggaggcgagcaa

SEQ ID NO: 2981303 - RNA, 17 nt, Mycobacterium avium subsp. paratuberculosis
ccgcggauuccagcgcg

SEQ ID NO: 2981304 - RNA, 23 nt, Mycobacterium avium subsp. paratuberculosis
ccgcggcaccuucaccgaccagc

SEQ ID NO: 2981305 - RNA, 16 nt, Mycobacterium avium subsp. paratuberculosis
ccgcggcacgcugcgc

SEQ ID NO: 2981306 - RNA, 18 nt, Mycobacterium avium subsp. paratuberculosis
ccgcggcacgcugcgcca

SEQ ID NO: 2981307 - RNA, 19 nt, Mycobacterium avium subsp. paratuberculosis
ccgcggcacgcugcgccag

SEQ ID NO: 2981308 - RNA, 13 nt, Mycobacterium avium subsp. paratuberculosis
ccgcggcagccgg

SEQ ID NO: 2981309 - RNA, 16 nt, Mycobacterium avium subsp. paratuberculosis
ccgcggcagccgggcg

SEQ ID NO: 2981310 - RNA, 18 nt, Mycobacterium avium subsp. paratuberculosis
ccgcggcagccgggcgau

SEQ ID NO: 2981311 - RNA, 21 nt, Mycobacterium avium subsp. paratuberculosis
ccgcggccaacccgggcgcca

SEQ ID NO: 2981312 - RNA, 22 nt, Mycobacterium avium subsp. paratuberculosis
ccgcggccaacccgggcgccau

SEQ ID NO: 2981313 - RNA, 20 nt, Mycobacterium avium subsp. paratuberculosis
ccgcggccaagugcggucgg

SEQ ID NO: 2981314 - RNA, 20 nt, Mycobacterium avium subsp. paratuberculosis
ccgcggccacacuggcguga

SEQ ID NO: 2981315 - RNA, 14 nt, Mycobacterium avium subsp. paratuberculosis
ccgcggccaccacc

SEQ ID NO: 2981316 - RNA, 15 nt, Mycobacterium avium subsp. paratuberculosis
ccgcggccaccaccg

SEQ ID NO: 2981317 - RNA, 20 nt, Mycobacterium avium subsp. paratuberculosis
ccgcggccaccaccgccacg

SEQ ID NO: 2981318 - RNA, 16 nt, Mycobacterium avium subsp. paratuberculosis
ccgcggccaccccgga

SEQ ID NO: 2981319 - RNA, 17 nt, Mycobacterium avium subsp. paratuberculosis
ccgcggccaccccggag

SEQ ID NO: 2981320 - RNA, 15 nt, Mycobacterium avium subsp. paratuberculosis
ccgcggccaccgggu

SEQ ID NO: 2981321 - RNA, 18 nt, Mycobacterium avium subsp. paratuberculosis
ccgcggccaccgggucgu

SEQ ID NO: 2981322 - RNA, 15 nt, Mycobacterium avium subsp. paratuberculosis
ccgcggccaccuggg

SEQ ID NO: 2981323 - RNA, 18 nt, Mycobacterium avium subsp. paratuberculosis
ccgcggccaccugggcgg

SEQ ID NO: 2981324 - RNA, 13 nt, Mycobacterium avium subsp. paratuberculosis
ccgcggccacgcu

SEQ ID NO: 2981325 - RNA, 14 nt, Mycobacterium avium subsp. paratuberculosis
ccgcggccacgcuc

SEQ ID NO: 2981326 - RNA, 18 nt, Mycobacterium avium subsp. paratuberculosis
ccgcggccagccggucgu

SEQ ID NO: 2981327 - RNA, 18 nt, Mycobacterium avium subsp. paratuberculosis
ccgcggccagcgccccgc

SEQ ID NO: 2981328 - RNA, 15 nt, Mycobacterium avium subsp. paratuberculosis
ccgcggccagcgcgc

SEQ ID NO: 2981329 - RNA, 21 nt, Mycobacterium avium subsp. paratuberculosis
ccgcggccagcgcgcgggcgu

SEQ ID NO: 2981330 - RNA, 12 nt, Mycobacterium avium subsp. paratuberculosis
ccgcggccagcu

SEQ ID NO: 2981331 - RNA, 13 nt, Mycobacterium avium subsp. paratuberculosis
ccgcggccagcuc

SEQ ID NO: 2981332 - RNA, 14 nt, Mycobacterium avium subsp. paratuberculosis
ccgcggccagcucc

SEQ ID NO: 2981333 - RNA, 19 nt, Mycobacterium avium subsp. paratuberculosis
ccgcggccagcucggucgc

SEQ ID NO: 2981334 - RNA, 22 nt, Mycobacterium avium subsp. paratuberculosis
ccgcggccagcucggucgcggu

SEQ ID NO: 2981335 - RNA, 15 nt, Mycobacterium avium subsp. paratuberculosis
ccgcggccagcugcc

SEQ ID NO: 2981336 - RNA, 20 nt, Mycobacterium avium subsp. paratuberculosis
ccgcggccagcugcccgccg

SEQ ID NO: 2981337 - RNA, 16 nt, Mycobacterium avium subsp. paratuberculosis
ccgcggccagcugcga

SEQ ID NO: 2981338 - RNA, 12 nt, Mycobacterium avium subsp. paratuberculosis
ccgcggcccgcu

SEQ ID NO: 2981339 - RNA, 13 nt, Mycobacterium avium subsp. paratuberculosis
ccgcggcccgcuu

SEQ ID NO: 2981340 - RNA, 12 nt, Mycobacterium avium subsp. paratuberculosis
ccgcggcccggc

SEQ ID NO: 2981341 - RNA, 15 nt, Mycobacterium avium subsp. paratuberculosis
ccgcggcccggccac

SEQ ID NO: 2981342 - RNA, 18 nt, Mycobacterium avium subsp. paratuberculosis
ccgcggcccggccaccag

SEQ ID NO: 2981343 - RNA, 19 nt, Mycobacterium avium subsp. paratuberculosis
ccgcggcccggccaccagg

SEQ ID NO: 2981344 - RNA, 16 nt, Mycobacterium avium subsp. paratuberculosis
ccgcggcccugcagcg

SEQ ID NO: 2981345 - RNA, 13 nt, Mycobacterium avium subsp. paratuberculosis
ccgcggccgccgc

SEQ ID NO: 2981346 - RNA, 14 nt, Mycobacterium avium subsp. paratuberculosis
ccgcggccgccgcc

SEQ ID NO: 2981347 - RNA, 18 nt, Mycobacterium avium subsp. paratuberculosis
ccgcggccgccgccgcgg

SEQ ID NO: 2981348 - RNA, 22 nt, Mycobacterium avium subsp. paratuberculosis
ccgcggccgccgccgcggccgc

SEQ ID NO: 2981349 - RNA, 15 nt, Mycobacterium avium subsp. paratuberculosis
ccgcggccgccgcga

SEQ ID NO: 2981350 - RNA, 18 nt, Mycobacterium avium subsp. paratuberculosis
ccgcggccgccgcgacgg

SEQ ID NO: 2981351 - RNA, 14 nt, Mycobacterium avium subsp. paratuberculosis
ccgcggccgccucc

SEQ ID NO: 2981352 - RNA, 19 nt, Mycobacterium avium subsp. paratuberculosis
ccgcggccgccucccgcag

SEQ ID NO: 2981353 - RNA, 21 nt, Mycobacterium avium subsp. paratuberculosis
ccgcggccgccuucacgaccg

SEQ ID NO: 2981354 - RNA, 22 nt, Mycobacterium avium subsp. paratuberculosis
ccgcggccgccuucacgaccgg

SEQ ID NO: 2981355 - RNA, 15 nt, Mycobacterium avium subsp. paratuberculosis
ccgcggccgcgacgg

SEQ ID NO: 2981356 - RNA, 18 nt, Mycobacterium avium subsp. paratuberculosis
ccgcggccgcgcgcccgu

SEQ ID NO: 2981357 - RNA, 12 nt, Mycobacterium avium subsp. paratuberculosis
ccgcggccgcgg

SEQ ID NO: 2981358 - RNA, 13 nt, Mycobacterium avium subsp. paratuberculosis
ccgcggccgcggc

SEQ ID NO: 2981359 - RNA, 14 nt, Mycobacterium avium subsp. paratuberculosis
ccgcggccgcggcg

SEQ ID NO: 2981360 - RNA, 15 nt, Mycobacterium avium subsp. paratuberculosis
ccgcggccgcggcgc

SEQ ID NO: 2981361 - RNA, 16 nt, Mycobacterium avium subsp. paratuberculosis
ccgcggccgcggcgcg

SEQ ID NO: 2981362 - RNA, 17 nt, Mycobacterium avium subsp. paratuberculosis
ccgcggccgcggcgcgc

SEQ ID NO: 2981363 - RNA, 15 nt, Mycobacterium avium subsp. paratuberculosis
ccgcggccgcguugu

SEQ ID NO: 2981364 - RNA, 23 nt, Mycobacterium avium subsp. paratuberculosis
ccgcggccgcguugucgaccacc

SEQ ID NO: 2981365 - RNA, 11 nt, Mycobacterium avium subsp. paratuberculosis
ccgcggccgcu

SEQ ID NO: 2981366 - RNA, 20 nt, Mycobacterium avium subsp. paratuberculosis
ccgcggccgcugcgcccagc

SEQ ID NO: 2981367 - RNA, 21 nt, Mycobacterium avium subsp. paratuberculosis
ccgcggccgcugcgcccagcg

SEQ ID NO: 2981368 - RNA, 22 nt, Mycobacterium avium subsp. paratuberculosis
ccgcggccggcacuaccgccuc

SEQ ID NO: 2981369 - RNA, 16 nt, Mycobacterium avium subsp. paratuberculosis
ccgcggccggcccagc

SEQ ID NO: 2981370 - RNA, 17 nt, Mycobacterium avium subsp. paratuberculosis
ccgcggccggcccagcg

SEQ ID NO: 2981371 - RNA, 20 nt, Mycobacterium avium subsp. paratuberculosis
ccgcggccggcccagcgcgc

SEQ ID NO: 2981372 - RNA, 15 nt, Mycobacterium avium subsp. paratuberculosis
ccgcggccggcggca

SEQ ID NO: 2981373 - RNA, 17 nt, Mycobacterium avium subsp. paratuberculosis
ccgcggccggcggcagu

SEQ ID NO: 2981374 - RNA, 18 nt, Mycobacterium avium subsp. paratuberculosis
ccgcggccggcggcaguc

SEQ ID NO: 2981375 - RNA, 13 nt, Mycobacterium avium subsp. paratuberculosis
ccgcggccggugc

SEQ ID NO: 2981376 - RNA, 22 nt, Mycobacterium avium subsp. paratuberculosis
ccgcggccggugccacggucag

SEQ ID NO: 2981377 - RNA, 16 nt, Mycobacterium avium subsp. paratuberculosis
ccgcggccgucgcggc

SEQ ID NO: 2981378 - RNA, 18 nt, Mycobacterium avium subsp. paratuberculosis
ccgcggccgucgcggcga

SEQ ID NO: 2981379 - RNA, 19 nt, Mycobacterium avium subsp. paratuberculosis
ccgcggccgucgcggcgau

SEQ ID NO: 2981380 - RNA, 20 nt, Mycobacterium avium subsp. paratuberculosis
ccgcggccgucgcggcgauc

SEQ ID NO: 2981381 - RNA, 13 nt, Mycobacterium avium subsp. paratuberculosis
ccgcggccgucgu

SEQ ID NO: 2981382 - RNA, 16 nt, Mycobacterium avium subsp. paratuberculosis
ccgcggccgucgucgu

SEQ ID NO: 2981383 - RNA, 20 nt, Mycobacterium avium subsp. paratuberculosis
ccgcggccgucgucgugcac

SEQ ID NO: 2981384 - RNA, 11 nt, Mycobacterium avium subsp. paratuberculosis
ccgcggccucc

SEQ ID NO: 2981385 - RNA, 17 nt, Mycobacterium avium subsp. paratuberculosis
ccgcggccuccagccgc

SEQ ID NO: 2981386 - RNA, 13 nt, Mycobacterium avium subsp. paratuberculosis
ccgcggccucggc

SEQ ID NO: 2981387 - RNA, 16 nt, Mycobacterium avium subsp. paratuberculosis
ccgcggccucggcguc

SEQ ID NO: 2981388 - RNA, 17 nt, Mycobacterium avium subsp. paratuberculosis
ccgcggccucggcgucg

SEQ ID NO: 2981389 - RNA, 15 nt, Mycobacterium avium subsp. paratuberculosis
ccgcggccucgucga

SEQ ID NO: 2981390 - RNA, 17 nt, Mycobacterium avium subsp. paratuberculosis
ccgcggccucgucgagg

SEQ ID NO: 2981391 - RNA, 18 nt, Mycobacterium avium subsp. paratuberculosis
ccgcggccucgucgaggu

SEQ ID NO: 2981392 - RNA, 19 nt, Mycobacterium avium subsp. paratuberculosis
ccgcggccuugcgagccgg

SEQ ID NO: 2981393 - RNA, 13 nt, Mycobacterium avium subsp. paratuberculosis
ccgcggcgaaaac

SEQ ID NO: 2981394 - RNA, 20 nt, Mycobacterium avium subsp. paratuberculosis
ccgcggcgaauccgagcauc

SEQ ID NO: 2981395 - RNA, 20 nt, Mycobacterium avium subsp. paratuberculosis
ccgcggcgacacccagcggc

SEQ ID NO: 2981396 - RNA, 22 nt, Mycobacterium avium subsp. paratuberculosis
ccgcggcgacacccagcggcgc

SEQ ID NO: 2981397 - RNA, 20 nt, Mycobacterium avium subsp. paratuberculosis
ccgcggcgaccacgaacacc

SEQ ID NO: 2981398 - RNA, 18 nt, Mycobacterium avium subsp. paratuberculosis
ccgcggcgacgucgugca

SEQ ID NO: 2981399 - RNA, 15 nt, Mycobacterium avium subsp. paratuberculosis
ccgcggcgagccggc

SEQ ID NO: 2981400 - RNA, 16 nt, Mycobacterium avium subsp. paratuberculosis
ccgcggcgagccggcc

SEQ ID NO: 2981401 - RNA, 18 nt, Mycobacterium avium subsp. paratuberculosis
ccgcggcgagccggccgu

SEQ ID NO: 2981402 - RNA, 16 nt, Mycobacterium avium subsp. paratuberculosis
ccgcggcgaucgccgu

SEQ ID NO: 2981403 - RNA, 13 nt, Mycobacterium avium subsp. paratuberculosis
ccgcggcgaucgg

SEQ ID NO: 2981404 - RNA, 16 nt, Mycobacterium avium subsp. paratuberculosis
ccgcggcgaucggcgg

SEQ ID NO: 2981405 - RNA, 17 nt, Mycobacterium avium subsp. paratuberculosis
ccgcggcgaucucgauc

SEQ ID NO: 2981406 - RNA, 18 nt, Mycobacterium avium subsp. paratuberculosis
ccgcggcgaugaccggac

SEQ ID NO: 2981407 - RNA, 14 nt, Mycobacterium avium subsp. paratuberculosis
ccgcggcgaugauc

SEQ ID NO: 2981408 - RNA, 22 nt, Mycobacterium avium subsp. paratuberculosis
ccgcggcgaugauccgcggcgc

SEQ ID NO: 2981409 - RNA, 12 nt, Mycobacterium avium subsp. paratuberculosis
ccgcggcgaugg

SEQ ID NO: 2981410 - RNA, 20 nt, Mycobacterium avium subsp. paratuberculosis
ccgcggcgauggugggcagc

SEQ ID NO: 2981411 - RNA, 23 nt, Mycobacterium avium subsp. paratuberculosis
ccgcggcgauggugggcagccgg

SEQ ID NO: 2981412 - RNA, 14 nt, Mycobacterium avium subsp. paratuberculosis
ccgcggcgcccgga

SEQ ID NO: 2981413 - RNA, 19 nt, Mycobacterium avium subsp. paratuberculosis
ccgcggcgcccucgccggc

SEQ ID NO: 2981414 - RNA, 20 nt, Mycobacterium avium subsp. paratuberculosis
ccgcggcgcccucgccggcg

SEQ ID NO: 2981415 - RNA, 13 nt, Mycobacterium avium subsp. paratuberculosis
ccgcggcgccgcc

SEQ ID NO: 2981416 - RNA, 17 nt, Mycobacterium avium subsp. paratuberculosis
ccgcggcgccgccacgg

SEQ ID NO: 2981417 - RNA, 22 nt, Mycobacterium avium subsp. paratuberculosis
ccgcggcgccgccacggcacgu

SEQ ID NO: 2981418 - RNA, 13 nt, Mycobacterium avium subsp. paratuberculosis
ccgcggcgccggg

SEQ ID NO: 2981419 - RNA, 12 nt, Mycobacterium avium subsp. paratuberculosis
ccgcggcgccgu

SEQ ID NO: 2981420 - RNA, 13 nt, Mycobacterium avium subsp. paratuberculosis
ccgcggcgccguu

SEQ ID NO: 2981421 - RNA, 21 nt, Mycobacterium avium subsp. paratuberculosis
ccgcggcgccguugaccggcc

SEQ ID NO: 2981422 - RNA, 22 nt, Mycobacterium avium subsp. paratuberculosis
ccgcggcgccguugaccggccg

SEQ ID NO: 2981423 - RNA, 14 nt, Mycobacterium avium subsp. paratuberculosis
ccgcggcgcgauga

SEQ ID NO: 2981424 - RNA, 22 nt, Mycobacterium avium subsp. paratuberculosis
ccgcggcgcgaugaucgccggc

SEQ ID NO: 2981425 - RNA, 18 nt, Mycobacterium avium subsp. paratuberculosis
ccgcggcgcgcaggucgu

SEQ ID NO: 2981426 - RNA, 15 nt, Mycobacterium avium subsp. paratuberculosis
ccgcggcgcgcggcc

SEQ ID NO: 2981427 - RNA, 16 nt, Mycobacterium avium subsp. paratuberculosis
ccgcggcgcgcggccg

SEQ ID NO: 2981428 - RNA, 14 nt, Mycobacterium avium subsp. paratuberculosis
ccgcggcgcggccc

SEQ ID NO: 2981429 - RNA, 15 nt, Mycobacterium avium subsp. paratuberculosis
ccgcggcgcggcccg

SEQ ID NO: 2981430 - RNA, 18 nt, Mycobacterium avium subsp. paratuberculosis
ccgcggcgcggcccggcc

SEQ ID NO: 2981431 - RNA, 22 nt, Mycobacterium avium subsp. paratuberculosis
ccgcggcgcggcccggcccgcu

SEQ ID NO: 2981432 - RNA, 23 nt, Mycobacterium avium subsp. paratuberculosis
ccgcggcgcggcccggcccgcug

SEQ ID NO: 2981433 - RNA, 15 nt, Mycobacterium avium subsp. paratuberculosis
ccgcggcgcgguuga

SEQ ID NO: 2981434 - RNA, 17 nt, Mycobacterium avium subsp. paratuberculosis
ccgcggcgcgguugacg

SEQ ID NO: 2981435 - RNA, 21 nt, Mycobacterium avium subsp. paratuberculosis
ccgcggcgcuugaccucgccg

SEQ ID NO: 2981436 - RNA, 21 nt, Mycobacterium avium subsp. paratuberculosis
ccgcggcggauccagcaccgc

SEQ ID NO: 2981437 - RNA, 14 nt, Mycobacterium avium subsp. paratuberculosis
ccgcggcggcaccc

SEQ ID NO: 2981438 - RNA, 17 nt, Mycobacterium avium subsp. paratuberculosis
ccgcggcggcacccagg

SEQ ID NO: 2981439 - RNA, 13 nt, Mycobacterium avium subsp. paratuberculosis
ccgcggcggcagc

SEQ ID NO: 2981440 - RNA, 20 nt, Mycobacterium avium subsp. paratuberculosis
ccgcggcggcagcacccgca

SEQ ID NO: 2981441 - RNA, 17 nt, Mycobacterium avium subsp. paratuberculosis
ccgcggcggcagcagcc

SEQ ID NO: 2981442 - RNA, 12 nt, Mycobacterium avium subsp. paratuberculosis
ccgcggcggcca

SEQ ID NO: 2981443 - RNA, 22 nt, Mycobacterium avium subsp. paratuberculosis
ccgcggcggcccggcgucacgc

SEQ ID NO: 2981444 - RNA, 16 nt, Mycobacterium avium subsp. paratuberculosis
ccgcggcggccggcga

SEQ ID NO: 2981445 - RNA, 14 nt, Mycobacterium avium subsp. paratuberculosis
ccgcggcggccugc

SEQ ID NO: 2981446 - RNA, 20 nt, Mycobacterium avium subsp. paratuberculosis
ccgcggcggccugcuugacc

SEQ ID NO: 2981447 - RNA, 13 nt, Mycobacterium avium subsp. paratuberculosis
ccgcggcggcgcc

SEQ ID NO: 2981448 - RNA, 15 nt, Mycobacterium avium subsp. paratuberculosis
ccgcggcggcgccau

SEQ ID NO: 2981449 - RNA, 14 nt, Mycobacterium avium subsp. paratuberculosis
ccgcggcggcgccg

SEQ ID NO: 2981450 - RNA, 16 nt, Mycobacterium avium subsp. paratuberculosis
ccgcggcggcgccgac

SEQ ID NO: 2981451 - RNA, 21 nt, Mycobacterium avium subsp. paratuberculosis
ccgcggcggcgccgacgggcc

SEQ ID NO: 2981452 - RNA, 16 nt, Mycobacterium avium subsp. paratuberculosis
ccgcggcggcggcccg

SEQ ID NO: 2981453 - RNA, 21 nt, Mycobacterium avium subsp. paratuberculosis
ccgcggcggcggcccguccgc

SEQ ID NO: 2981454 - RNA, 13 nt, Mycobacterium avium subsp. paratuberculosis
ccgcggcggcguc

SEQ ID NO: 2981455 - RNA, 14 nt, Mycobacterium avium subsp. paratuberculosis
ccgcggcggcgucg

SEQ ID NO: 2981456 - RNA, 20 nt, Mycobacterium avium subsp. paratuberculosis
ccgcggcggcgucgaccgcc

SEQ ID NO: 2981457 - RNA, 16 nt, Mycobacterium avium subsp. paratuberculosis
ccgcggcggcgucggc

SEQ ID NO: 2981458 - RNA, 14 nt, Mycobacterium avium subsp. paratuberculosis
ccgcggcggcgugc

SEQ ID NO: 2981459 - RNA, 20 nt, Mycobacterium avium subsp. paratuberculosis
ccgcggcggcgugccgcccg

SEQ ID NO: 2981460 - RNA, 21 nt, Mycobacterium avium subsp. paratuberculosis
ccgcggcggcgugccgcccgg

SEQ ID NO: 2981461 - RNA, 23 nt, Mycobacterium avium subsp. paratuberculosis
ccgcggcggcgugccgcccggac

SEQ ID NO: 2981462 - RNA, 12 nt, Mycobacterium avium subsp. paratuberculosis
ccgcggcggcuc

SEQ ID NO: 2981463 - RNA, 18 nt, Mycobacterium avium subsp. paratuberculosis
ccgcggcggcucggcggc

SEQ ID NO: 2981464 - RNA, 20 nt, Mycobacterium avium subsp. paratuberculosis
ccgcggcggcucggcggcgu

SEQ ID NO: 2981465 - RNA, 22 nt, Mycobacterium avium subsp. paratuberculosis
ccgcggcggcucggcggcgucg

SEQ ID NO: 2981466 - RNA, 23 nt, Mycobacterium avium subsp. paratuberculosis
ccgcggcggcucggcggcgucgu

SEQ ID NO: 2981467 - RNA, 13 nt, Mycobacterium avium subsp. paratuberculosis
ccgcggcgggcag

SEQ ID NO: 2981468 - RNA, 14 nt, Mycobacterium avium subsp. paratuberculosis
ccgcggcgggcagg

SEQ ID NO: 2981469 - RNA, 15 nt, Mycobacterium avium subsp. paratuberculosis
ccgcggcgguagcgg

SEQ ID NO: 2981470 - RNA, 22 nt, Mycobacterium avium subsp. paratuberculosis
ccgcggcggucgccacucgggc

SEQ ID NO: 2981471 - RNA, 16 nt, Mycobacterium avium subsp. paratuberculosis
ccgcggcggugccggu

SEQ ID NO: 2981472 - RNA, 12 nt, Mycobacterium avium subsp. paratuberculosis
ccgcggcggugg

SEQ ID NO: 2981473 - RNA, 16 nt, Mycobacterium avium subsp. paratuberculosis
ccgcggcgguggccug

SEQ ID NO: 2981474 - RNA, 20 nt, Mycobacterium avium subsp. paratuberculosis
ccgcggcgguggccugcccg

SEQ ID NO: 2981475 - RNA, 21 nt, Mycobacterium avium subsp. paratuberculosis
ccgcggcgguggccugcccgg

SEQ ID NO: 2981476 - RNA, 15 nt, Mycobacterium avium subsp. paratuberculosis
ccgcggcggugucgg

SEQ ID NO: 2981477 - RNA, 19 nt, Mycobacterium avium subsp. paratuberculosis
ccgcggcggugucggcgcc

SEQ ID NO: 2981478 - RNA, 23 nt, Mycobacterium avium subsp. paratuberculosis
ccgcggcggugucggcgccccgg

SEQ ID NO: 2981479 - RNA, 17 nt, Mycobacterium avium subsp. paratuberculosis
ccgcggcguagcgccag

SEQ ID NO: 2981480 - RNA, 21 nt, Mycobacterium avium subsp. paratuberculosis
ccgcggcgucaucccccgcag

SEQ ID NO: 2981481 - RNA, 22 nt, Mycobacterium avium subsp. paratuberculosis
ccgcggcgucaucccccgcagc

SEQ ID NO: 2981482 - RNA, 23 nt, Mycobacterium avium subsp. paratuberculosis
ccgcggcgucaucccccgcagcu

SEQ ID NO: 2981483 - RNA, 14 nt, Mycobacterium avium subsp. paratuberculosis
ccgcggcgucccgg

SEQ ID NO: 2981484 - RNA, 12 nt, Mycobacterium avium subsp. paratuberculosis
ccgcggcgucgg

SEQ ID NO: 2981485 - RNA, 14 nt, Mycobacterium avium subsp. paratuberculosis
ccgcggcgucggga

SEQ ID NO: 2981486 - RNA, 21 nt, Mycobacterium avium subsp. paratuberculosis
ccgcggcgucgggauggucga

SEQ ID NO: 2981487 - RNA, 23 nt, Mycobacterium avium subsp. paratuberculosis
ccgcggcgucgggauggucgauc

SEQ ID NO: 2981488 - RNA, 19 nt, Mycobacterium avium subsp. paratuberculosis
ccgcggcgucggguagggc

SEQ ID NO: 2981489 - RNA, 16 nt, Mycobacterium avium subsp. paratuberculosis
ccgcggcgugcgccag

SEQ ID NO: 2981490 - RNA, 13 nt, Mycobacterium avium subsp. paratuberculosis
ccgcggcguggac

SEQ ID NO: 2981491 - RNA, 14 nt, Mycobacterium avium subsp. paratuberculosis
ccgcggcuccagca

SEQ ID NO: 2981492 - RNA, 17 nt, Mycobacterium avium subsp. paratuberculosis
ccgcggcuccagcagcg

SEQ ID NO: 2981493 - RNA, 19 nt, Mycobacterium avium subsp. paratuberculosis
ccgcggcuccagcagcggc

SEQ ID NO: 2981494 - RNA, 15 nt, Mycobacterium avium subsp. paratuberculosis
ccgcggcuccggccg

SEQ ID NO: 2981495 - RNA, 22 nt, Mycobacterium avium subsp. paratuberculosis
ccgcggcuccggccgcgccggc

SEQ ID NO: 2981496 - RNA, 19 nt, Mycobacterium avium subsp. paratuberculosis
ccgcggcucgauggacgcc

SEQ ID NO: 2981497 - RNA, 22 nt, Mycobacterium avium subsp. paratuberculosis
ccgcggcucgauggacgccagc

SEQ ID NO: 2981498 - RNA, 16 nt, Mycobacterium avium subsp. paratuberculosis
ccgcggcucgcgacgc

SEQ ID NO: 2981499 - RNA, 18 nt, Mycobacterium avium subsp. paratuberculosis
ccgcggcucgcgacgcgg

SEQ ID NO: 2981500 - RNA, 16 nt, Mycobacterium avium subsp. paratuberculosis
ccgcgggaauggccgc

SEQ ID NO: 2981501 - RNA, 17 nt, Mycobacterium avium subsp. paratuberculosis
ccgcgggaauggccgcg

SEQ ID NO: 2981502 - RNA, 18 nt, Mycobacterium avium subsp. paratuberculosis
ccgcgggaauggccgcgc

SEQ ID NO: 2981503 - RNA, 21 nt, Mycobacterium avium subsp. paratuberculosis
ccgcgggaauggccgcgccgu

SEQ ID NO: 2981504 - RNA, 20 nt, Mycobacterium avium subsp. paratuberculosis
ccgcgggaauuggcaccgga

SEQ ID NO: 2981505 - RNA, 21 nt, Mycobacterium avium subsp. paratuberculosis
ccgcgggaauuggcaccggac

SEQ ID NO: 2981506 - RNA, 17 nt, Mycobacterium avium subsp. paratuberculosis
ccgcgggacacggcggc

SEQ ID NO: 2981507 - RNA, 18 nt, Mycobacterium avium subsp. paratuberculosis
ccgcgggacacggcggcg

SEQ ID NO: 2981508 - RNA, 21 nt, Mycobacterium avium subsp. paratuberculosis
ccgcgggacacggcggcgcgg

SEQ ID NO: 2981509 - RNA, 23 nt, Mycobacterium avium subsp. paratuberculosis
ccgcgggacacggcggcgcgggc

SEQ ID NO: 2981510 - RNA, 17 nt, Mycobacterium avium subsp. paratuberculosis
ccgcgggaggcccagua

SEQ ID NO: 2981511 - RNA, 16 nt, Mycobacterium avium subsp. paratuberculosis
ccgcgggaguccacgc

SEQ ID NO: 2981512 - RNA, 19 nt, Mycobacterium avium subsp. paratuberculosis
ccgcgggaguccacgccgu

SEQ ID NO: 2981513 - RNA, 22 nt, Mycobacterium avium subsp. paratuberculosis
ccgcgggaugcuuggucgcggc

SEQ ID NO: 2981514 - RNA, 18 nt, Mycobacterium avium subsp. paratuberculosis
ccgcgggcacggcgaugu

SEQ ID NO: 2981515 - RNA, 16 nt, Mycobacterium avium subsp. paratuberculosis
ccgcgggcaucgccgu

SEQ ID NO: 2981516 - RNA, 17 nt, Mycobacterium avium subsp. paratuberculosis
ccgcgggcaucgccguc

SEQ ID NO: 2981517 - RNA, 16 nt, Mycobacterium avium subsp. paratuberculosis
ccgcgggccagcagcc

SEQ ID NO: 2981518 - RNA, 17 nt, Mycobacterium avium subsp. paratuberculosis
ccgcgggccagcagccg

SEQ ID NO: 2981519 - RNA, 20 nt, Mycobacterium avium subsp. paratuberculosis
ccgcgggccagcagccgggu

SEQ ID NO: 2981520 - RNA, 13 nt, Mycobacterium avium subsp. paratuberculosis
ccgcgggccagcc

SEQ ID NO: 2981521 - RNA, 17 nt, Mycobacterium avium subsp. paratuberculosis
ccgcgggcccaccgcca

SEQ ID NO: 2981522 - RNA, 11 nt, Mycobacterium avium subsp. paratuberculosis
ccgcgggccgg

SEQ ID NO: 2981523 - RNA, 23 nt, Mycobacterium avium subsp. paratuberculosis
ccgcgggcgauucccggaugcug

SEQ ID NO: 2981524 - RNA, 21 nt, Mycobacterium avium subsp. paratuberculosis
ccgcgggcgcauaccagcgcu

SEQ ID NO: 2981525 - RNA, 20 nt, Mycobacterium avium subsp. paratuberculosis
ccgcgggcgccguaggccgc

SEQ ID NO: 2981526 - RNA, 15 nt, Mycobacterium avium subsp. paratuberculosis
ccgcgggcgcgccgu

SEQ ID NO: 2981527 - RNA, 16 nt, Mycobacterium avium subsp. paratuberculosis
ccgcgggcgcgccguc

SEQ ID NO: 2981528 - RNA, 14 nt, Mycobacterium avium subsp. paratuberculosis
ccgcgggcgggccg

SEQ ID NO: 2981529 - RNA, 13 nt, Mycobacterium avium subsp. paratuberculosis
ccgcgggcggggc

SEQ ID NO: 2981530 - RNA, 15 nt, Mycobacterium avium subsp. paratuberculosis
ccgcgggcggggccu

SEQ ID NO: 2981531 - RNA, 20 nt, Mycobacterium avium subsp. paratuberculosis
ccgcgggcggggccugcggg

SEQ ID NO: 2981532 - RNA, 19 nt, Mycobacterium avium subsp. paratuberculosis
ccgcgggcggucgcgcagc

SEQ ID NO: 2981533 - RNA, 23 nt, Mycobacterium avium subsp. paratuberculosis
ccgcgggcggucgcgcagccgcc

SEQ ID NO: 2981534 - RNA, 22 nt, Mycobacterium avium subsp. paratuberculosis
ccgcgggcguggcggucggugc

SEQ ID NO: 2981535 - RNA, 19 nt, Mycobacterium avium subsp. paratuberculosis
ccgcgggcguucaucaccu

SEQ ID NO: 2981536 - RNA, 23 nt, Mycobacterium avium subsp. paratuberculosis
ccgcgggcguucaucaccugguc

SEQ ID NO: 2981537 - RNA, 12 nt, Mycobacterium avium subsp. paratuberculosis
ccgcgggcucga

SEQ ID NO: 2981538 - RNA, 15 nt, Mycobacterium avium subsp. paratuberculosis
ccgcgggcucgaaca

SEQ ID NO: 2981539 - RNA, 13 nt, Mycobacterium avium subsp. paratuberculosis
ccgcggggccggc

SEQ ID NO: 2981540 - RNA, 14 nt, Mycobacterium avium subsp. paratuberculosis
ccgcggggccggcg

SEQ ID NO: 2981541 - RNA, 20 nt, Mycobacterium avium subsp. paratuberculosis
ccgcggggcguacgcgcugc

SEQ ID NO: 2981542 - RNA, 15 nt, Mycobacterium avium subsp. paratuberculosis
ccgcgggggcggccg

SEQ ID NO: 2981543 - RNA, 14 nt, Mycobacterium avium subsp. paratuberculosis
ccgcggggugcccg

SEQ ID NO: 2981544 - RNA, 18 nt, Mycobacterium avium subsp. paratuberculosis
ccgcggguagcccgucga

SEQ ID NO: 2981545 - RNA, 22 nt, Mycobacterium avium subsp. paratuberculosis
ccgcggguauccgugaccccgg

SEQ ID NO: 2981546 - RNA, 14 nt, Mycobacterium avium subsp. paratuberculosis
ccgcgggucggcga

SEQ ID NO: 2981547 - RNA, 20 nt, Mycobacterium avium subsp. paratuberculosis
ccgcgggucggcgacggcgc

SEQ ID NO: 2981548 - RNA, 14 nt, Mycobacterium avium subsp. paratuberculosis
ccgcgggucgucga

SEQ ID NO: 2981549 - RNA, 15 nt, Mycobacterium avium subsp. paratuberculosis
ccgcgggucgucgac

SEQ ID NO: 2981550 - RNA, 17 nt, Mycobacterium avium subsp. paratuberculosis
ccgcgggucgucgacgu

SEQ ID NO: 2981551 - RNA, 24 nt, Mycobacterium avium subsp. paratuberculosis
ccgcgggucgucgacgucggacgc

SEQ ID NO: 2981552 - RNA, 14 nt, Mycobacterium avium subsp. paratuberculosis
ccgcgggucgucgg

SEQ ID NO: 2981553 - RNA, 21 nt, Mycobacterium avium subsp. paratuberculosis
ccgcgggucgucgggcggcag

SEQ ID NO: 2981554 - RNA, 16 nt, Mycobacterium avium subsp. paratuberculosis
ccgcgggugacgauca

SEQ ID NO: 2981555 - RNA, 18 nt, Mycobacterium avium subsp. paratuberculosis
ccgcgggugacgaucacc

SEQ ID NO: 2981556 - RNA, 22 nt, Mycobacterium avium subsp. paratuberculosis
ccgcgggugaggggcgcgcgcc

SEQ ID NO: 2981557 - RNA, 14 nt, Mycobacterium avium subsp. paratuberculosis
ccgcgggugaucug

SEQ ID NO: 2981558 - RNA, 22 nt, Mycobacterium avium subsp. paratuberculosis
ccgcgggugaucugcgccguga

SEQ ID NO: 2981559 - RNA, 18 nt, Mycobacterium avium subsp. paratuberculosis
ccgcgggugcagccggau

SEQ ID NO: 2981560 - RNA, 18 nt, Mycobacterium avium subsp. paratuberculosis
ccgcgggugcggcacggc

SEQ ID NO: 2981561 - RNA, 19 nt, Mycobacterium avium subsp. paratuberculosis
ccgcgggugcggcacggca

SEQ ID NO: 2981562 - RNA, 22 nt, Mycobacterium avium subsp. paratuberculosis
ccgcgggugcggcacggcaugg

SEQ ID NO: 2981563 - RNA, 20 nt, Mycobacterium avium subsp. paratuberculosis
ccgcggguggccagccaggu

SEQ ID NO: 2981564 - RNA, 15 nt, Mycobacterium avium subsp. paratuberculosis
ccgcggguggccuuc

SEQ ID NO: 2981565 - RNA, 22 nt, Mycobacterium avium subsp. paratuberculosis
ccgcggguggccuucaucaccg

SEQ ID NO: 2981566 - RNA, 13 nt, Mycobacterium avium subsp. paratuberculosis
ccgcggguggcgc

SEQ ID NO: 2981567 - RNA, 15 nt, Mycobacterium avium subsp. paratuberculosis
ccgcggguggcgcca

SEQ ID NO: 2981568 - RNA, 22 nt, Mycobacterium avium subsp. paratuberculosis
ccgcggguggcgccacagccgg

SEQ ID NO: 2981569 - RNA, 19 nt, Mycobacterium avium subsp. paratuberculosis
ccgcgggugucgcccucgg

SEQ ID NO: 2981570 - RNA, 18 nt, Mycobacterium avium subsp. paratuberculosis
ccgcgguagaaccaacgc

SEQ ID NO: 2981571 - RNA, 21 nt, Mycobacterium avium subsp. paratuberculosis
ccgcgguagaaccaacgcggc

SEQ ID NO: 2981572 - RNA, 22 nt, Mycobacterium avium subsp. paratuberculosis
ccgcgguagaaccaacgcggcg

SEQ ID NO: 2981573 - RNA, 17 nt, Mycobacterium avium subsp. paratuberculosis
ccgcgguagacaccgcc

SEQ ID NO: 2981574 - RNA, 17 nt, Mycobacterium avium subsp. paratuberculosis
ccgcgguagcggaccug

SEQ ID NO: 2981575 - RNA, 13 nt, Mycobacterium avium subsp. paratuberculosis
ccgcggucaccgg

SEQ ID NO: 2981576 - RNA, 20 nt, Mycobacterium avium subsp. paratuberculosis
ccgcggucaccggucggugc

SEQ ID NO: 2981577 - RNA, 23 nt, Mycobacterium avium subsp. paratuberculosis
ccgcggucagacgaugggccgcc

SEQ ID NO: 2981578 - RNA, 16 nt, Mycobacterium avium subsp. paratuberculosis
ccgcggucaucgagcc

SEQ ID NO: 2981579 - RNA, 14 nt, Mycobacterium avium subsp. paratuberculosis
ccgcggucaugcgc

SEQ ID NO: 2981580 - RNA, 18 nt, Mycobacterium avium subsp. paratuberculosis
ccgcggucaugcgcgggc

SEQ ID NO: 2981581 - RNA, 19 nt, Mycobacterium avium subsp. paratuberculosis
ccgcggucaugcgcgggca

SEQ ID NO: 2981582 - RNA, 18 nt, Mycobacterium avium subsp. paratuberculosis
ccgcgguccuccuggaug

SEQ ID NO: 2981583 - RNA, 12 nt, Mycobacterium avium subsp. paratuberculosis
ccgcggucgacc

SEQ ID NO: 2981584 - RNA, 13 nt, Mycobacterium avium subsp. paratuberculosis
ccgcggucgacca

SEQ ID NO: 2981585 - RNA, 13 nt, Mycobacterium avium subsp. paratuberculosis
ccgcggucgcacu

SEQ ID NO: 2981586 - RNA, 17 nt, Mycobacterium avium subsp. paratuberculosis
ccgcggucgcacuugaa

SEQ ID NO: 2981587 - RNA, 14 nt, Mycobacterium avium subsp. paratuberculosis
ccgcggucgccccg

SEQ ID NO: 2981588 - RNA, 16 nt, Mycobacterium avium subsp. paratuberculosis
ccgcggucgccccggc

SEQ ID NO: 2981589 - RNA, 17 nt, Mycobacterium avium subsp. paratuberculosis
ccgcggucgccccggcc

SEQ ID NO: 2981590 - RNA, 19 nt, Mycobacterium avium subsp. paratuberculosis
ccgcggucgccccggccgc

SEQ ID NO: 2981591 - RNA, 22 nt, Mycobacterium avium subsp. paratuberculosis
ccgcggucgccccggccgcggu

SEQ ID NO: 2981592 - RNA, 23 nt, Mycobacterium avium subsp. paratuberculosis
ccgcggucgccccggccgcggug

SEQ ID NO: 2981593 - RNA, 12 nt, Mycobacterium avium subsp. paratuberculosis
ccgcggucgcgg

SEQ ID NO: 2981594 - RNA, 15 nt, Mycobacterium avium subsp. paratuberculosis
ccgcggucgcggcgc

SEQ ID NO: 2981595 - RNA, 17 nt, Mycobacterium avium subsp. paratuberculosis
ccgcggucgcggcgccg

SEQ ID NO: 2981596 - RNA, 18 nt, Mycobacterium avium subsp. paratuberculosis
ccgcggucgcggcgccgg

SEQ ID NO: 2981597 - RNA, 13 nt, Mycobacterium avium subsp. paratuberculosis
ccgcggucggcgg

SEQ ID NO: 2981598 - RNA, 14 nt, Mycobacterium avium subsp. paratuberculosis
ccgcggucggcggc

SEQ ID NO: 2981599 - RNA, 15 nt, Mycobacterium avium subsp. paratuberculosis
ccgcggucggcggcg

SEQ ID NO: 2981600 - RNA, 18 nt, Mycobacterium avium subsp. paratuberculosis
ccgcggucgggucccggc

SEQ ID NO: 2981601 - RNA, 16 nt, Mycobacterium avium subsp. paratuberculosis
ccgcggucucgaccga

SEQ ID NO: 2981602 - RNA, 16 nt, Mycobacterium avium subsp. paratuberculosis
ccgcggucugcgccag

SEQ ID NO: 2981603 - RNA, 19 nt, Mycobacterium avium subsp. paratuberculosis
ccgcggucugcgccagcuc

SEQ ID NO: 2981604 - RNA, 21 nt, Mycobacterium avium subsp. paratuberculosis
ccgcggucugcgccagcucca

SEQ ID NO: 2981605 - RNA, 17 nt, Mycobacterium avium subsp. paratuberculosis
ccgcggugaccgcccgc

SEQ ID NO: 2981606 - RNA, 14 nt, Mycobacterium avium subsp. paratuberculosis
ccgcggugaccgcg

SEQ ID NO: 2981607 - RNA, 19 nt, Mycobacterium avium subsp. paratuberculosis
ccgcggugagcaccggauc

SEQ ID NO: 2981608 - RNA, 14 nt, Mycobacterium avium subsp. paratuberculosis
ccgcggugagcggc

SEQ ID NO: 2981609 - RNA, 16 nt, Mycobacterium avium subsp. paratuberculosis
ccgcggugagcggccg

SEQ ID NO: 2981610 - RNA, 18 nt, Mycobacterium avium subsp. paratuberculosis
ccgcggugagcggccgca

SEQ ID NO: 2981611 - RNA, 22 nt, Mycobacterium avium subsp. paratuberculosis
ccgcggugagcggccgcagcgc

SEQ ID NO: 2981612 - RNA, 21 nt, Mycobacterium avium subsp. paratuberculosis
ccgcggugaguucaucgacgu

SEQ ID NO: 2981613 - RNA, 19 nt, Mycobacterium avium subsp. paratuberculosis
ccgcggugcagucggucgg

SEQ ID NO: 2981614 - RNA, 12 nt, Mycobacterium avium subsp. paratuberculosis
ccgcggugccgc

SEQ ID NO: 2981615 - RNA, 14 nt, Mycobacterium avium subsp. paratuberculosis
ccgcggugccgcag

SEQ ID NO: 2981616 - RNA, 22 nt, Mycobacterium avium subsp. paratuberculosis
ccgcggugccgcagcucgauca

SEQ ID NO: 2981617 - RNA, 14 nt, Mycobacterium avium subsp. paratuberculosis
ccgcggugcgccac

SEQ ID NO: 2981618 - RNA, 16 nt, Mycobacterium avium subsp. paratuberculosis
ccgcggugcgccacgc

SEQ ID NO: 2981619 - RNA, 20 nt, Mycobacterium avium subsp. paratuberculosis
ccgcggugcgccacgcccgc

SEQ ID NO: 2981620 - RNA, 23 nt, Mycobacterium avium subsp. paratuberculosis
ccgcggugcgccacgcccgcagc

SEQ ID NO: 2981621 - RNA, 13 nt, Mycobacterium avium subsp. paratuberculosis
ccgcggugcgcga

SEQ ID NO: 2981622 - RNA, 13 nt, Mycobacterium avium subsp. paratuberculosis
ccgcggugcggcc

SEQ ID NO: 2981623 - RNA, 16 nt, Mycobacterium avium subsp. paratuberculosis
ccgcggugcggcccgc

SEQ ID NO: 2981624 - RNA, 20 nt, Mycobacterium avium subsp. paratuberculosis
ccgcggugcggcccgcggca

SEQ ID NO: 2981625 - RNA, 18 nt, Mycobacterium avium subsp. paratuberculosis
ccgcggugcugcagcgcg

SEQ ID NO: 2981626 - RNA, 17 nt, Mycobacterium avium subsp. paratuberculosis
ccgcgguggaacccagc

SEQ ID NO: 2981627 - RNA, 13 nt, Mycobacterium avium subsp. paratuberculosis
ccgcgguggccgg

SEQ ID NO: 2981628 - RNA, 15 nt, Mycobacterium avium subsp. paratuberculosis
ccgcgguggccggga

SEQ ID NO: 2981629 - RNA, 17 nt, Mycobacterium avium subsp. paratuberculosis
ccgcgguggccgggaug

SEQ ID NO: 2981630 - RNA, 15 nt, Mycobacterium avium subsp. paratuberculosis
ccgcgguggcgccgc

SEQ ID NO: 2981631 - RNA, 20 nt, Mycobacterium avium subsp. paratuberculosis
ccgcgguggcgccgcgggcg

SEQ ID NO: 2981632 - RNA, 12 nt, Mycobacterium avium subsp. paratuberculosis
ccgcgguggcgg

SEQ ID NO: 2981633 - RNA, 21 nt, Mycobacterium avium subsp. paratuberculosis
ccgcgguggguccgccgggcg

SEQ ID NO: 2981634 - RNA, 23 nt, Mycobacterium avium subsp. paratuberculosis
ccgcgguggguccgccgggcgcg

SEQ ID NO: 2981635 - RNA, 12 nt, Mycobacterium avium subsp. paratuberculosis
ccgcgguggugg

SEQ ID NO: 2981636 - RNA, 19 nt, Mycobacterium avium subsp. paratuberculosis
ccgcgguucgaucuccucg

SEQ ID NO: 2981637 - RNA, 23 nt, Mycobacterium avium subsp. paratuberculosis
ccgcgguucgaucuccucggcgu

SEQ ID NO: 2981638 - RNA, 13 nt, Mycobacterium avium subsp. paratuberculosis
ccgcgguucggcg

SEQ ID NO: 2981639 - RNA, 16 nt, Mycobacterium avium subsp. paratuberculosis
ccgcgguucggcgucg

SEQ ID NO: 2981640 - RNA, 18 nt, Mycobacterium avium subsp. paratuberculosis
ccgcgguucuuguccucg

SEQ ID NO: 2981641 - RNA, 17 nt, Mycobacterium avium subsp. paratuberculosis
ccgcgguuggucaccag

SEQ ID NO: 2981642 - RNA, 22 nt, Mycobacterium avium subsp. paratuberculosis
ccgcgguuggucaccaggucgc

SEQ ID NO: 2981643 - RNA, 17 nt, Mycobacterium avium subsp. paratuberculosis
ccgcgguuucaccgugc

SEQ ID NO: 2981644 - RNA, 18 nt, Mycobacterium avium subsp. paratuberculosis
ccgcgguuucaccgugcg

SEQ ID NO: 2981645 - RNA, 23 nt, Mycobacterium avium subsp. paratuberculosis
ccgcgguuucaccgugcgcgcgc

SEQ ID NO: 2981646 - RNA, 18 nt, Mycobacterium avium subsp. paratuberculosis
ccgcgguuuggucagcgc

SEQ ID NO: 2981647 - RNA, 19 nt, Mycobacterium avium subsp. paratuberculosis
ccgcgguuuggucagcgcc

SEQ ID NO: 2981648 - RNA, 15 nt, Mycobacterium avium subsp. paratuberculosis
ccgcguacagcagcu

SEQ ID NO: 2981649 - RNA, 18 nt, Mycobacterium avium subsp. paratuberculosis
ccgcguacagcagcugcc

SEQ ID NO: 2981650 - RNA, 16 nt, Mycobacterium avium subsp. paratuberculosis
ccgcguacagccagcc

SEQ ID NO: 2981651 - RNA, 14 nt, Mycobacterium avium subsp. paratuberculosis
ccgcguacagcggg

SEQ ID NO: 2981652 - RNA, 16 nt, Mycobacterium avium subsp. paratuberculosis
ccgcguacagcggguc

SEQ ID NO: 2981653 - RNA, 17 nt, Mycobacterium avium subsp. paratuberculosis
ccgcguacagcgggucg

SEQ ID NO: 2981654 - RNA, 22 nt, Mycobacterium avium subsp. paratuberculosis
ccgcguacagcgggucguuggc

SEQ ID NO: 2981655 - RNA, 15 nt, Mycobacterium avium subsp. paratuberculosis
ccgcguaccagcgcc

SEQ ID NO: 2981656 - RNA, 17 nt, Mycobacterium avium subsp. paratuberculosis
ccgcguaccagcgccac

SEQ ID NO: 2981657 - RNA, 18 nt, Mycobacterium avium subsp. paratuberculosis
ccgcguaccagcgccacg

SEQ ID NO: 2981658 - RNA, 14 nt, Mycobacterium avium subsp. paratuberculosis
ccgcguacgccgcc

SEQ ID NO: 2981659 - RNA, 17 nt, Mycobacterium avium subsp. paratuberculosis
ccgcguagcgccgcccg

SEQ ID NO: 2981660 - RNA, 18 nt, Mycobacterium avium subsp. paratuberculosis
ccgcguagcucgccgcgg

SEQ ID NO: 2981661 - RNA, 19 nt, Mycobacterium avium subsp. paratuberculosis
ccgcguagcucgccgcggc

SEQ ID NO: 2981662 - RNA, 20 nt, Mycobacterium avium subsp. paratuberculosis
ccgcguagcucgccgcggcc

SEQ ID NO: 2981663 - RNA, 22 nt, Mycobacterium avium subsp. paratuberculosis
ccgcguagcucgccgcggccac

SEQ ID NO: 2981664 - RNA, 14 nt, Mycobacterium avium subsp. paratuberculosis
ccgcguaggccagg

SEQ ID NO: 2981665 - RNA, 23 nt, Mycobacterium avium subsp. paratuberculosis
ccgcguaggccuugcugagccgg

SEQ ID NO: 2981666 - RNA, 21 nt, Mycobacterium avium subsp. paratuberculosis
ccgcguaggucuucggugaag

SEQ ID NO: 2981667 - RNA, 21 nt, Mycobacterium avium subsp. paratuberculosis
ccgcguagucguugucggcgg

SEQ ID NO: 2981668 - RNA, 16 nt, Mycobacterium avium subsp. paratuberculosis
ccgcguauugcacggc

SEQ ID NO: 2981669 - RNA, 20 nt, Mycobacterium avium subsp. paratuberculosis
ccgcguauugcacggcggcg

SEQ ID NO: 2981670 - RNA, 21 nt, Mycobacterium avium subsp. paratuberculosis
ccgcgucacauccgucacgcc

SEQ ID NO: 2981671 - RNA, 15 nt, Mycobacterium avium subsp. paratuberculosis
ccgcgucacgucggc

SEQ ID NO: 2981672 - RNA, 18 nt, Mycobacterium avium subsp. paratuberculosis
ccgcgucacgucggccug

SEQ ID NO: 2981673 - RNA, 19 nt, Mycobacterium avium subsp. paratuberculosis
ccgcgucagcagcgcgacg

SEQ ID NO: 2981674 - RNA, 17 nt, Mycobacterium avium subsp. paratuberculosis
ccgcgucagcggcgggc

SEQ ID NO: 2981675 - RNA, 19 nt, Mycobacterium avium subsp. paratuberculosis
ccgcgucagcggcgggcau

SEQ ID NO: 2981676 - RNA, 20 nt, Mycobacterium avium subsp. paratuberculosis
ccgcgucaucgggcccgacg

SEQ ID NO: 2981677 - RNA, 18 nt, Mycobacterium avium subsp. paratuberculosis
ccgcguccacgaccccgg

SEQ ID NO: 2981678 - RNA, 19 nt, Mycobacterium avium subsp. paratuberculosis
ccgcguccacgaccccggc

SEQ ID NO: 2981679 - RNA, 21 nt, Mycobacterium avium subsp. paratuberculosis
ccgcguccacgaccccggcgg

SEQ ID NO: 2981680 - RNA, 22 nt, Mycobacterium avium subsp. paratuberculosis
ccgcguccacgaccccggcggc

SEQ ID NO: 2981681 - RNA, 14 nt, Mycobacterium avium subsp. paratuberculosis
ccgcguccagcagc

SEQ ID NO: 2981682 - RNA, 15 nt, Mycobacterium avium subsp. paratuberculosis
ccgcguccgaggcgg

SEQ ID NO: 2981683 - RNA, 16 nt, Mycobacterium avium subsp. paratuberculosis
ccgcguccgcgguuuc

SEQ ID NO: 2981684 - RNA, 16 nt, Mycobacterium avium subsp. paratuberculosis
ccgcguccgcgucguc

SEQ ID NO: 2981685 - RNA, 24 nt, Mycobacterium avium subsp. paratuberculosis
ccgcguccucgccguacgcgccgg

SEQ ID NO: 2981686 - RNA, 19 nt, Mycobacterium avium subsp. paratuberculosis
ccgcguccucgucgaugcc

SEQ ID NO: 2981687 - RNA, 17 nt, Mycobacterium avium subsp. paratuberculosis
ccgcguccugcagcgcc

SEQ ID NO: 2981688 - RNA, 14 nt, Mycobacterium avium subsp. paratuberculosis
ccgcguccuucucc

SEQ ID NO: 2981689 - RNA, 19 nt, Mycobacterium avium subsp. paratuberculosis
ccgcguccuucuccgccgg

SEQ ID NO: 2981690 - RNA, 21 nt, Mycobacterium avium subsp. paratuberculosis
ccgcguccuucuccgccgggc

SEQ ID NO: 2981691 - RNA, 14 nt, Mycobacterium avium subsp. paratuberculosis
ccgcgucgaccacc

SEQ ID NO: 2981692 - RNA, 17 nt, Mycobacterium avium subsp. paratuberculosis
ccgcgucgaccaccgcc

SEQ ID NO: 2981693 - RNA, 21 nt, Mycobacterium avium subsp. paratuberculosis
ccgcgucgaccaccgccggcc

SEQ ID NO: 2981694 - RNA, 23 nt, Mycobacterium avium subsp. paratuberculosis
ccgcgucgaccaccgccggcccg

SEQ ID NO: 2981695 - RNA, 16 nt, Mycobacterium avium subsp. paratuberculosis
ccgcgucgaccagccg

SEQ ID NO: 2981696 - RNA, 17 nt, Mycobacterium avium subsp. paratuberculosis
ccgcgucgaccagccgg

SEQ ID NO: 2981697 - RNA, 22 nt, Mycobacterium avium subsp. paratuberculosis
ccgcgucgaccagccgguaggc

SEQ ID NO: 2981698 - RNA, 12 nt, Mycobacterium avium subsp. paratuberculosis
ccgcgucgacgc

SEQ ID NO: 2981699 - RNA, 13 nt, Mycobacterium avium subsp. paratuberculosis
ccgcgucgacggc

SEQ ID NO: 2981700 - RNA, 17 nt, Mycobacterium avium subsp. paratuberculosis
ccgcgucgacggcgugg

SEQ ID NO: 2981701 - RNA, 20 nt, Mycobacterium avium subsp. paratuberculosis
ccgcgucgaugcgggcccgc

SEQ ID NO: 2981702 - RNA, 15 nt, Mycobacterium avium subsp. paratuberculosis
ccgcgucgccgacca

SEQ ID NO: 2981703 - RNA, 16 nt, Mycobacterium avium subsp. paratuberculosis
ccgcgucgccgaccag

SEQ ID NO: 2981704 - RNA, 18 nt, Mycobacterium avium subsp. paratuberculosis
ccgcgucgccgaccagca

SEQ ID NO: 2981705 - RNA, 19 nt, Mycobacterium avium subsp. paratuberculosis
ccgcgucgccgaccagcag

SEQ ID NO: 2981706 - RNA, 15 nt, Mycobacterium avium subsp. paratuberculosis
ccgcgucgccgaucg

SEQ ID NO: 2981707 - RNA, 21 nt, Mycobacterium avium subsp. paratuberculosis
ccgcgucgccgaucgcccggu

SEQ ID NO: 2981708 - RNA, 13 nt, Mycobacterium avium subsp. paratuberculosis
ccgcgucgccgcc

SEQ ID NO: 2981709 - RNA, 14 nt, Mycobacterium avium subsp. paratuberculosis
ccgcgucgccgccg

SEQ ID NO: 2981710 - RNA, 16 nt, Mycobacterium avium subsp. paratuberculosis
ccgcgucgcgccgccg

SEQ ID NO: 2981711 - RNA, 13 nt, Mycobacterium avium subsp. paratuberculosis
ccgcgucggaccc

SEQ ID NO: 2981712 - RNA, 19 nt, Mycobacterium avium subsp. paratuberculosis
ccgcgucggaccccgaugc

SEQ ID NO: 2981713 - RNA, 15 nt, Mycobacterium avium subsp. paratuberculosis
ccgcgucggaggcca

SEQ ID NO: 2981714 - RNA, 18 nt, Mycobacterium avium subsp. paratuberculosis
ccgcgucggaggccauga

SEQ ID NO: 2981715 - RNA, 14 nt, Mycobacterium avium subsp. paratuberculosis
ccgcgucggcccag

SEQ ID NO: 2981716 - RNA, 20 nt, Mycobacterium avium subsp. paratuberculosis
ccgcgucggcccccagcgag

SEQ ID NO: 2981717 - RNA, 21 nt, Mycobacterium avium subsp. paratuberculosis
ccgcgucggcccccagcgagg

SEQ ID NO: 2981718 - RNA, 15 nt, Mycobacterium avium subsp. paratuberculosis
ccgcgucggcgccgg

SEQ ID NO: 2981719 - RNA, 16 nt, Mycobacterium avium subsp. paratuberculosis
ccgcgucggcgccggc

SEQ ID NO: 2981720 - RNA, 17 nt, Mycobacterium avium subsp. paratuberculosis
ccgcgucggcgccggcc

SEQ ID NO: 2981721 - RNA, 15 nt, Mycobacterium avium subsp. paratuberculosis
ccgcgucggcgcugg

SEQ ID NO: 2981722 - RNA, 20 nt, Mycobacterium avium subsp. paratuberculosis
ccgcgucggcgcuggccagc

SEQ ID NO: 2981723 - RNA, 13 nt, Mycobacterium avium subsp. paratuberculosis
ccgcgucggcggc

SEQ ID NO: 2981724 - RNA, 16 nt, Mycobacterium avium subsp. paratuberculosis
ccgcgucggcggcggc

SEQ ID NO: 2981725 - RNA, 20 nt, Mycobacterium avium subsp. paratuberculosis
ccgcgucggcggcggcggcc

SEQ ID NO: 2981726 - RNA, 22 nt, Mycobacterium avium subsp. paratuberculosis
ccgcgucggcggcggcggccgc

SEQ ID NO: 2981727 - RNA, 23 nt, Mycobacterium avium subsp. paratuberculosis
ccgcgucggcggucgccagcgcc

SEQ ID NO: 2981728 - RNA, 13 nt, Mycobacterium avium subsp. paratuberculosis
ccgcgucgggcag

SEQ ID NO: 2981729 - RNA, 15 nt, Mycobacterium avium subsp. paratuberculosis
ccgcgucgggcaggu

SEQ ID NO: 2981730 - RNA, 16 nt, Mycobacterium avium subsp. paratuberculosis
ccgcgucggucagcgc

SEQ ID NO: 2981731 - RNA, 12 nt, Mycobacterium avium subsp. paratuberculosis
ccgcgucgucga

SEQ ID NO: 2981732 - RNA, 17 nt, Mycobacterium avium subsp. paratuberculosis
ccgcgucgucgaggcgg

SEQ ID NO: 2981733 - RNA, 12 nt, Mycobacterium avium subsp. paratuberculosis
ccgcgucgucgu

SEQ ID NO: 2981734 - RNA, 15 nt, Mycobacterium avium subsp. paratuberculosis
ccgcgucgucgucga

SEQ ID NO: 2981735 - RNA, 16 nt, Mycobacterium avium subsp. paratuberculosis
ccgcgucgucgucgac

SEQ ID NO: 2981736 - RNA, 17 nt, Mycobacterium avium subsp. paratuberculosis
ccgcgucgucgucgacc

SEQ ID NO: 2981737 - RNA, 22 nt, Mycobacterium avium subsp. paratuberculosis
ccgcgucgucgucgaccgucag

SEQ ID NO: 2981738 - RNA, 17 nt, Mycobacterium avium subsp. paratuberculosis
ccgcgucgugccgagcg

SEQ ID NO: 2981739 - RNA, 20 nt, Mycobacterium avium subsp. paratuberculosis
ccgcgucgugccgagcguga

SEQ ID NO: 2981740 - RNA, 14 nt, Mycobacterium avium subsp. paratuberculosis
ccgcgucguggccc

SEQ ID NO: 2981741 - RNA, 15 nt, Mycobacterium avium subsp. paratuberculosis
ccgcgucguggcccu

SEQ ID NO: 2981742 - RNA, 19 nt, Mycobacterium avium subsp. paratuberculosis
ccgcgucguguccgggccc

SEQ ID NO: 2981743 - RNA, 21 nt, Mycobacterium avium subsp. paratuberculosis
ccgcgucguguccgggcccga

SEQ ID NO: 2981744 - RNA, 23 nt, Mycobacterium avium subsp. paratuberculosis
ccgcgucguugagugcgcugugg

SEQ ID NO: 2981745 - RNA, 18 nt, Mycobacterium avium subsp. paratuberculosis
ccgcgucuugcgccgaag

SEQ ID NO: 2981746 - RNA, 16 nt, Mycobacterium avium subsp. paratuberculosis
ccgcgucuuggacgcc

SEQ ID NO: 2981747 - RNA, 17 nt, Mycobacterium avium subsp. paratuberculosis
ccgcgucuuggacgccc

SEQ ID NO: 2981748 - RNA, 20 nt, Mycobacterium avium subsp. paratuberculosis
ccgcgugacaagccggcguc

SEQ ID NO: 2981749 - RNA, 22 nt, Mycobacterium avium subsp. paratuberculosis
ccgcgugacaagccggcgucga

SEQ ID NO: 2981750 - RNA, 18 nt, Mycobacterium avium subsp. paratuberculosis
ccgcgugacaggggcagc

SEQ ID NO: 2981751 - RNA, 21 nt, Mycobacterium avium subsp. paratuberculosis
ccgcgugacaggggcagcagc

SEQ ID NO: 2981752 - RNA, 13 nt, Mycobacterium avium subsp. paratuberculosis
ccgcgugacggcc

SEQ ID NO: 2981753 - RNA, 20 nt, Mycobacterium avium subsp. paratuberculosis
ccgcgugcacacccuuuucc

SEQ ID NO: 2981754 - RNA, 18 nt, Mycobacterium avium subsp. paratuberculosis
ccgcgugcgagccgagca

SEQ ID NO: 2981755 - RNA, 19 nt, Mycobacterium avium subsp. paratuberculosis
ccgcgugcgagccgagcac

SEQ ID NO: 2981756 - RNA, 18 nt, Mycobacterium avium subsp. paratuberculosis
ccgcguggcaggucgggc

SEQ ID NO: 2981757 - RNA, 19 nt, Mycobacterium avium subsp. paratuberculosis
ccgcguggcaggucgggcu

SEQ ID NO: 2981758 - RNA, 17 nt, Mycobacterium avium subsp. paratuberculosis
ccgcguggccgaggaug

SEQ ID NO: 2981759 - RNA, 12 nt, Mycobacterium avium subsp. paratuberculosis
ccgcguggccuc

SEQ ID NO: 2981760 - RNA, 14 nt, Mycobacterium avium subsp. paratuberculosis
ccgcguggcgcaca

SEQ ID NO: 2981761 - RNA, 15 nt, Mycobacterium avium subsp. paratuberculosis
ccgcguggcgcacag

SEQ ID NO: 2981762 - RNA, 20 nt, Mycobacterium avium subsp. paratuberculosis
ccgcgugggcaccccgauca

SEQ ID NO: 2981763 - RNA, 14 nt, Mycobacterium avium subsp. paratuberculosis
ccgcgugucggcac

SEQ ID NO: 2981764 - RNA, 17 nt, Mycobacterium avium subsp. paratuberculosis
ccgcgugucggcacacc

SEQ ID NO: 2981765 - RNA, 18 nt, Mycobacterium avium subsp. paratuberculosis
ccgcgugucggcacacca

SEQ ID NO: 2981766 - RNA, 19 nt, Mycobacterium avium subsp. paratuberculosis
ccgcguucacccgcgcccg

SEQ ID NO: 2981767 - RNA, 22 nt, Mycobacterium avium subsp. paratuberculosis
ccgcguucacccgcgcccgcau

SEQ ID NO: 2981768 - RNA, 16 nt, Mycobacterium avium subsp. paratuberculosis
ccgcguuccccggcgu

SEQ ID NO: 2981769 - RNA, 19 nt, Mycobacterium avium subsp. paratuberculosis
ccgcguucgaccuccacga

SEQ ID NO: 2981770 - RNA, 22 nt, Mycobacterium avium subsp. paratuberculosis
ccgcguucgaccuccacgagcc

SEQ ID NO: 2981771 - RNA, 16 nt, Mycobacterium avium subsp. paratuberculosis
ccgcguucucggcgga

SEQ ID NO: 2981772 - RNA, 17 nt, Mycobacterium avium subsp. paratuberculosis
ccgcguugaucagcgcc

SEQ ID NO: 2981773 - RNA, 16 nt, Mycobacterium avium subsp. paratuberculosis
ccgcguugcggcgcag

SEQ ID NO: 2981774 - RNA, 15 nt, Mycobacterium avium subsp. paratuberculosis
ccgcguuggccagcg

SEQ ID NO: 2981775 - RNA, 15 nt, Mycobacterium avium subsp. paratuberculosis
ccgcguuggcgccga

SEQ ID NO: 2981776 - RNA, 17 nt, Mycobacterium avium subsp. paratuberculosis
ccgcguuguccggggug

SEQ ID NO: 2981777 - RNA, 18 nt, Mycobacterium avium subsp. paratuberculosis
ccgcguuguccggggugg

SEQ ID NO: 2981778 - RNA, 14 nt, Mycobacterium avium subsp. paratuberculosis
ccgcguugucgacc

SEQ ID NO: 2981779 - RNA, 17 nt, Mycobacterium avium subsp. paratuberculosis
ccgcguugucggcgacg

SEQ ID NO: 2981780 - RNA, 18 nt, Mycobacterium avium subsp. paratuberculosis
ccgcguugucggcgacgg

SEQ ID NO: 2981781 - RNA, 19 nt, Mycobacterium avium subsp. paratuberculosis
ccgcguugucggcgacggc

SEQ ID NO: 2981782 - RNA, 16 nt, Mycobacterium avium subsp. paratuberculosis
ccgcguugucggcguc

SEQ ID NO: 2981783 - RNA, 18 nt, Mycobacterium avium subsp. paratuberculosis
ccgcguugucggcguccu

SEQ ID NO: 2981784 - RNA, 15 nt, Mycobacterium avium subsp. paratuberculosis
ccgcguugugcacca

SEQ ID NO: 2981785 - RNA, 17 nt, Mycobacterium avium subsp. paratuberculosis
ccgcguugugcaccaac

SEQ ID NO: 2981786 - RNA, 15 nt, Mycobacterium avium subsp. paratuberculosis
ccgcuaaagccgacu

SEQ ID NO: 2981787 - RNA, 12 nt, Mycobacterium avium subsp. paratuberculosis
ccgcuacccggc

SEQ ID NO: 2981788 - RNA, 13 nt, Mycobacterium avium subsp. paratuberculosis
ccgcuacccggcg

SEQ ID NO: 2981789 - RNA, 16 nt, Mycobacterium avium subsp. paratuberculosis
ccgcuacccggcgaac

SEQ ID NO: 2981790 - RNA, 20 nt, Mycobacterium avium subsp. paratuberculosis
ccgcuagaccgauggcggcg

SEQ ID NO: 2981791 - RNA, 23 nt, Mycobacterium avium subsp. paratuberculosis
ccgcuagaccgauggcggcggcc

SEQ ID NO: 2981792 - RNA, 18 nt, Mycobacterium avium subsp. paratuberculosis
ccgcuagguuuggccagc

SEQ ID NO: 2981793 - RNA, 19 nt, Mycobacterium avium subsp. paratuberculosis
ccgcuagguuuggccagca

SEQ ID NO: 2981794 - RNA, 13 nt, Mycobacterium avium subsp. paratuberculosis
ccgcuagucgccc

SEQ ID NO: 2981795 - RNA, 15 nt, Mycobacterium avium subsp. paratuberculosis
ccgcuagucgcccag

SEQ ID NO: 2981796 - RNA, 17 nt, Mycobacterium avium subsp. paratuberculosis
ccgcuagucgcccagca

SEQ ID NO: 2981797 - RNA, 21 nt, Mycobacterium avium subsp. paratuberculosis
ccgcuagucgcccagcagccc

SEQ ID NO: 2981798 - RNA, 16 nt, Mycobacterium avium subsp. paratuberculosis
ccgcuaguuggugcug

SEQ ID NO: 2981799 - RNA, 20 nt, Mycobacterium avium subsp. paratuberculosis
ccgcucaacuugaucagcuc

SEQ ID NO: 2981800 - RNA, 21 nt, Mycobacterium avium subsp. paratuberculosis
ccgcucaacuugaucagcucg

SEQ ID NO: 2981801 - RNA, 22 nt, Mycobacterium avium subsp. paratuberculosis
ccgcucaacuugaucagcucgc

SEQ ID NO: 2981802 - RNA, 12 nt, Mycobacterium avium subsp. paratuberculosis
ccgcucaccgcc

SEQ ID NO: 2981803 - RNA, 13 nt, Mycobacterium avium subsp. paratuberculosis
ccgcucaccgccg

SEQ ID NO: 2981804 - RNA, 15 nt, Mycobacterium avium subsp. paratuberculosis
ccgcucaccugcggc

SEQ ID NO: 2981805 - RNA, 18 nt, Mycobacterium avium subsp. paratuberculosis
ccgcucaccugcggcccg

SEQ ID NO: 2981806 - RNA, 20 nt, Mycobacterium avium subsp. paratuberculosis
ccgcucagcgauugcggccg

SEQ ID NO: 2981807 - RNA, 21 nt, Mycobacterium avium subsp. paratuberculosis
ccgcucagcgauugcggccgc

SEQ ID NO: 2981808 - RNA, 22 nt, Mycobacterium avium subsp. paratuberculosis
ccgcucagcgauugcggccgcc

SEQ ID NO: 2981809 - RNA, 23 nt, Mycobacterium avium subsp. paratuberculosis
ccgcucagcgauugcggccgccg

SEQ ID NO: 2981810 - RNA, 14 nt, Mycobacterium avium subsp. paratuberculosis
ccgcucagcgggcg

SEQ ID NO: 2981811 - RNA, 16 nt, Mycobacterium avium subsp. paratuberculosis
ccgcucagcgggcggc

SEQ ID NO: 2981812 - RNA, 20 nt, Mycobacterium avium subsp. paratuberculosis
ccgcucagcgggcggccagc

SEQ ID NO: 2981813 - RNA, 22 nt, Mycobacterium avium subsp. paratuberculosis
ccgcucagcgggcggccagccg

SEQ ID NO: 2981814 - RNA, 23 nt, Mycobacterium avium subsp. paratuberculosis
ccgcucagcgggcggccagccgc

SEQ ID NO: 2981815 - RNA, 16 nt, Mycobacterium avium subsp. paratuberculosis
ccgcucaggucggccg

SEQ ID NO: 2981816 - RNA, 17 nt, Mycobacterium avium subsp. paratuberculosis
ccgcucaggucggccgc

SEQ ID NO: 2981817 - RNA, 19 nt, Mycobacterium avium subsp. paratuberculosis
ccgcucaggucggccgcgg

SEQ ID NO: 2981818 - RNA, 17 nt, Mycobacterium avium subsp. paratuberculosis
ccgcucaguccagcucc

SEQ ID NO: 2981819 - RNA, 15 nt, Mycobacterium avium subsp. paratuberculosis
ccgcucaucgucguu

SEQ ID NO: 2981820 - RNA, 14 nt, Mycobacterium avium subsp. paratuberculosis
ccgcuccaccagcg

SEQ ID NO: 2981821 - RNA, 22 nt, Mycobacterium avium subsp. paratuberculosis
ccgcuccaccagcgcggugaug

SEQ ID NO: 2981822 - RNA, 14 nt, Mycobacterium avium subsp. paratuberculosis
ccgcuccaccgaaa

SEQ ID NO: 2981823 - RNA, 17 nt, Mycobacterium avium subsp. paratuberculosis
ccgcuccaccgcguccu

SEQ ID NO: 2981824 - RNA, 13 nt, Mycobacterium avium subsp. paratuberculosis
ccgcuccagcggc

SEQ ID NO: 2981825 - RNA, 20 nt, Mycobacterium avium subsp. paratuberculosis
ccgcuccagcggccacaccg

SEQ ID NO: 2981826 - RNA, 16 nt, Mycobacterium avium subsp. paratuberculosis
ccgcuccauggcggcg

SEQ ID NO: 2981827 - RNA, 18 nt, Mycobacterium avium subsp. paratuberculosis
ccgcuccauggcggcgac

SEQ ID NO: 2981828 - RNA, 20 nt, Mycobacterium avium subsp. paratuberculosis
ccgcuccauggcggcgacca

SEQ ID NO: 2981829 - RNA, 18 nt, Mycobacterium avium subsp. paratuberculosis
ccgcuccauguucggggc

SEQ ID NO: 2981830 - RNA, 16 nt, Mycobacterium avium subsp. paratuberculosis
ccgcucccauccggaa

SEQ ID NO: 2981831 - RNA, 17 nt, Mycobacterium avium subsp. paratuberculosis
ccgcuccccgagcacgu

SEQ ID NO: 2981832 - RNA, 20 nt, Mycobacterium avium subsp. paratuberculosis
ccgcuccccgagcacgucga

SEQ ID NO: 2981833 - RNA, 22 nt, Mycobacterium avium subsp. paratuberculosis
ccgcuccccgagcacgucgagc

SEQ ID NO: 2981834 - RNA, 12 nt, Mycobacterium avium subsp. paratuberculosis
ccgcucccggcg

SEQ ID NO: 2981835 - RNA, 15 nt, Mycobacterium avium subsp. paratuberculosis
ccgcucccggcgcag

SEQ ID NO: 2981836 - RNA, 15 nt, Mycobacterium avium subsp. paratuberculosis
ccgcucccgggacag

SEQ ID NO: 2981837 - RNA, 22 nt, Mycobacterium avium subsp. paratuberculosis
ccgcuccgacgcgguggcgugc

SEQ ID NO: 2981838 - RNA, 12 nt, Mycobacterium avium subsp. paratuberculosis
ccgcuccgcggc

SEQ ID NO: 2981839 - RNA, 14 nt, Mycobacterium avium subsp. paratuberculosis
ccgcuccgcggcgg

SEQ ID NO: 2981840 - RNA, 16 nt, Mycobacterium avium subsp. paratuberculosis
ccgcuccgcgggcagc

SEQ ID NO: 2981841 - RNA, 14 nt, Mycobacterium avium subsp. paratuberculosis
ccgcuccgcggugc

SEQ ID NO: 2981842 - RNA, 17 nt, Mycobacterium avium subsp. paratuberculosis
ccgcuccgcggugcugc

SEQ ID NO: 2981843 - RNA, 15 nt, Mycobacterium avium subsp. paratuberculosis
ccgcuccggcggacc

SEQ ID NO: 2981844 - RNA, 13 nt, Mycobacterium avium subsp. paratuberculosis
ccgcuccggucgc

SEQ ID NO: 2981845 - RNA, 18 nt, Mycobacterium avium subsp. paratuberculosis
ccgcuccggucgcgucgu

SEQ ID NO: 2981846 - RNA, 23 nt, Mycobacterium avium subsp. paratuberculosis
ccgcuccggucgcgucgugcggc

SEQ ID NO: 2981847 - RNA, 24 nt, Mycobacterium avium subsp. paratuberculosis
ccgcuccggucgcgucgugcggcc

SEQ ID NO: 2981848 - RNA, 23 nt, Mycobacterium avium subsp. paratuberculosis
ccgcuccuccucgcgccgccacg

SEQ ID NO: 2981849 - RNA, 16 nt, Mycobacterium avium subsp. paratuberculosis
ccgcucgaacacccgg

SEQ ID NO: 2981850 - RNA, 17 nt, Mycobacterium avium subsp. paratuberculosis
ccgcucgaacacccggc

SEQ ID NO: 2981851 - RNA, 14 nt, Mycobacterium avium subsp. paratuberculosis
ccgcucgaccccuc

SEQ ID NO: 2981852 - RNA, 18 nt, Mycobacterium avium subsp. paratuberculosis
ccgcucgacgcgcacccg

SEQ ID NO: 2981853 - RNA, 18 nt, Mycobacterium avium subsp. paratuberculosis
ccgcucgaucuggcggac

SEQ ID NO: 2981854 - RNA, 16 nt, Mycobacterium avium subsp. paratuberculosis
ccgcucgauggcgccg

SEQ ID NO: 2981855 - RNA, 17 nt, Mycobacterium avium subsp. paratuberculosis
ccgcucgauggcgccga

SEQ ID NO: 2981856 - RNA, 23 nt, Mycobacterium avium subsp. paratuberculosis
ccgcucgauggguguggcgucga

SEQ ID NO: 2981857 - RNA, 14 nt, Mycobacterium avium subsp. paratuberculosis
ccgcucgcccagcg

SEQ ID NO: 2981858 - RNA, 23 nt, Mycobacterium avium subsp. paratuberculosis
ccgcucgccgaaaugccgugcca

SEQ ID NO: 2981859 - RNA, 15 nt, Mycobacterium avium subsp. paratuberculosis
ccgcucgccgaugac

SEQ ID NO: 2981860 - RNA, 18 nt, Mycobacterium avium subsp. paratuberculosis
ccgcucgccgaugacguu

SEQ ID NO: 2981861 - RNA, 13 nt, Mycobacterium avium subsp. paratuberculosis
ccgcucgccgcgg

SEQ ID NO: 2981862 - RNA, 21 nt, Mycobacterium avium subsp. paratuberculosis
ccgcucgccggggacgacggc

SEQ ID NO: 2981863 - RNA, 14 nt, Mycobacterium avium subsp. paratuberculosis
ccgcucgcgcaccg

SEQ ID NO: 2981864 - RNA, 19 nt, Mycobacterium avium subsp. paratuberculosis
ccgcucgcgcaccgggacc

SEQ ID NO: 2981865 - RNA, 14 nt, Mycobacterium avium subsp. paratuberculosis
ccgcucgcgggcca

SEQ ID NO: 2981866 - RNA, 15 nt, Mycobacterium avium subsp. paratuberculosis
ccgcucgcgggcccg

SEQ ID NO: 2981867 - RNA, 20 nt, Mycobacterium avium subsp. paratuberculosis
ccgcucgcgggcccgcgccg

SEQ ID NO: 2981868 - RNA, 13 nt, Mycobacterium avium subsp. paratuberculosis
ccgcucggccagc

SEQ ID NO: 2981869 - RNA, 16 nt, Mycobacterium avium subsp. paratuberculosis
ccgcucggccagcagc

SEQ ID NO: 2981870 - RNA, 18 nt, Mycobacterium avium subsp. paratuberculosis
ccgcucggccagcagcac

SEQ ID NO: 2981871 - RNA, 17 nt, Mycobacterium avium subsp. paratuberculosis
ccgcucggccagcgcag

SEQ ID NO: 2981872 - RNA, 22 nt, Mycobacterium avium subsp. paratuberculosis
ccgcucggccagcgcagcgacc

SEQ ID NO: 2981873 - RNA, 18 nt, Mycobacterium avium subsp. paratuberculosis
ccgcucggccagcgcgcc

SEQ ID NO: 2981874 - RNA, 11 nt, Mycobacterium avium subsp. paratuberculosis
ccgcucggcga

SEQ ID NO: 2981875 - RNA, 20 nt, Mycobacterium avium subsp. paratuberculosis
ccgcucggcggcgccgucgu

SEQ ID NO: 2981876 - RNA, 13 nt, Mycobacterium avium subsp. paratuberculosis
ccgcucggcgggu

SEQ ID NO: 2981877 - RNA, 16 nt, Mycobacterium avium subsp. paratuberculosis
ccgcucggcgggucgu

SEQ ID NO: 2981878 - RNA, 13 nt, Mycobacterium avium subsp. paratuberculosis
ccgcucggcgugg

SEQ ID NO: 2981879 - RNA, 22 nt, Mycobacterium avium subsp. paratuberculosis
ccgcucggcguggcgcucagcg

SEQ ID NO: 2981880 - RNA, 13 nt, Mycobacterium avium subsp. paratuberculosis
ccgcucggcucga

SEQ ID NO: 2981881 - RNA, 18 nt, Mycobacterium avium subsp. paratuberculosis
ccgcucggcucgauccac

SEQ ID NO: 2981882 - RNA, 13 nt, Mycobacterium avium subsp. paratuberculosis
ccgcucgggcccg

SEQ ID NO: 2981883 - RNA, 14 nt, Mycobacterium avium subsp. paratuberculosis
ccgcucgggcccgc

SEQ ID NO: 2981884 - RNA, 16 nt, Mycobacterium avium subsp. paratuberculosis
ccgcucgggcccgcgc

SEQ ID NO: 2981885 - RNA, 17 nt, Mycobacterium avium subsp. paratuberculosis
ccgcucgggcccgcgca

SEQ ID NO: 2981886 - RNA, 13 nt, Mycobacterium avium subsp. paratuberculosis
ccgcucgggcgcc

SEQ ID NO: 2981887 - RNA, 17 nt, Mycobacterium avium subsp. paratuberculosis
ccgcucgggcgccucga

SEQ ID NO: 2981888 - RNA, 15 nt, Mycobacterium avium subsp. paratuberculosis
ccgcucgggcgugcg

SEQ ID NO: 2981889 - RNA, 18 nt, Mycobacterium avium subsp. paratuberculosis
ccgcucgggcgugcgcgu

SEQ ID NO: 2981890 - RNA, 23 nt, Mycobacterium avium subsp. paratuberculosis
ccgcucggggaucccgaaaccgu

SEQ ID NO: 2981891 - RNA, 15 nt, Mycobacterium avium subsp. paratuberculosis
ccgcucgggugucgc

SEQ ID NO: 2981892 - RNA, 23 nt, Mycobacterium avium subsp. paratuberculosis
ccgcucggucuugaucaggucgc

SEQ ID NO: 2981893 - RNA, 17 nt, Mycobacterium avium subsp. paratuberculosis
ccgcucguaacgccacg

SEQ ID NO: 2981894 - RNA, 21 nt, Mycobacterium avium subsp. paratuberculosis
ccgcucguaacgccacggcgg

SEQ ID NO: 2981895 - RNA, 21 nt, Mycobacterium avium subsp. paratuberculosis
ccgcucguaguuggggccggc

SEQ ID NO: 2981896 - RNA, 22 nt, Mycobacterium avium subsp. paratuberculosis
ccgcucguaguuggggccggcc

SEQ ID NO: 2981897 - RNA, 17 nt, Mycobacterium avium subsp. paratuberculosis
ccgcucgucggccagcg

SEQ ID NO: 2981898 - RNA, 20 nt, Mycobacterium avium subsp. paratuberculosis
ccgcucgucggccagcgagu

SEQ ID NO: 2981899 - RNA, 22 nt, Mycobacterium avium subsp. paratuberculosis
ccgcucgucgggaacgccgauc

SEQ ID NO: 2981900 - RNA, 13 nt, Mycobacterium avium subsp. paratuberculosis
ccgcucgucgggc

SEQ ID NO: 2981901 - RNA, 15 nt, Mycobacterium avium subsp. paratuberculosis
ccgcucgucgggcac

SEQ ID NO: 2981902 - RNA, 14 nt, Mycobacterium avium subsp. paratuberculosis
ccgcucuucgacga

SEQ ID NO: 2981903 - RNA, 15 nt, Mycobacterium avium subsp. paratuberculosis
ccgcucuucgacgac

SEQ ID NO: 2981904 - RNA, 18 nt, Mycobacterium avium subsp. paratuberculosis
ccgcucuucgacgacccg

SEQ ID NO: 2981905 - RNA, 20 nt, Mycobacterium avium subsp. paratuberculosis
ccgcucuucgacgacccgau

SEQ ID NO: 2981906 - RNA, 22 nt, Mycobacterium avium subsp. paratuberculosis
ccgcucuucggucaucgugauc

SEQ ID NO: 2981907 - RNA, 21 nt, Mycobacterium avium subsp. paratuberculosis
ccgcugaaagcucgcgucgac

SEQ ID NO: 2981908 - RNA, 23 nt, Mycobacterium avium subsp. paratuberculosis
ccgcugaaagcucgcgucgacgu

SEQ ID NO: 2981909 - RNA, 21 nt, Mycobacterium avium subsp. paratuberculosis
ccgcugaaauccggggucagg

SEQ ID NO: 2981910 - RNA, 16 nt, Mycobacterium avium subsp. paratuberculosis
ccgcugaacgggcagc

SEQ ID NO: 2981911 - RNA, 17 nt, Mycobacterium avium subsp. paratuberculosis
ccgcugaagccgaacgc

SEQ ID NO: 2981912 - RNA, 21 nt, Mycobacterium avium subsp. paratuberculosis
ccgcugaccaggaagaugccg

SEQ ID NO: 2981913 - RNA, 14 nt, Mycobacterium avium subsp. paratuberculosis
ccgcugaccaggcc

SEQ ID NO: 2981914 - RNA, 15 nt, Mycobacterium avium subsp. paratuberculosis
ccgcugaccaggccg

SEQ ID NO: 2981915 - RNA, 16 nt, Mycobacterium avium subsp. paratuberculosis
ccgcugaccgccgcgc

SEQ ID NO: 2981916 - RNA, 22 nt, Mycobacterium avium subsp. paratuberculosis
ccgcugaccgccgcgcucggcc

SEQ ID NO: 2981917 - RNA, 16 nt, Mycobacterium avium subsp. paratuberculosis
ccgcugacgauggcga

SEQ ID NO: 2981918 - RNA, 17 nt, Mycobacterium avium subsp. paratuberculosis
ccgcugacgcggcgggc

SEQ ID NO: 2981919 - RNA, 17 nt, Mycobacterium avium subsp. paratuberculosis
ccgcugacggucgccga

SEQ ID NO: 2981920 - RNA, 22 nt, Mycobacterium avium subsp. paratuberculosis
ccgcugacggucgccgacucgc

SEQ ID NO: 2981921 - RNA, 20 nt, Mycobacterium avium subsp. paratuberculosis
ccgcugacugcgaucgccga

SEQ ID NO: 2981922 - RNA, 23 nt, Mycobacterium avium subsp. paratuberculosis
ccgcugacugcgaucgccgacgc

SEQ ID NO: 2981923 - RNA, 20 nt, Mycobacterium avium subsp. paratuberculosis
ccgcugagcuucugcccggc

SEQ ID NO: 2981924 - RNA, 11 nt, Mycobacterium avium subsp. paratuberculosis
ccgcugaggcg

SEQ ID NO: 2981925 - RNA, 14 nt, Mycobacterium avium subsp. paratuberculosis
ccgcugauccagca

SEQ ID NO: 2981926 - RNA, 13 nt, Mycobacterium avium subsp. paratuberculosis
ccgcugaugccgc

SEQ ID NO: 2981927 - RNA, 15 nt, Mycobacterium avium subsp. paratuberculosis
ccgcugaugccgccg

SEQ ID NO: 2981928 - RNA, 17 nt, Mycobacterium avium subsp. paratuberculosis
ccgcugaugccgccgaa

SEQ ID NO: 2981929 - RNA, 18 nt, Mycobacterium avium subsp. paratuberculosis
ccgcugaugccgccgaag

SEQ ID NO: 2981930 - RNA, 15 nt, Mycobacterium avium subsp. paratuberculosis
ccgcugaugcggccg

SEQ ID NO: 2981931 - RNA, 19 nt, Mycobacterium avium subsp. paratuberculosis
ccgcugaugcggccggaau

SEQ ID NO: 2981932 - RNA, 15 nt, Mycobacterium avium subsp. paratuberculosis
ccgcugcaaccggua

SEQ ID NO: 2981933 - RNA, 21 nt, Mycobacterium avium subsp. paratuberculosis
ccgcugcaaccgguagcgguc

SEQ ID NO: 2981934 - RNA, 14 nt, Mycobacterium avium subsp. paratuberculosis
ccgcugcaccagcc

SEQ ID NO: 2981935 - RNA, 18 nt, Mycobacterium avium subsp. paratuberculosis
ccgcugcaccagcccguc

SEQ ID NO: 2981936 - RNA, 22 nt, Mycobacterium avium subsp. paratuberculosis
ccgcugcaccagcccgucggcc

SEQ ID NO: 2981937 - RNA, 17 nt, Mycobacterium avium subsp. paratuberculosis
ccgcugcacgcguugca

SEQ ID NO: 2981938 - RNA, 13 nt, Mycobacterium avium subsp. paratuberculosis
ccgcugcagcgcc

SEQ ID NO: 2981939 - RNA, 15 nt, Mycobacterium avium subsp. paratuberculosis
ccgcugcagcgccgc

SEQ ID NO: 2981940 - RNA, 16 nt, Mycobacterium avium subsp. paratuberculosis
ccgcugcagcgccgcc

SEQ ID NO: 2981941 - RNA, 17 nt, Mycobacterium avium subsp. paratuberculosis
ccgcugcagcgccgccc

SEQ ID NO: 2981942 - RNA, 18 nt, Mycobacterium avium subsp. paratuberculosis
ccgcugcagcgccgcccg

SEQ ID NO: 2981943 - RNA, 19 nt, Mycobacterium avium subsp. paratuberculosis
ccgcugcagcgccgcccgc

SEQ ID NO: 2981944 - RNA, 21 nt, Mycobacterium avium subsp. paratuberculosis
ccgcugcagcggguuuggccg

SEQ ID NO: 2981945 - RNA, 23 nt, Mycobacterium avium subsp. paratuberculosis
ccgcugcagcggguuuggccgcg

SEQ ID NO: 2981946 - RNA, 13 nt, Mycobacterium avium subsp. paratuberculosis
ccgcugcagcugc

SEQ ID NO: 2981947 - RNA, 18 nt, Mycobacterium avium subsp. paratuberculosis
ccgcugcagcugcucguc

SEQ ID NO: 2981948 - RNA, 19 nt, Mycobacterium avium subsp. paratuberculosis
ccgcugcagcugcucgucc

SEQ ID NO: 2981949 - RNA, 14 nt, Mycobacterium avium subsp. paratuberculosis
ccgcugcauccgca

SEQ ID NO: 2981950 - RNA, 20 nt, Mycobacterium avium subsp. paratuberculosis
ccgcugcauccgcagcacca

SEQ ID NO: 2981951 - RNA, 17 nt, Mycobacterium avium subsp. paratuberculosis
ccgcugcaugccgucga

SEQ ID NO: 2981952 - RNA, 19 nt, Mycobacterium avium subsp. paratuberculosis
ccgcugcaugccgucgauc

SEQ ID NO: 2981953 - RNA, 13 nt, Mycobacterium avium subsp. paratuberculosis
ccgcugccacggu

SEQ ID NO: 2981954 - RNA, 21 nt, Mycobacterium avium subsp. paratuberculosis
ccgcugccacgguuucgccgu

SEQ ID NO: 2981955 - RNA, 12 nt, Mycobacterium avium subsp. paratuberculosis
ccgcugcccgcc

SEQ ID NO: 2981956 - RNA, 14 nt, Mycobacterium avium subsp. paratuberculosis
ccgcugcccgccgc

SEQ ID NO: 2981957 - RNA, 22 nt, Mycobacterium avium subsp. paratuberculosis
ccgcugcccgccgcguacagca

SEQ ID NO: 2981958 - RNA, 13 nt, Mycobacterium avium subsp. paratuberculosis
ccgcugcccggcg

SEQ ID NO: 2981959 - RNA, 14 nt, Mycobacterium avium subsp. paratuberculosis
ccgcugcccggcgc

SEQ ID NO: 2981960 - RNA, 13 nt, Mycobacterium avium subsp. paratuberculosis
ccgcugcccgggc

SEQ ID NO: 2981961 - RNA, 15 nt, Mycobacterium avium subsp. paratuberculosis
ccgcugcccgggcau

SEQ ID NO: 2981962 - RNA, 18 nt, Mycobacterium avium subsp. paratuberculosis
ccgcugccgcaccccgug

SEQ ID NO: 2981963 - RNA, 13 nt, Mycobacterium avium subsp. paratuberculosis
ccgcugccggacc

SEQ ID NO: 2981964 - RNA, 17 nt, Mycobacterium avium subsp. paratuberculosis
ccgcugccggggugcag

SEQ ID NO: 2981965 - RNA, 22 nt, Mycobacterium avium subsp. paratuberculosis
ccgcugccggggugcagcacca

SEQ ID NO: 2981966 - RNA, 13 nt, Mycobacterium avium subsp. paratuberculosis
ccgcugccguccg

SEQ ID NO: 2981967 - RNA, 16 nt, Mycobacterium avium subsp. paratuberculosis
ccgcugccguccggcg

SEQ ID NO: 2981968 - RNA, 18 nt, Mycobacterium avium subsp. paratuberculosis
ccgcugccguccggcggc

SEQ ID NO: 2981969 - RNA, 23 nt, Mycobacterium avium subsp. paratuberculosis
ccgcugccguucgccgguaccgc

SEQ ID NO: 2981970 - RNA, 17 nt, Mycobacterium avium subsp. paratuberculosis
ccgcugcgacaggucgg

SEQ ID NO: 2981971 - RNA, 18 nt, Mycobacterium avium subsp. paratuberculosis
ccgcugcgacaggucggc

SEQ ID NO: 2981972 - RNA, 21 nt, Mycobacterium avium subsp. paratuberculosis
ccgcugcgacaggucggcggu

SEQ ID NO: 2981973 - RNA, 22 nt, Mycobacterium avium subsp. paratuberculosis
ccgcugcgacaggucggcgguc

SEQ ID NO: 2981974 - RNA, 14 nt, Mycobacterium avium subsp. paratuberculosis
ccgcugcgcccagc

SEQ ID NO: 2981975 - RNA, 22 nt, Mycobacterium avium subsp. paratuberculosis
ccgcugcgccgacuugaucgcg

SEQ ID NO: 2981976 - RNA, 16 nt, Mycobacterium avium subsp. paratuberculosis
ccgcugcgccggcgcg

SEQ ID NO: 2981977 - RNA, 21 nt, Mycobacterium avium subsp. paratuberculosis
ccgcugcgccggcgcggccag

SEQ ID NO: 2981978 - RNA, 16 nt, Mycobacterium avium subsp. paratuberculosis
ccgcugcgcgggucgg

SEQ ID NO: 2981979 - RNA, 20 nt, Mycobacterium avium subsp. paratuberculosis
ccgcugcggcaaugccguug

SEQ ID NO: 2981980 - RNA, 13 nt, Mycobacterium avium subsp. paratuberculosis
ccgcugcggcaca

SEQ ID NO: 2981981 - RNA, 17 nt, Mycobacterium avium subsp. paratuberculosis
ccgcugcggcacaccag

SEQ ID NO: 2981982 - RNA, 12 nt, Mycobacterium avium subsp. paratuberculosis
ccgcugcgggcc

SEQ ID NO: 2981983 - RNA, 24 nt, Mycobacterium avium subsp. paratuberculosis
ccgcugcgggccaucgacuccagc

SEQ ID NO: 2981984 - RNA, 17 nt, Mycobacterium avium subsp. paratuberculosis
ccgcugcgggcgggccg

SEQ ID NO: 2981985 - RNA, 18 nt, Mycobacterium avium subsp. paratuberculosis
ccgcugcgggcgggccgc

SEQ ID NO: 2981986 - RNA, 19 nt, Mycobacterium avium subsp. paratuberculosis
ccgcugcgggcgggccgcc

SEQ ID NO: 2981987 - RNA, 20 nt, Mycobacterium avium subsp. paratuberculosis
ccgcugcgggcgggccgcca

SEQ ID NO: 2981988 - RNA, 22 nt, Mycobacterium avium subsp. paratuberculosis
ccgcugcgugcccggaucgccg

SEQ ID NO: 2981989 - RNA, 19 nt, Mycobacterium avium subsp. paratuberculosis
ccgcugcuccggguccgcg

SEQ ID NO: 2981990 - RNA, 21 nt, Mycobacterium avium subsp. paratuberculosis
ccgcugcuccggguccgcggu

SEQ ID NO: 2981991 - RNA, 17 nt, Mycobacterium avium subsp. paratuberculosis
ccgcugcugcucggccg

SEQ ID NO: 2981992 - RNA, 18 nt, Mycobacterium avium subsp. paratuberculosis
ccgcugcugcucggccgc

SEQ ID NO: 2981993 - RNA, 19 nt, Mycobacterium avium subsp. paratuberculosis
ccgcugcugggugccgcgu

SEQ ID NO: 2981994 - RNA, 20 nt, Mycobacterium avium subsp. paratuberculosis
ccgcugcugggugccgcguu

SEQ ID NO: 2981995 - RNA, 16 nt, Mycobacterium avium subsp. paratuberculosis
ccgcuggaacagcggg

SEQ ID NO: 2981996 - RNA, 17 nt, Mycobacterium avium subsp. paratuberculosis
ccgcuggaacagcgggc

SEQ ID NO: 2981997 - RNA, 18 nt, Mycobacterium avium subsp. paratuberculosis
ccgcuggaacagcgggcc

SEQ ID NO: 2981998 - RNA, 20 nt, Mycobacterium avium subsp. paratuberculosis
ccgcuggaacagcgggccgg

SEQ ID NO: 2981999 - RNA, 22 nt, Mycobacterium avium subsp. paratuberculosis
ccgcuggaacagcgggccggcg

SEQ ID NO: 2982000 - RNA, 23 nt, Mycobacterium avium subsp. paratuberculosis
ccgcuggaacagcgggccggcgu

SEQ ID NO: 2982001 - RNA, 21 nt, Mycobacterium avium subsp. paratuberculosis
ccgcuggaagucggucugcgg

SEQ ID NO: 2982002 - RNA, 23 nt, Mycobacterium avium subsp. paratuberculosis
ccgcuggaagucggucugcggag

SEQ ID NO: 2982003 - RNA, 15 nt, Mycobacterium avium subsp. paratuberculosis
ccgcuggaucccggu

SEQ ID NO: 2982004 - RNA, 18 nt, Mycobacterium avium subsp. paratuberculosis
ccgcuggaucccggugag

SEQ ID NO: 2982005 - RNA, 19 nt, Mycobacterium avium subsp. paratuberculosis
ccgcuggauuccaccgugg

SEQ ID NO: 2982006 - RNA, 13 nt, Mycobacterium avium subsp. paratuberculosis
ccgcuggcccggc

SEQ ID NO: 2982007 - RNA, 14 nt, Mycobacterium avium subsp. paratuberculosis
ccgcuggcccggcg

SEQ ID NO: 2982008 - RNA, 20 nt, Mycobacterium avium subsp. paratuberculosis
ccgcuggccgaggccuccag

SEQ ID NO: 2982009 - RNA, 11 nt, Mycobacterium avium subsp. paratuberculosis
ccgcuggccgc

SEQ ID NO: 2982010 - RNA, 12 nt, Mycobacterium avium subsp. paratuberculosis
ccgcuggccgcc

SEQ ID NO: 2982011 - RNA, 19 nt, Mycobacterium avium subsp. paratuberculosis
ccgcuggccgccccgaaca

SEQ ID NO: 2982012 - RNA, 22 nt, Mycobacterium avium subsp. paratuberculosis
ccgcuggccgccccgaacagcg

SEQ ID NO: 2982013 - RNA, 13 nt, Mycobacterium avium subsp. paratuberculosis
ccgcuggccgccg

SEQ ID NO: 2982014 - RNA, 14 nt, Mycobacterium avium subsp. paratuberculosis
ccgcuggccgccgc

SEQ ID NO: 2982015 - RNA, 13 nt, Mycobacterium avium subsp. paratuberculosis
ccgcuggccgcgc

SEQ ID NO: 2982016 - RNA, 13 nt, Mycobacterium avium subsp. paratuberculosis
ccgcuggcgccgg

SEQ ID NO: 2982017 - RNA, 21 nt, Mycobacterium avium subsp. paratuberculosis
ccgcuggcguagaucugcacg

SEQ ID NO: 2982018 - RNA, 18 nt, Mycobacterium avium subsp. paratuberculosis
ccgcuggcgucgaucgcg

SEQ ID NO: 2982019 - RNA, 11 nt, Mycobacterium avium subsp. paratuberculosis
ccgcugggagc

SEQ ID NO: 2982020 - RNA, 14 nt, Mycobacterium avium subsp. paratuberculosis
ccgcugggcggcgc

SEQ ID NO: 2982021 - RNA, 18 nt, Mycobacterium avium subsp. paratuberculosis
ccgcugggcggcgcggcg

SEQ ID NO: 2982022 - RNA, 19 nt, Mycobacterium avium subsp. paratuberculosis
ccgcugggcggcgcggcgg

SEQ ID NO: 2982023 - RNA, 16 nt, Mycobacterium avium subsp. paratuberculosis
ccgcugggcguggugc

SEQ ID NO: 2982024 - RNA, 18 nt, Mycobacterium avium subsp. paratuberculosis
ccgcugggcguggugcgg

SEQ ID NO: 2982025 - RNA, 16 nt, Mycobacterium avium subsp. paratuberculosis
ccgcuggggcccagcu

SEQ ID NO: 2982026 - RNA, 17 nt, Mycobacterium avium subsp. paratuberculosis
ccgcuggggcccagcuc

SEQ ID NO: 2982027 - RNA, 20 nt, Mycobacterium avium subsp. paratuberculosis
ccgcuggggcgcaccgccug

SEQ ID NO: 2982028 - RNA, 16 nt, Mycobacterium avium subsp. paratuberculosis
ccgcugguaggcggcg

SEQ ID NO: 2982029 - RNA, 21 nt, Mycobacterium avium subsp. paratuberculosis
ccgcugguaggcggcgcagcc

SEQ ID NO: 2982030 - RNA, 16 nt, Mycobacterium avium subsp. paratuberculosis
ccgcuggucaggccga

SEQ ID NO: 2982031 - RNA, 19 nt, Mycobacterium avium subsp. paratuberculosis
ccgcuggugaacucgccga

SEQ ID NO: 2982032 - RNA, 23 nt, Mycobacterium avium subsp. paratuberculosis
ccgcuggugaacucgccgaucgg

SEQ ID NO: 2982033 - RNA, 18 nt, Mycobacterium avium subsp. paratuberculosis
ccgcuggugaggucgcgc

SEQ ID NO: 2982034 - RNA, 21 nt, Mycobacterium avium subsp. paratuberculosis
ccgcuggugaggucgcgcagg

SEQ ID NO: 2982035 - RNA, 16 nt, Mycobacterium avium subsp. paratuberculosis
ccgcuggugcgcgccg

SEQ ID NO: 2982036 - RNA, 17 nt, Mycobacterium avium subsp. paratuberculosis
ccgcuggugcgcgccgg

SEQ ID NO: 2982037 - RNA, 19 nt, Mycobacterium avium subsp. paratuberculosis
ccgcuggugcgcgccggcg

SEQ ID NO: 2982038 - RNA, 22 nt, Mycobacterium avium subsp. paratuberculosis
ccgcuggugcgcgccggcgucg

SEQ ID NO: 2982039 - RNA, 22 nt, Mycobacterium avium subsp. paratuberculosis
ccgcugguggugaucacccagc

SEQ ID NO: 2982040 - RNA, 23 nt, Mycobacterium avium subsp. paratuberculosis
ccgcugguggugaucacccagcc

SEQ ID NO: 2982041 - RNA, 22 nt, Mycobacterium avium subsp. paratuberculosis
ccgcugucaauccccgcgguuc

SEQ ID NO: 2982042 - RNA, 14 nt, Mycobacterium avium subsp. paratuberculosis
ccgcugucggugug

SEQ ID NO: 2982043 - RNA, 11 nt, Mycobacterium avium subsp. paratuberculosis
ccgcugucguc

SEQ ID NO: 2982044 - RNA, 14 nt, Mycobacterium avium subsp. paratuberculosis
ccgcugucgucgaa

SEQ ID NO: 2982045 - RNA, 15 nt, Mycobacterium avium subsp. paratuberculosis
ccgcugucugcgugc

SEQ ID NO: 2982046 - RNA, 17 nt, Mycobacterium avium subsp. paratuberculosis
ccgcugugcggcccggc

SEQ ID NO: 2982047 - RNA, 14 nt, Mycobacterium avium subsp. paratuberculosis
ccgcuguggacagg

SEQ ID NO: 2982048 - RNA, 23 nt, Mycobacterium avium subsp. paratuberculosis
ccgcuguggacaggucgaugaug

SEQ ID NO: 2982049 - RNA, 18 nt, Mycobacterium avium subsp. paratuberculosis
ccgcugugguccucguca

SEQ ID NO: 2982050 - RNA, 19 nt, Mycobacterium avium subsp. paratuberculosis
ccgcugugguccucgucac

SEQ ID NO: 2982051 - RNA, 22 nt, Mycobacterium avium subsp. paratuberculosis
ccgcuguucggguagacgauca

SEQ ID NO: 2982052 - RNA, 17 nt, Mycobacterium avium subsp. paratuberculosis
ccgcuucaggcagcgca

SEQ ID NO: 2982053 - RNA, 18 nt, Mycobacterium avium subsp. paratuberculosis
ccgcuucaggcagcgcac

SEQ ID NO: 2982054 - RNA, 13 nt, Mycobacterium avium subsp. paratuberculosis
ccgcuucccaccc

SEQ ID NO: 2982055 - RNA, 17 nt, Mycobacterium avium subsp. paratuberculosis
ccgcuucccacccgguc

SEQ ID NO: 2982056 - RNA, 14 nt, Mycobacterium avium subsp. paratuberculosis
ccgcuucgaggugc

SEQ ID NO: 2982057 - RNA, 16 nt, Mycobacterium avium subsp. paratuberculosis
ccgcuucgcccggcug

SEQ ID NO: 2982058 - RNA, 17 nt, Mycobacterium avium subsp. paratuberculosis
ccgcuucgcccggcugc

SEQ ID NO: 2982059 - RNA, 19 nt, Mycobacterium avium subsp. paratuberculosis
ccgcuucgucgccggccgc

SEQ ID NO: 2982060 - RNA, 15 nt, Mycobacterium avium subsp. paratuberculosis
ccgcuucuggcgggc

SEQ ID NO: 2982061 - RNA, 18 nt, Mycobacterium avium subsp. paratuberculosis
ccgcuugacgccgccgaa

SEQ ID NO: 2982062 - RNA, 19 nt, Mycobacterium avium subsp. paratuberculosis
ccgcuugacgccgccgaac

SEQ ID NO: 2982063 - RNA, 14 nt, Mycobacterium avium subsp. paratuberculosis
ccgcuugauggcgg

SEQ ID NO: 2982064 - RNA, 15 nt, Mycobacterium avium subsp. paratuberculosis
ccgcuugauggcggc

SEQ ID NO: 2982065 - RNA, 18 nt, Mycobacterium avium subsp. paratuberculosis
ccgcuugccggauugcga

SEQ ID NO: 2982066 - RNA, 21 nt, Mycobacterium avium subsp. paratuberculosis
ccgcuugcgacuggauggcga

SEQ ID NO: 2982067 - RNA, 15 nt, Mycobacterium avium subsp. paratuberculosis
ccgcuuggcccaccg

SEQ ID NO: 2982068 - RNA, 14 nt, Mycobacterium avium subsp. paratuberculosis
ccgcuuggccgggc

SEQ ID NO: 2982069 - RNA, 23 nt, Mycobacterium avium subsp. paratuberculosis
ccgcuuggcgcgccgcaccucgc

SEQ ID NO: 2982070 - RNA, 14 nt, Mycobacterium avium subsp. paratuberculosis
ccgcuuggcggucu

SEQ ID NO: 2982071 - RNA, 20 nt, Mycobacterium avium subsp. paratuberculosis
ccgcuugggugaaucaccaa

SEQ ID NO: 2982072 - RNA, 14 nt, Mycobacterium avium subsp. paratuberculosis
ccgcuugguggcgc

SEQ ID NO: 2982073 - RNA, 17 nt, Mycobacterium avium subsp. paratuberculosis
ccgcuugguggcgccgg

SEQ ID NO: 2982074 - RNA, 23 nt, Mycobacterium avium subsp. paratuberculosis
ccgcuuguucgggcccacacugu

SEQ ID NO: 2982075 - RNA, 17 nt, Mycobacterium avium subsp. paratuberculosis
ccgcuuuccaccccggc

SEQ ID NO: 2982076 - RNA, 19 nt, Mycobacterium avium subsp. paratuberculosis
ccgcuuugaauugagcgcc

SEQ ID NO: 2982077 - RNA, 22 nt, Mycobacterium avium subsp. paratuberculosis
ccgcuuugaauugagcgccggg

SEQ ID NO: 2982078 - RNA, 23 nt, Mycobacterium avium subsp. paratuberculosis
ccgcuuugaauugagcgccgggg

SEQ ID NO: 2982079 - RNA, 15 nt, Mycobacterium avium subsp. paratuberculosis
ccgcuuuugccgucg

SEQ ID NO: 2982080 - RNA, 16 nt, Mycobacterium avium subsp. paratuberculosis
ccgcuuuugccgucgg

SEQ ID NO: 2982081 - RNA, 22 nt, Mycobacterium avium subsp. paratuberculosis
ccggaaaaagcguugcgccagc

SEQ ID NO: 2982082 - RNA, 18 nt, Mycobacterium avium subsp. paratuberculosis
ccggaaagcgcgggcagc

SEQ ID NO: 2982083 - RNA, 20 nt, Mycobacterium avium subsp. paratuberculosis
ccggaaagcgcgggcagccc

SEQ ID NO: 2982084 - RNA, 17 nt, Mycobacterium avium subsp. paratuberculosis
ccggaacacaacgccuu

SEQ ID NO: 2982085 - RNA, 22 nt, Mycobacterium avium subsp. paratuberculosis
ccggaacagcuggucccacagc

SEQ ID NO: 2982086 - RNA, 22 nt, Mycobacterium avium subsp. paratuberculosis
ccggaacagcuuggcgcagccg

SEQ ID NO: 2982087 - RNA, 18 nt, Mycobacterium avium subsp. paratuberculosis
ccggaaccgcgccuucga

SEQ ID NO: 2982088 - RNA, 20 nt, Mycobacterium avium subsp. paratuberculosis
ccggaaccgggcacccggcg

SEQ ID NO: 2982089 - RNA, 23 nt, Mycobacterium avium subsp. paratuberculosis
ccggaacgacgcguccguagugc

SEQ ID NO: 2982090 - RNA, 18 nt, Mycobacterium avium subsp. paratuberculosis
ccggaacgcgucgcccac

SEQ ID NO: 2982091 - RNA, 22 nt, Mycobacterium avium subsp. paratuberculosis
ccggaacgcgucgcccacgccg

SEQ ID NO: 2982092 - RNA, 14 nt, Mycobacterium avium subsp. paratuberculosis
ccggaacggcgggc

SEQ ID NO: 2982093 - RNA, 23 nt, Mycobacterium avium subsp. paratuberculosis
ccggaacggcgggcccgucgccg

SEQ ID NO: 2982094 - RNA, 17 nt, Mycobacterium avium subsp. paratuberculosis
ccggaagaccguugacg

SEQ ID NO: 2982095 - RNA, 18 nt, Mycobacterium avium subsp. paratuberculosis
ccggaagaucagcaggcu

SEQ ID NO: 2982096 - RNA, 19 nt, Mycobacterium avium subsp. paratuberculosis
ccggaagaucagcaggcug

SEQ ID NO: 2982097 - RNA, 14 nt, Mycobacterium avium subsp. paratuberculosis
ccggaagccgucgg

SEQ ID NO: 2982098 - RNA, 17 nt, Mycobacterium avium subsp. paratuberculosis
ccggaagccgucggugc

SEQ ID NO: 2982099 - RNA, 16 nt, Mycobacterium avium subsp. paratuberculosis
ccggaagccuguuggc

SEQ ID NO: 2982100 - RNA, 19 nt, Mycobacterium avium subsp. paratuberculosis
ccggaaggccaaggccagc

SEQ ID NO: 2982101 - RNA, 16 nt, Mycobacterium avium subsp. paratuberculosis
ccggaagugccggcga

SEQ ID NO: 2982102 - RNA, 22 nt, Mycobacterium avium subsp. paratuberculosis
ccggaaguucucgccgugcagc

SEQ ID NO: 2982103 - RNA, 21 nt, Mycobacterium avium subsp. paratuberculosis
ccggaaucgcgggaucggccg

SEQ ID NO: 2982104 - RNA, 15 nt, Mycobacterium avium subsp. paratuberculosis
ccggaaucgucggcc

SEQ ID NO: 2982105 - RNA, 16 nt, Mycobacterium avium subsp. paratuberculosis
ccggaaucgucggcca

SEQ ID NO: 2982106 - RNA, 23 nt, Mycobacterium avium subsp. paratuberculosis
ccggaaugcggugcugccgugcc

SEQ ID NO: 2982107 - RNA, 15 nt, Mycobacterium avium subsp. paratuberculosis
ccggaauggcagcag

SEQ ID NO: 2982108 - RNA, 16 nt, Mycobacterium avium subsp. paratuberculosis
ccggaauggcagcagc

SEQ ID NO: 2982109 - RNA, 17 nt, Mycobacterium avium subsp. paratuberculosis
ccggaauggcagcagcc

SEQ ID NO: 2982110 - RNA, 19 nt, Mycobacterium avium subsp. paratuberculosis
ccggaauggcagcagccgg

SEQ ID NO: 2982111 - RNA, 17 nt, Mycobacterium avium subsp. paratuberculosis
ccggaauugaagaagcg

SEQ ID NO: 2982112 - RNA, 15 nt, Mycobacterium avium subsp. paratuberculosis
ccggacaacggaucg

SEQ ID NO: 2982113 - RNA, 14 nt, Mycobacterium avium subsp. paratuberculosis
ccggacaccaccgc

SEQ ID NO: 2982114 - RNA, 15 nt, Mycobacterium avium subsp. paratuberculosis
ccggacaccaccgcg

SEQ ID NO: 2982115 - RNA, 16 nt, Mycobacterium avium subsp. paratuberculosis
ccggacaccaccgcgg

SEQ ID NO: 2982116 - RNA, 15 nt, Mycobacterium avium subsp. paratuberculosis
ccggacaccccggcc

SEQ ID NO: 2982117 - RNA, 17 nt, Mycobacterium avium subsp. paratuberculosis
ccggacaccccggccag

SEQ ID NO: 2982118 - RNA, 20 nt, Mycobacterium avium subsp. paratuberculosis
ccggacaccgaaccgccccg

SEQ ID NO: 2982119 - RNA, 15 nt, Mycobacterium avium subsp. paratuberculosis
ccggacaccggcacg

SEQ ID NO: 2982120 - RNA, 19 nt, Mycobacterium avium subsp. paratuberculosis
ccggacaccggcacgucgg

SEQ ID NO: 2982121 - RNA, 15 nt, Mycobacterium avium subsp. paratuberculosis
ccggacacggccagc

SEQ ID NO: 2982122 - RNA, 16 nt, Mycobacterium avium subsp. paratuberculosis
ccggacacggccagcg

SEQ ID NO: 2982123 - RNA, 21 nt, Mycobacterium avium subsp. paratuberculosis
ccggacagaucgcccaucacc

SEQ ID NO: 2982124 - RNA, 15 nt, Mycobacterium avium subsp. paratuberculosis
ccggacagccacucc

SEQ ID NO: 2982125 - RNA, 18 nt, Mycobacterium avium subsp. paratuberculosis
ccggacagccggggcagc

SEQ ID NO: 2982126 - RNA, 15 nt, Mycobacterium avium subsp. paratuberculosis
ccggacagcgcgacg

SEQ ID NO: 2982127 - RNA, 18 nt, Mycobacterium avium subsp. paratuberculosis
ccggacagcggccccccg

SEQ ID NO: 2982128 - RNA, 15 nt, Mycobacterium avium subsp. paratuberculosis
ccggacagcgggccg

SEQ ID NO: 2982129 - RNA, 17 nt, Mycobacterium avium subsp. paratuberculosis
ccggacagcgggccgac

SEQ ID NO: 2982130 - RNA, 18 nt, Mycobacterium avium subsp. paratuberculosis
ccggacagcgggccgacc

SEQ ID NO: 2982131 - RNA, 20 nt, Mycobacterium avium subsp. paratuberculosis
ccggacagcgggccgacccg

SEQ ID NO: 2982132 - RNA, 21 nt, Mycobacterium avium subsp. paratuberculosis
ccggacagcgggccgacccgg

SEQ ID NO: 2982133 - RNA, 20 nt, Mycobacterium avium subsp. paratuberculosis
ccggacagcuggcggucgcu

SEQ ID NO: 2982134 - RNA, 13 nt, Mycobacterium avium subsp. paratuberculosis
ccggacagcuggg

SEQ ID NO: 2982135 - RNA, 13 nt, Mycobacterium avium subsp. paratuberculosis
ccggacaggucga

SEQ ID NO: 2982136 - RNA, 15 nt, Mycobacterium avium subsp. paratuberculosis
ccggacaggucgggc

SEQ ID NO: 2982137 - RNA, 16 nt, Mycobacterium avium subsp. paratuberculosis
ccggacaggucgggca

SEQ ID NO: 2982138 - RNA, 20 nt, Mycobacterium avium subsp. paratuberculosis
ccggacauaggcgucgcggu

SEQ ID NO: 2982139 - RNA, 22 nt, Mycobacterium avium subsp. paratuberculosis
ccggacauccauugggccgcgg

SEQ ID NO: 2982140 - RNA, 23 nt, Mycobacterium avium subsp. paratuberculosis
ccggacauccauugggccgcggc

SEQ ID NO: 2982141 - RNA, 13 nt, Mycobacterium avium subsp. paratuberculosis
ccggaccaccagg

SEQ ID NO: 2982142 - RNA, 19 nt, Mycobacterium avium subsp. paratuberculosis
ccggaccacguccccgggc

SEQ ID NO: 2982143 - RNA, 17 nt, Mycobacterium avium subsp. paratuberculosis
ccggaccaggguggccc

SEQ ID NO: 2982144 - RNA, 21 nt, Mycobacterium avium subsp. paratuberculosis
ccggaccaggguggccccagc

SEQ ID NO: 2982145 - RNA, 23 nt, Mycobacterium avium subsp. paratuberculosis
ccggaccaggguggccccagccc

SEQ ID NO: 2982146 - RNA, 21 nt, Mycobacterium avium subsp. paratuberculosis
ccggaccagguauucaucgcg

SEQ ID NO: 2982147 - RNA, 17 nt, Mycobacterium avium subsp. paratuberculosis
ccggacccauucgucgg

SEQ ID NO: 2982148 - RNA, 18 nt, Mycobacterium avium subsp. paratuberculosis
ccggacccauucgucggc

SEQ ID NO: 2982149 - RNA, 16 nt, Mycobacterium avium subsp. paratuberculosis
ccggaccccacagcgc

SEQ ID NO: 2982150 - RNA, 18 nt, Mycobacterium avium subsp. paratuberculosis
ccggacccccucggggcu

SEQ ID NO: 2982151 - RNA, 22 nt, Mycobacterium avium subsp. paratuberculosis
ccggacccccucggggcucacc

SEQ ID NO: 2982152 - RNA, 16 nt, Mycobacterium avium subsp. paratuberculosis
ccggacccgcucgccg

SEQ ID NO: 2982153 - RNA, 17 nt, Mycobacterium avium subsp. paratuberculosis
ccggacccgcucgccga

SEQ ID NO: 2982154 - RNA, 18 nt, Mycobacterium avium subsp. paratuberculosis
ccggacccgcucgccgaa

SEQ ID NO: 2982155 - RNA, 15 nt, Mycobacterium avium subsp. paratuberculosis
ccggaccgauccggc

SEQ ID NO: 2982156 - RNA, 13 nt, Mycobacterium avium subsp. paratuberculosis
ccggaccgccgcg

SEQ ID NO: 2982157 - RNA, 14 nt, Mycobacterium avium subsp. paratuberculosis
ccggaccgccgcgg

SEQ ID NO: 2982158 - RNA, 22 nt, Mycobacterium avium subsp. paratuberculosis
ccggaccgccgcggcgcccggc

SEQ ID NO: 2982159 - RNA, 17 nt, Mycobacterium avium subsp. paratuberculosis
ccggaccgccgcggcgg

SEQ ID NO: 2982160 - RNA, 21 nt, Mycobacterium avium subsp. paratuberculosis
ccggaccgccgcggcggccug

SEQ ID NO: 2982161 - RNA, 22 nt, Mycobacterium avium subsp. paratuberculosis
ccggaccgccgcggcggccugc

SEQ ID NO: 2982162 - RNA, 16 nt, Mycobacterium avium subsp. paratuberculosis
ccggaccgcgcgggcc

SEQ ID NO: 2982163 - RNA, 17 nt, Mycobacterium avium subsp. paratuberculosis
ccggaccgcgcgggcca

SEQ ID NO: 2982164 - RNA, 19 nt, Mycobacterium avium subsp. paratuberculosis
ccggaccgcuugacgccgc

SEQ ID NO: 2982165 - RNA, 14 nt, Mycobacterium avium subsp. paratuberculosis
ccggaccggccagc

SEQ ID NO: 2982166 - RNA, 15 nt, Mycobacterium avium subsp. paratuberculosis
ccggaccggccagca

SEQ ID NO: 2982167 - RNA, 16 nt, Mycobacterium avium subsp. paratuberculosis
ccggaccggccagcag

SEQ ID NO: 2982168 - RNA, 17 nt, Mycobacterium avium subsp. paratuberculosis
ccggaccggccagcagc

SEQ ID NO: 2982169 - RNA, 22 nt, Mycobacterium avium subsp. paratuberculosis
ccggaccggccagcagccgcuc

SEQ ID NO: 2982170 - RNA, 22 nt, Mycobacterium avium subsp. paratuberculosis
ccggaccggccgugcgcgucga

SEQ ID NO: 2982171 - RNA, 17 nt, Mycobacterium avium subsp. paratuberculosis
ccggaccgggugaccgg

SEQ ID NO: 2982172 - RNA, 23 nt, Mycobacterium avium subsp. paratuberculosis
ccggaccgggugaccggcgcgca

SEQ ID NO: 2982173 - RNA, 17 nt, Mycobacterium avium subsp. paratuberculosis
ccggaccguucgguccg

SEQ ID NO: 2982174 - RNA, 15 nt, Mycobacterium avium subsp. paratuberculosis
ccggaccucgaccag

SEQ ID NO: 2982175 - RNA, 20 nt, Mycobacterium avium subsp. paratuberculosis
ccggaccucgaccagccggu

SEQ ID NO: 2982176 - RNA, 17 nt, Mycobacterium avium subsp. paratuberculosis
ccggaccugccggcgau

SEQ ID NO: 2982177 - RNA, 18 nt, Mycobacterium avium subsp. paratuberculosis
ccggaccugccggcgauc

SEQ ID NO: 2982178 - RNA, 21 nt, Mycobacterium avium subsp. paratuberculosis
ccggacgaacaucgagcccac

SEQ ID NO: 2982179 - RNA, 12 nt, Mycobacterium avium subsp. paratuberculosis
ccggacgaccug

SEQ ID NO: 2982180 - RNA, 23 nt, Mycobacterium avium subsp. paratuberculosis
ccggacgaccugggcgccgucgc

SEQ ID NO: 2982181 - RNA, 23 nt, Mycobacterium avium subsp. paratuberculosis
ccggacgaggaucgcaggauggc

SEQ ID NO: 2982182 - RNA, 17 nt, Mycobacterium avium subsp. paratuberculosis
ccggacgaugacccagc

SEQ ID NO: 2982183 - RNA, 20 nt, Mycobacterium avium subsp. paratuberculosis
ccggacgaugacccagccca

SEQ ID NO: 2982184 - RNA, 16 nt, Mycobacterium avium subsp. paratuberculosis
ccggacgaugccgcgg

SEQ ID NO: 2982185 - RNA, 18 nt, Mycobacterium avium subsp. paratuberculosis
ccggacgaugccgcggcg

SEQ ID NO: 2982186 - RNA, 21 nt, Mycobacterium avium subsp. paratuberculosis
ccggacgaugcgcacccccgg

SEQ ID NO: 2982187 - RNA, 18 nt, Mycobacterium avium subsp. paratuberculosis
ccggacgcagcgaucggc

SEQ ID NO: 2982188 - RNA, 19 nt, Mycobacterium avium subsp. paratuberculosis
ccggacgcagcgaucggcg

SEQ ID NO: 2982189 - RNA, 20 nt, Mycobacterium avium subsp. paratuberculosis
ccggacgcagcgaucggcgg

SEQ ID NO: 2982190 - RNA, 22 nt, Mycobacterium avium subsp. paratuberculosis
ccggacgcgcacacggccucgc

SEQ ID NO: 2982191 - RNA, 13 nt, Mycobacterium avium subsp. paratuberculosis
ccggacggagccg

SEQ ID NO: 2982192 - RNA, 16 nt, Mycobacterium avium subsp. paratuberculosis
ccggacggagccgugc

SEQ ID NO: 2982193 - RNA, 20 nt, Mycobacterium avium subsp. paratuberculosis
ccggacggccgaaacgcccg

SEQ ID NO: 2982194 - RNA, 22 nt, Mycobacterium avium subsp. paratuberculosis
ccggacggccgaaacgcccggc

SEQ ID NO: 2982195 - RNA, 23 nt, Mycobacterium avium subsp. paratuberculosis
ccggacggccgaaacgcccggcu

SEQ ID NO: 2982196 - RNA, 20 nt, Mycobacterium avium subsp. paratuberculosis
ccggacgggaucggcgcguc

SEQ ID NO: 2982197 - RNA, 18 nt, Mycobacterium avium subsp. paratuberculosis
ccggacggugacgccgga

SEQ ID NO: 2982198 - RNA, 11 nt, Mycobacterium avium subsp. paratuberculosis
ccggacgugau

SEQ ID NO: 2982199 - RNA, 17 nt, Mycobacterium avium subsp. paratuberculosis
ccggacgugaucgcggu

SEQ ID NO: 2982200 - RNA, 18 nt, Mycobacterium avium subsp. paratuberculosis
ccggacuauacacgccug

SEQ ID NO: 2982201 - RNA, 20 nt, Mycobacterium avium subsp. paratuberculosis
ccggacuauacacgccugga

SEQ ID NO: 2982202 - RNA, 13 nt, Mycobacterium avium subsp. paratuberculosis
ccggacuccucgg

SEQ ID NO: 2982203 - RNA, 22 nt, Mycobacterium avium subsp. paratuberculosis
ccggacuccucgguggccucgc

SEQ ID NO: 2982204 - RNA, 16 nt, Mycobacterium avium subsp. paratuberculosis
ccggacucgaucgcca

SEQ ID NO: 2982205 - RNA, 17 nt, Mycobacterium avium subsp. paratuberculosis
ccggacucgaucgccac

SEQ ID NO: 2982206 - RNA, 19 nt, Mycobacterium avium subsp. paratuberculosis
ccggacucgaucgccaccg

SEQ ID NO: 2982207 - RNA, 22 nt, Mycobacterium avium subsp. paratuberculosis
ccggacugcuugggcgccucgc

SEQ ID NO: 2982208 - RNA, 21 nt, Mycobacterium avium subsp. paratuberculosis
ccggacuugaugcugcccggc

SEQ ID NO: 2982209 - RNA, 22 nt, Mycobacterium avium subsp. paratuberculosis
ccggacuugaugcugcccggcg

SEQ ID NO: 2982210 - RNA, 18 nt, Mycobacterium avium subsp. paratuberculosis
ccggagaaaccgucggcc

SEQ ID NO: 2982211 - RNA, 21 nt, Mycobacterium avium subsp. paratuberculosis
ccggagaaaccgucggcccgc

SEQ ID NO: 2982212 - RNA, 13 nt, Mycobacterium avium subsp. paratuberculosis
ccggagaccgccg

SEQ ID NO: 2982213 - RNA, 16 nt, Mycobacterium avium subsp. paratuberculosis
ccggagaccgccgugg

SEQ ID NO: 2982214 - RNA, 21 nt, Mycobacterium avium subsp. paratuberculosis
ccggagaucccguaggucgcc

SEQ ID NO: 2982215 - RNA, 12 nt, Mycobacterium avium subsp. paratuberculosis
ccggagcccagc

SEQ ID NO: 2982216 - RNA, 16 nt, Mycobacterium avium subsp. paratuberculosis
ccggagccgaccucgg

SEQ ID NO: 2982217 - RNA, 21 nt, Mycobacterium avium subsp. paratuberculosis
ccggagccgaccucggcgacg

SEQ ID NO: 2982218 - RNA, 12 nt, Mycobacterium avium subsp. paratuberculosis
ccggagccggag

SEQ ID NO: 2982219 - RNA, 18 nt, Mycobacterium avium subsp. paratuberculosis
ccggagccggccucgccg

SEQ ID NO: 2982220 - RNA, 21 nt, Mycobacterium avium subsp. paratuberculosis
ccggagccggccucgccggcg

SEQ ID NO: 2982221 - RNA, 12 nt, Mycobacterium avium subsp. paratuberculosis
ccggagccgucg

SEQ ID NO: 2982222 - RNA, 14 nt, Mycobacterium avium subsp. paratuberculosis
ccggagccgucggc

SEQ ID NO: 2982223 - RNA, 21 nt, Mycobacterium avium subsp. paratuberculosis
ccggagccgucucggagcggu

SEQ ID NO: 2982224 - RNA, 22 nt, Mycobacterium avium subsp. paratuberculosis
ccggagccgucucggagcggug

SEQ ID NO: 2982225 - RNA, 15 nt, Mycobacterium avium subsp. paratuberculosis
ccggagccuucuucg

SEQ ID NO: 2982226 - RNA, 21 nt, Mycobacterium avium subsp. paratuberculosis
ccggagccuucuucgccgcag

SEQ ID NO: 2982227 - RNA, 22 nt, Mycobacterium avium subsp. paratuberculosis
ccggagccuucuugaccgcagc

SEQ ID NO: 2982228 - RNA, 22 nt, Mycobacterium avium subsp. paratuberculosis
ccggagccuugcuggcggccuu

SEQ ID NO: 2982229 - RNA, 13 nt, Mycobacterium avium subsp. paratuberculosis
ccggagccuuggu

SEQ ID NO: 2982230 - RNA, 18 nt, Mycobacterium avium subsp. paratuberculosis
ccggagccuuggucgcgg

SEQ ID NO: 2982231 - RNA, 22 nt, Mycobacterium avium subsp. paratuberculosis
ccggagccuuggucgcggccuu

SEQ ID NO: 2982232 - RNA, 22 nt, Mycobacterium avium subsp. paratuberculosis
ccggagcgccccagggccucgg

SEQ ID NO: 2982233 - RNA, 23 nt, Mycobacterium avium subsp. paratuberculosis
ccggagcgcgguccacgguggcg

SEQ ID NO: 2982234 - RNA, 21 nt, Mycobacterium avium subsp. paratuberculosis
ccggagcggauggcgccgucg

SEQ ID NO: 2982235 - RNA, 22 nt, Mycobacterium avium subsp. paratuberculosis
ccggagcggauggcgccgucga

SEQ ID NO: 2982236 - RNA, 13 nt, Mycobacterium avium subsp. paratuberculosis
ccggagcggugcg

SEQ ID NO: 2982237 - RNA, 21 nt, Mycobacterium avium subsp. paratuberculosis
ccggaggccagcucgaccgcg

SEQ ID NO: 2982238 - RNA, 18 nt, Mycobacterium avium subsp. paratuberculosis
ccggaggcgaucaggugg

SEQ ID NO: 2982239 - RNA, 12 nt, Mycobacterium avium subsp. paratuberculosis
ccggaggcggcg

SEQ ID NO: 2982240 - RNA, 13 nt, Mycobacterium avium subsp. paratuberculosis
ccggaggcggcgu

SEQ ID NO: 2982241 - RNA, 22 nt, Mycobacterium avium subsp. paratuberculosis
ccggaggcggcguagucggcgc

SEQ ID NO: 2982242 - RNA, 20 nt, Mycobacterium avium subsp. paratuberculosis
ccggaggggcgacgggccga

SEQ ID NO: 2982243 - RNA, 21 nt, Mycobacterium avium subsp. paratuberculosis
ccggaggggcgacgggccgau

SEQ ID NO: 2982244 - RNA, 14 nt, Mycobacterium avium subsp. paratuberculosis
ccggaggugccggc

SEQ ID NO: 2982245 - RNA, 15 nt, Mycobacterium avium subsp. paratuberculosis
ccggaggugccggcc

SEQ ID NO: 2982246 - RNA, 17 nt, Mycobacterium avium subsp. paratuberculosis
ccggaggugccggccgg

SEQ ID NO: 2982247 - RNA, 19 nt, Mycobacterium avium subsp. paratuberculosis
ccggaggugccggccgguc

SEQ ID NO: 2982248 - RNA, 19 nt, Mycobacterium avium subsp. paratuberculosis
ccggaggugcgggucucga

SEQ ID NO: 2982249 - RNA, 14 nt, Mycobacterium avium subsp. paratuberculosis
ccggagguucgccg

SEQ ID NO: 2982250 - RNA, 13 nt, Mycobacterium avium subsp. paratuberculosis
ccggaguccggcu

SEQ ID NO: 2982251 - RNA, 15 nt, Mycobacterium avium subsp. paratuberculosis
ccggaguccggcucg

SEQ ID NO: 2982252 - RNA, 18 nt, Mycobacterium avium subsp. paratuberculosis
ccggaguccggcucggug

SEQ ID NO: 2982253 - RNA, 13 nt, Mycobacterium avium subsp. paratuberculosis
ccggagucgucga

SEQ ID NO: 2982254 - RNA, 17 nt, Mycobacterium avium subsp. paratuberculosis
ccggagugaaguccaug

SEQ ID NO: 2982255 - RNA, 18 nt, Mycobacterium avium subsp. paratuberculosis
ccggagugaaguccauga

SEQ ID NO: 2982256 - RNA, 15 nt, Mycobacterium avium subsp. paratuberculosis
ccggagugacgucgc

SEQ ID NO: 2982257 - RNA, 18 nt, Mycobacterium avium subsp. paratuberculosis
ccggagugacgucgcgcg

SEQ ID NO: 2982258 - RNA, 21 nt, Mycobacterium avium subsp. paratuberculosis
ccggauacacgguggugaccc

SEQ ID NO: 2982259 - RNA, 14 nt, Mycobacterium avium subsp. paratuberculosis
ccggauaccccgga

SEQ ID NO: 2982260 - RNA, 15 nt, Mycobacterium avium subsp. paratuberculosis
ccggauagccgucgg

SEQ ID NO: 2982261 - RNA, 17 nt, Mycobacterium avium subsp. paratuberculosis
ccggauagccgucggcg

SEQ ID NO: 2982262 - RNA, 18 nt, Mycobacterium avium subsp. paratuberculosis
ccggauagccgucggcgg

SEQ ID NO: 2982263 - RNA, 19 nt, Mycobacterium avium subsp. paratuberculosis
ccggaucaaccacaccagc

SEQ ID NO: 2982264 - RNA, 20 nt, Mycobacterium avium subsp. paratuberculosis
ccggaucaaccacaccagca

SEQ ID NO: 2982265 - RNA, 21 nt, Mycobacterium avium subsp. paratuberculosis
ccggaucaaccacaccagcau

SEQ ID NO: 2982266 - RNA, 23 nt, Mycobacterium avium subsp. paratuberculosis
ccggaucaaccacaccagcauga

SEQ ID NO: 2982267 - RNA, 15 nt, Mycobacterium avium subsp. paratuberculosis
ccggaucagcagugc

SEQ ID NO: 2982268 - RNA, 14 nt, Mycobacterium avium subsp. paratuberculosis
ccggaucagcugac

SEQ ID NO: 2982269 - RNA, 20 nt, Mycobacterium avium subsp. paratuberculosis
ccggaucagcugaccggcga

SEQ ID NO: 2982270 - RNA, 23 nt, Mycobacterium avium subsp. paratuberculosis
ccggauccaccaauucgcgcugc

SEQ ID NO: 2982271 - RNA, 12 nt, Mycobacterium avium subsp. paratuberculosis
ccggauccggua

SEQ ID NO: 2982272 - RNA, 15 nt, Mycobacterium avium subsp. paratuberculosis
ccggauccgucgccc

SEQ ID NO: 2982273 - RNA, 17 nt, Mycobacterium avium subsp. paratuberculosis
ccggauccgucgccccg

SEQ ID NO: 2982274 - RNA, 18 nt, Mycobacterium avium subsp. paratuberculosis
ccggauccgucgccccgc

SEQ ID NO: 2982275 - RNA, 21 nt, Mycobacterium avium subsp. paratuberculosis
ccggaucgaacuugaucaccg

SEQ ID NO: 2982276 - RNA, 16 nt, Mycobacterium avium subsp. paratuberculosis
ccggaucgaauccggc

SEQ ID NO: 2982277 - RNA, 18 nt, Mycobacterium avium subsp. paratuberculosis
ccggaucgaauccggcgg

SEQ ID NO: 2982278 - RNA, 19 nt, Mycobacterium avium subsp. paratuberculosis
ccggaucgaauccggcggc

SEQ ID NO: 2982279 - RNA, 21 nt, Mycobacterium avium subsp. paratuberculosis
ccggaucgaauccggcggcgc

SEQ ID NO: 2982280 - RNA, 22 nt, Mycobacterium avium subsp. paratuberculosis
ccggaucgaauccggcggcgcu

SEQ ID NO: 2982281 - RNA, 20 nt, Mycobacterium avium subsp. paratuberculosis
ccggaucgagcacccggcgg

SEQ ID NO: 2982282 - RNA, 13 nt, Mycobacterium avium subsp. paratuberculosis
ccggaucgccgaa

SEQ ID NO: 2982283 - RNA, 13 nt, Mycobacterium avium subsp. paratuberculosis
ccggaucgccgag

SEQ ID NO: 2982284 - RNA, 21 nt, Mycobacterium avium subsp. paratuberculosis
ccggaucgccgagguagccgc

SEQ ID NO: 2982285 - RNA, 12 nt, Mycobacterium avium subsp. paratuberculosis
ccggaucggcag

SEQ ID NO: 2982286 - RNA, 18 nt, Mycobacterium avium subsp. paratuberculosis
ccggaucggcugcgggcc

SEQ ID NO: 2982287 - RNA, 23 nt, Mycobacterium avium subsp. paratuberculosis
ccggaucggcugcgggccagcgc

SEQ ID NO: 2982288 - RNA, 17 nt, Mycobacterium avium subsp. paratuberculosis
ccggaucgggaccggga

SEQ ID NO: 2982289 - RNA, 18 nt, Mycobacterium avium subsp. paratuberculosis
ccggaucgggaccgggaa

SEQ ID NO: 2982290 - RNA, 22 nt, Mycobacterium avium subsp. paratuberculosis
ccggaucgggcgguccaccgac

SEQ ID NO: 2982291 - RNA, 18 nt, Mycobacterium avium subsp. paratuberculosis
ccggaucgggguggacgc

SEQ ID NO: 2982292 - RNA, 21 nt, Mycobacterium avium subsp. paratuberculosis
ccggaucgggguggacgcgac

SEQ ID NO: 2982293 - RNA, 17 nt, Mycobacterium avium subsp. paratuberculosis
ccggaucgugucccggc

SEQ ID NO: 2982294 - RNA, 20 nt, Mycobacterium avium subsp. paratuberculosis
ccggaucgugucccggcgcc

SEQ ID NO: 2982295 - RNA, 19 nt, Mycobacterium avium subsp. paratuberculosis
ccggaucugcgucuguggu

SEQ ID NO: 2982296 - RNA, 19 nt, Mycobacterium avium subsp. paratuberculosis
ccggaucuugccgucggcc

SEQ ID NO: 2982297 - RNA, 21 nt, Mycobacterium avium subsp. paratuberculosis
ccggaucuugccgucggccgc

SEQ ID NO: 2982298 - RNA, 22 nt, Mycobacterium avium subsp. paratuberculosis
ccggaucuugccgucggccgcc

SEQ ID NO: 2982299 - RNA, 23 nt, Mycobacterium avium subsp. paratuberculosis
ccggaucuugccgucggccgccg

SEQ ID NO: 2982300 - RNA, 13 nt, Mycobacterium avium subsp. paratuberculosis
ccggaugaugccg

SEQ ID NO: 2982301 - RNA, 19 nt, Mycobacterium avium subsp. paratuberculosis
ccggaugcaccggcagcca

SEQ ID NO: 2982302 - RNA, 14 nt, Mycobacterium avium subsp. paratuberculosis
ccggaugcacgugc

SEQ ID NO: 2982303 - RNA, 19 nt, Mycobacterium avium subsp. paratuberculosis
ccggaugcacgugcaccgc

SEQ ID NO: 2982304 - RNA, 22 nt, Mycobacterium avium subsp. paratuberculosis
ccggaugcacgugcaccgcggc

SEQ ID NO: 2982305 - RNA, 16 nt, Mycobacterium avium subsp. paratuberculosis
ccggaugccgcgcggc

SEQ ID NO: 2982306 - RNA, 18 nt, Mycobacterium avium subsp. paratuberculosis
ccggaugccgcgcggcgc

SEQ ID NO: 2982307 - RNA, 14 nt, Mycobacterium avium subsp. paratuberculosis
ccggaugccggcgc

SEQ ID NO: 2982308 - RNA, 19 nt, Mycobacterium avium subsp. paratuberculosis
ccggaugccggcgcccagc

SEQ ID NO: 2982309 - RNA, 20 nt, Mycobacterium avium subsp. paratuberculosis
ccggaugcggccgaagucca

SEQ ID NO: 2982310 - RNA, 13 nt, Mycobacterium avium subsp. paratuberculosis
ccggaugcggcgc

SEQ ID NO: 2982311 - RNA, 14 nt, Mycobacterium avium subsp. paratuberculosis
ccggaugcggcgcc

SEQ ID NO: 2982312 - RNA, 15 nt, Mycobacterium avium subsp. paratuberculosis
ccggaugcggcgccc

SEQ ID NO: 2982313 - RNA, 16 nt, Mycobacterium avium subsp. paratuberculosis
ccggaugcggcgccca

SEQ ID NO: 2982314 - RNA, 22 nt, Mycobacterium avium subsp. paratuberculosis
ccggaugcggcgcccacagcag

SEQ ID NO: 2982315 - RNA, 15 nt, Mycobacterium avium subsp. paratuberculosis
ccggaugcggucgau

SEQ ID NO: 2982316 - RNA, 15 nt, Mycobacterium avium subsp. paratuberculosis
ccggaugcucaccgg

SEQ ID NO: 2982317 - RNA, 19 nt, Mycobacterium avium subsp. paratuberculosis
ccggaugcugcgcaacacc

SEQ ID NO: 2982318 - RNA, 22 nt, Mycobacterium avium subsp. paratuberculosis
ccggaugcugcgcaacaccucg

SEQ ID NO: 2982319 - RNA, 21 nt, Mycobacterium avium subsp. paratuberculosis
ccggaugcugcgggucagcag

SEQ ID NO: 2982320 - RNA, 20 nt, Mycobacterium avium subsp. paratuberculosis
ccggauggagcgcgacgggc

SEQ ID NO: 2982321 - RNA, 22 nt, Mycobacterium avium subsp. paratuberculosis
ccggauggagcgcgacgggcug

SEQ ID NO: 2982322 - RNA, 13 nt, Mycobacterium avium subsp. paratuberculosis
ccggauggccagc

SEQ ID NO: 2982323 - RNA, 14 nt, Mycobacterium avium subsp. paratuberculosis
ccggauggccagca

SEQ ID NO: 2982324 - RNA, 15 nt, Mycobacterium avium subsp. paratuberculosis
ccggauggccagcag

SEQ ID NO: 2982325 - RNA, 14 nt, Mycobacterium avium subsp. paratuberculosis
ccggauggccgggc

SEQ ID NO: 2982326 - RNA, 15 nt, Mycobacterium avium subsp. paratuberculosis
ccggauggcggucgc

SEQ ID NO: 2982327 - RNA, 19 nt, Mycobacterium avium subsp. paratuberculosis
ccggauggcggucgcgcca

SEQ ID NO: 2982328 - RNA, 13 nt, Mycobacterium avium subsp. paratuberculosis
ccggaugggcgca

SEQ ID NO: 2982329 - RNA, 13 nt, Mycobacterium avium subsp. paratuberculosis
ccggauggucugc

SEQ ID NO: 2982330 - RNA, 17 nt, Mycobacterium avium subsp. paratuberculosis
ccggauggucugcagcg

SEQ ID NO: 2982331 - RNA, 20 nt, Mycobacterium avium subsp. paratuberculosis
ccggauggucugcagcgacg

SEQ ID NO: 2982332 - RNA, 13 nt, Mycobacterium avium subsp. paratuberculosis
ccggaugucgggc

SEQ ID NO: 2982333 - RNA, 14 nt, Mycobacterium avium subsp. paratuberculosis
ccggaugucgggcg

SEQ ID NO: 2982334 - RNA, 17 nt, Mycobacterium avium subsp. paratuberculosis
ccggauuacucgccggc

SEQ ID NO: 2982335 - RNA, 18 nt, Mycobacterium avium subsp. paratuberculosis
ccggauuacucgccggcg

SEQ ID NO: 2982336 - RNA, 19 nt, Mycobacterium avium subsp. paratuberculosis
ccggauuacucgccggcgg

SEQ ID NO: 2982337 - RNA, 17 nt, Mycobacterium avium subsp. paratuberculosis
ccggauucggcgcggcu

SEQ ID NO: 2982338 - RNA, 16 nt, Mycobacterium avium subsp. paratuberculosis
ccggauucguucaugu

SEQ ID NO: 2982339 - RNA, 19 nt, Mycobacterium avium subsp. paratuberculosis
ccggauucucgcccggcuc

SEQ ID NO: 2982340 - RNA, 16 nt, Mycobacterium avium subsp. paratuberculosis
ccggauugccgggcag

SEQ ID NO: 2982341 - RNA, 17 nt, Mycobacterium avium subsp. paratuberculosis
ccggauugccgggcagc

SEQ ID NO: 2982342 - RNA, 20 nt, Mycobacterium avium subsp. paratuberculosis
ccggauugccgggcagcggc

SEQ ID NO: 2982343 - RNA, 20 nt, Mycobacterium avium subsp. paratuberculosis
ccggauuggcgucgguggcg

SEQ ID NO: 2982344 - RNA, 17 nt, Mycobacterium avium subsp. paratuberculosis
ccggauuucgucccagu

SEQ ID NO: 2982345 - RNA, 24 nt, Mycobacterium avium subsp. paratuberculosis
ccggauuucgucccaguccagccg

SEQ ID NO: 2982346 - RNA, 17 nt, Mycobacterium avium subsp. paratuberculosis
ccggcaacaacgccagc

SEQ ID NO: 2982347 - RNA, 18 nt, Mycobacterium avium subsp. paratuberculosis
ccggcaacaccggcggcg

SEQ ID NO: 2982348 - RNA, 19 nt, Mycobacterium avium subsp. paratuberculosis
ccggcaacaccggcggcga

SEQ ID NO: 2982349 - RNA, 13 nt, Mycobacterium avium subsp. paratuberculosis
ccggcaaccgcca

SEQ ID NO: 2982350 - RNA, 16 nt, Mycobacterium avium subsp. paratuberculosis
ccggcaaccgccacga

SEQ ID NO: 2982351 - RNA, 17 nt, Mycobacterium avium subsp. paratuberculosis
ccggcaaccgcugcggu

SEQ ID NO: 2982352 - RNA, 18 nt, Mycobacterium avium subsp. paratuberculosis
ccggcaacgacccgucgg

SEQ ID NO: 2982353 - RNA, 13 nt, Mycobacterium avium subsp. paratuberculosis
ccggcaacgaggc

SEQ ID NO: 2982354 - RNA, 15 nt, Mycobacterium avium subsp. paratuberculosis
ccggcaacgaggcca

SEQ ID NO: 2982355 - RNA, 18 nt, Mycobacterium avium subsp. paratuberculosis
ccggcaacucccgaucgc

SEQ ID NO: 2982356 - RNA, 17 nt, Mycobacterium avium subsp. paratuberculosis
ccggcaacuggccgccc

SEQ ID NO: 2982357 - RNA, 16 nt, Mycobacterium avium subsp. paratuberculosis
ccggcaaggugccguc

SEQ ID NO: 2982358 - RNA, 18 nt, Mycobacterium avium subsp. paratuberculosis
ccggcaaggugccguccg

SEQ ID NO: 2982359 - RNA, 13 nt, Mycobacterium avium subsp. paratuberculosis
ccggcaaucggga

SEQ ID NO: 2982360 - RNA, 14 nt, Mycobacterium avium subsp. paratuberculosis
ccggcacaccgagc

SEQ ID NO: 2982361 - RNA, 18 nt, Mycobacterium avium subsp. paratuberculosis
ccggcacaccgagcgagc

SEQ ID NO: 2982362 - RNA, 12 nt, Mycobacterium avium subsp. paratuberculosis
ccggcaccacca

SEQ ID NO: 2982363 - RNA, 14 nt, Mycobacterium avium subsp. paratuberculosis
ccggcaccaccacc

SEQ ID NO: 2982364 - RNA, 13 nt, Mycobacterium avium subsp. paratuberculosis
ccggcaccacgau

SEQ ID NO: 2982365 - RNA, 17 nt, Mycobacterium avium subsp. paratuberculosis
ccggcaccacgaucacc

SEQ ID NO: 2982366 - RNA, 15 nt, Mycobacterium avium subsp. paratuberculosis
ccggcaccagcagcc

SEQ ID NO: 2982367 - RNA, 18 nt, Mycobacterium avium subsp. paratuberculosis
ccggcaccagcagccagc

SEQ ID NO: 2982368 - RNA, 16 nt, Mycobacterium avium subsp. paratuberculosis
ccggcaccagcagccg

SEQ ID NO: 2982369 - RNA, 18 nt, Mycobacterium avium subsp. paratuberculosis
ccggcaccagcagccgca

SEQ ID NO: 2982370 - RNA, 22 nt, Mycobacterium avium subsp. paratuberculosis
ccggcaccagcagccgcagcgc

SEQ ID NO: 2982371 - RNA, 13 nt, Mycobacterium avium subsp. paratuberculosis
ccggcacccgggc

SEQ ID NO: 2982372 - RNA, 18 nt, Mycobacterium avium subsp. paratuberculosis
ccggcaccgaccgggcgc

SEQ ID NO: 2982373 - RNA, 13 nt, Mycobacterium avium subsp. paratuberculosis
ccggcaccgccag

SEQ ID NO: 2982374 - RNA, 15 nt, Mycobacterium avium subsp. paratuberculosis
ccggcaccgccagcc

SEQ ID NO: 2982375 - RNA, 16 nt, Mycobacterium avium subsp. paratuberculosis
ccggcaccgccagcca

SEQ ID NO: 2982376 - RNA, 21 nt, Mycobacterium avium subsp. paratuberculosis
ccggcaccgccagccaccaca

SEQ ID NO: 2982377 - RNA, 12 nt, Mycobacterium avium subsp. paratuberculosis
ccggcaccgccc

SEQ ID NO: 2982378 - RNA, 14 nt, Mycobacterium avium subsp. paratuberculosis
ccggcaccgccccc

SEQ ID NO: 2982379 - RNA, 18 nt, Mycobacterium avium subsp. paratuberculosis
ccggcaccgcccccgcgg

SEQ ID NO: 2982380 - RNA, 19 nt, Mycobacterium avium subsp. paratuberculosis
ccggcaccgcccccgcggc

SEQ ID NO: 2982381 - RNA, 20 nt, Mycobacterium avium subsp. paratuberculosis
ccggcaccgcccccgcggcg

SEQ ID NO: 2982382 - RNA, 23 nt, Mycobacterium avium subsp. paratuberculosis
ccggcaccgcccccgcggcggcc

SEQ ID NO: 2982383 - RNA, 14 nt, Mycobacterium avium subsp. paratuberculosis
ccggcaccgcggcg

SEQ ID NO: 2982384 - RNA, 15 nt, Mycobacterium avium subsp. paratuberculosis
ccggcaccgcggcgg

SEQ ID NO: 2982385 - RNA, 17 nt, Mycobacterium avium subsp. paratuberculosis
ccggcaccgcggcggug

SEQ ID NO: 2982386 - RNA, 13 nt, Mycobacterium avium subsp. paratuberculosis
ccggcaccgcggu

SEQ ID NO: 2982387 - RNA, 19 nt, Mycobacterium avium subsp. paratuberculosis
ccggcaccggugcggcggu

SEQ ID NO: 2982388 - RNA, 16 nt, Mycobacterium avium subsp. paratuberculosis
ccggcaccguccggcg

SEQ ID NO: 2982389 - RNA, 17 nt, Mycobacterium avium subsp. paratuberculosis
ccggcacgaacgcgacg

SEQ ID NO: 2982390 - RNA, 19 nt, Mycobacterium avium subsp. paratuberculosis
ccggcacgaacgcgacgau

SEQ ID NO: 2982391 - RNA, 18 nt, Mycobacterium avium subsp. paratuberculosis
ccggcacgaucgucgccg

SEQ ID NO: 2982392 - RNA, 19 nt, Mycobacterium avium subsp. paratuberculosis
ccggcacgaucgucgccgc

SEQ ID NO: 2982393 - RNA, 22 nt, Mycobacterium avium subsp. paratuberculosis
ccggcacgaucgucgccgccaa

SEQ ID NO: 2982394 - RNA, 20 nt, Mycobacterium avium subsp. paratuberculosis
ccggcacgauggcgcggcgc

SEQ ID NO: 2982395 - RNA, 21 nt, Mycobacterium avium subsp. paratuberculosis
ccggcacgauggcgcggcgca

SEQ ID NO: 2982396 - RNA, 15 nt, Mycobacterium avium subsp. paratuberculosis
ccggcacgcgcgccg

SEQ ID NO: 2982397 - RNA, 18 nt, Mycobacterium avium subsp. paratuberculosis
ccggcacggcaccgcgag

SEQ ID NO: 2982398 - RNA, 15 nt, Mycobacterium avium subsp. paratuberculosis
ccggcacggccggcc

SEQ ID NO: 2982399 - RNA, 16 nt, Mycobacterium avium subsp. paratuberculosis
ccggcacggccggccg

SEQ ID NO: 2982400 - RNA, 17 nt, Mycobacterium avium subsp. paratuberculosis
ccggcacggccggccgg

SEQ ID NO: 2982401 - RNA, 21 nt, Mycobacterium avium subsp. paratuberculosis
ccggcacggugcacacgccga

SEQ ID NO: 2982402 - RNA, 22 nt, Mycobacterium avium subsp. paratuberculosis
ccggcacggugcacacgccgag

SEQ ID NO: 2982403 - RNA, 23 nt, Mycobacterium avium subsp. paratuberculosis
ccggcacggugcacacgccgagg

SEQ ID NO: 2982404 - RNA, 19 nt, Mycobacterium avium subsp. paratuberculosis
ccggcacgucgagcuccuc

SEQ ID NO: 2982405 - RNA, 22 nt, Mycobacterium avium subsp. paratuberculosis
ccggcacgucgagcuccucggc

SEQ ID NO: 2982406 - RNA, 14 nt, Mycobacterium avium subsp. paratuberculosis
ccggcacgucggcc

SEQ ID NO: 2982407 - RNA, 19 nt, Mycobacterium avium subsp. paratuberculosis
ccggcacgucggccacgcc

SEQ ID NO: 2982408 - RNA, 18 nt, Mycobacterium avium subsp. paratuberculosis
ccggcacgugcggguugg

SEQ ID NO: 2982409 - RNA, 13 nt, Mycobacterium avium subsp. paratuberculosis
ccggcacguugac

SEQ ID NO: 2982410 - RNA, 14 nt, Mycobacterium avium subsp. paratuberculosis
ccggcacguugacg

SEQ ID NO: 2982411 - RNA, 15 nt, Mycobacterium avium subsp. paratuberculosis
ccggcacguugacgu

SEQ ID NO: 2982412 - RNA, 17 nt, Mycobacterium avium subsp. paratuberculosis
ccggcacuaccgccucg

SEQ ID NO: 2982413 - RNA, 18 nt, Mycobacterium avium subsp. paratuberculosis
ccggcacuaccgccucgc

SEQ ID NO: 2982414 - RNA, 15 nt, Mycobacterium avium subsp. paratuberculosis
ccggcacucgccucg

SEQ ID NO: 2982415 - RNA, 22 nt, Mycobacterium avium subsp. paratuberculosis
ccggcacucgucguggcggugc

SEQ ID NO: 2982416 - RNA, 21 nt, Mycobacterium avium subsp. paratuberculosis
ccggcacugaaggcgcgggca

SEQ ID NO: 2982417 - RNA, 23 nt, Mycobacterium avium subsp. paratuberculosis
ccggcacugcugcccgcgacggc

SEQ ID NO: 2982418 - RNA, 14 nt, Mycobacterium avium subsp. paratuberculosis
ccggcacuggcgaa

SEQ ID NO: 2982419 - RNA, 16 nt, Mycobacterium avium subsp. paratuberculosis
ccggcacuucgaucau

SEQ ID NO: 2982420 - RNA, 23 nt, Mycobacterium avium subsp. paratuberculosis
ccggcacuucgaucaucuccacc

SEQ ID NO: 2982421 - RNA, 15 nt, Mycobacterium avium subsp. paratuberculosis
ccggcagaacgacgc

SEQ ID NO: 2982422 - RNA, 16 nt, Mycobacterium avium subsp. paratuberculosis
ccggcagaacgacgcc

SEQ ID NO: 2982423 - RNA, 17 nt, Mycobacterium avium subsp. paratuberculosis
ccggcagaacgacgcca

SEQ ID NO: 2982424 - RNA, 18 nt, Mycobacterium avium subsp. paratuberculosis
ccggcagaucgcggcccg

SEQ ID NO: 2982425 - RNA, 13 nt, Mycobacterium avium subsp. paratuberculosis
ccggcagcaaccg

SEQ ID NO: 2982426 - RNA, 16 nt, Mycobacterium avium subsp. paratuberculosis
ccggcagcaaccggcg

SEQ ID NO: 2982427 - RNA, 17 nt, Mycobacterium avium subsp. paratuberculosis
ccggcagcaaccggcgg

SEQ ID NO: 2982428 - RNA, 19 nt, Mycobacterium avium subsp. paratuberculosis
ccggcagcaaccggcggcu

SEQ ID NO: 2982429 - RNA, 20 nt, Mycobacterium avium subsp. paratuberculosis
ccggcagcaaccggcggcug

SEQ ID NO: 2982430 - RNA, 14 nt, Mycobacterium avium subsp. paratuberculosis
ccggcagcaccgcc

SEQ ID NO: 2982431 - RNA, 15 nt, Mycobacterium avium subsp. paratuberculosis
ccggcagcaccgccg

SEQ ID NO: 2982432 - RNA, 16 nt, Mycobacterium avium subsp. paratuberculosis
ccggcagcaccgccga

SEQ ID NO: 2982433 - RNA, 19 nt, Mycobacterium avium subsp. paratuberculosis
ccggcagcaccgccgagcc

SEQ ID NO: 2982434 - RNA, 22 nt, Mycobacterium avium subsp. paratuberculosis
ccggcagcaccgccgagccguc

SEQ ID NO: 2982435 - RNA, 13 nt, Mycobacterium avium subsp. paratuberculosis
ccggcagcaccgg

SEQ ID NO: 2982436 - RNA, 15 nt, Mycobacterium avium subsp. paratuberculosis
ccggcagcaccggcc

SEQ ID NO: 2982437 - RNA, 16 nt, Mycobacterium avium subsp. paratuberculosis
ccggcagcaccggccg

SEQ ID NO: 2982438 - RNA, 17 nt, Mycobacterium avium subsp. paratuberculosis
ccggcagcaccggccgg

SEQ ID NO: 2982439 - RNA, 23 nt, Mycobacterium avium subsp. paratuberculosis
ccggcagcagcgagucgaagccg

SEQ ID NO: 2982440 - RNA, 15 nt, Mycobacterium avium subsp. paratuberculosis
ccggcagcaggugca

SEQ ID NO: 2982441 - RNA, 20 nt, Mycobacterium avium subsp. paratuberculosis
ccggcagcaggugcaccacc

SEQ ID NO: 2982442 - RNA, 23 nt, Mycobacterium avium subsp. paratuberculosis
ccggcagcaggugcaccacccag

SEQ ID NO: 2982443 - RNA, 17 nt, Mycobacterium avium subsp. paratuberculosis
ccggcagcaucgggacg

SEQ ID NO: 2982444 - RNA, 21 nt, Mycobacterium avium subsp. paratuberculosis
ccggcagcaucgggacgccug

SEQ ID NO: 2982445 - RNA, 22 nt, Mycobacterium avium subsp. paratuberculosis
ccggcagcaucgggacgccugc

SEQ ID NO: 2982446 - RNA, 16 nt, Mycobacterium avium subsp. paratuberculosis
ccggcagcauucgccg

SEQ ID NO: 2982447 - RNA, 19 nt, Mycobacterium avium subsp. paratuberculosis
ccggcagcauucgccgggg

SEQ ID NO: 2982448 - RNA, 14 nt, Mycobacterium avium subsp. paratuberculosis
ccggcagcccggag

SEQ ID NO: 2982449 - RNA, 13 nt, Mycobacterium avium subsp. paratuberculosis
ccggcagccgcag

SEQ ID NO: 2982450 - RNA, 14 nt, Mycobacterium avium subsp. paratuberculosis
ccggcagccgcagc

SEQ ID NO: 2982451 - RNA, 17 nt, Mycobacterium avium subsp. paratuberculosis
ccggcagccgcagcgac

SEQ ID NO: 2982452 - RNA, 13 nt, Mycobacterium avium subsp. paratuberculosis
ccggcagccgcgc

SEQ ID NO: 2982453 - RNA, 16 nt, Mycobacterium avium subsp. paratuberculosis
ccggcagccgcgccca

SEQ ID NO: 2982454 - RNA, 13 nt, Mycobacterium avium subsp. paratuberculosis
ccggcagccgcuc

SEQ ID NO: 2982455 - RNA, 14 nt, Mycobacterium avium subsp. paratuberculosis
ccggcagccggcca

SEQ ID NO: 2982456 - RNA, 13 nt, Mycobacterium avium subsp. paratuberculosis
ccggcagccggcg

SEQ ID NO: 2982457 - RNA, 16 nt, Mycobacterium avium subsp. paratuberculosis
ccggcagccggcgcgg

SEQ ID NO: 2982458 - RNA, 19 nt, Mycobacterium avium subsp. paratuberculosis
ccggcagccggcgcgguga

SEQ ID NO: 2982459 - RNA, 13 nt, Mycobacterium avium subsp. paratuberculosis
ccggcagccgggg

SEQ ID NO: 2982460 - RNA, 22 nt, Mycobacterium avium subsp. paratuberculosis
ccggcagccggggugcccgggc

SEQ ID NO: 2982461 - RNA, 14 nt, Mycobacterium avium subsp. paratuberculosis
ccggcagcgaaacc

SEQ ID NO: 2982462 - RNA, 20 nt, Mycobacterium avium subsp. paratuberculosis
ccggcagcgccaccagcucc

SEQ ID NO: 2982463 - RNA, 16 nt, Mycobacterium avium subsp. paratuberculosis
ccggcagcgccucccg

SEQ ID NO: 2982464 - RNA, 15 nt, Mycobacterium avium subsp. paratuberculosis
ccggcagcgcgccca

SEQ ID NO: 2982465 - RNA, 19 nt, Mycobacterium avium subsp. paratuberculosis
ccggcagcgcucgucgucg

SEQ ID NO: 2982466 - RNA, 20 nt, Mycobacterium avium subsp. paratuberculosis
ccggcagcgcucgucgucgg

SEQ ID NO: 2982467 - RNA, 12 nt, Mycobacterium avium subsp. paratuberculosis
ccggcagcggcc

SEQ ID NO: 2982468 - RNA, 14 nt, Mycobacterium avium subsp. paratuberculosis
ccggcagcggccgc

SEQ ID NO: 2982469 - RNA, 23 nt, Mycobacterium avium subsp. paratuberculosis
ccggcagcggccgcaaucggcgc

SEQ ID NO: 2982470 - RNA, 16 nt, Mycobacterium avium subsp. paratuberculosis
ccggcagcggcugcug

SEQ ID NO: 2982471 - RNA, 22 nt, Mycobacterium avium subsp. paratuberculosis
ccggcagcggcugcugcagcgc

SEQ ID NO: 2982472 - RNA, 18 nt, Mycobacterium avium subsp. paratuberculosis
ccggcagcggugccgccc

SEQ ID NO: 2982473 - RNA, 23 nt, Mycobacterium avium subsp. paratuberculosis
ccggcagcggugccgcccggagg

SEQ ID NO: 2982474 - RNA, 23 nt, Mycobacterium avium subsp. paratuberculosis
ccggcagcgucuuggacgcccgg

SEQ ID NO: 2982475 - RNA, 18 nt, Mycobacterium avium subsp. paratuberculosis
ccggcagcugcccgucgg

SEQ ID NO: 2982476 - RNA, 18 nt, Mycobacterium avium subsp. paratuberculosis
ccggcaggacgggggccg

SEQ ID NO: 2982477 - RNA, 20 nt, Mycobacterium avium subsp. paratuberculosis
ccggcaggacgggggccggu

SEQ ID NO: 2982478 - RNA, 17 nt, Mycobacterium avium subsp. paratuberculosis
ccggcaggccgcccgac

SEQ ID NO: 2982479 - RNA, 15 nt, Mycobacterium avium subsp. paratuberculosis
ccggcaggccgcggc

SEQ ID NO: 2982480 - RNA, 17 nt, Mycobacterium avium subsp. paratuberculosis
ccggcaggccgcggccg

SEQ ID NO: 2982481 - RNA, 18 nt, Mycobacterium avium subsp. paratuberculosis
ccggcaggccgcggccgu

SEQ ID NO: 2982482 - RNA, 19 nt, Mycobacterium avium subsp. paratuberculosis
ccggcaggccgcggccguc

SEQ ID NO: 2982483 - RNA, 21 nt, Mycobacterium avium subsp. paratuberculosis
ccggcaggccgcggccgucgu

SEQ ID NO: 2982484 - RNA, 19 nt, Mycobacterium avium subsp. paratuberculosis
ccggcaggcucagcagcac

SEQ ID NO: 2982485 - RNA, 21 nt, Mycobacterium avium subsp. paratuberculosis
ccggcaggcucagcagcaccg

SEQ ID NO: 2982486 - RNA, 22 nt, Mycobacterium avium subsp. paratuberculosis
ccggcaggcucagcagcaccgc

SEQ ID NO: 2982487 - RNA, 19 nt, Mycobacterium avium subsp. paratuberculosis
ccggcaggucgaggccggc

SEQ ID NO: 2982488 - RNA, 23 nt, Mycobacterium avium subsp. paratuberculosis
ccggcaggucgaggccggccagc

SEQ ID NO: 2982489 - RNA, 21 nt, Mycobacterium avium subsp. paratuberculosis
ccggcagguuguugacgacgu

SEQ ID NO: 2982490 - RNA, 16 nt, Mycobacterium avium subsp. paratuberculosis
ccggcaguacgcgccg

SEQ ID NO: 2982491 - RNA, 16 nt, Mycobacterium avium subsp. paratuberculosis
ccggcaguccggacac

SEQ ID NO: 2982492 - RNA, 19 nt, Mycobacterium avium subsp. paratuberculosis
ccggcaguccggacacggc

SEQ ID NO: 2982493 - RNA, 21 nt, Mycobacterium avium subsp. paratuberculosis
ccggcaguccggacacggcca

SEQ ID NO: 2982494 - RNA, 13 nt, Mycobacterium avium subsp. paratuberculosis
ccggcagugaucg

SEQ ID NO: 2982495 - RNA, 16 nt, Mycobacterium avium subsp. paratuberculosis
ccggcagugaucggcg

SEQ ID NO: 2982496 - RNA, 18 nt, Mycobacterium avium subsp. paratuberculosis
ccggcaguuccucgccgg

SEQ ID NO: 2982497 - RNA, 20 nt, Mycobacterium avium subsp. paratuberculosis
ccggcaguuccucgccggag

SEQ ID NO: 2982498 - RNA, 18 nt, Mycobacterium avium subsp. paratuberculosis
ccggcauaggccagcacc

SEQ ID NO: 2982499 - RNA, 20 nt, Mycobacterium avium subsp. paratuberculosis
ccggcauccagcacggccgc

SEQ ID NO: 2982500 - RNA, 16 nt, Mycobacterium avium subsp. paratuberculosis
ccggcaucccacccgg

SEQ ID NO: 2982501 - RNA, 13 nt, Mycobacterium avium subsp. paratuberculosis
ccggcauccucgg

SEQ ID NO: 2982502 - RNA, 14 nt, Mycobacterium avium subsp. paratuberculosis
ccggcauccucggc

SEQ ID NO: 2982503 - RNA, 15 nt, Mycobacterium avium subsp. paratuberculosis
ccggcauccucggcg

SEQ ID NO: 2982504 - RNA, 21 nt, Mycobacterium avium subsp. paratuberculosis
ccggcauccucggcgcgucgg

SEQ ID NO: 2982505 - RNA, 21 nt, Mycobacterium avium subsp. paratuberculosis
ccggcaucgacaugcccggcg

SEQ ID NO: 2982506 - RNA, 22 nt, Mycobacterium avium subsp. paratuberculosis
ccggcaucgacaugcccggcga

SEQ ID NO: 2982507 - RNA, 14 nt, Mycobacterium avium subsp. paratuberculosis
ccggcaucgaccgc

SEQ ID NO: 2982508 - RNA, 15 nt, Mycobacterium avium subsp. paratuberculosis
ccggcaucgaccgcc

SEQ ID NO: 2982509 - RNA, 20 nt, Mycobacterium avium subsp. paratuberculosis
ccggcaucgaccgcccgcug

SEQ ID NO: 2982510 - RNA, 14 nt, Mycobacterium avium subsp. paratuberculosis
ccggcaucggcucg

SEQ ID NO: 2982511 - RNA, 11 nt, Mycobacterium avium subsp. paratuberculosis
ccggcaucggu

SEQ ID NO: 2982512 - RNA, 13 nt, Mycobacterium avium subsp. paratuberculosis
ccggcaugggcgg

SEQ ID NO: 2982513 - RNA, 21 nt, Mycobacterium avium subsp. paratuberculosis
ccggcaugggcggcaagccga

SEQ ID NO: 2982514 - RNA, 17 nt, Mycobacterium avium subsp. paratuberculosis
ccggcaugugccacagg

SEQ ID NO: 2982515 - RNA, 15 nt, Mycobacterium avium subsp. paratuberculosis
ccggcauucgugugg

SEQ ID NO: 2982516 - RNA, 22 nt, Mycobacterium avium subsp. paratuberculosis
ccggcauucguguggcgcacgc

SEQ ID NO: 2982517 - RNA, 20 nt, Mycobacterium avium subsp. paratuberculosis
ccggccaacagcagcgccgc

SEQ ID NO: 2982518 - RNA, 13 nt, Mycobacterium avium subsp. paratuberculosis
ccggccaaggcaa

SEQ ID NO: 2982519 - RNA, 14 nt, Mycobacterium avium subsp. paratuberculosis
ccggccaccaacag

SEQ ID NO: 2982520 - RNA, 20 nt, Mycobacterium avium subsp. paratuberculosis
ccggccaccaacaggucggc

SEQ ID NO: 2982521 - RNA, 21 nt, Mycobacterium avium subsp. paratuberculosis
ccggccaccaacaggucggcg

SEQ ID NO: 2982522 - RNA, 22 nt, Mycobacterium avium subsp. paratuberculosis
ccggccaccaacaggucggcgu

SEQ ID NO: 2982523 - RNA, 12 nt, Mycobacterium avium subsp. paratuberculosis
ccggccaccacg

SEQ ID NO: 2982524 - RNA, 15 nt, Mycobacterium avium subsp. paratuberculosis
ccggccaccagcggc

SEQ ID NO: 2982525 - RNA, 17 nt, Mycobacterium avium subsp. paratuberculosis
ccggccaccagcggccg

SEQ ID NO: 2982526 - RNA, 21 nt, Mycobacterium avium subsp. paratuberculosis
ccggccaccagggcgaccgcc

SEQ ID NO: 2982527 - RNA, 19 nt, Mycobacterium avium subsp. paratuberculosis
ccggccaccagggucucgc

SEQ ID NO: 2982528 - RNA, 16 nt, Mycobacterium avium subsp. paratuberculosis
ccggccaccaggucgc

SEQ ID NO: 2982529 - RNA, 13 nt, Mycobacterium avium subsp. paratuberculosis
ccggccaccccgc

SEQ ID NO: 2982530 - RNA, 15 nt, Mycobacterium avium subsp. paratuberculosis
ccggccaccgcccca

SEQ ID NO: 2982531 - RNA, 19 nt, Mycobacterium avium subsp. paratuberculosis
ccggccaccgccccagccg

SEQ ID NO: 2982532 - RNA, 20 nt, Mycobacterium avium subsp. paratuberculosis
ccggccaccgccccagccga

SEQ ID NO: 2982533 - RNA, 14 nt, Mycobacterium avium subsp. paratuberculosis
ccggccaccgccgc

SEQ ID NO: 2982534 - RNA, 21 nt, Mycobacterium avium subsp. paratuberculosis
ccggccaccgccgccagcagc

SEQ ID NO: 2982535 - RNA, 13 nt, Mycobacterium avium subsp. paratuberculosis
ccggccaccggcg

SEQ ID NO: 2982536 - RNA, 16 nt, Mycobacterium avium subsp. paratuberculosis
ccggccaccggcgcga

SEQ ID NO: 2982537 - RNA, 12 nt, Mycobacterium avium subsp. paratuberculosis
ccggccaccucg

SEQ ID NO: 2982538 - RNA, 17 nt, Mycobacterium avium subsp. paratuberculosis
ccggccaccucgucggc

SEQ ID NO: 2982539 - RNA, 18 nt, Mycobacterium avium subsp. paratuberculosis
ccggccaccucgucggcg

SEQ ID NO: 2982540 - RNA, 20 nt, Mycobacterium avium subsp. paratuberculosis
ccggccaccucgucggcggu

SEQ ID NO: 2982541 - RNA, 16 nt, Mycobacterium avium subsp. paratuberculosis
ccggccaccuggccgg

SEQ ID NO: 2982542 - RNA, 17 nt, Mycobacterium avium subsp. paratuberculosis
ccggccaccuggccggu

SEQ ID NO: 2982543 - RNA, 15 nt, Mycobacterium avium subsp. paratuberculosis
ccggccacgaccucg

SEQ ID NO: 2982544 - RNA, 11 nt, Mycobacterium avium subsp. paratuberculosis
ccggccacgcc

SEQ ID NO: 2982545 - RNA, 15 nt, Mycobacterium avium subsp. paratuberculosis
ccggccacgccgggu

SEQ ID NO: 2982546 - RNA, 20 nt, Mycobacterium avium subsp. paratuberculosis
ccggccacgccggguuuguc

SEQ ID NO: 2982547 - RNA, 14 nt, Mycobacterium avium subsp. paratuberculosis
ccggccacgcucgg

SEQ ID NO: 2982548 - RNA, 15 nt, Mycobacterium avium subsp. paratuberculosis
ccggccacgcucggc

SEQ ID NO: 2982549 - RNA, 16 nt, Mycobacterium avium subsp. paratuberculosis
ccggccacgcucggcg

SEQ ID NO: 2982550 - RNA, 17 nt, Mycobacterium avium subsp. paratuberculosis
ccggccacgcucggcgg

SEQ ID NO: 2982551 - RNA, 18 nt, Mycobacterium avium subsp. paratuberculosis
ccggccacgcucggcggc

SEQ ID NO: 2982552 - RNA, 21 nt, Mycobacterium avium subsp. paratuberculosis
ccggccacgcucggcggcgcg

SEQ ID NO: 2982553 - RNA, 22 nt, Mycobacterium avium subsp. paratuberculosis
ccggccacgcucggcggcgcgc

SEQ ID NO: 2982554 - RNA, 19 nt, Mycobacterium avium subsp. paratuberculosis
ccggccacguaguccgacg

SEQ ID NO: 2982555 - RNA, 20 nt, Mycobacterium avium subsp. paratuberculosis
ccggccacguaguccgacga

SEQ ID NO: 2982556 - RNA, 13 nt, Mycobacterium avium subsp. paratuberculosis
ccggccacgucga

SEQ ID NO: 2982557 - RNA, 15 nt, Mycobacterium avium subsp. paratuberculosis
ccggccacgucgaug

SEQ ID NO: 2982558 - RNA, 16 nt, Mycobacterium avium subsp. paratuberculosis
ccggccacucgccgcg

SEQ ID NO: 2982559 - RNA, 17 nt, Mycobacterium avium subsp. paratuberculosis
ccggccacucgccgcga

SEQ ID NO: 2982560 - RNA, 22 nt, Mycobacterium avium subsp. paratuberculosis
ccggccacucgcguccccgcgc

SEQ ID NO: 2982561 - RNA, 13 nt, Mycobacterium avium subsp. paratuberculosis
ccggccagaucga

SEQ ID NO: 2982562 - RNA, 22 nt, Mycobacterium avium subsp. paratuberculosis
ccggccagaucgacgccgcggu

SEQ ID NO: 2982563 - RNA, 14 nt, Mycobacterium avium subsp. paratuberculosis
ccggccagcaccac

SEQ ID NO: 2982564 - RNA, 17 nt, Mycobacterium avium subsp. paratuberculosis
ccggccagcaccacggu

SEQ ID NO: 2982565 - RNA, 15 nt, Mycobacterium avium subsp. paratuberculosis
ccggccagcacccgc

SEQ ID NO: 2982566 - RNA, 22 nt, Mycobacterium avium subsp. paratuberculosis
ccggccagcacccgcugaucca

SEQ ID NO: 2982567 - RNA, 12 nt, Mycobacterium avium subsp. paratuberculosis
ccggccagcacg

SEQ ID NO: 2982568 - RNA, 21 nt, Mycobacterium avium subsp. paratuberculosis
ccggccagcacgaacaccacg

SEQ ID NO: 2982569 - RNA, 13 nt, Mycobacterium avium subsp. paratuberculosis
ccggccagcacgc

SEQ ID NO: 2982570 - RNA, 19 nt, Mycobacterium avium subsp. paratuberculosis
ccggccagcacggccagcc

SEQ ID NO: 2982571 - RNA, 16 nt, Mycobacterium avium subsp. paratuberculosis
ccggccagcacggcgg

SEQ ID NO: 2982572 - RNA, 20 nt, Mycobacterium avium subsp. paratuberculosis
ccggccagcacggcggcgug

SEQ ID NO: 2982573 - RNA, 12 nt, Mycobacterium avium subsp. paratuberculosis
ccggccagcagc

SEQ ID NO: 2982574 - RNA, 13 nt, Mycobacterium avium subsp. paratuberculosis
ccggccagcagca

SEQ ID NO: 2982575 - RNA, 14 nt, Mycobacterium avium subsp. paratuberculosis
ccggccagcagcag

SEQ ID NO: 2982576 - RNA, 15 nt, Mycobacterium avium subsp. paratuberculosis
ccggccagcagcagc

SEQ ID NO: 2982577 - RNA, 16 nt, Mycobacterium avium subsp. paratuberculosis
ccggccagcagcagcc

SEQ ID NO: 2982578 - RNA, 23 nt, Mycobacterium avium subsp. paratuberculosis
ccggccagcagcagcccgccgau

SEQ ID NO: 2982579 - RNA, 17 nt, Mycobacterium avium subsp. paratuberculosis
ccggccagcagcaggua

SEQ ID NO: 2982580 - RNA, 13 nt, Mycobacterium avium subsp. paratuberculosis
ccggccagcagcc

SEQ ID NO: 2982581 - RNA, 18 nt, Mycobacterium avium subsp. paratuberculosis
ccggccagcagccgguac

SEQ ID NO: 2982582 - RNA, 18 nt, Mycobacterium avium subsp. paratuberculosis
ccggccagcagcggcuug

SEQ ID NO: 2982583 - RNA, 19 nt, Mycobacterium avium subsp. paratuberculosis
ccggccagcauggucucgc

SEQ ID NO: 2982584 - RNA, 12 nt, Mycobacterium avium subsp. paratuberculosis
ccggccagccgc

SEQ ID NO: 2982585 - RNA, 14 nt, Mycobacterium avium subsp. paratuberculosis
ccggccagccgcgc

SEQ ID NO: 2982586 - RNA, 15 nt, Mycobacterium avium subsp. paratuberculosis
ccggccagccgcgcg

SEQ ID NO: 2982587 - RNA, 14 nt, Mycobacterium avium subsp. paratuberculosis
ccggccagccggcc

SEQ ID NO: 2982588 - RNA, 16 nt, Mycobacterium avium subsp. paratuberculosis
ccggccagccggccgc

SEQ ID NO: 2982589 - RNA, 20 nt, Mycobacterium avium subsp. paratuberculosis
ccggccagccggccgcugac

SEQ ID NO: 2982590 - RNA, 20 nt, Mycobacterium avium subsp. paratuberculosis
ccggccagccggcucuuggc

SEQ ID NO: 2982591 - RNA, 14 nt, Mycobacterium avium subsp. paratuberculosis
ccggccagccgggg

SEQ ID NO: 2982592 - RNA, 14 nt, Mycobacterium avium subsp. paratuberculosis
ccggccagcggcag

SEQ ID NO: 2982593 - RNA, 16 nt, Mycobacterium avium subsp. paratuberculosis
ccggccagcggcaucc

SEQ ID NO: 2982594 - RNA, 22 nt, Mycobacterium avium subsp. paratuberculosis
ccggccagcggcaucccuuccu

SEQ ID NO: 2982595 - RNA, 14 nt, Mycobacterium avium subsp. paratuberculosis
ccggccagcggcca

SEQ ID NO: 2982596 - RNA, 16 nt, Mycobacterium avium subsp. paratuberculosis
ccggccagcggccagc

SEQ ID NO: 2982597 - RNA, 18 nt, Mycobacterium avium subsp. paratuberculosis
ccggccagcggccagccc

SEQ ID NO: 2982598 - RNA, 22 nt, Mycobacterium avium subsp. paratuberculosis
ccggccagcggccagcccgcgg

SEQ ID NO: 2982599 - RNA, 18 nt, Mycobacterium avium subsp. paratuberculosis
ccggccagcggcuuggcc

SEQ ID NO: 2982600 - RNA, 12 nt, Mycobacterium avium subsp. paratuberculosis
ccggccagcggg

SEQ ID NO: 2982601 - RNA, 19 nt, Mycobacterium avium subsp. paratuberculosis
ccggccagcgucuccggcg

SEQ ID NO: 2982602 - RNA, 13 nt, Mycobacterium avium subsp. paratuberculosis
ccggccagcucga

SEQ ID NO: 2982603 - RNA, 20 nt, Mycobacterium avium subsp. paratuberculosis
ccggccagcucgagcaucac

SEQ ID NO: 2982604 - RNA, 23 nt, Mycobacterium avium subsp. paratuberculosis
ccggccagcucgagcaucacgaa

SEQ ID NO: 2982605 - RNA, 13 nt, Mycobacterium avium subsp. paratuberculosis
ccggccagcucgc

SEQ ID NO: 2982606 - RNA, 21 nt, Mycobacterium avium subsp. paratuberculosis
ccggccagcucgccgccgacg

SEQ ID NO: 2982607 - RNA, 21 nt, Mycobacterium avium subsp. paratuberculosis
ccggccaggaucuugucggcg

SEQ ID NO: 2982608 - RNA, 13 nt, Mycobacterium avium subsp. paratuberculosis
ccggccaggaugg

SEQ ID NO: 2982609 - RNA, 20 nt, Mycobacterium avium subsp. paratuberculosis
ccggccaggauggagcugac

SEQ ID NO: 2982610 - RNA, 16 nt, Mycobacterium avium subsp. paratuberculosis
ccggccaggcacagca

SEQ ID NO: 2982611 - RNA, 21 nt, Mycobacterium avium subsp. paratuberculosis
ccggccaggcacagcagggca

SEQ ID NO: 2982612 - RNA, 12 nt, Mycobacterium avium subsp. paratuberculosis
ccggccaggccc

SEQ ID NO: 2982613 - RNA, 16 nt, Mycobacterium avium subsp. paratuberculosis
ccggccaggcccagcc

SEQ ID NO: 2982614 - RNA, 12 nt, Mycobacterium avium subsp. paratuberculosis
ccggccaggccg

SEQ ID NO: 2982615 - RNA, 14 nt, Mycobacterium avium subsp. paratuberculosis
ccggccaggccggc

SEQ ID NO: 2982616 - RNA, 16 nt, Mycobacterium avium subsp. paratuberculosis
ccggccaggccggccu

SEQ ID NO: 2982617 - RNA, 19 nt, Mycobacterium avium subsp. paratuberculosis
ccggccaggccggccugcc

SEQ ID NO: 2982618 - RNA, 15 nt, Mycobacterium avium subsp. paratuberculosis
ccggccagggccgcc

SEQ ID NO: 2982619 - RNA, 16 nt, Mycobacterium avium subsp. paratuberculosis
ccggccagggccgccg

SEQ ID NO: 2982620 - RNA, 19 nt, Mycobacterium avium subsp. paratuberculosis
ccggccagggccgccgcau

SEQ ID NO: 2982621 - RNA, 15 nt, Mycobacterium avium subsp. paratuberculosis
ccggccagggugccg

SEQ ID NO: 2982622 - RNA, 17 nt, Mycobacterium avium subsp. paratuberculosis
ccggccagggugccgac

SEQ ID NO: 2982623 - RNA, 19 nt, Mycobacterium avium subsp. paratuberculosis
ccggccagggugccgacga

SEQ ID NO: 2982624 - RNA, 13 nt, Mycobacterium avium subsp. paratuberculosis
ccggccaggucgc

SEQ ID NO: 2982625 - RNA, 15 nt, Mycobacterium avium subsp. paratuberculosis
ccggccaggucgccg

SEQ ID NO: 2982626 - RNA, 20 nt, Mycobacterium avium subsp. paratuberculosis
ccggccagguuccaccgggc

SEQ ID NO: 2982627 - RNA, 19 nt, Mycobacterium avium subsp. paratuberculosis
ccggccagguugaccacca

SEQ ID NO: 2982628 - RNA, 20 nt, Mycobacterium avium subsp. paratuberculosis
ccggccagguugaccaccag

SEQ ID NO: 2982629 - RNA, 14 nt, Mycobacterium avium subsp. paratuberculosis
ccggccaguccagc

SEQ ID NO: 2982630 - RNA, 17 nt, Mycobacterium avium subsp. paratuberculosis
ccggccaguccgcguga

SEQ ID NO: 2982631 - RNA, 15 nt, Mycobacterium avium subsp. paratuberculosis
ccggccaguccggca

SEQ ID NO: 2982632 - RNA, 17 nt, Mycobacterium avium subsp. paratuberculosis
ccggccaguccggcagc

SEQ ID NO: 2982633 - RNA, 20 nt, Mycobacterium avium subsp. paratuberculosis
ccggccaguccggcagcagc

SEQ ID NO: 2982634 - RNA, 20 nt, Mycobacterium avium subsp. paratuberculosis
ccggccaguucccgggcgaa

SEQ ID NO: 2982635 - RNA, 19 nt, Mycobacterium avium subsp. paratuberculosis
ccggccaucaugcccacca

SEQ ID NO: 2982636 - RNA, 12 nt, Mycobacterium avium subsp. paratuberculosis
ccggccauccgc

SEQ ID NO: 2982637 - RNA, 23 nt, Mycobacterium avium subsp. paratuberculosis
ccggccaucuccugcacgcgcgg

SEQ ID NO: 2982638 - RNA, 14 nt, Mycobacterium avium subsp. paratuberculosis
ccggccaucucggc

SEQ ID NO: 2982639 - RNA, 16 nt, Mycobacterium avium subsp. paratuberculosis
ccggccaucucggcgg

SEQ ID NO: 2982640 - RNA, 17 nt, Mycobacterium avium subsp. paratuberculosis
ccggccaucucggcggc

SEQ ID NO: 2982641 - RNA, 17 nt, Mycobacterium avium subsp. paratuberculosis
ccggccaucugcgcgac

SEQ ID NO: 2982642 - RNA, 19 nt, Mycobacterium avium subsp. paratuberculosis
ccggccaucugcgcgacga

SEQ ID NO: 2982643 - RNA, 23 nt, Mycobacterium avium subsp. paratuberculosis
ccggccaucuucaguucggccgg

SEQ ID NO: 2982644 - RNA, 19 nt, Mycobacterium avium subsp. paratuberculosis
ccggccaugaccaugucga

SEQ ID NO: 2982645 - RNA, 21 nt, Mycobacterium avium subsp. paratuberculosis
ccggccaugcccucgaucgag

SEQ ID NO: 2982646 - RNA, 23 nt, Mycobacterium avium subsp. paratuberculosis
ccggccaugcccucgaucgagga

SEQ ID NO: 2982647 - RNA, 12 nt, Mycobacterium avium subsp. paratuberculosis
ccggcccaccac

SEQ ID NO: 2982648 - RNA, 14 nt, Mycobacterium avium subsp. paratuberculosis
ccggcccaccaccg

SEQ ID NO: 2982649 - RNA, 12 nt, Mycobacterium avium subsp. paratuberculosis
ccggcccaccgg

SEQ ID NO: 2982650 - RNA, 14 nt, Mycobacterium avium subsp. paratuberculosis
ccggcccaccggcc

SEQ ID NO: 2982651 - RNA, 15 nt, Mycobacterium avium subsp. paratuberculosis
ccggcccaccggccc

SEQ ID NO: 2982652 - RNA, 19 nt, Mycobacterium avium subsp. paratuberculosis
ccggcccaccggcccggcg

SEQ ID NO: 2982653 - RNA, 21 nt, Mycobacterium avium subsp. paratuberculosis
ccggcccaccggcccggcggg

SEQ ID NO: 2982654 - RNA, 16 nt, Mycobacterium avium subsp. paratuberculosis
ccggcccacgccgucg

SEQ ID NO: 2982655 - RNA, 13 nt, Mycobacterium avium subsp. paratuberculosis
ccggcccagcagc

SEQ ID NO: 2982656 - RNA, 15 nt, Mycobacterium avium subsp. paratuberculosis
ccggcccagccgcug

SEQ ID NO: 2982657 - RNA, 16 nt, Mycobacterium avium subsp. paratuberculosis
ccggcccagccgcugc

SEQ ID NO: 2982658 - RNA, 22 nt, Mycobacterium avium subsp. paratuberculosis
ccggcccagccgcugcgacagg

SEQ ID NO: 2982659 - RNA, 16 nt, Mycobacterium avium subsp. paratuberculosis
ccggcccagccggcgg

SEQ ID NO: 2982660 - RNA, 15 nt, Mycobacterium avium subsp. paratuberculosis
ccggcccagccgguc

SEQ ID NO: 2982661 - RNA, 17 nt, Mycobacterium avium subsp. paratuberculosis
ccggcccagccggucgc

SEQ ID NO: 2982662 - RNA, 17 nt, Mycobacterium avium subsp. paratuberculosis
ccggcccagcgcgcggc

SEQ ID NO: 2982663 - RNA, 14 nt, Mycobacterium avium subsp. paratuberculosis
ccggcccagcgcgg

SEQ ID NO: 2982664 - RNA, 15 nt, Mycobacterium avium subsp. paratuberculosis
ccggcccagcuccac

SEQ ID NO: 2982665 - RNA, 19 nt, Mycobacterium avium subsp. paratuberculosis
ccggcccaggcaguagccg

SEQ ID NO: 2982666 - RNA, 22 nt, Mycobacterium avium subsp. paratuberculosis
ccggcccaguggaucggcccga

SEQ ID NO: 2982667 - RNA, 17 nt, Mycobacterium avium subsp. paratuberculosis
ccggcccaucaccggac

SEQ ID NO: 2982668 - RNA, 22 nt, Mycobacterium avium subsp. paratuberculosis
ccggcccaucaccggaccggcc

SEQ ID NO: 2982669 - RNA, 24 nt, Mycobacterium avium subsp. paratuberculosis
ccggcccaucaccggaccggccag

SEQ ID NO: 2982670 - RNA, 16 nt, Mycobacterium avium subsp. paratuberculosis
ccggccccaacggcgu

SEQ ID NO: 2982671 - RNA, 18 nt, Mycobacterium avium subsp. paratuberculosis
ccggccccaacggcgugc

SEQ ID NO: 2982672 - RNA, 21 nt, Mycobacterium avium subsp. paratuberculosis
ccggccccaacggcgugcagc

SEQ ID NO: 2982673 - RNA, 23 nt, Mycobacterium avium subsp. paratuberculosis
ccggccccaacggcgugcagccg

SEQ ID NO: 2982674 - RNA, 17 nt, Mycobacterium avium subsp. paratuberculosis
ccggccccaccgccgcu

SEQ ID NO: 2982675 - RNA, 19 nt, Mycobacterium avium subsp. paratuberculosis
ccggccccaccgccgcugc

SEQ ID NO: 2982676 - RNA, 20 nt, Mycobacterium avium subsp. paratuberculosis
ccggcccccgagcuucgggu

SEQ ID NO: 2982677 - RNA, 18 nt, Mycobacterium avium subsp. paratuberculosis
ccggcccccugcucagcg

SEQ ID NO: 2982678 - RNA, 14 nt, Mycobacterium avium subsp. paratuberculosis
ccggccccgagccg

SEQ ID NO: 2982679 - RNA, 16 nt, Mycobacterium avium subsp. paratuberculosis
ccggccccgagccgac

SEQ ID NO: 2982680 - RNA, 18 nt, Mycobacterium avium subsp. paratuberculosis
ccggccccgagcgucacg

SEQ ID NO: 2982681 - RNA, 14 nt, Mycobacterium avium subsp. paratuberculosis
ccggccccgcccgg

SEQ ID NO: 2982682 - RNA, 15 nt, Mycobacterium avium subsp. paratuberculosis
ccggccccgcccggc

SEQ ID NO: 2982683 - RNA, 16 nt, Mycobacterium avium subsp. paratuberculosis
ccggccccgcccggcg

SEQ ID NO: 2982684 - RNA, 21 nt, Mycobacterium avium subsp. paratuberculosis
ccggccccgcccggcgcgcag

SEQ ID NO: 2982685 - RNA, 13 nt, Mycobacterium avium subsp. paratuberculosis
ccggccccgcugc

SEQ ID NO: 2982686 - RNA, 15 nt, Mycobacterium avium subsp. paratuberculosis
ccggccccgcugccg

SEQ ID NO: 2982687 - RNA, 19 nt, Mycobacterium avium subsp. paratuberculosis
ccggccccgcugccguccg

SEQ ID NO: 2982688 - RNA, 23 nt, Mycobacterium avium subsp. paratuberculosis
ccggccccgcugccguccggcgg

SEQ ID NO: 2982689 - RNA, 14 nt, Mycobacterium avium subsp. paratuberculosis
ccggccccggccgg

SEQ ID NO: 2982690 - RNA, 16 nt, Mycobacterium avium subsp. paratuberculosis
ccggccccggccggcg

SEQ ID NO: 2982691 - RNA, 13 nt, Mycobacterium avium subsp. paratuberculosis
ccggccccggcga

SEQ ID NO: 2982692 - RNA, 19 nt, Mycobacterium avium subsp. paratuberculosis
ccggccccgggggaccagc

SEQ ID NO: 2982693 - RNA, 20 nt, Mycobacterium avium subsp. paratuberculosis
ccggccccgggggaccagcg

SEQ ID NO: 2982694 - RNA, 17 nt, Mycobacterium avium subsp. paratuberculosis
ccggccccuaccgccga

SEQ ID NO: 2982695 - RNA, 21 nt, Mycobacterium avium subsp. paratuberculosis
ccggcccgaacaccuccucgg

SEQ ID NO: 2982696 - RNA, 14 nt, Mycobacterium avium subsp. paratuberculosis
ccggcccgagcacc

SEQ ID NO: 2982697 - RNA, 19 nt, Mycobacterium avium subsp. paratuberculosis
ccggcccgagcaccaccag

SEQ ID NO: 2982698 - RNA, 18 nt, Mycobacterium avium subsp. paratuberculosis
ccggcccgauaggccgac

SEQ ID NO: 2982699 - RNA, 16 nt, Mycobacterium avium subsp. paratuberculosis
ccggcccgaucgcggc

SEQ ID NO: 2982700 - RNA, 18 nt, Mycobacterium avium subsp. paratuberculosis
ccggcccgaucgcggcga

SEQ ID NO: 2982701 - RNA, 12 nt, Mycobacterium avium subsp. paratuberculosis
ccggcccgaugc

SEQ ID NO: 2982702 - RNA, 14 nt, Mycobacterium avium subsp. paratuberculosis
ccggcccgcagcca

SEQ ID NO: 2982703 - RNA, 15 nt, Mycobacterium avium subsp. paratuberculosis
ccggcccgcagcgcc

SEQ ID NO: 2982704 - RNA, 14 nt, Mycobacterium avium subsp. paratuberculosis
ccggcccgcaucgc

SEQ ID NO: 2982705 - RNA, 20 nt, Mycobacterium avium subsp. paratuberculosis
ccggcccgcaucgcggcgau

SEQ ID NO: 2982706 - RNA, 22 nt, Mycobacterium avium subsp. paratuberculosis
ccggcccgcaucgcggcgaugg

SEQ ID NO: 2982707 - RNA, 21 nt, Mycobacterium avium subsp. paratuberculosis
ccggcccgcaugcaccggugc

SEQ ID NO: 2982708 - RNA, 19 nt, Mycobacterium avium subsp. paratuberculosis
ccggcccgcccggcggcgc

SEQ ID NO: 2982709 - RNA, 21 nt, Mycobacterium avium subsp. paratuberculosis
ccggcccgcccggcggcgcug

SEQ ID NO: 2982710 - RNA, 13 nt, Mycobacterium avium subsp. paratuberculosis
ccggcccgccgcu

SEQ ID NO: 2982711 - RNA, 15 nt, Mycobacterium avium subsp. paratuberculosis
ccggcccgccgcugc

SEQ ID NO: 2982712 - RNA, 18 nt, Mycobacterium avium subsp. paratuberculosis
ccggcccgccgcugcagc

SEQ ID NO: 2982713 - RNA, 13 nt, Mycobacterium avium subsp. paratuberculosis
ccggcccgcggcg

SEQ ID NO: 2982714 - RNA, 15 nt, Mycobacterium avium subsp. paratuberculosis
ccggcccgcucggcg

SEQ ID NO: 2982715 - RNA, 17 nt, Mycobacterium avium subsp. paratuberculosis
ccggcccgcuggccgcc

SEQ ID NO: 2982716 - RNA, 14 nt, Mycobacterium avium subsp. paratuberculosis
ccggcccggcccga

SEQ ID NO: 2982717 - RNA, 13 nt, Mycobacterium avium subsp. paratuberculosis
ccggcccggccgg

SEQ ID NO: 2982718 - RNA, 14 nt, Mycobacterium avium subsp. paratuberculosis
ccggcccggccggc

SEQ ID NO: 2982719 - RNA, 12 nt, Mycobacterium avium subsp. paratuberculosis
ccggcccggcga

SEQ ID NO: 2982720 - RNA, 15 nt, Mycobacterium avium subsp. paratuberculosis
ccggcccggcgaugc

SEQ ID NO: 2982721 - RNA, 17 nt, Mycobacterium avium subsp. paratuberculosis
ccggcccggcgaugccg

SEQ ID NO: 2982722 - RNA, 13 nt, Mycobacterium avium subsp. paratuberculosis
ccggcccggcgcg

SEQ ID NO: 2982723 - RNA, 15 nt, Mycobacterium avium subsp. paratuberculosis
ccggcccggcgcggc

SEQ ID NO: 2982724 - RNA, 13 nt, Mycobacterium avium subsp. paratuberculosis
ccggcccggcggc

SEQ ID NO: 2982725 - RNA, 15 nt, Mycobacterium avium subsp. paratuberculosis
ccggcccggcggccg

SEQ ID NO: 2982726 - RNA, 17 nt, Mycobacterium avium subsp. paratuberculosis
ccggcccggcggccggc

SEQ ID NO: 2982727 - RNA, 18 nt, Mycobacterium avium subsp. paratuberculosis
ccggcccggcggccggcc

SEQ ID NO: 2982728 - RNA, 16 nt, Mycobacterium avium subsp. paratuberculosis
ccggcccggcgggcau

SEQ ID NO: 2982729 - RNA, 14 nt, Mycobacterium avium subsp. paratuberculosis
ccggcccggcgggu

SEQ ID NO: 2982730 - RNA, 12 nt, Mycobacterium avium subsp. paratuberculosis
ccggcccggcgu

SEQ ID NO: 2982731 - RNA, 20 nt, Mycobacterium avium subsp. paratuberculosis
ccggcccggggacacccucg

SEQ ID NO: 2982732 - RNA, 15 nt, Mycobacterium avium subsp. paratuberculosis
ccggcccggggugug

SEQ ID NO: 2982733 - RNA, 15 nt, Mycobacterium avium subsp. paratuberculosis
ccggcccgucaggcc

SEQ ID NO: 2982734 - RNA, 19 nt, Mycobacterium avium subsp. paratuberculosis
ccggcccguccagaucggc

SEQ ID NO: 2982735 - RNA, 23 nt, Mycobacterium avium subsp. paratuberculosis
ccggcccguccagaucggccagc

SEQ ID NO: 2982736 - RNA, 17 nt, Mycobacterium avium subsp. paratuberculosis
ccggcccgucgagcggc

SEQ ID NO: 2982737 - RNA, 17 nt, Mycobacterium avium subsp. paratuberculosis
ccggcccuauggcaucg

SEQ ID NO: 2982738 - RNA, 21 nt, Mycobacterium avium subsp. paratuberculosis
ccggcccuauggcaucgccaa

SEQ ID NO: 2982739 - RNA, 15 nt, Mycobacterium avium subsp. paratuberculosis
ccggcccugcggcca

SEQ ID NO: 2982740 - RNA, 16 nt, Mycobacterium avium subsp. paratuberculosis
ccggcccuggucggcc

SEQ ID NO: 2982741 - RNA, 19 nt, Mycobacterium avium subsp. paratuberculosis
ccggcccuggucggccagg

SEQ ID NO: 2982742 - RNA, 15 nt, Mycobacterium avium subsp. paratuberculosis
ccggccgaacacggc

SEQ ID NO: 2982743 - RNA, 16 nt, Mycobacterium avium subsp. paratuberculosis
ccggccgaacacggcc

SEQ ID NO: 2982744 - RNA, 18 nt, Mycobacterium avium subsp. paratuberculosis
ccggccgaacacggccgc

SEQ ID NO: 2982745 - RNA, 22 nt, Mycobacterium avium subsp. paratuberculosis
ccggccgacaacgacagcaccc

SEQ ID NO: 2982746 - RNA, 22 nt, Mycobacterium avium subsp. paratuberculosis
ccggccgacauggacgcggccu

SEQ ID NO: 2982747 - RNA, 17 nt, Mycobacterium avium subsp. paratuberculosis
ccggccgaccggucucg

SEQ ID NO: 2982748 - RNA, 18 nt, Mycobacterium avium subsp. paratuberculosis
ccggccgaccggucucga

SEQ ID NO: 2982749 - RNA, 14 nt, Mycobacterium avium subsp. paratuberculosis
ccggccgacgauga

SEQ ID NO: 2982750 - RNA, 22 nt, Mycobacterium avium subsp. paratuberculosis
ccggccgacgaugaacagucgg

SEQ ID NO: 2982751 - RNA, 23 nt, Mycobacterium avium subsp. paratuberculosis
ccggccgacgaugaacagucggc

SEQ ID NO: 2982752 - RNA, 17 nt, Mycobacterium avium subsp. paratuberculosis
ccggccgacgcggccuc

SEQ ID NO: 2982753 - RNA, 18 nt, Mycobacterium avium subsp. paratuberculosis
ccggccgacgcggccucg

SEQ ID NO: 2982754 - RNA, 16 nt, Mycobacterium avium subsp. paratuberculosis
ccggccgacgggcgug

SEQ ID NO: 2982755 - RNA, 19 nt, Mycobacterium avium subsp. paratuberculosis
ccggccgagccgagccgac

SEQ ID NO: 2982756 - RNA, 21 nt, Mycobacterium avium subsp. paratuberculosis
ccggccgagccgagccgaccc

SEQ ID NO: 2982757 - RNA, 22 nt, Mycobacterium avium subsp. paratuberculosis
ccggccgagccgagccgacccg

SEQ ID NO: 2982758 - RNA, 23 nt, Mycobacterium avium subsp. paratuberculosis
ccggccgagccgagccgacccgg

SEQ ID NO: 2982759 - RNA, 21 nt, Mycobacterium avium subsp. paratuberculosis
ccggccgagccgaugcccagc

SEQ ID NO: 2982760 - RNA, 14 nt, Mycobacterium avium subsp. paratuberculosis
ccggccgagcgcag

SEQ ID NO: 2982761 - RNA, 12 nt, Mycobacterium avium subsp. paratuberculosis
cagcgcgagguc

SEQ ID NO: 2982762 - RNA, 17 nt, Mycobacterium avium subsp. paratuberculosis
cagcgcgaucaacgggu

SEQ ID NO: 2982763 - RNA, 20 nt, Mycobacterium avium subsp. paratuberculosis
cagcgcgaucaacgggucga

SEQ ID NO: 2982764 - RNA, 22 nt, Mycobacterium avium subsp. paratuberculosis
cagcgcgaucaacgggucgagc

SEQ ID NO: 2982765 - RNA, 23 nt, Mycobacterium avium subsp. paratuberculosis
cagcgcgauccggggggcggggu

SEQ ID NO: 2982766 - RNA, 15 nt, Mycobacterium avium subsp. paratuberculosis
cagcgcgaucgccgg

SEQ ID NO: 2982767 - RNA, 16 nt, Mycobacterium avium subsp. paratuberculosis
cagcgcgaucgccggg

SEQ ID NO: 2982768 - RNA, 17 nt, Mycobacterium avium subsp. paratuberculosis
cagcgcgaucuccuuga

SEQ ID NO: 2982769 - RNA, 15 nt, Mycobacterium avium subsp. paratuberculosis
cagcgcgaugccggc

SEQ ID NO: 2982770 - RNA, 18 nt, Mycobacterium avium subsp. paratuberculosis
cagcgcgaugccggccag

SEQ ID NO: 2982771 - RNA, 20 nt, Mycobacterium avium subsp. paratuberculosis
cagcgcgaugccggccaggc

SEQ ID NO: 2982772 - RNA, 24 nt, Mycobacterium avium subsp. paratuberculosis
cagcgcgaugccggccaggcacag

SEQ ID NO: 2982773 - RNA, 13 nt, Mycobacterium avium subsp. paratuberculosis
cagcgcgaugucc

SEQ ID NO: 2982774 - RNA, 21 nt, Mycobacterium avium subsp. paratuberculosis
cagcgcgauguccgacagccc

SEQ ID NO: 2982775 - RNA, 16 nt, Mycobacterium avium subsp. paratuberculosis
cagcgcgcacagcgcc

SEQ ID NO: 2982776 - RNA, 17 nt, Mycobacterium avium subsp. paratuberculosis
cagcgcgcacagcgcca

SEQ ID NO: 2982777 - RNA, 19 nt, Mycobacterium avium subsp. paratuberculosis
cagcgcgcacagcgccaca

SEQ ID NO: 2982778 - RNA, 17 nt, Mycobacterium avium subsp. paratuberculosis
cagcgcgcacgcggaca

SEQ ID NO: 2982779 - RNA, 20 nt, Mycobacterium avium subsp. paratuberculosis
cagcgcgcagaacaccaccg

SEQ ID NO: 2982780 - RNA, 12 nt, Mycobacterium avium subsp. paratuberculosis
cagcgcgcccag

SEQ ID NO: 2982781 - RNA, 18 nt, Mycobacterium avium subsp. paratuberculosis
cagcgcgcccaggcccga

SEQ ID NO: 2982782 - RNA, 18 nt, Mycobacterium avium subsp. paratuberculosis
cagcgcgccccagugcag

SEQ ID NO: 2982783 - RNA, 22 nt, Mycobacterium avium subsp. paratuberculosis
cagcgcgcccgacggucgccac

SEQ ID NO: 2982784 - RNA, 14 nt, Mycobacterium avium subsp. paratuberculosis
cagcgcgcccgcca

SEQ ID NO: 2982785 - RNA, 20 nt, Mycobacterium avium subsp. paratuberculosis
cagcgcgcccugaggcccgg

SEQ ID NO: 2982786 - RNA, 11 nt, Mycobacterium avium subsp. paratuberculosis
cagcgcgccga

SEQ ID NO: 2982787 - RNA, 19 nt, Mycobacterium avium subsp. paratuberculosis
cagcgcgccgaccacggcc

SEQ ID NO: 2982788 - RNA, 22 nt, Mycobacterium avium subsp. paratuberculosis
cagcgcgccgaccacggcccca

SEQ ID NO: 2982789 - RNA, 16 nt, Mycobacterium avium subsp. paratuberculosis
cagcgcgccgaucgcc

SEQ ID NO: 2982790 - RNA, 12 nt, Mycobacterium avium subsp. paratuberculosis
cagcgcgccgca

SEQ ID NO: 2982791 - RNA, 20 nt, Mycobacterium avium subsp. paratuberculosis
cagcgcgccgcacagccggc

SEQ ID NO: 2982792 - RNA, 23 nt, Mycobacterium avium subsp. paratuberculosis
cagcgcgccgcacagccggcggc

SEQ ID NO: 2982793 - RNA, 12 nt, Mycobacterium avium subsp. paratuberculosis
cagcgcgccgcc

SEQ ID NO: 2982794 - RNA, 13 nt, Mycobacterium avium subsp. paratuberculosis
cagcgcgccgccc

SEQ ID NO: 2982795 - RNA, 15 nt, Mycobacterium avium subsp. paratuberculosis
cagcgcgccgcccag

SEQ ID NO: 2982796 - RNA, 17 nt, Mycobacterium avium subsp. paratuberculosis
cagcgcgccgcccagcg

SEQ ID NO: 2982797 - RNA, 18 nt, Mycobacterium avium subsp. paratuberculosis
cagcgcgccgcccagcgg

SEQ ID NO: 2982798 - RNA, 14 nt, Mycobacterium avium subsp. paratuberculosis
cagcgcgccgccga

SEQ ID NO: 2982799 - RNA, 23 nt, Mycobacterium avium subsp. paratuberculosis
cagcgcgccgccgaugugaucgg

SEQ ID NO: 2982800 - RNA, 13 nt, Mycobacterium avium subsp. paratuberculosis
cagcgcgccgcgc

SEQ ID NO: 2982801 - RNA, 14 nt, Mycobacterium avium subsp. paratuberculosis
cagcgcgccgcuga

SEQ ID NO: 2982802 - RNA, 14 nt, Mycobacterium avium subsp. paratuberculosis
cagcgcgccggcca

SEQ ID NO: 2982803 - RNA, 15 nt, Mycobacterium avium subsp. paratuberculosis
cagcgcgccggccag

SEQ ID NO: 2982804 - RNA, 20 nt, Mycobacterium avium subsp. paratuberculosis
cagcgcgccggccagcagca

SEQ ID NO: 2982805 - RNA, 17 nt, Mycobacterium avium subsp. paratuberculosis
cagcgcgccgucggacu

SEQ ID NO: 2982806 - RNA, 16 nt, Mycobacterium avium subsp. paratuberculosis
cagcgcgcgaccgcga

SEQ ID NO: 2982807 - RNA, 20 nt, Mycobacterium avium subsp. paratuberculosis
cagcgcgcgaccgcgaugcg

SEQ ID NO: 2982808 - RNA, 23 nt, Mycobacterium avium subsp. paratuberculosis
cagcgcgcgagacaccucgucga

SEQ ID NO: 2982809 - RNA, 13 nt, Mycobacterium avium subsp. paratuberculosis
cagcgcgcgauca

SEQ ID NO: 2982810 - RNA, 16 nt, Mycobacterium avium subsp. paratuberculosis
cagcgcgcgaucagcg

SEQ ID NO: 2982811 - RNA, 18 nt, Mycobacterium avium subsp. paratuberculosis
cagcgcgcgaucagcgcc

SEQ ID NO: 2982812 - RNA, 15 nt, Mycobacterium avium subsp. paratuberculosis
cagcgcgcgaucgcc

SEQ ID NO: 2982813 - RNA, 14 nt, Mycobacterium avium subsp. paratuberculosis
cagcgcgcgcucgg

SEQ ID NO: 2982814 - RNA, 20 nt, Mycobacterium avium subsp. paratuberculosis
cagcgcgcgcucggucagca

SEQ ID NO: 2982815 - RNA, 23 nt, Mycobacterium avium subsp. paratuberculosis
cagcgcgcgcucggucagcaccg

SEQ ID NO: 2982816 - RNA, 20 nt, Mycobacterium avium subsp. paratuberculosis
cagcgcgcgcuugcgcucgg

SEQ ID NO: 2982817 - RNA, 24 nt, Mycobacterium avium subsp. paratuberculosis
cagcgcgcgcuugcgcucggucgc

SEQ ID NO: 2982818 - RNA, 13 nt, Mycobacterium avium subsp. paratuberculosis
cagcgcgcggcgc

SEQ ID NO: 2982819 - RNA, 16 nt, Mycobacterium avium subsp. paratuberculosis
cagcgcgcggcgcaga

SEQ ID NO: 2982820 - RNA, 14 nt, Mycobacterium avium subsp. paratuberculosis
cagcgcgcggcgga

SEQ ID NO: 2982821 - RNA, 18 nt, Mycobacterium avium subsp. paratuberculosis
cagcgcgcggcggauguc

SEQ ID NO: 2982822 - RNA, 14 nt, Mycobacterium avium subsp. paratuberculosis
cagcgcgcgggagc

SEQ ID NO: 2982823 - RNA, 23 nt, Mycobacterium avium subsp. paratuberculosis
cagcgcgcgggagcgcuggucgg

SEQ ID NO: 2982824 - RNA, 14 nt, Mycobacterium avium subsp. paratuberculosis
cagcgcgcgggcgc

SEQ ID NO: 2982825 - RNA, 23 nt, Mycobacterium avium subsp. paratuberculosis
cagcgcgcgggcgcgcgccgccc

SEQ ID NO: 2982826 - RNA, 14 nt, Mycobacterium avium subsp. paratuberculosis
cagcgcgcggguga

SEQ ID NO: 2982827 - RNA, 20 nt, Mycobacterium avium subsp. paratuberculosis
cagcgcgcgguucuuggcgu

SEQ ID NO: 2982828 - RNA, 14 nt, Mycobacterium avium subsp. paratuberculosis
cagcgcggacacca

SEQ ID NO: 2982829 - RNA, 15 nt, Mycobacterium avium subsp. paratuberculosis
cagcgcggacaccag

SEQ ID NO: 2982830 - RNA, 20 nt, Mycobacterium avium subsp. paratuberculosis
cagcgcggauuccagcgcga

SEQ ID NO: 2982831 - RNA, 13 nt, Mycobacterium avium subsp. paratuberculosis
cagcgcggcaugg

SEQ ID NO: 2982832 - RNA, 14 nt, Mycobacterium avium subsp. paratuberculosis
cagcgcggccacac

SEQ ID NO: 2982833 - RNA, 20 nt, Mycobacterium avium subsp. paratuberculosis
cagcgcggccacaccgauca

SEQ ID NO: 2982834 - RNA, 13 nt, Mycobacterium avium subsp. paratuberculosis
cagcgcggccacc

SEQ ID NO: 2982835 - RNA, 14 nt, Mycobacterium avium subsp. paratuberculosis
cagcgcggccacca

SEQ ID NO: 2982836 - RNA, 16 nt, Mycobacterium avium subsp. paratuberculosis
cagcgcggccaccacc

SEQ ID NO: 2982837 - RNA, 17 nt, Mycobacterium avium subsp. paratuberculosis
cagcgcggccaccacca

SEQ ID NO: 2982838 - RNA, 19 nt, Mycobacterium avium subsp. paratuberculosis
cagcgcggccaccaccacg

SEQ ID NO: 2982839 - RNA, 23 nt, Mycobacterium avium subsp. paratuberculosis
cagcgcggccaccacgacgggga

SEQ ID NO: 2982840 - RNA, 20 nt, Mycobacterium avium subsp. paratuberculosis
cagcgcggccaccuccagcc

SEQ ID NO: 2982841 - RNA, 22 nt, Mycobacterium avium subsp. paratuberculosis
cagcgcggccaccuccagcccg

SEQ ID NO: 2982842 - RNA, 12 nt, Mycobacterium avium subsp. paratuberculosis
cagcgcggccag

SEQ ID NO: 2982843 - RNA, 17 nt, Mycobacterium avium subsp. paratuberculosis
cagcgcggccagcacgg

SEQ ID NO: 2982844 - RNA, 12 nt, Mycobacterium avium subsp. paratuberculosis
cagcgcggcccg

SEQ ID NO: 2982845 - RNA, 19 nt, Mycobacterium avium subsp. paratuberculosis
cagcgcggcccgcggcguc

SEQ ID NO: 2982846 - RNA, 13 nt, Mycobacterium avium subsp. paratuberculosis
cagcgcggccgga

SEQ ID NO: 2982847 - RNA, 19 nt, Mycobacterium avium subsp. paratuberculosis
cagcgcggccgggcgcccc

SEQ ID NO: 2982848 - RNA, 10 nt, Mycobacterium avium subsp. paratuberculosis
cagcgcggcg

SEQ ID NO: 2982849 - RNA, 13 nt, Mycobacterium avium subsp. paratuberculosis
cagcgcggcgaca

SEQ ID NO: 2982850 - RNA, 17 nt, Mycobacterium avium subsp. paratuberculosis
cagcgcggcgaucagca

SEQ ID NO: 2982851 - RNA, 20 nt, Mycobacterium avium subsp. paratuberculosis
cagcgcggcgaucagcagca

SEQ ID NO: 2982852 - RNA, 23 nt, Mycobacterium avium subsp. paratuberculosis
cagcgcggcgaucagcagcaccc

SEQ ID NO: 2982853 - RNA, 14 nt, Mycobacterium avium subsp. paratuberculosis
cagcgcggcgaucg

SEQ ID NO: 2982854 - RNA, 20 nt, Mycobacterium avium subsp. paratuberculosis
cagcgcggcgaucucggcgg

SEQ ID NO: 2982855 - RNA, 13 nt, Mycobacterium avium subsp. paratuberculosis
cagcgcggcgaug

SEQ ID NO: 2982856 - RNA, 16 nt, Mycobacterium avium subsp. paratuberculosis
cagcgcggcgaugacc

SEQ ID NO: 2982857 - RNA, 23 nt, Mycobacterium avium subsp. paratuberculosis
cagcgcggcggaggucagcggcc

SEQ ID NO: 2982858 - RNA, 17 nt, Mycobacterium avium subsp. paratuberculosis
cagcgcggcggccaccu

SEQ ID NO: 2982859 - RNA, 19 nt, Mycobacterium avium subsp. paratuberculosis
cagcgcggcggccaccucg

SEQ ID NO: 2982860 - RNA, 23 nt, Mycobacterium avium subsp. paratuberculosis
cagcgcggcggccaccucggcgg

SEQ ID NO: 2982861 - RNA, 14 nt, Mycobacterium avium subsp. paratuberculosis
cagcgcggcggcgc

SEQ ID NO: 2982862 - RNA, 16 nt, Mycobacterium avium subsp. paratuberculosis
cagcgcggcggcgccg

SEQ ID NO: 2982863 - RNA, 17 nt, Mycobacterium avium subsp. paratuberculosis
cagcgcggcggcgccgu

SEQ ID NO: 2982864 - RNA, 12 nt, Mycobacterium avium subsp. paratuberculosis
cagcgcggcggg

SEQ ID NO: 2982865 - RNA, 15 nt, Mycobacterium avium subsp. paratuberculosis
cagcgcggcggucgc

SEQ ID NO: 2982866 - RNA, 21 nt, Mycobacterium avium subsp. paratuberculosis
cagcgcggcggucgcgcgccg

SEQ ID NO: 2982867 - RNA, 14 nt, Mycobacterium avium subsp. paratuberculosis
cagcgcggcgguga

SEQ ID NO: 2982868 - RNA, 16 nt, Mycobacterium avium subsp. paratuberculosis
cagcgcggcggugagc

SEQ ID NO: 2982869 - RNA, 17 nt, Mycobacterium avium subsp. paratuberculosis
cagcgcggcggugagcc

SEQ ID NO: 2982870 - RNA, 21 nt, Mycobacterium avium subsp. paratuberculosis
cagcgcggcggugagccgcca

SEQ ID NO: 2982871 - RNA, 19 nt, Mycobacterium avium subsp. paratuberculosis
cagcgcggcgucacccugg

SEQ ID NO: 2982872 - RNA, 20 nt, Mycobacterium avium subsp. paratuberculosis
cagcgcggcgucacccugga

SEQ ID NO: 2982873 - RNA, 20 nt, Mycobacterium avium subsp. paratuberculosis
cagcgcggcguucagcagcg

SEQ ID NO: 2982874 - RNA, 13 nt, Mycobacterium avium subsp. paratuberculosis
cagcgcggcuugg

SEQ ID NO: 2982875 - RNA, 18 nt, Mycobacterium avium subsp. paratuberculosis
cagcgcggcuuggccacc

SEQ ID NO: 2982876 - RNA, 19 nt, Mycobacterium avium subsp. paratuberculosis
cagcgcggcuuggccacca

SEQ ID NO: 2982877 - RNA, 22 nt, Mycobacterium avium subsp. paratuberculosis
cagcgcggcuuggccaccacca

SEQ ID NO: 2982878 - RNA, 12 nt, Mycobacterium avium subsp. paratuberculosis
cagcgcgggcca

SEQ ID NO: 2982879 - RNA, 17 nt, Mycobacterium avium subsp. paratuberculosis
cagcgcggucgccacca

SEQ ID NO: 2982880 - RNA, 18 nt, Mycobacterium avium subsp. paratuberculosis
cagcgcggucgccaccac

SEQ ID NO: 2982881 - RNA, 19 nt, Mycobacterium avium subsp. paratuberculosis
cagcgcggucgccaccacc

SEQ ID NO: 2982882 - RNA, 21 nt, Mycobacterium avium subsp. paratuberculosis
cagcgcggucgccaccaccag

SEQ ID NO: 2982883 - RNA, 21 nt, Mycobacterium avium subsp. paratuberculosis
cagcgcggugaagucggugcc

SEQ ID NO: 2982884 - RNA, 17 nt, Mycobacterium avium subsp. paratuberculosis
cagcgcggugagcagca

SEQ ID NO: 2982885 - RNA, 22 nt, Mycobacterium avium subsp. paratuberculosis
cagcgcggugagcagcaugccg

SEQ ID NO: 2982886 - RNA, 20 nt, Mycobacterium avium subsp. paratuberculosis
cagcgcggugaugugcagga

SEQ ID NO: 2982887 - RNA, 20 nt, Mycobacterium avium subsp. paratuberculosis
cagcgcggugauguugucga

SEQ ID NO: 2982888 - RNA, 23 nt, Mycobacterium avium subsp. paratuberculosis
cagcgcggugauguugucgaaca

SEQ ID NO: 2982889 - RNA, 13 nt, Mycobacterium avium subsp. paratuberculosis
cagcgcggugccc

SEQ ID NO: 2982890 - RNA, 14 nt, Mycobacterium avium subsp. paratuberculosis
cagcgcggugccca

SEQ ID NO: 2982891 - RNA, 16 nt, Mycobacterium avium subsp. paratuberculosis
cagcgcggugcccagc

SEQ ID NO: 2982892 - RNA, 19 nt, Mycobacterium avium subsp. paratuberculosis
cagcgcggugcccagccag

SEQ ID NO: 2982893 - RNA, 14 nt, Mycobacterium avium subsp. paratuberculosis
cagcgcggugccgg

SEQ ID NO: 2982894 - RNA, 17 nt, Mycobacterium avium subsp. paratuberculosis
cagcgcgguggccagca

SEQ ID NO: 2982895 - RNA, 18 nt, Mycobacterium avium subsp. paratuberculosis
cagcgcgguggccagcag

SEQ ID NO: 2982896 - RNA, 19 nt, Mycobacterium avium subsp. paratuberculosis
cagcgcgguggccagcagg

SEQ ID NO: 2982897 - RNA, 15 nt, Mycobacterium avium subsp. paratuberculosis
cagcgcgguggucag

SEQ ID NO: 2982898 - RNA, 19 nt, Mycobacterium avium subsp. paratuberculosis
cagcgcgguggucagcacc

SEQ ID NO: 2982899 - RNA, 19 nt, Mycobacterium avium subsp. paratuberculosis
cagcgcgguggucagcggc

SEQ ID NO: 2982900 - RNA, 20 nt, Mycobacterium avium subsp. paratuberculosis
cagcgcgguggucagcggcg

SEQ ID NO: 2982901 - RNA, 23 nt, Mycobacterium avium subsp. paratuberculosis
cagcgcgguggucagcggcgcca

SEQ ID NO: 2982902 - RNA, 23 nt, Mycobacterium avium subsp. paratuberculosis
cagcgcgguguacagcgcgccgc

SEQ ID NO: 2982903 - RNA, 18 nt, Mycobacterium avium subsp. paratuberculosis
cagcgcggugucgacguc

SEQ ID NO: 2982904 - RNA, 20 nt, Mycobacterium avium subsp. paratuberculosis
cagcgcggugucgacgucgg

SEQ ID NO: 2982905 - RNA, 19 nt, Mycobacterium avium subsp. paratuberculosis
cagcgcggugugcggcggc

SEQ ID NO: 2982906 - RNA, 20 nt, Mycobacterium avium subsp. paratuberculosis
cagcgcggugugcggcggcu

SEQ ID NO: 2982907 - RNA, 21 nt, Mycobacterium avium subsp. paratuberculosis
cagcgcggugugcggcggcuc

SEQ ID NO: 2982908 - RNA, 19 nt, Mycobacterium avium subsp. paratuberculosis
cagcgcguacuccgacaga

SEQ ID NO: 2982909 - RNA, 14 nt, Mycobacterium avium subsp. paratuberculosis
cagcgcguagagca

SEQ ID NO: 2982910 - RNA, 17 nt, Mycobacterium avium subsp. paratuberculosis
cagcgcguagagcauca

SEQ ID NO: 2982911 - RNA, 22 nt, Mycobacterium avium subsp. paratuberculosis
cagcgcguagagcaucaggucg

SEQ ID NO: 2982912 - RNA, 17 nt, Mycobacterium avium subsp. paratuberculosis
cagcgcguagucggcgu

SEQ ID NO: 2982913 - RNA, 18 nt, Mycobacterium avium subsp. paratuberculosis
cagcgcguagucggcguc

SEQ ID NO: 2982914 - RNA, 16 nt, Mycobacterium avium subsp. paratuberculosis
cagcgcguccaaccgc

SEQ ID NO: 2982915 - RNA, 20 nt, Mycobacterium avium subsp. paratuberculosis
cagcgcguccaggugcgccg

SEQ ID NO: 2982916 - RNA, 23 nt, Mycobacterium avium subsp. paratuberculosis
cagcgcguccaggugcgccgccg

SEQ ID NO: 2982917 - RNA, 13 nt, Mycobacterium avium subsp. paratuberculosis
cagcgcgucgagg
